US008445666B2

(12) United States Patent
Rigoutsos et al.

(10) Patent No.: US 8,445,666 B2
(45) Date of Patent: May 21, 2013

(54) RIBONUCLEIC ACID INTERFERENCE MOLECULES

(75) Inventors: Isidore Rigoutsos, Astoria, NY (US); Tien Huynh, Yorktown Heights, NY (US); Kevin Charles Miranda, McDowall (AU)

(73) Assignee: International Business Machines Corporation, Armonk, NY (US)

( * ) Notice: Subject to any disclaimer, the term of this patent is extended or adjusted under 35 U.S.C. 154(b) by 0 days.

(21) Appl. No.: 13/283,103

(22) Filed: Oct. 27, 2011

(65) Prior Publication Data

US 2012/0040460 A1    Feb. 16, 2012

Related U.S. Application Data

(62) Division of application No. 11/352,152, filed on Feb. 10, 2006, now abandoned.

(60) Provisional application No. 60/652,499, filed on Feb. 11, 2005.

(51) Int. Cl.
*C07H 2/04* (2006.01)
*C07H 21/02* (2006.01)
*C12N 15/00* (2006.01)

(52) U.S. Cl.
USPC .......................................... 536/24.5; 435/455

(58) Field of Classification Search
None
See application file for complete search history.

(56) References Cited

U.S. PATENT DOCUMENTS

| | | | |
|---|---|---|---|
| 5,474,796 | A | 12/1995 | Brennan |
| 6,108,666 | A | 8/2000 | Floratos et al. |
| 6,812,339 | B1 | 11/2004 | Venter et al. |
| 2006/0263798 | A1 | 11/2006 | Huynh et al. |
| 2007/0154896 | A1 | 7/2007 | Huynh et al. |

OTHER PUBLICATIONS

Hofacker et al. Fast Folding and Comparison of RNA Secondary Structures, Monatshefte fur Chemie (Chemical Monthly), vol. 125, pp. 167-188, 1994.

Mathews et al. Expanded Sequence Dependence of Thermodynamic Parameters Improves Prediction of RNA Secondary Structure, J. Mol. Biol. vol. 228, pp. 911-940, 1999.
Griffiths-Jones et al. Rfam: An RNA Family Database, Nucleic Acids Research, vol. 31, No. 1, pp. 439-441, 2003.
Altschul et al., Basic Local Alignment Search Tool, J. Mol. Biol., vol. 215, pp. 403-410, 1990.
Rigoutsos et al., Combinatorial Pattern Discovery in Biological Sequences: The Teiresias Algorithm, Bioinformatics, vol. 14, No. 1, pp. 55-67, 1998.
Stabenau et al. The Ensemble Core Software Libraries, Genome Research, vol. 14, pp. 929-933, 2004.
Stark et al., Identification of *Drosophila* MicroRNA Targets, PLos Biology, vol. 1, Issue 3, pp. 397-409, 2003.
Rehmsmeier et al., Fast and Effective Prediction of MicroRNA/Target Duplexes, RNA, vol. 10, pp. 1507-1517, 2004.
Enright et al., MicroRNA Targets in *Drosophila*, Genome Biology, vol. 5, Issue 1, Article R1, pp. 1-14, 2003.
Lai et al., Computational Identification of *Drosophilia* MicroRNA Genes, Genome Biology, vol. 4, Issue 7, Article R42, pp. 1-20, 2003.
Lim et al., The MicroRNAs of *Caenorhabditis elegans*, Genes and Development, vol. 17, pp. 991-1008, 2003.
Berezikov et al., Phylogenetic Shadowing and Computational Identification of Human MicroRNA Genes, Cell, vol. 120, pp. 21-24, 2005.
Lim et al., Vertebrate MicroRNA Genes, Science Magazine, vol. 299, p. 1540, Mar. 2003.
Bentwich et al., Identification of Hundreds of Conserved and Nonconserved Human microRNAs, Nature Genetics, vol. 37, No. 7, pp. 766-770, Jul. 2005.
Wootton et al., Statistics of Local Complexity in Amino Acid Sequences and Sequence Databases, Computers and Chemistry, vol. 17, No. 2, pp. 149-163, 1993.
Brazma et al., Approaches to the Automatic Discovery of Patterns in Biosequences, Journal of Computational Biology 5, 279-305 (1998).
Cowan, Expected Frequencies of DNA Patterns using Whittle's Formula, Journal of Applied Probability 28, 886-892 (1991).

*Primary Examiner* — Richard Schnizer
(74) *Attorney, Agent, or Firm* — Ryan, Mason & Lewis, LLP

(57) ABSTRACT

Ribonucleic acid interference molecules are provided. In one aspect of the invention, a method for regulating gene expression comprises the following step. At least one nucleic acid molecule comprising at least one of one or more precursor sequences having SEQ ID NO: 1 through SEQ ID NO: 103, 948, each one of the precursor sequences containing one or more mature sequences having SEQ ID NO: 103,949 through SEQ ID NO: 230,447, is used to regulate the expression of one or more genes.

8 Claims, No Drawings

RIBONUCLEIC ACID INTERFERENCE MOLECULES

CROSS REFERENCE TO RELATED APPLICATIONS

This application is a divisional of U.S. patent application Ser. No. 11/352,152, filed Feb. 10, 2006, which claims the benefit of U.S. Provisional Application No. 60/652,499, filed Feb. 11, 2005, the disclosure of which are incorporated by reference herein.

This application is related to U.S. patent application Ser. No. 11/351,821, entitled "System and Method for Identification of MicroRNA Target Sites and Corresponding Targeting MicroRNA," and to U.S. patent application Ser. No. 11/351,951, entitled "System and Method for Identification of MicroRNA Precursor Sequences and Corresponding Mature MicroRNA Sequences from Genomic Sequences," the disclosures of which are incorporated by reference herein.

FIELD OF THE INVENTION

The present invention relates to genes and, more particularly, to ribonucleic acid interference molecules and their role in gene expression.

BACKGROUND OF THE INVENTION

The ability of an organism to regulate the expression of its genes is of central importance to life. A breakdown in this homeostasis leads to disease states, such as cancer, where a cell multiplies uncontrollably, to the detriment of the organism. The general mechanisms utilized by organisms to maintain this gene expression homeostasis are the focus of intense scientific study.

It recently has been discovered that some cells are able to down-regulate their gene expression through certain ribonucleic acid (RNA) molecules. Namely, RNA molecules can act as potent gene expression regulators either by inducing mRNA degradation or by inhibiting translation; this activity is summarily referred to as post-transcriptional gene silencing or PTGS for short. An alternative name by which it is also known is RNA interference, or RNAi. PTGS/RNAi has been found to function as a mediator of resistance to endogenous and exogenous pathogenic nucleic acids and also as a regulator of the expression of genes inside cells.

The term 'gene expression,' as used herein, refers generally to the transcription of messenger-RNA (mRNA) from a gene, and its subsequent translation into a functional protein. One class of RNA molecules involved in gene expression regulation comprises microRNAs, which are endogenously encoded and regulate gene expression by either disrupting the translation processes or by degrading mRNA transcripts, e.g., inducing post-transcriptional repression of one or more target sequences.

The RNAi/PTGS mechanism allows an organism to employ short RNA sequences to either degrade or disrupt translation of complementary mRNA transcripts. Early studies suggested only a limited role for RNAi, that of a defense mechanism against pathogens. However, the subsequent discovery of many endogenously-encoded microRNAs pointed towards the possibility of this being a more general, in nature, control mechanism. Recent evidence has led the community to hypothesize that a wider spectrum of biological processes are affected by RNAi, thus extending the range of this presumed control layer.

A better understanding of the mechanism of the RNA interference process would benefit drug design, the fight against disease, and the understanding of host defense mechanisms.

SUMMARY OF THE INVENTION

Ribonucleic acid interference molecules are provided. For example, in one aspect of the invention, a method for regulating gene expression comprises the following step. At least one nucleic acid molecule comprising at least one of one or more precursor sequences having SEQ ID NO: 1 through SEQ ID NO: 103,948, each one of the precursor sequences containing one or more mature sequences having SEQ ID NO: 103,949 through SEQ ID NO: 230,447, is used to regulate the expression of one or more genes.

It is to be understood that "SEQ ID NO." stands for sequence identification number. Each sequence identification number corresponds to a sequence stored in a text file on the accompanying Sequence Listing.

The method may further comprise inserting the at least one nucleic acid molecule into an environment where the at least one nucleic acid molecule can be produced biochemically. The method may further comprise inserting the at least one nucleic acid molecule in to an environment where the at least one nucleic acid molecule can be produced biochemically, giving rise to one or more interfering ribonucleic acids which affect one or more target sequences.

One or more of the sequences may be synthetically removed from the genome that contains them naturally. One or more of the sequences may be synthetically introduced in a genome that does not contain them naturally.

One or more target sequences may be encoded by the same genome as the one or more sequences. One or more target sequences may be encoded by a different genome from the one or more sequences. One or more target sequences are naturally occurring. One or more target sequences may be synthetically constructed.

One or more sequences may be transcribed, giving rise to one or more interfering ribonucleic acids which induce post-transcriptional repression of one or more target sequences. One or more sequences may be transcribed, giving rise to one or more interfering ribonucleic acids which induce gene silencing of one or more target sequences. One or more of the sequences may be synthetically constructed.

In a yet another aspect of the invention, at least one nucleic acid molecule comprises at least a portion of a precursor sequence having one of SEQ ID NO: 1 through SEQ ID NO: 103,948, wherein the portion comprises an amount of the sequence that does not significantly alter a behavior of the complete precursor sequence.

In a further aspect of the invention, at least one nucleic acid molecule comprises at least a portion of a mature sequence having one of SEQ ID NO: 103,949 through SEQ ID NO: 230,447, wherein the portion comprises an amount of the sequence that does not significantly alter a behavior of the complete mature sequence.

A more complete understanding of the present invention, as well as further features and advantages of the present invention, will be obtained by reference to the following detailed description.

DETAILED DESCRIPTION OF PREFERRED EMBODIMENTS

The teachings of the present invention relate to ribonucleic acid (RNA) molecules and their role in gene expression regulation. The term 'gene expression,' as used herein, refers generally to the transcription of messenger-RNA (mRNA) from a gene, and, e.g., its subsequent translation into a functional protein. One class of RNA molecules involved in gene expression regulation comprises microRNAs, which are endogenously encoded and regulate gene expression by either disrupting the translation processes or by degrading mRNA transcripts, e.g., inducing post-transcriptional repression of one or more target sequences. MicroRNAs are transcribed by RNA polymerase II as parts of longer primary transcripts known as pri-microRNAs. Pri-microRNAs are subsequently cleaved by Drosha, a double-stranded-RNA-specific ribonuclease, to form microRNA precursors or pre-microRNAs. Pre-microRNAs are exported by Exportin-5 from the nucleus into the cytoplasm where they are processed by Dicer. Dicer is a member of the RNase III family of nucleases that cleaves the pre-microRNA and forms a double-stranded RNA with overhangs at the 3' of both ends that are one to four nucleotides long. The mature microRNA is derived from either the leading or the lagging arm of the microRNA precursor. Finally, a helicase separates the double-stranded RNA species into single-stranded and the strand containing the mature microRNA becomes associated with an effector complex known as RISC (for RNA-induced silencing complex). The RISC+microRNA construct base pairs with its target in a sequence-specific manner using Watson-Crick pairing (and the occasional formation of G:U pairs). If the microRNA is loaded into an Argonaute-2 RISC, the target is cleaved at the binding site and degraded. In the presence of mismatches between a microRNA and its target, post-transcriptional gene silencing is effected through translational inhibition.

According to the teachings presented herein, the target sequence(s) may be naturally occurring. Alternatively, the target sequences may be synthetically constructed. A target sequence may be synthetically constructed so as to test prediction methods and/or to induce the RNAi/PTGS control of genes of interest. Additionally, a target sequence may be synthetically constructed so as to control multiple genes with a single RNA molecule, and also possibly to modify, in a combinatorial manner, the kinetics of the reaction by, for example, introducing multiple target sites. Similarly, the precursor sequence(s) may be either naturally occurring or synthetically constructed. For example, a precursor sequence of interest may be synthetically constructed and introduced into a cell that lacks that particular precursor. Further, when any of the above sequences are naturally occurring, they may be synthetically removed, for analysis purposes, from the genome that contains them, e.g., using standard molecular techniques.

As mentioned above, the present application is related to U.S. patent application entitled "System and Method for Identification of MicroRNA Target Sites and Corresponding Targeting MicroRNA," (Ser. No. 11/351,821), and to U.S. patent application entitled "System and Method for Identification of MicroRNA Precursor Sequences and Corresponding Mature MicroRNA Sequences from Genomic Sequences" (Ser. No. 11/351,951), both filed concurrently herewith, the disclosures of which are incorporated by reference herein.

In such related applications, several important questions are addressed. For example, for a given nucleotide sequence, is it part of or does it contain a microRNA precursor? Or, given the sequence of a microRNA precursor, where is the segment which will give rise to the mature microRNA? Further, is there more than one mature microRNA produced by a particular precursor, and if so, where are the segments which, after transcription, will give rise to these additional mature microRNAs? Another question addressed is the following: given the 3' untranslated region (3'UTR) of a given gene, which region(s) of it will function as a target(s) for some mature microRNA? This last question can also be asked when we are instead presented with the 5' untranslated region (5'UTR) or the amino acid coding region of a given gene. Also, for a given putative target site, which microRNA, if any, will bind to the putative target site?

For the purposes of this discussion, we only focus on the problem of whether a specific nucleotide sequence corresponds to a microRNA precursor or to a mature microRNA. A method for answering this question is described in the above referenced Ser. No. 11/351,951 patent application.

Summarily, the method comprises a first phase during which patterns are generated by processing an appropriate training set using a pattern discovery algorithm. If the training set comprises sequences of microRNA precursors, then the generated patterns, after appropriate attribute-based filtering, will be microRNA-precursor specific. If the training set comprises sequences of mature microRNAs, then the generated patterns, after appropriate attribute-based filtering, will be mature-microRNA specific. Alternatively, the training set can comprise putative mature microRNAs or putative microRNA precursors. In a preferred embodiment, two training sets were used, one comprising sequences of known microRNA precursors and one comprising sequences of known mature microRNAs.

The basic idea of this pattern-based method is to replace the training set of sequences with an "equivalent" representation that consists of patterns. The patterns can be derived using a pattern discovery algorithm, such as the Teiresias algorithm. See, for example, U.S. Pat. No. 6,108,666 issued to A. Floratos and I. Rigoutsos, entitled "Method and Apparatus for Pattern Discovery in 1-Dimensional Event Streams," the disclosure of which is incorporated by reference herein. The patterns are, ideally, maximal in composition and length (properties which are, by default, guaranteed by the Teiresias algorithm).

The generated microRNA-precursor-specific or mature-microRNA-specific patterns can then be used as predicates to identify, in a de novo manner, microRNA precursors from genomic sequence, or mature microRNAs in the sequence of a putative microRNA precursor. This is exploited in the method's second phase during which the patterns at hand are sought in the sequence under consideration: to determine whether a given nucleotide sequence S is part of, or encodes, a microRNA precursor the microRNA-precursor-specific patterns are used; and to determine whether a given nucleotide sequence S corresponds to, or contains a mature microRNA mature-microRNA-specific patterns are used.

In general, one anticipates numerous instances of microRNA-precursor-specific patterns in sequences that correspond to microRNA precursors whereas background and unrelated sequences should receive few or no such hits. If the number of pattern instances exceeds a predetermined threshold, then the corresponding segment of the sequence that receives the pattern support (and possibly an appropriately sized flanking region) is reported as a putative microRNA precursor. Analogous comments can be made about mature-microRNA-specific patterns and sequences containing mature microRNAs.

In the present application, pattern-discovery techniques, such as those described above, have been used in conjunction with recently released, publicly available genomic sequences to predict microRNA precursor and mature miRNA sequences related to the following organisms: *C. elegans* (Wormbase release 140); *D. melanogaster* (Berkely *Droso-*

*phila* Genome Project release 3.2); *M. musculus* (Ensembl assembly based on the NCBI 31 assembly); and *H. sapiens* (Ensembl assembly based on the NCBI 31 assembly). Namely, precursor sequences having SEQ ID NO: 1 through SEQ ID NO: 57,431 derived from the genome of *H. sapiens* are presented; precursor sequences having SEQ ID NO: 57,432 through SEQ ID NO: 101,967 derived from the genome of *M. musculus* are presented; precursor sequences having SEQ ID NO: 101,968 through SEQ ID NO: 103,203 derived from the genome of *D. melanogaster* are presented; precursor sequences having SEQ ID NO: 103,204 through SEQ ID NO: 103,948 derived from the genome of *C. elegans* are presented; mature sequences having SEQ ID NO: 103,949 through SEQ ID NO: 173,336 derived from the genome of *H. sapiens* are presented; mature sequences having SEQ ID NO: 173,337 through SEQ ID NO: 228,005 derived from the genome of *M. musculus* are presented; mature sequences having SEQ ID NO: 228,006 through SEQ ID NO: 229,484 derived from the genome of *D. melanogaster* are presented; and mature sequences having SEQ ID NO: 229,485 through SEQ ID NO: 230,447 derived from the genome of *C. elegans* are presented.

These predicted precursor and mature sequences are submitted herewith in electronic text format as 1500-565 DIV Sequence Listing.ST25 (including the same sequence listing as in the noted relation applications identified therein as the files ALL_MATURES.txt, created on Friday, Feb. 10, 2006, having a size of 11.4 Megabytes, and ALL_PRECURSORS.txt, Friday, Feb. 10, 2006, having a size of 14.5 Megabytes, on compact disc (CDROM)), the contents of which are incorporated by reference herein.

With respect to the sequences submitted herewith, for each precursor sequence that is listed, five features are presented (in addition to the sequence ID number and the corresponding organism name). One, the chromosome number (e.g., the chromosome identifier) is displayed. Two, the precursor start and end points on the corresponding chromosome are denoted. Three, the strand, either forward or reverse, on which the precursor will be found, is listed. Four, since the sequences displayed are predicted to fold into hairpin-like shapes, the predicted folding energy (also known as the energy required to denature the precursor) is presented. Five, each precursor sequence is presented.

As above, with respect to the sequences submitted herewith, for each mature sequence predicted, six features are presented (in addition to the sequence ID number and the corresponding organism name). One, as above, the chromosome number, (e.g., chromosome identifier) is displayed. Two, as above, the start and end points of the corresponding precursor sequence on the corresponding chromosome are denoted. Three, as above, the strand, either forward or reverse, on which the corresponding precursor will be found is listed. Four, as above, since the sequences displayed are derived from precursors which are predicted to fold into hairpin-like shapes, the folding energy of the corresponding precursor (also known as the energy required to denature the precursor) is presented. Five, the start and end points of the mature sequence on the corresponding chromosome are denoted. Six, each mature sequence is presented.

All of the sequences presented herein, whether precursors or matures, are deoxyribonucleic acid (DNA) sequences. One of ordinary skill in the art would easily be able to derive the RNA transcripts corresponding to these DNA sequences. As such, the RNA forms of these DNA sequences are considered to be within the scope of the present teachings. Also, it should be understood that the locations of the described sequences are given in the form of global coordinates, i.e., in terms of distances from the leftmost tip of the forward strand in the chromosome where the sequence at hand is located. In other words, all of the stated coordinates use the beginning of each chromosome's forward strand as a point of reference. If a sequence is reported to be on the reverse strand between locations X and Y, then one can actually generate the actual nucleotide sequence for it by excising the string contained between locations X and Y of the forward strand and then generating its reverse complement. These global coordinates are likely to change from one release of the genomic assembly to the next. Nonetheless, even though its actual location may change, the actual sequence that corresponds to a microRNA precursor or a mature microRNA is expected to remain unique and thus the corresponding sequence's new location will still be identifiable (except of course for the case where the sequence at hand corresponds to a segment that has been removed from the genomic assembly that is being examined).

One of ordinary skill in the art would also recognize that sequences that are either homologous or orthologous to the sequences presented herein, e.g., sequences that are related by vertical descent from a common ancestor or through other means (e.g., through horizontal gene transfer), will likely be present in genomes other than the ones mentioned herein. Such homologous/orthologous sequences are expected to generally differ from the sequences listed herein by only a small number of locations. Thus, the teachings presented herein should be construed as being broadly applicable to such homologous/orthologous sequences from species other than those listed above.

According to an exemplary embodiment, nucleic acid molecules may be generated based on the predicted precursor and mature sequences. The nucleic acid molecules generated may then be used to regulate gene expression. For example, as described generally above, mechanisms exist by which RNA molecules effect the expression of genes. By way of example only, the nucleic acid molecules generated may regulate the expression of a gene, or genes, by inducing post-transcriptional silencing of the gene, e.g. as described above. Using the predicted precursor and mature sequences to study gene expression may be conducted using techniques and procedures commonly known to those skilled in the art.

Although illustrative embodiments of the present invention have been described herein, it is to be understood that the invention is not limited to those precise embodiments, and that various other changes and modifications may be made by one skilled in the art without departing from the scope or spirit of the invention. For example, one may modify one or more of the described precursor sequences by adding or removing a number of nucleotides which is small enough to not significantly or radically alter the original sequence's behavior. The percentage of the resulting portion, with respect to the complete original sequence, that does not significantly alter such behavior depends on the sequence under consideration. Or one may insert one or more of the described mature sequences in an appropriately constructed "container sequence" (e.g., a precursor-like construct that is different than the precursor where this mature sequence naturally occurs) that still permits the excision of effectively the same mature sequence and thus the generation of an active molecule whose action is essentially unchanged with respect to that of the molecule corresponding to the starting mature sequence.

SEQUENCE LISTING (230447 sequences)

SEQ ID NO: 1 - DNA, 106 bp, Homo sapiens
tacgtattttcacactgtagggtgaagattcaaatacaggtctgacaagaatgtgtgctctcagctctgtgcttttttgcctcactgtatgtgtgaaatctaggtg

SEQ ID NO: 2 - DNA, 84 bp, Homo sapiens
tgtatatttgtgttagtgtatatgtatatatgtgtataaatgtctttgtgtgtatatatgcacaaacatacatacaaacatgcg

SEQ ID NO: 3 - DNA, 86 bp, Homo sapiens
ctgtgtattatttatttatgattaatatggtttatatatggttgatatatacatgatattaattttgatgatagtgatgacagcag

SEQ ID NO: 4 - DNA, 70 bp, Homo sapiens
cactttgggaggctgaggttggaggatcatttgagctcaggagttcaagatcagcctgggcaacatagtg

SEQ ID NO: 5 - DNA, 114 bp, Homo sapiens
gacatctggctctggttgttcttaagaagccaaagagatgtatatttctattaaattatgtacatcaagggtgattttaataaaaagatccagtaacagaaaattactaatgtc

SEQ ID NO: 6 - DNA, 61 bp, Homo sapiens
tggctcacatctgtgatcccaacactttgggaggctgaggtaggaggatcacttgagtcca

SEQ ID NO: 7 - DNA, 113 bp, Homo sapiens
ttgtttcttagcattttatctgacatgacttcaaagtttcagcttcatttttttttttttttttttgagatggagtctcactctgtcgcccaggctggagtgcaatggagcga

SEQ ID NO: 8 - DNA, 83 bp, Homo sapiens
gggcaacacagcaagaccctgcctctatttaaatttttttttttttttttttttttttgagacggagtctcgctctgtcgccc

SEQ ID NO: 9 - DNA, 112 bp, Homo sapiens
ctcccattcattttattttaccttggccttttagagatacttcctgggtttttttttttttaagtgtgttcaaaaagtattggtaaaatttgaaagtataaatggatgagag

SEQ ID NO: 10 - DNA, 58 bp, Homo sapiens
tgagatggagtctcgctctgtcgctcaggctggagtgcagtggcgcgatctcggctca

SEQ ID NO: 11 - DNA, 107 bp, Homo sapiens
ggaaacatgtataataactgaaggttttatatatatatatatctgtgtatatatatctgtatatatatcttatgtatatatatatctgtatatatatgtacatggcc

SEQ ID NO: 12 - DNA, 101 bp, Homo sapiens
tagcctgggcaacatagctagattcctgtctctttttttattttttattttttattttattttattttttgagatggagtctcgctctgtcacccaggctg

SEQ ID NO: 13 - DNA, 72 bp, Homo sapiens
gtttttttgagacaaggtctcactctgtcacccaggctggagtggagtgaggtgatcttggctcactggaac

SEQ ID NO: 14 - DNA, 83 bp, Homo sapiens
gctttctcataaattgggtcaagacaggaagaactctaggtagccagaggtgtctctgtgtctcttttcaaataattgaaggc

SEQ ID NO: 15 - DNA, 95 bp, Homo sapiens
gaggaactggagataaagtctttggtgggccaaaggcattgcagacagatgagagtatgcctacataaatccacgacccagactattctctactc

SEQ ID NO: 16 - DNA, 96 bp, Homo sapiens
gctttctgctagctttggggtttgtttgctcttgattctccagttctcttaattgtgatattaggttgctaacttgacatctttctagctttatgc

SEQ ID NO: 17 - DNA, 98 bp, Homo sapiens
attcaggctcttttttggttccatatgaattttgaaacagttttttttttaattctgtgaagaatgtcaatggtagtttcatggggatagcattgaat

SEQ ID NO: 18 - DNA, 68 bp, Homo sapiens
gggcatggtggtgcaagcctgtagtcccagctactcaggaggctgaggtaggaggatcacttgagccc

SEQ ID NO: 19 - DNA, 77 bp, Homo sapiens
tgtatttgtatatatacatatatatacacacatatatacatcatatatgcgtgtatgtgtatctatacacacatata

SEQ ID NO: 20 - DNA, 87 bp, Homo sapiens
gactattagactctgagtccagatctcctttaaattgttatatattcaatcagtagggatttactgagctcctagtatctactggtt

SEQ ID NO: 21 - DNA, 106 bp, Homo sapiens
aatgactgtcaatatataagtaatgacagtatttataaatgacatatttatgatattatatatgaataatgttagaaacaaaaactacttagtatatccagtcatt

SEQ ID NO: 22 - DNA, 83 bp, Homo sapiens
atctgaatgtcaatgagtgagacatttattagagggaaaacttttaatatatgttaatttacttttcaacattagtaacagat

SEQ ID NO: 23 - DNA, 114 bp, Homo sapiens
agaggttttgataggttgtgtcactattgtcattcagttcaaacaattttttaatttccatcttgattttatttttaacccaatgatcattcaggggcaagctgtttaatttct

SEQ ID NO: 24 - DNA, 206 bp, Homo sapiens
tatacatatatgtgtgtatatatatacacacatatatgtacatgtgatatatatgtatatatacatatatgtacatgtgatatatatgtgtgtgtatgtatatgtgatatatatgtgtgtgtatgtatatgtgatatatacatatatgtatatgtgagatatatatatatatatatatatatatatatatatatatatatatcaca

SEQ ID NO: 25 - DNA, 123 bp, Homo sapiens
acatatatatcacatatacatacacacacatatatatcacatgtacatatatgtatatatacatatatatcacatgtacatatatgtgtgtatatatatacacacatatatgtatatatgatg

SEQ ID NO: 26 - DNA, 74 bp, Homo sapiens
tggcagtcagagaaaacagagaagttaagtaacttgccagaagttacacagctgttcaggtctcctggactcca

SEQ ID NO: 27 - DNA, 67 bp, Homo sapiens
tcccgggtgtgtgtctgtgtctgtctgtgtctcgcagcggcgcgcggccccggacaagcgctgggga

SEQ ID NO: 28 - DNA, 76 bp, Homo sapiens
atgaagaaactgaggttcagagaagtttggaaatgtgaacattgacaatttctatttctgaacagttttgtgccat

SEQ ID NO: 29 - DNA, 66 bp, Homo sapiens
taggcatttacactgtgagggtgagcaaggattgttagtttgcacacaccctcactgacttgctta

SEQ ID NO: 30 - DNA, 69 bp, Homo sapiens
ggaaggctgaggtaggaggatcacttgagccctgaagtcgaggctgcagtgaactatgctcagtgtcac

SEQ ID NO: 31 - DNA, 77 bp, Homo sapiens
gggattacaggtgtcagacacgtgcccagccttgttttttgcttttttgagacagggtctctcactctgttgccctg

SEQ ID NO: 32 - DNA, 93 bp, Homo sapiens
gtattcctatatattttattctctttgtagcaattgtgaatgggagttcactcatgatttgtctctctgtctgttattggtgtataggaatgc

SEQ ID NO: 33 - DNA, 88 bp, Homo sapiens
gcatcttcttgtccttcagattacgacaaagcgctgatgccaggaagattaaaatagtctttgttgttgtcaaagagaaggaagctgc

SEQ ID NO: 34 - DNA, 84 bp, Homo sapiens
ggtaggggaatagactgcagctaaagattcaacaacacccagcaatgtactgatgagtgtgagcaaagcaggagtcctaaagcc

SEQ ID NO: 35 - DNA, 86 bp, Homo sapiens
ccagcttgggaaaactagcaagactctctctctttaatatttatttatttatttgagacggagtctcactctgtcgcccaggctgg

SEQ ID NO: 36 - DNA, 116 bp, Homo sapiens
gacagaaacccaatatcaggagacactttcatcccaagaaggactggctaaggacaaacaaatttttttttttttttttttttttttttttttctgagatggagtctcactctgtc

SEQ ID NO: 37 - DNA, 91 bp, Homo sapiens
agctaggtgccacataatttttttttaatcttggaacatttttaaaaatttttatttccataggtttttgaggaacaggtggtatttggtt

SEQ ID NO: 38 - DNA, 128 bp, Homo sapiens
tatatatataattatactttatataattatactttatatatgtatacatatacatgtataattatatataaaattatactttatatatgtatacatatacatgtataattatacatatataattatac

SEQ ID NO: 39 - DNA, 115 bp, Homo sapiens
cctgactttttaatgattgccattctaactggtgtgagatggtatctcattgtggttgtgatttgcatttctctgatagccagtgatggtgagcattttttcacgtgttttttgg

SEQ ID NO: 40 - DNA, 101 bp, Homo sapiens
gttggttatgttatctatataatagaatttttgcttttttttagcttatttctgttaaggtcaggcacaatgtggtatagcaattaagagcatagactagc

SEQ ID NO: 41 - DNA, 101 bp, Homo sapiens
tgactttttaatgattgccattctaactggtgtgagatggtatctcactgtggttgtgatttgcatttctctgatagccagtgatggtgagcattttttca

SEQ ID NO: 42 - DNA, 73 bp, Homo sapiens
tctagggaggccttcagtgatgcaaaaacgtttttctttttatttgaaagagagtctcactctgtcgcccagg

SEQ ID NO: 43 - DNA, 111 bp, Homo sapiens
ttaaggttgtcttggctatatgggctcttttttggttccatatgaaatttaaagtagttttttctaattctgtgaagaaagtcaatggtagcttgatggggatagcattga

SEQ ID NO: 44 - DNA, 84 bp, Homo sapiens
gaccaagtcctgaaaacgtcaattgaatcatagatgtagacatatttgcaactatgacaatgaatttttttcattacatgagtc

SEQ ID NO: 45 - DNA, 57 bp, Homo sapiens
cagtggctcacacctgtagtcccagcactttgggaggctgaggttgatggatcactg

SEQ ID NO: 46 - DNA, 113 bp, Homo sapiens
tctattagagcagtgaagctattttatatgatactgtgatggtggatatatgtcattatatatttgccaaaatccatagaatgtacaacatgaattctactgtgaactgtgga

SEQ ID NO: 47 - DNA, 58 bp, Homo sapiens
tgagatggagtctcactctgtcacccaggctggagtgcagtggcgtgatctcagctca

SEQ ID NO: 48 - DNA, 86 bp, Homo sapiens
gactagtggctatcataatgaaatatgcagctccagaccatgaatgagatcatgagagtagtcagtctcctgtgatgtccagagtc

SEQ ID NO: 49 - DNA, 115 bp, Homo sapiens
ggaatacttgtgggatacatgaggaaggggtactaatgccttttttttttttttttttcagaacaaaaagagaggaagttctttttcatttaagtttcctttactagatgatacc

SEQ ID NO: 50 - DNA, 110 bp, Homo sapiens
tcagctggggggatcactaatggaatataccatttataactaaaagaagaatataagcctctttatttatttatgcatagtgtttttagatgaccaaatccctagataga

SEQ ID NO: 51 - DNA, 101 bp, Homo sapiens
gggcatggtggtgcacccctgtagctccagctgctcgggaaactgagacaagagagtcacttgagcctgggaggttgaggctgcagtgagccatgattccc

SEQ ID NO: 52 - DNA, 75 bp, Homo sapiens
tcacaataaggctcatgctcctatgaggatttaatgtcaccaatgatctgacaggagacagagctcaggcagtga

SEQ ID NO: 53 - DNA, 113 bp, Homo sapiens
tacttttccaggaacaataatgtaaggcatacaaaatagcttaaatcaatactatttatttttatagtgctgggactttaatatgtaaaatatgtgggtctggaatccaagtg

SEQ ID NO: 54 - DNA, 73 bp, Homo sapiens
gtttatcgatttgcccatgttgaaccagccttgaatcccagggatgaagctgacttgatcatggtggataagc

SEQ ID NO: 55 - DNA, 108 bp, Homo sapiens
gtatatatatacacacacataaatatgttagaatatatgtagtgatctcaaatttttcattttcattattttaacatttactgtgtttctgtgtgagtgtgtgtgtat

SEQ ID NO: 56 - DNA, 62 bp, Homo sapiens
ccaaggctcatcttgcggactcccagatttgtaattggtgtcagaagtgagagtggttctgg

SEQ ID NO: 57 - DNA, 84 bp, Homo sapiens
gtatatacacacacaatatatatgtgtatatatacacacatatgtgtgtgtatataatagatgatatataaagtgtgtatatat

SEQ ID NO: 58 - DNA, 118 bp, Homo sapiens
aatatttcaaacagcatagcttatcttcaatatatttaatggctggttgattaatttatagtataaatttttaacaaacaatagtaaatgtaaggatttgtttgtttgtttgcttgtt

SEQ ID NO: 59 - DNA, 115 bp, Homo sapiens
gtgttaatcaaagcatgtgttattttgttgtatatttttattatgtttatttttaattgagacatattcgtgcatatttatgaagataatgtggtgttgtgatacatgtatacac

SEQ ID NO: 60 - DNA, 74 bp, Homo sapiens
tataagtttctatatatgtgtatatatgtagttacatacaagtatatgtatataagatgtatagaaaccctgta

SEQ ID NO: 61 - DNA, 119 bp, Homo sapiens
gtgtcttttactcagggcatttagcctgtttacatttaagattagtagcagtatgtatatttttttttctgtcatcatgatgttagctagttattttgttggttgctctatagtgtcac

SEQ ID NO: 62 - DNA, 95 bp, Homo sapiens
caggttctcttttgattccatatgaatttcaaaatagtttttctagttctgtgaagaatgtcagtggtagtttaatgggaataggattgaatctg

SEQ ID NO: 63 - DNA, 77 bp, Homo sapiens
ggtaagtagagaagactgaatgatcccatgataaagactgggagaatgtgatgggattatttttttctcttttgtcc

SEQ ID NO: 64 - DNA, 95 bp, Homo sapiens
ttggtgattagaaatttttcagtattgatattctcgttcattttttattttgaattttgcttaattctgatctgaaaaattcctgataaaaccaa

SEQ ID NO: 65 - DNA, 82 bp, Homo sapiens
tatgtatatatatgtgtgtatatatatgtgtatatatgtatatacgtgtgtgtgtgtgtgtgtgtatatatatatatatata

SEQ ID NO: 66 - DNA, 253 bp, Homo sapiens
cataggcatatatatatatgtatatatatatatgtgtatatatgtatatatatatgtatatatgtgtatatatgtatatatgtatatatatgtgtatatatgtatatatatgtatatatatacgtatatatatacgtgtatatatatacgtatatatacgtgtatatatatgtgtgtatatatgtatatatatgtgtatatatatgtgtgtgtgtatatatatatatatatatatatatatatatatatacac

SEQ ID NO: 67 - DNA, 122 bp, Homo sapiens
tatgcacacacacatcatatatataatatagtatatatatatgtgtgtgtaccttgtatatgcatgtactatgtgtgtgtatatatatatatgcacacacatataaagtattattatatata

SEQ ID NO: 68 - DNA, 95 bp, Homo sapiens
gcccactttttgatggggttgtttgtttttttcttgtaaatttgtttgagttcattgtagattctggatattagccctttgtcagatgagtaggt

SEQ ID NO: 69 - DNA, 93 bp, Homo sapiens
cccactttttgatggggttgtttgtttttttcttgtaaatttgtttgagttcattgtagattctggatattagccctttgtcagatgagtagg

SEQ ID NO: 70 - DNA, 90 bp, Homo sapiens
gtatacactatataatgtatatttatatataattgtatacactatataatgtatatttatgtataattgtatacactatataatgtatat

SEQ ID NO: 71 - DNA, 119 bp, Homo sapiens
atcaatcttcttataccatggcttatctgtgagcattctcaccttccctataaattaaattttttttaaagttgtaagggtacagatgagtgtcaggaaagcttattaacaagattgat

SEQ ID NO: 72 - DNA, 119 bp, Homo sapiens; identical to SEQ ID NO: 71

SEQ ID NO: 73 - DNA, 110 bp, Homo sapiens
tgagagtatgcccagttctttctgtatctgtaaggaaataataataagccttacattagaggttcaaggttgtattgcaaatttcaaaaactgggatcatttagtcatca

SEQ ID NO: 74 - DNA, 76 bp, Homo sapiens
aattagttcatatgaaaatgaactaattttcattttatgttaaagtgaaaattttaacattttcataaagcttatt

SEQ ID NO: 75 - DNA, 94 bp, Homo sapiens
acacacacatatctacacagtccttatgtgtgtgtgtgtatgtatatatagactctgtgtgtgtgtgcgtgtgtgtatatatgtatatatgtat

SEQ ID NO: 76 - DNA, 102 bp, Homo sapiens
ggatggagccgctgatccacacggagtacttgtgctctggggatgcgatcatcttgatcttcatggtgctaggtgcccgggtggtgatctccttctgcatcc

SEQ ID NO: 77 - DNA, 95 bp, Homo sapiens
ttctttaaaataattattttgaattctttgtcaagaagtttatagatttttgtatttttgcaaggtttttcatgtcaaataattgttttaaagga

SEQ ID NO: 78 - DNA, 95 bp, Homo sapiens; identical to SEQ ID NO: 77

SEQ ID NO: 79 - DNA, 136 bp, Homo sapiens
gcgttccacttagttcttttggcttaggattgtcttggctatgtgggctttttttggttccatatgaaatgtaaattaggttttgccaattgtgtgaagaaagtcagtggtagcttgatggggatagcattgagtc

SEQ ID NO: 80 - DNA, 87 bp, Homo sapiens
atgtgtatatatatatatatgtatatatatatatatatacatatatatatgtgtatatatatacgtatacatatatgtatatatata

SEQ ID NO: 81 - DNA, 103 bp, Homo sapiens
cggtttttcactgtgggtttcaatgggctcagaaatgtcactttgcatattctatgaaaagaatgtttccaacctggtgaatcaaaacataggtacaattccg

SEQ ID NO: 82 - DNA, 70 bp, Homo sapiens
ttgttttgagttggagtctcactctgtcaccagggatggaatgcagtgacacgatcttggctcactacag

SEQ ID NO: 83 - DNA, 70 bp, Homo sapiens
gggtacttgagattagtgagaggtgacagcgtgctggcagtcctaaagccctcgctcgctctcggcacct

SEQ ID NO: 84 - DNA, 115 bp, Homo sapiens
atgcttgatagaattcacagtgaagttatctggtcctgggctgcttttttttttttttttttgagggggtgtcctaggagagatttttgaatgctgatttaatctacttactcat

SEQ ID NO: 85 - DNA, 95 bp, Homo sapiens; identical to SEQ ID NO: 68

SEQ ID NO: 86 - DNA, 93 bp, Homo sapiens; identical to SEQ ID NO: 69

SEQ ID NO: 87 - DNA, 58 bp, Homo sapiens
tgagacggagtctcactctgtcacccaggctggagtgcagtggtgtgatctcggctca

SEQ ID NO: 88 - DNA, 56 bp, Homo sapiens
gagacggagtctcactctgtcacccaggctggagtgcagtggtgtgatctcggctc

SEQ ID NO: 89 - DNA, 87 bp, Homo sapiens
gaggcctgagttcgaagcttatatacttctaaggttatacgtgtcattggcagaagtcattttcttgtggtatagaactgaggactc

SEQ ID NO: 90 - DNA, 88 bp, Homo sapiens
agttttttgttttgttgctgaaattagactgagtcagtctctgtgactgactttaactatgcctgatatagtagccattcatgaaatt

SEQ ID NO: 91 - DNA, 115 bp, Homo sapiens
gtcggataaataagtcattttggttcaaacaatttttgtgtttttaatatttatgttaaaaatataaatcaagtctattttttgttttccaaaacctaaacatatatttactgat

SEQ ID NO: 92 - DNA, 69 bp, Homo sapiens
gagctgtggtacagtagtgttttttagctcagcacacaatgttggactactggggcacatattacagtc

SEQ ID NO: 93 - DNA, 81 bp, Homo sapiens
tgcgcccggcctattgtgacatattgtgatatttctttcttttttgtgtgacagtgtctcactctgttgcaggctggagta

SEQ ID NO: 94 - DNA, 65 bp, Homo sapiens
tgtatataagtatatgtatatgtgtgtgagacacacatatatctaaatatatatacatgtataca

SEQ ID NO: 95 - DNA, 112 bp, Homo sapiens
gtgtgtatatatatatgtgtgtgtgtatatatatatgtgtatatatgtatgtgtgtatatatatgtgtgtatatatatatgtgtgtgtgtatatatatatataatggctcac

SEQ ID NO: 96 - DNA, 85 bp, Homo sapiens
agaccctgtctcaaagagaaattttctttgaatgaaaacatactgtttttatcccaatcttttttttctttttgagatggagtct

SEQ ID NO: 97 - DNA, 98 bp, Homo sapiens
agtgctacttgtcaagcacatccatgtgaagagagccaccaagttgtgtctttgtgtgagcaacaaggttgtttatttcacttgggtgcaagtgggct

SEQ ID NO: 98 - DNA, 99 bp, Homo sapiens
atatactaatagtgtatatatatacactatatagtatatatatatactaaatagtatatatatactaaatagtatatgtgtgtgtatatatatgtatat

SEQ ID NO: 99 - DNA, 119 bp, Homo sapiens
agcaaatattatgtatatttaaggtgaacaaactggtgttttggtatatatatatatatatatatatatatacacattataaaacaataatcacaacagtgttaattatcatatctgtt

SEQ ID NO: 100 - DNA, 74 bp, Homo sapiens
gagataaatggttgtattctttcgagtttctaattagcttctccaagggaggcaatcagatatggatttatctc

SEQ ID NO: 101 - DNA, 95 bp, Homo sapiens; identical to SEQ ID NO: 68

SEQ ID NO: 102 - DNA, 93 bp, Homo sapiens; identical to SEQ ID NO: 69

SEQ ID NO: 103 - DNA, 95 bp, Homo sapiens; identical to SEQ ID NO: 68

SEQ ID NO: 104 - DNA, 93 bp, Homo sapiens; identical to SEQ ID NO: 69

SEQ ID NO: 105 - DNA, 95 bp, Homo sapiens; identical to SEQ ID NO: 68

SEQ ID NO: 106 - DNA, 93 bp, Homo sapiens; identical to SEQ ID NO: 69

SEQ ID NO: 107 - DNA, 120 bp, Homo sapiens
cagaggcttgtgtaaaagcacattatattttacctaggaaacataagtttatatatatcttaaaaaggcttcgttggtttctttggataatgttgtgttctcagctcctactgcaggctt

SEQ ID NO: 108 - DNA, 104 bp, Homo sapiens
atatagtatatatatagatatctatatctatctatatatctatagatagctatatctatctatagatatatatatagagagagagagcgtgtgtgtgtgtgtgt

SEQ ID NO: 109 - DNA, 90 bp, Homo sapiens
actgatataaataatatattatttgtaactaaatataattatattaatatataaattatatttcatataattgatatgagttatatcagt

SEQ ID NO: 110 - DNA, 108 bp, Homo sapiens
ttattgcgtatatatatgtattgaaaggggatatatatataaagtagctataatatatatgttttatataatttgttttctggtgatataagggtgaatatgaaataa

SEQ ID NO: 111 - DNA, 87 bp, Homo sapiens
gcagctgttatttgtttgggatttaagagaatatatgaacagaaagtatttatataattttcttctagtcctttaaatgcagaatgt

SEQ ID NO: 112 - DNA, 80 bp, Homo sapiens
tccatagagcctctggagggaacacagcctcactgacacattgattttggacttgtggctttcctttcatatctgtgaga

SEQ ID NO: 113 - DNA, 103 bp, Homo sapiens
cttctgaagagctgcaaaattttaatatgtaaagttgttaatggaagtaatattgtttttcataaattaataattttaaaaatattattttgagctcaggatg

SEQ ID NO: 114 - DNA, 105 bp, Homo sapiens
atgtatatatatatatatatatatctgtgtgtgtgtatatataatatgtgtatatatatatatatatatatatctgtgtgtgtgtatatataatatgtgtatata

SEQ ID NO: 115 - DNA, 70 bp, Homo sapiens
atatatgtatgtatgtatatatgtatgtacatatatgtatgtatgtatatgtatatatacatacatatat

SEQ ID NO: 116 - DNA, 124 bp, Homo sapiens
atatatatatacatatatgtatacatatatgtatacatatatgtatacatatatgtatgtatacatatgtatatatgtatgtatatatgttgtatgtatatatgtatgtatgtatgtgttatat

SEQ ID NO: 117 - DNA, 144 bp, Homo sapiens
agatacagcatatatatatatatatatgctgtatccatatatatatatgctgtatctatatatatgctgtatctatatatatatatatgctgtatatatcaggtatatatatacctgatatatataaacatttatatatgtata

SEQ ID NO: 118 - DNA, 99 bp, Homo sapiens
ttttaaacatactgggatctgaaaagtctatttgttgttgcctccactgtcctttaacttagcattaggaaaagactcagaatctcacattgggtagaa

SEQ ID NO: 119 - DNA, 73 bp, Homo sapiens
tgtatatattacacacatacatatatatgtatgtatgtatatgtatgtatgtatatatgtgtgtatatataca

SEQ ID NO: 120 - DNA, 82 bp, Homo sapiens
ctcccatctgatttggcaggaactctacttttttttttttttttttttgagatggagtctcactctgtcgcccaggccggag

SEQ ID NO: 121 - DNA, 68 bp, Homo sapiens
atatatatgtgtttgtgtatatgtatatatgtatacatatatgtatatatatacaaacacacatatgt

SEQ ID NO: 122 - DNA, 85 bp, Homo sapiens
tctgggattggacaggttgcaattaaagcaaagaaatttcaggttttttttttttttttttgacacggtctcactgtctcccagg

SEQ ID NO: 123 - DNA, 130 bp, Homo sapiens
tcttgtttatacatatatgcttttatgtatataagtatatgtatatatgtatacatatatgcttatatgtatataagatatgtatatatgtatatacatatgcttatatgtatgtaagtatatatgtatg

SEQ ID NO: 124 - DNA, 71 bp, Homo sapiens
ttacctctcactgtgtccctccctccacacatgggattatgggactacaatttaagatgagatgtgggtga

SEQ ID NO: 125 - DNA, 117 bp, Homo sapiens
tgtcagctacttcattcctgttgctctggaggtaaatagtatttttctatatgtttagaaattgttatacttgagtccatgctttcaaccagtaaattggcatttgagcttgtgaca

SEQ ID NO: 126 - DNA, 95 bp, Homo sapiens; identical to SEQ ID NO: 68

SEQ ID NO: 127 - DNA, 93 bp, Homo sapiens; identical to SEQ ID NO: 69

SEQ ID NO: 128 - DNA, 119 bp, Homo sapiens
tttcccttcttgccacttactactaatctgaatatgtatttatgtatatgattatttatttgtatattaatattttgttctttgttttgatgagtatataagtgtgtttgtatatgaga

SEQ ID NO: 129 - DNA, 116 bp, Homo sapiens
gcctcttgttttatcggtggattcttgatgagaagtaacaccagctgaaagcttgctttgagtatttttctatttctgtaaccccgagagttttgccgtcatatttatcctgagcc

SEQ ID NO: 130 - DNA, 109 bp, Homo sapiens
gaggagctgggattacaggcatgcgccaccacactcagctaatctttatatttttagtagagacggagtttcactgtgttggccaggctggtctcgaacgcctgacctc

SEQ ID NO: 131 - DNA, 106 bp, Homo sapiens
gtagtccatggtgtgtgtgtgtgtgtgtatatatatttatgtctatatgtatatatatatgtctctctatatatgtgtgtgtgtatatatatatagacatatatat

SEQ ID NO: 132 - DNA, 95 bp, Homo sapiens; identical to SEQ ID NO: 68

SEQ ID NO: 133 - DNA, 93 bp, Homo sapiens; identical to SEQ ID NO: 69

SEQ ID NO: 134 - DNA, 106 bp, Homo sapiens
gtctggcggtctggagtaggaaccctgaggggctgtgtctgggggtggtgggtgacacgcactcactctcagactgcccgggttttccttcctgagacctacaggc

SEQ ID NO: 135 - DNA, 119 bp, Homo sapiens
tccttcagatgtatctggagtttcttccttctggtgggtctgtggtctcgctgacttcaggagtaaagccacagaccttcacagtgagtgttacagctcttaaaggtggtgtcttggga

SEQ ID NO: 136 - DNA, 99 bp, Homo sapiens
ctccttctgcatgaggcccacataatgtatttatcacagctgagtgagctcacttgaaagccatttatgatgtgtaatgctctgtgtcctttgttggag

SEQ ID NO: 137 - DNA, 107 bp, Homo sapiens
tgttctcagcaagggagatggtgaaattgtttctttttttaaaattttttttattttaattttttttttgagacagagtctcgctctgtcgcccaggctggggtgca

SEQ ID NO: 138 - DNA, 113 bp, Homo sapiens
ctctgcactgtgtatcctgatacagtttactgaatgtcactgagtctcagtttttcatctgttaataggggcaatgatactgtttaggccacatagcttgattttaaatagag

SEQ ID NO: 139 - DNA, 58 bp, Homo sapiens
tgagacagagtctctctctgtcacccaggctggagtgcagtggcgtgattttggctca

SEQ ID NO: 140 - DNA, 82 bp, Homo sapiens
gtttatgagaaataaatacttttccatcccttgactttaaatttatgtgtgtctttacaggtcaagtgattttcttgtaagc

SEQ ID NO: 141 - DNA, 125 bp, Homo sapiens
atgctttatgtatttatgtgagtgcgtctatatatatatatatgcatgtgtatatatatatagacgcacacacgtacatatgtgtatatatatatatgcatgtgtatatatatatatagacgcac

SEQ ID NO: 142 - DNA, 106 bp, Homo sapiens
tatatatgtgattgtatgtgtgtgcgtctatatatatatatacacatgcatatatatatatacacatatgtacgtgtgtgcgtctatatatatatacacatgcata

SEQ ID NO: 143 - DNA, 107 bp, Homo sapiens
acaatttctttaatagctatatgtctattctattcagattgtctatttcttcttgtgagttttggccaatcttatttaggatatcaaatgtgtagtcatagacttgt

SEQ ID NO: 144 - DNA, 125 bp, Homo sapiens
cgccagggagggggaggttgtgtgtgtgcacacacgcgcgtgcacgcacacacactctctcgcactcttgtgctcacgctgcctctctcctgctggggaggggggctgagggggctggcagggag

SEQ ID NO: 145 - DNA, 158 bp, Homo sapiens
atagatagatatacgatatctatatatatatggatatatacatacgtatctatatatatatgtatatgtgtgtatatatatatacatatatatatacatatatatatatctatatatatgtatatatacgtatatatacatatatatgtatatatgta

SEQ ID NO: 146 - DNA, 76 bp, Homo sapiens
gttgttgttgttgagatggagtctcgctctgtctcccaggctagagtgcaggggcgcgatctcggctcactgcaac

SEQ ID NO: 147 - DNA, 133 bp, Homo sapiens
tgctaaatgtcagaggacttggtgcggggcgcccctgagcactgttccaaatggcagcactgagtgaggacacacaggcctccagccctaggtatctaccgtgctgcctggcccacgtccccaaacatctctg

SEQ ID NO: 148 - DNA, 90 bp, Homo sapiens
gtaatataagagtttagataatatacagattatatatttatgtgtatacaaaaatatacattatatatgtatatgctatatctatattat

SEQ ID NO: 149 - DNA, 97 bp, Homo sapiens
tggcagatttcttggctgtgtgctttgatggtaatgatgaaaggaaatactttttattttattattccataatgtgcattccaacttgagaatccca

SEQ ID NO: 150 - DNA, 88 bp, Homo sapiens
cctggtgtctgttttagttcatttggtaaagtcatttttttttttcctggagaatgttaatgatagcaggtgttcttcagtgtctagg

SEQ ID NO: 151 - DNA, 98 bp, Homo sapiens
atatcaattacatacagaccttacctttaaggagtcttcaatgcctcatgtaataaaagacagaagacatacaggtgaggtctacagtgcaatggtat

SEQ ID NO: 152 - DNA, 99 bp, Homo sapiens
gcagatgaatatatatacctgtatgtgtatgtatatctatttgtatatgtgcatataaacatggactaatatacatacatatatatatatttgttcagc

SEQ ID NO: 153 - DNA, 68 bp, Homo sapiens
gtgaaataagtgctgtatatatatgtatttatggatccatatttgtacgtgtgtgtacacacactcac

SEQ ID NO: 154 - DNA, 107 bp, Homo sapiens
tatatatatatgtgtgtgtgtgtgtgtgtgtgtgtatgtatatatgtgtatacatatttatgtatatatgtgtgtgtatatatatatatgtatgtgcatatatatat

SEQ ID NO: 155 - DNA, 91 bp, Homo sapiens
ccaagtgtggtttatcctagtgatacaaggttgttttgattcataaatgaatctttgtcgtcaccatattactagaataaagaaggaaagg

SEQ ID NO: 156 - DNA, 71 bp, Homo sapiens
aatccttgatttcatagagttcataatatattggggaaacaaataattgtgattttgttgagatgaggatt

SEQ ID NO: 157 - DNA, 113 bp, Homo sapiens
acactcagagagagaggattaaacaaagttgtgaatatctagaggtgaggatcatggttttcatcctagagtctgcgcaatactgcagggtggttctgtcttaggtctcaggt

SEQ ID NO: 158 - DNA, 89 bp, Homo sapiens
gctacacaaattgcacgatcctacccctctcactgactcagtccaacaatgtgggggtacatttttaatttgtgaaagtttgtagtagt

SEQ ID NO: 159 - DNA, 116 bp, Homo sapiens
atatatagttatatatagttggttatatatagtttcttaacccaaaaactaactctctctctctatatataactatatatgcatatattatacatagagagagttagtttttgggt

SEQ ID NO: 160 - DNA, 87 bp, Homo sapiens
atatatgcaatttatatatatgtatgtgtatatacatgtatatatgtatgtatatatgtgtatatatgtatgtatatatgtatgtat

SEQ ID NO: 161 - DNA, 66 bp, Homo sapiens
ggaccaacaaatgtctgaccacaaaagaagctactcaaatagcttcttctcagatgactgtgatcc

SEQ ID NO: 162 - DNA, 115 bp, Homo sapiens
gctaatgtgtaggttactaactttatatataatgttgcctgttgtttagttttatatatttgctttatatacatagaaaccaataaacaagagtatgagtgttacctacatttgc

SEQ ID NO: 163 - DNA, 86 bp, Homo sapiens
tgctattctctctgttattcttggaaagtttttgaaattaaaagtctttttaaaaatcagaagaagaagaaagcagggagaaagca

SEQ ID NO: 164 - DNA, 117 bp, Homo sapiens
gacagaccctgagctgatagaccatgagctgatagactgagtctgtgagatttaaaaaaaaatttttttttatacagtcttgctctgttaccaaggctggagtgcagtggtacagtc

SEQ ID NO: 165 - DNA, 117 bp, Homo sapiens
ggtttgaccaataagagaaaggaggcttgtgggtgaagggtgaagtcacagaggtcagaggtggcctggcccaggactcggacgcccctctccgtggtcctcataggggtcccaacc

SEQ ID NO: 166 - DNA, 86 bp, Homo sapiens
gatgtgcttctagcccatgattccaacagttagagggcactgtatgtatggtaaagttctgtatttgttggaggactaacacaatc

SEQ ID NO: 167 - DNA, 72 bp, Homo sapiens
aagctacaaccatgagctgacaagaaaaacgagaatctcatttctatttttcttttagtctggaagtagctt

SEQ ID NO: 168 - DNA, 110 bp, Homo sapiens
tgttgtggtactgattggtggaggttctgcatggtagggatgagatataaactgagacagtcagtctgacttatagggccataccttttcactcttctgtacagctgtca

SEQ ID NO: 169 - DNA, 107 bp, Homo sapiens
gaaagcactatggtaaattaactgcattgagaccagttatgtatgtatgtttgtatgtatgtatgtatgcatgtatctatgtatgtagttattttttatattgagtc

SEQ ID NO: 170 - DNA, 80 bp, Homo sapiens
tatatatttatttatatatatatatatagaccaatataaatatttctgtatgtatgtgtgtgtgtgtatatatatatata

SEQ ID NO: 171 - DNA, 145 bp, Homo sapiens
agataatgtgttgtccatacatatgtgtgtatatatatctttatgtgtatgtgcacatatatttatatgtactatatatgtgtgtgtatatatatatctttatgtgtatatatgccgtgtgtgtgtatctttatatgtgtgtgta

SEQ ID NO: 172 - DNA, 86 bp, Homo sapiens
gtgtgtgtgtgtatatatatatatatatatatacgtatatatatatatgtgtgtatatatatgtgtgtatatatatacacacacac

SEQ ID NO: 173 - DNA, 115 bp, Homo sapiens
ttgcctaggattgtcttggctatgcagacttttttttttttttggttgcatatgaaatttaaagtagttttttctaattctgtgaagaaagtcaatggtagcttaataggggtag

SEQ ID NO: 174 - DNA, 104 bp, Homo sapiens
agtccccttcctctagctttgggaatgagggccggcttctttttttttttttttttttgagacggagtctcactctttctcccaagctggactgcagtggcgct

SEQ ID NO: 175 - DNA, 61 bp, Homo sapiens
ccccaaggttatctgtgtttttccctggattctgtgaagtcacacaggtcacactctgggg

SEQ ID NO: 176 - DNA, 110 bp, Homo sapiens
gccaggcatggtggcaggtgcgtgtaataccagctactcgcgaggctgaggtaggagaatgacttgaacccgggagtggaggttgcagtgagccaagatcgtgccactgc

SEQ ID NO: 177 - DNA, 58 bp, Homo sapiens
tgagacagagtgtcactctgtcacccaggctggagtgcagtggtgtgatctcggctca

SEQ ID NO: 178 - DNA, 120 bp, Homo sapiens
ggggttaaaccaatttcctaaagtcatggagacataaggggtaaagctatgtatgattcccagtctctctgactttcaagcctatccttttgaccactaatttgctatactctcctgact

SEQ ID NO: 179 - DNA, 86 bp, Homo sapiens
atacagtggtgggattgcaggatcatatggtagttctatatttaatttttaaaggaactccatactgctttccataatggctgtat

SEQ ID NO: 180 - DNA, 69 bp, Homo sapiens
acagacagacagacagacagacagaggggctgcccactggagcctccagctcgctgggtgaaagtttgt

SEQ ID NO: 181 - DNA, 113 bp, Homo sapiens
gtgtcttttaattggggcatttagcctgtttacatttaaggttaatattgttatgtgtgaatttgatcttgacattatgacgttagctggttattttgcccattagtttatgc

SEQ ID NO: 182 - DNA, 111 bp, Homo sapiens
gagtaggagactaagaggactggaaacataagagacagtggtaggaggaagaaaactttaaattgaaattttttgggggtgaagtttctaggagtaaaaaggtctagactc

SEQ ID NO: 183 - DNA, 61 bp, Homo sapiens
ggggatgaggaaagggtggtgttggcggttcaggactgtctctctgaccctcttcaatgcc

SEQ ID NO: 184 - DNA, 72 bp, Homo sapiens
ccaggtgtggtggtgtgtgcctatagtctcagctacttgggaggctgaggtaggaggatcacttgagcttgg

SEQ ID NO: 185 - DNA, 114 bp, Homo sapiens
agtcctggtgattttctatttatcatttgttctaattaggctagaaagaatctaaaaatgtaagattatatctatcctaattcatattaaggtgatagaaaattaaaagaaact

SEQ ID NO: 186 - DNA, 122 bp, Homo sapiens
gatagatatcatatgtatttatatatgatatatagatagatatcatatgtatttatatatgatatatagatatcatatgtatttatatatgatacagatatcatatgtatttatatatgata

SEQ ID NO: 187 - DNA, 185 bp, Homo sapiens
tatcatatgtatttatatatgatacagatagatatcatatgtatttatatatgatacagatagatatcatgtatttatatatgatacagatagatatcatgtatttatatatgatatatagatagatatcatatgtatttatatatgatatatagatagatatcatatgtatttatatatgatat

SEQ ID NO: 188 - DNA, 235 bp, Homo sapiens
aaatatatatttatatttatgttatatataatgtatatattatatagatatatatcatatgtatttatatattatatagatatatatcatatgtatttatatattatatatagatagatatcatgtatttatatattatacagatagatatatgtatttatatattatacagatagatatcatatgtatttatatatacagatagatatcatatgtatttatatatacagatatc

SEQ ID NO: 189 - DNA, 85 bp, Homo sapiens
gagcatttccctacactaggatgttgcatgttgtatttatttatttgcaaaatgtaaagaattaataggctgggcatgggggctc

SEQ ID NO: 190 - DNA, 57 bp, Homo sapiens
cgctggttcccaggaaaattgggtggcagttttactcagtttcactcagtttcagcg

SEQ ID NO: 191 - DNA, 105 bp, Homo sapiens
caatcatatggttactttcttcaggcctttactcatttttattatttttggagacaaggtctcactctgtggtcaaggctggggtgcagtgatcatagctcattg

SEQ ID NO: 192 - DNA, 115 bp, Homo sapiens
gtatgtcattctatgtctttgctagaaatgataccaaaatattattttttaaaaattaggttattttttgaataagtggtatattcatggcagagaatttagaaaaggcagatac

SEQ ID NO: 193 - DNA, 106 bp, Homo sapiens
gcaatctagtccccaggcaagaagggggtttgttttgggaaagagctattactttttttcttttttttgagacaagagtctcgctctgtcgcccagactggagtgt

SEQ ID NO: 194 - DNA, 82 bp, Homo sapiens
agagagagacacagaagaataaatcagaggcagggttttatagactttttttttttttttttctgagacagagtctcgctct

SEQ ID NO: 195 - DNA, 95 bp, Homo sapiens
gcatgccactttgaaggggttaagtggttttaataagttgaatatgttttttgttttcaactaaatattaagaatatatttctttatagcaatgc

SEQ ID NO: 196 - DNA, 82 bp, Homo sapiens
agcaagaggtggggagaggtagcatgctctttttatttatttatttatttttgagatggagtctctatctgtcacccaggct

SEQ ID NO: 197 - DNA, 85 bp, Homo sapiens
tgagatggagtctcacactgtcacccaggctggagtgcagtggtgcgatctcagctcactgtaacctctgcctcctgggttcaag

SEQ ID NO: 198 - DNA, 58 bp, Homo sapiens
tgagatggagtctcacactgtcacccaggctggagtgcagtggtgcgatctcagctca

SEQ ID NO: 199 - DNA, 69 bp, Homo sapiens
caggcctctagctgagggagaaaatgtactcatctgctgatgagagcattctagtctgctagacatttg

SEQ ID NO: 200 - DNA, 62 bp, Homo sapiens
gtctgccacccactaggctctgcgctcctctggggatggctggctcagtgactggcacagac

SEQ ID NO: 201 - DNA, 105 bp, Homo sapiens
ggcctggtagataggagaggctcaatatttattgaatgatttttttttttttttttttttttttttttttttttagagacagggtcttactctgtcacccaggct

SEQ ID NO: 202 - DNA, 79 bp, Homo sapiens
agccctggagcagacacacctgagtgtggattcttttttttttttttttttgacggagtctcactctgtcgcccaggct

SEQ ID NO: 203 - DNA, 73 bp, Homo sapiens
ctctaatctgtgcatgtgcatgtgtacctgctgtgttaagaactggcaggtggacagtatgatgagagtaggg

SEQ ID NO: 204 - DNA, 95 bp, Homo sapiens
gctcaatttggtagaacccattttccagtagtattgtagaaactatttatttatttatttattttgaggtggagttttgctcttgttgcccaggc

SEQ ID NO: 205 - DNA, 74 bp, Homo sapiens
gttattgtttttgatacagactctcactctgtctccaggctggagtgtagtggtgctgtgtccggaattttttc

SEQ ID NO: 206 - DNA, 118 bp, Homo sapiens
ggggcagagcaggcgagcggggccggagcgcgagcggccgtcggtgggccggagtccagtctggctggctggctggctgggacgcgggggcgctgctgttcgtgctctcagaggctgc

SEQ ID NO: 207 - DNA, 105 bp, Homo sapiens
gagaactctaagcagggaaggaagaggatctcactttttttttcttttttgagactgagtatctcactctgtcacccaggctggagtgcagtggcacagtctcgg

SEQ ID NO: 208 - DNA, 92 bp, Homo sapiens
tgtgctctgggggctgtgccgggtagagagggcagtgggaggtaagagctcttcacccttcaccaccttctccacccagcatggccggcaca

SEQ ID NO: 209 - DNA, 81 bp, Homo sapiens
ctgatttcttggcttagagttctctgcagattgggtacagtctgcaagtccagggtccttgaagccaaaaggatgtgttag

SEQ ID NO: 210 - DNA, 72 bp, Homo sapiens
tttgttttgagacggagtctcgctctgtcgctcacgctggagtgcagtggcgcgatctcggctcactgcaag

SEQ ID NO: 211 - DNA, 74 bp, Homo sapiens
gcaactcccactgtgcctcacaccctgcctcatgcagaggagaaggtcggtgaatagcagtaaaatcagtgtgc

SEQ ID NO: 212 - DNA, 65 bp, Homo sapiens
gcccagactgtgtctgtcactgcctcttctgagggactggctggtgaccctggcagtagctgggt

SEQ ID NO: 213 - DNA, 111 bp, Homo sapiens
tcactgcactcatttccaggatggggctgtcatctatgcatctcccactgtgcctcacaccctgcctcatgcagaggagaaggtcagtgaacaggagtaaaatcagcgtgc

SEQ ID NO: 214 - DNA, 114 bp, Homo sapiens
tttccaggatggggcagtcatctatacatctcccactgtgcctcactccctgcctcatgcagagaaggtcggtgaataggagtaaaatcagcatgctactcatctcacaggggg

SEQ ID NO: 215 - DNA, 102 bp, Homo sapiens
ggatggggcagtcatctatgcaactcccactgtgcctcacaccctgcctcatgcagaggagaaggtcggtgaataggagtaaaatcagtgtgctactcatct

SEQ ID NO: 216 - DNA, 117 bp, Homo sapiens
ctgcttccaagtctcaggttaccatgtggtagtggccagtctgtctctgtgtctctgtcatcagtaagagtttccctcaccattccacacaagccacatgagcctaaaaaatgtagg

SEQ ID NO: 217 - DNA, 106 bp, Homo sapiens
gcaaaagttatttccttttattgtgaagagagacaataagtgacattggttattagccatgtctgtcactttgtcactagtagaaatcaggtattttcttttttgt

SEQ ID NO: 218 - DNA, 95 bp, Homo sapiens; identical to SEQ ID NO: 68

SEQ ID NO: 219 - DNA, 93 bp, Homo sapiens; identical to SEQ ID NO: 69

SEQ ID NO: 220 - DNA, 72 bp, Homo sapiens
ggattgcctctctgtgacactccctcccacccaagtctgtgggccccctggtgtcagtagtggagcgtgtct

SEQ ID NO: 221 - DNA, 95 bp, Homo sapiens; identical to SEQ ID NO: 68

SEQ ID NO: 222 - DNA, 93 bp, Homo sapiens; identical to SEQ ID NO: 69

SEQ ID NO: 223 - DNA, 96 bp, Homo sapiens
ttgacagtcttggacaaggaagaggaacagaccatgcctcactgcctgtaacccttatgtggcttcctttgtcttaatcttcctgaaggcctgcag

SEQ ID NO: 224 - DNA, 65 bp, Homo sapiens
cggtggggttaagagtgattttttttttttttttgagacggagtctcactctgtcacccaggctg

SEQ ID NO: 225 - DNA, 120 bp, Homo sapiens
aggttcttctgtggcaagtgctggcatggaccatagagaagtcattttgtagaggagtttttttttttttttttgagacggagtctctgtcgcccaggctggagtgcagtggcgtgacct

SEQ ID NO: 226 - DNA, 59 bp, Homo sapiens
gtggaccccacacgggtgctctcatctgactctggcaggcagttctgtgtgtggaccac

SEQ ID NO: 227 - DNA, 76 bp, Homo sapiens
gtgcgtgtgtgcacatgcatgtgcatgtgcatgcatatgtgtgtatgcatgctagtgtgtgtgtgtgcacatggat

SEQ ID NO: 228 - DNA, 87 bp, Homo sapiens
cctgctccagcctggctcactctccctgtgctctgggctggacttgggtgctgctagcctgtggcaggggagtggccagagggcagg

SEQ ID NO: 229 - DNA, 113 bp, Homo sapiens
gtaccactgccctccagcctgggacagagcgagactccgtctatttttttttttttttttttttttttttgagatggagtctcgctgtgtcccaggctggagtgcagtagcac

SEQ ID NO: 230 - DNA, 95 bp, Homo sapiens
accagtagccgaacagcctgtctgtctgtctgtctgtccaccccacacccagaccagcaaggaacaaggctgttatgtcgggcatctctgctggt

SEQ ID NO: 231 - DNA, 73 bp, Homo sapiens
ccgacataacagccttgttccttgctggtctgggtgtggggtggacagacagacagacagacaggctgttcgg

SEQ ID NO: 232 - DNA, 79 bp, Homo sapiens
gcctctggctttctgtctgtctgcctgtctctctcacgttggtgccgctttaagagagggtgaggacttcagcctgggc

SEQ ID NO: 233 - DNA, 76 bp, Homo sapiens
gtgtgggtgacagtggccctggaggtcacagccagactgttcagtgtgtctccctctgtcttccccaggccccgcc

SEQ ID NO: 234 - DNA, 115 bp, Homo sapiens
cccatatgtgtctactgaacttctttagggagataagctgctgactggagggtgtgagcacaaaccaggaggctgagcgaatgaccttcaagaaaggaacaaacaggtgcaaggg

SEQ ID NO: 235 - DNA, 114 bp, Homo sapiens
tgagaggaactttacctctcctggttccacagttctctgagcctcagttctatttattttttaatcagtaaaactgggaactcaaattacttgtccaagattccttcctcatca

SEQ ID NO: 236 - DNA, 77 bp, Homo sapiens
gtgacacacactcagtcactgccctgatggggtttttacaacctggtgaggcagagagatactggtcaaatagtcac

SEQ ID NO: 237 - DNA, 78 bp, Homo sapiens
ccactttagaactagcaccaagaaactttggaattaaggaccttctaagttttttgtttgttttttgttttgagatgg

SEQ ID NO: 238 - DNA, 118 bp, Homo sapiens
gcaagtatttcaagatctcttttgcgtatgtattctccagggaagagaagcatgtttactttagaaattatgctcatttcctctcttgcaataccttgtgaaatcgattgctctgaaa

SEQ ID NO: 239 - DNA, 108 bp, Homo sapiens
tcccagttgtatatgttcctatatgtatatgtgtgtatatatatattcctctgtgtgtgtgtgtgtaagaaaaatatatatatagcctagcatcatttcatcctgtga

SEQ ID NO: 240 - DNA, 73 bp, Homo sapiens
tatatttgtcatcttcacattgagtaggctgaaaaggagggtttgtctcactgtctcaggggtgacagaggtg

SEQ ID NO: 241 - DNA, 113 bp, Homo sapiens
cacgttgcgagatcctggctttgtgtcctgatgggccatgtgggcaggctgctctctgctctaacactccctcaacactatgttcacaccatcctgattttttcccccaagtg

SEQ ID NO: 242 - DNA, 65 bp, Homo sapiens
ccagatgccagtgttcagagttcctgtgagtgcccaggctcacagagccctgcacattctcctgg

SEQ ID NO: 243 - DNA, 103 bp, Homo sapiens
ggctggtgccagtgactgcagctgcagaggcaagccctccattcccagtggggtaggtgtcactgtctctgtgcaccgacactaggtcatcggtttcttagcc

SEQ ID NO: 244 - DNA, 75 bp, Homo sapiens
ctccctggctgtctctgtctctggaggaagctggagagaggatccagtcgtggtcagtgggcaggatacagggtg

SEQ ID NO: 245 - DNA, 81 bp, Homo sapiens
tcttgtatgagctcacatgcatgagttacaaaaggctggctgaccttaacgatggctgggtctgtgaggctctcattgaga

SEQ ID NO: 246 - DNA, 70 bp, Homo sapiens
ggtgtctttctgagtctctgtgagaggcctctaagccctgcttctccttgaaaatgattccctagacacc

SEQ ID NO: 247 - DNA, 96 bp, Homo sapiens
tgagttttgattatgtgatattttcatctgattgattttttaaatttctcattggatttaaagtgttttctttgctaatgttatatacagaattca

SEQ ID NO: 248 - DNA, 77 bp, Homo sapiens
gattacttgtgtatttcatattcacaaaacattgtattaattatacagtgcttgtgagtgatgatcacaatataatc

SEQ ID NO: 249 - DNA, 105 bp, Homo sapiens
tgataattgtgttatgcaaaattaggtgacagtagaaagtcaggactgaagctagaggaattcagaacttcagcactggattgacctgtgcaacacaaagtttca

SEQ ID NO: 250 - DNA, 95 bp, Homo sapiens; identical to SEQ ID NO: 68

SEQ ID NO: 251 - DNA, 93 bp, Homo sapiens; identical to SEQ ID NO: 69

SEQ ID NO: 252 - DNA, 110 bp, Homo sapiens
ccgtcctgggtgacagagcgagaccttgtctcaaagcaattttatatatatatatataaatttttttttttttttttagagacaaagtctcactgtgtcacccagcctgg

SEQ ID NO: 253 - DNA, 112 bp, Homo sapiens
ctcccaattagtattgttaatgatgttgaggcaccacagggttgaaagtattgtaaattttaaaactttatattttcttgctgcctcaacatccccacaaacaggctatgag

SEQ ID NO: 254 - DNA, 95 bp, Homo sapiens; identical to SEQ ID NO: 68

SEQ ID NO: 255 - DNA, 93 bp, Homo sapiens; identical to SEQ ID NO: 69

SEQ ID NO: 256 - DNA, 89 bp, Homo sapiens
atagaacttcaaagagagcagagaagataggttaggttagagatgcaagactttttcttttctttttttttaatggagtatcgctctgt

SEQ ID NO: 257 - DNA, 88 bp, Homo sapiens
gtgtgctgatgagaagaatgtgtattctgcagctatggaatgaaatgttctgtaaatgtctgttaggtccatttggtctgtagtgcac

SEQ ID NO: 258 - DNA, 106 bp, Homo sapiens
ctgggcaacatagtgacactccgtctctaccaattatatatatatatacacacacacacacacataattttttttttttgacatggagtctcgctctgtcacccag

SEQ ID NO: 259 - DNA, 106 bp, Homo sapiens
gctatatatgtgtgtgtattcatatgtgtgtgtatatatatgtgtgtatgtatatatgtatatgtgtgtatacatgtgtatagatgtatatgtgtgtgtgtgtata

SEQ ID NO: 260 - DNA, 70 bp, Homo sapiens
ccggtacctcagatggaaatgcagaaatcacccgtcttctgtgtctctcactctgggagctgtagaccgg

SEQ ID NO: 261 - DNA, 74 bp, Homo sapiens
cagcacatctggaattgtagttgtgattggcagcacaacctgattatcaactgtaattcttcagaatttgtctg

SEQ ID NO: 262 - DNA, 117 bp, Homo sapiens
ttctagtagagtgagtgcagagctgatgacaagttgaaatgagatcaatctatttgtttaaaaatatacaaatattttgcatttaatttcatcggttaaaatgtctaaacattagag

SEQ ID NO: 263 - DNA, 64 bp, Homo sapiens
acacacacacacatatacatatatatacatatatacacacacatatgtgtgtgtgtgtgtgtgt

SEQ ID NO: 264 - DNA, 106 bp, Homo sapiens
tgtccaatgcattccagcctgggtgacagagagagagatcttgtctttttttttttttttttgaaacagagtctcactctgttgcccaggctggagtgcagtggca

SEQ ID NO: 265 - DNA, 83 bp, Homo sapiens
tccagcctgggcaacagagtgagactctgtttcaaaaaaaaaaaaaaaaagacaagatctctctctctgtcacccaggctgga

SEQ ID NO: 266 - DNA, 71 bp, Homo sapiens
agcagctatattttctgctatgactcactgtgactcaggactcaagcagcccagtgtccagtctggctgct

SEQ ID NO: 267 - DNA, 72 bp, Homo sapiens
tacctaagtaacaaatgagtcaccacacttccacagaagagctctgaggatcagtgggtgtgttggggggta

SEQ ID NO: 268 - DNA, 117 bp, Homo sapiens
ctgtgttaagtacaaccaggtgatggacaatgggtggactgaatttttcatttttatcaagcatggtatggaagaagcagcagtagcctgaccttctcaactgcttggaattcatgg

SEQ ID NO: 269 - DNA, 87 bp, Homo sapiens
agccactgttgcagacatctttggaaaatagaatttgccagaatttattttttctttttttgagagtcttgttctgttgctcaggct

SEQ ID NO: 270 - DNA, 102 bp, Homo sapiens
gcttgagccagggcaagactgagaggggaggcccgggcggcccttctgacacagaggagaaagtgaggagtctccttggtctagccacccagggcatggagc

SEQ ID NO: 271 - DNA, 126 bp, Homo sapiens
gtatttttttagtagagacagggtttcaccgtgttagccaggatggtctcgctctcttgacttcatgatccgcccgccttgccctcccaaagtgctgcgattacagtcgtgagccaccacgcctgg

SEQ ID NO: 272 - DNA, 78 bp, Homo sapiens
gctcttggaatttcagaacaattactctgcctaactgttatgcagtctggctgactctgtgagtgtgtgtgcgagagt

SEQ ID NO: 273 - DNA, 107 bp, Homo sapiens
gcattttacagatattatttcatttcaccttcacaacaatcctatttgatagatttttttttatcaagaaggagaaatttgaagcctagagagactgaatgatttgc

SEQ ID NO: 274 - DNA, 95 bp, Homo sapiens; identical to SEQ ID NO: 68

SEQ ID NO: 275 - DNA, 93 bp, Homo sapiens; identical to SEQ ID NO: 69

SEQ ID NO: 276 - DNA, 58 bp, Homo sapiens
tgagacagagtctcgctctgtcacccaggctggagtgcagtggtgcgattttggctca

SEQ ID NO: 277 - DNA, 72 bp, Homo sapiens
gttcaggatgagtagtccaggatgcatgattatctagtgtctgatgatcactcattcactctcagccagggc

SEQ ID NO: 278 - DNA, 96 bp, Homo sapiens
actagagtggaaagagaccaggcccaggagacatgacatctgaattctaggcttgcctctgacactgtctctcctgcacccctttctcctttgagt

SEQ ID NO: 279 - DNA, 150 bp, Homo sapiens
acagagtaagattctgtctcaaaaaaaaggagcaattatatatatatatatatttatatatatatatatataattttttttttttgagacagtgtctcactctgtcaactcaggatggaatgcagtggtgcagtggtgagatcacagctc

SEQ ID NO: 280 - DNA, 70 bp, Homo sapiens
tttttctattttttttttgctttgaggcagggtctcgctctgtcactcaggctggagtgtaatggtggaa

SEQ ID NO: 281 - DNA, 77 bp, Homo sapiens
tatctatctatctatctatctatctatctctattaccagaaaaagtggggatggatgtttgggaagaaaatagtatg

SEQ ID NO: 282 - DNA, 105 bp, Homo sapiens
tacatctttttgtttctgtggtatcggttgtactgtcttctcttttttttttttttttttgagacggagtcttactctgtcacccaggctgagtgcagtggtgtg

SEQ ID NO: 283 - DNA, 119 bp, Homo sapiens
tctctatatatatgtgtgtgtatatatatatatatatatgtgtatatatatatgtgtatatatatgtgtatatatatgtgtatatatatatgtgtatatatatataaaatttttggaga

SEQ ID NO: 284 - DNA, 92 bp, Homo sapiens
tccagaaggtaggagagggggaatatgctggggggttttgtttgattatattttatgttcttagagtatttttttctgtctctgactgtgga

SEQ ID NO: 285 - DNA, 58 bp, Homo sapiens
tgagacggagtctcactctgtcacccaggctggagtgcagtggtgcaatcttggctca

SEQ ID NO: 286 - DNA, 78 bp, Homo sapiens
aagcacggagaaagcttcagtgaaccccaagttgctgcccggatccagcgtctggtggctctcactgtgactgtggtt

SEQ ID NO: 287 - DNA, 90 bp, Homo sapiens
cattgatctatgtgtttggttttgtaccagtgccatgttatttcagttactgtggccctgtagtatagtttgaagtcaggtagcgtgatg

SEQ ID NO: 288 - DNA, 89 bp, Homo sapiens
agtgttgggattacaggcgtgagccaccgcgctggccactgcagcatttttctggccctcgacagctctgtgtctgtgactcttctatt

SEQ ID NO: 289 - DNA, 85 bp, Homo sapiens
tgctttacctcactatatatacatatattcatgtgtatatgtgtttatatgtgtgtatatatgtacatgaatgtgatagactgca

SEQ ID NO: 290 - DNA, 58 bp, Homo sapiens
tgagactgagtctcactctgtcacccaagctggagggcagtggtgggatctcagctca

SEQ ID NO: 291 - DNA, 80 bp, Homo sapiens
ttatgggatatctttcccagtttttgattgtaagtatttcaaatgcttccagtcttttgaggctgtataagaaaccatgg

SEQ ID NO: 292 - DNA, 91 bp, Homo sapiens
tgtaagtgcaggtcacaggggatatgatggcttagcttgggctcagaggcctgacagttacccactcacaccctcactgccaccactcaca

SEQ ID NO: 293 - DNA, 58 bp, Homo sapiens
tgagatagagtctcgctctgtcacccaggctggagtgcagtggcgcgatctcagctca

SEQ ID NO: 294 - DNA, 84 bp, Homo sapiens
ctgttgtgggtattgatggccaggtttcttttttttttttttttttttttttgagatggagtctggctctgtcgcccaggctgg

SEQ ID NO: 295 - DNA, 58 bp, Homo sapiens
tgagatggagtctcactctgtcacccaggctggagtgcagtggtatgatttcggctca

SEQ ID NO: 296 - DNA, 124 bp, Homo sapiens
cttgctcagagccctctcattccacagccagcatgctgcacagacttcagcagcccacctctggctcactcgctcacttgctggcaggctggctcatcctccaggggcaagagaaggagagagg

SEQ ID NO: 297 - DNA, 89 bp, Homo sapiens
ggcatgagcgacgacgcctggcccgcttttctttttcttttctttttttttttttttttgagacagagtctcgctctgtcgctcaggct

SEQ ID NO: 298 - DNA, 84 bp, Homo sapiens
tggtgggaatggatcctgggtgctatgcagccacatgagtactaagcacactatgactgacagcatcctgaatgcttcccacca

SEQ ID NO: 299 - DNA, 56 bp, Homo sapiens
tgagaccgtctcactctgtcacccaggctggagtgcagtggtgtgaacacggctca

SEQ ID NO: 300 - DNA, 67 bp, Homo sapiens
gtgctgggattacaggcatgagccaccatgcctagcctggtatttatctttgtaattctaactgtac

SEQ ID NO: 301 - DNA, 92 bp, Homo sapiens
ctcagagtcaacagtgtggtgatactgatctttgttttgtgggattttttttttttttttttttgacacagggtctcactgttgaccaggag

SEQ ID NO: 302 - DNA, 60 bp, Homo sapiens
ggattgttcattgttaatatatagaaatacaattgatttctgtgtattgatgttgtatcc

SEQ ID NO: 303 - DNA, 58 bp, Homo sapiens
tgagacggagtctctctctgtcacccaggctggagtgcagtggcgtgatctcggctca

SEQ ID NO: 304 - DNA, 72 bp, Homo sapiens
ccaggtgtggtagcatgtgcctgtagtcccagctacttgggaggctgaggtagaagaatcacttgaacctgg

SEQ ID NO: 305 - DNA, 131 bp, Homo sapiens
gcttgttgagttactatccttttggttttggggtaactgagtagactagctgtcctagtaggtagcatagaacaaagagtgttccttggccaggcgcagtggctcacacttgtaatcccagcacactggga

SEQ ID NO: 306 - DNA, 79 bp, Homo sapiens
tttaggataaagagaaagagaaaagctatatcttaaatagcatggtgacatggcttttcttttcttttttttttttgga

SEQ ID NO: 307 - DNA, 88 bp, Homo sapiens
ttgtgagagtggctggaactttcttcattcaaaaactatttcttgcaaactttgttcctgatagtgcatgaccagctgactcttgcag

SEQ ID NO: 308 - DNA, 94 bp, Homo sapiens
taacttgttttttattttacaggctcacaggtggaagggatttgccttgtctgagatgtgactttgtacttttgaattaatgtggaatgagtta

SEQ ID NO: 309 - DNA, 82 bp, Homo sapiens
ggcagggagcacaccctgaagtgagagaggccagagggatgtgggtccctccctggagacactgggtgacaggctcagtgct

SEQ ID NO: 310 - DNA, 108 bp, Homo sapiens
attgatggatggatggatggaatgaggtctgcccaggagatgcaccatgataatatttttttttttttgagacggagtctcactctatcacccaggctggaatgcaat

SEQ ID NO: 311 - DNA, 102 bp, Homo sapiens
ggcatggtggtgtgcacctgtaaccccagctacttgggaggctgaggtaggaggatcgcttgagcccagaagtttgaggttacagtgagctgtgaccatgct

SEQ ID NO: 312 - DNA, 94 bp, Homo sapiens
tgcctgaaagcagaaccctgtatatctttaaaacaaatatgttacaatttttgttttaacatttggttaaggtgtacagcatgatgttttggta

SEQ ID NO: 313 - DNA, 105 bp, Homo sapiens
atgcacagtaggagttttgtagttttgccaagtgtcatctggtagttggatctttagtgaatattaaatgttggtagattattggtgaatgcacttactgtacat

SEQ ID NO: 314 - DNA, 101 bp, Homo sapiens
ataaaagtataatatagtagatacataaaccagtaacatagtttttattatcattatcaagtattatttactgaatataattgtatgtgctatacttttat

SEQ ID NO: 315 - DNA, 58 bp, Homo sapiens
tgagacagagtctcgctctgtcacccaggctggagtgcagtggcgcgatctcggctca

SEQ ID NO: 316 - DNA, 114 bp, Homo sapiens
ggtgtatggccttatttctgggttctctaatccattccattggtctatctgtctgcttttgtagcagtatcatgctgttttggttactgtagccctgtagtacggttttaagtc

SEQ ID NO: 317 - DNA, 95 bp, Homo sapiens; identical to SEQ ID NO: 68

SEQ ID NO: 318 - DNA, 93 bp, Homo sapiens; identical to SEQ ID NO: 69

SEQ ID NO: 319 - DNA, 70 bp, Homo sapiens
gagaccacctagaatcctgaaagaatggtccgtagatggacagactcactctgtgaagcaggtggatctc

SEQ ID NO: 320 - DNA, 80 bp, Homo sapiens
aaaccacatattgtctgattttgtttatatgaaatgcctatattgggcacatctatacatggatagtagattcgtggttt

SEQ ID NO: 321 - DNA, 114 bp, Homo sapiens
cttggcccttgtgctcactgggaaaatggggagagacagaactcattcaggagacctgtaattctgttctttctctgggaggcaagaagaaaggtgagttttgcatatgggtga

SEQ ID NO: 322 - DNA, 56 bp, Homo sapiens
gagacagaatctcactctgtcacccaggctggagtgcagtggtgggatctcggctc

SEQ ID NO: 323 - DNA, 112 bp, Homo sapiens
agagagtgtgctgtcaacaccatgtctcttcagaaggcatttctttttcttttttttttttccagaaggcatttctgtcatgaagggttatttattgaccagggcttttttt

SEQ ID NO: 324 - DNA, 56 bp, Homo sapiens
gagacagagtctcgctctgtcacccaggctggagtgcagtggcgtgatcttggctc

SEQ ID NO: 325 - DNA, 101 bp, Homo sapiens
actggctggaaagtctggaaactgattgaggggccatgattctctgtttttataattcatgttagttttttatccatttgacctagaagttttctgcttgt

SEQ ID NO: 326 - DNA, 79 bp, Homo sapiens
cggccgatgggcgtcttaccagacatggttagacctggccctctgtctaatactgtctggtaaaaccgtccatccgctg

SEQ ID NO: 327 - DNA, 81 bp, Homo sapiens
tgacctgacacctgagtctctgcttgttctatgtgtcggatggttccgaaccatgtatgatctagagggacacagaggcag

SEQ ID NO: 328 - DNA, 62 bp, Homo sapiens
gtgtgtgtgtgtgtgtgtatatatatacgtgtgtgtgtatatatatatatacacacacacac

SEQ ID NO: 329 - DNA, 111 bp, Homo sapiens
atgtattttggtgctccattattaggtgcatatatttataattattatatctctctgagggattaatcttataaaatgtcccttcatataattttttgttctaaaatccat

SEQ ID NO: 330 - DNA, 76 bp, Homo sapiens
aggtctctctctgtcacccaggctggggtgcagtggtgtgatcacgactcacagcagcctcgatcttcctgggctt

SEQ ID NO: 331 - DNA, 92 bp, Homo sapiens
ctgctcttgggagtttggagttttggagactttaataaacacgtactttttttttttttaaaagacagagtctcactctgtctcccaggcgg

SEQ ID NO: 332 - DNA, 100 bp, Homo sapiens
ggtgtgatgtcttatctgtagtcctagctacttgggaggttgaggtaggaggatctcttgagcccaagagtttgagcctgcagtgagctgtgattgtgcc

SEQ ID NO: 333 - DNA, 81 bp, Homo sapiens
gtggactgagggatgaatgggatgtgaggaaatagagatttttattttattattacttttagagacagggtctcagtctgt

SEQ ID NO: 334 - DNA, 95 bp, Homo sapiens
ggaattaaataaaatgcaagatgtactatttttttttttaaagacagttctggttctttagagtgaagaatggtatttattgtagaaattattct

SEQ ID NO: 335 - DNA, 56 bp, Homo sapiens
gagacagagtctcgctctgtcacccaggctggagtgcagtggtgcgatcttggctc

SEQ ID NO: 336 - DNA, 63 bp, Homo sapiens
aggaggtagaggttgcagtgagcctgggcaacagagtgagacactgactctctctctctctct

SEQ ID NO: 337 - DNA, 115 bp, Homo sapiens
ggtcatcatccacctgaactgctttcctcatcacttctcccatttcacagattctgtcaatctgactctcaatttcctgtgaagatattaaggaaacaaaggtggaaaaatcacc

SEQ ID NO: 338 - DNA, 114 bp, Homo sapiens
gcctccagctttgttcttttgcttaggattgtcttggctatatgggctcttttttggttccatatgaaatctaaagtagttttttctagttctgtgaagaaagtcaatggtagc

SEQ ID NO: 339 - DNA, 102 bp, Homo sapiens
gtgaaacaggaaaaggctctaatctgtgattgatgatccaattcatgatctttttttcattatcattccattagactcttggtctgtgactatcttctttac

SEQ ID NO: 340 - DNA, 76 bp, Homo sapiens
actatcttgatatggagagagagattcaaagttggtcctttcaactttaaaatctcttactctgtgactctgtggt

SEQ ID NO: 341 - DNA, 119 bp, Homo sapiens
gccaggtgtggtggcacatggcctgtagtctaactactcaggaggctgaggtagaaggatcacttgagcccaggagttcaaagttatagtcagctatgattatgtcactacactccagc

SEQ ID NO: 342 - DNA, 89 bp, Homo sapiens
gaagcagagtacacaggttacaatattatgtgaatctactcagcacaatggatacgcataattttataacagttttgtgtcccagcttt

SEQ ID NO: 343 - DNA, 58 bp, Homo sapiens
gaagcattgaagagacttgagagctggccagtggcagagctgtgtctctatgtgtgtc

SEQ ID NO: 344 - DNA, 99 bp, Homo sapiens
ggagatgggcgaggtgagggtttctttacaaatgggcattattattattattattattataattaattaattaatttgagacagtctcactctgtctcc

SEQ ID NO: 345 - DNA, 118 bp, Homo sapiens
ctctgtgggcaaggcagcaagcagtgagccagggcagcgtgacaggacagtgtggtgacagaccatagtgaaacgtgaggggagccctgagtcactgcatttggtggagtccactgag

SEQ ID NO: 346 - DNA, 74 bp, Homo sapiens
ccctccgcaggcctgggtttgagggacaggtgactcacagactgaccctctctttggtctggtttttcagaggg

SEQ ID NO: 347 - DNA, 73 bp, Homo sapiens
ttttgccaatgacttgttgtatgatcttgggaaagttatttaacttccctctgtctcagtttctctggcagag

SEQ ID NO: 348 - DNA, 73 bp, Homo sapiens
cttctaatgccataagggacttaagcagactcacagaataagtagagtgctgtgagatcatggtggaagggag

SEQ ID NO: 349 - DNA, 74 bp, Homo sapiens
gtctcagtgtcacactctcaggtccagggaactcagaaaagacaactgactcccacccagaagttgcactgtgc

SEQ ID NO: 350 - DNA, 63 bp, Homo sapiens
tgtttgtgtgtgtatatatatatctgtacatatgtgtaccatatatgtgtatatacatagaga

SEQ ID NO: 351 - DNA, 59 bp, Homo sapiens
tgtgtgtgtctatatatatatctgtacatatgtgtaccatatatgtgtatatacataga

SEQ ID NO: 352 - DNA, 94 bp, Homo sapiens
gaaccccaagcatgactgaatgatggttatcaagcgcgtggagatctctgtgtgtatgtgagtgaaaatctgaggacttttctgcctggggttt

SEQ ID NO: 353 - DNA, 81 bp, Homo sapiens
ggaggtgacagagtgatcagagagtccagctagcagaagacatccccctaagttggcctggcctctcttcatgtctcctct

SEQ ID NO: 354 - DNA, 62 bp, Homo sapiens
ggaaggctccctgtgtgggtctgcagtgacggtgagagcttccacccagcgcagggaattcc

SEQ ID NO: 355 - DNA, 58 bp, Homo sapiens
tgagacagagtctcactctgtcacccaggctggagtgtagtggtgtgatcttgactca

SEQ ID NO: 356 - DNA, 119 bp, Homo sapiens
gctgggaatttgagaatctctgtggagctgttagtgtagtgaccattgtatgtaacatatatgcatatatattttttaaaagacaaggtcttgctctgttacccactctagagtgcagt

SEQ ID NO: 357 - DNA, 81 bp, Homo sapiens
agttttatatatctatatctctctacatatatatagagaaagataatatacattgtatagagagatgtagtatgtaaatct

SEQ ID NO: 358 - DNA, 74 bp, Homo sapiens
gtttgttttgagatggagtctcgctctgtctcccaggctggagtgcagtggtgcgatctcggctcactgcaagc

SEQ ID NO: 359 - DNA, 112 bp, Homo sapiens
tgcttaagattgtcttggctataaggactcttttttttggttccatatgaaatttaaagtagttttttccagttctgtgaagaaagtcattggtagcttgatggggatggca

SEQ ID NO: 360 - DNA, 113 bp, Homo sapiens
ggagcctgagggtcatttacaacaggccagggcctctctttgaggtctgttgcatattctgtgtctgtgagtccctcaggcccctggtagagagggctcagctgacctgagtg

SEQ ID NO: 361 - DNA, 71 bp, Homo sapiens
tgcctctgccacactcagtcattggctgggagcagggccccaggagcagtggggaatgtggccttaggaca

SEQ ID NO: 362 - DNA, 66 bp, Homo sapiens
ttgtaggcagagtctcactctgtcacccaggctggagtgcagtggtgcgatctctgctccttacaa

SEQ ID NO: 363 - DNA, 80 bp, Homo sapiens
gggctggtactgggggttgtctgcacagagtcctgtgatgtaaactgtctctgcgtctctcagccgtggataccagcacc

SEQ ID NO: 364 - DNA, 72 bp, Homo sapiens
agactacaacgtccatgagtggaaaactgaggcaagagaggcttagttctttttttttttgagacggagtct

SEQ ID NO: 365 - DNA, 72 bp, Homo sapiens
gtcaaagaagtcagagaggagagtcccgagctgtgtgcatctttggatttgagagtctttttcttctaaggc

SEQ ID NO: 366 - DNA, 68 bp, Homo sapiens
ctgccggctctctgtgctctgtctgtctgtaatcccccaattgcacttaatggggcagtgaggtgcag

SEQ ID NO: 367 - DNA, 95 bp, Homo sapiens; identical to SEQ ID NO: 68

SEQ ID NO: 368 - DNA, 93 bp, Homo sapiens; identical to SEQ ID NO: 69

SEQ ID NO: 369 - DNA, 86 bp, Homo sapiens
aaattagctgggtgtggtggtgtgtgcctgtgtacctagttgcttggcaggctgaggtagaaggatcacctgagttcagagagttt

SEQ ID NO: 370 - DNA, 84 bp, Homo sapiens
tatacacacagacacacatataaatgtgtatatatatgtattcctgtatatatatatgtgtgtgtgtgtgtgtttgtgtgtgtg

SEQ ID NO: 371 - DNA, 105 bp, Homo sapiens
tgtttcataaaactgttcacatacaaaccagttttactatatgttaatttttaatataaagttcaaaaaaattatgtttttgtatgtgtcatctctgtgatgaca

SEQ ID NO: 372 - DNA, 110 bp, Homo sapiens
gccaatgagatgcacttgcttacaatttggagatgggagggagtcagaagcaagctatacgactctctttttctctctggtagtggcttgtagatacttgggcactctca

SEQ ID NO: 373 - DNA, 117 bp, Homo sapiens
aaagaaaaatgcaatactagaatatttgaatatttatatgtatatattttttattgacactaatgatcatgtacaatgtttattattctgcactttgatgttttaggtgttttcttt

SEQ ID NO: 374 - DNA, 69 bp, Homo sapiens
aggccagaggggccatgggaagaggccacatgcacatccgcacctgtgcctctcagtgtgtccctgcct

SEQ ID NO: 375 - DNA, 60 bp, Homo sapiens
tatgtgtgtgtgtgtgtatatatatacatatatgtatatatatacacatatatacatata

SEQ ID NO: 376 - DNA, 90 bp, Homo sapiens
ggaggtaccaacagaagcaaggtgtatggaggcagtggtgtactttggtgcagcccacagcttcattacacagttgcctagggaacttcc

SEQ ID NO: 377 - DNA, 105 bp, Homo sapiens
ctggattatagttgtctttataccagcacagtcataaaaaataatttttaatattttttctttctttttatggaggaatgggcccatgaaggcaaaattgcctag

SEQ ID NO: 378 - DNA, 58 bp, Homo sapiens
tgagccagagtctcgctctgtcacccaggctggagtgcagtggcgtgatctcggctca

SEQ ID NO: 379 - DNA, 56 bp, Homo sapiens
gagccagagtctcgctctgtcacccaggctggagtgcagtggcgtgatctcggctc

SEQ ID NO: 380 - DNA, 80 bp, Homo sapiens
gtagctctggtgtggtgaaaagagctctgggcttggaaccataaactccaggtctcagttctatcactgtcacctactgc

SEQ ID NO: 381 - DNA, 96 bp, Homo sapiens
tatatacacacacttatacattcaaatatacacccatacttatatttatttatattgctatgtatgtgtatttgaatgtatatatgtgtgtatata

SEQ ID NO: 382 - DNA, 117 bp, Homo sapiens
cccagggaaaatgtgaactttatggtttgtgaattatatctccacagagaagttttttttttttttttttttttttaaagtggcagttgagctggatcaaaagttcttaccttgtgg

SEQ ID NO: 383 - DNA, 58 bp, Homo sapiens
gcagtgtctcactctgttactcaggctagagtgcagtagtgcgatcatagctcactgt

SEQ ID NO: 384 - DNA, 117 bp, Homo sapiens
agggttctccagagggacagaaccaataggatacatgtatatatatgtgtatatatacaaatgtatatgtatcttatatatatgtatcctatttgttctgtccctctggacaaccct

SEQ ID NO: 385 - DNA, 95 bp, Homo sapiens; identical to SEQ ID NO: 68

SEQ ID NO: 386 - DNA, 93 bp, Homo sapiens; identical to SEQ ID NO: 69

SEQ ID NO: 387 - DNA, 84 bp, Homo sapiens
ccaaaggtaagcataagagtcaaagaagtcccaacccagctttccctgaaagtgactctcagtaactcttttgctttttatagg

SEQ ID NO: 388 - DNA, 124 bp, Homo sapiens
tgtgcccatgaagttcaatgtagtagaagactcacaggtatcgaagccaggaagttctgactctctctctcactggatttgtaagcttgagtaatttattcagcttctgtaaacactgattttc

SEQ ID NO: 389 - DNA, 82 bp, Homo sapiens
accctccccaacctcactgttgaataggtcatctcctcaccccagggaggagagagaatagacagagagagaccaggagtgt

SEQ ID NO: 390 - DNA, 81 bp, Homo sapiens
cttaaagtcacccagtgagtaagtggcagagctgggattccagcctacactctgaccactgtgctctctgtctctgaggct

SEQ ID NO: 391 - DNA, 58 bp, Homo sapiens
tgagatggagtctcactctgtcgctcaggctggagtgcagtggtgcgatctcagctca

SEQ ID NO: 392 - DNA, 114 bp, Homo sapiens
ggattacaggtctgagccactgggctggcactttttcttctttttcttttttctttcttttttttttttatttgaggctagaagtttgagaccactcgggcaacattgtgagac

SEQ ID NO: 393 - DNA, 88 bp, Homo sapiens
gaccccccttcagggacacacagtgtctggctgtctctcatttctctgattttagtagccattgctgatcagtgtttctatttcagtc

SEQ ID NO: 394 - DNA, 93 bp, Homo sapiens
gactagctggaattacatgcgtatgccaccatgcccagctaattttcttatttttagtagagatggggtttcaccatgttggccaggctagtc

SEQ ID NO: 395 - DNA, 119 bp, Homo sapiens
tcatctgtctggggaagcaatagtcatgggatgagaggaacaggactgatgaaagtgaccagcgttcatgaaagtgtctacaagactttcagcccacacctgtttgcccaagacaggga

SEQ ID NO: 396 - DNA, 132 bp, Homo sapiens
accttagcttcccaagtagctgggattatatgtgtgtgccactatgcccagctaatatttttatttttgtagcaatgaggtctcaccatgttgcccaggctagtcttgaactcctgggctcaagtgatcctc

SEQ ID NO: 397 - DNA, 98 bp, Homo sapiens
ccttctatgcaacttttctgtacacgtgaaattatttcaaaattaaaagttgatttttttttaatggggatgatagtattcacaggagtgttgtgagg

SEQ ID NO: 398 - DNA, 79 bp, Homo sapiens
tgtatatgtatgtatgtatatgtatgtatatgtatatgtatatatacatgtcatatatatatttttatatatatatata

SEQ ID NO: 399 - DNA, 84 bp, Homo sapiens
agtgagagtctcagagaacagtgtcaggggagccaagagaggctttcaaatgctggagagttcaatgtttccaagactctctct

SEQ ID NO: 400 - DNA, 80 bp, Homo sapiens
agcttggtctaatggtgtgaaataatgtgctaaaaaaaatttttttttttgagtcggagtctcactctgtcgcccaggct

SEQ ID NO: 401 - DNA, 95 bp, Homo sapiens; identical to SEQ ID NO: 68

SEQ ID NO: 402 - DNA, 93 bp, Homo sapiens; identical to SEQ ID NO: 69

SEQ ID NO: 403 - DNA, 75 bp, Homo sapiens
ccctcatttctaggtatattattttctattttcacttagaagatcaggaggtggtatataaaaagaaaaagaggg

SEQ ID NO: 404 - DNA, 72 bp, Homo sapiens
ctgggctgactgggctgatgcttttttttttttttttttttttttgagacagggtctggctctgtgacccag

SEQ ID NO: 405 - DNA, 111 bp, Homo sapiens
ttaggattgtcttggctatatgtgctcttttttggttccatatgaaatttaaagtagttttttctaattctgtgaagaaagtcaatggtagcttgttggggatagcactga

SEQ ID NO: 406 - DNA, 106 bp, Homo sapiens
acacatactggatatcaaggtctcagtatgataaaaggaatgtaaactatctcatttagattttttatattgattacatactgaaatgatgaaatttgatatggta

SEQ ID NO: 407 - DNA, 76 bp, Homo sapiens
atgtgtgtatatataactgtatgcgtgtgaatataaatgtgtatatatgcacatatatatatatatatatatatat

SEQ ID NO: 408 - DNA, 75 bp, Homo sapiens
gctggtactgggggttgtctgcacagagtcttgtgatgtgaactgtctgtgggtctctcagtggtggataccagc

SEQ ID NO: 409 - DNA, 146 bp, Homo sapiens
tatatatatgtgtgtgtgtgtgtgtgtgtgtgtgtgtgtatatatatatatatatgtgtatatgtgtatatatacatatgtgtgtatatatatgtgtatatatacatatgtgtgtatatatatgtatatgtatacacacacacata

SEQ ID NO: 410 - DNA, 60 bp, Homo sapiens
gggtctcagtctgtcacccacactggagtgcagtggtgtgattatagctctctgtgacct

SEQ ID NO: 411 - DNA, 62 bp, Homo sapiens
gtgtgtgtgtgtgtgtgtgtgttctgtttgttcgagacagggtcgctctctgtcactcaggc

SEQ ID NO: 412 - DNA, 98 bp, Homo sapiens
cctctctgtagcttagttgcctcatctataaaatggaaacaatagtagtttgttgtgagaattgagtgagttagtatatggaaaatgcagagaacagg

SEQ ID NO: 413 - DNA, 89 bp, Homo sapiens
cacagtgatttccatgctcatttgaccaggagccattttttcttttttaaatggagaactaggtctaagtggccatagggctcactttg

SEQ ID NO: 414 - DNA, 110 bp, Homo sapiens
gacatcccattcttcatgttgtactgttctgtgtcccttagaagtgagtctctgggtctcactcacactctaagggagggggttacagagggtatgaagaccaggaggtt

SEQ ID NO: 415 - DNA, 80 bp, Homo sapiens
ccaacatctgacaggagctggctttttttttttttttttttttaaatagagacagagtcttgctctgtcaccaaggctgg

SEQ ID NO: 416 - DNA, 80 bp, Homo sapiens
tatatgtatgtgtatgtatatatatgtatacgtgtatatgtatgtatacgtgtatatatatgtatatgtatatatatata

SEQ ID NO: 417 - DNA, 81 bp, Homo sapiens
agggagctacacttttttggaggtatttcctgtaaaagtagaaaatgcagagggaaatgaacagagaaagctcacagccct

SEQ ID NO: 418 - DNA, 116 bp, Homo sapiens
actagtctagctagtggccaatctattttattatttaaaaaaaaactggattcattgatctttttttttgttatactttaagttttagggtacatgtgcacattgtgcaggttagt

SEQ ID NO: 419 - DNA, 95 bp, Homo sapiens; identical to SEQ ID NO: 68

SEQ ID NO: 420 - DNA, 93 bp, Homo sapiens; identical to SEQ ID NO: 69

SEQ ID NO: 421 - DNA, 119 bp, Homo sapiens
tgtcccataacctcacttgatggtgttccataattcccaaatgctttcttcactcaccttttatcctttttttttaatttaagttttagggtacatgtgcacattgtgcaggttagaca

SEQ ID NO: 422 - DNA, 90 bp, Homo sapiens
tctgtattatgtctaaattgtagcatcaattgtattgtgtcttgtgtgataaaaactaaaggtgttaacatcatagaggtgattagcagg

SEQ ID NO: 423 - DNA, 110 bp, Homo sapiens
gggaaaatgcgttgttatgtgtgatatttggtgtgagtttttttttttgtttttttttttttggcggagtctcgctctgttgccaggctggagtgcagtgacgtggtctc

SEQ ID NO: 424 - DNA, 95 bp, Homo sapiens; identical to SEQ ID NO: 68

SEQ ID NO: 425 - DNA, 93 bp, Homo sapiens; identical to SEQ ID NO: 69

SEQ ID NO: 426 - DNA, 126 bp, Homo sapiens
gcagctttgttctttttgcttaggattgtcttggctatatgagttcttttatggttccatatgaaatttaaagtagttttttctagttctgtgaagaaaatcaatggtagcttgaagggaatagca

SEQ ID NO: 427 - DNA, 118 bp, Homo sapiens
ggctgtgggcggctgcttcagggcctgagcccggggtagatttttttttttttttttttttttttttgagacagagtctcgctctgtcgctcaggatcgagtgcagtggcgcgatctc

SEQ ID NO: 428 - DNA, 95 bp, Homo sapiens; identical to SEQ ID NO: 68

SEQ ID NO: 429 - DNA, 93 bp, Homo sapiens; identical to SEQ ID NO: 69

SEQ ID NO: 430 - DNA, 93 bp, Homo sapiens
agtttgagggcatttatttacattcaaatgacagattaccaggggttatctttggtattctgtctgtaagaattttcaaataaaccaaaaact

SEQ ID NO: 431 - DNA, 108 bp, Homo sapiens
gagaagacaaagactttgcaatggaaatttcttgctaattctgtgaggatatgttggcatcagattcttctaagaaaaagcatgaagtgttgagtcacctttattccc

SEQ ID NO: 432 - DNA, 95 bp, Homo sapiens; identical to SEQ ID NO: 68

SEQ ID NO: 433 - DNA, 93 bp, Homo sapiens; identical to SEQ ID NO: 69

SEQ ID NO: 434 - DNA, 80 bp, Homo sapiens
gtgcacgtgtgtgtgtgtgtgtgtgtgtgcatatatggatacatacatatagctagacacacacacacacacatatgcat

SEQ ID NO: 435 - DNA, 58 bp, Homo sapiens
tgagacagagtctcgctctgtcacccaggctggagtgcagtggctagatcttgtctca

SEQ ID NO: 436 - DNA, 114 bp, Homo sapiens
caggatcggtgacagtgagcttccttgtattgttcttttttttctcttttcctttttatttattttttattattttttttttccagtcagggtctcactttgtcactcaggctg

SEQ ID NO: 437 - DNA, 188 bp, Homo sapiens
gtgcgtgtgtgtgtgtgtgtgtatatatatatattttatatgtgtgtgtgtatatatatattttatgtgtgtgtgtatatatatatacattttatatgtgtgtgtatatatgtatatatgtatacatatacatgtatgtatatatgtatatatgtatacatatacatgtatgtatatatatacataca

SEQ ID NO: 438 - DNA, 167 bp, Homo sapiens
gagtatggtcactatatatatatatatatgtgtgtgtgtgtgtatatatatatgtgtatatatatatgtgtatatatgtgtgtatatatatgtgtgtgtgtatatatatatgtatttatatatgtgtgtgtgtgtatatatatatatatatatatatatatatatat

SEQ ID NO: 439 - DNA, 99 bp, Homo sapiens
gtgtatatgtgtatatatgtgtatatgtaaatgtatatatgtgtgtatatatacgtatatatgtatatgtatatgtgtatatatacacatatatatata

SEQ ID NO: 440 - DNA, 82 bp, Homo sapiens
tgggactacaggcacgcaccatcacgcccaactaattttatttttattatttttatttttgtgtgtgtgtgacggagtctca

SEQ ID NO: 441 - DNA, 118 bp, Homo sapiens
atttatactagtggatggtcagaatgttcctttatgtctctttgtgtctctgtctgtctgcctcgggagcagggtgaacatggtgttaaggaagttttgaacattttaacaaatgagt

SEQ ID NO: 442 - DNA, 108 bp, Homo sapiens
agagtaaagttttagaaagggcgccaagtcccactgtctctgtggctgatttctgatggaggacaagggtatgagtgcaggggaacaagccagaggagagcaaagtct

SEQ ID NO: 443 - DNA, 116 bp, Homo sapiens
ggcagggaagaggctgctggggaggaggtgggtgtcagcccgagagtggaattttctctggttgtatttccacctctaccttttctactcccttcatctgcttctcctttgctgcc

SEQ ID NO: 444 - DNA, 100 bp, Homo sapiens
agcattctagtgggtaagaagtggtgtgtcattgtagttttgatttgcatttccctgctgactgatgatactgaccatcttttcatgtgctttattagct

SEQ ID NO: 445 - DNA, 134 bp, Homo sapiens
tgtttctactttatggactattatggataaagctgctactaatattcacattcatgtgttgtgtggacataggtttttttcctttggagtagacaacaaggaatgaaagtgctaggtaatatggtaaatgtatc

SEQ ID NO: 446 - DNA, 128 bp, Homo sapiens
gcagtggggggaggtaggaaagaggctgttggggaggaggtggctaacagcctgagagtggaattttctctggttgtttttccacctctgcccttcctactcccttcctctgcttcttctttgctgcc

SEQ ID NO: 447 - DNA, 115 bp, Homo sapiens
cctccccaggatactgtacctttcacattggctttcatgatagactgtctgtgagtgacaccgaagacgtcaatgatagaggcagtgtggatgatgaccaagatgtcctggcagg

SEQ ID NO: 448 - DNA, 57 bp, Homo sapiens
agcaggctgacattccctgagcatgtggacaattcagttgtctcagtgtcacctgtt

SEQ ID NO: 449 - DNA, 114 bp, Homo sapiens
gggggaggcagggaagaggctgctggggaggacatgggtgacagcctgagagtggaattttctctggttgtatttccacctctgcacttcctgctcccttcctctgcttcccct

SEQ ID NO: 450 - DNA, 118 bp, Homo sapiens
gaggcatgttgtatgtgtggagtaattgaatgtcaagttgtctttttttttttttttttttttttttttgagacagagtctcactctgttacccaggctggagtacaatagtgcagtc

SEQ ID NO: 451 - DNA, 121 bp, Homo sapiens
tgcaaataggttttcaaactacagacagttttgaaagacattaattctcattttcttctagtcaggagtaatacaagcaaacaagtgtccgttttgaattctgatttgtaatctgaatact

SEQ ID NO: 452 - DNA, 81 bp, Homo sapiens
ggagtcagactgtctgtctggggtcaaatcttacctttatcatttatttgctgtaggatcctgggacacgatgtcttcttt

SEQ ID NO: 453 - DNA, 83 bp, Homo sapiens
gattcactgtctacaaccagaattgagttgactttgtcttcctcagatgtgattttgatgttcttgtgaggcgggttggagtc

SEQ ID NO: 454 - DNA, 58 bp, Homo sapiens
tgagacagagtctcgctctgtcacccaggctggagtgcagtggcgtgatctcagctca

SEQ ID NO: 455 - DNA, 70 bp, Homo sapiens
ttgttttgagagagagtcgcactgtgtctcccaggctggagtgcagtggtgtgatctcggctcactgcaa

SEQ ID NO: 456 - DNA, 100 bp, Homo sapiens
ggattgagagtcaagtgtgtaaatgacaggagagagagctctcactgggaaagtttgggtcctctttgctgacttctgcaactagagtcaaaaacgatct

SEQ ID NO: 457 - DNA, 58 bp, Homo sapiens
tgagatggagtctctctctgtcactcaggctggagtgcagtggagcaatctcggctca

SEQ ID NO: 458 - DNA, 99 bp, Homo sapiens
tccagcctgggcaagggcaagaacctgcctctaaaaaagctcttattttaattatttttattttttgaggcggagtctcactctgtcacccaggctgga

SEQ ID NO: 459 - DNA, 117 bp, Homo sapiens
tttgttttaaaaacaattcatcttcttccgctctttttttcacaagaggtagttgtttggatagtaaccttttgagaaccaaagtaagtgaaggagagctacttttgtgagaatgaa

SEQ ID NO: 460 - DNA, 58 bp, Homo sapiens
tgagtcagagtctcgctctgtcacccaggttggagtgcagtggcgtgatctcagctca

SEQ ID NO: 461 - DNA, 134 bp, Homo sapiens
cagcagggcccatttgaatggttggttcttgattcccatgttgatataggcagatccttgacaggaattttgaatggtcccaaatgtggtaaatcgctggtacatcaagtcatcctcaaagttgtctgtgtaac

SEQ ID NO: 462 - DNA, 58 bp, Homo sapiens
tgagatggagtctcactctgtcacccaggctggagtgcagtggtaggatctctgctca

SEQ ID NO: 463 - DNA, 90 bp, Homo sapiens
gagtggagctttctcaccctggtttgaggtgctgcagaaatggtctgcttttctagtgccttgaaaaaggatgagaagagaggtgcattc

SEQ ID NO: 464 - DNA, 58 bp, Homo sapiens
ttgacagagtctcactctgtcgcccaggctggagtgcagtggtgagatcgtggctcaa

SEQ ID NO: 465 - DNA, 84 bp, Homo sapiens
gcctgggcaacatagcaagaccctgtctctttaaaaaaaaaaaaaaattttttttttggcagagtctcactctgtcgcccaggc

SEQ ID NO: 466 - DNA, 77 bp, Homo sapiens
ggaaatgaacattagaccaggaatcaggtaacctggttggggacccagggctctagatggtttatttttttattttc

SEQ ID NO: 467 - DNA, 82 bp, Homo sapiens
acacagagatgggatggggtaatacacagggggtttaaatattagttaacatgtccgtgtgtgtgcatgtgcatgtgtgtgt

SEQ ID NO: 468 - DNA, 95 bp, Homo sapiens; identical to SEQ ID NO: 68

SEQ ID NO: 469 - DNA, 93 bp, Homo sapiens; identical to SEQ ID NO: 69

SEQ ID NO: 470 - DNA, 122 bp, Homo sapiens
tgatctggtgtgtactgaggcttgtgtttacctctcctttgatgaaatccagttacttttattgtattttattttttaaattctggggtacatgtgcaggatgtgcaggtttgttacataga

SEQ ID NO: 471 - DNA, 77 bp, Homo sapiens
gagtctcactctgtcacccaggttggagtgcaatggcgcaatctcggctcactgcaacctgggttcaagtgattctc

SEQ ID NO: 472 - DNA, 95 bp, Homo sapiens; identical to SEQ ID NO: 68

SEQ ID NO: 473 - DNA, 93 bp, Homo sapiens; identical to SEQ ID NO: 69

SEQ ID NO: 474 - DNA, 66 bp, Homo sapiens
ctgggtgtcaggagacatgatggagaggaaagcatcatcatggtcattctctgtctcactgtccag

SEQ ID NO: 475 - DNA, 102 bp, Homo sapiens
accttaggtatttcaaaatttgggggcgggtctgaatggaatcttttttttttttttttttttcgtaacttctctctcactctcatattttggacctcaggt

SEQ ID NO: 476 - DNA, 82 bp, Homo sapiens
gtgtgtgtatatatatatctgtgtatgtatatatatatgtgtgtatgtgtgtatatatatatatctgtgtgtgtatatatat

SEQ ID NO: 477 - DNA, 120 bp, Homo sapiens
gtgtgtatgccatcaggacgcatgtatgtgcgtgtctgcatgccatcaggacacgtgtgtgtgcatgtgtatgtgcatgccatcaggacgcgtgtgcacgtgcgtgccatcaggacgcat

SEQ ID NO: 478 - DNA, 102 bp, Homo sapiens
gggccaccctcttgttctggaggtgctgagagccggcctggctgggggctgtaactgtcaggctgactcccagccacactgtcctccctggagtaggtgctc

SEQ ID NO: 479 - DNA, 82 bp, Homo sapiens
cccttgaacatgagcccttccaagcttcccagctatagtatatccctcacactgtctctgtgttaagctggtgggctgaggg

SEQ ID NO: 480 - DNA, 117 bp, Homo sapiens
gtggcatctttgtggggacacccagaaggctgggacacctggttcacgaggatggctgtgcctgtctctctgcccctgtggagtctcggggcctctctccctgtcttacatggcctc

SEQ ID NO: 481 - DNA, 106 bp, Homo sapiens
ctgtttcctttgctgcctgccttaaagctgctgttacactttttgttttttttaggtagagtctcactgtgttgcccaggctagagtgcaggggtgcgatctcggc

SEQ ID NO: 482 - DNA, 74 bp, Homo sapiens
gcccagcttccctgcatagggcagatttatttatttattgagacggagtcttgctctgtcgctcaggctggagt

SEQ ID NO: 483 - DNA, 59 bp, Homo sapiens
tgagtgagtggaaactgggagctgtggatccccggcaggctccctccctcactcactca

SEQ ID NO: 484 - DNA, 100 bp, Homo sapiens
ttttatgcagtttgcaagtctgagtggttttcagttttaaatggttggaaaataatcaaaacaagaatgatatttcatgacgtgtgaaagttgcatgaaa

SEQ ID NO: 485 - DNA, 57 bp, Homo sapiens
gccggactgcctgagtgtgtgtcccagctctgtcactcactcgctgtgcggtcctgc

SEQ ID NO: 486 - DNA, 58 bp, Homo sapiens
tgagatggagtctcgctctgtcgctcaggctggagtgcagtggcgtgatctcggctca

SEQ ID NO: 487 - DNA, 59 bp, Homo sapiens
gcctgcctgcctgcctgcctgtttcaagtgggaaacagagcaagagaaggctctgtagc

SEQ ID NO: 488 - DNA, 82 bp, Homo sapiens
tcttcaggaaggccaggtttttgtagctctgtgtttaggttatatatttttgaatatctccattgcttggtttccaagaaga

SEQ ID NO: 489 - DNA, 107 bp, Homo sapiens
ccagctttgttctttttgcttaggattgtcttggatatatgggctcctttttggttccatatgaaatttaaagtagttttttctaattctgtgaaggaagtcaatgg

SEQ ID NO: 490 - DNA, 65 bp, Homo sapiens
cagacagaaaaatattgtgtgccactttgggatgtgtgtcaccgtccctgactggctggctgctg

SEQ ID NO: 491 - DNA, 72 bp, Homo sapiens
ttcagtgagatgcagtggtctccgcctgtagtccaagctactagggaggctgaggtaggaggatcacttgaa

SEQ ID NO: 492 - DNA, 105 bp, Homo sapiens
tctgattttgtagggatgacttctctgtttttataaagctgttttaactataaaacaattttataattttaatgtggccaaagatctcccaacactactttcagg

SEQ ID NO: 493 - DNA, 95 bp, Homo sapiens; identical to SEQ ID NO: 68

SEQ ID NO: 494 - DNA, 93 bp, Homo sapiens; identical to SEQ ID NO: 69

SEQ ID NO: 495 - DNA, 65 bp, Homo sapiens; identical to SEQ ID NO: 490

SEQ ID NO: 496 - DNA, 117 bp, Homo sapiens
gattgcgccactgcagcctgggtgacagccccaccctgtctctcaattttatttatttatttttttttgagacacagtctcgctctgtcgcccaggctggagtgcagtggcgcgatc

SEQ ID NO: 497 - DNA, 56 bp, Homo sapiens
ttctctgtcacagtctgtggttcctaaccagctcagctcacaggggcgacagagga

SEQ ID NO: 498 - DNA, 73 bp, Homo sapiens
ggagaggcggatgtctgccctcccaaccgtcctcccaacccagcctcttggttctgggtgactctgtctctct

SEQ ID NO: 499 - DNA, 108 bp, Homo sapiens
gtctgaccacactgctcctctctgggctctgccccagctcacacactcagattcactcttcccaagctggtattctgagggaagcccatcctgtttgtgagtaatgat

SEQ ID NO: 500 - DNA, 65 bp, Homo sapiens; identical to SEQ ID NO: 490

SEQ ID NO: 501 - DNA, 102 bp, Homo sapiens
ctgtagtcccagctgctctgcaggctgaggtggaaggatggcttgtgtctgggaagcagaagttacagtgatctgagactgtgccactgtacccccagcctg

SEQ ID NO: 502 - DNA, 58 bp, Homo sapiens
tgagacagagtctcgctctgtcacccaggctggagtgcagtggcacgatctctgctca

SEQ ID NO: 503 - DNA, 82 bp, Homo sapiens
ctgggattaccgatgtgagccaccgcgcccaacccttttttttttttttttttttgagatggagtctcactctgtttcccag

SEQ ID NO: 504 - DNA, 65 bp, Homo sapiens; identical to SEQ ID NO: 490

SEQ ID NO: 505 - DNA, 102 bp, Homo sapiens; identical to SEQ ID NO: 501

SEQ ID NO: 506 - DNA, 120 bp, Homo sapiens
gtgggatggatatgctttcttcaggacccttaggcactaaaatctaggacacaggtgggtttttttgtttttttgttttttttttgatggagtctcgctctgtccctcaggctaaagtgc

SEQ ID NO: 507 - DNA, 58 bp, Homo sapiens; identical to SEQ ID NO: 502

SEQ ID NO: 508 - DNA, 58 bp, Homo sapiens
tgaggtggagtctcactctgtcacccaggctggagtgcactggtgcgatctcagctca

SEQ ID NO: 509 - DNA, 110 bp, Homo sapiens
atgaggaactgctgaacgtgggtggaactgagggtgcggacacctggctcccgggctcggctctgtcactgactcattgtgcaacctaggggtatgtgtgagtttcttat

SEQ ID NO: 510 - DNA, 93 bp, Homo sapiens
tatagtgtatttatatgctgtatatattcatatatattagcatgccacatactatttagtatatactaatatatatgcgtatatatatctata

SEQ ID NO: 511 - DNA, 73 bp, Homo sapiens
tgtgtgtctgtgtctgtctcagatgggctacacgtggagaagggagtggttcagggcagggagagttactaca

SEQ ID NO: 512 - DNA, 80 bp, Homo sapiens
tatatatatacacatatgtgtgtatatatacgtatacatatatgtatacgtgtatatatatgtatatgtatatacatata

SEQ ID NO: 513 - DNA, 91 bp, Homo sapiens
gcacttgaaaagagctgtcagtcaaagaactttttttttttcttactggagagatggttctcttggaagactacgtttttcttttttaggc

SEQ ID NO: 514 - DNA, 58 bp, Homo sapiens
tgagacggagtctcgctctgtctcccaggctggagtgcagtggcgcgatctcgactca

SEQ ID NO: 515 - DNA, 77 bp, Homo sapiens
tcacgagatctgagggttgtagaagtatgtgacaattcctccttcacacactttctctctctcctgcagccttgtga

SEQ ID NO: 516 - DNA, 95 bp, Homo sapiens; identical to SEQ ID NO: 68

SEQ ID NO: 517 - DNA, 93 bp, Homo sapiens; identical to SEQ ID NO: 69

SEQ ID NO: 518 - DNA, 134 bp, Homo sapiens; identical to SEQ ID NO: 461

SEQ ID NO: 519 - DNA, 77 bp, Homo sapiens; identical to SEQ ID NO: 466

SEQ ID NO: 520 - DNA, 78 bp, Homo sapiens
gattccctggtagacagcacttcccacatattgtcacagctcattgctgagagaattaagtgtgccctctaggacatc

SEQ ID NO: 521 - DNA, 75 bp, Homo sapiens
gtagaagctaatgcaaacagaggaactgccagctctctgtggcactctagctctctctgtcagtatttggttggc

SEQ ID NO: 522 - DNA, 115 bp, Homo sapiens
gaagttatcagaaggcaggttttggctcaacagtggtatagtgaatgcttgttgattttgctctccagcatgcattcttcctttttctggtaatggcaccctgattttgttcttc

SEQ ID NO: 523 - DNA, 58 bp, Homo sapiens
tgagatggagtctcactctgtcacccaggctggagtgtagtggtgtgatctcagctca

SEQ ID NO: 524 - DNA, 87 bp, Homo sapiens
agcagaacaaatacagtaagatctacaggctcaccatcatgaaagtgatgaatgatatcctgtcttctctctgagacactaaatgct

SEQ ID NO: 525 - DNA, 66 bp, Homo sapiens
ttgagcctgtgtgtgtctctgcatgtgagatggttttcctgaatgcagcacactgatgggtcttga

SEQ ID NO: 526 - DNA, 58 bp, Homo sapiens
tgagacagagtctcactctgtcacccaggctggagtgcagtggtgagatcttggctca

SEQ ID NO: 527 - DNA, 108 bp, Homo sapiens
ctctggtgcctgctttctgctttccttctctgtaaagaaagaggactggaataaatcagagcctctctcaaacactgacgtggaactgtgcggaacaatcaccttggg

SEQ ID NO: 528 - DNA, 58 bp, Homo sapiens
tgagacagggtctcactctctcactatggatgtagtgcagtggtgtgatcatagctca

SEQ ID NO: 529 - DNA, 78 bp, Homo sapiens
gcacagcgtctgacctgtttggggctctcaaaatttatttatttatttatttatttttgagacagagtctcactgtgt

SEQ ID NO: 530 - DNA, 74 bp, Homo sapiens
gttcaaattccaactcagcttcctctttgccacctctgtggccttgggcaacttgagtatttttaaatttgaat

SEQ ID NO: 531 - DNA, 63 bp, Homo sapiens
catacaagaggcaactatatatatatatatatctgtgtgtatgtgtttgcatgtgcgtgtatg

SEQ ID NO: 532 - DNA, 111 bp, Homo sapiens
gttttaaaaacaattcatcttcttccgctctttttttcacaagaggtagttgtttggatagtaaccttttgagaaccaaaagaagtgaaggagagctacttttgtgagaat

SEQ ID NO: 533 - DNA, 58 bp, Homo sapiens; identical to SEQ ID NO: 457

SEQ ID NO: 534 - DNA, 59 bp, Homo sapiens
atatgtatatattacatacacacacacaaatatgtgtgtgtgtgtgtgtgtgtgtgtat

SEQ ID NO: 535 - DNA, 128 bp, Homo sapiens
actgctttccacagtggctgaactatttcccatttctctgcaacgttaccagaatctgtttttttgttttttgtttttcactttttagtaatagccatttgactggtgtgaggtggtatctcattgtg

SEQ ID NO: 536 - DNA, 140 bp, Homo sapiens
cagatcaagaccttgtctcaaaaaacaagaagaagaaaaactactttttttttttcagatggggtctcactctcacccagtctggagtgcagtggcgccatctcagctcattgcagcctctgcctcctgggcttgagtga

SEQ ID NO: 537 - DNA, 93 bp, Homo sapiens
tccagtgtcattgtcacactctcactgtctttttccaatgtctaggtccctggttgattccagccttggaaatctcagtggtaattaactggg

SEQ ID NO: 538 - DNA, 84 bp, Homo sapiens
taaaaaaatttaaaaaaaaaacagcttttcttccgggaggaacaatacttctctgaaggaagtttgtttttttgtttttttttg

SEQ ID NO: 539 - DNA, 76 bp, Homo sapiens
ctctagtggggaaacaaaggactcttttttttttttttttttttgagggagtctcgctctgtcacccaggctggag

SEQ ID NO: 540 - DNA, 95 bp, Homo sapiens; identical to SEQ ID NO: 68

SEQ ID NO: 541 - DNA, 93 bp, Homo sapiens; identical to SEQ ID NO: 69

SEQ ID NO: 542 - DNA, 117 bp, Homo sapiens
cattgttctttgggggtgaggggtgttaactttattttattttattttattttattttattttatttatttattttgagacggagtctcgctctgtcacccaggctagagtgcagtg

SEQ ID NO: 543 - DNA, 122 bp, Homo sapiens
ctagcgtagagaactggatgtgccactgctatattacaggctttttaatttttatttttagtttttgtgacagggtctcattctgtctctaaggctggagtgcagtggcctgattgcgtctc

SEQ ID NO: 544 - DNA, 98 bp, Homo sapiens
gttttcgaagcttctactaaaagtttttgttttttagcactttccctgaatctcaggtgtgagtgcagtaaaggtgttggctgaagggggatggaaac

SEQ ID NO: 545 - DNA, 116 bp, Homo sapiens
ttttgtccttgggatggacctggctcctgccctgtaggcagtgactgcaacagcatgtccagccttccactgaggcaggtgtgtctgtcttttctcagagtgtgaagagtgcaaag

SEQ ID NO: 546 - DNA, 95 bp, Homo sapiens; identical to SEQ ID NO: 68

SEQ ID NO: 547 - DNA, 93 bp, Homo sapiens; identical to SEQ ID NO: 69

SEQ ID NO: 548 - DNA, 69 bp, Homo sapiens
tgcttattgcttgcagtggtggggcctgatgctgtagcgttggattctcaaactgcatgagcatgtgca

SEQ ID NO: 549 - DNA, 80 bp, Homo sapiens
tgaaagacagggaaaatgagagagggggagattaattcattctatgtctctctatgtctctgaaccacctgtttatttca

SEQ ID NO: 550 - DNA, 118 bp, Homo sapiens
tgttcttaaccagaagggggtcaatgtcattcctaaaaccatcactgggtcagaagagagacaggtctctttgattgccttaggcagattgagattctctctctggagggtgggaagg

SEQ ID NO: 551 - DNA, 73 bp, Homo sapiens
gggttttggatgtgtgggctactcaattctgggacacacacagcactgacagccacactcactgcgtgaaccc

SEQ ID NO: 552 - DNA, 57 bp, Homo sapiens
gagtcagtgtctcactgtgtcaccccaggctggaatgcagtggcatgatcttgactc

SEQ ID NO: 553 - DNA, 91 bp, Homo sapiens
ccacactgggctctctgtgatccactctctctctaggcttatttcttttctttttttttgagacggagtctcgctctgtcgcccaggctgg

SEQ ID NO: 554 - DNA, 94 bp, Homo sapiens
ctagcaggtggtaaggctggcattgttctgtgttcttaggttttttttttgtttttttttttgagacggagtcttgcgctgttgcccaagctgg

SEQ ID NO: 555 - DNA, 58 bp, Homo sapiens
tgagacggagtctcactctgtcactcaggctggagtgcagtggtgtgatctcagctca

SEQ ID NO: 556 - DNA, 77 bp, Homo sapiens
tttggctaggattttagctgtgtgatcttggggaaattatttaatgtctcttacactcagtttcttcatctgccaaa

SEQ ID NO: 557 - DNA, 77 bp, Homo sapiens
ggcactacagacgtgtactaccacactctgctgattttttttatttttttgtagagacagggtctcactttgttgcc

SEQ ID NO: 558 - DNA, 63 bp, Homo sapiens
gagattgggtctggctctgtcactcaggcgggagtgtggagtgcagtggcttactgcaacctc

SEQ ID NO: 559 - DNA, 122 bp, Homo sapiens; identical to SEQ ID NO: 543

SEQ ID NO: 560 - DNA, 90 bp, Homo sapiens
gtgtatatgtgtatgtgtgtatacatatgtatatatgtgtatatatatgtgtgtatgtatatatatgtacacacacacacacacacacac

SEQ ID NO: 561 - DNA, 93 bp, Homo sapiens
agaaagtacctaggattattgtttttctttgttttttcctttttttttttttattttgagacagagtctggctctgttgcccaggtgcaatct

SEQ ID NO: 562 - DNA, 68 bp, Homo sapiens
ctgtgtgctcagactctgtgtcgctgtgtcttcagacacagcaatgcatctttcctctgggtacagag

SEQ ID NO: 563 - DNA, 75 bp, Homo sapiens; identical to SEQ ID NO: 521

SEQ ID NO: 564 - DNA, 92 bp, Homo sapiens
tgcctgttggcacgaaatgaggccttatgaatttctcttttttttttttaagggaccttacactggattcatttattttgaaatggcaggca

SEQ ID NO: 565 - DNA, 57 bp, Homo sapiens
ggagatgctggggagagtgctgcccccccgcctgcagtctctctctgcctgtcatcc

SEQ ID NO: 566 - DNA, 58 bp, Homo sapiens; identical to SEQ ID NO: 523

SEQ ID NO: 567 - DNA, 75 bp, Homo sapiens; identical to SEQ ID NO: 521

SEQ ID NO: 568 - DNA, 75 bp, Homo sapiens; identical to SEQ ID NO: 521

SEQ ID NO: 569 - DNA, 110 bp, Homo sapiens
tggtgatggtcctgaataaagtcttctttactgtgcatttgaagtatcactgaataattttttctttaacaactatggtgttgaaactcaactaggacagattcatcact

SEQ ID NO: 570 - DNA, 78 bp, Homo sapiens
gccgtccaggggagcatcgcgcgcgagggacggggcgcgctcggcaactcgctcgctcgctcgctcgctcggggctgc

SEQ ID NO: 571 - DNA, 119 bp, Homo sapiens
tgcattataaggtcttatcgatacagagaaaactctcaatttcaaaaaatgatgagaaactcagtctttttttttttttagatagtcttgctctgtctcatctcccaggctggagtgca

SEQ ID NO: 572 - DNA, 95 bp, Homo sapiens; identical to SEQ ID NO: 68

SEQ ID NO: 573 - DNA, 93 bp, Homo sapiens; identical to SEQ ID NO: 69

SEQ ID NO: 574 - DNA, 114 bp, Homo sapiens
ctctctgtgtgtgtatatatatgtatacagtatatatgtatatgtgtatacatgtatatatgtatatatgtacgtgtgtacatatatacacctatatatagtgtgtatatatgt

SEQ ID NO: 575 - DNA, 107 bp, Homo sapiens
cactggttggccaggtgtaggtattatgcctctctctgtctctttgcatccaaggggttgggtcagttcacctaaaccactgtgacctgccagtgagaagagatggt

SEQ ID NO: 576 - DNA, 79 bp, Homo sapiens
cagcctgggcaacatagtgagattcagtctttttttttttttttttctgaaatggagtctcactctgtggcccaggctg

SEQ ID NO: 577 - DNA, 118 bp, Homo sapiens
tggtacagatttgcactactctttttgttgtttgttttcttgactttaaaaaattttttatttccaacttttactttaagttcaggggtacatgtgcagtatgtgcaggtttgtctca

SEQ ID NO: 578 - DNA, 64 bp, Homo sapiens
tattgagactgagtctcactctgtcacctgggctggagtgcagtggtgtgatcttagctcagtg

SEQ ID NO: 579 - DNA, 76 bp, Homo sapiens
gagtcaggagagtgaggagagctgtctatttttttttttttttttttttttgagacagggtctcgctctgtcactc

SEQ ID NO: 580 - DNA, 95 bp, Homo sapiens
acccactttttgatggggttgtttgtttttttcttgtaaatttgtttgagttcattgtagattctggatattagccctttgtcagatgagtaggt

SEQ ID NO: 581 - DNA, 93 bp, Homo sapiens; identical to SEQ ID NO: 69

SEQ ID NO: 582 - DNA, 111 bp, Homo sapiens
gttggccagagctggtgtgtgtcttgggtgttgggcaaagaacagagaacagtcaaagctctgtgaggtcaatgtgaagggtgatttccttgttgggctcaagtttatgac

SEQ ID NO: 583 - DNA, 86 bp, Homo sapiens
ctctttggttctctcttccttccagtctctggcatctcctggtacaatagatgttcactagactgtgagctctgagacagtagaga

SEQ ID NO: 584 - DNA, 82 bp, Homo sapiens
attcacagcctggtttaatttcatatgcacttaccttggtctttctgtctgtgagtgagtgaaatctcaaaggctgttgagt

SEQ ID NO: 585 - DNA, 105 bp, Homo sapiens
ccacagcttgacaaggaggaagtgcatccttcagtgactgtagtcagtgagtagccacatggctccagtttttggggctcatgcattgtctaggccaagaggtgg

SEQ ID NO: 586 - DNA, 111 bp, Homo sapiens
gtatatgtataaatatttgtagttgttataccctagttctttttttttattattacactttaagttttagggtacatgtgctcaacgtgcaggtttgttacatatgtatac

SEQ ID NO: 587 - DNA, 80 bp, Homo sapiens
cctgggctcaagtgagtgtgccaccatgcccagctaatttttattttttttagacacagtgtctcactctttttcccagg

SEQ ID NO: 588 - DNA, 90 bp, Homo sapiens; identical to SEQ ID NO: 463

SEQ ID NO: 589 - DNA, 58 bp, Homo sapiens; identical to SEQ ID NO: 462

SEQ ID NO: 590 - DNA, 92 bp, Homo sapiens; identical to SEQ ID NO: 564

SEQ ID NO: 591 - DNA, 75 bp, Homo sapiens; identical to SEQ ID NO: 521

SEQ ID NO: 592 - DNA, 103 bp, Homo sapiens
cctgactgaggagagaggagcgtgagatgggcatcctggatttttaaaaattttttattattaatttttttgagacggagtctcgctctgtcacccaggctgg

SEQ ID NO: 593 - DNA, 111 bp, Homo sapiens; identical to SEQ ID NO: 582

SEQ ID NO: 594 - DNA, 82 bp, Homo sapiens; identical to SEQ ID NO: 584

SEQ ID NO: 595 - DNA, 106 bp, Homo sapiens
ccacagcttgacaaggaggaagtgcatccttcagtgactgtagtcagtgagtagccacatggctccagtttttgggggctcatgcattgtctaggccaagaggtgg

SEQ ID NO: 596 - DNA, 60 bp, Homo sapiens
tgagtcagtgtctcactttgtcactcagggtggagtgcagagtggcacgatgtcatctca

SEQ ID NO: 597 - DNA, 108 bp, Homo sapiens
ctctctctcatttgtacattgtcaaccatttttttccatgatccacatggaattctgtttttgattttatgaaatgaacatctggagatagtggttaacagggataca

SEQ ID NO: 598 - DNA, 80 bp, Homo sapiens; identical to SEQ ID NO: 587

SEQ ID NO: 599 - DNA, 90 bp, Homo sapiens; identical to SEQ ID NO: 463

SEQ ID NO: 600 - DNA, 78 bp, Homo sapiens
tgtgtcacagtctttgtgtcacagatgtcctgagaaaggaaacaatttgaggatgagtggaggggaatttgtggtgta

SEQ ID NO: 601 - DNA, 58 bp, Homo sapiens; identical to SEQ ID NO: 462

SEQ ID NO: 602 - DNA, 108 bp, Homo sapiens
catgtagatatgagttttcagtctgagtgacagttaaatatttatgataaattaatatttatgtattatggctttatatttcagaagattgtgaactttgttggcatg

SEQ ID NO: 603 - DNA, 56 bp, Homo sapiens
gacagggtctcactctgtcacccaggctggagtgcagtggtgtgatctcggctgtc

SEQ ID NO: 604 - DNA, 81 bp, Homo sapiens
agccagatcatgaagggccttgtttgtcctgtatagattttttttttttttcatacagggtctcactgtgtccctcaggct

SEQ ID NO: 605 - DNA, 58 bp, Homo sapiens
tgagacagagtctcactctgtcacccaggctggagtgcagtggtgtgatctcagctca

SEQ ID NO: 606 - DNA, 71 bp, Homo sapiens
ggtgaagcagagattagacacattttcataattttttttttttttttgagatggagtctcgctctgtcacc

SEQ ID NO: 607 - DNA, 95 bp, Homo sapiens
cactgctcccggcccgattattcttattttttgtttagttcttcagtgaaatcaactaagtcagtgagaaatttgatgaggggaggaagttagtg

SEQ ID NO: 608 - DNA, 58 bp, Homo sapiens; identical to SEQ ID NO: 47

SEQ ID NO: 609 - DNA, 99 bp, Homo sapiens
acatgagtgagcacatgccgtgttaacttgatgggtgttggtatctcactatggttatttatttatttatttattttttgagatggagtctcactctgt

SEQ ID NO: 610 - DNA, 58 bp, Homo sapiens
tgagactgagtctcgctctgtcacccaggctggagtgctgtggtgtgatctcggctca

SEQ ID NO: 611 - DNA, 97 bp, Homo sapiens
tgcagggtgtatatatgtgtgtgtgtgtgtgtgtgtgtgtgcgcgggtatatatatatagtgtatgtgtatatatgcatatacatatatatgtgtgt

SEQ ID NO: 612 - DNA, 115 bp, Homo sapiens
agtgcttcttcttggttaaaaaacaaattatatgcctctgtgtgtgtgtgtgtgtatacacactatatatacatacatatgtacatatacacataatataactatatataacatt

SEQ ID NO: 613 - DNA, 102 bp, Homo sapiens
tatatatgtgtgtatatatgtgtgtatatatgtgtatatatatgtgtgtgtatatatacacacacacacacacacatatacacacacatacatatatatatg

SEQ ID NO: 614 - DNA, 83 bp, Homo sapiens
gggcgacatagcgagaccctgtctctacaaaagaaaacttttttttttttttttttttgagacggagtttcactctgtcaccc

SEQ ID NO: 615 - DNA, 100 bp, Homo sapiens
tagttcttacaggttttgggataggtggtgaagttgagagcaatgttttgtgggcaggggtggatctcacaaagtacattctcaagggtggggagaatta

SEQ ID NO: 616 - DNA, 58 bp, Homo sapiens
tgagacggagtctcactctgtcactcaggctggagtgcagtggtgcgatctcagctca

SEQ ID NO: 617 - DNA, 73 bp, Homo sapiens
ggacatgacagagctgcttaatgcactgttgacttttgtttgtatttagagacaggctctcactctgtcttcc

SEQ ID NO: 618 - DNA, 71 bp, Homo sapiens
gaaggaataggaggagcagggaaatcagaaaaactgttggtctcactctgtctctctacctggtcatcttc

SEQ ID NO: 619 - DNA, 115 bp, Homo sapiens
gttgtggggagatagacttagagcctggacatgttttccattttttttcttttttttttttttttggagatgggagtctcactttgtcacccaggttggagtacagtggtacaat

SEQ ID NO: 620 - DNA, 102 bp, Homo sapiens
gctcatttgtgttttttaagaaattttatatgtatttcctaaaacctatgtaaatatgaaatatcttttattatatgcatgtcttctagaagaacataaagc

SEQ ID NO: 621 - DNA, 95 bp, Homo sapiens
tgtttttttgagggggacggagtctcactgtgtcacccaggctggggtgcagtggtgcgatctcggctcactacaacctcctcctggttcaagca

SEQ ID NO: 622 - DNA, 76 bp, Homo sapiens
gtccaggacacagaaaagactctggccagggtggcttccttgcagctgtgcagtctctattttaacagtcctggtc

SEQ ID NO: 623 - DNA, 96 bp, Homo sapiens
gcaaaacatttcaggtataaggttcctctgcagccagacttttttatcttttaaaaaagaatgccgggcgcagaggctcaaacttgtaatcccagc

SEQ ID NO: 624 - DNA, 107 bp, Homo sapiens
ccagcctgggtgacagagcacagactttgtttaaaataaataaaaatatatatatatattttttaattttttattttttgagagtctccctctgtcgcccaggctgg

SEQ ID NO: 625 - DNA, 73 bp, Homo sapiens
ggctcttccagaactctctctcagtgacttgcttgtggtctttgacaacactgggtcaggagttctgccaccc

SEQ ID NO: 626 - DNA, 80 bp, Homo sapiens
gggaggcaaaggcaagaggattgcttggggccaggagtttgagaccagcctgggcaacaaagtgagactctgtctctctc

SEQ ID NO: 627 - DNA, 74 bp, Homo sapiens
agtgtgtggctatgtggctgtgcatgtgcttgtgtaagcctgcgcacgtatgtgttcctgtgtctccaaatgct

SEQ ID NO: 628 - DNA, 58 bp, Homo sapiens
tgagatggagtctcactctgtcacccaggctggagtgatgtggtgtgatctcggctca

SEQ ID NO: 629 - DNA, 110 bp, Homo sapiens
agtgtggtggcatgcatttgtagtcccagctattcaggaggctgaggtaggaggatcacttgagcctggaaggttgaggctgcagtaagcaaagatcacgccactatact

SEQ ID NO: 630 - DNA, 83 bp, Homo sapiens
gcagcaagatgagctggtttgatggggagccatcccttgatgaggagaacccttcccactctcactcagcctcacccagctgc

SEQ ID NO: 631 - DNA, 75 bp, Homo sapiens
gcagagtctcgctctgtctcccaggctggaatgcaatggcgcaatctcagctcactcctgggttcaagcgattgt

SEQ ID NO: 632 - DNA, 105 bp, Homo sapiens
tagccaagcatggtgacacatgcaggcggtccaagctaggaggctgaggtaggaggatcagttgagcctaggaggttaaggctacagtgagctatgattgtgcta

SEQ ID NO: 633 - DNA, 81 bp, Homo sapiens
ggtggggcgagtattggtgtgaggtgacggtgagtgttttgcatactttcttttttcttttctttctccttttcccccact

SEQ ID NO: 634 - DNA, 57 bp, Homo sapiens
ttgagacggagtctctggctctgtcgcccaggctggagcgcagtggcgcgatctcgg

SEQ ID NO: 635 - DNA, 65 bp, Homo sapiens
gtttgaagcttgtatggtttaggcaaggaacaaatgttcaatcttgatagaactaggcttcgaat

SEQ ID NO: 636 - DNA, 56 bp, Homo sapiens
tgaggcagagtctcactctcacccaggttggggtgcaatggcgtgatcttggctca

SEQ ID NO: 637 - DNA, 58 bp, Homo sapiens
tgagacagagtctcactctgtcacccaggctggagtgcagtggtgcgatctcggctca

SEQ ID NO: 638 - DNA, 110 bp, Homo sapiens
agttatggagtttgcatatgtttagctttagagatattgccctacagttctcctaaatgattattgtatcaatttatttctctactactagtgtgagagttctaattgct

SEQ ID NO: 639 - DNA, 66 bp, Homo sapiens
cctgtctctccctgtgtctttcccaacagataagaagaaaaggaggtgagacagagagaccacagg

SEQ ID NO: 640 - DNA, 152 bp, Homo sapiens
agatgtatattagtatacataaatatgtaaatacctatatgtatatgtatgtatatatgtatatgtaggtgtatattatgtgtatatatgtatacatctatacatatatgtataatgtacacatatatacatatgtatatatgtatgtatgc

SEQ ID NO: 641 - DNA, 76 bp, Homo sapiens
atatatatatatgcatgtatgtaatatatgtgtacatatatacatatatattactacatatatgtgtgtgtgtgtg

SEQ ID NO: 642 - DNA, 127 bp, Homo sapiens
tatatatatgtatatatatactttacgtaaagtatatatatactttacgtaaagtatatatattcatatatatactttacgtaaagtatatatatacatatatatactttacgtaaagtatatatat

SEQ ID NO: 643 - DNA, 58 bp, Homo sapiens; identical to SEQ ID NO: 523

SEQ ID NO: 644 - DNA, 66 bp, Homo sapiens
cattcatatatatatgtatgtgtttatatacatatatatgtgagtgtatatatgtatatatgtgtg

SEQ ID NO: 645 - DNA, 66 bp, Homo sapiens
gccacacagatggtaggtggcagagccaggattgaacccaggtctatctgtccctctgacactggc

SEQ ID NO: 646 - DNA, 95 bp, Homo sapiens; identical to SEQ ID NO: 68

SEQ ID NO: 647 - DNA, 93 bp, Homo sapiens; identical to SEQ ID NO: 69

SEQ ID NO: 648 - DNA, 95 bp, Homo sapiens; identical to SEQ ID NO: 68

SEQ ID NO: 649 - DNA, 93 bp, Homo sapiens; identical to SEQ ID NO: 69

SEQ ID NO: 650 - DNA, 95 bp, Homo sapiens
ggccaggattggtggctcacatctgtgattcctgtgctttgggaggctgaggtaggaggatcccttgagtctgggagtttgaggccagcctgggc

SEQ ID NO: 651 - DNA, 76 bp, Homo sapiens
aggagggatggtgtcagacctctcagggtgatgtggcccacacacctcactgagcctgtctcagagtgtgtctcct

SEQ ID NO: 652 - DNA, 99 bp, Homo sapiens
tgcttttcataaggtcatgcaggtaataagtggcagaatcaggtttctctctatgtctgactctttaaccagttacctaatggctttaatacagaagca

SEQ ID NO: 653 - DNA, 58 bp, Homo sapiens; identical to SEQ ID NO: 526

SEQ ID NO: 654 - DNA, 58 bp, Homo sapiens
tgagatggagtctcactctgtcacccaggctggagtgcagtggtgaggtctcggctca

SEQ ID NO: 655 - DNA, 109 bp, Homo sapiens
atgtgtatatacatatgtatatgtgtgtatgtatatgtgtatatatatatacacatagtatgtgtatgtacacatgtatgtatgtatatatctgtgtgtatgtatgcat

SEQ ID NO: 656 - DNA, 79 bp, Homo sapiens
tggctgtgacaggttccactaggtgacttcaaagacacattctagctctgtgagtcagtcacttacctcaacatggcca

SEQ ID NO: 657 - DNA, 107 bp, Homo sapiens
ttgttctgttggctgggtggccctgggaagacccttttcctttcctttttttttttttttttttttttgaggtggagtctctctctgttacccaggctggagtgcag

SEQ ID NO: 658 - DNA, 78 bp, Homo sapiens
gggccagcaatcctgttcacatttccaggagaaaggaaactggttcttgaggaagagtagggtgtgaggacagagatt

SEQ ID NO: 659 - DNA, 84 bp, Homo sapiens
atatttatactagttacaagttatatatatatatatatatctctacagatatatctctatatatatgtaactctatatatatat

SEQ ID NO: 660 - DNA, 175 bp, Homo sapiens
cataactgtatatagttttacatacatacataactgtatatagttttatatacatatgtgactatagttttatatacatatatgactatatatagttttatatacatatatgactatatatagttttatatacatatatgactatatatagtcatatatgtatatataactatgt

SEQ ID NO: 661 - DNA, 95 bp, Homo sapiens; identical to SEQ ID NO: 68

SEQ ID NO: 662 - DNA, 93 bp, Homo sapiens; identical to SEQ ID NO: 69

SEQ ID NO: 663 - DNA, 90 bp, Homo sapiens
gtgcacactgagaattgtcatggctcagagctctattttactttttttttcatttttatagatttaggggctacaaatctattgtgttac

SEQ ID NO: 664 - DNA, 75 bp, Homo sapiens
ttgtttttttttgagacagagtctctttctgtcacccaggctggagtgcagtagtgagatctcagctcagtacaa

SEQ ID NO: 665 - DNA, 89 bp, Homo sapiens
tatacacatatatatgtatatatcatatatatacatatatatatgtttaaagacatatatatatgtgtgtgtatatatatatgtgttta

SEQ ID NO: 666 - DNA, 86 bp, Homo sapiens
gctctactcagttcctctctctgagtctgtttcctcatatgtaaaatggagagaggcagggcacgggaggggttgaatgagtgagc

SEQ ID NO: 667 - DNA, 106 bp, Homo sapiens
tggtttttagtaacaaatggcagagtatttctctctgtctctctctctttttttttttttttttttgagacacagggtcttgctctgtcacgtggactagagtaca

SEQ ID NO: 668 - DNA, 95 bp, Homo sapiens; identical to SEQ ID NO: 68

SEQ ID NO: 669 - DNA, 93 bp, Homo sapiens; identical to SEQ ID NO: 69

SEQ ID NO: 670 - DNA, 97 bp, Homo sapiens
gatcacgggtagacaaatcttgtccttttagacagagcttcttgataatttttaatgcctcattcttaaaaggaacagataggctgtgtgcagtggc

SEQ ID NO: 671 - DNA, 117 bp, Homo sapiens
gatcttggcccactgcaacctctgcctccccggtgagtagttccttctttagttcaacattttttttttgagacggagtctcgctctgttgccaggctggagtgcagtggcacgatc

SEQ ID NO: 672 - DNA, 106 bp, Homo sapiens
ctgtgttttctcttggcctccttccagctctgacagtctgtgaatctcctggaagccagctctgggtccagtcctgtcttggggaaattagaccagaaaggcacag

SEQ ID NO: 673 - DNA, 95 bp, Homo sapiens
ctaagtgcaggcctgttctctgtgtccctcagtctgtaccccagccagagggaatcagggttggggcatggagagagagcagttggagctgggct

SEQ ID NO: 674 - DNA, 84 bp, Homo sapiens
agtctcgctctgtcactcaggctgaagtgcagtggtgccatcttggctcagtgcaacttccacctcctgggttcaagcgattct

SEQ ID NO: 675 - DNA, 102 bp, Homo sapiens
gagtagttactgagttatagtgtcccgttttcttctcatgactgctaccatttaatcatggtagtagagagaaatgagtgagcagccatttcagaattgctt

SEQ ID NO: 676 - DNA, 75 bp, Homo sapiens
ctgggattacagggttgagccactatacctagccttttttttttttttttaagatagtctcgctctgtggcccag

SEQ ID NO: 677 - DNA, 68 bp, Homo sapiens
ttgttttgagacagtctcactctgtcacccaggctggggtgcagtggtgtgaacctgactcactgcaa

SEQ ID NO: 678 - DNA, 72 bp, Homo sapiens
ctgggcaaagtggcacaggcctatagacccagctactgaggaggctgaggtaagaggatcacttgaactcag

SEQ ID NO: 679 - DNA, 111 bp, Homo sapiens
tgtacacctgtagtcccagctatttgggaggctgaagtgggaggatctcttttttttttttttttttgagacagagtctcgctctgtcgcccaggctggaatgcagtggca

SEQ ID NO: 680 - DNA, 84 bp, Homo sapiens
cccttgtctggctccctcactcccccagtcagctttcctaaccacttgctagtgaggtggggaagaccagaaacagagtggagg

SEQ ID NO: 681 - DNA, 106 bp, Homo sapiens
gtactggggagtggattcactgccctctggtaaggcaggctcctcgggaggtgtgataaagacagtgagctcacttcctgacagctcctctagctccactaagggt

SEQ ID NO: 682 - DNA, 119 bp, Homo sapiens
gaccctgattaaaaaaaaaaaaaagttattttgtcttcaaaggcaaacagattttgttgttctcaaatatgtggtcatgagatggaatctgtacttgtgtgaaacagatacttttggtt

SEQ ID NO: 683 - DNA, 58 bp, Homo sapiens
tgagacagaatctcactctgtcacccaggctggagtgcagcggcatgattttgactca

SEQ ID NO: 684 - DNA, 86 bp, Homo sapiens
cggaggttgcagtgagcctccctcttttttttggtctcaaaaaaaaaaaaagaaagaaagtgaggatagctgcatgctgaataccg

SEQ ID NO: 685 - DNA, 75 bp, Homo sapiens
tcctttctgcacatccctggctagtaggaaattctagagttttgaaagtactagattagagattttgctgaagga

SEQ ID NO: 686 - DNA, 58 bp, Homo sapiens
tgatacagagactcactctgtcacccaggctggagtgcaatggtgtgatctctgctca

SEQ ID NO: 687 - DNA, 58 bp, Homo sapiens
tgagatggagtctcactctgtcacccaggttggagtgcagtggtgcgatctcagctca

SEQ ID NO: 688 - DNA, 56 bp, Homo sapiens
gagatggagtctcactctgtcacccaggttggagtgcagtggtgcgatctcagctc

SEQ ID NO: 689 - DNA, 99 bp, Homo sapiens
caagtagctgggactacaggcgtgtgccaccctgccccactaatttttaaaattttttgtagagatggaggtctcactctgttgtccaggctggtcttg

SEQ ID NO: 690 - DNA, 85 bp, Homo sapiens
ctgagattacaggcatgaggctctgtgcccggctgctttttttttttttctttttcttgggacagggtctcactctgtcactcag

SEQ ID NO: 691 - DNA, 65 bp, Homo sapiens
ttgtgatagagtctcactgtgtcacccaggctggagtgcagtggcgcagtctcggctcactgcaa

SEQ ID NO: 692 - DNA, 82 bp, Homo sapiens
ctaagagatggacagcaggcatagctggatccagaggttcaaacactatctgggtccctctgaccgtctctccatctcttag

SEQ ID NO: 693 - DNA, 94 bp, Homo sapiens
cctcagaaaaacttgataaatagacgtgatcatcagctccaccttggacccactgctgaactctctgagactctctttgttcatacatttgagg

SEQ ID NO: 694 - DNA, 102 bp, Homo sapiens
aggagctgggataacaggcgtgagccaccaggtccggctaattttcttatttttagtagagatgaggtttcgccatgttggccaggctggtctcgagctcct

SEQ ID NO: 695 - DNA, 129 bp, Homo sapiens
ggactcgcctgggctgctgtcccaggaggggccatggcaggccatctatggggagtgtgatggctgtgtgcacactggagtcggaaattgccacagccaggaggaacacctcacaggagcgtggctgcc

SEQ ID NO: 696 - DNA, 56 bp, Homo sapiens
gacagggtctcactctgtcacccaggctggagtgcagtggtgcgatctcggctgtc

SEQ ID NO: 697 - DNA, 77 bp, Homo sapiens
gggtggctgctgtaccagacagaacagatacagaacatcctctttgtcacagaaagttccactgaacagtgctgcct

SEQ ID NO: 698 - DNA, 58 bp, Homo sapiens
tgaaatggagtctcgctctgtcgctcaggctggagtctagcggcgcgatctccgctca

SEQ ID NO: 699 - DNA, 58 bp, Homo sapiens
tgagacggtgtctcgctctgtcacccaggctggagtgcagccgcgcgatctgggctca

SEQ ID NO: 700 - DNA, 106 bp, Homo sapiens
acaaagtgaggcactatctctacaagaaaaaaaaaaatagctgggcgtggtgatgcgcgcttttttttttttttttttttttttttgagacagagtctcgctctgt

SEQ ID NO: 701 - DNA, 79 bp, Homo sapiens
ggatgaggttcctgggcagaggaggagtgaagctggtgcctgttctctgctactgcctcctgccttcttacctgaatct

SEQ ID NO: 702 - DNA, 67 bp, Homo sapiens
tgtgtgtatgtgtgtgtatatatatatgtgtgtgtgtatatatatacacacacacacacacacctgc

SEQ ID NO: 703 - DNA, 115 bp, Homo sapiens
ccagttttctgtagataattgtttggatttttttagggttttttttttttatattaaaatagtggtgcattttggacccttgtgcagacattatatttttaagagtgtatcttgg

SEQ ID NO: 704 - DNA, 85 bp, Homo sapiens
gtggggagcagaggaccataactacctttcttttttttttttttttttttttttttttgagatagagtctcactctgtcacccac

SEQ ID NO: 705 - DNA, 101 bp, Homo sapiens
agtgctgggattacaagtgagctactgcacctggccagtgtttatattttttaaagaaatcctggccgggtgcggtggctcacacctgtaattctagcact

SEQ ID NO: 706 - DNA, 84 bp, Homo sapiens
gcctctgactcactcactgccttttggccctccctctctttctgaagtctgggggatgccttggggcaggagcgaacctcaggc

SEQ ID NO: 707 - DNA, 64 bp, Homo sapiens
tataggcgtgagcctctgtgcctggcaaaaaactttttttttttagggatggggtgtccctata

SEQ ID NO: 708 - DNA, 79 bp, Homo sapiens
aggtttgtgagggagattaaagaagttggaatcttttttcttttttttttttttaagatggagtctcgctctgtcacct

SEQ ID NO: 709 - DNA, 80 bp, Homo sapiens
tatatatatgtgtgtgtgtgtgtgtgtgtgtgtgtgtatatatgtatatacacacacgatatgcatatcatatgtatata

SEQ ID NO: 710 - DNA, 84 bp, Homo sapiens; identical to SEQ ID NO: 706

SEQ ID NO: 711 - DNA, 84 bp, Homo sapiens
ttctttgttaccaggcagagtctctgtgtgtttcccagttgactgggaaagcagaacatggaagtatgtgggattgattgggaa

SEQ ID NO: 712 - DNA, 86 bp, Homo sapiens
ttgctttttgttgttgttgttgttagacagactcttgctctgtcactcaggcttgagtagagtggcgcaatcttggctcactgcag

SEQ ID NO: 713 - DNA, 58 bp, Homo sapiens
tgagacagggtctcactctgtcaccctcgctggagtgcagtggcgtgatcatgactca

SEQ ID NO: 714 - DNA, 60 bp, Homo sapiens
gtgagacagggtctcactctgtcacccaggctggagtgcagtggtgagatcttagctcac

SEQ ID NO: 715 - DNA, 58 bp, Homo sapiens
tgagatggagtctcactctgtcacctaggctggagtgcagtggtgcgatctcagctca

SEQ ID NO: 716 - DNA, 64 bp, Homo sapiens
tggatgtctggagagagacagcagccagaggtcagcagctttgctcctgcctctccagggtcca

SEQ ID NO: 717 - DNA, 92 bp, Homo sapiens
gggattactggcacggccaccatgcagggctagtttttttatttttagtagagacgggctttcaccatgttggccaggctggtctcgatctc

SEQ ID NO: 718 - DNA, 87 bp, Homo sapiens
ccgtgcctggcattgtgactgcgtttattctctcaattttttttttttttgttttgagacagagtcttgctctgtcacccagactgg

SEQ ID NO: 719 - DNA, 79 bp, Homo sapiens
ggggcaggtgagagacgggattttagaggggttcagaggatggactctggactcactatctgtctcacagccgtgctct

SEQ ID NO: 720 - DNA, 100 bp, Homo sapiens
gcatccagaacagggcctgcactgactgactcgctgtcaggctagggtggaagggtgtggagatgagtttagatggtcttggtagggtgttcagggtagt

SEQ ID NO: 721 - DNA, 168 bp, Homo sapiens
gagaagcctgtctaagtgctctgggcacctagagctgggagattcaggggaggcttttttaattaattaattaattaatttatttatttattttttaattttattttttgagacagagtctctcgctctgtcacccaggctggagtgtagtggcgagacctcggctca

SEQ ID NO: 722 - DNA, 61 bp, Homo sapiens
tggctcatgcctgtaaactcagcactttggaatgctgaagtggtacggtcacttgaagcca

SEQ ID NO: 723 - DNA, 86 bp, Homo sapiens
tctgaccctttatagcaagtgtgcccaccatccccactttaaacagctatttggtgtgcaagacttgtgaaaatataaacttcagg

SEQ ID NO: 724 - DNA, 96 bp, Homo sapiens
gggcgacagagcgagactccatctcaaaaaaaaaaaaaaattttttttctttttttcttttttttttggttgagaagaggtctcactctgtcaccc

SEQ ID NO: 725 - DNA, 107 bp, Homo sapiens
gggggcactaacaaaagtaaccactgcaaatcttttttttgtttttttaattcacaaatacaaggataaaaacaaaggggcacacaggttccaatgttgggaattcc

SEQ ID NO: 726 - DNA, 116 bp, Homo sapiens
gagtctcactgttgtatgggctgcataaagggaggttgattcttttttttttttttttttgagatggagtcttgctgtgtcacccaggctagagtgcagtggtgcaatctgggctc

SEQ ID NO: 727 - DNA, 97 bp, Homo sapiens
ggaaagggacctctcagcacccccttggcctccactgccacactctctggctgcccctttccccaaacagaggctcacccagcaatgttggtggtag

SEQ ID NO: 728 - DNA, 78 bp, Homo sapiens
gccggggactgaggagtctcctaggataagggaatttttttttttttttgagacggagtctcgctgtgtctcccaggc

SEQ ID NO: 729 - DNA, 73 bp, Homo sapiens
gtggctcccactctctcccagtgtcctcagggttaataactatgtgccaccagatagagagttaaggggctgc

SEQ ID NO: 730 - DNA, 112 bp, Homo sapiens
gggattttgaatgacttgagcacaggctaacactctccctgtctgtgtgtcttcttgcagccaggaggaagaagaggaggatgaggaggctgcctcaaggtactatgttccc

SEQ ID NO: 731 - DNA, 110 bp, Homo sapiens
ggactaagggatgtgactgatagacagggactgagaggggttttttttttttttatgagatggagtcccactctgttgccaggctggagcaagtgacgtgatctcagctc

SEQ ID NO: 732 - DNA, 111 bp, Homo sapiens
ccactgccaagatccagaaagtccttgtggtttcgctgctttctcctttttttttttttttttttttctgagatggagtctggctctgtcgcccaggctggagtgcagtgg

SEQ ID NO: 733 - DNA, 73 bp, Homo sapiens
ccacgcctggtctagaggtttggctttttttttttttttttgagacagagtctcactctgttacccaggctgg

SEQ ID NO: 734 - DNA, 78 bp, Homo sapiens
ggaggctgactgtggccttcagtttgcagtctcagcacctggccctgcctccctctgtcccacggttgcgtagcctcc

SEQ ID NO: 735 - DNA, 111 bp, Homo sapiens
gccaggcatggtggtgcaggcctgtaatcccagctgcttgggaggctgaggtagtagaatcgcttgaacccgggaggcggaggttgcagtgaaccgacatcatgctactgc

SEQ ID NO: 736 - DNA, 114 bp, Homo sapiens
tgtgagccaccacacccagccttaattgtgcacattttctaattttaattttttatttttttgaaacagaatcttgctctattgcccaggctggagtgcaatagtgtgatcacg

SEQ ID NO: 737 - DNA, 71 bp, Homo sapiens
gggttgcttctgctggcctggaatgttaagaagaatctggaggttccagattatcaggttctcatgtaccc

SEQ ID NO: 738 - DNA, 72 bp, Homo sapiens
ggcctcacctgtagtcccagcaacttaggaggccaaagtgggaggactggctgagtacaggagtttgaggct

SEQ ID NO: 739 - DNA, 108 bp, Homo sapiens
gccaggaggcggggttggttgttatctttggttatctagctgtatgagtggtgtggagtcttcataaagctagataaccgaaagtaaaaataaccccatacactgcgc

SEQ ID NO: 740 - DNA, 87 bp, Homo sapiens
ggggttatttttactttcggttatctagctttatgaagactccacaccactcatacagctagataaccaaagataacaaccaacccc

SEQ ID NO: 741 - DNA, 87 bp, Homo sapiens
ggtctctaacatgggacggagagtggaaagcttggcccctggggttggctgtcagtctctttgtctgccctatccttgaccaggttt

SEQ ID NO: 742 - DNA, 105 bp, Homo sapiens
caaaggtttatatgggggctttctaatctgtttcactgtctatgtgtctggcataaatgctaagcccacagtgttttgattaccctatctttttaataacttttg

SEQ ID NO: 743 - DNA, 75 bp, Homo sapiens
gagtctctgtctgtcactcaggctggagtgcagtggtgaaatcacaactcactgcagccttgacctcccgggctc

SEQ ID NO: 744 - DNA, 82 bp, Homo sapiens
gtctttggttttactgacagggtaatgctggtctcttacttcgccttttgagtctcagcttctccatctgtaatatggagat

SEQ ID NO: 745 - DNA, 117 bp, Homo sapiens
ccactgcactccagcctgggcgatagaccaagattctgtctgaaaaaaaaaaaaaaaagagagagagagagagtgagatgggatctgtctctgtgactcagaactgcagtacagtgg

SEQ ID NO: 746 - DNA, 95 bp, Homo sapiens; identical to SEQ ID NO: 68

SEQ ID NO: 747 - DNA, 93 bp, Homo sapiens; identical to SEQ ID NO: 69

SEQ ID NO: 748 - DNA, 63 bp, Homo sapiens
tgggctgggagacagggcgggaggggcccctgccatatgctctcactctctctcactcgccta

SEQ ID NO: 749 - DNA, 114 bp, Homo sapiens
tgtgggcaaaccctggggagaagtgagccaaagaaggctgtgggagggtggactctctctgagactcagctgggctgtggaacgcgttcttgccctgagactgggtgctagacg

SEQ ID NO: 750 - DNA, 117 bp, Homo sapiens
ggtcaacgggtttggctgctaagctcgggaagccaagggctgaagcgaccccgggctctcaaccactctcactctgaccccgaggggactgagggtgtgtcagtcacccagggtcct

SEQ ID NO: 751 - DNA, 64 bp, Homo sapiens
tgagacaggatctcactctgtcgctcaggctggagtgcagtggcagtggtgtgatctcagctca

SEQ ID NO: 752 - DNA, 56 bp, Homo sapiens
gaatctcaagctgagtttgggcaagttacttaactggctctctcagtctcagattc

SEQ ID NO: 753 - DNA, 119 bp, Homo sapiens
ggctaataaatcatcaccaactgccttctcctacagggattcaagtcctccaggctccttctgtttctgtctctgactttctctctctcatactgtggaaggcaaggagttgaactgcc

SEQ ID NO: 754 - DNA, 66 bp, Homo sapiens
catactgtgggtccctctatccctcaaagttcagagctctgggattgcagggacactgactgtctg

SEQ ID NO: 755 - DNA, 116 bp, Homo sapiens
ccgtctggtcaccttcttgagctcaggctgctcggtcggtctgtgtgtccctgtctcggggacttggggggccatccgtgctggggccttggcggagagaaccgtgagcctctagg

SEQ ID NO: 756 - DNA, 93 bp, Homo sapiens
gggctgctcgtaggtgccactgtctctctgtggctggggttgccgccgcctctggctgtcccagaactgaggaggctgcctggggggagatcc

SEQ ID NO: 757 - DNA, 97 bp, Homo sapiens
cagcacttgggacaaagcctggactatagccggcagtcaaaacatgtatgttgaatgaatgaatgaatgaatggcctgttgaccagctcccctgctg

SEQ ID NO: 758 - DNA, 96 bp, Homo sapiens
tatatacacatatatgtgtatatatatgtgtgtgtgtgtgtatatctatatatgtgtgtatatatatgtatctatatatatatctgtgtgtgtgta

SEQ ID NO: 759 - DNA, 76 bp, Homo sapiens
cctgggtgtctctgggcctgtcttagacttttttctttctttctttttgagacagggtctcactctgtcacccagg

SEQ ID NO: 760 - DNA, 85 bp, Homo sapiens
ctgggcacacacatcactggcctcactctctgtgacagataagatcttagaggcaggaagggagagaggtcaggaggagggccag

SEQ ID NO: 761 - DNA, 85 bp, Homo sapiens
ccccatgattcaattacctctccctgtgtccctctcacaatgtgtgggaactctgggagatacaattcaagttgagatttggtgg

SEQ ID NO: 762 - DNA, 126 bp, Homo sapiens
tatatatatatgaatctatatataggaatatatatatatgaatctatatataggaatatatatatgaatctatatataggaatatatatatgaatctatataggaatatatatatgaatctatatg

SEQ ID NO: 763 - DNA, 114 bp, Homo sapiens
tgtgcacaatggaatcaaacagccccgggttatcggacatgggtgtttccttttttttttttttttttgagatggagtctcactctgtcactcaggctggagtgcagtggcgcg

SEQ ID NO: 764 - DNA, 89 bp, Homo sapiens
ttcagtatgcactcactctctgcctctctgtgccgctggtctgtgagctggtccagggctgcgttctggaagacggtgagagaactgaa

SEQ ID NO: 765 - DNA, 80 bp, Homo sapiens
gggaaacttttattgcagcaagtgaacatgtgtctgatttttttttttttttttttagacagggtctcgctctgccgccc

SEQ ID NO: 766 - DNA, 66 bp, Homo sapiens
tgtgtgtgtgtgtgtgtgtgtgtgtgtatgtatacatacatatatatatgattacatatgtacata

SEQ ID NO: 767 - DNA, 117 bp, Homo sapiens
gggccaaccacactgtttgttttcctctgtcaaaggcccagaagacttaatgccatcagattttttttttttgagtctcgctctgttgcccagactggagtacagtggtgcaatctc

SEQ ID NO: 768 - DNA, 119 bp, Homo sapiens
ccctgattcaaaccctgcccacttggaggcaggagactttttaaaaaaatttttttattttaattttaattttttttgagatggagtctcactctgacacccaagctggagtacagtgg

SEQ ID NO: 769 - DNA, 62 bp, Homo sapiens
tgagacagaatctcactcactctgttgcccaggctggagtgcagtggaacgatcttggctca

SEQ ID NO: 770 - DNA, 79 bp, Homo sapiens
ccacagtcaggccagggaggctcttccatggtctcagggcacagtactgagtgaggagctggtgcaggtaagggtgtgg

SEQ ID NO: 771 - DNA, 104 bp, Homo sapiens
acgtcagtgctggtctaaaacgagcttggtctaagactggatttttttttttttttttttggagatggagtctcgttttgttgcccaggctggagtgcagtgac

SEQ ID NO: 772 - DNA, 102 bp, Homo sapiens
ggtgactagaggcttttcccttgccatttaaaaaattctgtctttgtatttgactttagactgttttattataatgtgccatggaaaagacctttttgcatt

SEQ ID NO: 773 - DNA, 66 bp, Homo sapiens
tagtgatgtgggaagtggactagattgggcacagcctgggccattgtcactgtcacactgtcactg

SEQ ID NO: 774 - DNA, 108 bp, Homo sapiens
gcattgtcttttctctacagccttaccagcatctgttgttttttgatttttttttaaatatccattctgactgatgtgaaatggtatctcactgtggttttgatttgc

SEQ ID NO: 775 - DNA, 81 bp, Homo sapiens
tgtacacctcctagggaagttggggtaggtaccattcacattgtgctcaatgggactgactgactctgctggaattgtgca

SEQ ID NO: 776 - DNA, 76 bp, Homo sapiens
gactgatctctgggatcttgaaagtgctgtgtttacctccaccataacactttttttttttttttgagacacagtc

SEQ ID NO: 777 - DNA, 76 bp, Homo sapiens
tctgtttttttcatgtttttaattggaggggttataaatttccatagtgtctccagtagaagaggtgtttaagagg

SEQ ID NO: 778 - DNA, 76 bp, Homo sapiens
gagtctcccagcacctcctgctagacagctgtctgcctgcagctcccctcacagggtctgtgtctgcctgaaactc

SEQ ID NO: 779 - DNA, 57 bp, Homo sapiens
tgagacagagtctcactctgtcacccaggctggagtgcagtggtggatcttggctca

SEQ ID NO: 780 - DNA, 83 bp, Homo sapiens
tctatctatctatctatctatctagagcaggaagtgttggcaatgacattcctcctgactggtctgaaaggaagcctagaaga

SEQ ID NO: 781 - DNA, 79 bp, Homo sapiens
gcaatgcagacggtaagaactctgacaactgcccagttgggtggtgggtgaaggtctctctctctctctctgtgtgtgt

SEQ ID NO: 782 - DNA, 95 bp, Homo sapiens; identical to SEQ ID NO: 68

SEQ ID NO: 783 - DNA, 93 bp, Homo sapiens; identical to SEQ ID NO: 69

SEQ ID NO: 784 - DNA, 97 bp, Homo sapiens
ctcatatttctcagagattttgttcatccttctgtattattttttctttattttgtgtgactgagttaattagaagaactggtctttgagctctgag

SEQ ID NO: 785 - DNA, 100 bp, Homo sapiens
gaagaggtccttcacatcccttgtaagttggattcctaggtattttattctttttgaagcaattgtgaatgggagttcactcatggtttggctctctgtc

SEQ ID NO: 786 - DNA, 66 bp, Homo sapiens
ttgagcccatgtgtgtctctgtatgtgagatgggtctcctgaatacagcacactgatgggtcttga

SEQ ID NO: 787 - DNA, 115 bp, Homo sapiens
catgaccccaggcaagcactaatcttctgtcactataacatgtctttttttataatttcatataaataaaaatatgcattgcagtatagaaatacattatgcagtcttgtgtctg

SEQ ID NO: 788 - DNA, 109 bp, Homo sapiens
gctttgatttgtgtgtctagtttgctctaatatcacactggttgagtagttattttatagtacattttactttctgacagagcaaatcttatcactattctttagaagc

SEQ ID NO: 789 - DNA, 90 bp, Homo sapiens
gccttcttctgtcaatttgtcacactcattctctgtccagtttttttcccttgctggcagggagttgtgatcctttagaggagaagaagc

SEQ ID NO: 790 - DNA, 93 bp, Homo sapiens
gaagtcagataatgtgatgcctctgtatttgttcttttttaaaaaatttctaaaaacggaacaaatacagaggcatcacattatttgttcttt

SEQ ID NO: 791 - DNA, 62 bp, Homo sapiens
tacagcaggagaggggaaactggcaaaattcccaagtgtgccattctctctcacactctgta

SEQ ID NO: 792 - DNA, 111 bp, Homo sapiens
agataaggaggattcataaaccttgccttgcttgtaagtcccactctcacactgcctagtgaataccaagctgcaatgagcaaggacaagttttgtgttgactgtgtgtgt

SEQ ID NO: 793 - DNA, 114 bp, Homo sapiens
ggtgggaagatgtgtagaggagtgcttgtgaattcctgagtcctgcctcagatctgagtctgtttctgaaaataatggggttttctttctcttaccactctggttttcctgact

SEQ ID NO: 794 - DNA, 137 bp, Homo sapiens
aaggctagattaacgagtgtcaaaaaagaaacatgaagcaacaagaactcttcagtgctcctttttttttttttttttgtgagttgagtcttgctctgtcacccaggctggagtgcaatggtgcgatctcggctcac

SEQ ID NO: 795 - DNA, 77 bp, Homo sapiens
ctctgcttcaagggattgatgcttctgatatttcccctaaagtttagaaatcagagtttttgtctaatgaagcacag

SEQ ID NO: 796 - DNA, 92 bp, Homo sapiens
ggtggagggtcaggtggatcagtgcagatttgggggtcatcttactgtatagagacagtagatacactgcacataatcatgtaacaatcact

SEQ ID NO: 797 - DNA, 93 bp, Homo sapiens
attttttgcatcaattgagatgatcattttttttttgtctttcattctggtaatgtggtgtattatcttaattgatttttacaagtgaaaaat

SEQ ID NO: 798 - DNA, 115 bp, Homo sapiens
gtgcggggcacgtagtagttgcagcaagcggtagtttccttccttcttttttttttttttttttttttttgagatggaatctcgctctgttgcccaggctggagtgcagtggcgc

SEQ ID NO: 799 - DNA, 75 bp, Homo sapiens
gacatcagggtcttcatgatgtgattggtcccttttaaagaaaaggcatcagatctctccctgtctctctgtgtc

SEQ ID NO: 800 - DNA, 111 bp, Homo sapiens
ggcacactgtaagcctaagaattcaccaagctttttttcttttttttgcattttattgccccatttataaattgagcagttaagctacgtgacttttttagtctttttgct

SEQ ID NO: 801 - DNA, 118 bp, Homo sapiens
tttatttctgcattatttttgtactttgtacatattatctttattttaagtgactatagttgtgattatctttattttaagtgactattgttgtgaatgcaaagtaagtgtagttgag

SEQ ID NO: 802 - DNA, 109 bp, Homo sapiens
gaacaactacatgcagtgtgtaagccttgattggattctagtttgaaaaagctaactactaatgtatttgttgttcagtttgggaaatttgagtatggcctggatgttg

SEQ ID NO: 803 - DNA, 67 bp, Homo sapiens
ctggaaggtagcagagagaccacacagagtcacgaggcatgtggggtctcaggctgtgcacccccag

SEQ ID NO: 804 - DNA, 131 bp, Homo sapiens
atgtatatatacacacacatacatgtatttcaatatacatatatgtatacttatatatttatattatatatttacatatttatatataatacatacttaatttgaatatatgtatattcatgtacatgtat

SEQ ID NO: 805 - DNA, 100 bp, Homo sapiens
ctaatggtgtttagtgtgtgcttgaagagaggtgagctggttgactggccaagaacctgtgtttattattctttatttataatttaaaaacatcaattgg

SEQ ID NO: 806 - DNA, 84 bp, Homo sapiens
ggatctcactctgtcactcaggctggagtgcagtggcacagactcggctcactgcagttccgacttcctgggctcaagtgatcc

SEQ ID NO: 807 - DNA, 111 bp, Homo sapiens
gctggatgtggtggcaggcacctgtagtcccagctacttgggaggctgaggtaggaggatcacttgagcccaggaggtcgaggctgcagtgagccatgatcatgtcgctgc

SEQ ID NO: 808 - DNA, 95 bp, Homo sapiens; identical to SEQ ID NO: 68

SEQ ID NO: 809 - DNA, 93 bp, Homo sapiens; identical to SEQ ID NO: 69

SEQ ID NO: 810 - DNA, 82 bp, Homo sapiens
atgtgtgtgtgtgtatatatatatatatgtattctaaatatgttattcagtctatatatgtatattcagcatgtatatatat

SEQ ID NO: 811 - DNA, 95 bp, Homo sapiens
aggtaataagctccatttacaggactttgtcattgtgaggtttattatttctctctcagtaagtcactgttagtttgaatgactgcttattattt

SEQ ID NO: 812 - DNA, 95 bp, Homo sapiens; identical to SEQ ID NO: 68

SEQ ID NO: 813 - DNA, 93 bp, Homo sapiens; identical to SEQ ID NO: 69

SEQ ID NO: 814 - DNA, 141 bp, Homo sapiens
gtacatatacatatactatatatattatacattgtatatattgtatatatgtatacaatgtatatatgtatatatacatatatatgtatatgtatgtatatattgtgtatatatacaatgtatatatatgtgtatatgtat

SEQ ID NO: 815 - DNA, 95 bp, Homo sapiens; identical to SEQ ID NO: 68

SEQ ID NO: 816 - DNA, 93 bp, Homo sapiens; identical to SEQ ID NO: 69

SEQ ID NO: 817 - DNA, 82 bp, Homo sapiens
gagatgacactggcaccactgtgagcctgagtgcctccttaacttttgtgcctgaggtgcctctctagtctcaccctggtcc

SEQ ID NO: 818 - DNA, 79 bp, Homo sapiens
tgagacagagtctcactctgtcacccaggctggagtgcagtggtgcgatctcgtctcactacaacctccacctcctggg

SEQ ID NO: 819 - DNA, 70 bp, Homo sapiens
tctctcactctctctcctcctaactgctgcttctgcaaagagtggtagcctggcagagaactgtgaaaga

SEQ ID NO: 820 - DNA, 118 bp, Homo sapiens
tataatgttggggtgctctaggcctcagaagcaggcctcaggaaacagaatctctctctctttgatcttcttctgctctcctttcatctgcccaaggtaagactctaatctggttgtg

SEQ ID NO: 821 - DNA, 92 bp, Homo sapiens
gatctctttgctcaaagagtgcatagttctgtaggggagatacaacacagatagaagccatactatttatttattttttgagacagagtctc

SEQ ID NO: 822 - DNA, 96 bp, Homo sapiens
ggtgttacctttaccccaaggcttcccagtcagactctgtgtctccccagggggaatttgagggacgctgggccagtctgacattaagttccagcc

SEQ ID NO: 823 - DNA, 64 bp, Homo sapiens
gtgggactgaggcggaggcagggatgggcagggactgctctcacctcttgctgactgtcaccac

SEQ ID NO: 824 - DNA, 112 bp, Homo sapiens
ccaggatgtccacattctaatccctggaacctgtccatgttttattatatggcaaaagagactttgtagatgtgattaaattaaggctcttgagattgggagattatcctgg

SEQ ID NO: 825 - DNA, 104 bp, Homo sapiens
gagctggacatagttcttatggctgtttactctgtgtgtgtgtgtgtgtaaatatatataccatatataatcagtaagcctacctttctacttatgttttgctt

SEQ ID NO: 826 - DNA, 67 bp, Homo sapiens
tgtgtgagaacactgcatgggttgtgaacactacatgtgtgcacagtctcactgttactctcggaca

SEQ ID NO: 827 - DNA, 57 bp, Homo sapiens
ctcggaatttcagggagcttggcctcctctgtgcctcagtgtctctgaaagtccaag

SEQ ID NO: 828 - DNA, 102 bp, Homo sapiens
agattgttaatgagtgtactctatgattcagcaacaggaactgattctacagaaatagaagctcaagggcctgatgatatctatgtgcaagaatgacactct

SEQ ID NO: 829 - DNA, 114 bp, Homo sapiens
ggttatataggtgttcttggtgctatttttattcttgcaacttctctgaaagtttaaaattattttcaagttaaatgttttttaaaggtacctggaaagaatacgacggtaaac

SEQ ID NO: 830 - DNA, 73 bp, Homo sapiens
gagaactgtccggtcgctgtcagtctctctccctctggggggtaacaaatggtgacctcttatctcagctctc

SEQ ID NO: 831 - DNA, 115 bp, Homo sapiens
ccatcatgtgtggatgtattatcatgcatgaagagggtcacagaatcacagagcgcctcactctctcacacagatcctcacgcacaatgtcatgatggatatcttcaccagctgg

SEQ ID NO: 832 - DNA, 62 bp, Homo sapiens
tgagtcggagtctcactcccagtctcacccaggctggagtgcaatggtacgacctcggctca

SEQ ID NO: 833 - DNA, 76 bp, Homo sapiens
cagtcctttgtcagagctacatgttgcaaatattagtatctcctcttttgtagcatgtcttctgattttctttatg

SEQ ID NO: 834 - DNA, 66 bp, Homo sapiens
gggcccgccccgcccccacagtcactgaagcccgactcagtctctgagtgggtgggcggcaggtcc

SEQ ID NO: 835 - DNA, 116 bp, Homo sapiens
gtgtaaagtagaggtagataacagtacctatattacacagttattatgaaatgtatgtaaatatgtatgtacataaataaagtgttgtcaatactgtatatagcttagcttaatgc

SEQ ID NO: 836 - DNA, 96 bp, Homo sapiens
gtcttctgactccagtgactttgtgctgtcttcatgataccagaagatttttttttaattctctcagaaagattatagtttagttattgaggagac

SEQ ID NO: 837 - DNA, 99 bp, Homo sapiens
tattagtttttttattttcataccaccagatgtctaacagttattagttttatttaaaactaaggctgactctggaagaggttgaattttgaactaatg

SEQ ID NO: 838 - DNA, 74 bp, Homo sapiens
ctgtgggacactcagtgcctcagcccatggaggctgccatggggtgacaatgggtcacgttcctgtcctcatag

SEQ ID NO: 839 - DNA, 58 bp, Homo sapiens
tgagacagggtctcactctgtcacccaggctggagtgcagtggtgtggtcttggctta

SEQ ID NO: 840 - DNA, 61 bp, Homo sapiens
gctctaaggcaaagtgcccttggcctgtttacagaacagagggagctgatgtggttggagt

SEQ ID NO: 841 - DNA, 84 bp, Homo sapiens
gtgtctcctgtgtgtaattggccctgtgagactgaccaagcatccaggctctgtttcatttcacagcctgctctcttagacaca

SEQ ID NO: 842 - DNA, 83 bp, Homo sapiens
tctaggcatacagatcggaaatgtggagcaaaacaaaatttttttttttttttttgagacacagtgtcgctctgtcacctagg

SEQ ID NO: 843 - DNA, 68 bp, Homo sapiens
agcagatattgtgtgatagagtttgtcagggaccacaagacagacacacactcagtggtacagctgct

SEQ ID NO: 844 - DNA, 121 bp, Homo sapiens
caggtatggtggcatgcctgtggtctcagctacctgagaggctgaggtagaaggatctcttgagccagggaggtcaatgcttcagtgatctgtgctcatgccactgcacgccagcctgggc

SEQ ID NO: 845 - DNA, 58 bp, Homo sapiens
tgagatggagtctcgctctgtcgctcaggctagagtacagtggcgcgatcttggctca

SEQ ID NO: 846 - DNA, 58 bp, Homo sapiens
tgagacagggtctcactctgtcacccaggttggagtgcagtggtgtgatcttggctca

SEQ ID NO: 847 - DNA, 111 bp, Homo sapiens
gaattgctgggtcgaatggtagttctgttttaagttctttgagaaattgccaaattgcttttcacagtggctgaacttatttacattgccaccagcagcgtataagcattc

SEQ ID NO: 848 - DNA, 101 bp, Homo sapiens
gtgacactgttctttcagtgtctcttgcagtctgtctctctcttggactcagacaggaatctaaggagacgaggatagaggacaaacctggaagatgtcat

SEQ ID NO: 849 - DNA, 76 bp, Homo sapiens
ggagtctcactctgtctcccagtggcgcaatctcagttcactgcaacctccgcctctcaggttcaagtgactctcc

SEQ ID NO: 850 - DNA, 85 bp, Homo sapiens
aagcctcagcctaccaagtagctgggattcaggtgcctgccaccacgcccagctaatttttatatttttggtacagatggggttt

SEQ ID NO: 851 - DNA, 80 bp, Homo sapiens
ggcaagtgtgagtggtgagccatacctggctaattttttatttttttagtacagacagggtctcatctgttgtacaggct

SEQ ID NO: 852 - DNA, 58 bp, Homo sapiens
tgagacagagtctcactctgtcacccaggctggagtgcagtggtgggatctcggctca

SEQ ID NO: 853 - DNA, 109 bp, Homo sapiens
gctgtctgctgatgcagcacaccgtcctttttttttttttttttttttttttgagacagggtctcgctgtgtcgctcggactggagcgcagtggcgcaatcacagctca

SEQ ID NO: 854 - DNA, 84 bp, Homo sapiens
cctttccctcactctctgcctctcctggggctctgtcccaccaaaaagggaaagagacagctgagggctgattgtggggtttgg

SEQ ID NO: 855 - DNA, 83 bp, Homo sapiens
tgagacagagtctcactgtcaccctggctggagtgcagtggcgtgatctctgctcactgtaacctctgcctcctgggttcaag

SEQ ID NO: 856 - DNA, 118 bp, Homo sapiens
cctgtctgggcaacagaacaaggcctgtctccgagtttattttattttattttgttttattttttaattaattaattatatattttgagacaaagtctccctctgtcacccaggctgg

SEQ ID NO: 857 - DNA, 81 bp, Homo sapiens
cgatcttgtgccatccactttgacttgatttggggaaacttgaagtggcatagtcagaaatgagactggacaggaaagtcg

SEQ ID NO: 858 - DNA, 83 bp, Homo sapiens
gtatgtatatatgtatatatgtatgtatgatgtatgtatatacttatatacacacacgtatgtatgtgacagagattgcatac

SEQ ID NO: 859 - DNA, 58 bp, Homo sapiens
tgagactgagtctcactctgtcacccaggctggagggcagtggcgagatctcagctca

SEQ ID NO: 860 - DNA, 74 bp, Homo sapiens
aggtgacagaccgagactctgtctcaaaaaaaaaaattttttttttgtatggataggtgtggtggtttattcct

SEQ ID NO: 861 - DNA, 68 bp, Homo sapiens
gtgatgtcatgagggtgaactccaggacctcctgtccttcaggacggtcccacagtctcactgaccac

SEQ ID NO: 862 - DNA, 109 bp, Homo sapiens
gtgtcagtgctacacagtttttaaaatttactatggctattgtcttttttttttttttaatagagatgagggtatcgccatgtttgttgcccaggctggtttcaaacac

SEQ ID NO: 863 - DNA, 90 bp, Homo sapiens
gaatggtcttgccctgatagtctgtttttttggttttctttttttttttttttgacaggatgagtagacaggcagattagggaaatgttc

SEQ ID NO: 864 - DNA, 58 bp, Homo sapiens; identical to SEQ ID NO: 637

SEQ ID NO: 865 - DNA, 121 bp, Homo sapiens
gctgggattacaggcgtgagccaccgtgcccagcgtttttttatttttgagacagtctcactctgtctcccaagttagagtgcagtggcatgatcttggcttactgcaacctccagctccc

SEQ ID NO: 866 - DNA, 102 bp, Homo sapiens
taatttggtggtatcaaatgaaacctgtagcaaaaataatcagatccatatttcattatatagtagtcattattgtgctatgtcgttgtgccaattaaatta

SEQ ID NO: 867 - DNA, 108 bp, Homo sapiens
ctataaccactgtcactcactgattcaccaaaaactggattaataattatctttttttaaaattttttatttccataggtttttggggaacaggtggcatttggtgag

SEQ ID NO: 868 - DNA, 58 bp, Homo sapiens; identical to SEQ ID NO: 605

SEQ ID NO: 869 - DNA, 115 bp, Homo sapiens
gtgaggtcaaggatccttgttttgcttgctgttgttatccatactccataaacatgtgctggaaggatggattggatgactcacttactcccagccatcggggttcaggacccat

SEQ ID NO: 870 - DNA, 75 bp, Homo sapiens
gatgtggaaactgccttctttggtgagtcaggatctcatggggtccttcaaactagctgagtcagtagcttcatc

SEQ ID NO: 871 - DNA, 116 bp, Homo sapiens
gcctcccaaagtgctggaattgcagatgtgagctaccgcgcctggccaagtttttttcttaattaaaaagggccaggtgtggtggcagcagctaccattttttagtatgtacatgc

SEQ ID NO: 872 - DNA, 101 bp, Homo sapiens
agctactggacatccatagcattcaagggatgtcagcctcactctaacacaccaaactcttgctgaattcatccaaccctgtgtgtctttactgagtggct

SEQ ID NO: 873 - DNA, 95 bp, Homo sapiens; identical to SEQ ID NO: 580

SEQ ID NO: 874 - DNA, 93 bp, Homo sapiens; identical to SEQ ID NO: 69

SEQ ID NO: 875 - DNA, 194 bp, Homo sapiens
atatacatatacacatacatatatatatacacatacatatacacatatatacatatatatgtatatgtatgtgtatatatatatgtatgtgtatatgtatgtatgtgtgtatatatgtatgtgtatatatatatagagagagagcttatatatatagagagctcatatatatatatatagagcctatatacata

SEQ ID NO: 876 - DNA, 60 bp, Homo sapiens
ctactgtatgcacgtggcatgtgtccatctgtcctcacagaggagactgtgcattggtag

SEQ ID NO: 877 - DNA, 92 bp, Homo sapiens
tgcaacatttatgcctaatagctattgaagcttttttttttttttttttttttgagatggagtttcactcttgttgaccaggcaggagtgca

SEQ ID NO: 878 - DNA, 77 bp, Homo sapiens
gggagcttaaaatactggggggaaatatgggaggcagaatctctcagtgcctgtgtagagtttttaaaatgcgaccc

SEQ ID NO: 879 - DNA, 58 bp, Homo sapiens
tgagacagagtctcactctgtcgctcaggctggagtgcagtggtgcgatctcggctca

SEQ ID NO: 880 - DNA, 58 bp, Homo sapiens
tgagctgagattgcaccactgcactccagcctgggtgacagtgtgacactctgtctca

SEQ ID NO: 881 - DNA, 84 bp, Homo sapiens
ttagcctggcatagtggtgtgttcctgcagtcccagctattcaagaggctgaggtaggaggatcatttgagcccgggaggttga

SEQ ID NO: 882 - DNA, 104 bp, Homo sapiens
gtcttttaggtccatgttttggtgcagattaggtcagaagtttctttctttttttttttttgaaacggagtcttgctctgttgtccaggctggagtgcagtggc

SEQ ID NO: 883 - DNA, 111 bp, Homo sapiens
gtacctgatgcttttatgggtaaaaattgctttcttgggagtaaaatcagtatcattctttattattgatatcccaaacaatcaagagtcttacgtattctttcttggtgc

SEQ ID NO: 884 - DNA, 58 bp, Homo sapiens
tgagacggagtctcactctgtcacccaggctggagtgcagtggtgcgatctcggctca

SEQ ID NO: 885 - DNA, 56 bp, Homo sapiens
gagacggagtctcactctgtcacccaggctggagtgcagtggtgcgatctcggctc

SEQ ID NO: 886 - DNA, 58 bp, Homo sapiens
tgagacagagtctcgctctgtcacccaggctggagtgcagtggccggatctcagctca

SEQ ID NO: 887 - DNA, 70 bp, Homo sapiens
cctgagtagctgggattacaggcgtgtgctatcacgcccaactaatttttgtatttttagtacagacagg

SEQ ID NO: 888 - DNA, 93 bp, Homo sapiens
tttatgtacatatttatggactatgtatgtatatatataaagatatatctatctatatatatataaagatatatctatctatatatatataaa

SEQ ID NO: 889 - DNA, 84 bp, Homo sapiens
cctagaagtctggagggtgacatctgaccagcagacaaatttttttttttttgaggcggagtctcgctctgtcacccaggctgg

SEQ ID NO: 890 - DNA, 58 bp, Homo sapiens
tgagacagagtctcgctctgtcacccaggctggagtgcagtagcgcgatctccactca

SEQ ID NO: 891 - DNA, 73 bp, Homo sapiens
tggctccaggctaacactgggggttgtctacagagtgtcctgtgatgtgaactgtctgtgggtctctcagcca

SEQ ID NO: 892 - DNA, 121 bp, Homo sapiens
gtgtgtatgtgtgtgtatatgtatatatacgtatgtgtgtgtatatgtatatatacatatatgtgtttatatgtatatatacgtatatatgtgtatatgtgtatatacgtatatatacaca

SEQ ID NO: 893 - DNA, 69 bp, Homo sapiens
tactgcacaagcgctggcactgccctaccccatgagttctacaaggggagtgcaatgttgtatggggta

SEQ ID NO: 894 - DNA, 117 bp, Homo sapiens
ttgagacagtccttaaagcagggttcttcagattgtgggtcataaatttattatggaagagatgagagactgcacattgcaagaatgagtattgtttttttggaatttttgattcag

SEQ ID NO: 895 - DNA, 126 bp, Homo sapiens
ggtcgagtgtgaataacatgtcagtctgaggtcctcagacactgagagtttacactcactcacaggctcttctttatgggcctctactggtgctcatgagagagacccctagtttgtaagtggaac

SEQ ID NO: 896 - DNA, 222 bp, Homo sapiens
tgtgtatatatgtgtatatatgtgtatatatgtgtgtatatatgtgtatatatgtgtgtatatatgtgtatatatgtgtatacatatgtgtatatatatgtgtacatatgtatgtgtatatatatgtgtatatatgtgtatatatgtatatatgtgtatatatatgtgtatatatatatgtgtgtgtgtgtgtatatatatatatatatatatataaaatgc

SEQ ID NO: 897 - DNA, 70 bp, Homo sapiens
gcatatatatatacatatatatacgtatatatatgtgtatatatatgtatatctatgtgtgtgtatatgt

SEQ ID NO: 898 - DNA, 89 bp, Homo sapiens
ggagaatcatttgaacccgggaggcggaggttgcagtgagcagagactgtgcaattgcactccagcctgggtgacaagagtgaaactcc

SEQ ID NO: 899 - DNA, 61 bp, Homo sapiens
gtatatatgtatgtatacgtatgtatatctcacttgtatgtgtgtatatatatatatacac

SEQ ID NO: 900 - DNA, 94 bp, Homo sapiens
gctattagttacttggctgatatgactggccaggcgagtaggttcctcctttgttctctggactctcagtgtctgtgtcccccaagctgctggc

SEQ ID NO: 901 - DNA, 92 bp, Homo sapiens
cactcagaaccatgtctggcacctagtagactgtataaatgttaatttttattaatgtacagggactgggagagggaggcaagtttgcagtg

SEQ ID NO: 902 - DNA, 58 bp, Homo sapiens
tgagacggagtctcgctctgtcgctcaggctggagtgcagtggcgggatctcggctca

SEQ ID NO: 903 - DNA, 115 bp, Homo sapiens
gtatgtcctttgtatacagaatatagttaggtcttacttctgactttttttttttttttttttttttttttaatggaggtggagtcttgttctgttgcccagggttggagtgtac

SEQ ID NO: 904 - DNA, 58 bp, Homo sapiens
tgagacagagtctcactctgtcacccaggctggagtgcagcggcgggatctcagctca

SEQ ID NO: 905 - DNA, 103 bp, Homo sapiens
ggatggactcagctatctcagcatattgaaacctgactcactgtgactcttccttgacagtgggaacagtcttcccttttgtatctgaggaagctagtcttct

SEQ ID NO: 906 - DNA, 83 bp, Homo sapiens
cagacgcggaacacatggatatggaggactgactgtatatatatatatagtggggtgtgtctgtgtgcatgtgtgtgtgtgtg

SEQ ID NO: 907 - DNA, 68 bp, Homo sapiens
tcactctgtcactcagactggaagtgtggcggcatgatcatagctcactgcagtcttgactcaagtga

SEQ ID NO: 908 - DNA, 113 bp, Homo sapiens
gcctctgttggctgaaagtccttgtagagctctctatgtctccaatttttttcacttcttttttttttttgagacaaggtctcgctctgtcactcaggctggagtgcagtggc

SEQ ID NO: 909 - DNA, 107 bp, Homo sapiens
tgctaccaaagggagatcctaatgtatatggttgttgaatgtttcttaaaaatgaaacaacaaaggcatcaatttacatcaaactgaaatacacttttgcagtagca

SEQ ID NO: 910 - DNA, 149 bp, Homo sapiens
tgtgtgtgtttattttatctttctataatgtgattttatatatttttattgccacattgtaattggtcatattatgggatacaatttaatgtttcaatacatatatatatatatgtcttataatgatgatcaagtccaggtgtttagta

SEQ ID NO: 911 - DNA, 95 bp, Homo sapiens; identical to SEQ ID NO: 68

SEQ ID NO: 912 - DNA, 93 bp, Homo sapiens; identical to SEQ ID NO: 69

SEQ ID NO: 913 - DNA, 102 bp, Homo sapiens
tcctgaaactcttcatcttatggtggaagtagtatgtttagtttaaaatctttcggcactcatctagggactgagtccactatgtctttgaattttaaagga

SEQ ID NO: 914 - DNA, 112 bp, Homo sapiens
atattttattagcacttttaagaatacatttttataatttatttataattcaccactaacatgtggtgaattggtaaatttttataaatgtccaatatgcatgagagaatat

SEQ ID NO: 915 - DNA, 133 bp, Homo sapiens
tgtgtgtgtatgcatgtgtatatatatatacacacatatatgtgtatatatatacacatatatatgtatatatgtgtatatatgtgcgtatatatatacacacatatatattctctcacatatatcttctgta

SEQ ID NO: 916 - DNA, 116 bp, Homo sapiens
ttgtatatattatatgtatagtggatacataaaggatatatgtatacacatacatttttcattttatctatatgtgtatatataaggatatgtagtatttcattttatatatatag

SEQ ID NO: 917 - DNA, 76 bp, Homo sapiens
atatatatcaatgatatatatgtatatatcaatatgtatattgatatatgtatatgtatacatcaatgatatatat

SEQ ID NO: 918 - DNA, 117 bp, Homo sapiens
taggattgctttagctattcgggctcttttttggctccatatgaattttagaatactttttttctaattctgtgaagaatgatattagtagcttgataggaatagcattgaatctta

SEQ ID NO: 919 - DNA, 111 bp, Homo sapiens
tgtgttcatttgcttaggactatggcctccagctctcttcacgttgctgcaaagaatattatttcattctttatgtggctgtgtagtattccatggtgtctatgtaccaca

SEQ ID NO: 920 - DNA, 95 bp, Homo sapiens; identical to SEQ ID NO: 68

SEQ ID NO: 921 - DNA, 93 bp, Homo sapiens; identical to SEQ ID NO: 69

SEQ ID NO: 922 - DNA, 107 bp, Homo sapiens
acatgaagcccactgtgtgttgagtgtatatatatatatatatgtatatacatatatgagtatatacatatatatgagtatatacatatatatatatgaatctctgt

SEQ ID NO: 923 - DNA, 62 bp, Homo sapiens
gccaatgaaatctctctctgtgtctctgagctgcctggagcaggaggaggggtgtcagaagc

SEQ ID NO: 924 - DNA, 87 bp, Homo sapiens
gctggctttgcctctggggctgtgtgaccctgggccagtcactcagactctctgggccgcagaatccccattaggtacaagaagggc

SEQ ID NO: 925 - DNA, 71 bp, Homo sapiens
gaaggtgtgtctgtttctctcagggtttccagccctgccctaagtttgagaactccaggcaggcggcctcc

SEQ ID NO: 926 - DNA, 74 bp, Homo sapiens
gtatgtgtagatataggtttatatactttaagtgtatatatatactttatataaatgtctgtatatatatatat

SEQ ID NO: 927 - DNA, 87 bp, Homo sapiens
agtataattggtgtgtgtgtgtatgtgtatatatatatataatttatagtatatgtatatgtatacacatatatatcagttgatgct

SEQ ID NO: 928 - DNA, 95 bp, Homo sapiens; identical to SEQ ID NO: 68

SEQ ID NO: 929 - DNA, 93 bp, Homo sapiens; identical to SEQ ID NO: 69

SEQ ID NO: 930 - DNA, 73 bp, Homo sapiens
gtttgtttgagacggagtctcactctgtcacccagcctggagtgcaatggtaggatctcggcttactgcaagc

SEQ ID NO: 931 - DNA, 95 bp, Homo sapiens; identical to SEQ ID NO: 68

SEQ ID NO: 932 - DNA, 93 bp, Homo sapiens; identical to SEQ ID NO: 69

SEQ ID NO: 933 - DNA, 96 bp, Homo sapiens
ttggagatgaactcataaggatatcaaaagtgtcttcacgtgctgagtcagtttctgagtgggggggtcacagtttgagttgagtcagttctttgg

SEQ ID NO: 934 - DNA, 74 bp, Homo sapiens
gtgtgtgtgtgtgtgtgtgtgtgtgtgtgtcccttaacacagggggcaatgactcttatcactttcaattacat

SEQ ID NO: 935 - DNA, 113 bp, Homo sapiens
gcgtgtgaggctgtatgtgccggactgctgcaagtgagaactctgtgtctgtgtgtgcctcatccgcacaaaacgatgtgaagaagagaagcagatgggtcaacaggatgact

SEQ ID NO: 936 - DNA, 100 bp, Homo sapiens
gctgtaacactggagcccttggccacttagaaggcctgagtttttttatattttccaccaagctgctgattctaaactgtggtggggtttctttcatggc

SEQ ID NO: 937 - DNA, 82 bp, Homo sapiens
gacaggggacagaagggccagagcacagctgatgttcccagttacccctgggcctttctctctgtgtctgacctgtcaccct

SEQ ID NO: 938 - DNA, 73 bp, Homo sapiens
tggtgactgtcactgtctgtggggtcgtgaccctgccatcagatggcaatccccccagtgcagggcagcacta

SEQ ID NO: 939 - DNA, 91 bp, Homo sapiens
gagttagcaatattatcagtctttcagcaacagcaagtcctaggtgcctccctctggaattagtctttgatgagtgttattgacttagctc

SEQ ID NO: 940 - DNA, 130 bp, Homo sapiens
tatatatatacacacagaatatgtatatatattatatatatgtgtgtatgtgtgtatatatatatatacacacagaatatgtatatatattatatatatgtgtgtatgtgtgtatatatatacatatttt

SEQ ID NO: 941 - DNA, 123 bp, Homo sapiens
ttgttcttttggcttagaattgacttggcgatgcgggctcttttttggttccatatgaaatttaaagtagttttttccaattctgtgaagaaagtcattggtagcttaatggggatggcattg

SEQ ID NO: 942 - DNA, 65 bp, Homo sapiens
atgtgagtctctcataggcagcatataattggtgtttgtgtgtgtgcctgtgtctgtgtgtccat

SEQ ID NO: 943 - DNA, 115 bp, Homo sapiens
gcctccagctttgttctttttgcttaggattgtcttggctatgtgggctcttttttggttccatataaaatgtaaagtagttttttccaattctgtgaagaaagtcgttggtagc

SEQ ID NO: 944 - DNA, 104 bp, Homo sapiens
ctggccaaggccactagctagtaaatgacagagcaaaatatttgagtccaaagcatctctcttagtcactctgttatactgcctccagaagtaggtcaaaacag

SEQ ID NO: 945 - DNA, 108 bp, Homo sapiens
tatcctgaacataaaaatatttatacattatatacttatgtgtgtatatatatgtgtatatgcatatactcatatacatgtggaatcattggactttagaaatggata

SEQ ID NO: 946 - DNA, 81 bp, Homo sapiens
aggcgagcaggctggtggacacaggacagacagagcacaaggacatcagttcaatctgcttccaccccacgtgactgtctc

SEQ ID NO: 947 - DNA, 106 bp, Homo sapiens
tatattaagcagtttataattcactctctttgctcccttcaggtctgctcctgcgtctatgacagcacacagacagcactgaagtgcaatggatctgcataatgtg

SEQ ID NO: 948 - DNA, 100 bp, Homo sapiens
ggagaaccttgtctcaatacaaaaaaaaaaaaaaaagaaagaaattatcaacccccatccttttttttttttttttttttttttggtatgaggtttctgc

SEQ ID NO: 949 - DNA, 120 bp, Homo sapiens
actcagtatacctacgaatagaagtttccttgccctaggtcactagtggcatagcagagaactgactgagctctctaaggacctaaagtatttataactcttatagtatttctgcaaggt

SEQ ID NO: 950 - DNA, 164 bp, Homo sapiens
gtatgtgtgtatatgtatacgtatatacatatatgtgtgtatatgtatacgtatatacatatatgtgtgtatatgtatacgtatatacaatgtatgtatatatgtatacatatacatacatatatacatgcatgtatgtatatgtgtatatatacatacatata

SEQ ID NO: 951 - DNA, 74 bp, Homo sapiens
tatacacatatatgtatatatacacatatacatatatgtatgtatgtatgtgtatatatgtatgtatgtgtata

SEQ ID NO: 952 - DNA, 69 bp, Homo sapiens
agtatacatagtacagattatgtagaatattctatatatttattctatatattctatactatatgtatt

SEQ ID NO: 953 - DNA, 111 bp, Homo sapiens
agaggccatggtggctttccctggaccagaacagtcagaattcagtgaacactgcattaaaccctgcactgttttcattctgggcaccatgtcataggcaccattggatct

SEQ ID NO: 954 - DNA, 68 bp, Homo sapiens
attttgcaaaatatggcaggccagtaggggagacatctctgtgtgtgtgtctgtctgtcttgcagagt

SEQ ID NO: 955 - DNA, 114 bp, Homo sapiens
tatatatacatatatttatatatgtgtatacatatagatacacatatatgtctatatgtatatacatatatgtgtgtctctatgtatacacatatataaatatatgtatatata

SEQ ID NO: 956 - DNA, 95 bp, Homo sapiens; identical to SEQ ID NO: 68

SEQ ID NO: 957 - DNA, 93 bp, Homo sapiens; identical to SEQ ID NO: 69

SEQ ID NO: 958 - DNA, 83 bp, Homo sapiens
gtgagtctagaatacagttttcactttcgtactcagtgcatattccactgagtacagactgaggaggtagtattattaataac

SEQ ID NO: 959 - DNA, 114 bp, Homo sapiens
ccaggaatgcaaacatacagagttccttgcctcagagacctgacagtacagagggaccagcacaagccgatcatctgaacatgttgcagctctgggcaatgatggcgtctatgg

SEQ ID NO: 960 - DNA, 64 bp, Homo sapiens
gggagaacatacggtgggagttaggcaggtctgggctcagtcactcactgactctcagtctccc

SEQ ID NO: 961 - DNA, 105 bp, Homo sapiens
atgtaaatctctggccacatgtaaatccctcagtggtcagagagccactcagtggctctctggccactgagagatttacgtgtgactttgctcaagtagtgacat

SEQ ID NO: 962 - DNA, 112 bp, Homo sapiens
actatgtatcatatgtgtatatatatgtgtgtgtgtatatattatatattatataatatatattatatataataatacatatattatatatatatacatatttgagacaggt

SEQ ID NO: 963 - DNA, 95 bp, Homo sapiens; identical to SEQ ID NO: 68

SEQ ID NO: 964 - DNA, 93 bp, Homo sapiens; identical to SEQ ID NO: 69

SEQ ID NO: 965 - DNA, 58 bp, Homo sapiens; identical to SEQ ID NO: 315

SEQ ID NO: 966 - DNA, 83 bp, Homo sapiens
ctgagtcagcatgtggtttagctggcctgtccctgtctctgtgtggggactcagaatggttgagacagacccatctggttctg

SEQ ID NO: 967 - DNA, 95 bp, Homo sapiens; identical to SEQ ID NO: 68

SEQ ID NO: 968 - DNA, 93 bp, Homo sapiens; identical to SEQ ID NO: 69

SEQ ID NO: 969 - DNA, 74 bp, Homo sapiens
ttgtttttttgagatggagtctcgctctgtctctccaggctggagtgcagcggcgcaatctcggctcactgcaa

SEQ ID NO: 970 - DNA, 99 bp, Homo sapiens
tcctaggtattttattctctttgtagcaattatgaatgggagttcagtcatgatttggctctctgtttgtctgttattgatgtataagaatgcttgtga

SEQ ID NO: 971 - DNA, 73 bp, Homo sapiens
gagttttttttttttttttgaccgagtctcactctgtcacccaggctggagtgcagtggtgtgatctcagctc

SEQ ID NO: 972 - DNA, 118 bp, Homo sapiens
gatttaatgttctgtaaatgtctgtaaggttcatttggtctagttttttttttatatttatttatttattaaagagagtctcactttgtcacccaggctggagtgcagtggcaggatc

SEQ ID NO: 973 - DNA, 110 bp, Homo sapiens
gacttgcttacctaaaccaatgcaaattattttattttggtaagcttaataatctgataaataattatcattattagaatgaagatatagaaagcagtggttttcaagtc

SEQ ID NO: 974 - DNA, 118 bp, Homo sapiens
gatctcctgaatccttgttcattattccccatgacactcagttcttgctttgtaaacaactatggagattgtagaagctcatatgaaaagggggtgcaatgaacaagaagtgtagatt

SEQ ID NO: 975 - DNA, 74 bp, Homo sapiens
actagtcagtctccctgtctcagtatcttcaggtgtgcatatacctgctagaggttgtccagggtggggacagt

SEQ ID NO: 976 - DNA, 86 bp, Homo sapiens
cagcctgggaaacacagtgagacccatctctctttttttttttttttttttcctttagactgagtctcactctgtcacctaggatg

SEQ ID NO: 977 - DNA, 71 bp, Homo sapiens
gtgagtgtgtgtatgtgtgtatatatgtatatgtgtatacatgtctgtatatatacacatacatacctctc

SEQ ID NO: 978 - DNA, 120 bp, Homo sapiens
aagatgaaaaagttccagggatgggtagtggtgatgattgtacaactttatgaatatatttaacatcacttaactgtacacttaaaatggtcacgattatagattctatgctgtgttttc

SEQ ID NO: 979 - DNA, 120 bp, Homo sapiens
ctcattgtgactggttgtcctgctttcctcaggttttcttccatcatctgtgacagcttcttgatctgtccccaggtaggtggctgtatttgacgggtgttgctcatgacagttgaggtc

SEQ ID NO: 980 - DNA, 100 bp, Homo sapiens
catgcatttagctaaagaacatggggaactgacattgcaaaagacagattttttttctctttaaagtgtcatgatttccttcagatgtagctaggtcctg

SEQ ID NO: 981 - DNA, 81 bp, Homo sapiens
atagcagagatgactcactgtctcacacatgggtggcaacattcaccgcagagcacatgaaaaaaaatccatgtctgctgt

SEQ ID NO: 982 - DNA, 58 bp, Homo sapiens
tgagacagggtctcactctgtcactcaggctggagtgtagtgatgtgatcttggttca

SEQ ID NO: 983 - DNA, 56 bp, Homo sapiens
gagacagggtctcactctgtcacccaggctggagtgcagtggtgcgatcctagctc

SEQ ID NO: 984 - DNA, 67 bp, Homo sapiens
gagttggagtcagatgtttcacagattaccttgtttggcctgttctgtgtgactctggctgtcactt

SEQ ID NO: 985 - DNA, 119 bp, Homo sapiens
ggtagtatttgagttggccctcagagaaagaagctgcatgtgatgttgggacgttcactctctctcagggattgggcatctgctgcacatgaggaggacggggtgactcagtccctgcc

SEQ ID NO: 986 - DNA, 86 bp, Homo sapiens
tgaactagctgggtgtaggtggcacatgcctgtcccagctacctgggaggctgaggtaggaggatcacttgagcccaggaggttga

SEQ ID NO: 987 - DNA, 80 bp, Homo sapiens
gacagagtgagaccctgtctcaaaaaaaaaaaacgtgttttgttttttttttttttttgagacggagttccactcttgtt

SEQ ID NO: 988 - DNA, 96 bp, Homo sapiens
ctttcaatgataaggagagatcttgctggtgatttgggagatgaattgggcaagtataactcagtccgtgtctctctctatcttgagagccagtga

SEQ ID NO: 989 - DNA, 76 bp, Homo sapiens
agagaacgacctggatgttttctgtgaactgacaaacacagacactcacacagaatctatgtccactacgtactct

SEQ ID NO: 990 - DNA, 105 bp, Homo sapiens
ttggtgaaaaatagaatatcttcaaacaatcagctaccaagaaggttgaattattcaatatttattgagggcctattgtatattagacactgttctggcactcag

SEQ ID NO: 991 - DNA, 139 bp, Homo sapiens
acttgttattgtctgtcttttttattttagtcatcctagtgggtatgaagtgatatctcactgtggttgtgatctgcatttccctgaggactaataacgttgagtatctccttatgtacttattgccatttctattata

SEQ ID NO: 992 - DNA, 66 bp, Homo sapiens
ccaggcatggtgatgcacacttgtggcccctcgggaggctgaggtaggaggatcacttgagccagg

SEQ ID NO: 993 - DNA, 58 bp, Homo sapiens; identical to SEQ ID NO: 315

SEQ ID NO: 994 - DNA, 108 bp, Homo sapiens
tggggcagggagagctgcacttaggaaggtggctagggagttgtatatcattattattattactattactattattatttttgagacggagtctctctctgtcaccca

SEQ ID NO: 995 - DNA, 80 bp, Homo sapiens
tgtgtgtatgtatgtgcatatctatatctatatctatatagatagatatagatagatagatagacagatacatacatata

SEQ ID NO: 996 - DNA, 72 bp, Homo sapiens
tgtatgtatctgtctatctatctatctatatctatctatatagatatagatatagatatgcacatacataca

SEQ ID NO: 997 - DNA, 75 bp, Homo sapiens
gggtggtatcaggagactttgttttgttttgtttttttttttttttttttgagacagagtcttgctctgtcaccc

SEQ ID NO: 998 - DNA, 110 bp, Homo sapiens
caggctcagtgttattcaaagtgagtcatatttttgtctgatgttaagaatgcaagaaaaatattaattttaaataaaaataatactcacaatcttcacactcaggcttg

SEQ ID NO: 999 - DNA, 90 bp, Homo sapiens
ggaaattagagtagctaaaatggtacctggatggaatttgtaggcaatgcgctcacaggcagtctgactggcagttattcacaaaggtcc

SEQ ID NO: 1000 - DNA, 112 bp, Homo sapiens
tgtacagaagctcaattacttgtcaacacagtaaattccaaaaggcaatttgtaactatatttattcaaaagtccaaaattgctaaagggagggatgggagttaagcttaca

SEQ ID NO: 1001 - DNA, 94 bp, Homo sapiens
ctgtgccctgaagatgtcaagcactcagtctgtgggtcactgggctattcccccagcctacatcacaagcatttaagtcttgtttccaggccgg

SEQ ID NO: 1002 - DNA, 76 bp, Homo sapiens
tgggttgtcagagaggagctattcctttttttttttttttttttttttttgagacggagtctcgctctgtcaccca

SEQ ID NO: 1003 - DNA, 58 bp, Homo sapiens; identical to SEQ ID NO: 605

SEQ ID NO: 1004 - DNA, 87 bp, Homo sapiens
ttctgtagctgcttcagtgtttccctagctctcccagcctctcactctgtccaaggtcaagagaaaggaaagattgagatagtagaa

SEQ ID NO: 1005 - DNA, 89 bp, Homo sapiens
tcctgtggtccctcctgaatgcgtaagtaaagaagctctgattcctttatcactggaaacagagagagcagtcagaggggtgtgcaggg

SEQ ID NO: 1006 - DNA, 87 bp, Homo sapiens
gcatttggggagaggagatggggagcagcctgtggggcagcagcaaagctgccaaacttctgtttttcatgtactccatgtaagtgt

SEQ ID NO: 1007 - DNA, 117 bp, Homo sapiens
gataaggattgtcttggctataagggctctctttttggttccatatgaaatttaaagtagtttttttctaattctgtgaagaaaagatagggtttttgtgtgggcatcatttttgtt

SEQ ID NO: 1008 - DNA, 101 bp, Homo sapiens
tacaaaaattaaccggtcatgtagttccagctactagggaggctgaggtaggaggatcgcttgagctcaagaggttgaggctatagttggccttgagtgtg

SEQ ID NO: 1009 - DNA, 119 bp, Homo sapiens
attagattctgggggttgtcacacaatcctgtcaatatattaatatcattgaattattatatactttaaatggatgagtggtatagcatgtgaattttgcctcaataaagctgtctagt

SEQ ID NO: 1010 - DNA, 138 bp, Homo sapiens
tatgtgtgtgtatatatatatatgtgtgtgtatatatatatatatgtgtgtgtgtgtatacatatatgtgtgtgtgtgtgtatatatatatatgtgtatatatatatatatatatatatacacacatacatttgttta

SEQ ID NO: 1011 - DNA, 80 bp, Homo sapiens
gctttatgtgcatgctggctacctgggctctgtttagttcagagactgagtctacacagtgagcagtcaacatataatgc

SEQ ID NO: 1012 - DNA, 132 bp, Homo sapiens
gggcttcaacacagtgagctctcaggaatggctgcattttattctgactgtgtttccagaatcccagtcctctctctctcactgaccccgaagataagcattggaaaggggagctttggggaaatgaatctg

SEQ ID NO: 1013 - DNA, 58 bp, Homo sapiens
gtcgcaggctcagtctcagtgattgtatgctgtggtcagctgtttttgtttttgtgac

SEQ ID NO: 1014 - DNA, 100 bp, Homo sapiens
tgagacaatgcctctgtcaggggaatgatgtcgtgggacctcctcttattgagattagcctctcagaagggtgtctgctcattgccttttaagcagatgg

SEQ ID NO: 1015 - DNA, 99 bp, Homo sapiens
gagcatggtggcaggtgtttaaagtctcagctagtcaggaggctgaggtggtaggatctcttgaggctgggaggttcgagattgcagtgagccatgatc

SEQ ID NO: 1016 - DNA, 110 bp, Homo sapiens
agacatatagtgtgaggtatggatttagccagctatcacaatattattaataataaacaatttattttatttaaatggctaaatccatccatcctttcattgttctttct

SEQ ID NO: 1017 - DNA, 104 bp, Homo sapiens
gcaattcaatctgtttggtgcatttctacttatatatttttaaaaatatgtgtattttataaatactggtgtatagtttttgaatgctcagaagattgaaaggc

SEQ ID NO: 1018 - DNA, 78 bp, Homo sapiens
gactactggtgcctgccaccacacctggctaattgtttgtaaattttttagtagagatggggtttcaccatgttagtc

SEQ ID NO: 1019 - DNA, 114 bp, Homo sapiens
tgggtgtgtgcacatgtgtgttcaagtttatgtgtatataaatatatataaatatatttatatattctactggcacatatactacctggcacacagtatataggtatacaaata

SEQ ID NO: 1020 - DNA, 90 bp, Homo sapiens
tatatatatatatacaagtacatatatatagtatatatatatacaagtacatatatatagtatatatatatacaagtacatatatatata

SEQ ID NO: 1021 - DNA, 184 bp, Homo sapiens
atacaagtatatatatgtacttgtatatatatatatatatactaatacaagtatatatatgtacttgtatatatatatatacactatatatatgtacttgtatatatgtatatatactatatatatgtacttgtatatatatatactatatatatatgtacttgtatatatatatactatatat

SEQ ID NO: 1022 - DNA, 129 bp, Homo sapiens
gtacatatatatagtatatatacatatatacaagtacatatatatagtgtatatatatatatacaagtacatatatatacttgtattagtatatatatatatatatacaagtacatatatatacttgta

SEQ ID NO: 1023 - DNA, 116 bp, Homo sapiens
tctctctttacatgtgtataatgtgtatatgtatttctgtaaaacatatatatgtatatatgcatatgtatgtgtgtatatatatgtatatacataagttagtgtcaataagtaga

SEQ ID NO: 1024 - DNA, 111 bp, Homo sapiens
tttgtttctttgttgaggataagtgcattatgtattgttattaatatttaatttttaacaacaattttattaggtactggtgctacttcattttatagattaagggacaga

SEQ ID NO: 1025 - DNA, 126 bp, Homo sapiens
ctaacctccagtgtgatggcattagcaggtggggcctttgggagatttttttttattatactttaagttttagggtacatgtgcacattgtgcaggttagttacatatgtatacatgtgccatgct

SEQ ID NO: 1026 - DNA, 60 bp, Homo sapiens
gtgtcctctgtggagcaggacactgggggcctcagtggctctgtgtcacatgactgacac

SEQ ID NO: 1027 - DNA, 84 bp, Homo sapiens
cagcacccactcccagagcccctggaactctggcccaaggctctctgactgactccttcccagatcttcttggcttagtggctg

SEQ ID NO: 1028 - DNA, 92 bp, Homo sapiens
acagcatttatatacattttatatatatacatacacacatatacacacatatatgtgtgtatgtatatatataaaatatatataaatactgt

SEQ ID NO: 1029 - DNA, 69 bp, Homo sapiens
gtctcctaatatgatgcaccaggaaggatgcaacgtcatgaacgttgtattcttttgtattcaacagac

SEQ ID NO: 1030 - DNA, 79 bp, Homo sapiens
gctgctgatctgacaggagacagagctcaggcagtaatactcatttgcctaccgctcacctcctgccgtgcagctcagt

SEQ ID NO: 1031 - DNA, 83 bp, Homo sapiens
gttacaaggtcaagctcctaaggacatttttcaacatgtggtctctgggcaagatgaaagagtggacagttgatctgagtaac

SEQ ID NO: 1032 - DNA, 58 bp, Homo sapiens
tgagacggagtctcgcactgtcgctcaggctggagtgcagtggtgtgatctcggctca

SEQ ID NO: 1033 - DNA, 101 bp, Homo sapiens
tacttggggaccaatctgttcaccttctctatctccatttcaaatgcatcactttgatagaagtgagagagaggatgtgtgtaggctaaactgtacaagta

SEQ ID NO: 1034 - DNA, 57 bp, Homo sapiens
tgagacgagtctcgctctgtcacccaggctggagtgcagtggcgtgatctcggctca

SEQ ID NO: 1035 - DNA, 89 bp, Homo sapiens
tcaattttatatggattctagccatataaaaacttgtgattttatatatagtaaactttttaaaaatggctgggattttgtgaaagtgg

SEQ ID NO: 1036 - DNA, 68 bp, Homo sapiens
gtatgtaatgtgtatatgtttatatacatgtatattcacatgtcaatatatgtctatatattacatat

SEQ ID NO: 1037 - DNA, 60 bp, Homo sapiens
cctgcctctcaggcactctgtcccagggagaacatgggcaggggtgtctgaaggccctgg

SEQ ID NO: 1038 - DNA, 110 bp, Homo sapiens
tgatctgacttgtattttaagagcatcactctggttgctaaatatgaaatcacagagattttggagtcaagtgtagtaatccaagtgagggaagatactgtcttggctca

SEQ ID NO: 1039 - DNA, 112 bp, Homo sapiens
atttgcctagactgagaatatgttcccgttagaggtaaaagcagaccccagaatatcctgtatgagactctcacaaacatacatatttgccattcatcagcaaggatcaagt

SEQ ID NO: 1040 - DNA, 103 bp, Homo sapiens
tagcatttgccattgcctcctagaaggtgtggtaatattttattaaatgctaacattgtatatgaaatattttagcaatacctttatgcttttgatgatgtta

SEQ ID NO: 1041 - DNA, 95 bp, Homo sapiens
gcaggctcggtctcagtgattgtatgctgtggtcagctgtttttgtttttgtgagaccttgctttcttgtttactgtcctgggacagatgtctgt

SEQ ID NO: 1042 - DNA, 69 bp, Homo sapiens
gtctacggataatcctctgtcgtccgtctgcggagccctaacctgacagaagacagagaggtgctgagc

SEQ ID NO: 1043 - DNA, 110 bp, Homo sapiens
ctcagcaaaactattagcacaagtcatgatgacacctacctcagctataatattgtttttattacaaattgagggaatgatctagatttgtgtacagagtcaaaatgtag

SEQ ID NO: 1044 - DNA, 58 bp, Homo sapiens
tgagtcagggtctcactctgtcacccaggctggggtgcactggcgtgatctcagctca

SEQ ID NO: 1045 - DNA, 77 bp, Homo sapiens
tgtcatatatatatgtgtatatatgtgtgtgtatatatgtgtgtatatatatgtgtgtatatatatgtgtgtgtata

SEQ ID NO: 1046 - DNA, 83 bp, Homo sapiens
aaagtgtgggtgtgtgtgtgtgcatgttgtatatatatgtgtgtgtgtgtgtgtataaatatatatatatatatatatatttt

SEQ ID NO: 1047 - DNA, 64 bp, Homo sapiens
tcacatgagtcttttaagtctgggtctggaggttggagacagaagtcagagattggtagtgtga

SEQ ID NO: 1048 - DNA, 107 bp, Homo sapiens
agtcatcctcatgggtttggtgataatatcacattgtaattttaattttcattttttgttgttaattaataagatcatgtgtgtatttactggccatttggatgtct

SEQ ID NO: 1049 - DNA, 58 bp, Homo sapiens; identical to SEQ ID NO: 315

SEQ ID NO: 1050 - DNA, 95 bp, Homo sapiens; identical to SEQ ID NO: 1041

SEQ ID NO: 1051 - DNA, 95 bp, Homo sapiens; identical to SEQ ID NO: 68

SEQ ID NO: 1052 - DNA, 93 bp, Homo sapiens; identical to SEQ ID NO: 69

SEQ ID NO: 1053 - DNA, 76 bp, Homo sapiens
actaccatgcctggctgcagaggattttttgttttgtttttgagacagggtctcactctgtcacccaagctggagt

SEQ ID NO: 1054 - DNA, 68 bp, Homo sapiens
gggtacatgagtttgggagagagaaggggtgagtggctcatggactttttgtttttctaaattagccc

SEQ ID NO: 1055 - DNA, 58 bp, Homo sapiens
ggcaatgagaggaaagtgagcacagtagcgtctgtgtctgggggagcctctcagagtc

SEQ ID NO: 1056 - DNA, 82 bp, Homo sapiens
gcataaggtaactttgtggagtgatgggcatgtatatacatatcatatatatattcatcatatatatatatattttagaggc

SEQ ID NO: 1057 - DNA, 71 bp, Homo sapiens
tttcaagaggaaaataactgctagcatttggttagctatttcgactaagtgttatctttttttttttgaga

SEQ ID NO: 1058 - DNA, 74 bp, Homo sapiens
atatatacgtatatgtatgtatatatgtacatgtaaatacacacatatatacatacatacatatatgtacatgt

SEQ ID NO: 1059 - DNA, 68 bp, Homo sapiens
catatatgtatgtatgtatatatgtgtgtatttacatgtacatatatacatacatatacgtatatatg

SEQ ID NO: 1060 - DNA, 95 bp, Homo sapiens
cttgtcttggctatatgggctcttttttggtttcatatgaaatttaaagtagttttttctaaatctgtgaagaaagtcaatggtagcttgagggg

SEQ ID NO: 1061 - DNA, 152 bp, Homo sapiens
gattgtatctgtctatgagcaaaggaaacctgaaggaaccaagggcctggctggacagagttgtcatgtgtctgcctgtctacacttgctgtgcagaacatccgctcacctgtacagcaggcacagacaggcagtcacatgacaacccagcc

SEQ ID NO: 1062 - DNA, 96 bp, Homo sapiens
tgtgtatatgtatgtgtatatatgtatatatgcacatgtgtatatatgtatatatgcatgtgcatatatacacatgcatacatatatatacacaca

SEQ ID NO: 1063 - DNA, 95 bp, Homo sapiens; identical to SEQ ID NO: 68

SEQ ID NO: 1064 - DNA, 93 bp, Homo sapiens; identical to SEQ ID NO: 69

SEQ ID NO: 1065 - DNA, 58 bp, Homo sapiens
tgaggcggagtctcgctctgtcacccaggctggagtgcagtggcgtgatctcggctca

SEQ ID NO: 1066 - DNA, 103 bp, Homo sapiens
tgtttggctatcctggatctcttgcattttaatataaattttaagatatgattgcaaatttctataaaaatggcatctgggattttgaggattacattaaata

SEQ ID NO: 1067 - DNA, 73 bp, Homo sapiens
tgttttggcacccagtcgcaaacaccagaaaccttagggcctttgtggttctgcatctggatgtgcctttgca

SEQ ID NO: 1068 - DNA, 95 bp, Homo sapiens
tttatgcattcaagtctgtattactgtattaggtgaactcagtttattttttatatgtctaacattctaagatacttgatttgaatgttaataaa

SEQ ID NO: 1069 - DNA, 72 bp, Homo sapiens
tatatgtatatgtgtattatatgtatatatgtatgtataaagatatgtatgtgtgttatgtgtatatatata

SEQ ID NO: 1070 - DNA, 76 bp, Homo sapiens
tgatggaccgaagtgaggctttttaacccacaagtaacctttttatttttttgagacagtcttgctctgtctgtca

SEQ ID NO: 1071 - DNA, 101 bp, Homo sapiens
atttttctgaatgttggatcacaatatccttggaattaagtaagtttgtttttataataatgaccagcttttggactgtgcatttaacatatagcaaaggt

SEQ ID NO: 1072 - DNA, 72 bp, Homo sapiens
ctgggcatcgtggcttactcctgcaatcccaacattttgggaggctgaggtaggaggatcacttgagctcag

SEQ ID NO: 1073 - DNA, 78 bp, Homo sapiens
gtcagttagggagacagatttgagactgagctcacatctcagctgcagcacctgattaaatccttcttccttggtgat

SEQ ID NO: 1074 - DNA, 73 bp, Homo sapiens
tatatatatgtgtgtatatatatatatgtgtgtgtgtatatatatgtatacatatatgtatatgtatacacac

SEQ ID NO: 1075 - DNA, 92 bp, Homo sapiens
ccctgagtaatcattatgcaatgtatacatgtatggaaacatcacgctgtaccccataaatatgtatagttattatgtgtcagttaaaaggg

SEQ ID NO: 1076 - DNA, 77 bp, Homo sapiens
gtgtttattgatttgcatatgttgaaccagccttgtatcccagggatgaagctggcttgattgtggtcgataagctc

SEQ ID NO: 1077 - DNA, 95 bp, Homo sapiens; identical to SEQ ID NO: 68

SEQ ID NO: 1078 - DNA, 93 bp, Homo sapiens; identical to SEQ ID NO: 69

SEQ ID NO: 1079 - DNA, 112 bp, Homo sapiens
tttctcagaatgtattgctgtcgttaagggatgcatgattatagttgactctagagacttatcagagtcaggtttcatttttctgtcaaaacgacttcatacatggtagaaa

SEQ ID NO: 1080 - DNA, 95 bp, Homo sapiens
ccgtgggagaagcgtggtttcctggggttgcacactcactcactgcttcccttggctgggggtgggagttctcttggcttcatgttgctcccagg

SEQ ID NO: 1081 - DNA, 107 bp, Homo sapiens
taattattagtataaatgtgtaaaaggtgatttatgagcattactatttcatactttattattaatagtattgcaatgaatctgtttattgctatttttaatagttg

SEQ ID NO: 1082 - DNA, 95 bp, Homo sapiens
ggtaaatacacaggagtgagattggtgagtcatgtggcaagtatatatttaactttataagaaactcccaaactgtttcccaaagtggttgtacc

SEQ ID NO: 1083 - DNA, 89 bp, Homo sapiens
atcccagtctggtgtgtgtgggctgtgtgactttggggaggttactctgacactctgaggctcagttttctcatctgttagatagggat

SEQ ID NO: 1084 - DNA, 125 bp, Homo sapiens
ctttgttattgtgaacagtgctgtagtaaacatacatatgcatgtgcctttattttttatttattatatttcaagttctggggtacatgtgcagaatgtgcagtttcattacatagttatacaca

SEQ ID NO: 1085 - DNA, 115 bp, Homo sapiens
tgtatatacacgtatgtgtatatatatgcatatatcgtatgtatatgtgtacatatacatatgtacacatgtatgtatatacatgtgtgtatatatgtaaatatgtatatataca

SEQ ID NO: 1086 - DNA, 74 bp, Homo sapiens
gtaaaatgctttcatataggtatatatgtatccacatatatatatttctttatatgcaagcatgttttctttgc

SEQ ID NO: 1087 - DNA, 58 bp, Homo sapiens
tgagacagagtctcgctctgtcacccaggctggagtgcagtggtgagatctctgctca

SEQ ID NO: 1088 - DNA, 58 bp, Homo sapiens
tgagactgagtctcactctgtcacccaggttggagtgcagtggcatgatttcgtctca

SEQ ID NO: 1089 - DNA, 63 bp, Homo sapiens
tgcatgctaagtctcactctgtcaccaggctggagtacggtggcgtgatcttggctcactgca

SEQ ID NO: 1090 - DNA, 77 bp, Homo sapiens
aggtaagatttcctgtgtaaaagaaaaagacttattcacgtttttttttttttttgaacagtgggattaatttatct

SEQ ID NO: 1091 - DNA, 112 bp, Homo sapiens
gccagatactatttaagcatttaatattattatttacttttaatattattatttacttttccaagtcctacattaaaggtagagagatagctgatgctattttgtatcttgt

SEQ ID NO: 1092 - DNA, 85 bp, Homo sapiens
ttctcccaggagactcacttctggctctgtgtctctctgtcaagggaacaacactgccggaggggctaaatctgttggaagagga

SEQ ID NO: 1093 - DNA, 118 bp, Homo sapiens
atagagaggctgcagtatctgaaattcttatcatgttcagatatcaatatttaattttgttgcccaaatcaaacaatgtcagaacacttgagtttagtgcttttttttctctctctgt

SEQ ID NO: 1094 - DNA, 89 bp, Homo sapiens
ggtgcctccattctgcgtacaccagacctgtttgtttttttttttttttttaagacagtctcgctctgtcacccaggttggagtgcagt

SEQ ID NO: 1095 - DNA, 115 bp, Homo sapiens
atatatatatatatgtgtatatatacacattaagtgtgtgtgtatatatatatgtgtgtgtgtatatatatatatacacatatatacacacatatatgtgtatatatacacacac

SEQ ID NO: 1096 - DNA, 71 bp, Homo sapiens
cattgagactacagcaatatgttatctctcagtttcactgtgagatgatgtattagtctgttttcacactg

SEQ ID NO: 1097 - DNA, 79 bp, Homo sapiens
gactgtcacttcacaatgacactctctcagtcaaccttggcaaagaggaaaaggggagtggaacttgagggaggaagtc

SEQ ID NO: 1098 - DNA, 114 bp, Homo sapiens
ttgtggcttcaaaaactatatatatacacacatatatatatgtgtatatatgtagttacatacatatatatgtatatatatagttacgtatatgtagtttgtatatagttttag

SEQ ID NO: 1099 - DNA, 58 bp, Homo sapiens
tgagacagggtctcactctgtcacccaggctggagtgcagtggtgcgatcttggctca

SEQ ID NO: 1100 - DNA, 60 bp, Homo sapiens
ttatacatacatatatacatatatatgtatatacatatgtgtgtgtatttgtgtgtatag

SEQ ID NO: 1101 - DNA, 58 bp, Homo sapiens
tgagacagagtctcactctgtcacccaggctggagtgcagtggtgtgatcttggctca

SEQ ID NO: 1102 - DNA, 56 bp, Homo sapiens
gagacagagtctcactctgtcacccaggctggagtgcagtggtgtgatcttggctc

SEQ ID NO: 1103 - DNA, 107 bp, Homo sapiens
catgcggtgtttggttttttgtccttgctatagtttgctgagaatgatggagtctcgctctgtctcccaggctggagtgcagtggtgccaaaaactcaaatttcatg

SEQ ID NO: 1104 - DNA, 138 bp, Homo sapiens
tccttgtttgcgtgacatagtctaagtttaacctgtcttccagaataatttttttttttgagatgaggtctcactctgtcactcaggctggagtgcagtggcacaatcttggctcactgcaactgtggcctcccaggc

SEQ ID NO: 1105 - DNA, 116 bp, Homo sapiens
ggcttgtgcttataatcccagcattttggaaggctgaagcaggagaattttttttttttgagacagagttttcgctcttgttgcccaggctggagtgcaatggcacaatcttggct

SEQ ID NO: 1106 - DNA, 58 bp, Homo sapiens
tgatacagggtctcactctgtcacccaggctggagtgcagtggcgtgatcttggctca

SEQ ID NO: 1107 - DNA, 114 bp, Homo sapiens
gggtgatggggattggagagattagtaaatgatttctaagttctgttaattaaaatgtaactatatattttagagagaagttagtagtcatatcactttagttcatgaagactt

SEQ ID NO: 1108 - DNA, 109 bp, Homo sapiens
gtacacggtatatatatatatatatatatgtacatatatgtgtgtatatatatgtacatatatatgtgtgtatatatatgtacatatatatgtgtgtgtgtatatatac

SEQ ID NO: 1109 - DNA, 86 bp, Homo sapiens
aggtgagaaaggatttggggacactagctgtctctgccacactatctgtgtgaccgtaaccactttatgtccttgatttctcatct

SEQ ID NO: 1110 - DNA, 95 bp, Homo sapiens; identical to SEQ ID NO: 68

SEQ ID NO: 1111 - DNA, 93 bp, Homo sapiens; identical to SEQ ID NO: 69

SEQ ID NO: 1112 - DNA, 87 bp, Homo sapiens
gggtaacatagggagactccgtctctacaaaaaaaaaaaaaaaaaaacttttttttttttttcagacagagccttgctctgtcgccc

SEQ ID NO: 1113 - DNA, 82 bp, Homo sapiens
cacctgtatagggcacttactgagaatgcagctggcaggactggaagttgctctgggtgagtcagtgagtgagaggtgggtg

SEQ ID NO: 1114 - DNA, 116 bp, Homo sapiens
tccaaaaagatttgctgatggtttaactgttcgttgtgagagaaagaaaggataattctatgattttttgcttatgcaactagaggaatgcacttaccattgaagaagagattgga

SEQ ID NO: 1115 - DNA, 94 bp, Homo sapiens
gattctcctgcctcaggctgctgagtagctgggattacaggcatatgccaccacgcctagataatttttatacttttagtagggacggggtttc

SEQ ID NO: 1116 - DNA, 103 bp, Homo sapiens
attaactagctgtgtgtgtgtgtggggggggggtgtatttttatttttattttttgagacggagtctcactctgtcgcccaggctggagcgcagtggcgtgat

SEQ ID NO: 1117 - DNA, 103 bp, Homo sapiens
cttttatatttgtttaaagtttgccagtgttttgctattttaattaagagatctgattttcatgaactgggaatgggaaagtactgggcaaactaggtgaagg

SEQ ID NO: 1118 - DNA, 65 bp, Homo sapiens
gcgcttcacagagcagccttgcatggtgtttacaaggattcagtgggatgttgtgtgcgaagggc

SEQ ID NO: 1119 - DNA, 107 bp, Homo sapiens
tatatatatatatgcgcatatatatatgtgtatatatatatgtgtatatatatgcgcatatatatatgtgtatatatatgcgcatatatatatatacatatatatat

SEQ ID NO: 1120 - DNA, 79 bp, Homo sapiens
acagttgccaaatctgtatgcgtgtttctagcccaggtatccttgtgagctcagagatgacagagagggccatgactgt

SEQ ID NO: 1121 - DNA, 67 bp, Homo sapiens
aaggaggccctgaaagttgtgagcagaggagacctgacagcctcactctttcagtggccacattctt

SEQ ID NO: 1122 - DNA, 85 bp, Homo sapiens
gtcaagcctagatcggtccgtggtcagaggctgcacagtggaagcccaggaggcagctgccaccagagagtggattgtgtttgat

SEQ ID NO: 1123 - DNA, 102 bp, Homo sapiens
atgtatatatacatgtatgtgtatatatacacacacatgtatatatacatgtatgtgtatatatacatatgtgtatatatacacatatatgtatatatacat

SEQ ID NO: 1124 - DNA, 114 bp, Homo sapiens
gtatgtatatgtgtgtatgtgtatatatatacacatatatgtatatatacatatgtgtgtatatacacacatgtatatatacatatatgtgtatatatacacatatgtatatat

SEQ ID NO: 1125 - DNA, 75 bp, Homo sapiens
tctgtttgcaggagatgtccctgactttacttggaactgagtcaagttagagagctgagcctagcaaaatacagg

SEQ ID NO: 1126 - DNA, 106 bp, Homo sapiens
tataggtatatgtatatatatatctctctacatatgtatgtgtatatatgtagatatatatacacatatatatgtagagagatatatatacacacacatacatata

SEQ ID NO: 1127 - DNA, 60 bp, Homo sapiens
tgagtctcactctgtcgctctgtttcccagactggagtacagtggcacagtcacggctca

SEQ ID NO: 1128 - DNA, 62 bp, Homo sapiens
tgagacagagtctcactcactctgttgcccaagctagagtgcagtggcaccatcttggctca

SEQ ID NO: 1129 - DNA, 96 bp, Homo sapiens
gatcggatggttttatgtctagcatttcctttgctttcactcactctgtccttccgccctgtgaagaaggtgcttgcttctcctttgccttccatc

SEQ ID NO: 1130 - DNA, 71 bp, Homo sapiens
cattagatgtgtgtgtttgtgcatgtgcacctgtgtatgtgtgcatgcatgtgtgtgtgtgcatgtgtgtg

SEQ ID NO: 1131 - DNA, 74 bp, Homo sapiens
ggcactttgtctggtgacttcactggctgtcaggtttgccggagggtccaggactgcaaagaggagaaagtgcc

SEQ ID NO: 1132 - DNA, 74 bp, Homo sapiens
tgggcttgtgatgaatcaggcctcacacctgcccttccagaccagcagtgagccactgtctgtctcatagccca

SEQ ID NO: 1133 - DNA, 92 bp, Homo sapiens
tggggactgctagttttgttttaagaaacagtgcctcactctgtcacccaggttggagtacagtggcttgatcatggctcactgcaacctca

SEQ ID NO: 1134 - DNA, 111 bp, Homo sapiens
gctcttgctgataataagtgatcagtaatttactgtttgtttcttttttcttttccttttcttttcctggggaactgtgtaaacagttgactgcactgtgaaaagctgagt

SEQ ID NO: 1135 - DNA, 129 bp, Homo sapiens
cagactgagtggcttaaaccatagatattgactttctcatggtactggaggctagaagtctgagatcaaggtgtcagcagggttggtttctttaagttccctctcctttgattgtagatgtcttcttct

SEQ ID NO: 1136 - DNA, 106 bp, Homo sapiens
atctgtgaaataagcaaccagctggatgacatctgtggttttcttctttttttttctttgaaatggagtctcactctgtcccccaggcagtggcatgatcatggat

SEQ ID NO: 1137 - DNA, 114 bp, Homo sapiens
atgaagagggaggcttatggatctcttgccatttttctcatagaaaggtgaggatgcaggttgaaaggttttattggaagaatgttgcaggaatgtagagggctatctgtttgt

SEQ ID NO: 1138 - DNA, 73 bp, Homo sapiens
gaagcacctgaactttattatattagttttttttaattgccatttttctgaactgagctgaaagtggtgcttc

SEQ ID NO: 1139 - DNA, 94 bp, Homo sapiens
gtccatctttctctagacctgagtttctttcctgtttctttctttgtccaaatagaactgtgaagccagtgagctcacgtacaatgatgatggc

SEQ ID NO: 1140 - DNA, 81 bp, Homo sapiens
cctcctctgtatctgtgtctgtcactgcatgtctggtttcaggccctggtggctctgacactgccctctccccacaggagg

SEQ ID NO: 1141 - DNA, 71 bp, Homo sapiens
gcatcttctaagctagtgcaggcagtctagagaccacacctggagagtctgagctctgaggctggggatgc

SEQ ID NO: 1142 - DNA, 85 bp, Homo sapiens
gctccgtgacctcagtcagactctcagcctccctatgcctcagtgtctgccttattgctaggggctagtgagcatcaggagaggt

SEQ ID NO: 1143 - DNA, 75 bp, Homo sapiens
ggattacaggcgtgcaccaccatgcccagctaatttttatatttttagtagagatggtgttttgccatggtagcc

SEQ ID NO: 1144 - DNA, 57 bp, Homo sapiens
tgatctgacaggagacagagcacaggcagtagtgctcgctcacctgccagcccctca

SEQ ID NO: 1145 - DNA, 123 bp, Homo sapiens
tcttgctttctgagtttctccctgggtgtctaccaggcattttattttatttattttttattttttgagacaacgtcgtgctctgtcacccaggctggagtgcaaaggcatgatctcagctca

SEQ ID NO: 1146 - DNA, 101 bp, Homo sapiens
gtgtgtatatatgtgtatatatatgtgtgtatatatgtgtatatgtgtgtgtatatatgtgtgtatgtatatatatatgagctacatgtggtgatatgcac

SEQ ID NO: 1147 - DNA, 100 bp, Homo sapiens
tattcctctgcatgtaatgtgtctttctagggctgcctttaaggttttctttttatttttggttttagcagtttaaagtgcattgtacgtgttagggata

SEQ ID NO: 1148 - DNA, 119 bp, Homo sapiens
agggtagcatgatccctgaactctgaaaactgaagtagggttgtggaaactgaagagtgaattttttttttcttttttctttttttttttttttttgacaggagacagggtctcactct

SEQ ID NO: 1149 - DNA, 73 bp, Homo sapiens
ttgtttttttgagacagggtctcactctgtcacccagactggagtgcagtggtgtgatcttggctcactgcaa

SEQ ID NO: 1150 - DNA, 58 bp, Homo sapiens
tgagacagagtctcactctctcacccaggttggagtgcagtggtgcagtctctgctca

SEQ ID NO: 1151 - DNA, 95 bp, Homo sapiens; identical to SEQ ID NO: 68

SEQ ID NO: 1152 - DNA, 93 bp, Homo sapiens; identical to SEQ ID NO: 69

SEQ ID NO: 1153 - DNA, 160 bp, Homo sapiens
atatatatatatacacatatatgtgtgcatgtacacatatatgtatgtatatatgtatatacatgcatgtatatcattacgcatacatatatacatacatgcgtgtatatatgtatatgtatgacatctgttgttttatatataaatatatatatgatgt

SEQ ID NO: 1154 - DNA, 67 bp, Homo sapiens
ggcacggtggctcactcatgtaatcccagggctttgggaggctgaggtaagaggatcacttgaggcc

SEQ ID NO: 1155 - DNA, 67 bp, Homo sapiens
gggtggctttcctgaagtcacatgatctagcgagcggcagagctggtgagagtcaggacagagtccc

SEQ ID NO: 1156 - DNA, 95 bp, Homo sapiens; identical to SEQ ID NO: 68

SEQ ID NO: 1157 - DNA, 93 bp, Homo sapiens; identical to SEQ ID NO: 69

SEQ ID NO: 1158 - DNA, 116 bp, Homo sapiens
tgcagttcatccccttttaatacaaagttctggtcaatgcatgccccttttgcgtttcactgcatttatgtatggcattctagcttcccttgaatattaagctaatttgaatggca

SEQ ID NO: 1159 - DNA, 116 bp, Homo sapiens
gtactggttgtgctttggatatgatctgagctaggctccaggaaggggaaaatattttttgttatctttttttctgtacctcccctaacttttcaaacagtcacacattcactcac

SEQ ID NO: 1160 - DNA, 117 bp, Homo sapiens
tcgtgttccacacaggagttccttcctggcttcaatactgtttttctttttctttttttcttttttttagagacaggagtgtcgctctgttgcccaggctggagtgcagtggctcga

SEQ ID NO: 1161 - DNA, 95 bp, Homo sapiens; identical to SEQ ID NO: 68

SEQ ID NO: 1162 - DNA, 93 bp, Homo sapiens; identical to SEQ ID NO: 69

SEQ ID NO: 1163 - DNA, 89 bp, Homo sapiens
gctccagtgtattcttttttttttttttttttgagacggagtctcgctctgtcgctcaggctggagtgcagtggcgagatctgggctca

SEQ ID NO: 1164 - DNA, 75 bp, Homo sapiens
tccattcttctgtatctctgtgtttcttgatctaattctgggaatccaggatccacatgagactggagaggggga

SEQ ID NO: 1165 - DNA, 98 bp, Homo sapiens
tgtattatactatgtgtataataattaataatatataatctatattatagatctgtaacataaagtatatttttattttatacgcacgtatagatgca

SEQ ID NO: 1166 - DNA, 101 bp, Homo sapiens
atatctatgcaatgcatgtgcatatgtatgtatatgcaattgtatacatatatccgtatgtatatatttgtatgtacttatatacacatatgcatagatgt

SEQ ID NO: 1167 - DNA, 111 bp, Homo sapiens
gaagatgatctacatatatattatatacatacacatgacctacatatatatgtgtatatatatgtgtatatgtgtctgtgtgtgtatatatatatatatatgatttatttc

SEQ ID NO: 1168 - DNA, 80 bp, Homo sapiens
catggtgtctgggtctgagagcctcagtctcagccaatttacccggctgcctgagagatctcagttcttttctaatcatg

SEQ ID NO: 1169 - DNA, 83 bp, Homo sapiens
agagagagtctcactctgtcacccaggctggagcgtagtggcacaactgcaacctccgcctctcaggttcaagtgactctcct

SEQ ID NO: 1170 - DNA, 107 bp, Homo sapiens
cctggggaggggccttttatttgatgcaagagttattcacagtacattgtttggatactttatggagccaattcttgcctctaggtatttccaaattaaatcccagg

SEQ ID NO: 1171 - DNA, 70 bp, Homo sapiens
atatatgtatgtatatatgtatctgtgtatatatgaatgtgggtatgggtgtgtgtgtgtgtgtgtgtgt

SEQ ID NO: 1172 - DNA, 67 bp, Homo sapiens
ctgtctctggctgcatgacctcagtgaccttcttcctcacagacaccatgccatcagttggagtcag

SEQ ID NO: 1173 - DNA, 71 bp, Homo sapiens
cctagagacctctgactctctctgaaaggcagaagtgctttctgcaggagtttgggccaggtggtgttagg

SEQ ID NO: 1174 - DNA, 58 bp, Homo sapiens
ccactgtagggcttatgagaccttgggggtctcactcaatctctctaagtctttgtgg

SEQ ID NO: 1175 - DNA, 125 bp, Homo sapiens
ccagctttgtgctttttacttaggattgtcttggctacgcgggctctattttgtttccatatgaaatttaaagtagttttttctaactctgtgaagaaagtcaatggtagcttgttggggatagc

SEQ ID NO: 1176 - DNA, 90 bp, Homo sapiens
gtctcttcttatctatccatctatttatctatctgccttaagcagggactgataggggaacagacagataacatgagaaggatggattag

SEQ ID NO: 1177 - DNA, 106 bp, Homo sapiens
tggtgttgaggctcatttatgtgattttcctactccctctgtgtcattctaggctataggagagaagacacagagctctcatgaagaacagagctgagacccaggg

SEQ ID NO: 1178 - DNA, 76 bp, Homo sapiens
acacacacacacacgtatatgtacacatatatatgtatatttacatatatgtgtacatatatgtatgtatgtatgt

SEQ ID NO: 1179 - DNA, 68 bp, Homo sapiens
ggtgtcccagccagcagagcaaagcactggcatggtttgcctggctccctctgtgagctgttggcact

SEQ ID NO: 1180 - DNA, 117 bp, Homo sapiens
gcgaatgttaaattcagccagatgttgacctcaactgtgaatttaaatcttttttatttatttatttattatttaactttaagttctgggatatatgtgctgaatgtgcaggtttgt

SEQ ID NO: 1181 - DNA, 89 bp, Homo sapiens
ggctggcaaacggtaaagatggagtttgagcctggatattttatattccagagctctctcactcttccactgtgtcacatattgtagcc

SEQ ID NO: 1182 - DNA, 115 bp, Homo sapiens
atgaaagtccccctttctctaccatcttgccagcatctgttattttttttgactttttaataactgccaatctgactggtgtgagatggtagctcattgaggttttgatttgcat

SEQ ID NO: 1183 - DNA, 107 bp, Homo sapiens
attatatgtgtgcgtatacatatgtgtctatgtgtgtgtgtgtgtgtatatgcgtgtatatatgtatatatatgtgtgtgtgtatatatatgattacacatatttgg

SEQ ID NO: 1184 - DNA, 63 bp, Homo sapiens
tttgctctcatcctctgactgtctgtcatgcaatgtgcatcagtcagagattttgattgcaag

SEQ ID NO: 1185 - DNA, 73 bp, Homo sapiens
aatggtctgttcttggcatgcacagataggggcatatgtgtgtctctgtgtgtctgtgttaaattcaaccatt

SEQ ID NO: 1186 - DNA, 89 bp, Homo sapiens
aggacttttactttgtagaacatcctgtgtttctaaaacatccacagtgactgttgttgttctatattatttaaatgagtaagtgtcct

SEQ ID NO: 1187 - DNA, 93 bp, Homo sapiens
cctcccaggccttgttgatcagtctgtacaatggctgtatttctttttatatgaaaatgcaccccatgtctcatttcatcaagaattggtagg

SEQ ID NO: 1188 - DNA, 90 bp, Homo sapiens
cttctgactcagttatactcatattgtagtactcatgagagtggttaaaagactaatgtatgtttatgtgggtgtgggttggggaagggg

SEQ ID NO: 1189 - DNA, 91 bp, Homo sapiens
ggtggtgacaacaagcagggtgttgaaacagtccctgggcaaacagagagctgtctcaatcaatcactctgattgtaatgtgcctgggacc

SEQ ID NO: 1190 - DNA, 58 bp, Homo sapiens
tgagacagggtctcactctgtcacccaggctggagtgcagtggcatgatcttggctca

SEQ ID NO: 1191 - DNA, 56 bp, Homo sapiens
gagacagggtctcactctgtcacccaggctggagtgcagtggcatgatcttggctc

SEQ ID NO: 1192 - DNA, 83 bp, Homo sapiens
gggtctcactctgtcacacaggctggagcacagtggtgcaatcatggctccatggctcactacggccttgacctcctgggctc

SEQ ID NO: 1193 - DNA, 110 bp, Homo sapiens
gtagtagaatagcagatggaacactgagaagtgatttccttaaggatagatttccacaatggaaaggaaatgagaggttctaagaggtgggctagcggcttgtaacctac

SEQ ID NO: 1194 - DNA, 83 bp, Homo sapiens
gcggtggtggtgggaacattgacgacaaaatggcaccttcttactcaattttgctgctccctgtgtgtctgactcacacctgc

SEQ ID NO: 1195 - DNA, 93 bp, Homo sapiens
agtgataacttctgtatcatagtctagcaaatgaaatgtttttatgcctttaagggttcaatttttatttcttttgtttactgtatactcact

SEQ ID NO: 1196 - DNA, 116 bp, Homo sapiens
tcactgttgaatgtctcaagagttgtgtgtgtattcagtttctatttccctctctgtctcatttactgactccagtctgactaatgctctaatatgctcttgagaagtcaccatga

SEQ ID NO: 1197 - DNA, 98 bp, Homo sapiens
gattaagtaaaacataacaaaggtagatttatttttcatttctggctgttgtacaaattgtcagtataaaatactctaaaattgttgtggatttaatt

SEQ ID NO: 1198 - DNA, 112 bp, Homo sapiens
gatcacagtcctgtgctctgttgtctagcatctgaaaaaaagttgtttcatatattttgtctggttttctaggtgtttataggagggcaagttcagtatcggtcacttggtc

SEQ ID NO: 1199 - DNA, 69 bp, Homo sapiens
accatgagtgactatatatttattctttgaaataagatttggaaggatgtatgtggtaatactgatggt

SEQ ID NO: 1200 - DNA, 86 bp, Homo sapiens
cttaggtgagggatagtcttagaaaatgactggagagcctttatttatttatttttttgagactcagtctcgctctgtcacccagg

SEQ ID NO: 1201 - DNA, 87 bp, Homo sapiens
gtgtgtgtgtgtgtgtgagatgggagtctcactctgtcgctgaggctggagtgcaatggcgtgatctcagctcaccacaacctccgc

SEQ ID NO: 1202 - DNA, 85 bp, Homo sapiens
attgctgggttttgtggtaattgcatgtttagttttataagaaacttccaaaatgttctctagagtggctatacccaccagcaat

SEQ ID NO: 1203 - DNA, 81 bp, Homo sapiens
gcccagacctgaccatcgggagctctttttttttttttttttttttgaaacagagtctcactctgtcgcccaggctggagt

SEQ ID NO: 1204 - DNA, 101 bp, Homo sapiens
ctgctaactttgggcttagtttgtctttttttttttttgagacagagtctcactctgttgcacaggctagagtaaagtcgcacagtctcagctcactgcag

SEQ ID NO: 1205 - DNA, 87 bp, Homo sapiens
cgggaagcatcagcagaggctggctgcatgttgtatctaagggctaggatctcagcaccaggggcccagtctcagcgaagattcctg

SEQ ID NO: 1206 - DNA, 118 bp, Homo sapiens
gtgggagaaaggaagaggaagtataggaaggggttcacaggttaaatttgattttttaaacttgaaggttgaaggttaggtgaaggataactctatcttatctgtcaatctatctatc

SEQ ID NO: 1207 - DNA, 79 bp, Homo sapiens
ggtgtatgtgtgtgaaatgtgtgtgcagagctaacctgtagcagcaggggcagcaacaagaaggcacagcagaaagatc

SEQ ID NO: 1208 - DNA, 91 bp, Homo sapiens
tctgtaggctctgtaatgatgtcacttctgtctttcctgatctcaatcagcacagttagagctttatcaattttatcgatgttgccacaga

SEQ ID NO: 1209 - DNA, 93 bp, Homo sapiens
cttcgcttatgaagcttagtttggctagatatgaagttcttggttggaaagttttttctttaagaatgctgaatataggctgatatggtttgg

SEQ ID NO: 1210 - DNA, 98 bp, Homo sapiens
gtatttgaggggttgctgggggggagtgccctatagtcctaagattaggtttcagtctttcactgagtgtgtccccaggctatgaccttcacaaatgc

SEQ ID NO: 1211 - DNA, 86 bp, Homo sapiens
ttttttttgagatggagtctcactctgtcacccaggctggagtgcagtggtgcaatcttggctcactgaaagctctgcctcctggg

SEQ ID NO: 1212 - DNA, 110 bp, Homo sapiens
agtgtgactgagggatgtcagggagggaaaagactgtagtcttaattcttaatttttttttttttttttttgagacgagtcttgctctgtcatccaggcttgagtacagt

SEQ ID NO: 1213 - DNA, 57 bp, Homo sapiens
agacaggtctcactctgtcacccaggctggagggcagtggcacgagcatggcttgct

SEQ ID NO: 1214 - DNA, 89 bp, Homo sapiens
gggaaggaactagacagacgagaaaatttttcattgaatttcacagaattttttttttttttttgagacataatcttgctctgtctccc

SEQ ID NO: 1215 - DNA, 58 bp, Homo sapiens
tgagatggagtctcactctgtcacccaggctggagtgcagtggtgtgatctcagctca

SEQ ID NO: 1216 - DNA, 120 bp, Homo sapiens
gttttgatttgcatttccctgatggttagtgatacagaacattttttcttttttttttttttttttgagatgaagtcttgttctgtcaccaaggctggagtgcagcgatgtgatctcggc

SEQ ID NO: 1217 - DNA, 106 bp, Homo sapiens
ccttgggtttctggagcatgaatctgcatactctaaagatttcttacacaaataatttttttttttttttttttgaggcagagtcttgctctgtcacccagtctgg

SEQ ID NO: 1218 - DNA, 102 bp, Homo sapiens
tgaacatgggcatgcaagtatatctgagttcctgctttcaattcttttgaatatatatatacagaagtgaaattgttggatcatacagtaattctatgttta

SEQ ID NO: 1219 - DNA, 109 bp, Homo sapiens
gagatggggtttcaccaggttggccatgatggagtttcctccttttttttcattttctttttttgaggcaagggctctctctgtcacacagtggcgggatgatcagatc

SEQ ID NO: 1220 - DNA, 109 bp, Homo sapiens
gtctgggtgacagagtaagactctgtcttaaaaaaaaaaaaataggggattgtttcctgaaatccattttttttttttttgagacagggtcttgttatttctcccaggc

SEQ ID NO: 1221 - DNA, 58 bp, Homo sapiens
tgagatggagtctcactctgtcacctaggctggagtggagtggtgggatctcagctca

SEQ ID NO: 1222 - DNA, 68 bp, Homo sapiens
ctgggccctgtctctcaaactgtctggtctcttttgtgtctaagtaaattgaagacggcagggcgtgg

SEQ ID NO: 1223 - DNA, 86 bp, Homo sapiens
tccgaaggtcacatggtctgggggaaggagcatgaactctggatttaaatcccagctctttcactctcccactgtgtgaccttgga

SEQ ID NO: 1224 - DNA, 119 bp, Homo sapiens
ctgattagatgatgaacttgtaggcaattattgccttgggttgctgctataattttaataattttgtttaataaagtaccaagaaatgtgtatgtatataggtattctttctgagaaag

SEQ ID NO: 1225 - DNA, 98 bp, Homo sapiens
atgcatgagccactgtggctgacccactctctgattctgtttaccttggtacacaagatgacaaatgaattgaaatatggtacactgtggaccattat

SEQ ID NO: 1226 - DNA, 67 bp, Homo sapiens
cacacacacacacacatatgtgagacagggtctaactctgtcacccacactggagtgcagtggtgtg

SEQ ID NO: 1227 - DNA, 58 bp, Homo sapiens
tgaaacagagtctcactctctcccctaggctggggtgcaagggtgcaatctctgctca

SEQ ID NO: 1228 - DNA, 84 bp, Homo sapiens
tgcagatacctctggagcaatctggcactgctatatttatatatattagtgcaataaaatcacttttttcctgagggttgtgca

SEQ ID NO: 1229 - DNA, 95 bp, Homo sapiens; identical to SEQ ID NO: 68

SEQ ID NO: 1230 - DNA, 93 bp, Homo sapiens; identical to SEQ ID NO: 69

SEQ ID NO: 1231 - DNA, 114 bp, Homo sapiens
cagtttctaattcagtgtgtttttctttttttttttttttaagacagagtctcactctgtcttaaaaaaaaaaaaaaaaaaaagaaaaagaaaaacacactgaattagaaactg

SEQ ID NO: 1232 - DNA, 83 bp, Homo sapiens
ggaaggcctagatctaggagagaggtgatacggggacagggctgttctgtcacgcagtcactctgcctccttctcagctttcc

SEQ ID NO: 1233 - DNA, 108 bp, Homo sapiens
gatttcattcaactttctatggttagcttttaagaatattatctaaaaactgtgtaagctttttttttttttggatggattgaaacctattatggaaaggctgtcatc

SEQ ID NO: 1234 - DNA, 92 bp, Homo sapiens
gcaaataggagtatgtgtgtattgtgtgtctgtgtatttatttattttcttcctctttttatacagttattagcatactaaactcattttgc

SEQ ID NO: 1235 - DNA, 98 bp, Homo sapiens
acaaagtgaggccctcgtctctgcaaaataaataagataaagtgaaataaataaaataaatactttttttttttttttgacacagagtctcactctgt

SEQ ID NO: 1236 - DNA, 99 bp, Homo sapiens
gattggcatggagtttggtttcatctgtatttatctatttatagataataacatatttgaaacaaatgtgcaaactgttaaatatgtttaatgccagtc

SEQ ID NO: 1237 - DNA, 58 bp, Homo sapiens
tgaggcggagtctcgctctgtcacccaggctggagtgcggtggcgtgatctcggctca

SEQ ID NO: 1238 - DNA, 56 bp, Homo sapiens
tgagacagtcttgctctgtcactcaggctggagtgcagtggcatgatcttggctca

SEQ ID NO: 1239 - DNA, 84 bp, Homo sapiens
gcttgtggctgcagggatcttgaggggttgcctttttaaaatttttttattttttgagacagagtctctctctgtcgcccaggc

SEQ ID NO: 1240 - DNA, 58 bp, Homo sapiens
tgagacagagtctcgctctgtcgctcaggctggagtgcagtggcgcgatctcggctca

SEQ ID NO: 1241 - DNA, 115 bp, Homo sapiens
tgaatgagagatgcaattttttttggctaacctattggcaaagaaatgatgatgatgatgatgatgatacctagtgttgctggagtgaggggaaatgagatgtatcagttatcca

SEQ ID NO: 1242 - DNA, 123 bp, Homo sapiens
tgcatgtctatgtatataagtatggtgtgggcgtgtatatatatctgtgtgtatatatatatatctgcgtgtatattgagtgtgtatgtgagtgcgtgtgaggatgtctgtatgtgttcatgc

SEQ ID NO: 1243 - DNA, 118 bp, Homo sapiens
cagcctgtccggatggcccctgggggtgttcttcagcatgtcctgccaggtcagagcagagactgagcagcccacccatgaccaactctaccccagcctggggcaaagcctcaccctg

SEQ ID NO: 1244 - DNA, 77 bp, Homo sapiens
gtttgcatgtatgtgtgtgtgtgtgtgtgcgcactcacgcacacacacacacactttcattgattaacattggaagc

SEQ ID NO: 1245 - DNA, 129 bp, Homo sapiens
tggtgaggatgtggtgaaactggaagcatcatacacagctgctgggcatgaaaaatggtgtagctcctatggaaaacagtttgtcagttgctcaaaaagttaaacatcaaattaccatatgacccagta

SEQ ID NO: 1246 - DNA, 118 bp, Homo sapiens
ttttcctttcatttgatactaggttttacttgaaacttagagactattgtattactggctaataatttcaatatttttgtgtctgagtgaatagggaagcctgaagagagggggagag

SEQ ID NO: 1247 - DNA, 107 bp, Homo sapiens
cagctggaaacgattttgactcaaggggtttcttggccagaggtaaattgtttctttatatctatactggtggccatctgaattgtataagtttaaacgtttttctg

SEQ ID NO: 1248 - DNA, 72 bp, Homo sapiens
cctgaggtggctatagtttcagtcattctttttttttttttttttaaatggagtctggctctgtcacccagg

SEQ ID NO: 1249 - DNA, 92 bp, Homo sapiens
tgtcctgaattgggacttccaagacaatcactcccacactcaatgtagtacagagctctgtgagtgatctctgcccatgttccccagggaca

SEQ ID NO: 1250 - DNA, 111 bp, Homo sapiens
ctttgaatgactgttgaagcgaatgagagcaacataacagtagacattttgttgatgattgtcataatatttatagtatgttgtgtatgagacataatggttagctgatag

SEQ ID NO: 1251 - DNA, 95 bp, Homo sapiens; identical to SEQ ID NO: 68

SEQ ID NO: 1252 - DNA, 93 bp, Homo sapiens; identical to SEQ ID NO: 69

SEQ ID NO: 1253 - DNA, 56 bp, Homo sapiens
gaggcagagtctcgcactgtcacccaggctggagtgcagtggcatgatctctgctc

SEQ ID NO: 1254 - DNA, 66 bp, Homo sapiens
tgttgcctaggctggagtgcagtgatgcagtcatagctcactgcagactctctcagactcaaaaca

SEQ ID NO: 1255 - DNA, 95 bp, Homo sapiens; identical to SEQ ID NO: 68

SEQ ID NO: 1256 - DNA, 93 bp, Homo sapiens; identical to SEQ ID NO: 69

SEQ ID NO: 1257 - DNA, 91 bp, Homo sapiens
ccctgctcccagcacttgagagcccacctctgtctctgtgtggacccctctgggcttgcgtgtgtgttccagggtctcacacttaccagag

SEQ ID NO: 1258 - DNA, 120 bp, Homo sapiens
atttccctggtcaattctcacctggatgattgctgtgaattcttttttttttttttttttttttttttttttgagatggagtctcgctctgtcacacaggctagagtgcagtggggcgat

SEQ ID NO: 1259 - DNA, 98 bp, Homo sapiens
gacagcctttagccagagacagcttggcactcaggctcctgccatctgggttgtgagtgctgtgtgtgtatgtgtgtgtccctgtgtgtgtgtctgtt

SEQ ID NO: 1260 - DNA, 105 bp, Homo sapiens
agtgagatgagcatgagtcggggaggttcaaccccacgctgcccctctcactggctgtgtgacgggggtaagtgtcttcacctctctgaggctgttttctcaact

SEQ ID NO: 1261 - DNA, 82 bp, Homo sapiens
gtgtgggtggtgatgggtgtgttcattcatttggttgtgataatcactatataatatatgtatatcaaatcattacttgtac

SEQ ID NO: 1262 - DNA, 76 bp, Homo sapiens
agggtgggtgaatggcatcttaagcattatccttttaactcaccagggtaaggactgtgactatttctctctccct

SEQ ID NO: 1263 - DNA, 117 bp, Homo sapiens
gcctgcttttccagactttgggaagagctgggcgcttttttttttttttttttttttttttttttttttttgaaacaaggtcgtctcgctctctcacccaggctggagtgcaatggc

SEQ ID NO: 1264 - DNA, 76 bp, Homo sapiens
ccttaatcacctcctatgaggctctctctgtcaatgtagtcacattggggattagggcttcaacatatggatttgg

SEQ ID NO: 1265 - DNA, 58 bp, Homo sapiens
tgagatggagtctcactctgtcacccaggctggagtgcagtggtgcgatctcggctca

SEQ ID NO: 1266 - DNA, 124 bp, Homo sapiens
atccatcagattggctaacatgagtaggaagattagtggaatgttgcctacctgtggttctgtgcgtctgtgtgggtctactttaatgagtttagatctaggtgcttgtcctggaggcacattc

SEQ ID NO: 1267 - DNA, 110 bp, Homo sapiens
tctgctttctcatatagctacagtctcagctgtgaagctgggtctaagagacagaaaagagagacctgactcaacatgaatgtggactgtggtccctgtagagccccaga

SEQ ID NO: 1268 - DNA, 88 bp, Homo sapiens
gtctagctgctgagattggggactctttttttttttttttttttttttttttttgagacaaggtctcactctgtcatgcaggctggac

SEQ ID NO: 1269 - DNA, 80 bp, Homo sapiens
tcattgatactgacagtgggggtttaaagcctcccactattattgtgtgggagtctaagtctctttgtcagtctctaaga

SEQ ID NO: 1270 - DNA, 113 bp, Homo sapiens
ttgggtatataccaagtaatgggattgctgggtcaaatgagagttattttttaaattatttgagaactctccaaactgctttccacagttgctgaactaatttacatttccaa

SEQ ID NO: 1271 - DNA, 58 bp, Homo sapiens
tgagtcggagtctcactctgtcacccaggctggagtacagtggtgtgatcttggctca

SEQ ID NO: 1272 - DNA, 121 bp, Homo sapiens
atatacatatacatagtgaaatgattacttatagttaagcaaattaatctatcactgtatatgtatatacatatatgtgtatatatacatatatgtatacatatatacatatacatgcaca

SEQ ID NO: 1273 - DNA, 66 bp, Homo sapiens
gacagctgcaaccacctgcagagtgtgcctacaatgtgccaggctctgtgtgagtgactcactgtc

SEQ ID NO: 1274 - DNA, 66 bp, Homo sapiens
gacagtgagtcactcacacagagcctggcacattgtaggcacactctgcaggtggttgcagctgtc

SEQ ID NO: 1275 - DNA, 120 bp, Homo sapiens
ttgttcttttggcttaggattgtcttagctatacaggctctttttttggttccatatgaaatttaaagtagttttttctaattctgtgaagaaagtcaatgttagcttgatggggatagc

SEQ ID NO: 1276 - DNA, 80 bp, Homo sapiens
gttgccaactgtggtggcaggagagtgagtgcagggtgccctccactcaggctagcttccatccctcccacattgaaagc

SEQ ID NO: 1277 - DNA, 56 bp, Homo sapiens
tgagacagtcttgctctgtcactcaggctggagtgcagtggcatgatcatgactca

SEQ ID NO: 1278 - DNA, 85 bp, Homo sapiens
ttgagatggagtctcactcactgtgttgcccaggctagagtgcagtggcgcgatctcagctcactgtaacctctgtctcctgggc

SEQ ID NO: 1279 - DNA, 137 bp, Homo sapiens
tcagccaagagccgctcagtctggaaggataaaggctggaggagaagcccgaatttccaccctggctctgtcactgtctagctgtgtgaccttcggctgattacctagcgtctctgagctccaaacccctcatctct

SEQ ID NO: 1280 - DNA, 103 bp, Homo sapiens
tcacagtgataaatatttgttataatttatataatatatattagtcatatatcattatataaatatatatcgatatatatatttgtgacatatgtcatggtga

SEQ ID NO: 1281 - DNA, 58 bp, Homo sapiens
tgagacagagtctcactctgtcactcaggctggagtgcagtggtgcgatctcggctca

SEQ ID NO: 1282 - DNA, 84 bp, Homo sapiens
gggacagatagggaagaggataattccagggaagctcgttggctggctgctgtcactgtgtgtgtgcctctgtgtgtctgtgtc

SEQ ID NO: 1283 - DNA, 87 bp, Homo sapiens
tgatccagaaagcacagtcccagtctgaatctctgtcgtaaaatggctccacaaaatgcagaaagaccactgtgctttaattaatca

SEQ ID NO: 1284 - DNA, 97 bp, Homo sapiens
ctgggtgaaagaatgaaaccctgtctctaaaataataaaatgaaataacattacaagtttttttttttttttgacagagtcacgctctgtcacccag

SEQ ID NO: 1285 - DNA, 106 bp, Homo sapiens
gtatgtgtgtgtatatatatatatgtatgcatatttacttattttttacgaatttttacataagtaaatatgtgtatgcttttatatatctgttttacatatatat

SEQ ID NO: 1286 - DNA, 69 bp, Homo sapiens
gtaacagagcaagactccatctcaaaaaaataattttttttttttcaagacggagtctcactctgtcac

SEQ ID NO: 1287 - DNA, 96 bp, Homo sapiens
ccccattcaaattataagtttcattaggtaagggactttgtgtggctcactgtgacatacacagtgactgtaacagtgtcttgaatataattgggg

SEQ ID NO: 1288 - DNA, 80 bp, Homo sapiens
tatatgtgtgtgtgtgattgcgtgcatgtatgtgtataattatacatatatatctgtgtgtatacatatatatacatata

SEQ ID NO: 1289 - DNA, 58 bp, Homo sapiens
tgaggcagggtctcactctgtcactcaggctggagtgcagtggtatgatcacagctca

SEQ ID NO: 1290 - DNA, 58 bp, Homo sapiens
tgagaccgagtctcgctctgtcacccaggctggagtgcagtggtgctatcttggctca

SEQ ID NO: 1291 - DNA, 96 bp, Homo sapiens
aggataggcctaactttttttatctagaaatgtcaatttcttcttcattttgaaaaggtattttttctagatatagaatttttggttgtttatctt

SEQ ID NO: 1292 - DNA, 176 bp, Homo sapiens
tatatgtgtgtatatatatgtatatatatatgtgtatatatatgtgtatatatatgtatatatatgtgtatatatatgtatatatgtgtgtatatatatgtgtatatatatgtgtatatatatacacacacacgtatatatgtgtgtgtatatatacatatatatgtgtatatata

SEQ ID NO: 1293 - DNA, 58 bp, Homo sapiens
tcgggcctggttagtgcttggatgggagatggagtctcgctctgtcactcaggctgga

SEQ ID NO: 1294 - DNA, 105 bp, Homo sapiens
gactgaagaattcaaagaggtaaccaggaggcacttgacaaaaggtaatttagtttcttttgtcacccagctttcaagttctcctcagaatccatctggcacgtc

SEQ ID NO: 1295 - DNA, 90 bp, Homo sapiens
gaataaaaagtgctattaaattcactgtttttttgtataaaaatactctatgaacagaaacttgtgaatacttggtggcactaacctgtc

SEQ ID NO: 1296 - DNA, 58 bp, Homo sapiens; identical to SEQ ID NO: 1215

SEQ ID NO: 1297 - DNA, 76 bp, Homo sapiens
ccactagtccctgagagacaaggagcgattcctcatgtgtggcctggaccccgctttgtctctctctggctgccgg

SEQ ID NO: 1298 - DNA, 58 bp, Homo sapiens
tgagacagagtctcgctctgtcacccacgctggagtgcagtggcgcgatctcggctca

SEQ ID NO: 1299 - DNA, 105 bp, Homo sapiens
gggaaagactgctgtgtgccatgccatctgcactccagtatataaaaataatctttgtttttacatttactgctgcaaactacaatgaatactatgtgctttccc

SEQ ID NO: 1300 - DNA, 72 bp, Homo sapiens
tgaggcaggaagtgctaggatgagaggaatgacagagctcagttctctaatctcacaggcaattttgaatca

SEQ ID NO: 1301 - DNA, 78 bp, Homo sapiens
cagcattgccgtgaccttgctgtgtgacccagggtaggtgccttcccctctctgagtctctgtgtaacagcggagttg

SEQ ID NO: 1302 - DNA, 111 bp, Homo sapiens
actgtgttttcactaccccttttaccatgtaccagctgtgtgaccttgggtaagttactcgccctctctgtgcctcagtttccgcatctgtaaaatgatggaaataacagt

SEQ ID NO: 1303 - DNA, 105 bp, Homo sapiens
tgtgtgtgtgtgtgtgtgtgtatgtgtgcatatgtgtatatatacatatatacatgtgtgcatatgtgtatatatgcatatatacacgtgtgtgcatatgtgtat

SEQ ID NO: 1304 - DNA, 105 bp, Homo sapiens
tggtttgcatgtatgtattttgggatataaatgtgtgcatgtgcatgtatagaatgttacatacatgcacatatatatacactcgggtacatacatatgtggcta

SEQ ID NO: 1305 - DNA, 58 bp, Homo sapiens
tgagacagagtctcactctgtcacccaggctggagtgcagtggtgtgatctctgctca

SEQ ID NO: 1306 - DNA, 90 bp, Homo sapiens
ccatgtagtgcttggcattattgtaatttatgtttattatttgtattttacaaatatgattatttgattatctgtctcaccactacatgg

SEQ ID NO: 1307 - DNA, 97 bp, Homo sapiens
tcacctggcagccactcccagagcccctggaactctggcccaaggctctctgactgactccttcccagatcttctcggcttagcggctgaagactga

SEQ ID NO: 1308 - DNA, 88 bp, Homo sapiens
ctggcagccactcccagagcccctggaactctggcccaaggctctctgactgactccttcccagatcttctcggcttagcggctgaag

SEQ ID NO: 1309 - DNA, 81 bp, Homo sapiens
cagccactcccagagcccctggaactctggcccaaggctctctgactgactccttcccagatcttctcggcttagcggctg

SEQ ID NO: 1310 - DNA, 77 bp, Homo sapiens
gccactcccagagcccctggaactctggcccaaggctctctgactgactccttcccagatcttctcggcttagcggc

SEQ ID NO: 1311 - DNA, 98 bp, Homo sapiens
cgtccactttttgatggggttgtttgtttttttcttgtaaatttgtttgagttcattgtagattctggatattagccctttgtcagatgagtaggttg

SEQ ID NO: 1312 - DNA, 67 bp, Homo sapiens
gtaaggttgggctgaggcattgtactggctgtcaggcgtgtctgtgtctgtgacagtcccttcatac

SEQ ID NO: 1313 - DNA, 81 bp, Homo sapiens
gagaaccatctttacctctccaagacctatgaaggtgcctgggtccctgtatagacttggaggagggtaaggacggagatc

SEQ ID NO: 1314 - DNA, 119 bp, Homo sapiens
gtataggcagcttgttttcttgtgcttcactttatagcacttagtagatactgtgtttttttatatatatatattttaagttctggggtacatgtgcagaacgtgcaggtttgttatat

SEQ ID NO: 1315 - DNA, 74 bp, Homo sapiens
cccaatattctttgcaatctagagaagtgtggcctttccatgggcctcattttgatgtttaaagaaaaagtggg

SEQ ID NO: 1316 - DNA, 71 bp, Homo sapiens
aattactgagagagaaatgttgaaatccccatacatttatgtggatttgtctatttctttttcagtttgtt

SEQ ID NO: 1317 - DNA, 112 bp, Homo sapiens
cagtaacatcattatctgagatttgaattcacttcaggcacaatagaaaatatatttttttaattttctggacatcttaggaggatattttagatcagaaatcatgttgagg

SEQ ID NO: 1318 - DNA, 105 bp, Homo sapiens
ggccctggcaggaaaatagagggtgaactgagagggcacaaacagggtatttatttgcctggctcccactttgctgaatcactgttggctgtgtctgccatggcc

SEQ ID NO: 1319 - DNA, 97 bp, Homo sapiens
taggtgctttccatatctcatctttacaacaatcttgtaagacgggtattatttttattgttttacagttgaaagaactgagggtcagaaatatttg

SEQ ID NO: 1320 - DNA, 56 bp, Homo sapiens
gagaaggagtctcgctctgtctcccaggctagagtacagtggcgtgatcttggctc

SEQ ID NO: 1321 - DNA, 77 bp, Homo sapiens
gtgtgtgtatatatatacacatatatgtgtgtgtatatatatacatatatatgtgtgtgtatatatatacatatata

SEQ ID NO: 1322 - DNA, 96 bp, Homo sapiens
cacctgttaggtcctgagaaaggttcatcttgaaagtgggggtaaaaattgccacatcctcaggggattgttgtaaggaccgaatgagacaaggtg

SEQ ID NO: 1323 - DNA, 79 bp, Homo sapiens
aggctgtttatcggcacgcggcgacgcatcactcgtacgtgttaaatatatatacgtctctgtgtgtctgtgtatgcct

SEQ ID NO: 1324 - DNA, 169 bp, Homo sapiens
tatatatatatatatgtgtgtgtgtgtatatatatttgtgtgtgtgtatatatatgtgtgtgtgtatatatatatgtgtatatatacgtgtgtgtatatatatgtgtgtgtatatatatgtgtgtgtatatatatgtgtatatacatatacacatatatatatatatat

SEQ ID NO: 1325 - DNA, 98 bp, Homo sapiens
ctagggcaacactatagttttagacagaacaatgagaggtaatgggagtttcctctggctcttgagacccttcttgtttctgatgcttgtcatcctgg

SEQ ID NO: 1326 - DNA, 63 bp, Homo sapiens
tgtcattatatatatgtgtgtgtatatatatataatgtgtatgtatatatgtgtatggagaga

SEQ ID NO: 1327 - DNA, 114 bp, Homo sapiens
gcatgttataatcatagcccgtgtgactttgcattgtacttttttcatgtaactatttttttctttttttgagtcggagtcttgctctgtcacccaggctggagtgcagtgaca

SEQ ID NO: 1328 - DNA, 116 bp, Homo sapiens
gtagtttaatagtgggtcctgaactcaggcagtttaagtctttcagctttgttgttcttttttaaaattgctgaagttaccagatctaggagcaaagagtcagtttttgatgctgc

SEQ ID NO: 1329 - DNA, 95 bp, Homo sapiens; identical to SEQ ID NO: 68

SEQ ID NO: 1330 - DNA, 93 bp, Homo sapiens; identical to SEQ ID NO: 69

SEQ ID NO: 1331 - DNA, 83 bp, Homo sapiens
cctcgagtcacacaggagatgaagcagaagtggaaatagtggccagttttgattctcactagacactgtgctatggcctgagg

SEQ ID NO: 1332 - DNA, 106 bp, Homo sapiens
tgttttttcatttcattggtgttggtgggtgtttaggttttttttcttttttttcttcttttaagatggagtctcgctcagtcacacaggctggagtgcaatggca

SEQ ID NO: 1333 - DNA, 69 bp, Homo sapiens
ccagcagggcagtcatgaattttttttttttttttttgagagagagtctcactctgtcacccaagctgg

SEQ ID NO: 1334 - DNA, 99 bp, Homo sapiens
atttttacatatatatatgcatgtatatataatatgtatatacatatatacataaaatgtgtgtatatatatgtaaaaattggtgtgtatttttgtata

SEQ ID NO: 1335 - DNA, 101 bp, Homo sapiens
gttggatgaatgcgtgaatgaatgaatgaatgaatgaatgaatgagggtaggtcattcagtcttatccactctgttcctcagctccttgcacaagtctggc

SEQ ID NO: 1336 - DNA, 56 bp, Homo sapiens
gggggtcccaggggcaagggggacattctagtgtctctcagtctttgtgacactcc

SEQ ID NO: 1337 - DNA, 110 bp, Homo sapiens
ttaatgtataagagacaggccaagaccttaaattatgatctgggtccaggcttcaaagattcttacccagaaatatatttggggtatggtcctgcattctgtgttattaa

SEQ ID NO: 1338 - DNA, 114 bp, Homo sapiens
gggtgactatggctcaaagtaaagtattgcacattacaaaatagctagaagagaggcttttgatttttttttttttttttttttttttgagatggcgtcttgctttgtcaccca

SEQ ID NO: 1339 - DNA, 57 bp, Homo sapiens
ttctctgtctcactgtaactgactgaggccccggtctgagcaggttgagtcggggag

SEQ ID NO: 1340 - DNA, 101 bp, Homo sapiens
gggtctcactctgtcactcaggctggagtgcagtggctctcactgcactgtacagtctcagctcactgcaacctctgtcccctgtgctcaagtgatcctcc

SEQ ID NO: 1341 - DNA, 118 bp, Homo sapiens
atagacatcataaaattctttgtattttcttctggattcatgttaggttgtatagaattaaatatagcacttcatatatggccagtctagtatagagctcagtgagatgattattcta

SEQ ID NO: 1342 - DNA, 96 bp, Homo sapiens
tgtatgtacagtgcctggtttctctcttttttttcttttttagcctggagctccttcctgccagtcctaagggtgggtccctgggtacagtaagca

SEQ ID NO: 1343 - DNA, 124 bp, Homo sapiens
tgtgtatatatatacatatatatgtatgtgtacatacgtatatatatgtgtgtgtatatatatacgtatatatgtatgtatatatatgtatgtgtatatatatacgtatatatattagtttata

SEQ ID NO: 1344 - DNA, 86 bp, Homo sapiens
gtgtgtgtatatatatatggaatcttcatatatgtgtatatatatatatacacatatatgaagattccatatatatatacacacat

SEQ ID NO: 1345 - DNA, 70 bp, Homo sapiens
tatacacacatatatatgtatatgtatatgtatacacacatatatatgtatatgtatatgtatatgtata

SEQ ID NO: 1346 - DNA, 72 bp, Homo sapiens
ggagggggtttctaggataagtagataagagacaaatggttgtattcttttgagtttctgattagcctctcc

SEQ ID NO: 1347 - DNA, 263 bp, Homo sapiens
atatgtatatatgtgcgtgtgtgtatatatatatgtgtgtgtatatatagatgtgtatatatatgtgtgtatatatgtatatatatgtgtatatatgtgtgtatatatatgtgtatatatatgtgtatatatgtgtatatatatgtgtgtatatatgtgtatatatgtgtgtatatatgtgtatatatgtgtgtatatatgtgtatatatgtgtgtatatatgtgtatatatatgtgtgcgtgtatatatatatatatgctac

SEQ ID NO: 1348 - DNA, 95 bp, Homo sapiens; identical to SEQ ID NO: 68

SEQ ID NO: 1349 - DNA, 93 bp, Homo sapiens; identical to SEQ ID NO: 69

SEQ ID NO: 1350 - DNA, 147 bp, Homo sapiens
gtactttaagcatattttgtgtgtgtgtatatatatatatatatacatgtatatgtatatatatacacacatatatatgtgtatatatgtatatatacacatatatatgtgtgtatatatgtatatatacacatatacatatatgtg

SEQ ID NO: 1351 - DNA, 110 bp, Homo sapiens
tccccaatcatgtcttctccatactgaaaaccaagacattcatatggtatgtataaatatcacatatatgtttaatatgtttaaatcagatgacatatacatattggaga

SEQ ID NO: 1352 - DNA, 115 bp, Homo sapiens
gtctttagacagaatatcagggacacaataagcatttagatactttttttaatttaaaaaggtagatttccaattggtgaatccttatagaatgtctacaaaattgtaaagagac

SEQ ID NO: 1353 - DNA, 95 bp, Homo sapiens; identical to SEQ ID NO: 68

SEQ ID NO: 1354 - DNA, 93 bp, Homo sapiens; identical to SEQ ID NO: 69

SEQ ID NO: 1355 - DNA, 97 bp, Homo sapiens; identical to SEQ ID NO: 1307

SEQ ID NO: 1356 - DNA, 88 bp, Homo sapiens; identical to SEQ ID NO: 1308

SEQ ID NO: 1357 - DNA, 81 bp, Homo sapiens; identical to SEQ ID NO: 1309

SEQ ID NO: 1358 - DNA, 77 bp, Homo sapiens; identical to SEQ ID NO: 1310

SEQ ID NO: 1359 - DNA, 85 bp, Homo sapiens
gtgtctcaggagtagttggagcaggcttcttgggggtagtgggtgcaggctccttgggggtagttggagcagtctccttaggtgt

SEQ ID NO: 1360 - DNA, 115 bp, Homo sapiens
gaataacttagatttctgggcatttcaaagaaaagcatcctgagtaatataatttaattaataaaattagtttctcaggaacttctttctgatcttacagactctgcagtgatgc

SEQ ID NO: 1361 - DNA, 103 bp, Homo sapiens
cccccaatctttcagtgtaggttctttctattttctatgagtgtcggctggctgagaaatagacagtacaaagagaggaattttacagctgggctgccagggg

SEQ ID NO: 1362 - DNA, 100 bp, Homo sapiens
tcagctgtattatatactacagtctatgtttatgtattttatgtctctgcctccttcagtctgtttataaatataggctgagtatatgttcttatattga

SEQ ID NO: 1363 - DNA, 104 bp, Homo sapiens
gaatttggaatgtgatgtacaatgcagtctttctgggcttctgttttttcatttattaaaatatgtaaggttggcagttgcataaaaacactcattgcaagttt

SEQ ID NO: 1364 - DNA, 86 bp, Homo sapiens
tgtttatattacatgtttatgtatgtatatgtttatattatatataaacattatatattgtttatatgtttatataaacataaata

SEQ ID NO: 1365 - DNA, 90 bp, Homo sapiens
gcttttggaagagaaacactgcccctgtcactctgtggcccaggagggacagagcttcagggaaaaacaacttgcactctctcctcgtgc

SEQ ID NO: 1366 - DNA, 58 bp, Homo sapiens
tgagacggagtctcactgtgtctctcaggctggagtacagtggtatgattttggctca

SEQ ID NO: 1367 - DNA, 91 bp, Homo sapiens
tggaaacagagaagttggcagcaaattgagcaaaagaatcaaactgttttttattttgtgaagtttgacattggttgtatctctgtcttca

SEQ ID NO: 1368 - DNA, 74 bp, Homo sapiens
tacaaataacaatacctgtacatatgtatgtgtgtgaatgtttatatatgtgtgtgcatgtctgtgtgtgtgta

SEQ ID NO: 1369 - DNA, 106 bp, Homo sapiens
ttttggaaggttattaattatcgattcaattttttaaatagggataggccaattcagattgtcaatttcttattgtgtgaattttggcagattgtaccttctagaa

SEQ ID NO: 1370 - DNA, 114 bp, Homo sapiens
gtcttggctgtgcgggttcttttttggttccatatgaaatttaaagtagtttttttctaattctgtgaagaaagtcaatggtagcttaatggaaagtcaatggatagcattgat

SEQ ID NO: 1371 - DNA, 113 bp, Homo sapiens
accattctctattcttatatagtgatcatctgttctaaatgttattcaaggttcatttaagtgtttttttttttttttttgagacagagtctcgctatgttgcccaggctggt

SEQ ID NO: 1372 - DNA, 58 bp, Homo sapiens
tgagacagggtctcacactgtcacccaggctggagtgcagtggtgagatcttggctca

SEQ ID NO: 1373 - DNA, 87 bp, Homo sapiens
ctggaccagacagaagaggctgtgcacgtagttatgcaaaagaatctgcatcctaaccagtgcctacacaggctgagtgtcccccag

SEQ ID NO: 1374 - DNA, 116 bp, Homo sapiens
gtgaaggtaaggagagaaatagagcagaagggaggagagaatacagaatccagaaaatgttttttgttctttattttctttttataactgagtttagaacatgtttatatttttat

SEQ ID NO: 1375 - DNA, 62 bp, Homo sapiens
tttctttagaggccggcagtctggcagcttattgactcggactgtgtgtcagactgaggggg

SEQ ID NO: 1376 - DNA, 119 bp, Homo sapiens
tcacctctccttatctgtgctttattgtctactctttctgtctgcttgttcctggaagagaagtgatttccttgaaatgtatgaggttagcaagagagctggaacttaaagtggtggtg

SEQ ID NO: 1377 - DNA, 86 bp, Homo sapiens
ctgtgtgagagttactttagttatctttgtgtttattatttcttgaggcctagaggatatcaaatctattgttggatctgacacag

SEQ ID NO: 1378 - DNA, 58 bp, Homo sapiens
tgagacggactctcgctctgtttcccatgctggaatgcagtggcgcgatcttagctca

SEQ ID NO: 1379 - DNA, 77 bp, Homo sapiens
gtcatgagggtttgttgtatataattaattatgttgtatatgttatatatataatatatatataacacctgggtgat

SEQ ID NO: 1380 - DNA, 109 bp, Homo sapiens
aagttccttgtagattctggatagtagacttttgtcagatagatagattgcaaaaattttctcccactctcactctgataatagtttcgttggctatgcagaggcactt

SEQ ID NO: 1381 - DNA, 83 bp, Homo sapiens
ttggaaacagacagatatcttggctcttaccagtgacagagagaatcctttgaggctgtgagttcatgctgagtgatttccaa

SEQ ID NO: 1382 - DNA, 63 bp, Homo sapiens
atgcatgtgtgtatagagatgtttttcctcggattgggggtcccactctgtgtgtgtgtgtat

SEQ ID NO: 1383 - DNA, 87 bp, Homo sapiens
ggaggtttggggtaagatttcttaggaatagagtccagggactcctagtactttatttattttcatagaaattagccttaattttct

SEQ ID NO: 1384 - DNA, 113 bp, Homo sapiens
ccttggcagcattgcagcccggatatagacaggagtgtctgacagaactgtgtgtcctgagtaccaggataagggtgtgacagagaaatgggtcatgttcctgcctacccagg

SEQ ID NO: 1385 - DNA, 90 bp, Homo sapiens
gcatctagcagtaatcagtggctgagttgacctcattttttttttttttttttgagacagggttttgctctgtcactcaggctggactgc

SEQ ID NO: 1386 - DNA, 82 bp, Homo sapiens
ttaaaaatatgtatgtgtatatatatgtatatgcatatataaatatatatttatacatacatatatacatgcatatctgtaa

SEQ ID NO: 1387 - DNA, 72 bp, Homo sapiens
tttttttgaggcggagtctcgctctgtcacccaggctggagtgtgcagtggcgtgatctcggctcactgaaa

SEQ ID NO: 1388 - DNA, 118 bp, Homo sapiens
gtgcaaggaaaaattttggttggcacctaaaggtggtatctcattatagtttttatttgatttttctgatgattagtgatgttgaacatcttttaatgtgcttattgaatatttgtat

SEQ ID NO: 1389 - DNA, 95 bp, Homo sapiens; identical to SEQ ID NO: 68

SEQ ID NO: 1390 - DNA, 93 bp, Homo sapiens; identical to SEQ ID NO: 69

SEQ ID NO: 1391 - DNA, 58 bp, Homo sapiens
tgagacagagtctcactctgtcacccaggctggagtgcagtggtgcgatcttggctca

SEQ ID NO: 1392 - DNA, 56 bp, Homo sapiens
gagacagagtctcactctgtcacccaggctggagtgcagtggtgcgatcttggctc

SEQ ID NO: 1393 - DNA, 95 bp, Homo sapiens; identical to SEQ ID NO: 68

SEQ ID NO: 1394 - DNA, 93 bp, Homo sapiens; identical to SEQ ID NO: 69

SEQ ID NO: 1395 - DNA, 82 bp, Homo sapiens
tttgaaggatgaaagtcagactgatatctggaaagaaattttctttttgtatgtcagtgattgaatttgggtcactttcaaa

SEQ ID NO: 1396 - DNA, 115 bp, Homo sapiens
ggattaagaaaattgacagtcctcttttgcaccacagcatatgacagggagctaagcacaggggaggcaccacttactacatgtgttgtatgctggagaacccaagttttgctcc

SEQ ID NO: 1397 - DNA, 95 bp, Homo sapiens; identical to SEQ ID NO: 68

SEQ ID NO: 1398 - DNA, 93 bp, Homo sapiens; identical to SEQ ID NO: 69

SEQ ID NO: 1399 - DNA, 106 bp, Homo sapiens
ttcataatgcttcaggcagtttttttaaggctttcagtatcatatgcagtttctgcttcagcaactgttggtacctttttaagattgtcaagatagaatccatgaa

SEQ ID NO: 1400 - DNA, 112 bp, Homo sapiens
atgtaagaattgccttgaaaagaagcaggtggtgcagaggagagtgagcagagctggcctgagactgctgtccttcaaagacctgcttgcaaagtgggcccatgtctggcat

SEQ ID NO: 1401 - DNA, 95 bp, Homo sapiens; identical to SEQ ID NO: 68

SEQ ID NO: 1402 - DNA, 93 bp, Homo sapiens; identical to SEQ ID NO: 69

SEQ ID NO: 1403 - DNA, 89 bp, Homo sapiens
ggcatggtggctcacacctgtaatctctgcactttggaaggctgaggtggcagatcacttgaagtcagaagtttgagaccagcctggcc

SEQ ID NO: 1404 - DNA, 102 bp, Homo sapiens
ccttttaattttattgagacttgtgttttgactaacacatggtctgtcctggagaatggtctatgtgcatttgaaatgaatgtgttatcttgttgtttgagg

SEQ ID NO: 1405 - DNA, 100 bp, Homo sapiens
atatatgtgaacttcatatatatatatatgaagttcatatatatatatgtgaacttcatatatatatatatgaacttcatatatatatatatgaacttca

SEQ ID NO: 1406 - DNA, 79 bp, Homo sapiens
cagacacgccagacacacagaggaggcctgcggcttagggtgttgagaatttgcctccctccctcactgacagcttctg

SEQ ID NO: 1407 - DNA, 114 bp, Homo sapiens
tttgggtcatttctttagggttgtactaaacccaggaagactctacttagctgtctctttcactgattcttggtggtgtactagctgggctatggttaaccttgttgctctaaa

SEQ ID NO: 1408 - DNA, 107 bp, Homo sapiens
tcaggcatctgttaagtaagaatgctgaatattttggatatgtttattattatttataatgtttttttaaaatattctataattttagtgaagtacattacgcttga

SEQ ID NO: 1409 - DNA, 58 bp, Homo sapiens
tgagatggagtctcactctgtcacccaggctggagtgcagtggtgtgatctcggctca

SEQ ID NO: 1410 - DNA, 63 bp, Homo sapiens
tataattgtaattgtatatgtataatccctaatacatatagtatgtgtataattgcaattgta

SEQ ID NO: 1411 - DNA, 76 bp, Homo sapiens
tttgtccttgcccttgatatggtaacagtgtgtgtcacatccgaccctctgtcagccagtgtccctgagagacaaa

SEQ ID NO: 1412 - DNA, 86 bp, Homo sapiens
tttggcaccaaataaagatattgatgatgatgttgatgataaaaataattaacatctgttgatttcttattatgtaatttgccagg

SEQ ID NO: 1413 - DNA, 98 bp, Homo sapiens
gcacatattagaagacttgaattttagtacagtcataataagtaattattattattattttttattattattatactttaagttttagggtcatgtgc

SEQ ID NO: 1414 - DNA, 67 bp, Homo sapiens
ggatacatatgtgtgtgtgtgtgtgtgtgtgtatatacacacacacatatagtgtatatgtgtgtgt

SEQ ID NO: 1415 - DNA, 107 bp, Homo sapiens
gttggttctatggtataatgtataagtatactgctctatttatataattgtacagtacatcagtacatatatatagcagtcttctacatatataatatataattaat

SEQ ID NO: 1416 - DNA, 83 bp, Homo sapiens
tatatataggtatatatacatatgtgtgtatatataggcatatatatacatatatgtgtgtgtgtgtatatatatatgtatat

SEQ ID NO: 1417 - DNA, 104 bp, Homo sapiens
agacattttttataagctttatagttaccctaaggaaatgaaatggctacaaaatatagatatatattttgtacttagatggtacttagattgttaatttgtct

SEQ ID NO: 1418 - DNA, 107 bp, Homo sapiens
tgagataggaagacaggttattattactgataagtatagtatgtgattcttctattatatatatctatataaatcaactcttgtatattatggcctttaatatttca

SEQ ID NO: 1419 - DNA, 107 bp, Homo sapiens
tgtgatcagtctcttttgtcttatggcttttaatattctctgtttgtatttgacttttgacatattgattacaacatggcttataagcacattgaactttgattata

SEQ ID NO: 1420 - DNA, 78 bp, Homo sapiens
tatagttctttgtttgttgttgaattcttgcccttggttttacagggggagaattagcagtgtttttttggtgttgta

SEQ ID NO: 1421 - DNA, 106 bp, Homo sapiens
ctgttcagtatgatgttggctacgtgtttgtaatagatggctaccattgtattgaagtatgttattttagtgtgtagtctgttgagggcttttatcatgaatggat

SEQ ID NO: 1422 - DNA, 94 bp, Homo sapiens
tgtcgtctatataagtcattttatattgtcatatatatatatagatatataaatgacttgctcttctgtgaaacatgaatatatatatatgacg

SEQ ID NO: 1423 - DNA, 80 bp, Homo sapiens
catgtgcatgtgcatgcgcatatatgtatgtatgtatgtatgtatgtatgtatgtatgtatgtagtgtgtgtttgtagat

SEQ ID NO: 1424 - DNA, 115 bp, Homo sapiens
ccagtactatgttgtacaggagtagtgagacagggtgtcctttttttttttttttttttttttctaattatcaaggggaacccttccagctttttctctttcagtatgatgttgg

SEQ ID NO: 1425 - DNA, 86 bp, Homo sapiens
ttgattggattttgtggttcaaaacatataatttgtaaacatttattgtgtttaggaatgctgttaagagtgacgactacaattaa

SEQ ID NO: 1426 - DNA, 95 bp, Homo sapiens; identical to SEQ ID NO: 68

SEQ ID NO: 1427 - DNA, 93 bp, Homo sapiens; identical to SEQ ID NO: 69

SEQ ID NO: 1428 - DNA, 97 bp, Homo sapiens
tctagtctctctctcaagagtctttcctatattgttcttatttatttatttatttattttatttgagacaaggtctcactctgttacacaggctaga

SEQ ID NO: 1429 - DNA, 99 bp, Homo sapiens
catttgcttggtagatcttcctccatccctttattttgagcctatgtgtgtctctgtatgtgagatgggtcttgactctatccaatttgccagcttgtg

SEQ ID NO: 1430 - DNA, 88 bp, Homo sapiens
tatgcatatatatgtatgtatgcatgtgtatatgtgtttgtgtataattatatatatatacacacacacatacatatacctgtgcata

SEQ ID NO: 1431 - DNA, 95 bp, Homo sapiens; identical to SEQ ID NO: 580

SEQ ID NO: 1432 - DNA, 93 bp, Homo sapiens; identical to SEQ ID NO: 69

SEQ ID NO: 1433 - DNA, 109 bp, Homo sapiens
tagatgtatatatattattcatccaatatatataagatgtgtatatatatatattactgtgtatatatatgtgtatatgtatgtgtgtatatgtatatatatgtatatc

SEQ ID NO: 1434 - DNA, 56 bp, Homo sapiens
tgtatgtgtgtatatatatgtgtatatatacacacacatatatatatacacacaca

SEQ ID NO: 1435 - DNA, 58 bp, Homo sapiens
tgagacagagtctcactctgtcacccaggctggagtgcagtggtgtgatctcggctca

SEQ ID NO: 1436 - DNA, 95 bp, Homo sapiens; identical to SEQ ID NO: 68

SEQ ID NO: 1437 - DNA, 93 bp, Homo sapiens; identical to SEQ ID NO: 69

SEQ ID NO: 1438 - DNA, 111 bp, Homo sapiens
ccttagtgtactgaataatgtgaattggagtgctacagaaatttgcagtttttcttcttcagaatgctgtattaaatattgcattgtctattaggcagacctacatggagg

SEQ ID NO: 1439 - DNA, 70 bp, Homo sapiens
cttatgcagtgagtccgtgggggcgaggggacttgagtgccagtcttgtctctgtgtgaccttgggtaag

SEQ ID NO: 1440 - DNA, 109 bp, Homo sapiens
gctgggaccacaggtgcacaccactacacctggctaattttgtattttttttgtaaagacagggtctcgctatgttgtccaggttggtcttgaactcctgagctctagc

SEQ ID NO: 1441 - DNA, 116 bp, Homo sapiens
gtgactatgggaaataaggtacagccttgtctttgatgtacatatggtaaagttagaaagataatttaaaattttaatttttgtttttttagagacagggtctcactctcttacac

SEQ ID NO: 1442 - DNA, 85 bp, Homo sapiens
ccttgcctatggctctgaagctaatgctttttataactatttttgtcataaaactgctaattttcaaggctgtcacagagctggg

SEQ ID NO: 1443 - DNA, 82 bp, Homo sapiens
tctataatttctctatatatctatatctctacataaagaaactatagatatataaaatgatatgtagagatatattgtgaga

SEQ ID NO: 1444 - DNA, 77 bp, Homo sapiens
tgatcttatttggactgtctgttattttgtgccaagccacatcacagaagactgactggatagttcttcttaggtta

SEQ ID NO: 1445 - DNA, 99 bp, Homo sapiens
agtgggagtacttaagaaacaaaataaaattgtgtttctttaatgttctttataaaagaatgaatattttattacaaacttttgttttgttttcccact

SEQ ID NO: 1446 - DNA, 102 bp, Homo sapiens
atgaatatatatatacacacacacatatatatgactatatatatactatatacagacactgtgtgtatgtgtatatatgtgtgtgtgtatatatatgtatat

SEQ ID NO: 1447 - DNA, 59 bp, Homo sapiens
gccaatagtgtaactctcagtctgaggctgaaggcctgagaacctgagggactactggt

SEQ ID NO: 1448 - DNA, 94 bp, Homo sapiens
gaacattcattgaccagagattttgaagtactgattagaagccagtcctaacaaaagtcagacttcttaatcttatctcacatttggactgttc

SEQ ID NO: 1449 - DNA, 75 bp, Homo sapiens
tcagagaagatttagtttcaatgctattttaattaattttgaaatatgccagttggaactatacttcagatctgg

SEQ ID NO: 1450 - DNA, 62 bp, Homo sapiens
ttttgaaatctacagatatttcaaaatatgtttatatttacaaatatctgtatatttcaaaa

SEQ ID NO: 1451 - DNA, 87 bp, Homo sapiens
tgagatttataattttcacacattctgacagcctcagtgctataatgcataagggttgcagagacctgtgggacctctaaaatctca

SEQ ID NO: 1452 - DNA, 68 bp, Homo sapiens
ggagatgcagaaggagagaggtgcagggtgaggatggagagcagacactgagtacactccctgactcc

SEQ ID NO: 1453 - DNA, 85 bp, Homo sapiens
cgccacaatgcccggctaattttttatatttttagtagagactgaatattttcttttagtcaagatacagaaggctggacaggcg

SEQ ID NO: 1454 - DNA, 111 bp, Homo sapiens
gcgccaccaggcattcgcctcttcaaagccgctttcgggggtttggttactttatttctaaagttgtttgtatttctaaagtggccattgaggcgcgagcggggactgtgc

SEQ ID NO: 1455 - DNA, 87 bp, Homo sapiens
gttatggacatgtttgcaaatataatgaaaatttttttcatggattgggaaaggtgggaaattatgcagatattaatggtgcatgac

SEQ ID NO: 1456 - DNA, 107 bp, Homo sapiens
ttttttcacatggtccaaatcacttctgaggattattttatgtggcagatatttttacatatatatttgaacagttgtccagagtagataatagattattggagaaa

SEQ ID NO: 1457 - DNA, 94 bp, Homo sapiens
aactgtgatgtatataactgtgatatctatatgtatctatatatctgtctatctatatatagatagatataaatcacagttatataccacagtt

SEQ ID NO: 1458 - DNA, 90 bp, Homo sapiens
tgggtattcaaaagggaaaatagtgtatatacatatatgtatttttgcatatatatatatgtgtgtgtatagtctttcaaaacttgctca

SEQ ID NO: 1459 - DNA, 95 bp, Homo sapiens; identical to SEQ ID NO: 68

SEQ ID NO: 1460 - DNA, 93 bp, Homo sapiens; identical to SEQ ID NO: 69

SEQ ID NO: 1461 - DNA, 101 bp, Homo sapiens
taagcctcagggatttttctcggtataaaatgaagtttcttgtatctgacaagacccatgttcataatttatccctgaaagtattcccactgggtggcttg

SEQ ID NO: 1462 - DNA, 109 bp, Homo sapiens
gaagaaatttgtcttaaaagggaaggggaaaagagaggtgacatgactataagccagtgatgaaataattttattttattttcctgaatgttataggacataaagctcc

SEQ ID NO: 1463 - DNA, 103 bp, Homo sapiens
tgttggcatcacctaactactgctcgtaactgccaattcaatctactgtcattcctacctatactgttgagctaattgagcaatagttttccatgcttctaca

SEQ ID NO: 1464 - DNA, 158 bp, Homo sapiens
cactccagcctggagatagagcgggactctgcctcaaaaaaaaaaaaaaaaaaaaagtcgaattcttttttttttttttggagatggagtctcactctgtcacccgggctggggtgcagtggcgcaatctcggctcactgcatcctccacctcccagg

SEQ ID NO: 1465 - DNA, 98 bp, Homo sapiens
gtaatgtggattcctcttaggtgttctgtaactctctatcactatatatgaatttcattttaaaacttaggcaggatatctattggatactgctctac

SEQ ID NO: 1466 - DNA, 116 bp, Homo sapiens
cattgtggttttgatttgcatttctctgatgatcagtgatgatgagcctttttttttgtttttgtatgtttgttggccacataaatgtcttgagaagtgtctgtccttaccctttg

SEQ ID NO: 1467 - DNA, 106 bp, Homo sapiens
tgtatatgtatatttaaaaataattctacacgtatatatatttgtgtgtatatatacatatatacacatatacatatatgtgtatatatgcatatgtgcatatata

SEQ ID NO: 1468 - DNA, 107 bp, Homo sapiens
tatctgtatatttaatatatatgctattataaatgtgtaacattttaaaatgtaatattttaatatttacatataatatatatttgtatatatgtcatataatgatg

SEQ ID NO: 1469 - DNA, 89 bp, Homo sapiens
gggtttaaaagtaacttatagcagctcaattctctctttactggctatggcagagaggatagcttttttttatttgtatgtaaaaaccc

SEQ ID NO: 1470 - DNA, 106 bp, Homo sapiens
tatgtgcctgtgtgttatatgtgcatgggagtattgtatgtgcatgtgtagaatctgtgtgtgcatgtgcaagtatttgtgtgtatatgtgtgaattttttatgtg

SEQ ID NO: 1471 - DNA, 113 bp, Homo sapiens
cacattcatcgactgagacaaccacttccatatatttaatgtgtatactagtttttaaatatttcacacatgtgatatggaatcttcaaaaatgggtgacttttgtaggtgtg

SEQ ID NO: 1472 - DNA, 111 bp, Homo sapiens
tatctggtggcaatataatggggcactctggatgagtaagtgaaacatatatatgaaaattttaaattattcaattaccagattttccagaatattgtaaatttgaagata

SEQ ID NO: 1473 - DNA, 70 bp, Homo sapiens
tatatatacattctgtatatgtgtataaatatataaaatacataatacatatattatagatgtatgtata

SEQ ID NO: 1474 - DNA, 71 bp, Homo sapiens
ccagcgtggtggcgggcgcctatagtcccagctactcaggaggctgaggaagaagaatgtcatgaacctgg

SEQ ID NO: 1475 - DNA, 101 bp, Homo sapiens
gctgtgtaatattctctggtatgaataaccacaatttgttcatctgttatactgttgatgagcatttgtttattttcctttcagggcttatttaatgtagt

SEQ ID NO: 1476 - DNA, 76 bp, Homo sapiens
agtgtggattgtagtaccagagtagtcccaccttgaggctgggggctggcttttggtactgtgtcagtcagtcatt

SEQ ID NO: 1477 - DNA, 132 bp, Homo sapiens
cccccacatcttcctgacttacctgaaggatagattggttgcagatgggtaggtgggggacagatgtgagacaggacatggctgggagcactagctctgatatacgctttctggattccataggggactggc

SEQ ID NO: 1478 - DNA, 113 bp, Homo sapiens
gtgcatgtctgtttttctaggcttcctttcagctccattgatttatttatttatcctcaagtaaatacttcattagagctttataggaaggatagaagtaatatggtttgtac

SEQ ID NO: 1479 - DNA, 83 bp, Homo sapiens
gtgagtttggctggtgaatcatcaagcctaagaggttttgtgaacctcttgaatttgtggttgatgacagaagtgagagtcgc

SEQ ID NO: 1480 - DNA, 108 bp, Homo sapiens
gaggaaccaaccctggactgagtcagggagccaggtggggctctgcctctccatcactgtgtgtctctgttaggttgcagccttaatcccctctctgggcctcagttt

SEQ ID NO: 1481 - DNA, 103 bp, Homo sapiens
tatatatatacatatatactgtatatgtatatatacatatatatgtatgtatatgtatatatatgtatatatgtatgtatatgtgtatatatatatatataca

SEQ ID NO: 1482 - DNA, 89 bp, Homo sapiens
gtctctgcaaacagcttagagtgaactcttttttttttttttttttgcgatggagtctcactctgtggcccaggctggagtgcagtggc

SEQ ID NO: 1483 - DNA, 58 bp, Homo sapiens
ctctgtgtatatgtgtatgtgtgtgtatatatatacatatatacacacacacacagag

SEQ ID NO: 1484 - DNA, 84 bp, Homo sapiens
tctgtgtgtgtgtgtgtgtatatatatatatatatatactaatggaatatatatatatacttttacatactattacatatgaca

SEQ ID NO: 1485 - DNA, 98 bp, Homo sapiens
tatatatatattccattagtgtgtgtatatatatatatatatacactatatagtatatatataaagtatatatgtatttcattagtgtatatatatat

SEQ ID NO: 1486 - DNA, 130 bp, Homo sapiens
gaaggaggaaatattcatgacaattacagtcctcgtttcttcagctggtcatgtgtttgtagctggtattgatgactactttctctactacccattctgtgttcccattgccttcagcaagcatcccagc

SEQ ID NO: 1487 - DNA, 117 bp, Homo sapiens
ctatacagtcagcacacagggattcaataaaaggtttatctggccaactgaaagggattttttttttttttttttttttgagactagtctcgccttgtcgcctaggctggagtgcag

SEQ ID NO: 1488 - DNA, 83 bp, Homo sapiens
gaaaagtttgcctccaagtcagtgattgagggacccagctgccttcaaatattgtcactgtcacactctgaggtcttagtatc

SEQ ID NO: 1489 - DNA, 91 bp, Homo sapiens
cctagctttaccacttagtgctgtgtgacctcaggcaatctactcagcctctctgtgcctcggtttaggattaagtgagtttgtatgtagg

SEQ ID NO: 1490 - DNA, 95 bp, Homo sapiens
gtaggctaggtatcagttgagactgtaattctatgacaattttactaaaataattttattttaagataagcaatggatcagcagatgtctgccac

SEQ ID NO: 1491 - DNA, 88 bp, Homo sapiens
tatacacacacatatatatacatatatgcaggggaatgtgtgtgtatgtatatgtgtgtgtgtgtgtatatatatatatatctcctgc

SEQ ID NO: 1492 - DNA, 79 bp, Homo sapiens
atgtgtgtgtatatatatatatagtgtgtgtatatacacatatatatacaccctgcatatatatatatcctgcatacat

SEQ ID NO: 1493 - DNA, 109 bp, Homo sapiens
gcttgtcaggagggttgaggtgaagatgttggcagagggagtaccttaagggctggctgtctcactgtttcatttgtgcaagcatctggcctttccacatgctgaaagc

SEQ ID NO: 1494 - DNA, 112 bp, Homo sapiens
gataagagctgtctgaagaacagaggagagtgaggacaagctggaacatgcaggcagccctgagtctgtttgtcactctatctaaccatgatgaccttcagacagtaatatc

SEQ ID NO: 1495 - DNA, 78 bp, Homo sapiens
atatataaatgtatatatacacatatatgtgtatatgtatatatgtgtatatatgtatatatatgtgtatgtgtgtgt

SEQ ID NO: 1496 - DNA, 111 bp, Homo sapiens
ggtagtatataaactgtttttctaaaacacaggtgtttgtgtttttgttttccctctcagacacactgactgcctggtattccctgaaagtcccactgtttcataactact

SEQ ID NO: 1497 - DNA, 82 bp, Homo sapiens
tgttatatactatatactagtatacttacatatactaatatatgtatatgtaacaaatatatttgtatattttgtgtgggca

SEQ ID NO: 1498 - DNA, 97 bp, Homo sapiens
tatatgtatgtatatacagacaaccatttattgtgtatattgattttataaatatatttacgcatattatggatgtgtgtcatgtataaaacatata

SEQ ID NO: 1499 - DNA, 119 bp, Homo sapiens
caaaatgcacaaggattagatcttctgggttgatattgaaaaataagggtctttatttgtttataatgaagattattcattaatttatccaacaagtactaattcagcaggtttttttg

SEQ ID NO: 1500 - DNA, 58 bp, Homo sapiens
tgagacagagactcactgtgtcacccaggctggagtgaagtggtgaagtctctgctca

SEQ ID NO: 1501 - DNA, 58 bp, Homo sapiens
tgagcagagacttcaccacttcactccagcctgggtgacacagtgagtctctgtctca

SEQ ID NO: 1502 - DNA, 95 bp, Homo sapiens
cccttataagaagagataccagaaagcttcctcactctgtctctccttgtgccatataaggacgaagcaagaaggcagctgtcggcaacctaggg

SEQ ID NO: 1503 - DNA, 100 bp, Homo sapiens
gaatttccttttttaaaaaagccgatttgtgtatatatgtatgtgtgtgtatatatatgtatatacatatatatataaaacacatttaaaaattcaattc

SEQ ID NO: 1504 - DNA, 111 bp, Homo sapiens
acagccaaacagaattgattttgaatacgttgaaaactaattttttcttctttaaaataaaggacagaaatgttttagaataatgattaaacttcagatttctgcagctgt

SEQ ID NO: 1505 - DNA, 84 bp, Homo sapiens
agcagaatggctagaaaccagactgccaaggttccaactggttcttcaaacctcaggaactcactctgtctgagcctattcgct

SEQ ID NO: 1506 - DNA, 72 bp, Homo sapiens
ctgggcgtggtggcacatgcctatgatcccagctgctaaagaggctgaggtaggaggatcacttgagcccag

SEQ ID NO: 1507 - DNA, 58 bp, Homo sapiens
tgagacaaggtctcactctgtcgctcaggctggagtgcgatggcgtgatcttggctca

SEQ ID NO: 1508 - DNA, 104 bp, Homo sapiens
aaatgccaaatttggagctgaatagatctgtgtgtctgtatcagtcttctgagactgcccataacaaaacaccatagactgggtggcttaaccagcaaacattt

SEQ ID NO: 1509 - DNA, 117 bp, Homo sapiens
ctcctcactctcagaagggagcccagttcagagagcttttcttttttcttttttttctttttttgttatttttcttgagatggactctcgctctctcgccaggctggagtgcagtgg

SEQ ID NO: 1510 - DNA, 118 bp, Homo sapiens
tttattgtatatagtatactagtatatatagatatatactatctacattattatagatatatagtacatgtcatatagtgtatacaatatgtaatatatacagtatatacactatgag

SEQ ID NO: 1511 - DNA, 82 bp, Homo sapiens
tgttaatttgattgtaggagctaaaatattttatatgtataatatgtagaaagttattttactcttatcaggtaaataagca

SEQ ID NO: 1512 - DNA, 73 bp, Homo sapiens
cacggtcatgtgtggggacgtgggccacaggactgaacggagagtctggtgtgtgcatctgcatgtgtatgtg

SEQ ID NO: 1513 - DNA, 106 bp, Homo sapiens
gagagtttcaagaagaatggaatggccattatcaaatcatgtgtaggcatcgagagagagaactgtatttgatcattaaaatgtcacaattcattctgagactgcc

SEQ ID NO: 1514 - DNA, 107 bp, Homo sapiens
tcagaagtgagaaacttgttctgtaaaaaagcagatataaaatgttttcatttttataaatgacttgcctatactgttctttattatatattaagtggctcctctga

SEQ ID NO: 1515 - DNA, 116 bp, Homo sapiens
gtgtgtgtgtgtgtgtgtgtatgtgtatatatatatatgtgtgtgtgtatatatatatatgtgtgtgtgtatacacacatatatatatatgtgtgtgtgtatacacacatatatat

SEQ ID NO: 1516 - DNA, 58 bp, Homo sapiens
tgagagggagtcccactctgtcactcaggccggagtgccgtggtgcgatctctgctca

SEQ ID NO: 1517 - DNA, 96 bp, Homo sapiens
ccatcagggatgtcaccaggctgacacagtgacttctggctggcaagtaattttgaagttgtgttaaggacaattagggagacattcctgtcgtgg

SEQ ID NO: 1518 - DNA, 95 bp, Homo sapiens; identical to SEQ ID NO: 68

SEQ ID NO: 1519 - DNA, 93 bp, Homo sapiens; identical to SEQ ID NO: 69

SEQ ID NO: 1520 - DNA, 78 bp, Homo sapiens
cctgagtggagacttgtctctttctataaactatggacccagggtgttcagagagatttgcctcagacatagcctagg

SEQ ID NO: 1521 - DNA, 61 bp, Homo sapiens
tttcagtagtaagtagttagagcttgtctttattctgacagtctctgactttgaactgaaa

SEQ ID NO: 1522 - DNA, 58 bp, Homo sapiens
tgagatggagtctctctctgacgctccggctggagtgcagtggcatgatcttggctca

SEQ ID NO: 1523 - DNA, 107 bp, Homo sapiens
ctctcagataagggggacaattgtaagtctttacttcacccagctcttttatttatttatctatttatttattgggaaaagatctctctctgtctctcaggctggag

SEQ ID NO: 1524 - DNA, 104 bp, Homo sapiens
ttgctgggtcaatgtaaatggtatatgtacaattgtatatgtatatatacaatgtatatgtattgtatacaattgtatatctatatgtacaatgtaaaatgtaa

SEQ ID NO: 1525 - DNA, 104 bp, Homo sapiens
gtgtatatatgtatatatatgtacatgtgtatatatgtatatatatgtacatgtgtatatatgtatatatatatatgtatgtgtgtgtctgtgtgtgtgtgtgt

SEQ ID NO: 1526 - DNA, 59 bp, Homo sapiens
atatacacacacacatatatatatgaagtctatatatatatatatatatgtgtgtatat

SEQ ID NO: 1527 - DNA, 78 bp, Homo sapiens
tggtgctctctctgacactgtggcaccagcagggctctttaacatggtgtcctcatggttcagagcactgagtatcca

SEQ ID NO: 1528 - DNA, 98 bp, Homo sapiens
acacatggacaaagaaatatagacaagaatgagcagtacaacatttatttcaaaataaataaatataagtatgtgcatatatgtgtctgtgtgtgtgt

SEQ ID NO: 1529 - DNA, 80 bp, Homo sapiens
atatattgggctgtttggcttttccttatggatatgtaattctttatatattcaagagagcaattcagtattaattatat

SEQ ID NO: 1530 - DNA, 76 bp, Homo sapiens
gatgctctcctacatgtctggcttctgcaaaaccttacctggttaggtctgagagtcgagtgtgtcctgagtgctc

SEQ ID NO: 1531 - DNA, 77 bp, Homo sapiens
acactatgtatatgtatatgtgtatatatacatatatagtgtatacatatacactatatatatatatctcacagtgt

SEQ ID NO: 1532 - DNA, 80 bp, Homo sapiens
tgtgtatgtgtgtatgtatgtatatgtatatatgtatgtatttatatatgtatacatgtatacacacaggtacatacaca

SEQ ID NO: 1533 - DNA, 95 bp, Homo sapiens; identical to SEQ ID NO: 68

SEQ ID NO: 1534 - DNA, 93 bp, Homo sapiens; identical to SEQ ID NO: 69

SEQ ID NO: 1535 - DNA, 95 bp, Homo sapiens; identical to SEQ ID NO: 68

SEQ ID NO: 1536 - DNA, 93 bp, Homo sapiens; identical to SEQ ID NO: 69

SEQ ID NO: 1537 - DNA, 126 bp, Homo sapiens
actataatgtgttatgtgttattatatactatagattatatgtttatattatatatagatatataatatctatatgatattgatatatatatcatatatagtttttgcgtgtatatatatttatgg

SEQ ID NO: 1538 - DNA, 101 bp, Homo sapiens
gctcggctaatagaagtagacgatggattactcattatgtaattgtgtcattacatttgctcattacattacattatcatgtctgggaatctaagttgagt

SEQ ID NO: 1539 - DNA, 182 bp, Homo sapiens
atatacacacatatatatgtgtgtatatatatgcatacgtgtatatatatgcatatgtatatatatatatatgtgtgtgtatatatgtgtatatatacgtgtgtgtatatatgtatatgtatatcttggaatgctatttatatatatcatatatatgttttatatatatatatatatcatat

SEQ ID NO: 1540 - DNA, 63 bp, Homo sapiens
catatatatacacacatatatatacacatatatacatgtgtatatatatgtgtgtatatagtg

SEQ ID NO: 1541 - DNA, 56 bp, Homo sapiens
tatatacacacatatatatacacatgtatatatgtgtatatatatgtgtgtatata

SEQ ID NO: 1542 - DNA, 77 bp, Homo sapiens
ctcacacactcacacacacatacatatacacatatataagtgtgtatatacatatgtgtgtctgtagagggagcgag

SEQ ID NO: 1543 - DNA, 118 bp, Homo sapiens
gctgttggactggaatttgaaatatcagtgtgaactcagggttttctttttctttctttctttttttttttttttgagatggaatctcactctgtcacccaggctggagtgcaatggc

SEQ ID NO: 1544 - DNA, 86 bp, Homo sapiens
tgagacagagtctcactctgtcactcaggcttgagggtagtggtgcgatcttggctcaccacgatctccactcccaggtgcaaggg

SEQ ID NO: 1545 - DNA, 108 bp, Homo sapiens
tatatatacatatatggaatatatacatgtttatatgtgtgtatatgtgtatgtatatatgtatgtatcatatttgtatatagatgtatgtatgtgtgtatgcacata

SEQ ID NO: 1546 - DNA, 62 bp, Homo sapiens
gtgtgtgtgtgtatatatgctcatacacatatatatgtgtgtgtatatatatatatatatat

SEQ ID NO: 1547 - DNA, 92 bp, Homo sapiens
tttcttccaggataacggcatagagaaagaacacgaatgagagtgtgcctgtgtgtctgtgtgtatacgtgtgtgtctgagagagggagaga

SEQ ID NO: 1548 - DNA, 90 bp, Homo sapiens
acacacacatatatatatacacatatatatgtatatatatgtatatatatataatatatacatatatatagtgtgtttgtgtgcatgtgt

SEQ ID NO: 1549 - DNA, 67 bp, Homo sapiens
tgggtttaccctcataatatctctgagctgagataataagctcaagagagtgaggacaaatgactca

SEQ ID NO: 1550 - DNA, 116 bp, Homo sapiens
gactttcctgtgaatctttgtggaacactatttggcacaatagatgaaacatttctaaaatgtttttactttttgaaattagtattccatctgcaagcattctatttcatgaagtc

SEQ ID NO: 1551 - DNA, 69 bp, Homo sapiens
gtcacataaggttttcactcagaaacagagtgagcaaacacggtctttgagaagagcttttgtagtgac

SEQ ID NO: 1552 - DNA, 58 bp, Homo sapiens
tgagacagtgtctcgctctgtcacccaggttggagtgcagtggcccgatctcgtctca

SEQ ID NO: 1553 - DNA, 107 bp, Homo sapiens
tctgtaaagttagtggtttggttttatatatatatacagagatagattaatatatatacatatatgaatgtacatataaagcatagctattaacttttctaaaaaga

SEQ ID NO: 1554 - DNA, 104 bp, Homo sapiens
catatatataattggtcccagtaaaatatatatattatatatgtatattatatttatgtgcatatgtatatattttactaacacctctcatttataatcttatg

SEQ ID NO: 1555 - DNA, 58 bp, Homo sapiens
tgagaccgagtctcgctctgtcacccaggctggagtgcagtggtgcgatctcggctca

SEQ ID NO: 1556 - DNA, 100 bp, Homo sapiens
gaaagtagaatgaacacgtctaatatatatatatatgtaaatatttaggaatacatatatatatatgcatatatatactagatgtgttcattctactttt

SEQ ID NO: 1557 - DNA, 116 bp, Homo sapiens
gctatcattctggtgtctgagagacaaactatatgtatttaaatgtgtatatgtatgtgtgtgtgtacatatatgtatatatttgtatacatttgtgtggcatatacctggtgtgt

SEQ ID NO: 1558 - DNA, 101 bp, Homo sapiens
tgggtaaatgcattttaataagtgatattggaatgtaggatatgtacttcaactcaatatgtatccaagtttgttgatcatcctgtttaatgtatttctga

SEQ ID NO: 1559 - DNA, 78 bp, Homo sapiens
gtgtatgtgtgtgtgcgtgtgtgtatgtgtatatgtacgtatatatatatacacacacacacgcacacacacatacat

SEQ ID NO: 1560 - DNA, 104 bp, Homo sapiens
tgattttttattgtggattttgtatcctgtgacttaactgaatatttttattagttctaatagcttttcagtggagtcgttagagatttccatatttaagatta

SEQ ID NO: 1561 - DNA, 97 bp, Homo sapiens
gaggctggtttggtcaagaggaaatagcttggtttgtgtttctccccagcctttgtttttttttttttttttaagaccaagtctcactctgttgacc

SEQ ID NO: 1562 - DNA, 117 bp, Homo sapiens
gaggaatacctttcaagagatctactgtccagcagaatgactatagttaatgatgatacattatattattgattatattcttaaaacatgtaaagaaagtggatgtgatgtgttttc

SEQ ID NO: 1563 - DNA, 87 bp, Homo sapiens
cagcgggcatggtgaggcacccccatggagggcgtgctcccgttctggaaggatgctccctgggtccctgtatccagagtccagctg

SEQ ID NO: 1564 - DNA, 89 bp, Homo sapiens
acggtgcattgcaaacagtacttagacaggagtgaagaaaacccagttcactgggtatttccttcactgttttacattacagtgcaagt

SEQ ID NO: 1565 - DNA, 109 bp, Homo sapiens
gatctgatggttttaaaaaaaggagttcccccacacaagctctctctctctttgtctgcagccatccatgtaagacatgacttgctgttccttgccttctgccatgatt

SEQ ID NO: 1566 - DNA, 86 bp, Homo sapiens
tgtacatatgaggtatactgtgatgtttcagtgtatatatatatatatatacacacacacacacacatatatgtacacattgtgta

SEQ ID NO: 1567 - DNA, 104 bp, Homo sapiens
gctgtgtgacctctgaggccatttggatagcacagctggtgatgtctataaatactcttgtgttgtgtttttctagtataggtggtcagaacaggcactactgc

SEQ ID NO: 1568 - DNA, 137 bp, Homo sapiens
tatggctgcatagtattccatggcatgcatatatatatatatgtatgtgtatgtgtatgtatatgtatatgtattatgtacataatacatatgtatatgtatatatatgtacataatacatatgtatatgtgtatat

SEQ ID NO: 1569 - DNA, 101 bp, Homo sapiens
gaagataagtgcgaggtagttctgacacaaatgtatacatatatatataatatatatatatatatgaatttctgttcatgagtaaaaatgcatgaatcttt

SEQ ID NO: 1570 - DNA, 117 bp, Homo sapiens
tgtatgagacacaaattttctgcagagcgggtgagtttaaggttttgttttattgtgtatcatataatttttaaaaatttaaaattcatctgatctcaaaaaatggtctcttttata

SEQ ID NO: 1571 - DNA, 114 bp, Homo sapiens
catctctctatggtagatacctaggagtggaattgttgggttgtatggcaggtatatatttttttattctctttatttccagcaaatttatttctatgtgttctgttttagatg

SEQ ID NO: 1572 - DNA, 82 bp, Homo sapiens
tatatatatatatgtgtatatatatgtgtgtgtctatgtgtgtgtgtatatatatgtgtgtgtgtatatatatatatatata

SEQ ID NO: 1573 - DNA, 101 bp, Homo sapiens
attactcaaaacccatgttatagtagaagagatgttttcaaaaattaagtaataattgcttgaaaactattgtctggtgtaaaaagtgtattaagactaat

SEQ ID NO: 1574 - DNA, 95 bp, Homo sapiens; identical to SEQ ID NO: 68

SEQ ID NO: 1575 - DNA, 93 bp, Homo sapiens; identical to SEQ ID NO: 69

SEQ ID NO: 1576 - DNA, 110 bp, Homo sapiens
tatatatatctattttttattcaaattcatttaaaatatagttgactacttaaatatagataatagcaacgaaattgaaagtgaagtgtacgaagtaagtagatgttgta

SEQ ID NO: 1577 - DNA, 74 bp, Homo sapiens
cttcagaactgtgagagatagatttctgttgcttataagcagtgcatggatttttttttttatagcagctggag

SEQ ID NO: 1578 - DNA, 82 bp, Homo sapiens
tgatggtagacttctgattttcagggagtgacaggctgcttgcatttcaggtcatgccaactcaaattcatccttgaatctc

SEQ ID NO: 1579 - DNA, 81 bp, Homo sapiens
tttgtgcattatgtatcagtcggggtcctgtttggagagagaaatcacacagtgatttggacagagaatattttacacaga

SEQ ID NO: 1580 - DNA, 95 bp, Homo sapiens; identical to SEQ ID NO: 68

SEQ ID NO: 1581 - DNA, 93 bp, Homo sapiens; identical to SEQ ID NO: 69

SEQ ID NO: 1582 - DNA, 56 bp, Homo sapiens; identical to SEQ ID NO: 324

SEQ ID NO: 1583 - DNA, 92 bp, Homo sapiens
tctgctaaggtggacttcgttttatttaaattattctaggaaaagttttatttttcccgaatgataaatgtctagccagacttaactgcagg

SEQ ID NO: 1584 - DNA, 103 bp, Homo sapiens
gctgaattctgcaagaatgctcatgtgtatgcctgtatgtgtgtctggatatgcacagaaaatagtgtgtaaagataagcatcaaattgtcaatagaaactgc

SEQ ID NO: 1585 - DNA, 94 bp, Homo sapiens
ttaccattacaccacatgacattgtatatgtatatgtaacatatataaacacatgcatatatgtgcatatacgtgtctctatgtgtgtgagtag

SEQ ID NO: 1586 - DNA, 119 bp, Homo sapiens
tagaagtgctctcagtggcagacctcacctgctggctgaggcaggcccctgttttttgttttttttttgacatggggtctcactctgtcacccaggctggactgcaatggcacgatctg

SEQ ID NO: 1587 - DNA, 89 bp, Homo sapiens
gttgcccaggctgcgtaccaccacgtccagctagtttttttttcttttctttttgtagagatgaggttttgtcatgttgcccaggctgc

SEQ ID NO: 1588 - DNA, 128 bp, Homo sapiens
tagttacagatagttcattcttattgcgatttaatactccactttttgaatagttcacattttatttatctgtgtgcctgttagtgagcatttgagcagattttagtttggagctggtatgaatagtg

SEQ ID NO: 1589 - DNA, 110 bp, Homo sapiens
gcccactagcctcatccttttggtgggagctggagtttccctctctcagtgcctcatgtcttcctcacttatatccaactccagccttagatgttgcaatagtgtctggc

SEQ ID NO: 1590 - DNA, 117 bp, Homo sapiens
ggcagaaaatttgtgagtgttttaatccaatcctgatacatttgattatagatatcaatttttatttaatgcatgtaattaagagtgtgtaattccattaaaacattctaaaggctc

SEQ ID NO: 1591 - DNA, 95 bp, Homo sapiens; identical to SEQ ID NO: 68

SEQ ID NO: 1592 - DNA, 93 bp, Homo sapiens; identical to SEQ ID NO: 69

SEQ ID NO: 1593 - DNA, 110 bp, Homo sapiens
ctaatttgcttttgattttacaaagggacttgccttgtctcagatgagacttgagactgtggacttttgagttaatgctgaaatgagttaagactttgagaggcttttgg

SEQ ID NO: 1594 - DNA, 82 bp, Homo sapiens
gttgtttttttcttttttgagatggagtctcactctgtggcccaggctggagtgcagtggcgcgatcttggctcattgcaac

SEQ ID NO: 1595 - DNA, 77 bp, Homo sapiens
ccaagaccaggatcttacagttaccactactaaatttaatttttttagatttagctttgcacgtaggattcttctgg

SEQ ID NO: 1596 - DNA, 86 bp, Homo sapiens
gtgtgtgtatatacatatgtgtgtgtatatatatgtgtgtgtgtgtatatatatatatatatatatatatatatatatatatatac

SEQ ID NO: 1597 - DNA, 74 bp, Homo sapiens
tctggaggaaggagagtcaggaatggtttcctgaaagagatgactgtgatctgactctcagtagctgagtgaga

SEQ ID NO: 1598 - DNA, 101 bp, Homo sapiens
gactttgctaagtatgaaaagtgcagaatccatcccccaaccaatccagacagctggggttctttttttttgttttgttttttgttttttgacacagagtc

SEQ ID NO: 1599 - DNA, 100 bp, Homo sapiens
cttggggaaggagcaacagaagcaggtctcatggggaggtaccgtttcctcggttatcttttttatttttttgagacggagtctcactctgtcacccagg

SEQ ID NO: 1600 - DNA, 117 bp, Homo sapiens
ggtgatgtatatctcaattggcctaatttgatcattacagattgtatacatgtatcaaaatatcacattcacccaaaaaatgtgtacaacagtatggtttggctctgtgtccccacc

SEQ ID NO: 1601 - DNA, 58 bp, Homo sapiens; identical to SEQ ID NO: 1391

SEQ ID NO: 1602 - DNA, 56 bp, Homo sapiens; identical to SEQ ID NO: 1392

SEQ ID NO: 1603 - DNA, 107 bp, Homo sapiens
gaaatgagtttggcctaaccaagtaactttaagacccccagcctagctacagtgaagagagtgaggactcaggaggtgattttggagaggataaccaaggacagatc

SEQ ID NO: 1604 - DNA, 93 bp, Homo sapiens; identical to SEQ ID NO: 69

SEQ ID NO: 1605 - DNA, 95 bp, Homo sapiens; identical to SEQ ID NO: 68

SEQ ID NO: 1606 - DNA, 93 bp, Homo sapiens; identical to SEQ ID NO: 69

SEQ ID NO: 1607 - DNA, 79 bp, Homo sapiens
ctggctgggtcactgcaagaatgccttttttttttttttttttaattagacatggggtctctctctgtcacccaggcag

SEQ ID NO: 1608 - DNA, 150 bp, Homo sapiens
tatattatatatgtatataatatatgtatattatataatatatgtattatattatatatgtatatatatgtatataatatatgtatataaatatatgcatataattacacatatatatgggtgataatgatatagatattatacatatat

SEQ ID NO: 1609 - DNA, 95 bp, Homo sapiens; identical to SEQ ID NO: 68

SEQ ID NO: 1610 - DNA, 93 bp, Homo sapiens; identical to SEQ ID NO: 69

SEQ ID NO: 1611 - DNA, 78 bp, Homo sapiens
atatatatgtgtatgtgtgtgtatatccatatgtgtgtatatatatgtgtgtgtgtgtgtatatgtatatatatatat

SEQ ID NO: 1612 - DNA, 95 bp, Homo sapiens; identical to SEQ ID NO: 68

SEQ ID NO: 1613 - DNA, 93 bp, Homo sapiens; identical to SEQ ID NO: 69

SEQ ID NO: 1614 - DNA, 99 bp, Homo sapiens
agagtgattataccgatgtatgtatgtgtgtatatatgtgtgtatataagtatatacatatgtatgtgtatatatgtatgtgtgtgtgtataaaatttt

SEQ ID NO: 1615 - DNA, 72 bp, Homo sapiens
ccaggtgtggtgatgcatgcctgtagtctcagctacttggtaggctgaggtaggaggatcacttgagcctgg

SEQ ID NO: 1616 - DNA, 113 bp, Homo sapiens
gtcctagttactttattccatctagaaagactctgcatttcatttacattaaaaaacttgtttggatatgaaaagtaatagtttgaagaacgagaatgggtgcagtggtaggc

SEQ ID NO: 1617 - DNA, 80 bp, Homo sapiens
gagggcatcacatggtgagagagcaagagcatgtgtccccaggtctctcttcctcttcttgtaaagccacctgtgccatc

SEQ ID NO: 1618 - DNA, 85 bp, Homo sapiens
tgtcctgtccccactgacgctcactgagtagcacagcatggactagcgtgtttcacacacactctgcctgtctggggaatgtaca

SEQ ID NO: 1619 - DNA, 84 bp, Homo sapiens
ctgaaaattatggggattacaattcaaggtgagatttgagtagagacacaaagcctaaccatatcaccatccctatgaatacag

SEQ ID NO: 1620 - DNA, 93 bp, Homo sapiens
cacatggacacaggaagggaaacttttattttaatatatgtacctttgtattgggctgcatgtagaaagtattttttttttttgtgcactgtg

SEQ ID NO: 1621 - DNA, 103 bp, Homo sapiens
ttgctgtactttgaaaattatgatatactttcagattttgtaaatcatataagatttcataaaaattagcttgaggtaaattgtaagaattcatagtatacaa

SEQ ID NO: 1622 - DNA, 111 bp, Homo sapiens
tgccatataatgattaacttttgggaatgtattttcatatatttgtacatatttatttacgaataaatgaatatatgtctgtgtatgtatttttccccatgtaggtgagta

SEQ ID NO: 1623 - DNA, 81 bp, Homo sapiens
gaaaacagaaattcaacaagaagagtattcttgtttataatttaataatactttcttcttgttgttgttgttattgttttt

SEQ ID NO: 1624 - DNA, 94 bp, Homo sapiens
tcttgtaggacagatctggtgttaatgattatctatctatctatctatctagatatatagttttgtcattaatttaaaataatgggttataaga

SEQ ID NO: 1625 - DNA, 113 bp, Homo sapiens
tatatatatatatatggacatatatatggacaaatatatctatatatttatatagatataatctatttatatagatatatatgtccatatacgtggacaatgatttctgtatg

SEQ ID NO: 1626 - DNA, 116 bp, Homo sapiens
tctctgccttatctttagtaattgtgtttatgttggctatctggctattgcccttgcgtgacagacacaagtgacagtgctgatggcccttctgattgcagatgtcccaggagaga

SEQ ID NO: 1627 - DNA, 110 bp, Homo sapiens
ggtctagtggtttcaatttatataagaacaaactatattatttttctatcaagcagctctgaagaaggagacatagtctgttacatatatatctttagtgcatactagcc

SEQ ID NO: 1628 - DNA, 119 bp, Homo sapiens
gcagttacttttgtgtgtgtgtgtgtgtgcggtcgccggggctggggggagggcagagtctcactctgtcgcccaggctggagggaagtggtgccatcttgactcactgcaacctctgt

SEQ ID NO: 1629 - DNA, 79 bp, Homo sapiens
ggtcacaatcaacattcattgctgtcggtgggttgaactgtgtggacaagctcactgaacaatgaatgcaactgtggcc

SEQ ID NO: 1630 - DNA, 118 bp, Homo sapiens
agtagaattctgagttttgaggttgcttcagtgaacattcaacgctgtcggtgagtttggaattaaaatcaaaaccatcgaccgttgattgtaccctatggctaaccatcatctactc

SEQ ID NO: 1631 - DNA, 95 bp, Homo sapiens; identical to SEQ ID NO: 68

SEQ ID NO: 1632 - DNA, 93 bp, Homo sapiens; identical to SEQ ID NO: 69

SEQ ID NO: 1633 - DNA, 106 bp, Homo sapiens
agtgagtcctaaagttgttgagagatgggtgagagaacactgagtcctcggtcaccaaatgtctgtcggtgtccacagggtgtatcactctctgctggccctttct

SEQ ID NO: 1634 - DNA, 110 bp, Homo sapiens
ggtggtgaagggtttcagttttgaaaaagtgatgaggtaatgtctttattttttaatcagcgtctcctccattccactcttttcgatgtttctgcctccttgaatagtcc

SEQ ID NO: 1635 - DNA, 89 bp, Homo sapiens
agatgttgctctgaaaatttgcttaaatattttcgactggaaatatatttttatttctatttggtaaatatttaggattggaaatatct

SEQ ID NO: 1636 - DNA, 114 bp, Homo sapiens
tctctatatatactgagctgtatgggcttagggcaagagctatcacaggtatagtgaaattgttcttcttacacatttcatttaagctcttctcagctttgtgctcacctgagg

SEQ ID NO: 1637 - DNA, 111 bp, Homo sapiens
aacagtcaacaggatagtgtacagctgcatttgacaggtgttttgggatttgggttttttttttttttaagttttctgtctgttcctgactgcttttaccctttggttgtt

SEQ ID NO: 1638 - DNA, 102 bp, Homo sapiens
gtttattgtttgcagaattagctcactacagtcaacacttattccactctaaaagccaggtagatgcttgtttactgtggcaaacagcaatgcagaatagac

SEQ ID NO: 1639 - DNA, 76 bp, Homo sapiens
aaacaaattgacaggagacagtctggtagaagggttccaattattcgaggctggttttttttgtttttgtttgttt

SEQ ID NO: 1640 - DNA, 86 bp, Homo sapiens
acctatgtctatacctatatatagatatgtatgtatgtatgtatgtatgtatatatgtaagtatgtatactaaggcttagaaaggt

SEQ ID NO: 1641 - DNA, 103 bp, Homo sapiens
ttttcatggactctgataatagtctcactgacaatgtactttttattttttttaaacatttattttgtcttatttgttggatgttatctaagttaactgaaga

SEQ ID NO: 1642 - DNA, 86 bp, Homo sapiens
ctctgcctaggtaactgttcccagcctctgttgtgtggttacttctctcgcctcacaattagctcaggaaacactgcctccaagag

SEQ ID NO: 1643 - DNA, 95 bp, Homo sapiens; identical to SEQ ID NO: 68

SEQ ID NO: 1644 - DNA, 93 bp, Homo sapiens; identical to SEQ ID NO: 69

SEQ ID NO: 1645 - DNA, 106 bp, Homo sapiens
tgatttgcatatattgaatcattcttgcattcctaggataaataccacttggccatgatgtattgtctttttgatgtactgttggattcaatatactagtatttta

SEQ ID NO: 1646 - DNA, 104 bp, Homo sapiens
tatatatgagatatatctatatctatatctatatgtgtatatatatcatatatatcctatatcatatatatacatatatacatatatagatatatacgtatata

SEQ ID NO: 1647 - DNA, 97 bp, Homo sapiens
tagtcctgctgaacatgtgcaaataactattaccatgaaaagtaaaaagactttttttttttttttaggtggagtttcgctcttgttgcccaggctg

SEQ ID NO: 1648 - DNA, 82 bp, Homo sapiens
gttagccaggtatggtggcatgcatctgtagtcccagctacttgggaggctgaggtaggaggatcacttgagcctgggaggc

SEQ ID NO: 1649 - DNA, 110 bp, Homo sapiens
gaaataggctttataagtgcttgaaggtgagacctaaatttggagtcagaagactgagatctgagtcttggatgtatcattattattaacttactgacctggccaatttt

SEQ ID NO: 1650 - DNA, 78 bp, Homo sapiens
agagtggaaaaacgaggtagtctgggaggattccagagacaaactggggatgttgtggcaactttatttttttatttt

SEQ ID NO: 1651 - DNA, 79 bp, Homo sapiens
aaaggctggatggtaaatagcttagactttgtaggatacatgcaatcttgcatagtttttgttttctatacaagccttt

SEQ ID NO: 1652 - DNA, 78 bp, Homo sapiens
gcctcctaggtgcaagcaattctcctgcctcagcctcccaagtagctgggatgacagttgtgtgccaccacgcctggc

SEQ ID NO: 1653 - DNA, 148 bp, Homo sapiens
tcactgcaagctagtctgggcaacatagcaaggctctgtcttttttttttttttttttttttgagacaaagtctcactctgtcacccaggctgaagtgcagtggctccatctcagctcaccgcaacctctgcttcccgggctcaagag

SEQ ID NO: 1654 - DNA, 58 bp, Homo sapiens
tgagttggagtctcactctgtcacccaggctggagtgcaatggagtggtctcggctca

SEQ ID NO: 1655 - DNA, 132 bp, Homo sapiens
ggcatgtcccttgggctccaggacagtttctttctcttcttggaggcgatcggcaggtctctctctttttctcaagtgactcagctgtctcggcatgtcggcttcctgagttctcttggtccagagaatgat

SEQ ID NO: 1656 - DNA, 86 bp, Homo sapiens
tccttttaccagataaacagttgtcaggagttttcatgaccacttatgcttacatcattattccacacttctgctgagtgagagga

SEQ ID NO: 1657 - DNA, 136 bp, Homo sapiens
agcctgggtaacatagcaagaccctgtctccaaaaaatttttttatttttatttttttgagactgagtctcactctgtcaccaggctggagtgcagtggcgtgatctcggctcactgcaacctccacctcccaggt

SEQ ID NO: 1658 - DNA, 101 bp, Homo sapiens
attataaatccttttgatatgatgagtacattgtatatatttttgacattatgtatataggtaggttattttgtctgagttatatctcaggatggtatggt

SEQ ID NO: 1659 - DNA, 121 bp, Homo sapiens
tggagagttggggtgggattgagaccatgggggaagatgagggaggtggtataatttagaatcttttttttttttttttttgagatggagtctctctctgtctcccaggctggagtgcagt

SEQ ID NO: 1660 - DNA, 81 bp, Homo sapiens
gggattatagctacttgggaggctgaggcagttggattgcttgagttcagaagtttgagactacagtgagccataatcgcc

SEQ ID NO: 1661 - DNA, 98 bp, Homo sapiens
agcatggctgctggatgccctgtgtgtatctgtgtgtatctgtgcatgtggttggagactggctctctagtagaacggctgggcagatacagagattc

SEQ ID NO: 1662 - DNA, 93 bp, Homo sapiens
ttatgcttgactgtatttgagtgtgactaatttaaatagactatatttaaattctttatgaatctttggcttacttatacaagtccagcgtaa

SEQ ID NO: 1663 - DNA, 58 bp, Homo sapiens
tgagacggagtctcactgtgtcacccaggctggagtgcaatggtgaggtctcggctca

SEQ ID NO: 1664 - DNA, 66 bp, Homo sapiens
cagtgagacagagtctctcgctctgtcacccaggctggagtgcagtggtgcgatctcggctcactg

SEQ ID NO: 1665 - DNA, 71 bp, Homo sapiens
gcaagaaggtgagttggcctggctggcgcagcctggaatgctagccagagttcagacttcattctcattgc

SEQ ID NO: 1666 - DNA, 58 bp, Homo sapiens
tgagacaaggtctctctctgtcacccaggctggagtgcagtggcgtgattttggctca

SEQ ID NO: 1667 - DNA, 95 bp, Homo sapiens; identical to SEQ ID NO: 68

SEQ ID NO: 1668 - DNA, 93 bp, Homo sapiens; identical to SEQ ID NO: 69

SEQ ID NO: 1669 - DNA, 58 bp, Homo sapiens
gtatgtgtgtgcatatatatgtgtgtgtatatatatacatatatatatatatatatat

SEQ ID NO: 1670 - DNA, 79 bp, Homo sapiens
tagcctggtgacaagacaagactccgtctcaaaaaaaaaaaaaaaaaagagtcagagtctcactctgtcacccaggctg

SEQ ID NO: 1671 - DNA, 105 bp, Homo sapiens
agctgcacttgagttgactgaggcttgaggtcactgagagagttcttttttttttgaaatagagtctttctctgtcacccaggctggagtggcacgatctcagct

SEQ ID NO: 1672 - DNA, 88 bp, Homo sapiens
tgacctgctctgacccccgcctgctgtgctctgttctcttgctccatctcaccccttcagaaagatacaaggagggcaggagcaatca

SEQ ID NO: 1673 - DNA, 58 bp, Homo sapiens
tgagatggagtctcactctgtcacccaggctggagtgcagtggcgtgatctcggctca

SEQ ID NO: 1674 - DNA, 89 bp, Homo sapiens
aggcaggggctggaagtcccaggctctgggtgcaattctgccactttctaggtgaacatccctggctccctctttgagcctcatttcct

SEQ ID NO: 1675 - DNA, 83 bp, Homo sapiens
gctcagggctgggcatcaggcttgccctgcctttgagggctcacagtttggcggtggcagacactgtctcagtcatcctgggc

SEQ ID NO: 1676 - DNA, 115 bp, Homo sapiens
tggctttgtttcctgggtgctttttcatactccagagaggctgccaaaagttcttactttttttttttgttttggttagcactcatcaaaaggaatttagcaaggccagagagca

SEQ ID NO: 1677 - DNA, 86 bp, Homo sapiens
ccagtaatatttggtgagaagagtggtgacgctattttacactttttgtaaatctcttcactgcctggcttgatagaggctgctgg

SEQ ID NO: 1678 - DNA, 58 bp, Homo sapiens
tgagacagggtctcactgtgtcactcgggctggagtgcagtggcatgatcttggctca

SEQ ID NO: 1679 - DNA, 85 bp, Homo sapiens
caaggtctcactctgtctcactctgtcatccaggctggagtgcagtggccagatcttggctcattgcagcctcaacctcccaggc

SEQ ID NO: 1680 - DNA, 74 bp, Homo sapiens
gagggaggaggagcagccagagagaggagagccgcctgaggtggggttctcactctccctgtctccttgtcatc

SEQ ID NO: 1681 - DNA, 58 bp, Homo sapiens
gagggattcagccgggagtcaggagaccaggactctctgcctgactctatgaactttc

SEQ ID NO: 1682 - DNA, 108 bp, Homo sapiens
cacataacataagtgtgtgcatgttatgtgtgtgtacgtgtgtgcatgtgtgggtgtgtggattcatgtgtggggtgtattgtgtatacatgcatatatgcatgtgtg

SEQ ID NO: 1683 - DNA, 64 bp, Homo sapiens
agagtcagtcagagatttaggctaagtttatattcagaatttggggcactctctctgtgactct

SEQ ID NO: 1684 - DNA, 104 bp, Homo sapiens
gacttcggctttctggcagctgaggacaaccgagggtggggacgcggatcgtggaggccgaccctctttccctctaggttgaatgcttgtcataaagtttgagc

SEQ ID NO: 1685 - DNA, 73 bp, Homo sapiens
actcaaaggcaagaggcctggagaagcaggggctcctaggaccctgcctgcatgcctctctgcctccaatagt

SEQ ID NO: 1686 - DNA, 57 bp, Homo sapiens
gggcctgtcagtcactcatactctccccggagttgggctgggggcactgaaagggcc

SEQ ID NO: 1687 - DNA, 80 bp, Homo sapiens
cccaccatgatgagatcacagacaaaggggaccacagagtgagcactctggggctgtccctaggtctctggctatgggtg

SEQ ID NO: 1688 - DNA, 102 bp, Homo sapiens
aggactggggcggcaggcaggagagcagtgactcacaccgacactgtttaattcagctgtctcactgtctacactccttcccgagctctcgcccccagtact

SEQ ID NO: 1689 - DNA, 85 bp, Homo sapiens
tccccacacacagacagactgtcagtctcgtgacttgttatctcatgaggtctgggttcagtccatttgtgacaccctctgggga

SEQ ID NO: 1690 - DNA, 79 bp, Homo sapiens
gaaaggggtcatgaagttttcctggtttgccttcggagtgagaacccacaggtattcagcatctttaaggacacctggc

SEQ ID NO: 1691 - DNA, 122 bp, Homo sapiens
ataggtgtgcaccaagactctggtgtctggccttggcctggagccctagtgtctctgagtccctgactgcctggggcgatagaaggagcaccagctttggagtcatgcgtgtgagggttcag

SEQ ID NO: 1692 - DNA, 72 bp, Homo sapiens
gccatcatctttctgtcactccctgactctctcctgcagattgtcttttagggaggtactgggggacttggt

SEQ ID NO: 1693 - DNA, 114 bp, Homo sapiens
tcaggctgagcacaaggtcactcttgtttctctggaggggtccctccacctctcagacactctctgtgcctgtctggttgccgcacaccccctgcacatcggcgggcctgtgtc

SEQ ID NO: 1694 - DNA, 91 bp, Homo sapiens
aggcccccatcagtgtatgtatgaaaagtgtgaagaattcagggtttttttttaacttatttttttcttttttgaaatacagacagggtct

SEQ ID NO: 1695 - DNA, 112 bp, Homo sapiens
cttaccagcaacaagtcttgagctgctattctaacagtataggagaatgtatcatcatcttcatcttctacaaattgttgggggttggctgtccatactttaatctgaaaag

SEQ ID NO: 1696 - DNA, 83 bp, Homo sapiens
tagccagggatatctgaagtggggaaaggcaggaggaggggaagggctgggaccctgcctgtgacccagtttgggcttggcta

SEQ ID NO: 1697 - DNA, 83 bp, Homo sapiens
gctggagggacagattattttttctattaagttatgcacagtttgttgcaacttgaggtcaaaagaaagtgttcagagccagc

SEQ ID NO: 1698 - DNA, 116 bp, Homo sapiens
tgcactccagcccagggaacagagcgagattccgtctcaacaacaacaaaaacatttatttatttttattatttttttgagacagagtctcgctctgtcgcctaggctggagtgca

SEQ ID NO: 1699 - DNA, 71 bp, Homo sapiens
gatggtgaggaggcagaaccctgagggcctgatctgtcctgcagagtgactcagtctccctctcacacatc

SEQ ID NO: 1700 - DNA, 80 bp, Homo sapiens
agctaggggctggggtgggatctctgagtctttttttttttttttttttttgagacagagtctcactctgtcaccaggct

SEQ ID NO: 1701 - DNA, 103 bp, Homo sapiens
cctgggtgacagagcaagactccgcctcaaaaaaaaaattaataataattattttattttattatttatttttttgagacagagtctcgctctgtcacccagg

SEQ ID NO: 1702 - DNA, 72 bp, Homo sapiens
ctctctggcagtggggaactgcctctccaggcagggaactgctctgacaggtctgatgactgcctccaggag

SEQ ID NO: 1703 - DNA, 70 bp, Homo sapiens
cagatacttactgaagcagctgtggcccccaggctgcctcttgccagctgtctgtctgtctgtcggtctg

SEQ ID NO: 1704 - DNA, 116 bp, Homo sapiens
gcccaaatgacttggatttgctggctcttttggagtaaaagagagcatggtgtatgtctctcacactttctccccatctctgaggtagcccattgtgcagatgaaggaagtgaggc

SEQ ID NO: 1705 - DNA, 58 bp, Homo sapiens
tgagacagagtctcactctgtcacccaggctggagtgcagtggcgagatctcagctca

SEQ ID NO: 1706 - DNA, 110 bp, Homo sapiens
gccaggcatggtggtgcattcctgtagtcgtagctactcaggaggctgaggtggaaggatggcttgggcccaggagtcaaggttgcagtgagccatgatcctgccattgc

SEQ ID NO: 1707 - DNA, 115 bp, Homo sapiens
atcaagttgagtaggagggaaggggagctaggctggaggaggaaggtggggtgagacgacctcgcacactcacactcacactctcagtagttctgggatgttctgctttgagggt

SEQ ID NO: 1708 - DNA, 93 bp, Homo sapiens
ggcccttgcaaccccacagttctgtggctgcagttctgggctggtgtctgagtccaggaagtgggcttggctgggtgatgggagcaggtggtc

SEQ ID NO: 1709 - DNA, 99 bp, Homo sapiens
gtggtggcatgcttgtattcccagctacatgggaggctgaggtaagaggatctcttgagcccaggaagttgaggctgcagtgagccaagatcataccac

SEQ ID NO: 1710 - DNA, 113 bp, Homo sapiens
aggtgcagtggctcacacctgtaatcccagcgctttgggaggctgaggtagaaggatcgcttgagcccaggaattccagagcaggctgggcaacatatggagaccctgtctct

SEQ ID NO: 1711 - DNA, 102 bp, Homo sapiens
agaaaaaaggagaaaagatgatgtggttcctggcaggtgttcggtggctccctgacacccacattctccgcaccctgcccggaacctcctccctccttgtct

SEQ ID NO: 1712 - DNA, 71 bp, Homo sapiens
tgcgtttttagagtatcacagttcttaggaaaagttttttttatctattcacagtgacactctgaaaggta

SEQ ID NO: 1713 - DNA, 112 bp, Homo sapiens
ttctttgtcaggagattttttttattactgattagatcttactaattatgagtcaactcatagtttctattttttaacgattcagtcttggtaggttttgtgtttctaggaa

SEQ ID NO: 1714 - DNA, 137 bp, Homo sapiens
aggtgacttcaacagctggctcaatactgatgaaagtaatcaatttagcaattcagaagttctgtgtcagtcagtgagtcgcttgtggattcttatggggatttatcttggattcttacaagtcttaaacaaacttc

SEQ ID NO: 1715 - DNA, 78 bp, Homo sapiens
ttattttttgcttttgagacagtctcagtctgtcacccaggctggggtgcagtggtgcgatctcctgggctcaagtga

SEQ ID NO: 1716 - DNA, 123 bp, Homo sapiens
catttttggctcaaggctttctctctcagtttacactcagcttcccaatggtcactcaactagatgtcagaagagactgtgaagacccagatgggcccagcttggggacggggatgggtgagt

SEQ ID NO: 1717 - DNA, 93 bp, Homo sapiens
ggctgtgagaactgaggtttttcagtctctctgagtctcagtcaagtggagatgaggaaaagataccaagaatgacaagcacctggcacagcc

SEQ ID NO: 1718 - DNA, 118 bp, Homo sapiens
atatacatatgtgtatatatacatatatatgtgtgtatatatatacacatatatgtgtgtgtatatatgtatatatgtatataattatatatgtatatatgtgtatatatacgtatat

SEQ ID NO: 1719 - DNA, 77 bp, Homo sapiens
ctttgaaatgaacgttcaggctgcaattaaccctaaggatttactgcagcttacaaagaaactttttcttttcagag

SEQ ID NO: 1720 - DNA, 127 bp, Homo sapiens
ccctgccaactgagtgccattcttaccttaagggtgcacagcactcaacttgagggagatgttctctggttcctagagtggatttgaagatactatatctcacttccctcagccacatgccttccct

SEQ ID NO: 1721 - DNA, 56 bp, Homo sapiens
tgagacagtctcactctgtcacccaggctggagtgcagtggtgagttcttggctca

SEQ ID NO: 1722 - DNA, 72 bp, Homo sapiens
ttgttttttgagacagagtctcactctgtcacccaggctggagtgcagtagtgcagtctcggctcactgcaa

SEQ ID NO: 1723 - DNA, 118 bp, Homo sapiens
gctggagaagagacttggagacaagcgacacccttgtcattatttgaaggactgatggattcatttatttatttatagacaaggtcttgctctgtcatccaggctggagtgcaatagt

SEQ ID NO: 1724 - DNA, 75 bp, Homo sapiens
ttgttttgttttgagatggagtctcactctgtcacccaagctggagtacagtggcacgatctcagctcactgcaa

SEQ ID NO: 1725 - DNA, 58 bp, Homo sapiens
tgagacagagtctcgctctgtcacccaggctggagtgcagtggcgcgatcttggctca

SEQ ID NO: 1726 - DNA, 119 bp, Homo sapiens
cagcctcccgagtagctgggactacaggcgcatggcaccatgcccagataatttttgtatttttagtagagatggggtttcaccatgttggccaggatggtctcgatctcttgagtttg

SEQ ID NO: 1727 - DNA, 74 bp, Homo sapiens
atagttccagctactcagaaggctgaggtggaaggatcacttgaacccaggaggttgaggcagcagtgagttgt

SEQ ID NO: 1728 - DNA, 95 bp, Homo sapiens
catacagcctaaacagaagcaatagcatagtactaattattattattattttgataataataatagactcttgctctgtcactcaggctggagtg

SEQ ID NO: 1729 - DNA, 123 bp, Homo sapiens
tgtcttccacaaaaccggtccctggtgccaaaatggttggggaccactgtttttttttttttttttgagacagagtctcgctgtgtcgcccaggctggagcgcagtggcgtgatctcagctca

SEQ ID NO: 1730 - DNA, 85 bp, Homo sapiens
gtttgcattttcagaaatttgatactggtcttttttttttttgaaatgaagtctcactgtgtcacccaggctggagtgcagtggc

SEQ ID NO: 1731 - DNA, 80 bp, Homo sapiens
ctggaggctgaggtaggaggatcacttgagctgggagggtcaagactatagtgaaccgtgattgcaccactgcactccag

SEQ ID NO: 1732 - DNA, 105 bp, Homo sapiens
gcctgggcaacagagtgagactccgtctcaaaaaaaaaaaaaaaaaaaaaaaaaaagaatatatatatttttaattgagaccgagtctcactctgtcactcaggc

SEQ ID NO: 1733 - DNA, 88 bp, Homo sapiens
tggaggagagagggagaaagggctctagtctctggctcttcttttatttgtttattttttttgagacagagtctcgctctctcaccca

SEQ ID NO: 1734 - DNA, 92 bp, Homo sapiens
gtggctgggaaagagcagccagtgaggtgggaggactcaagaaagtgtggactcatgaagtgagtgtttcaaggagtggctgactgggttac

SEQ ID NO: 1735 - DNA, 111 bp, Homo sapiens
gggagttttgcagggacaagagacagggctgactagctcagcagagcagagtctgaactcagagctggcttctgtgagctgggagaactttctgacccacagtctactgcc

SEQ ID NO: 1736 - DNA, 86 bp, Homo sapiens
tatacacatatacacacatatgtatacatatatgtatatatgtatacatatgtgtatatgtatacatatgtgtgtatatatgtata

SEQ ID NO: 1737 - DNA, 73 bp, Homo sapiens
tgattttttttttttattctccagcagcaccataatctggctatgagtgcagggagagtagacaatttgatta

SEQ ID NO: 1738 - DNA, 113 bp, Homo sapiens
tcacagtggacattgggtgtattgaagggggaatttgggtatgtgtgtgggagcatgagagagagacagagacattttcagatggagagacttgagtgcatctgctaaggaga

SEQ ID NO: 1739 - DNA, 100 bp, Homo sapiens
agcagattttcctttctttttagcttagtttaggtctatgagggaacttgtatttactgaagacactgagctcatcagctggtggaaggatacactggct

SEQ ID NO: 1740 - DNA, 83 bp, Homo sapiens
cagtttcagatttcagagccagctttattgggagatgttccttaggttttcagttagcgctggagcaaggagagagctgacac

SEQ ID NO: 1741 - DNA, 79 bp, Homo sapiens
tgcacctgtagacccagccacttgggaggctgaggtaggaggatcgcttgagcctaggaggttgagactgcagtgagca

SEQ ID NO: 1742 - DNA, 116 bp, Homo sapiens
gctcattgacggaggacatcccgtccactcccatatctctcattatttgctgggaatctcactgctagaaatcacggacaaaaaaggatggaatggttggtttgaactcggctggc

SEQ ID NO: 1743 - DNA, 71 bp, Homo sapiens
gggtgtgtatctagggaaggcttttttttattatttacttttttttgagacagagtcttgctctgtcaccc

SEQ ID NO: 1744 - DNA, 116 bp, Homo sapiens
ggatgaacaggcagatgtgagacactattggggttcacagaagagagagaggccagggctggctgagttctgtctggctgtggcccctggagtccttccaagccagctttatgtcc

SEQ ID NO: 1745 - DNA, 58 bp, Homo sapiens
tgagacagagtctcgctctgtcacccaggctggagtgcagtggcgggatctcggctca

SEQ ID NO: 1746 - DNA, 62 bp, Homo sapiens
gggtgataatggacataccatcgtaacttttttttttgatacagggtcttgttctgtcaccc

SEQ ID NO: 1747 - DNA, 122 bp, Homo sapiens
gtatatttatatatacatatattttgagatggaatatatatatgtgtatatatatgtgtatacatatgtgtgtatatatatatgtgtgtgtgtatatgcatatatttttaatttttgagatg

SEQ ID NO: 1748 - DNA, 87 bp, Homo sapiens
gtgcacacttgtgctctcagctactcaggaggctgaggtaggaggatcccttgggccccagagagattagcatttgaattggtggac

SEQ ID NO: 1749 - DNA, 93 bp, Homo sapiens
gcagagatgcctcatccctcagtgtgggggagaggacaacaataccccttttctgcctgcctgtgtccctggcatgagggcctagtgcgtctc

SEQ ID NO: 1750 - DNA, 80 bp, Homo sapiens
ccagccatttgcagttgtcctttattttattattattattatttttttgagatggagtctcactctgtcgcccaggctgg

SEQ ID NO: 1751 - DNA, 97 bp, Homo sapiens
cacttcatgctaaaccaaaacaagagtgaagacagagcccacacaggcttatgtcacctggtctggctgatgatgttcactttgacctttggaggtg

SEQ ID NO: 1752 - DNA, 108 bp, Homo sapiens
gtagctgggaccacaagcactgggcccacaggtgcatacctggctattttttaaattttttatagagacatggtgtcaccatgttacccaggctggtaatcatgcttc

SEQ ID NO: 1753 - DNA, 94 bp, Homo sapiens
ctctccaatgctaacccgtcggaactaacagcaagcattcagaatgagcgtaagtgccctgtgtgcctctctgtgcctctgggagttgggaggg

SEQ ID NO: 1754 - DNA, 91 bp, Homo sapiens
gtgatggggatctgaagcctttgacagcagagagatgagagtcagatgggacaacagctcgctacttacattgcaaaggttccccattcac

SEQ ID NO: 1755 - DNA, 78 bp, Homo sapiens
gtgtgtgtgtatatatatatatgtgtgtgtgtgtatatatatacgcatatatatatatatatatatatatatatacac

SEQ ID NO: 1756 - DNA, 104 bp, Homo sapiens
ttgctcattccccaaagacgtggcatggatcagaaaataattggaaccaaaacccttatttcttgtttaatataaattcatgttcaggagtggctaatgagcgg

SEQ ID NO: 1757 - DNA, 113 bp, Homo sapiens
accagactgcaaatgtgtgtgtgcgtgcgcctgtgtgtgtgcatgtgcatgtgtgcacgtgtgtgcatgtgtgtgcattcagcatgtgtgtatgcgcgtgtttgcgcatgtgt

SEQ ID NO: 1758 - DNA, 73 bp, Homo sapiens
tatatgtgtgatatacatatatgtatatgtatatatgtgtatatgtatgtatgtgtctatgtgtctgtgtatg

SEQ ID NO: 1759 - DNA, 69 bp, Homo sapiens
tgatagggttgacaggtcttccgttcttcctgggggcagccccaagacaaactctctctctctctgtca

SEQ ID NO: 1760 - DNA, 78 bp, Homo sapiens
tgtgtgtatagatacatatgtgtgtgtgtgtgtatatatatatatgtatacacacacacacacatacatatacacaca

SEQ ID NO: 1761 - DNA, 115 bp, Homo sapiens
cctctgtgaacctcagtttccccaacatacaataaccctgacagtctgtcattctgtgcttctgtgacgtcagccttaggagttatcagggacccaaacttgggcttcacagggg

SEQ ID NO: 1762 - DNA, 58 bp, Homo sapiens
tgagactgagtctcactctgtcgcccaggctggagtgcagtggtgcgatctcagctca

SEQ ID NO: 1763 - DNA, 58 bp, Homo sapiens
tgagacagagtctcgctctgtcacccaggctggagtgcagtggtgtgatctcggctca

SEQ ID NO: 1764 - DNA, 95 bp, Homo sapiens; identical to SEQ ID NO: 68

SEQ ID NO: 1765 - DNA, 93 bp, Homo sapiens; identical to SEQ ID NO: 69

SEQ ID NO: 1766 - DNA, 106 bp, Homo sapiens
gctggacccctccactctgctgtggcctatggcttttcattcctatgtgattgctgtcccaaactcatgtagggctaaaagccatgggctacagtgaggggcgagc

SEQ ID NO: 1767 - DNA, 80 bp, Homo sapiens
gggtctcactctgtcactcaggctggagtgcagtggcacgatcttggctcactgcagccttgggctcaggtgattcaccc

SEQ ID NO: 1768 - DNA, 102 bp, Homo sapiens
cagtaaactcgcctgcttgcacgattttctctcaggctctgtccttccctatcaagatccagcggctggagctggagcctggcgtcatcctggcccaagctg

SEQ ID NO: 1769 - DNA, 81 bp, Homo sapiens
gctggagttgggggaggcgtcatgtctgtggagctgctaagggcttcaagctcacggcattctatgtctctccctctcagt

SEQ ID NO: 1770 - DNA, 102 bp, Homo sapiens
atatatatgtatatatttgcatatatatgtgtatatatatttgcatatatatgtgtgtatatatatttgcatatatatgtgtatatatatttgcatatatat

SEQ ID NO: 1771 - DNA, 58 bp, Homo sapiens; identical to SEQ ID NO: 1215

SEQ ID NO: 1772 - DNA, 89 bp, Homo sapiens
gtctcagctgatttcagacacgtgagagagagctcagcgagactcagcttgtagctgactacagatgtgtgagggaacctggctgagac

SEQ ID NO: 1773 - DNA, 83 bp, Homo sapiens
tgggacagggtctcactctgtcacccaggctggagtggtggctcactgcagccacgacctcctggggccaggtgatcctccca

SEQ ID NO: 1774 - DNA, 117 bp, Homo sapiens
gcctgtagttctacaaggctgacaatcaagagtctatccacctatgtgtggatgtggatgtgaattccaggcctccccaccacactctgactctgctaagcccctgtagggaggcgg

SEQ ID NO: 1775 - DNA, 72 bp, Homo sapiens
ttctgccctcaatatttttttatgttgagaaaatcttgcatgtgagatttcttaatcatctttgaggcagga

SEQ ID NO: 1776 - DNA, 97 bp, Homo sapiens
agttggtaatatattggttttatatatatatacatactaagtatatatatatatatatacttagtaggagattgtgatctagtaaatgtgtctggct

SEQ ID NO: 1777 - DNA, 58 bp, Homo sapiens
tgagacggagtctcgctctgtcgctcaggttggagtgcagtcgcatgatctcagctca

SEQ ID NO: 1778 - DNA, 99 bp, Homo sapiens
tctgaaaggaacgatttattctggcttcaggaaatctgattttatatttctgtgacataagacaggttttcttttttccagaatgatcctctactctga

SEQ ID NO: 1779 - DNA, 119 bp, Homo sapiens
gagagccttgaacagtgcctggcatagagaaggtgcaccaataaatatttgtttcatgaatgaatgaatgaatgaatgtctagaaagctaatccctctcagcctctgtttccagttctt

SEQ ID NO: 1780 - DNA, 83 bp, Homo sapiens
ggagacacacagtgtcactctgggtcagatgcagagccactgcaggcagctgagcagaggagtggtgcccgatggatgtcttc

SEQ ID NO: 1781 - DNA, 77 bp, Homo sapiens; identical to SEQ ID NO: 466

SEQ ID NO: 1782 - DNA, 78 bp, Homo sapiens
cccatcaagattaccagaagggccccagttcctggcttctctgtggctcacactctggtcctattgcctacccttggg

SEQ ID NO: 1783 - DNA, 115 bp, Homo sapiens
gaatcagagggtcaggtcccagaataggcattttgaacaaactcaggttcataaagcttgaaaagtttttggggctgttgtgcctgttgttctcttagtctgggacactcttgtc

SEQ ID NO: 1784 - DNA, 107 bp, Homo sapiens
ttagtttttgccccaacccagttgccaaatgcacacacacacagaggcacacacatgcaccctctgccgtgtggctgcatagcctgagtggctattttctgaactag

SEQ ID NO: 1785 - DNA, 83 bp, Homo sapiens
gccactcaggctatgcagccacacggcagagggtgcatgtgtgtgcctctgtgtgtgtgtgcatttggcaactgggttggggc

SEQ ID NO: 1786 - DNA, 58 bp, Homo sapiens
tgagacaaggtctcactctgtcacccaggttggagtgcagtggtgggatctcggctca

SEQ ID NO: 1787 - DNA, 130 bp, Homo sapiens
tcattttggggactgcagacacttagcttttttttttttttttttttttttgaggtggagtctctctctgtcacccaggctggagtgcaatggcatgatcttggctcactgcaacctctgcctcccgggt

SEQ ID NO: 1788 - DNA, 77 bp, Homo sapiens
ctcccccatctgagtgactctgggtctctgtggctgtggccagggaaaggcagggagagggcaagaaggaatgggag

SEQ ID NO: 1789 - DNA, 83 bp, Homo sapiens
ggagctgcaaatcaaaggtcaacatgggtgggccggccctcagaaccctgtgatccactcagtttctctgtgaaagatgctcc

SEQ ID NO: 1790 - DNA, 111 bp, Homo sapiens
tgctgcaacagaccccaatgcctatcacacacccaaagtgtggccagtttggggtgcaaggagacaggagtctgtgagcactgtattcctctgggctttcctgacattggc

SEQ ID NO: 1791 - DNA, 111 bp, Homo sapiens
ggctaagaagaacgtttctcgtaaggcagttgtgaggatcacatgaggcaagtgttacaagggactcagcacacagcctgcgatgtggtcagagtgcagtggagatgagcc

SEQ ID NO: 1792 - DNA, 101 bp, Homo sapiens
atagctgcattttaatacttgaaagagcaggaaaaaggaagcaatagtcttttttttttttttttttttttttttttttttgtgagacagagtgttgctgt

SEQ ID NO: 1793 - DNA, 106 bp, Homo sapiens
ggtggaaaagtgatactctgttttaaaataaataaataaataaaatgtatgggttttttgtttttttgttgttgttatttttgagacagtgtctccctctgtcacc

SEQ ID NO: 1794 - DNA, 114 bp, Homo sapiens
gggatttggtggatatttatactcattaccacaagactttctcactgtctttctttcccttgttatcaggggcacttgattgcttgttgtctacgtatatacatcatttatttc

SEQ ID NO: 1795 - DNA, 97 bp, Homo sapiens
tgcttcactcttaaggaggcactcactcacagtgtcatacaagtgcagaatcagtacttgcacaaccctgagagcaagtgcctccttaagttttgca

SEQ ID NO: 1796 - DNA, 68 bp, Homo sapiens
ggcagaagtaggactttctttagaaattttgaattttttttttttttgagacagagtctcactctgtc

SEQ ID NO: 1797 - DNA, 111 bp, Homo sapiens
cattcagaccttgttgcttccacagctgtatcttatgccttaaaaaatataattttttggtaatctattgagattttatagtcgttttaatggaagcatcagcctgccatg

SEQ ID NO: 1798 - DNA, 76 bp, Homo sapiens
tgacagtttgagtatagtttgtcatggagaaaacctttttttttttttggttttgagacagagtctcattctgtca

SEQ ID NO: 1799 - DNA, 72 bp, Homo sapiens
tatatacatatgtatttgcatgtgtgtgtatatatgtgtatatatattcatgtgtgtgtatatgtgtgtatg

SEQ ID NO: 1800 - DNA, 132 bp, Homo sapiens
ccaaataatttagtgtgttcttcttttcactctttcctaaatagtttttaattttttaaattttatctttgatataagggtgatctaggagcatcttaattttcaagtggttaagattttgttgatcacctt

SEQ ID NO: 1801 - DNA, 122 bp, Homo sapiens
aatagtgagagaacagtgggtgcttttgaagatacttgatgcactattacattatactagtgattatgatgtaattattaatgacttcaatatcatttgggatttttgttgttgctgttgtt

SEQ ID NO: 1802 - DNA, 112 bp, Homo sapiens
gttttatctagctgtcccatagagaggtggtcaccaggaggcagttgtataaggcagatatctggctcgaccacgttgcaaaattgggaggaggtacagaactagaaagggc

SEQ ID NO: 1803 - DNA, 85 bp, Homo sapiens
atcgtgtccatggtgctgaggctgagaaaccctggcctagctgtggctctctaactctcaaattctctctgctgccaggcatggt

SEQ ID NO: 1804 - DNA, 91 bp, Homo sapiens
atgttccatgtatatatgtatatacatatgtatatatacatatgttccatatatatgtatatacatatgtatatatacatatgtatacata

SEQ ID NO: 1805 - DNA, 111 bp, Homo sapiens
gtctaaagcatccctgaaagcacaatattttctgtcttattttatcttttttttttttttttttttttttttttgagacggagtcttgctctgtcacccaggctggagtac

SEQ ID NO: 1806 - DNA, 120 bp, Homo sapiens
gctgggattacacgcatgagccactgcgcctggactcattttgttttttaaaattaattaatcaattaattaatttttattatactttaagttctggggtacatgtgcagaatgtgcagt

SEQ ID NO: 1807 - DNA, 86 bp, Homo sapiens
agtggtttctcctcctaggtgccctggagctggggctttctcctgctctgacagtcccagactctctgcctctgagatgtttccct

SEQ ID NO: 1808 - DNA, 106 bp, Homo sapiens
ctcctcataggttgttgtgtaattaaattagaagctatcttgtgtgtgtgcgtgtgtgtgtgtgtgtgtttgagacagagtcttgtttgttgtccaggctggggtg

SEQ ID NO: 1809 - DNA, 95 bp, Homo sapiens; identical to SEQ ID NO: 580

SEQ ID NO: 1810 - DNA, 93 bp, Homo sapiens; identical to SEQ ID NO: 69

SEQ ID NO: 1811 - DNA, 95 bp, Homo sapiens; identical to SEQ ID NO: 580

SEQ ID NO: 1812 - DNA, 93 bp, Homo sapiens; identical to SEQ ID NO: 69

SEQ ID NO: 1813 - DNA, 117 bp, Homo sapiens
gggatgggcaaggacagcttgggggctggaaaaaaaaatggagttgcttcggttggatctctttcactgtctcagtcacaattttgcaatgacagtttcaaaagctgcctatctccc

SEQ ID NO: 1814 - DNA, 117 bp, Homo sapiens
agtggtgcttttgactattagtttatgtcaacacttcaaaacaagatgagccagtttttttttgttttttttttttgtttgtttgtttgttttagacggagtctcaccctgtcaccc

SEQ ID NO: 1815 - DNA, 90 bp, Homo sapiens
tcttcttctggaagctggtttcacatggtggcttagatttttccatctttgtatctagcaccatttgaaatcagtgttttaggagtaaga

SEQ ID NO: 1816 - DNA, 59 bp, Homo sapiens
gcattcagagtgggagcgtgggagtcacaaagactcacactggctgtgtgacctgaggc

SEQ ID NO: 1817 - DNA, 76 bp, Homo sapiens
tcactctgtcactgtcactggggtgcagtggtgtgatctcagctcactgcagccttgatcttcccggctcaagtga

SEQ ID NO: 1818 - DNA, 112 bp, Homo sapiens
ccttgagcttcctgttcctcaccagttcctctgggtgttggttgtactgaatagaagaaactctgagccgggtaggcagcctagtcttggggacgtagagacgggagaaagg

SEQ ID NO: 1819 - DNA, 59 bp, Homo sapiens
cagacaatcgtggggatgtctgggaaagaaggagacccgtccatctctctgtctgtctg

SEQ ID NO: 1820 - DNA, 74 bp, Homo sapiens
tctaagccaatggggaaaggaagccttgtttttttttttcttaaacagggtctcactctgtcacccaggctgga

SEQ ID NO: 1821 - DNA, 75 bp, Homo sapiens
gaactctgtgtcaaaaccaagcttctgtcccagtgcagggttaggggacacttggttagagaagagagagaggtc

SEQ ID NO: 1822 - DNA, 129 bp, Homo sapiens
cattttattcttgatcgtgaccagggatggtgcctcctgactttctcctgtgtctttatgtctctggaagagaatgtttgcaggggctgttggtggtgccccagcctctgccctcagacagctagcttc

SEQ ID NO: 1823 - DNA, 84 bp, Homo sapiens
gggtgggtgtgactatgtaataaggagtcagctctatttttttatatatttttttctttgagacagagtctcactctgtcaccc

SEQ ID NO: 1824 - DNA, 102 bp, Homo sapiens
gctctttctgtcttgagagtctgggcatttaggatgttggagtcagaggagactggggacaccagccatccaaggggatttaggactctgacagccaagggc

SEQ ID NO: 1825 - DNA, 73 bp, Homo sapiens
gggtctcactgtcactcaggctggcatgcagtgatgcaatcatggctcactgcagcctggatctcgtgggctc

SEQ ID NO: 1826 - DNA, 118 bp, Homo sapiens
agcttccagagtaacagagactacaggcatgcaccactatgttggctacatttttgtattttttacgtagagatgtggtttcaccatgtttcccaggctggtcttgtactcctgggct

SEQ ID NO: 1827 - DNA, 87 bp, Homo sapiens
atctagtcccagtctctctgtctgtccctctgtagcatgtcaactgccccagctgctgggcctgcctgacgtggagcctgggagggt

SEQ ID NO: 1828 - DNA, 132 bp, Homo sapiens
ataccccatatatagtgtgtgtttatatcccatatatatgtatatatgaatatatgtatattatatatatggtttgtctgtgtgtgtgtatatatatatacacacacacactctctctctctgacacacaca

SEQ ID NO: 1829 - DNA, 79 bp, Homo sapiens
tccaggtaaggaaactgaggcacagagacgggacatcactcacccacactcacactgccctcaagtgacagagcctgga

SEQ ID NO: 1830 - DNA, 71 bp, Homo sapiens
ctcaaaagcatatgtatgtgtatatatatatatatatatatatatatatatattttttttttttttttgag

SEQ ID NO: 1831 - DNA, 118 bp, Homo sapiens
agaaacaaagaaatctggtttctgccttcaagggtcttctgtctctcactgtcttagttcaggctgctataacagagtgccatagactgggtggcttaaataacaaacttttttttct

SEQ ID NO: 1832 - DNA, 69 bp, Homo sapiens
tatgagttcagtgtgagctgtgagtgctctttgccaagtatatccagctcttctccttctgaacgaata

SEQ ID NO: 1833 - DNA, 58 bp, Homo sapiens; identical to SEQ ID NO: 1763

SEQ ID NO: 1834 - DNA, 113 bp, Homo sapiens
tactatgccaacctggaccaggtgtctgtgtgtatttatgcatgtatgtatgtatgcatgtatgaatatatgcatgtgttggtttatgcatgtgcatgtaggctgcctatcca

SEQ ID NO: 1835 - DNA, 66 bp, Homo sapiens
gctgtgggtgttcacagtggagatgggttcgtgcacttatttttctatcacagtggcataggcagc

SEQ ID NO: 1836 - DNA, 109 bp, Homo sapiens
atgtttattacttaccatctatgaggctggtattcatatatatatatgaattcatatatatgtatatattttacttgaggcaatcaggctcaggtaagttaaaatacat

SEQ ID NO: 1837 - DNA, 77 bp, Homo sapiens
ctgttgcctcagtgtctgtttatctgtctgcctctcacatgagaaaagattttaaaccagacagtctagctttacag

SEQ ID NO: 1838 - DNA, 58 bp, Homo sapiens; identical to SEQ ID NO: 1435

SEQ ID NO: 1839 - DNA, 58 bp, Homo sapiens
tgagatggagtctcactctgtcacccaggctggagtgcagtggcgagatctcagctca

SEQ ID NO: 1840 - DNA, 74 bp, Homo sapiens
tgtgaaggagacagaagtgtcagagggctgatagcaaacaagctctcaaaggctgcttctaaaacctgctcaca

SEQ ID NO: 1841 - DNA, 88 bp, Homo sapiens
tttgtatttctgtgcctggcttattttgagagaagagagacagaccctttcatgttgttttatcctcagaaaaggcaagagaagcaaa

SEQ ID NO: 1842 - DNA, 95 bp, Homo sapiens
ctggtatgtttcatcatgatgaatacagcatatattttgttatattcatgcaaaaatatataagctgaataaaattatgaaaaaatatcaaacag

SEQ ID NO: 1843 - DNA, 75 bp, Homo sapiens
tggcaactctgcattgagcaagtctattggtgccatttttccaatagcatatgctcactttgtgtctctgtgtca

SEQ ID NO: 1844 - DNA, 116 bp, Homo sapiens
ttgatttctttctcttgtctgattgctctggctaggacttccagtagtatgttgaatagatgtgttgaaagtctgcatttttgtcttgttccagttctcagagggaatgatttcaa

SEQ ID NO: 1845 - DNA, 95 bp, Homo sapiens; identical to SEQ ID NO: 68

SEQ ID NO: 1846 - DNA, 93 bp, Homo sapiens; identical to SEQ ID NO: 69

SEQ ID NO: 1847 - DNA, 58 bp, Homo sapiens
tgagacggagtctcgctctgtctcccaggctggagtgcagtggcgcgatctcggctca

SEQ ID NO: 1848 - DNA, 77 bp, Homo sapiens
caattcttatggggagaggtgtgatgttccatcataaagatgataaaattcagactctctctcacacacaaggcttg

SEQ ID NO: 1849 - DNA, 58 bp, Homo sapiens
tgggacagggtctcactctgtcacccaggctggagtgcagtggtgtgatcccagctca

SEQ ID NO: 1850 - DNA, 112 bp, Homo sapiens
cagtcttgtttgggagtggaatccatatcagtggcatacatacattaaacaaatttttattttttatttttgtattttttgagtcagagtctctgtttcctaggctggagtg

SEQ ID NO: 1851 - DNA, 60 bp, Homo sapiens
gctgagtggcaaagatgtagggaagtatgctaaagggtagcagtctctgtctcacacagc

SEQ ID NO: 1852 - DNA, 113 bp, Homo sapiens
gttttgacatgctgtagtcccttccttagtccagagatcacaaacctctgaattgggatgtgactctctctgtcattaatcggcaagaatcatggtagaattattgtccctac

SEQ ID NO: 1853 - DNA, 116 bp, Homo sapiens
cagtgtttctcaagctgggtagcatgcattctaaaggatctctgattttatatatatacatatatgggtttcctttaaaaatgggtccatgcattattcaagtttgagataccttg

SEQ ID NO: 1854 - DNA, 81 bp, Homo sapiens
ggaatggggaatggagaggggataagggaaggttattcattttttatttttgagatgaagtctcgctctgtcacccaggct

SEQ ID NO: 1855 - DNA, 76 bp, Homo sapiens
gttgaagagaggcagagtggttgaacactgccagtgtaaattagggaaggcttcagggactctgtgtcactcagac

SEQ ID NO: 1856 - DNA, 57 bp, Homo sapiens
agtagacaggattgagaggtgacagcgtgctgtcagccctcgcagcccttgctcgct

SEQ ID NO: 1857 - DNA, 89 bp, Homo sapiens
ttgtttggtcaaacactagtctatatgttgctgtgaaggtattttttagatgtgataacacttagataagtaaagtttgagttaagcag

SEQ ID NO: 1858 - DNA, 113 bp, Homo sapiens
ttgacagttctaaaatctgagatccctgattcaaaaggcttgtgtactcaataatgcagtcacacacacacaaacagccatgcagctaggaaggttttagaggaagaagtcaa

SEQ ID NO: 1859 - DNA, 95 bp, Homo sapiens; identical to SEQ ID NO: 68

SEQ ID NO: 1860 - DNA, 93 bp, Homo sapiens; identical to SEQ ID NO: 69

SEQ ID NO: 1861 - DNA, 119 bp, Homo sapiens
tatggtcttgctttacagctctaagggtcaagaaatgagaggcagtgaattgatttttcactagagaaatagatgtactgaataagattgtactggtagaaagttggtagctatacgtg

SEQ ID NO: 1862 - DNA, 116 bp, Homo sapiens
tcacactcaagcaagtgggcatcagaatgttttggagggcttctctttttaaatttatttatttttatattttttagagacagggtcttgttattagttgcccagctggaatttga

SEQ ID NO: 1863 - DNA, 114 bp, Homo sapiens
tatttagtttaatttgtgatttatatgaactttaaaggagaatatttttaaatgtttgcatttgtaagtctattttctttggaagccagatttgacttacaattaaagaaaata

SEQ ID NO: 1864 - DNA, 95 bp, Homo sapiens
ctaatgagtattatttctgaatggaagtcactatatatttatatatgtatgcatatgtatagagagagagtcccttgctcaaggtaatattttgg

SEQ ID NO: 1865 - DNA, 82 bp, Homo sapiens
gtggtggtagagataatgagaagtgatcagagtcaagaaatttttttttttttttttgagatggagtctcactctgtcaccc

SEQ ID NO: 1866 - DNA, 76 bp, Homo sapiens
aaagcacttgcaaagatgtaagttatgaacacttgaatctcgcatcctgccataaagtgcatcagcaagtgacttt

SEQ ID NO: 1867 - DNA, 58 bp, Homo sapiens
tgagacagtgtctcactctgtcacccaggctggagtgcagtggtgtgatcatggctca

SEQ ID NO: 1868 - DNA, 58 bp, Homo sapiens
tgagacagagtctcactctgtcgcccaggctggagtgcagtggtgcgatctcggctca

SEQ ID NO: 1869 - DNA, 124 bp, Homo sapiens
ccagtgagcagtgagccagaacaggcaggagctgaggtcagagaggtgtttggcacagatcatgaggatcttgtcaaggaaggtgaagacagttgatgttgttctgagtgatgggaagctcttg

SEQ ID NO: 1870 - DNA, 62 bp, Homo sapiens
agacacagcgtggctgagggggctgagacggactgggtctgagtctgactctgccactgtct

SEQ ID NO: 1871 - DNA, 80 bp, Homo sapiens
acagatttgtcaggatggcaaaagacggaatccttggagctcccagagtgtgtgtgtctgtgccacgtggacttttctgt

SEQ ID NO: 1872 - DNA, 72 bp, Homo sapiens
ggttgggcacagtgatttacacctgtaatcccagtgctttgggaggctgaggtaggaggatcacttgagacc

SEQ ID NO: 1873 - DNA, 93 bp, Homo sapiens
gccatttgttcgtttgtggttttatttatgagacagtgtctcgctctgtcacccaggctggaatgcagttttgtgattatagctcatagtggc

SEQ ID NO: 1874 - DNA, 73 bp, Homo sapiens
attttttggatcaacctcagggaatttttaattataattttaaatgctccactgaagttgtaatttgaagaat

SEQ ID NO: 1875 - DNA, 122 bp, Homo sapiens
tggggtacgaagtgatgctaggactttttttttttttttttttgagaaggagtctcactctgtcacccaggctggagtgcagtggcatgatctcggctcgctgcaacctccacctcccaggt

SEQ ID NO: 1876 - DNA, 93 bp, Homo sapiens
tatgcacatactcactgcaatatatttttacaatgtgtatttatatatgtacatatgctgtgactatatgtgtgcaacgtgtgtgtgtgcatg

SEQ ID NO: 1877 - DNA, 58 bp, Homo sapiens
tgagactgagtctcgctctgtcacccaggctggagtgcaatggcatgatctcggctca

SEQ ID NO: 1878 - DNA, 120 bp, Homo sapiens
ggcaacttcccttggccacctctgtcagtggaatgttgtgaggacccctgcatgacaggagccaaggctgctcacttttttttttttttttttgagatggagcctcgctctgtcatccag

SEQ ID NO: 1879 - DNA, 76 bp, Homo sapiens
tgggatggaggctaggattgtttttagtaatgacatcatgggattctttctttgagacagtctcactctgtcacca

SEQ ID NO: 1880 - DNA, 60 bp, Homo sapiens
ggaccagtttcaggcacggctggatctaggggctgaaacagtcagggtctgtgtctgtct

SEQ ID NO: 1881 - DNA, 110 bp, Homo sapiens
tgctgaggattgtcttgggcatatgggctcttttttcattccatatgaaatttaaagtagttttttctaattctgtgaagaaagtcaatggtggcttgatggggatagca

SEQ ID NO: 1882 - DNA, 94 bp, Homo sapiens
gctagcaaccagttttaccagtctttattagaaatgtctttattttgctgtcatttatgaagaatagttttgatatattagaattcttgctagc

SEQ ID NO: 1883 - DNA, 88 bp, Homo sapiens
gtagtttaactttgtgtactgttacctttttaatattttgaaagtttttgaaggtgaagatggagatcagtgcttagtaattgactac

SEQ ID NO: 1884 - DNA, 64 bp, Homo sapiens
gtgtatatatatatgtgtgtgtgtgtatatatatatatatacacacacacatatatatatacac

SEQ ID NO: 1885 - DNA, 135 bp, Homo sapiens
ccagtgccagagccgcagcagacacagtggagccacggcctgagtgtcggaggccatgtgtgtgaacagtgtgtgcacagtgagctccgggccctgggcaagctctgcctgctcagtgttcacatggcaccatgc

SEQ ID NO: 1886 - DNA, 96 bp, Homo sapiens
aaaccaactgtgtgtgcaaaagctcagatgtgtaaaggaaggcagtacaagagcttacttgacaggaatgtggtgtggctgaaacatagggggttt

SEQ ID NO: 1887 - DNA, 83 bp, Homo sapiens
ctgatcttcctgggatggtttgtgggactctttctttttttttttttttgagacaaagtctcactctgtcacccaagctgtag

SEQ ID NO: 1888 - DNA, 108 bp, Homo sapiens
gcatttgttccccaggttgatacagctatttgtcatttatctttttttttttttttttttttttgagacggggtctgactgtgttgccaggctggagtgcagtggtgc

SEQ ID NO: 1889 - DNA, 115 bp, Homo sapiens
ggccatgcaaggccactgccttaaaagagctcacattctagtggataaagctaagaaataaaccttttattttatatatatatgtattttttttaagacagggtctcgctctgtc

SEQ ID NO: 1890 - DNA, 80 bp, Homo sapiens
cagtatggtagcacagaggttagaggaagggctggaatttaagggagcttctgtctgacactttctctgtgacatggatg

SEQ ID NO: 1891 - DNA, 70 bp, Homo sapiens
cagacagtgtcactgaggctgtgctggcttgctattttagcgcaaaccaggagtcggcaaacattctctg

SEQ ID NO: 1892 - DNA, 102 bp, Homo sapiens
aaaatgttaaaatgggataaagctagatggttggtatacaagtgttcattatattattttctgtaactgtacattctggtaatatttcatattaaacatttt

SEQ ID NO: 1893 - DNA, 75 bp, Homo sapiens
gagaggagacaggagagactgaggtaatcagcagtggctggctgttgaatcaaccgtgcctgtcacgaagcctcc

SEQ ID NO: 1894 - DNA, 115 bp, Homo sapiens
tagcaataaacttagcaaaataagtgcaaaatgtgtacacttctgaaagaaactaaagatctaagttaagttgagagatactccatgttcatgtatattgttaagtatattgtta

SEQ ID NO: 1895 - DNA, 103 bp, Homo sapiens
gtattcccacagagttgagagaggaagctctaatatctcgtcgtcttcttaatttttttttttcttgagacggagtctcactctttcacccaagctggagtgc

SEQ ID NO: 1896 - DNA, 101 bp, Homo sapiens
cagcaagggtttgtttaagatagggtatgactctgtcactcaggctgcagtgacagtacagcaagggtttaagatagggtctaactctgtcgcccaggctg

SEQ ID NO: 1897 - DNA, 116 bp, Homo sapiens
gactagccactacactccagcctgggcaacacagtgaattctctaaaaaaaaaaattttttttttttgaagcagagtctcactctgtcacccaggctggaatgcagtggtgtgatc

SEQ ID NO: 1898 - DNA, 103 bp, Homo sapiens
ccactgcattccagcctgggtgacagagtgagactctgcttcaaaaaaaaaaaatttttttttttagagaattcactgtgttgcccaggctggagtgtagtgg

SEQ ID NO: 1899 - DNA, 71 bp, Homo sapiens
gggtgagaacactgtgtgcacaggccttctggcaggagggagtgtgtagattcatggtggtcagaaaggcc

SEQ ID NO: 1900 - DNA, 95 bp, Homo sapiens
cagatgtgagctaccactcacggcccaaatcttcttgatcatatgtttaaatatattttttaatatttggagcatgagttgtcacttcttgtttg

SEQ ID NO: 1901 - DNA, 231 bp, Homo sapiens
ctcgctctatatatatgtatatatatacatatgtgtgtgtatatatgtatatatacatgtgtgtgtatatatatgtatatatacgtgtgtgtatatatatgtgtgtatatgtgtgtatatatgtatatatgtgtatatatacgtgtgtatatatatgtatatatatgtgtatatatacatatgtgtgtgtgtgtgtatatatgtgtgtatatgtgtatatatatgtatata

SEQ ID NO: 1902 - DNA, 97 bp, Homo sapiens
gttatcagagcagactatggcttctttctccctttgaaattttctttttgaaatcttgtggattttgaagcctgagcagtctgaaagtctgacaaac

SEQ ID NO: 1903 - DNA, 79 bp, Homo sapiens
agtacttggtaggagagcgacagtatttctccttttttttttttttttggagactgggtgtcactctgtcgcccaggct

SEQ ID NO: 1904 - DNA, 99 bp, Homo sapiens
gaggcagaagaattgcttgaacctggaaggcagagattacagtgagcccagatcgcgccactgcacttcagcctgggtgacagagcaagaccctgtctc

SEQ ID NO: 1905 - DNA, 123 bp, Homo sapiens
ggtatggtggtggtgcacctgtagtctcagctgctctggaggctgaggtaaaaggatcacttgagcccaggagttcgaggctgcagtgagcaatgattgtgccattgcactcctagcctgggt

SEQ ID NO: 1906 - DNA, 103 bp, Homo sapiens
tatgacagttcctgtttttgcctaagttgtccctgtgcatacatgagtgtgcatagttgtgtgcactctggatccttttttgcaaacacactgagtgttcatg

SEQ ID NO: 1907 - DNA, 140 bp, Homo sapiens
ggcagagtctcactctgtcacccaggctggagtgcagtggcgggatggcagagtctcactctgtcgcccaggctggagtgcagtggcgggatggcagagtctcactctgtcgcccaggctggagtgcagtggcgggtggc

SEQ ID NO: 1908 - DNA, 111 bp, Homo sapiens
gagtgaggagttactgcatgatgttaggttgacaactgattttttttttttttttgagatgaagtcttgctctgtcacccaggctggagtgcaatggcacgatcttggccc

SEQ ID NO: 1909 - DNA, 58 bp, Homo sapiens; identical to SEQ ID NO: 1391

SEQ ID NO: 1910 - DNA, 56 bp, Homo sapiens; identical to SEQ ID NO: 1392

SEQ ID NO: 1911 - DNA, 58 bp, Homo sapiens
tgagacagagtctcgctctgtcacccaggctggagtgcagtggcgcagtctcggctca

SEQ ID NO: 1912 - DNA, 86 bp, Homo sapiens
agatgacgccaggaagagtcagacctgggaactcgacaccacagaccctttccttgtttccatctctgtctctcactgcctcattt

SEQ ID NO: 1913 - DNA, 60 bp, Homo sapiens
ttgagacggagtctcactctgtcacccaggctggggtgcagtggtgtgatcttggctcag

SEQ ID NO: 1914 - DNA, 104 bp, Homo sapiens
tgtccccatctctcaactctcatcgtccttacaggtatattatgtacactgaatgtttcattttatatctgtataattatgcagtagtttgttaggaggaaaca

SEQ ID NO: 1915 - DNA, 58 bp, Homo sapiens
tgagacggagtctcactctgtcactcaggctggagtgcaatggcgtgatcttgtctca

SEQ ID NO: 1916 - DNA, 84 bp, Homo sapiens
tgactaagaggatctagttcacagacacacacacagagagtgtgttcacccagctgctgatattaactactactgccttagtca

SEQ ID NO: 1917 - DNA, 94 bp, Homo sapiens
attgtacttggttatgtctgtgaggtctcttttcaatcttttttttttttttttttgagatgatttcgttctgtcacccaggctggagtgcagt

SEQ ID NO: 1918 - DNA, 89 bp, Homo sapiens
gagacacggtctcactctgtcactcaggctggagtgcgctggtgtgatcatagctcactgcagccttgaactcctggactcaagtgggg

SEQ ID NO: 1919 - DNA, 68 bp, Homo sapiens
gtttttgagacaaagtctcactctgtcacccaggctggagtgcagtggctgattttgttttgttttgc

SEQ ID NO: 1920 - DNA, 119 bp, Homo sapiens
attctgtctggaagaggagtgacatgttccctgctgttaaggaatctctcaggctgactgtcatttgttccttttaggggccctggaactttccctcctaccttccccactctcaggat

SEQ ID NO: 1921 - DNA, 125 bp, Homo sapiens
tatagagtagtggttaagagcttaagtgagcttgagcaaataacctagtctctctgtgtctcagtttcttcatctgtattatggggataatagtacccatctctgcaggtttttagagaagatta

SEQ ID NO: 1922 - DNA, 67 bp, Homo sapiens
gaggttgagtctcgctctgttcaccaggatggaatgcagtggtgcgatcttggctgactgcaacctc

SEQ ID NO: 1923 - DNA, 80 bp, Homo sapiens
gctatgtgtgtctcgctgccccacagctctccctccgcaaaagtggagctttgctttgtgtcacacagtgagtcacaggc

SEQ ID NO: 1924 - DNA, 90 bp, Homo sapiens
gggtagaggtggtggactgtctctctgtgattgttgttttccaggaactcagcttgttgccagggagatgtcacacactagaatgttccc

SEQ ID NO: 1925 - DNA, 84 bp, Homo sapiens
cacaagtgcctttttaattttttttgaaggctatgtattttcattgcatggagtgagagaggttgacaagaagggggttctgtg

SEQ ID NO: 1926 - DNA, 103 bp, Homo sapiens
actgcgcccagcccgagggtttttaatcataaagagatgctgttttttttgtttttttttttaaagacagagcctgactctctttcccagactggaatgcagt

SEQ ID NO: 1927 - DNA, 189 bp, Homo sapiens
atatatatatatgtatatatgtgtatatacatatgtatatatgtgtatatacatatgtatatatgtgtatatacatatgtatatatgtgtatatatgtatatatatgtatatatgtgtatatatgtgtatatatgtgtgtgtgtgtgtgtatatatatatatatatatatatatatatatatatatgga

SEQ ID NO: 1928 - DNA, 85 bp, Homo sapiens
ctcaccaggcctggtggtacatgcctgtgttcccagctacttgagaggctgaggtagaaggatcgcttgggcccaggaggtcgag

SEQ ID NO: 1929 - DNA, 118 bp, Homo sapiens
tcggactgttcaactcacctggcagccactcccagagcccctggaactctggcccaaggctctctgactgactccttcccagatcttctcggcttagtggctgaagactgacactgcc

SEQ ID NO: 1930 - DNA, 119 bp, Homo sapiens
tcggactgttcaactcacctggcagccactcccagagcccctggaactctggcccaaggctctctgactgactccttcccagatcttctcggcttagtggctgaagactgacactgccc

SEQ ID NO: 1931 - DNA, 117 bp, Homo sapiens
ggactgttcaactcacctggcagccactcccagagcccctggaactctggcccaaggctctctgactgactccttcccagatcttctcggcttagtggctgaagactgacactgccc

SEQ ID NO: 1932 - DNA, 116 bp, Homo sapiens
agttgtaggtattgataagaactcatttctaaaatatgtatatatgcatgtatttatctacatatttatgcatgtttgtatgtattatatatgtacatttactagtgccatatgct

SEQ ID NO: 1933 - DNA, 64 bp, Homo sapiens
catctgtgacagcttcttgatctgtcccctggtgggtggctgtgttcaacaggtgttgctcgtg

SEQ ID NO: 1934 - DNA, 116 bp, Homo sapiens
gtcttctgtatattttctactactgatttacttctagcttcaaggaacaattttctatatttttgatccttgcagggttatttctgtaggagtagagttttaatcattggaagtac

SEQ ID NO: 1935 - DNA, 75 bp, Homo sapiens
gagtctcactctgtcacccaggctggagtgtagtggaacgatcacggctcactctagccttgactttgcaggctc

SEQ ID NO: 1936 - DNA, 58 bp, Homo sapiens
tgaggcggagtctcgctctgtcacccaggctggagtgcagtggcgccatctcggctca

SEQ ID NO: 1937 - DNA, 113 bp, Homo sapiens
ccctattatatttattaaaaagtagacagcttattgggatctaaatttcaaactgttttttttccaatgactattgtcttttttccaattactgctgttaaatattacaaggg

SEQ ID NO: 1938 - DNA, 107 bp, Homo sapiens
tgggggttgttgacaataggggaggctatgcaagggtggggtcaagggggcacatggaaaaactctgtctctctctcaattttgctgtcaccctaaaactgccctca

SEQ ID NO: 1939 - DNA, 73 bp, Homo sapiens
aatcttggcacccagagagcagggagcgacagccatcctgatgttgccactctctgtccctctgctgcagatt

SEQ ID NO: 1940 - DNA, 100 bp, Homo sapiens
ggtgacagagcaagacccatttacttatttatttatttatttatttatttatttatttatttatttatttatttgtgagacagagtctctctctgtcgcc

SEQ ID NO: 1941 - DNA, 58 bp, Homo sapiens; identical to SEQ ID NO: 315

SEQ ID NO: 1942 - DNA, 107 bp, Homo sapiens
atgtttgtgtgtgggtgtgaatatatatagttcatgtgtcttaaagagtaaatatatatatatttcttattaagaataatatatatttactcctattatacatttat

SEQ ID NO: 1943 - DNA, 82 bp, Homo sapiens
gacctctgaaaatagagagaggaaaaaaggacagctttgctaaggaatgtgctttctgtctgtctgtctgtactctgagatc

SEQ ID NO: 1944 - DNA, 123 bp, Homo sapiens
tatatgtgtacatatatctgagatgtatatatgtgtacatatatctgagagatatatatgtgtatatatatctgagagatatatgtatgtgtatatatatctgagatatatatatgtatatat

SEQ ID NO: 1945 - DNA, 110 bp, Homo sapiens
tgcacccattcagcagctctctgttcaatatctctctctgtcagtcgctggcctaggccctgcgggtacagaggtgaagagtcagtcaagggccctgttctaagggagca

SEQ ID NO: 1946 - DNA, 122 bp, Homo sapiens
gatatatagatatataatacagatattatatatgtataatatagatattatgtatagatatatatatctctatatatgttatgtatatgtatatgtatctatatatcatatacatgatttct

SEQ ID NO: 1947 - DNA, 88 bp, Homo sapiens
gtgtaaatatagatacgtatatatattcagatatatatacatatgtatctatatatatctgaatatatataggtgtatgtatatatat

SEQ ID NO: 1948 - DNA, 91 bp, Homo sapiens
ttcttcatatatatacatacacctatatatattcagatatatatagatacatatgtatatatatctgaatatatatacgtatctatattta

SEQ ID NO: 1949 - DNA, 94 bp, Homo sapiens
ctctgctttcaaaaatctcaaggacagttgtgtgtttgttgtagctattcgtctcaaggattttccaagtgctttgaggcagtgagagagtgag

SEQ ID NO: 1950 - DNA, 96 bp, Homo sapiens
cgcaacctctaaatgccacagatgttcgaaacagagagagaagactgtggactagaatttttgaggaacattttcatggtgtgagagggacctgtg

SEQ ID NO: 1951 - DNA, 56 bp, Homo sapiens
ggcctggtttttcatgagagaggatgggatccacactctctctctgattcctggct

SEQ ID NO: 1952 - DNA, 83 bp, Homo sapiens
cagagtgcgcatgggcagggcctgacaggtgtgttgtgtcaagaaagacaggtgcaaatttcctctgtgtctgtgtgtgtctg

SEQ ID NO: 1953 - DNA, 70 bp, Homo sapiens
gatatgtgtatatatgtatatgtgtattgtgaacccatgcacatgcacatatgtgtgtgtatacattgtc

SEQ ID NO: 1954 - DNA, 102 bp, Homo sapiens
atctttgtgatgatggaagagttttgtatcttgatcatgctgctagctggtatttacaccagtctatgcatataataaaatggtacagaactgtacaaagat

SEQ ID NO: 1955 - DNA, 79 bp, Homo sapiens
tgaatcattatttttaatttcagttaagtccctgtgttaataaaggggctgaatgaaatgtgaggatgggggtggttgg

SEQ ID NO: 1956 - DNA, 72 bp, Homo sapiens
tcatctcttctgtatctgtctgagatattttaggttatttttatcaaaaatgtcctagcagaggatggatgg

SEQ ID NO: 1957 - DNA, 109 bp, Homo sapiens
gaattctccacagtgaacactcactatatgtatttgttcaataagcagacacagtgaacaaagattgcacaaatactggaaatatggtagtaagcaaggcagaagggtc

SEQ ID NO: 1958 - DNA, 77 bp, Homo sapiens
ctgcaggaatcattcactgcatcttgtatttatgtctaactggagtgagagatggtgtggaatgttctgaggggtag

SEQ ID NO: 1959 - DNA, 81 bp, Homo sapiens
agtgagtgtggatagagaagagaagagtattaaggaatgtgcccttgaattcttctcttttattgtttatttatacttgtt

SEQ ID NO: 1960 - DNA, 110 bp, Homo sapiens
ctattatagctgtgtgatcttggtcaagttatttaatctctctgtgtctcaatttccttctctgtgaaatggagatgataataatagcacctacctcatagggtcattag

SEQ ID NO: 1961 - DNA, 98 bp, Homo sapiens
agttgggtgcgttattttgtaacctgtgtgttttaatgaactgtatttatttttctaaatacgcctgggaagcaaagtatattactcattcacccact

SEQ ID NO: 1962 - DNA, 134 bp, Homo sapiens
gggtgataggaggctcttttgttttagtgagacaattttttttttttttttgagacacagtctcgctctgtcacccaggctggagtgaagtggtgcgatctcggctcactgcaagctccgcctcccaggttcac

SEQ ID NO: 1963 - DNA, 58 bp, Homo sapiens
tgagactgagtctcgctctgtcacccaggctggagtacaatagcgcaatctcggctca

SEQ ID NO: 1964 - DNA, 60 bp, Homo sapiens
gtctgatgagtcggctgccaccaggataggcatcctgttgtcagtgtcactcacacaggc

SEQ ID NO: 1965 - DNA, 79 bp, Homo sapiens
gctctggtttaagtatcaggtatatatatatatatatatatatgtatatagtttgtttgtttgttttttgagacagagt

SEQ ID NO: 1966 - DNA, 99 bp, Homo sapiens
ttggattttatcaaatgacttttctgcatctatttagataatcatagagtagttcttttttatttgattaatatgaagatgtcattgtttgattttcaa

SEQ ID NO: 1967 - DNA, 97 bp, Homo sapiens
agaaggggaggtctgaagcagagaaaataggttttataaactactatagatgaaagaggaaacctttttttttttcttttagacagggtctcattct

SEQ ID NO: 1968 - DNA, 117 bp, Homo sapiens
tgttctgaggttctgtgtggacataaattttggggagatactattcaacctacagtgatgtcaatgcggacatcatgtatcctctaatattatgcaatgagaagggcagtttacttc

SEQ ID NO: 1969 - DNA, 116 bp, Homo sapiens
aggtcttttgcattgctgaagacagttttgtgtctgattatgttatcaatttttgaatatgtgtcatgtggtgatgatatgaatgtatattctgttgtttttgggtggagagttct

SEQ ID NO: 1970 - DNA, 73 bp, Homo sapiens
tctgtgcggcaaaatggattctgctttttttttttttttttttttgagacggagtctggctctgtcgcccagg

SEQ ID NO: 1971 - DNA, 95 bp, Homo sapiens; identical to SEQ ID NO: 68

SEQ ID NO: 1972 - DNA, 93 bp, Homo sapiens; identical to SEQ ID NO: 69

SEQ ID NO: 1973 - DNA, 84 bp, Homo sapiens
tgggatacatgtgctattttatttatttatttgagatggagtctcactgcgttgcccaggttggagtgcaatggcatgatctca

SEQ ID NO: 1974 - DNA, 93 bp, Homo sapiens
attgctggatcaatggtaatcctatgtatagttttttgaggaactaccgtactgtttttcacagcagctatattttacagtttcaccagcaat

SEQ ID NO: 1975 - DNA, 82 bp, Homo sapiens
gccgagtgtggttgccagcacctgtagtctccgggaggctgaggtggtaggatcacttgagcacaggagtttaacaagttgc

SEQ ID NO: 1976 - DNA, 110 bp, Homo sapiens
gttgatagtttcttttcctgggcagaagctctttagtttaattatggcacgcttgtcaatttttgtttttgatgcaattgcctttgaggacttagccacaaattatttgc

SEQ ID NO: 1977 - DNA, 77 bp, Homo sapiens
aagtgaatgaactatatatatatgcatatatatatcattcattcatatatatatgcatatatatagttcattctctt

SEQ ID NO: 1978 - DNA, 83 bp, Homo sapiens
ctatcgcaaactgacagaatacagtgtagtcacgtgtcgcttaacagtagatgactatactgtattctgacagttcatgatag

SEQ ID NO: 1979 - DNA, 115 bp, Homo sapiens
gcatagcagttaagacttcaggctctagagcccaggtgtcttggtttaaatcctagctctgctactctgtcactgagaaagttacacactgctatgtgcctcagtctccccatgt

SEQ ID NO: 1980 - DNA, 84 bp, Homo sapiens
atatatgtacatacacacactatatactatatgtactatatatttatagtgtatatttatatatagtatgtatagtacatatat

SEQ ID NO: 1981 - DNA, 106 bp, Homo sapiens
ccaactcaagtatcgataatacttgtaagagttttgactttttttttttttttttttttagaaaagagcttattctgtacagatataatcattgtttttgatgtgg

SEQ ID NO: 1982 - DNA, 116 bp, Homo sapiens
tcatgggagtggattagttatcatgagactgagttgttataaagtgagtctggcccttggtgtctctctctgtcttgcaccctcactcaccaatgatgccttccgccatggcatga

SEQ ID NO: 1983 - DNA, 78 bp, Homo sapiens
gctgtgactagttgaagagtgaggcttgcaaagattgtgaggtttgttgactgcttctcctttatactgtaatatagc

SEQ ID NO: 1984 - DNA, 78 bp, Homo sapiens
agccccctaaatagctgggactacaggaatgcaccaccatgcatggctaatttctgtatttttattagagatggggtt

SEQ ID NO: 1985 - DNA, 74 bp, Homo sapiens
ttagaagatagagcaaaacttgagagttaaaccctagggttttttttgtttgtttgttttgttttgttttttag

SEQ ID NO: 1986 - DNA, 114 bp, Homo sapiens
acatttcaaattctagctgaactattaataaggagatgcagatatatgctatgtatctatgcatctatgtatctctccatctatatatctctttagcagtatgataaaagatgt

SEQ ID NO: 1987 - DNA, 91 bp, Homo sapiens
cagataaattcagtttaggacatgttggatttgaaatgagtgaaatatccaactcattttacaaacaaatggagataactgaagatgtttg

SEQ ID NO: 1988 - DNA, 157 bp, Homo sapiens
atatatagctatatatatatgtatatgtatatatgtatgtgtatacatgtttgtgtatatatgtatttgtatatatgtgtgtatgtatgtgtgtgtatatatgtatttatgtatatatttaaatatacacacacacacatacacaaagttgcataca

SEQ ID NO: 1989 - DNA, 84 bp, Homo sapiens
ttccagatctgtgtgtatgtgtctgtgtgtgtgtgcatgtatgcatgcagttatatcggggttttattttttgtacaactggaa

SEQ ID NO: 1990 - DNA, 117 bp, Homo sapiens
gggtgacagagtgagaccctgtctcaaaaaaaccccccaaaacaaacaaaaaaaacccttaattcatttatttattttatttatttatttttttgagacagtcttgctctgtcaccc

SEQ ID NO: 1991 - DNA, 86 bp, Homo sapiens
gactcgaaacacacaacctagaagtgagaacactgtgtgctgtgcatgcatgtgcagctcagctttctgactctggatcaagagtt

SEQ ID NO: 1992 - DNA, 98 bp, Homo sapiens
ctttgttttggaaatgttaaaaaaagcttatgagatctcctttttggtggtgctggtggtgatagtttttattttatttatttatttttgagacagag

SEQ ID NO: 1993 - DNA, 89 bp, Homo sapiens
gtatatcattaaatatattatatatctacatgtcatataatttgtatataattacatatgactgatataatgtatgtgtgtgtatatat

SEQ ID NO: 1994 - DNA, 122 bp, Homo sapiens
gtaacaggaacagaaaatggcacaacatgaatccattctcatgacaaagattataatgagaaatgacagtgaacaaaccaaactgattcttgttacctcgtgaggattttatatgtcaggcc

SEQ ID NO: 1995 - DNA, 105 bp, Homo sapiens
gaatcatacagtgttttatattatattgattttgtttatattgaaatcagcttaatatgatgtgtgtgtgtgtatcaatataatactagtcctacagtgtggttc

SEQ ID NO: 1996 - DNA, 58 bp, Homo sapiens; identical to SEQ ID NO: 1409

SEQ ID NO: 1997 - DNA, 78 bp, Homo sapiens
gatatatcatatataccatatattatatatctgtgatatatatcatatatatcatatattatatatctatgatatatc

SEQ ID NO: 1998 - DNA, 115 bp, Homo sapiens
catttcaaatatgtagtggttgggttctattctgaggtctaagttttggaattagtctttattagttatttattagtcttaccctaccaacatattttttttctattgggaaatg

SEQ ID NO: 1999 - DNA, 114 bp, Homo sapiens
gccttggcctccgaagtgctgggattacaggagtgagctactacacccaacctatttatgtattatttttttgagacaaggtctcgctctgtcacccaggctggagaacagtgt

SEQ ID NO: 2000 - DNA, 118 bp, Homo sapiens
gccaactagtattcgatagatttaaaatgaaatcttattctagttttaatttgtatttacaagatgaatagtgattttgaactttcatcgtagttcttcatttggatacttttttgtc

SEQ ID NO: 2001 - DNA, 74 bp, Homo sapiens
acagatatatatatgcatgtatacacatatatagatatatatatgcatgtatacacagatatatatatgcatgt

SEQ ID NO: 2002 - DNA, 71 bp, Homo sapiens
gttgtatattctatatatttctagttgtagagtggagtcactctaccactaattatatttcttattatgac

SEQ ID NO: 2003 - DNA, 73 bp, Homo sapiens
cctgggtaacaggtaagactccatctttttttttttttttaaattgtgacagagtctcgctctgtcacccagg

SEQ ID NO: 2004 - DNA, 85 bp, Homo sapiens
gggacagcccgaaaaggtgggactgagaggggacacttgtggccagcagtgtatctctgacacagtctcaccccgcagggctcct

SEQ ID NO: 2005 - DNA, 105 bp, Homo sapiens
aggaatcaaatggctgtaactgatctagatggaaaagcaatgataagaagcagccgatgcaacgttgcttaagttgtctaattagaggctgctcccatgaaatct

SEQ ID NO: 2006 - DNA, 87 bp, Homo sapiens
cccctttcattttggactgttgtagacagaagagtctctgcctccagaggtaatgttcatgctactcaaatctagttaggaaacagg

SEQ ID NO: 2007 - DNA, 88 bp, Homo sapiens
tcttgggagactgtctctgtgagtattttatgactatgatgcatggtttatgcattatcaaaatattttttgaaattttatttcaaga

SEQ ID NO: 2008 - DNA, 84 bp, Homo sapiens
actggatgctccctgtctctgactctcttcagatcactgggcaattaatctgattgaaagttataggtaaattggagcagaagt

SEQ ID NO: 2009 - DNA, 110 bp, Homo sapiens
tctggtaatttcagaatgtagaaaatcaaccagtccccatagattcatttttgttttgaatcagtagtgattaggtggtgggacttgataaccttcttttctgtccctga

SEQ ID NO: 2010 - DNA, 78 bp, Homo sapiens
catttatttcccatgattatccattgttttctcctgcaaggtgagaaaaatctgggaccagggaagtttcttgagatg

SEQ ID NO: 2011 - DNA, 85 bp, Homo sapiens
tagcatgcatctgtagtcccagctactcaggaggctgaggtaggaggatcacttgagctcaggagtttgaggctacagtgagcta

SEQ ID NO: 2012 - DNA, 83 bp, Homo sapiens
ggggggtgctcagaaacagtggcacagaagaataatttatgcccaaggcacagggtcctttctgtagttagtgtgcacaacgc

SEQ ID NO: 2013 - DNA, 70 bp, Homo sapiens
gtctgtgtgtgagagagagacagactgattaattaactgataaaggtttttgctgttatcacacagggac

SEQ ID NO: 2014 - DNA, 58 bp, Homo sapiens
gtgtccctctctgggtctcagaagggttttctccagcctggacctgggagaggaacat

SEQ ID NO: 2015 - DNA, 92 bp, Homo sapiens
gggtgacagagcgagactccatcaaaaaaaaaaaaaaattaaatatgacctttttttttttttttttgagacagagtttcactctgtcaccc

SEQ ID NO: 2016 - DNA, 107 bp, Homo sapiens
agaaaagatactagtttgagccaagtttcaaggaaataaatttatgttttatatattttactttgtctaaactatgagtttaattcttgtttaggtagtgtacatct

SEQ ID NO: 2017 - DNA, 77 bp, Homo sapiens
ctctaattagaaagtatttctaatgtactgatttgggtgactgcttggagttagggcatggtacttttttacctgag

SEQ ID NO: 2018 - DNA, 101 bp, Homo sapiens
atacaatgcatggctagtatattgtatgtttatatattgtattaatgttgcataagtatatacatatatatgcatattatatacgtattgtatgccggcca

SEQ ID NO: 2019 - DNA, 77 bp, Homo sapiens
aaatatatatgtatatagggtgtgtatatatctatttattgtgtatatatacacacacctatttattgtgtgtgttt

SEQ ID NO: 2020 - DNA, 120 bp, Homo sapiens
tatatgttgcatgtatatatacacgttgtatagatgtatgtatataggtatatattgtatgtgtatatatgttgtatgtacattacacacatatgtgttatgtgtatatatacatatatg

SEQ ID NO: 2021 - DNA, 85 bp, Homo sapiens
tgcccccagtgtctggcactgtgcctggctctgagaggaggctcagtaaatgtttgtaaatgcatgcgtgccaggcgctgtggta

SEQ ID NO: 2022 - DNA, 101 bp, Homo sapiens
cctgagataaccaggaagatctgggtttgggctccagctctggcaagctgcttcctttctctgagcctcagtctctgcatctgtaaaatggggatcccagg

SEQ ID NO: 2023 - DNA, 112 bp, Homo sapiens
tctttggagaaatgtctattcagagtcttgacgatttttaaattgggacttttgtctctttgttgttgagttgtaagagttctttatatattccgaatattaaatcctaaga

SEQ ID NO: 2024 - DNA, 64 bp, Homo sapiens
ggggcgggagggggtgcaaattgcaacggttctctctctttctgtgagcgttttttctcgcctc

SEQ ID NO: 2025 - DNA, 95 bp, Homo sapiens; identical to SEQ ID NO: 68

SEQ ID NO: 2026 - DNA, 93 bp, Homo sapiens; identical to SEQ ID NO: 69

SEQ ID NO: 2027 - DNA, 93 bp, Homo sapiens
gccattctgactggcaaagatgtatctcattgtgttttttttctttctttctttttttttttttgagatggagtctcgctctgtcacccaggc

SEQ ID NO: 2028 - DNA, 58 bp, Homo sapiens
tgagacggagtctctctctgtcacccaggctggagtgcagtggcgctatctctgctca

SEQ ID NO: 2029 - DNA, 130 bp, Homo sapiens
cagatcataaaaatatatgtagactgcaatcctcttttaaatgtgtatatgtatatgtgtgtatatatgtatatgtgtgtatatatgtgtgtctgtatatacatatacatatatacacacacatagagga

SEQ ID NO: 2030 - DNA, 116 bp, Homo sapiens
ctccaaactggggtacagtgagactctgtctcaaaaaggggaggaaaaaaaaaggaaaggttttttttttttttttttttttgagacagagtctcgctctgtcgcccaggctggag

SEQ ID NO: 2031 - DNA, 82 bp, Homo sapiens
ctgggcagttttggctacagagtctatgcttttttttttcttttttttagcgaagtctcactctgcctgtcaccctggctgg

SEQ ID NO: 2032 - DNA, 106 bp, Homo sapiens
gaagtcaaaattcatatatatatgtccatcatatatatatgcatttatatatgtccattatatatatgcatatgtatatgttcatcatatatatatgttccatttc

SEQ ID NO: 2033 - DNA, 97 bp, Homo sapiens
tcatatgtatataaatgtatttatatttgaattgtatgtatatgtatgtgtattttatacatatgcatatgaaagaaaattatacatatgcatatga

SEQ ID NO: 2034 - DNA, 93 bp, Homo sapiens
tgatgggaggctgtgctgtgattgtcactctgtctatgtgcattacttttagcattagaagaaagatatggttgacactgcactactcaatca

SEQ ID NO: 2035 - DNA, 76 bp, Homo sapiens
gcctgacaaaggcccaggggagtgacatccccaagagggttctaaaatgtctctgactctgtgatctttgtcaagc

SEQ ID NO: 2036 - DNA, 174 bp, Homo sapiens
atatatatatacacatatgtgtgtgtgtgtatatatatatatatatatatatgtatgtatatacacacatatgtgtatatatatatgtatacacatatgtgtatatatacatatatatgtatatatacacatatgtgtatatatacatatatatatatgtatatatacacatat

SEQ ID NO: 2037 - DNA, 57 bp, Homo sapiens
gaatcactgtgtgtgtgtctctctctgccaaagaggcaaaggcagacacacagggtc

SEQ ID NO: 2038 - DNA, 96 bp, Homo sapiens
ggccaaggcagcaaggggcagcaaggggctagtgtgtcagctctgctctgagtgtgcacacacctggccgggttgtgacagcacctgggtttggcc

SEQ ID NO: 2039 - DNA, 82 bp, Homo sapiens
ctctatatatatatgtgtgtgtatatatatgtgtgtgtatatatacatatatatatatatacacacacatatatatatagtg

SEQ ID NO: 2040 - DNA, 82 bp, Homo sapiens
agtctcactctgtccctcaggctggagtgcagtggctcagtctaggctcactgcaacctctgcctctggagttcaagagatt

SEQ ID NO: 2041 - DNA, 73 bp, Homo sapiens
gcattttagtcagtttcatatatctatctatatatacatatatagatagatagatatgaagagagtgagaggc

SEQ ID NO: 2042 - DNA, 91 bp, Homo sapiens
gaatttccttgagtttattctacttggaggatgtgcttgtcgaccctcttaaatgtgtagattagtgtttttcctgaagtttgggaagttt

SEQ ID NO: 2043 - DNA, 88 bp, Homo sapiens
gggggagatgttgtcaagaactgtgactagatggattgctggtgatggagaactagtgtgattctctcagtttgtcagcttttcctcc

SEQ ID NO: 2044 - DNA, 114 bp, Homo sapiens
gatctcagctcactgcaacttccgtctcctgggttcaagcgattcttttttttttttttttttttttgagacggagtctccctgtcacccaggctggagtgcagtggcatgatc

SEQ ID NO: 2045 - DNA, 107 bp, Homo sapiens
tagacacggttctaggtacttggggcataacagtgaccaaactttttttcttttttttttttttaagagagagagtctcactctgttgcccaggctgctggagtcta

SEQ ID NO: 2046 - DNA, 58 bp, Homo sapiens
tgagagggagtctcgctctgtctccctggctggagcgcagtggcgcgatctcggctca

SEQ ID NO: 2047 - DNA, 61 bp, Homo sapiens
gtatatgtatatgtatatgtatatgtataatgtgtatgtgtatgtgcatatgtatatgtat

SEQ ID NO: 2048 - DNA, 56 bp, Homo sapiens; identical to SEQ ID NO: 885

SEQ ID NO: 2049 - DNA, 94 bp, Homo sapiens
acaaagcaagacaaccagattgagtcacaattactttttttattaatcctatttattaagagattggcaactcgtttgaggagtctggtcttgt

SEQ ID NO: 2050 - DNA, 130 bp, Homo sapiens
tatatatatgagtgtgtgtgtgtgtgtatacgtatatatatgtatatacacacacacatatatgtgtatatgtatatatgtatatacacatatacacatatatgtgtgtgtgtatatacgtatatatatg

SEQ ID NO: 2051 - DNA, 58 bp, Homo sapiens
tgagatggagtctcactctgtcacccaggctggagtgcagtggtgcgatctcagctca

SEQ ID NO: 2052 - DNA, 70 bp, Homo sapiens
tggcaggaataaggggcaaaagtttttgtttttttttttgagacagaatctcgctctgtcattcaggccg

SEQ ID NO: 2053 - DNA, 58 bp, Homo sapiens; identical to SEQ ID NO: 1763

SEQ ID NO: 2054 - DNA, 94 bp, Homo sapiens
ttttttccactatatgaattgtttatgtatatagatagatagacagatatttgtttgtctaattagatcttcatgagctccgcagtggcaagaa

SEQ ID NO: 2055 - DNA, 80 bp, Homo sapiens
actgctgtcttctctgtgtcttagcagcacccctttgcttgaattcttaggcttttgttctatactgagaatcagccagt

SEQ ID NO: 2056 - DNA, 65 bp, Homo sapiens
cctctgaaattcacacattctgtctctggcccactgttgccagagacactgagtcttgtctttgg

SEQ ID NO: 2057 - DNA, 109 bp, Homo sapiens
acattcaattcatattttacagaacaattctctatctttgtgcactatactgactgttgagtgagagcagtggggtagaattgtggggtggggtgtgtactagaaagta

SEQ ID NO: 2058 - DNA, 81 bp, Homo sapiens
tggctgggtctgatgaaggagcctattatcctattatgtagtaataggtagtataggattacacagtaaacccagactcca

SEQ ID NO: 2059 - DNA, 70 bp, Homo sapiens
gttgtttgagatgagtctcactctgacacccaggctggagtgtggtgctgtgatcttgactcactgcaac

SEQ ID NO: 2060 - DNA, 68 bp, Homo sapiens
tatgtattatatatacatatatattatatacacacctgtataaacacatgtatgtatatgtagacata

SEQ ID NO: 2061 - DNA, 93 bp, Homo sapiens
ttttgtctctgttgatgtggcgaggccctgggttggtcactgggatttttttttttttttgagacggtgtctcgctctgtcgcccaggctgga

SEQ ID NO: 2062 - DNA, 90 bp, Homo sapiens
gcatatattagtactgtatttctttttttgtgatcaaataatgttccattgcatggatacacagtcaagcaacatttactaatgggatgc

SEQ ID NO: 2063 - DNA, 108 bp, Homo sapiens
tatttgtgtcagtttatctattaatttgtttgtttttattattaatttgtgggaattctttacaaatacttaatttgaactctttgttaataatgtatgttacaaata

SEQ ID NO: 2064 - DNA, 95 bp, Homo sapiens; identical to SEQ ID NO: 68

SEQ ID NO: 2065 - DNA, 93 bp, Homo sapiens; identical to SEQ ID NO: 69

SEQ ID NO: 2066 - DNA, 105 bp, Homo sapiens
ttgtggaaatgttttccctgcaaaatgttttagagatgcttgaagaagtggtagttggttgacaagaagtcaggtgaacatggcggatggggcaaaatttcatag

SEQ ID NO: 2067 - DNA, 95 bp, Homo sapiens; identical to SEQ ID NO: 68

SEQ ID NO: 2068 - DNA, 93 bp, Homo sapiens; identical to SEQ ID NO: 69

SEQ ID NO: 2069 - DNA, 96 bp, Homo sapiens
tcagatccatttggtccagtgttgagtttaggttctgaatatttttgttaattttctgcctcaatgatttgtctaatactgtcagtggagtgttga

SEQ ID NO: 2070 - DNA, 98 bp, Homo sapiens
ttgtattttttagaattgaagtggtattgatcagcatatttcaggaagtaggttctattttctatgctgagttttaaggattcagtctctgaaagcag

SEQ ID NO: 2071 - DNA, 98 bp, Homo sapiens
tccaagacacaatggcaagtccaattaatgtttttttttcttcaagtgggaccagctgaaagatgaagtgacttgagtgagaggcaaattgatttgga

SEQ ID NO: 2072 - DNA, 107 bp, Homo sapiens
gttttgggcagtgtctcagattgaaatcctgtgaataaaaagtggttctgaaaagttattcttagccacttaggtataggctcttagtcttgagaaatgggtaaggc

SEQ ID NO: 2073 - DNA, 114 bp, Homo sapiens
tagattatataaaaggtatctgagttagttttattttatttatatagatattttatctccaagaaagatcttgggaatattgtttattatcagagatcaattttatggaggctg

SEQ ID NO: 2074 - DNA, 95 bp, Homo sapiens; identical to SEQ ID NO: 580

SEQ ID NO: 2075 - DNA, 93 bp, Homo sapiens; identical to SEQ ID NO: 69

SEQ ID NO: 2076 - DNA, 102 bp, Homo sapiens
ggcgtggtggtgtgcatctgcagtcccaggtacttgggaggctgaggtaggaggatcacttgagcccgggaacttgaggctgcagtgagctatgattgtgcc

SEQ ID NO: 2077 - DNA, 85 bp, Homo sapiens
ggccaagtggacctccattttctcacctgtaaagggggacagctctgtctcactctcagggttgttaatgaggacacagcaggtc

SEQ ID NO: 2078 - DNA, 84 bp, Homo sapiens
tgaaggactcaggatagctgcctgtatagatttctggagttctttctctctgtgcctcacatttcagctcttttagctccttta

SEQ ID NO: 2079 - DNA, 108 bp, Homo sapiens
tctctgtaagtctctgtcatcttttgcacctctaattttttggagtatgaatgttttattttagaataactttagatttacagaaaaattgcaaagttagtacagaga

SEQ ID NO: 2080 - DNA, 84 bp, Homo sapiens
catttgggagtgatgcatgtatttattatcttgattgtggtgatggtttcatgaatatatgtatttgtcaagaactaacaaatg

SEQ ID NO: 2081 - DNA, 106 bp, Homo sapiens
gtgccgtaataccaaaagttccatacaaatgctgaatattaatttttagagtcccgacttttccttgtatcagcatcagtttaccagcttcacttgaaaatggcat

SEQ ID NO: 2082 - DNA, 72 bp, Homo sapiens
atatatatatggaaaaatatatatgtggaaaatatatatttccttgtatatatatattttccttgtatatat

SEQ ID NO: 2083 - DNA, 93 bp, Homo sapiens
tgggctcagacgcctgacactttctttttgagacagagacagactctcactctgtttgcccaggatggagtgcagtgacgtgatctcagctca

SEQ ID NO: 2084 - DNA, 94 bp, Homo sapiens
attgatttgcatatgttgaaccagccttgtatcccagggatgaagcggacttgaccatggtggataggctttttgatgtgctgctggattcagt

SEQ ID NO: 2085 - DNA, 101 bp, Homo sapiens
agtggtttgtcttgagttgtgtttgctttgcttgcccaaggggttttattactctgggttactctagctccaaaggaaatgagaatatcaatatctacact

SEQ ID NO: 2086 - DNA, 94 bp, Homo sapiens
caatgcgggctctttttggttccatatgaaatttaaagtagttttttccaattctgtgaagaaagtcattggtagcttgatggggatagcattg

SEQ ID NO: 2087 - DNA, 99 bp, Homo sapiens
gacctgccaaggttgaaatactgcctgactgcctgactcactcttactgaagcattaaaacctggcagctgcttaccacaggctcaatctccatgggtt

SEQ ID NO: 2088 - DNA, 115 bp, Homo sapiens
tgtggctattgagcatttgaaatgtgattgtggtgactgaggaagtgaatttttaattttatttactttaaattaaattcagccacatgactactatttggataatgcagttata

SEQ ID NO: 2089 - DNA, 120 bp, Homo sapiens
gtctgtttacttaagtaaaatagaaagttacactgttgtatgttgaattgtatttttgtttattcagcttatatataatttatgtttttaatttagctttatcacttattgtaggctgat

SEQ ID NO: 2090 - DNA, 60 bp, Homo sapiens
agaaagtgatggagcagagatgtggacctccatctctcggactcacagcctgcgctttct

SEQ ID NO: 2091 - DNA, 83 bp, Homo sapiens
cactggtctcctgaagcagctctgggcagggatccggaagctctctgtctccctctcagctgtctccccctctgtctccagtg

SEQ ID NO: 2092 - DNA, 114 bp, Homo sapiens
cattccttgcaaaagggtttgaaataatagagttttattctgtatttatatcacaaaacatgatttttttttttttttgagacggaatcttgctctgttgcccaggctggagtg

SEQ ID NO: 2093 - DNA, 100 bp, Homo sapiens
gaaatggtatacaggaaaatgacctatgaattgacagacaatatagctgagtttgtctgtcatttctttaggccaatattctgtatgactgtgctacttc

SEQ ID NO: 2094 - DNA, 116 bp, Homo sapiens
ccttatatgtttaatggtgttatcaagtgtaacagcaactccatgtggactgtgtaccaatttccagtggagatgctgttacttttgatggttaccaacttgctacaatataaagg

SEQ ID NO: 2095 - DNA, 108 bp, Homo sapiens
gagtttacttaatccaatgatttctaaacctttttctgtttttctagatgaaatttcatttagaatttataatacagaaaatagttaaacatgggaatatttttcctc

SEQ ID NO: 2096 - DNA, 56 bp, Homo sapiens; identical to SEQ ID NO: 324

SEQ ID NO: 2097 - DNA, 101 bp, Homo sapiens
tccctgcttggtgcatggagacccactccttttcaaattcttattattttatttatttatttatttttgagatggcgtctcactctgtcacccagactgga

SEQ ID NO: 2098 - DNA, 110 bp, Homo sapiens
gcattagctgtttattatcatcggtattgctctgtgatttatcattagtattatctatatatgaatttagatttcctattgggatgccagtgattccaacaaaagtttgc

SEQ ID NO: 2099 - DNA, 120 bp, Homo sapiens
cagactggggaagatctgtgtgtgggcatgtggaacagcctccaggactgacacacacacacagaggcagtgtgacagggaccagggctggaccaggctctgatgcttcctagctgtgtg

SEQ ID NO: 2100 - DNA, 114 bp, Homo sapiens
tccacaaaacagctattttgaatcctctgtctgaaaggtcacatatctctgtctctccaggattgatccctggtgccctatttagttcgtttggtgaggtcatgttttcctgga

SEQ ID NO: 2101 - DNA, 117 bp, Homo sapiens
gcatttgtttcaatgagttgtgaagttgaaggtacccatatagacaaagtatttattttatacttacacataagtttttttctttttggacttaaactgaagccatggagaaattgc

SEQ ID NO: 2102 - DNA, 80 bp, Homo sapiens
cacctccttgcatgccaggacctctgccaggctggccctggcaccctgtgcctctgagagactggcgctgtggagaggtg

SEQ ID NO: 2103 - DNA, 80 bp, Homo sapiens
gagcagagttatagtcagagctgtggcccaagcctcttcctgtgaagagagtgtggtcagagcagaccaagggatgcctc

SEQ ID NO: 2104 - DNA, 76 bp, Homo sapiens
gaaggggtctcctggactctctctctctgcctctattccccaactataggaaagcggagctcagacctgccccttc

SEQ ID NO: 2105 - DNA, 138 bp, Homo sapiens
atggattgctgagttaaatggtagctctgttttaagttatttgagagttgtccaaactgcttttcacagtggctgtactaatttaccttcccaccagcagtgtataagtgtttcgttaactctttaaccttaatggca

SEQ ID NO: 2106 - DNA, 124 bp, Homo sapiens
tatatgcatatatacagtatatcttctatatatgcatatatacatatgtatcttctatatatgcatatatatacatatgtatcttctatatatgcatatatctgcatatatatcttctatatat

SEQ ID NO: 2107 - DNA, 90 bp, Homo sapiens
gtcattgccaggacccatttgtgggcagagttcctctcactggctctctctgaggtctctgcttttgaactgtccatcctggctactgat

SEQ ID NO: 2108 - DNA, 95 bp, Homo sapiens; identical to SEQ ID NO: 68

SEQ ID NO: 2109 - DNA, 93 bp, Homo sapiens; identical to SEQ ID NO: 69

SEQ ID NO: 2110 - DNA, 92 bp, Homo sapiens
gcaattttgtactggtttgtagatattctttatatttttaaggtacaaatatttttgtatgtgaaaaaaaaagtcttctcccagtctgttgc

SEQ ID NO: 2111 - DNA, 104 bp, Homo sapiens
gtacacacatgcacatatatatacatatataaatctatatatattcacacacatcctcatatatatatatacacatatatgtgtatatatagaaatgtgtgtac

SEQ ID NO: 2112 - DNA, 90 bp, Homo sapiens
ctctatcccaacaacgtctctggctagagtctataggtgtttgcccctgggtggctctctgtgtgcctggccattacggaacagatgggg

SEQ ID NO: 2113 - DNA, 86 bp, Homo sapiens
tatttgaaaaaaatgtgtttttcttgttggttaacaatgtatgtacatatatattcaaccaacattattaattcagtttttaaatg

SEQ ID NO: 2114 - DNA, 95 bp, Homo sapiens
caatgcaggctcttttttggttccatatgaaatttaaagtagttttttccaattctgtgaagaaagtcattggtagcttgatggggatggcattg

SEQ ID NO: 2115 - DNA, 64 bp, Homo sapiens
atgtgtatgtatacatgtgtatgtatacatacgtgtgtatatatatacatatatacatatatat

SEQ ID NO: 2116 - DNA, 89 bp, Homo sapiens
ccatgtctctttcccattgtgtctttctgtcactccttgcctcctaccatgtgggcctttcagacagacactgatgtctcccttcatgg

SEQ ID NO: 2117 - DNA, 109 bp, Homo sapiens
ctcttaaaggataattttgttcagtatgtaattctaattgacagtcattttctctcagcagaagagactatttggcttctattattgctatggatatgtctgctattag

SEQ ID NO: 2118 - DNA, 73 bp, Homo sapiens
tatatgtatgtaatttatatacagatatatatataaatatgtgtgaatatgtgtacatatatacatgcatata

SEQ ID NO: 2119 - DNA, 118 bp, Homo sapiens
caggtgggcagcagaatgggagttcttgagatttaactctcgtgaggttccctgggtccctgtgtgcctgagtcaggacctaaatgtggctgagagtccagctcaccggtggagggga

SEQ ID NO: 2120 - DNA, 102 bp, Homo sapiens
ggtcttacttgggggtggagggtgggaggagggaggggagcagaaacaattttttttttttgaggcagggtctcgctgtcacccaggctagagtacagtgcc

SEQ ID NO: 2121 - DNA, 117 bp, Homo sapiens
ctttgagcattcctctgtagtcatatctgcctgtgaccacagctgggaaagattcttttttttttgagacagagtctcactctgttgccaggctggagtgcagtggcgagatctggg

SEQ ID NO: 2122 - DNA, 66 bp, Homo sapiens
tatgtgtatatagatacacacacgtatatgtgtgtgtgtgtgtgtatgtgtctgtatgtgcacatg

SEQ ID NO: 2123 - DNA, 110 bp, Homo sapiens
gcatattagctttaatgtaggtggtgataagtttttaggccaggggaggaacaaagtttttttcttttttttatatatatattatactttaagttctagggtacatgtgc

SEQ ID NO: 2124 - DNA, 111 bp, Homo sapiens
tgtactccagcctgggtgacacagtgagactgtctcaaaaataaataaataaataaataaataaaataaaacatgacagttcttactgttgtgacagccagtagaagtata

SEQ ID NO: 2125 - DNA, 56 bp, Homo sapiens
gagacaaggtctcactctgtcacccaggccggagtgcagtggtatgatcttagctc

SEQ ID NO: 2126 - DNA, 73 bp, Homo sapiens
gtatatgtgtatatgtatacatatatgtatatatgtatatatatgtgtgtgtatatatgtatatatatataca

SEQ ID NO: 2127 - DNA, 95 bp, Homo sapiens
atatacgtatatacgtatatacacatatatgtatatatgtatacatatacatatatacgtatatacgtatatatacataaacgtatatatgtata

SEQ ID NO: 2128 - DNA, 117 bp, Homo sapiens
cctttgggaatgggaacatttaccaaatgcttatactcctgttgtatcatggaagtaactaacttgtttttttattttacaggctcataggcagaagggaatggcttttctcagatg

SEQ ID NO: 2129 - DNA, 113 bp, Homo sapiens
gtagtaaatacagataatggaataaaatatacatattgtattacatgtttttctatttatgatttaaagaacttgatggtaaatgtctgtatatctttatctgtgtctatttc

SEQ ID NO: 2130 - DNA, 95 bp, Homo sapiens; identical to SEQ ID NO: 580

SEQ ID NO: 2131 - DNA, 93 bp, Homo sapiens; identical to SEQ ID NO: 69

SEQ ID NO: 2132 - DNA, 63 bp, Homo sapiens
gggaatgagagaggcagaagatggcctataaaggcacttcatcttttattctgttttatttct

SEQ ID NO: 2133 - DNA, 81 bp, Homo sapiens
gtcttgctctgtcaccctgactagagtgcagtggcacgatctcggctcactgcctcccaggttcaagtgattctccaagat

SEQ ID NO: 2134 - DNA, 68 bp, Homo sapiens
tgtcttgagacagggtctcactctgtcacccaggctggagtgcagtggtgagatcagagctcactgca

SEQ ID NO: 2135 - DNA, 58 bp, Homo sapiens
tgagacagggtctcactctgtcacccaggctggagtgcagtggtgagatcagagctca

SEQ ID NO: 2136 - DNA, 56 bp, Homo sapiens
gagacagggtctcactctgtcacccaggctggagtgcagtggtgagatcagagctc

SEQ ID NO: 2137 - DNA, 97 bp, Homo sapiens
tactccacccctgtctattgagtcagagtatcttttatttgtatttttttattttttgagatggagtctcactcactttgtcacccaggctggagtg

SEQ ID NO: 2138 - DNA, 73 bp, Homo sapiens
gagatggagcctcactctgtcactcacgctggaatgtagtggcgcgatctcggctcactgtaacctctgtctc

SEQ ID NO: 2139 - DNA, 80 bp, Homo sapiens
tgagtcggagtctcgctctgtcacccaggctggagtggagtggcgtgatctcggctcactgcacgctctgcttcctgggt

SEQ ID NO: 2140 - DNA, 102 bp, Homo sapiens
atatatatacgtgtgtgtgtgtgtatatatatgtgtgtgtgtgtgtatatatatatacatatatatacatatatatgtatatatatgtgtgtgtgtgtatgt

SEQ ID NO: 2141 - DNA, 101 bp, Homo sapiens
gtggcagatctaagattcaaacccaggcatgtgaattcagtctctctctctcacctgagattagggagcagttttgctttgtgaaatgctgtctctgctgt

SEQ ID NO: 2142 - DNA, 97 bp, Homo sapiens
gtcacatttgctttcatatatatatgtatatatgtgtgcatgtatatagatatattaatagatatatgtgtctatgtgtgtatatatatgggggggt

SEQ ID NO: 2143 - DNA, 83 bp, Homo sapiens
ttcattagggaacaaagtttgtgggactcttcttttttttttttttttttgagacagggtctcattttgtggcccaggctgga

SEQ ID NO: 2144 - DNA, 97 bp, Homo sapiens
aggcaggaggattgcctcagcccaggaagtcaaggctgtagtgggctatgatctcaccactgcactccagtctgggtgacagagcaagacccagcct

SEQ ID NO: 2145 - DNA, 116 bp, Homo sapiens
cctgctaaggtacatgtttgtcagattggtggccagctgtttcattttagttattttttacaatactgttttgttaaagctgccttcccaaatcatggatacattttttttttagg

SEQ ID NO: 2146 - DNA, 76 bp, Homo sapiens
tatgtgtgtctgtgtgtgtgtgtgtgtatccccatgatagacatggaggaactctgaatgctacattatatacatg

SEQ ID NO: 2147 - DNA, 75 bp, Homo sapiens
ttgtttttgagatggagtctcactcactctgtcacctgggctggagtgcagtggcgcgatctctgctcagtgcaa

SEQ ID NO: 2148 - DNA, 90 bp, Homo sapiens
tagaaagtttacaaacttaaaaataagaaaatgtaatttgtctcaggagggaagaagattatatttctttatttaagaccatcctttcta

SEQ ID NO: 2149 - DNA, 87 bp, Homo sapiens
atatatgagagatatatatatctcatatatatgagagatatatatctctcatatatatgatatatattatatataaatctcatatat

SEQ ID NO: 2150 - DNA, 75 bp, Homo sapiens
ggattacaggtgtgcaccaccacattcagctaatttttatatatttagtagagatggggtttcaccatgttagcc

SEQ ID NO: 2151 - DNA, 77 bp, Homo sapiens
gggcaggcttcccaaggggctggaagcaagagatctctcccctggtctttgtctctgctgtctctctctgtttgtct

SEQ ID NO: 2152 - DNA, 130 bp, Homo sapiens
cagagtacaaaggccaggattctgcacctaaccgctgtgtggctttggaccagtttcctagtctctctgtgcctcagtttctcctgcttctgtcatcacaggttctggcaagactgtcacagacaccgag

SEQ ID NO: 2153 - DNA, 58 bp, Homo sapiens
tatatgtatgtatatttgtacatatgtatatatatatgtacaaatatgcatatattta

SEQ ID NO: 2154 - DNA, 75 bp, Homo sapiens
gtgtgtctgtgtctgtgtgtgtatgatacgtatataaatatatgcatatttgtacatatatatatacatatgtac

SEQ ID NO: 2155 - DNA, 81 bp, Homo sapiens
tgcttctttggggccagctgtgaattactagacagtctgctcagatggagtctcatataacagcacctaatcaagggagca

SEQ ID NO: 2156 - DNA, 114 bp, Homo sapiens
tcctgggagaggagagcgaagactgtgctcaactaaagctcagaggaatgaagtgaggtgatactagagagaagcaaatggggatggagcattgcaaattctctgccactggga

SEQ ID NO: 2157 - DNA, 95 bp, Homo sapiens; identical to SEQ ID NO: 68

SEQ ID NO: 2158 - DNA, 93 bp, Homo sapiens; identical to SEQ ID NO: 69

SEQ ID NO: 2159 - DNA, 110 bp, Homo sapiens
gtttctcagccgtccctgcggctatttgtgcaatgtctgtctgtctgagtctccgggtgagggcagacaggatatggtgcgaggaagtctggggtaagtgtgagccgaac

SEQ ID NO: 2160 - DNA, 89 bp, Homo sapiens
ctaaccctgctgcagtgactccctcagtctcacaccagatctgacagggacctggcgggggcagggattagactttgggagcatggcag

SEQ ID NO: 2161 - DNA, 95 bp, Homo sapiens
agattgtcattatcttgggagtgagtttgttacaaaaatgaggtaagtctcctcttgccctttctggcacactctctcaccatgtgatgtcttct

SEQ ID NO: 2162 - DNA, 79 bp, Homo sapiens
aggggtggtgggagggcagggagcgcccagcaggtgtccagcggtgctggcgctgcctctgtctctctgtccacgccct

SEQ ID NO: 2163 - DNA, 117 bp, Homo sapiens
ctgggcatggtggtgcatgcctgtagtcccagctactcaagaggctgaggtaggaggatcacttgagcccaggaggtcaggtcaaggctgcagtgagtcacccactccagcctgggt

SEQ ID NO: 2164 - DNA, 73 bp, Homo sapiens
ggtgtgagcgactgagcccagcctgttttttttttttttttctgagacggtgtctcgctctgtcgcccaggct

SEQ ID NO: 2165 - DNA, 75 bp, Homo sapiens
ggtgtcacaagtgagtgagctgaaacagatcacattatcctcttttcagttcagcaactgacttcactgaccacc

SEQ ID NO: 2166 - DNA, 89 bp, Homo sapiens
ggagggagaatttgaccttgtacagagaattatttatgaggtatgattataattagtaaatttttttttttgagtcagagtctcgctct

SEQ ID NO: 2167 - DNA, 116 bp, Homo sapiens
gtctcagtctcagtctcaggtattttgttatagcagcacagactaagaatcgttttttttttctttacaagatggagtcttgctctgtcgcccaggctggagtgcagaggtgtgat

SEQ ID NO: 2168 - DNA, 112 bp, Homo sapiens
cagctcccctcatgaccctggagggaattctgcccactcacagactctttcttattctgggcctctgctgttatctgggtattgctccctgtcacagtcagtttggggactg

SEQ ID NO: 2169 - DNA, 86 bp, Homo sapiens
ttgttttgagacagggtctcactctgtcacccaggctggagtgcagaggcctgatcatgactcactgcagtctcagcctccctggg

SEQ ID NO: 2170 - DNA, 82 bp, Homo sapiens
tggagtctcactctgtctcccaggctggagtgcagtggtgcaatctcggctcactgcaggctggtctcaacctctgacttcg

SEQ ID NO: 2171 - DNA, 71 bp, Homo sapiens
ttgtttttgagactgagtctcgctctgtcacccaggctggagtgcagtggcgcaatcttggctcactacaa

SEQ ID NO: 2172 - DNA, 58 bp, Homo sapiens
tgagactgagtctcgctctgtcacccaggctggagtgcagtggcgcaatcttggctca

SEQ ID NO: 2173 - DNA, 58 bp, Homo sapiens
tgagacagagtctcactctgtcaccctggctggagtgcggtggtgcaggctcggctta

SEQ ID NO: 2174 - DNA, 98 bp, Homo sapiens
tatgcgcaatatacttagaggaagtcagattattatttttataagctacagagatgaaggtgatactgtcaaagatgcctttttggtataatgacatg

SEQ ID NO: 2175 - DNA, 58 bp, Homo sapiens
tgagtcagtgtctcgctctgtcgcccaggttggagtgcaggggcgcgatctcggctca

SEQ ID NO: 2176 - DNA, 119 bp, Homo sapiens
gctcactgcatcctccacctcccaggttcaagtgattctcctgcctcagctccaaatagaattttttttttttagactgagtctcgctcgctctgtcgcccaggctggagtgcagtggc

SEQ ID NO: 2177 - DNA, 88 bp, Homo sapiens
gaggtgaaggagttttctgaggtcccttttatttaattaattaattaattaattaatttttttgagatggagtctcgctctgtcaccc

SEQ ID NO: 2178 - DNA, 68 bp, Homo sapiens
aacagagtgacactctgtctcaaaaaaaaaaaatttgttttcttgtagagacagggtctcactctgtt

SEQ ID NO: 2179 - DNA, 73 bp, Homo sapiens
gtctttctgccactgtctctgtggccagctagagaagtcagcacgtactatagagacggccccagccggtgat

SEQ ID NO: 2180 - DNA, 111 bp, Homo sapiens
gtgccactgcactccatcctgggtgacagagcgagactccgtctcaaaaaaaaaaaatttttttttaagagttggaatattgctacatcacccaggctagagtgcagtcac

SEQ ID NO: 2181 - DNA, 58 bp, Homo sapiens; identical to SEQ ID NO: 1409

SEQ ID NO: 2182 - DNA, 130 bp, Homo sapiens
tgagtgagaccctgtctcaaaaacataaagttttttttttttttgagatggagtctcactcagtcacccaggctggagtgtggtggtgtgatgtctgcccactgcaacctccacctcctgggctcaagtg

SEQ ID NO: 2183 - DNA, 61 bp, Homo sapiens
cagagtctcgctcactcagtgctcaatcttgcccaggctggagtgcagtggcgtgattttg

SEQ ID NO: 2184 - DNA, 75 bp, Homo sapiens
gttgttgttgtttgagactatctcactctgtcacccaggctggagtggagtggcatgatcttggctcactgcaac

SEQ ID NO: 2185 - DNA, 58 bp, Homo sapiens; identical to SEQ ID NO: 285

SEQ ID NO: 2186 - DNA, 97 bp, Homo sapiens
taatttgtaaactaggatgagtataatgttttaaagtatgagttttatttctttaaaatcatacttagtaaatgtgtcatttgaaccttataaatta

SEQ ID NO: 2187 - DNA, 83 bp, Homo sapiens
gcagccagttctttatttgttgttcttaagctgtcattacaaattctgctagcttacagggtaaaaaaacatgagctggaggt

SEQ ID NO: 2188 - DNA, 71 bp, Homo sapiens
gagggactgactggttttacccaatctatgcaggctaacttgacagatgagtgggtggtcagcagcatttc

SEQ ID NO: 2189 - DNA, 95 bp, Homo sapiens
tgtgatttatacctaggagtggaattgtagtcatgggttttttttttttttattggactgactgccctccttgactgcccttcaaagtgattaca

SEQ ID NO: 2190 - DNA, 110 bp, Homo sapiens
tatatagagagtggttatatatacatatagaatggtctatatataatatataaattatatattatataatcatacataatatataaattatatataataatctctatata

SEQ ID NO: 2191 - DNA, 105 bp, Homo sapiens
tttcttattgaggtcatcctgagaaaagtttgaaaatcactgattctatttcattatttctcaaactgttctctagattattcacttcaaaattgcattaaggaa

SEQ ID NO: 2192 - DNA, 58 bp, Homo sapiens; identical to SEQ ID NO: 1745

SEQ ID NO: 2193 - DNA, 110 bp, Homo sapiens
gatttttgtatgttcattttgtatcctgtaacattactgaatttgtttattaattcaaatagatttttagtggagtccttaggtttttccaaatacaagatcatatcatc

SEQ ID NO: 2194 - DNA, 115 bp, Homo sapiens
gtgtgattatttggaggtaagaagacactctggcttttagagttgcagagttcttacactgtctgtttctgatctgtgaaagctgatgttcctttatcctttgaagttgttgttc

SEQ ID NO: 2195 - DNA, 98 bp, Homo sapiens
ctggcgagaaaagataatttatggctacttgtggttgaaaattagtattttcagatttcaaagtttattatttataagcctttacattttctggcgag

SEQ ID NO: 2196 - DNA, 117 bp, Homo sapiens
gttcatcttcatccatttagctatatagacaggaatgagaatgtaatgtttagaacattgattatgatgtgagactgcctatgttcaaaatctgtgatctagccatgatggagaaac

SEQ ID NO: 2197 - DNA, 91 bp, Homo sapiens
tcttaggagagcagatttgattatttgaattcctgttaaactacagaagtgtgcagattgattcattataattttgtcacctttgtaaaga

SEQ ID NO: 2198 - DNA, 77 bp, Homo sapiens
gtattatatatatacatgtatatatatgtgtatatatatgtatatatacatgtatatatatgtgtgtgtatatatat

SEQ ID NO: 2199 - DNA, 145 bp, Homo sapiens
atgtacacatgtatatatgtatatatacatatatgtatatatgtacatatgtacgttatatatacatatatgtacatatgtatatatgtgtatatatgtatgtatatatacatataagtatatatgcgtatatatagtatatatg

SEQ ID NO: 2200 - DNA, 114 bp, Homo sapiens
atacatatatgcatgtatgtatatatgcacatatacctatatatacatatatgtatatatacacatatacatatatgtacatatgtgtatatacacacatatgcatatatgtat

SEQ ID NO: 2201 - DNA, 90 bp, Homo sapiens
gagttgtgggcaggtcattggactgggactgactttaccagttttcaggctgtggggctagtcagtcattctctctgagccttctacctc

SEQ ID NO: 2202 - DNA, 100 bp, Homo sapiens
gtgtagagagtgtttactgtatcctggccagcattaagtattatttttgttttgaaaattttttttgctgtgggaaaatgcagataacataaaatttacc

SEQ ID NO: 2203 - DNA, 117 bp, Homo sapiens
atgcatttgcatttgttgatctgaggtcagcacttaagttggacatcttcaaatctttttttttttttaattgagatggagccttgctgtgttgccccggctggagtgcagtggcat

SEQ ID NO: 2204 - DNA, 73 bp, Homo sapiens
aggcccttaactggctctcaatgatggggctccaagagagaacagtcagtggagtataataacaaggggtcct

SEQ ID NO: 2205 - DNA, 79 bp, Homo sapiens
tctttgttctttgcagcagatcagactggaaccaggaaactgattgtttttctatgtttgctggtacttggtaaaagga

SEQ ID NO: 2206 - DNA, 61 bp, Homo sapiens
gtgagcctcactgtgtctcagggcttctgaaaggcaggtcctgcatatagtgcaagcttat

SEQ ID NO: 2207 - DNA, 83 bp, Homo sapiens
ttgtatgttttctacattgtcagtatctagttttatatagttaatatgtacttctaaaatttctgacagtgtttggtgtataa

SEQ ID NO: 2208 - DNA, 163 bp, Homo sapiens
atatatatatatatatatatatacacacacacatatgtatacacatatatatgtgcgtatatatatgtatgtgtgtgtgtatatatatatatattatatatatatatatatattatatatatatatatatatattatatatatataatatatatatatacaca

SEQ ID NO: 2209 - DNA, 71 bp, Homo sapiens
atatatatgtatgcatgtgtgtgtatatatacatataatgtgtgtgtgtgtgtgtgtgtgtgtgtgtgtgt

SEQ ID NO: 2210 - DNA, 84 bp, Homo sapiens
aattagctgggcacaatggtgcacccctgtaatcccagcactttgggaggctgaggtaggaggatcacttgagctcaggtggtt

SEQ ID NO: 2211 - DNA, 104 bp, Homo sapiens
gaccaaagtgagcatcaagccttacactcagaaagtatatttatttgaataaaatatcactgttagacactttgggaggctgaggcaggaggatcttttgagtc

SEQ ID NO: 2212 - DNA, 105 bp, Homo sapiens
tctttattcagaggaaggagcctgttttaaatattttcttatttttttccctcaggttattgataaggaaactatagatttattggcgttcacctctgttgcaga

SEQ ID NO: 2213 - DNA, 58 bp, Homo sapiens
tgagacggagtctcactctgtcacccaggctggagtacaatggcgcgatctcgtctca

SEQ ID NO: 2214 - DNA, 97 bp, Homo sapiens
tccagcctgggtggcagagtgagactctgtttcttttcttttctttctttctttttttttttttgagacagagtctggctctgtcacccacactgga

SEQ ID NO: 2215 - DNA, 82 bp, Homo sapiens
tccttgatgactgagagggaaggataccactcacaggccagaagactgccttggcagagtctgtttctctctctcctatgga

SEQ ID NO: 2216 - DNA, 110 bp, Homo sapiens
actaattaggaattgaacttggatggcactgtcaactttcacagcgagctttgtacagtaaactgtgacaagaacctgacagctccatggggtaggtttcttggcagagt

SEQ ID NO: 2217 - DNA, 58 bp, Homo sapiens
tgagacggagtctcgctctgtcacccacgctggagtgcagtggtgtgatctcggctca

SEQ ID NO: 2218 - DNA, 135 bp, Homo sapiens
ggctcaggtgatcttcccatcttggcctcccaaagtgctgggatcacaggtgtgagccactgtgcctggctgtctcattcattcaatcaacaaatgtttctcatgccaggccctgggccacattcacctttccca

SEQ ID NO: 2219 - DNA, 91 bp, Homo sapiens
gacagagtgagactgtctcaaaaaaaaaaaaaaaagtaataagaaacggtaaaattattattattattttgagatggagtctcactctgtc

SEQ ID NO: 2220 - DNA, 58 bp, Homo sapiens
tgagacagggtctcactctgtcacccaggctggagtacagtggtgcgaccttggctca

SEQ ID NO: 2221 - DNA, 58 bp, Homo sapiens
tgagacagggtctcactctgtcacccaggctggagtgcagtggtgcgatctcagctca

SEQ ID NO: 2222 - DNA, 79 bp, Homo sapiens
gtgaactaggcgcagggtctttgagggatggtaagtaaacaattttttttttttctgagacagactctcgctctgtcac

SEQ ID NO: 2223 - DNA, 119 bp, Homo sapiens
gcctgggcgacagagcaagattccatctccaaaaaaaagagagatacatttttttctttctttctttctcttttttttttttttttgagacagggtttcagtcactttgtcacccaggc

SEQ ID NO: 2224 - DNA, 58 bp, Homo sapiens
tgagacagagtctcgctctgtcacccaggctggagtgcagtggtgcgatcttggctca

SEQ ID NO: 2225 - DNA, 56 bp, Homo sapiens; identical to SEQ ID NO: 335

SEQ ID NO: 2226 - DNA, 75 bp, Homo sapiens
gcaacagagcgagaccctgcctcagaaaaaaaaaattgtttttgtcgagacagggtctctctgtgtttcccatgc

SEQ ID NO: 2227 - DNA, 88 bp, Homo sapiens
gttttctgggaggagatgacatttgagctgagttttcttttttttttttttaagacagagtctcgctctgtcggccaggctagagagc

SEQ ID NO: 2228 - DNA, 102 bp, Homo sapiens
gcttggcatgacacctggcagacggcgggcactgttctctctctcagggcatgggaaatgctctctggagctatggggccgatggctaagggagagtcagtg

SEQ ID NO: 2229 - DNA, 86 bp, Homo sapiens
caattaggtttcctcactgtcattctctcttgggccatgtcttacggcatgatactcctgcccaaggacagtgcttaacttgtttg

SEQ ID NO: 2230 - DNA, 76 bp, Homo sapiens
gtctgggacaggctttagagctcatttccttttttttttttttttttgaggtggagtctcgctctgtcacccaggc

SEQ ID NO: 2231 - DNA, 90 bp, Homo sapiens
tctctgtcctaacagccccttagtcactctctggctctgcccagtcatggccagcggtgctttcttcccagggctggatctgcatcgaga

SEQ ID NO: 2232 - DNA, 57 bp, Homo sapiens
cagtgagaagagacaggggacatggatttccatctgcctgccttaaacacctcactg

SEQ ID NO: 2233 - DNA, 97 bp, Homo sapiens
tcacctggcagccactcccagagcccctggaactctggcccaaggctctctgactgactccttcccagattttcttggcttagtggctgaagactga

SEQ ID NO: 2234 - DNA, 121 bp, Homo sapiens
gtgtgtatgtgtatatatgtgtatatgtgtgtatatatgtgtgtatatgtgtatatatatgtgtgtgtatatgtgtatatatgtgtatatgtgtatatatgtgtatatatgtgtatatgtg

SEQ ID NO: 2235 - DNA, 82 bp, Homo sapiens
tcagctttttcaggttgaagtgcccagtttttgtttttttttttttttttgagacagagactcccactgtcaccagggctgg

SEQ ID NO: 2236 - DNA, 76 bp, Homo sapiens
agctttctgaggatgggactctacttcttttttaattttttaaaaaaattttgagacagggtctcactctgttgct

SEQ ID NO: 2237 - DNA, 58 bp, Homo sapiens
tgagactgagtctcgctctgtcacccaggctggagtgcagtggcatgatcttggctca

SEQ ID NO: 2238 - DNA, 88 bp, Homo sapiens
tgcatgggctcagagctccaaccacaggcaggcaacagagggtcccaagcagcctctcccactctgtgagttgatatagccgatgaca

SEQ ID NO: 2239 - DNA, 81 bp, Homo sapiens
aaagcaccactttataccatcactttatttatcttttcaaaaggacattttaacagtgcaaaagtataaagtacgtgcttt

SEQ ID NO: 2240 - DNA, 106 bp, Homo sapiens
cacctccctgagcatggatccatggctgaaccctagagagttaggtgaaggtgagtgagcagacagaccactcttggggtgtccacagtcctccaggagacgtgac

SEQ ID NO: 2241 - DNA, 80 bp, Homo sapiens
tcaccttcatgagtcatattcttgttgatagttggagggtcttacctcgatgtggataagctgctgactgagcagggtgg

SEQ ID NO: 2242 - DNA, 86 bp, Homo sapiens
agactgtcgctctgtcgctcagtctggagtgcagtggtgcgatctcggctcactgctacctccacctcctgggttcaagtgattct

SEQ ID NO: 2243 - DNA, 78 bp, Homo sapiens
ttgcctcagtctctccctgtcttatgccccttggtctaattctttattctgaggaggcaagaattgaggctgctgcaa

SEQ ID NO: 2244 - DNA, 114 bp, Homo sapiens
cagtcatgcattgcttaacaccagggatattttctgagaaaggtattgttatatgattatatacaagattttttttaaaaagggtacacctatataaggcacttaccatgaatg

SEQ ID NO: 2245 - DNA, 56 bp, Homo sapiens
gagacagaatctcactctgtcacccaggctagggtgtagtggtgcaatcttgtctc

SEQ ID NO: 2246 - DNA, 103 bp, Homo sapiens
gacgaggcgttagcgctgaacctcactttctcactctgtaagatggccgtcataactgcatgcacttcttcagactggtgtgacgcttaaagactgccttttc

SEQ ID NO: 2247 - DNA, 69 bp, Homo sapiens
cctctgtgtctatgtctgtgtccatatttccctcttcttttaaggacaccagtcttgttggattagagg

SEQ ID NO: 2248 - DNA, 58 bp, Homo sapiens
tgagacagagtctcgctctgtcacccaggctggagtgcagtggtgtgatcttggctca

SEQ ID NO: 2249 - DNA, 98 bp, Homo sapiens
cctgggcaacaagagcaaaactccgtctcaaaaaaaagaaaaaaagaaccaaagatctttttttttttttgagacagagtctcgctctgtcacccagg

SEQ ID NO: 2250 - DNA, 95 bp, Homo sapiens
ataattcacttgcattttgtttattttttttccataggttattggggtacaggtggtgtttggttacatgagcaagttctttgctggtgatttgt

SEQ ID NO: 2251 - DNA, 100 bp, Homo sapiens
ccattttttaaggaacctgggggcagaggaagtatgcctacctggccggaagggctggggtttctcactcactctgtcagccacacggattgtctgatgg

SEQ ID NO: 2252 - DNA, 70 bp, Homo sapiens
ggttcagatgtgaaaagttgaaatggtgactaagcttgggggctatcttagctctgtctgtctgtctgcc

SEQ ID NO: 2253 - DNA, 103 bp, Homo sapiens
gcagtaagtggcagccactaaccttgagcttctaggatgtattcagtggacttcaagtgcctcttagaagcctgattccattaactcccccaaaacttaatgc

SEQ ID NO: 2254 - DNA, 109 bp, Homo sapiens
attagaaaaattgattctagcatgggcaacatggcaaggtcctgtctctacaatttttttttttttaatttgtagagcatggtggcatgtgcctgcagtatcagctagt

SEQ ID NO: 2255 - DNA, 76 bp, Homo sapiens
ggaggctgaggtaggaggatcacttgagcctgggaggtccaggctgcagtgagtcgtgattgtaccactgcactcc

SEQ ID NO: 2256 - DNA, 57 bp, Homo sapiens
ctgaggtcacagagggtggagtgaggtctgtcttggtgacagtctctgtgagtgagg

SEQ ID NO: 2257 - DNA, 58 bp, Homo sapiens
tgagacggagtctcgctctgtctcccaggctggagtgcagtggcgcgatctctgctca

SEQ ID NO: 2258 - DNA, 78 bp, Homo sapiens
gtggccataaaacactctgatcctagtaccttttgcgggtataaatgattactctgtcttactctctgttatggctac

SEQ ID NO: 2259 - DNA, 106 bp, Homo sapiens
ggaagatgagagaagagtcatacctcaaaagatgtagggatgacatttgataacattcaatattcattttttttttttttgagacggagtctcacccttgtcaccc

SEQ ID NO: 2260 - DNA, 86 bp, Homo sapiens; identical to SEQ ID NO: 2169

SEQ ID NO: 2261 - DNA, 66 bp, Homo sapiens; identical to SEQ ID NO: 474

SEQ ID NO: 2262 - DNA, 83 bp, Homo sapiens
atgtgtgcatgtgtgtggtgtgcatgcctatatgtgtgtgtttgcatgtgtgtgtgcatgtgcatcaggtggggtgtgcatgt

SEQ ID NO: 2263 - DNA, 58 bp, Homo sapiens
tgagacagagtctcactctgtcgcccaggctggagtgcagtggtgcgatcttggctca

SEQ ID NO: 2264 - DNA, 117 bp, Homo sapiens
gtgtttgcttttcttccctgaggctgcactttcggcatttctgtccgtggctccctgagtcagggctcacatggggccagaggtcagccaggcaagccccagaaaggagagggactc

SEQ ID NO: 2265 - DNA, 76 bp, Homo sapiens
gccccgcccgccccttccagctcgggaggccctgctcctcacgcacgcactctcagtcggcctcaaccggcgctgc

SEQ ID NO: 2266 - DNA, 94 bp, Homo sapiens
tctgttccattgatatgtgtgtctgtccctcagtggatgccacactgccctgtttctgtggccatgtacggtaggaagactcaccagcaggtac

SEQ ID NO: 2267 - DNA, 58 bp, Homo sapiens
gagacggagtctcactctgtcacccaggctggagtgcagtggtgcgatcttcgatctt

SEQ ID NO: 2268 - DNA, 99 bp, Homo sapiens
gccaactcctacccaaggctttggcactcggctcagaaacatggcccaatgagggaacacagtctgctcaggggataggctttggggttgagtgctggc

SEQ ID NO: 2269 - DNA, 62 bp, Homo sapiens
ctcctcagtgtgtctctgtgtcctaatatctgctttttataaggacaccagtcatattggag

SEQ ID NO: 2270 - DNA, 66 bp, Homo sapiens
gtggaggtgtctggctctctgtaactgaggaggagacagccttacttccaggcctgtgccctctac

SEQ ID NO: 2271 - DNA, 72 bp, Homo sapiens
ggtctatgagctggggctgagccactctccacaggctcactgtgggtggcctctgtgtctccctctgtgatc

SEQ ID NO: 2272 - DNA, 67 bp, Homo sapiens
ttccagggtggggagctctggtgtgggggtgcagcttggccttcctctcacaggctctctcagggaa

SEQ ID NO: 2273 - DNA, 72 bp, Homo sapiens
tatgtatatttatatgtgtacagtgtgtgcatatatgcacatgtgtagctgtgtataaagtgtgtgtgcata

SEQ ID NO: 2274 - DNA, 90 bp, Homo sapiens
ggattgggcaaatagggttggatctagtgagaacagactgagtggggacaccccgctaggcctgtctgtctggattcttcttggccttct

SEQ ID NO: 2275 - DNA, 85 bp, Homo sapiens
cacggttcctcatgctgtgcataccaggaagcagtgaaaatcctgtacacaagctcactgtactgtgtgtgcttggggtgccctg

SEQ ID NO: 2276 - DNA, 58 bp, Homo sapiens
tgagatggagtctcactctgtcacccaggctggagtgcagtggtgtgatctctgctca

SEQ ID NO: 2277 - DNA, 118 bp, Homo sapiens
ctggcactgtcactgggcctagggggcatcagcgtttggctccttctctttttttttttttttttgaggcagggtctcgctctgttgcccaggctggagtgcagtggcacagtctcag

SEQ ID NO: 2278 - DNA, 103 bp, Homo sapiens
ctctgtcatttcaggagctgaggacttgttcctagacttcagagccctattttgagagtagagattgtgctcagctggttataaagactgcattatgacagag

SEQ ID NO: 2279 - DNA, 95 bp, Homo sapiens; identical to SEQ ID NO: 68

SEQ ID NO: 2280 - DNA, 93 bp, Homo sapiens; identical to SEQ ID NO: 69

SEQ ID NO: 2281 - DNA, 82 bp, Homo sapiens
gacttatcttaccagcagcttatttttcatagtttttgaagatggttcttcttcaaaagttttgaagttggttctaaaagtc

SEQ ID NO: 2282 - DNA, 90 bp, Homo sapiens
tagatgaggaaggaccagactatggaagaccagtggtagaacaagaaggtagtttacatagaaaaaagaactgatctggtcttcagttta

SEQ ID NO: 2283 - DNA, 100 bp, Homo sapiens
gggtatgtgtgtacttatgtaaacatatgtgtaaacagaagtgtgtgtgctgtgtgatcttgtgtgtacatgtgtgtctgtatgcatgtattcagagtat

SEQ ID NO: 2284 - DNA, 81 bp, Homo sapiens
gttatctgtttagcacatactgtacatggctttgcagattctatctgtgtctgtctgtgtatgtgcaaatctcatattgac

SEQ ID NO: 2285 - DNA, 85 bp, Homo sapiens
ataaagccatgtgagtcacactctctgcttgcaaaagggttatctcctcaagcttgagtaggatggtccaagcctgtggttttat

SEQ ID NO: 2286 - DNA, 96 bp, Homo sapiens
ccaacatttagataaccatttttatagtttttgttgttgatttgtttataattaacctcccctacaagaatgaaagcttctaggttgtcttgttgg

SEQ ID NO: 2287 - DNA, 87 bp, Homo sapiens
gtttcactggaagaaatgtgaatttgttgaccaattattgtttactatggtaataggtacatattttctattatcttcacttgttgc

SEQ ID NO: 2288 - DNA, 69 bp, Homo sapiens
gtttaggaggctcagggcaatgggaaatggaggggactttgtgcctgtgtcccagtgtggctcaaggac

SEQ ID NO: 2289 - DNA, 87 bp, Homo sapiens
ggctgcatggatattcagaaggcttagaagagtgtgcaggcaataaacaccatctctgagtcacaaaacactgagtactagggaggc

SEQ ID NO: 2290 - DNA, 65 bp, Homo sapiens
tgggtgcaggaggatatgagctttggtctttttttttttgagacacagtctcgctctgtcaccca

SEQ ID NO: 2291 - DNA, 58 bp, Homo sapiens
tgagacagggtctcactctgtcacccaggctggagtgcagtggtgtgattttggctca

SEQ ID NO: 2292 - DNA, 58 bp, Homo sapiens; identical to SEQ ID NO: 1435

SEQ ID NO: 2293 - DNA, 59 bp, Homo sapiens
ggtgtgtgtctgtggtcccagctacttgggaggctgaggtaggaggatcacttgagccc

SEQ ID NO: 2294 - DNA, 89 bp, Homo sapiens
tgggattacagatgtgagccgctgcacctggcccttgagttttatttttatttatttatttttgagacagtgtctcactctgcctctca

SEQ ID NO: 2295 - DNA, 61 bp, Homo sapiens
agtgtgtttctgtctgtgtcagttctcacagaaggggagaaagacaggggcagaccccact

SEQ ID NO: 2296 - DNA, 82 bp, Homo sapiens
tgtgtgtgtgtatatataaaattgtgtgtatatatatatacacaatacacatatatatacattttatctatacacacacaca

SEQ ID NO: 2297 - DNA, 76 bp, Homo sapiens
gcttggttgtacagatctgatagtttttttttttttttttttaaagagacagggtctcactctctgtcgcccaggc

SEQ ID NO: 2298 - DNA, 76 bp, Homo sapiens
gggcacagtagtgagccaccacgccctgctattttttaaaaaatttttgtagagatagggtctcactatgttgccc

SEQ ID NO: 2299 - DNA, 95 bp, Homo sapiens
gctgtatttaaggatgcttctctgcatagctgacagtttttacttattcaatacaagtcacaagtcactgtgctgaaggccatgaataaaacagt

SEQ ID NO: 2300 - DNA, 77 bp, Homo sapiens
cagctccaggaggcatgcagagagtaccgtggaggggcccgaggccagcacaggctgcctcagtgcctcagcagctg

SEQ ID NO: 2301 - DNA, 99 bp, Homo sapiens
gacagagtgagactccatctcaaaaaaaaaaaaaaaagaaattaagtgatttgtactttttttaatttatttttttatgagacaggatctcactgtgtc

SEQ ID NO: 2302 - DNA, 103 bp, Homo sapiens
cactgcaacctccacctcctgggctcaatagaaacatttttttttaagtttctgctgtaaaaaaatatatttctgttgagcctaggaggtggaggttgcagtg

SEQ ID NO: 2303 - DNA, 95 bp, Homo sapiens
gccagggacaagagagtctggttacacagggaaagcagaagggaattctttttttttttttttttgaggcagagctttgctcttgttgcccaggc

SEQ ID NO: 2304 - DNA, 84 bp, Homo sapiens
agttttagggtacatgtgcacaatgtgcaggtttgttacatatatatatatatgtgccatgttggtgtgctgcacccattaact

SEQ ID NO: 2305 - DNA, 85 bp, Homo sapiens
gcagagcagagtggaaagatgactggatgggaaggggcctcagaggtctgggctgctccatccttcacattcaagtctgtcctgt

SEQ ID NO: 2306 - DNA, 84 bp, Homo sapiens
gtataaattcattatatatgaatatatgtctatattcattgttgtttgaatatatgtctatattcatatataatgtgtatgtat

SEQ ID NO: 2307 - DNA, 85 bp, Homo sapiens
atgtaggtaaatacacatgtgtgtttgtacatgtatgcaaacacacttgtgttgtactgcatatgttccatgcacacatgtgtat

SEQ ID NO: 2308 - DNA, 128 bp, Homo sapiens
tctgactttgagagcaggtgttcctgtctctgaaacactggcatcacctgttgttggactcagaaggaactgtggacatcatctctccaggtgtgaaaatctttccattacagtccctaatgtccagc

SEQ ID NO: 2309 - DNA, 105 bp, Homo sapiens
ctcatgttaaactttaattgccattataacagtattaagaggtgaggcttttttttttttttttgagacagagtctcgctctgttgcccaggttggagtgcagag

SEQ ID NO: 2310 - DNA, 81 bp, Homo sapiens
tttatagatgtatatgtggcatgtatatatatgtatacatatgtggtgtgtatatatatgtggcgtttatatatgtataaa

SEQ ID NO: 2311 - DNA, 120 bp, Homo sapiens
ggtgtttatataaatgtagcatgtatctatatgtatatatatggtgtgtttatatgtatatatatgtggcgtttatatatgtatatctatgtggcatgtatatatatgtatgtatctgtg

SEQ ID NO: 2312 - DNA, 214 bp, Homo sapiens
atatatacgtatatatatgtggcatgtatatatacgtatatatatgtggcatgtatatatgtatgtatctgtggtgtctatgtatatatgtggtgtttatatatgtatatatctgtggcatttatatatgtatatctatgtggcatgtatatacatgtatatatgtggcatgtatatttgtatatatatgtggcatgtatatatatgtatatat

SEQ ID NO: 2313 - DNA, 133 bp, Homo sapiens
atgtatatatatgtggtgtgtatatatatgtatatatctgtggtgtctatatatgtatatatgtgtttatatatgtatatatatgtggcatgtatatatacgtatatatatgtggcatgtatatacgtatata

SEQ ID NO: 2314 - DNA, 60 bp, Homo sapiens
ttgagatagagtctcgctctgtcacccaggctggagtgcaatggtgcgatctctgctcaa

SEQ ID NO: 2315 - DNA, 71 bp, Homo sapiens
tatattatagatgtatgcatatatgtatatatgtatacatatatgtatatgtgcatacatatagaggtata

SEQ ID NO: 2316 - DNA, 82 bp, Homo sapiens
gtatacatgtgtatatatatacatatatggatacatacatatttatgtgtacacatatatgtatatgtgtatatgtgtacac

SEQ ID NO: 2317 - DNA, 81 bp, Homo sapiens
cttacatgttgatgtatacatttatatgatatatatatttaaacatatacatttatgtgtgtgtgtacatctctagttaag

SEQ ID NO: 2318 - DNA, 72 bp, Homo sapiens
gtatgtatgtatgtatgtgtgtgtatgtatgtgtatatatgcatgtgtatatatatgtatgtatatgcatgc

SEQ ID NO: 2319 - DNA, 84 bp, Homo sapiens
attcttgaagcctagatgacggagcaccctttttaaattttattattttttaagagacagggtctctgtcacccaggctggagt

SEQ ID NO: 2320 - DNA, 64 bp, Homo sapiens
gccatggcctctctgtgtctctgaatagctggaaagtattgcatagagcagagcccagccaggt

SEQ ID NO: 2321 - DNA, 90 bp, Homo sapiens
tggactgtccctgggcctgtctgtctgcctgtgatgctgtcggtctacctgtgggtcatcaggcttcttgtgggtcaggctggctgtcca

SEQ ID NO: 2322 - DNA, 114 bp, Homo sapiens
gacgcgggcgaggcaggtaggagttggcccagtgagagttgagagagaggccacccgcggcgtcttgacttggcttagttttctccttaatctgagaaactttccctgtccgcg

SEQ ID NO: 2323 - DNA, 72 bp, Homo sapiens
actgtgtgtgtatctctgtgtgtgtgtgtatatatacatacataaacacacacacgcatatatacaatatgt

SEQ ID NO: 2324 - DNA, 100 bp, Homo sapiens
gatagatagatagatagatagatagatataatacataagaaatatatctattttttcttgttttgtattataatctcctattatttttatctgacccatc

SEQ ID NO: 2325 - DNA, 123 bp, Homo sapiens
atatatatatatctatagatatctagatatctatatctatatatatatctagatatctatatctatatatatatctagatatctatatctatatatatatctagatatctatatctatatatg

SEQ ID NO: 2326 - DNA, 73 bp, Homo sapiens
agatcatttgttgcggagatggaggcagcatgtgttcaaattcagtgtgtgtctctctttggctgtgtgatct

SEQ ID NO: 2327 - DNA, 98 bp, Homo sapiens
catggtagatgctttgtaactatttatttaatgaatgacttaatttttgttattttaacaatgagtttttataatgttccttgataatatctgccttg

SEQ ID NO: 2328 - DNA, 85 bp, Homo sapiens
cttaagaccatatgtgtgtgtgtgtatatatatatacgtatatacatgtatatatatacacatatatatataaaatgatcttaag

SEQ ID NO: 2329 - DNA, 77 bp, Homo sapiens
tgtgtgagcctgtgtctgtgcctgacctgggttccaagtgtgcacagggtgggaggcatggatgtaagggacacaga

SEQ ID NO: 2330 - DNA, 59 bp, Homo sapiens
tctatttggcttgcatttactatgtttaaaaaaaaacatagtaagcatagcttattgga

SEQ ID NO: 2331 - DNA, 73 bp, Homo sapiens
gtttcttttcagcagaagggggaagaggtgtccgctgtgtgggctgctgactcctctgtgtgtgaggcccttc

SEQ ID NO: 2332 - DNA, 75 bp, Homo sapiens
ggccctgcctctctctgagcctcagtctcccatctgtaaaacgaaggaggcagtgtcaggcaggggctctgggtc

SEQ ID NO: 2333 - DNA, 65 bp, Homo sapiens
tgaaagctcacagcagacagaccagcagacaactactatgcagtgtgttaagagtgagctgatca

SEQ ID NO: 2334 - DNA, 116 bp, Homo sapiens
ttgggggcaaagtaaggtgcaggagcactgctcccagagtcactgactcactgtgtgacctcagataagtgactccagtctctgggactgggtttcctcatctgtaaaatccctgg

SEQ ID NO: 2335 - DNA, 81 bp, Homo sapiens
cccagtgtgcctgactccctttctctcactctagaactggaccaccccagaggaacagagatggcctgggagggccctggg

SEQ ID NO: 2336 - DNA, 79 bp, Homo sapiens
ggaggtggaaggcagggatatttatgatcctgaccctgtataggcccaggctagtgtgtgtgttcttgtcttagtttct

SEQ ID NO: 2337 - DNA, 70 bp, Homo sapiens
gcacacatgtatgagtgtatgtgtgtgtgtgcaaacgtgtgtgtgcacgtgtgtgtgtgtgtgtgtgtgt

SEQ ID NO: 2338 - DNA, 58 bp, Homo sapiens
gcactggaccccgggctggtcctctgtgctcacaactgactcagtctcagggtcctgc

SEQ ID NO: 2339 - DNA, 108 bp, Homo sapiens
atcagtggaggtgtgcagccctggaaccaaggagttatctttatttttctttttaaaaaaatatttcagcattctcactccctgtgtctgtccccaaaccctgctggt

SEQ ID NO: 2340 - DNA, 72 bp, Homo sapiens
gcctcagatatagttgaattgagggacaccaaagaggtcatcagggctctgtgtttctctccgtgtcttggc

SEQ ID NO: 2341 - DNA, 65 bp, Homo sapiens
tgagactgagtctctctctgtcacccaggacccaggctggagggcagtgacatgatttcggctca

SEQ ID NO: 2342 - DNA, 87 bp, Homo sapiens
caagtgatccacctgccttggccttccaaagtacatttatatttttgaaagtctgagaagactataggtttctggtgtgattatctg

SEQ ID NO: 2343 - DNA, 104 bp, Homo sapiens
tgtcaactgtggagtgccgtatccaggtaaaaggttgttatgttgttacggttgtatactgagactgatatgggatactttgatctttgcgccccacaggagca

SEQ ID NO: 2344 - DNA, 110 bp, Homo sapiens
ggttaagtttaagatacagttgtatcccagcatgcttgtttttgagttgatagaaaacaacctactgtcaaacaaattaagatatgatattaaattgtgtttaaagtacc

SEQ ID NO: 2345 - DNA, 112 bp, Homo sapiens
ctgataggtgaaccaacccagtcaacaccccatctgacactgtctctgaatggtaccaattttttttttttttgagacagggtctggctctgttgctcaggttcgagtgcag

SEQ ID NO: 2346 - DNA, 79 bp, Homo sapiens
tgtgcaactcccatttggacagacagaacagtgtgtggagactcacattgtgaacttttgctccaagaaccattgcagg

SEQ ID NO: 2347 - DNA, 68 bp, Homo sapiens
tggaatagggagagacagggcaaactggaaaccaccagcacctttgcatctgtctctgactgtctcca

SEQ ID NO: 2348 - DNA, 109 bp, Homo sapiens
ggagcagcctaaggtatcttgtacagtggataagagtgtgggctctgagggacctgggttcaaatcctggcttacacctacacgctctgtgactttcgataggctcttt

SEQ ID NO: 2349 - DNA, 118 bp, Homo sapiens
gggaaggaggaaaatgggacatacatggaatactaaagacaagactgaagaaagagaggttgaaagctctctctcttctgattatgtttctgtgggtctctactgttttgtggccttc

SEQ ID NO: 2350 - DNA, 58 bp, Homo sapiens; identical to SEQ ID NO: 1215

SEQ ID NO: 2351 - DNA, 74 bp, Homo sapiens
tagcttacacatagtgagcatggtctgatttttttttgctggggggaaagggtctcactatgtcactcaggctg

SEQ ID NO: 2352 - DNA, 60 bp, Homo sapiens
tatgtatctccctcatatatatgtgtgtgtgtatatatatatatatgagagagataaata

SEQ ID NO: 2353 - DNA, 97 bp, Homo sapiens
gtcgctttgagttgggaacagttctttagtcattcctttattattttttaaattaagacaggatctggctctgttgctcaggctggaatgcagtgac

SEQ ID NO: 2354 - DNA, 96 bp, Homo sapiens
tttaaagtacaaatgggagcaaaagttacaaattgcacacagagagacactcagtgtgtgaaattgtggacatggttcagaatatgtttatttgga

SEQ ID NO: 2355 - DNA, 84 bp, Homo sapiens
ctgtgaagtaaatccctctgacagatgagagtgggaagataaatatccctaacatcctcgccccttagagggaaaaattctcag

SEQ ID NO: 2356 - DNA, 66 bp, Homo sapiens
agaaggtgggttttttgggggtaaaagtttaaaagtgattctcactttctctctggctcactttct

SEQ ID NO: 2357 - DNA, 71 bp, Homo sapiens
gcaagctctcagtcccactgacactggcccaagagggctgagtgtactgggcactcacgcagggagattgt

SEQ ID NO: 2358 - DNA, 101 bp, Homo sapiens
atggaaaaatacgatagaagaggtgtgccaggctctatctctgactcagcacctatggccagaaggatcagatgtctggcatgtgctctgcgttacttcat

SEQ ID NO: 2359 - DNA, 105 bp, Homo sapiens
tccatgcatgctcctttattcttcactacaaggcaggtactcactttgctctcatttctcagtgattatctctaggtggtgagaaattgttacttcgtccaaaga

SEQ ID NO: 2360 - DNA, 77 bp, Homo sapiens
aacctgggttaatacacagagaagtatgtgtggtcaagaacgtgtgcacacacacctttctctttatgctttgggtt

SEQ ID NO: 2361 - DNA, 108 bp, Homo sapiens
tgatttccccatcactctccagggacagtgacgacatgtcaagatctgtcaggctgagtctgtcccggggtggtcaggaccccagatctggccagagatagggcagcc

SEQ ID NO: 2362 - DNA, 58 bp, Homo sapiens; identical to SEQ ID NO: 2263

SEQ ID NO: 2363 - DNA, 133 bp, Homo sapiens
gggtgcaacagcaggaatagcaggaacagggtgcacgtcatcagaacaatgggtcctgagtcactctgtgcctgcccagccctgcatggccctgggtgagtcatgtcacttctctgagctgtgggttcttcct

SEQ ID NO: 2364 - DNA, 115 bp, Homo sapiens
atcccaaattaccttttagagagacaaaattaaattgtggaaaacaaactattagaaaagaggttactttttttttttcttttttcacagctaattcttttctaaaggaggggat

SEQ ID NO: 2365 - DNA, 82 bp, Homo sapiens
gtatgtgtgtgtatatatatgtatgtatatacaaaattagttgtatatatgtgtgtatatatatgtgtatatatgtatgtat

SEQ ID NO: 2366 - DNA, 80 bp, Homo sapiens
ccatggacagacactctcactcactctcgctgaggggcctgcccaggcgaaggagcttagccaatgctctgcctccgtgg

SEQ ID NO: 2367 - DNA, 59 bp, Homo sapiens
ggctcctacagtggagagtgtctcccaaagagagagactcagtctttctgtgtctggcc

SEQ ID NO: 2368 - DNA, 58 bp, Homo sapiens; identical to SEQ ID NO: 1763

SEQ ID NO: 2369 - DNA, 107 bp, Homo sapiens
acctgccctggggtgtgtcgggtccacactgtctcactgggtgactcttgtatggactccccatacaaggtatagggtagagaggtggggtcatccagaggtggagt

SEQ ID NO: 2370 - DNA, 104 bp, Homo sapiens
atctattatgcctcaataaatctggaaacttaattaattagctaattaattgattttaaaattagttggaagaattttgaagccagagagatctgggttctgat

SEQ ID NO: 2371 - DNA, 82 bp, Homo sapiens
tctatgcctgagtaagtaaagactatgacagccatgagaagctatgctttctgttcaaatcagagcttgctttgaacataga

SEQ ID NO: 2372 - DNA, 120 bp, Homo sapiens
atatatatgtataggtatttatgtatatatacacataatatatgtatgtatttatgtatatatatacataatatatgtatatgtatcatgtatatatacacataatatatgtatatgtat

SEQ ID NO: 2373 - DNA, 113 bp, Homo sapiens
attgtatggatccacttggctaggccacagtatcttacccagatatttggtcaaacactagtctagatgttgttgtgaaggtattttgagatgaggttaagatttaaagcagt

SEQ ID NO: 2374 - DNA, 80 bp, Homo sapiens
ttcactgaagcctcttggggcttatttagacaatggtttcatcatttcgtctgaatagagtctgaagagtctttggtgga

SEQ ID NO: 2375 - DNA, 67 bp, Homo sapiens
cccttgagacagagtctcactctgtcacccaggctggagtgcagtggtgtgatcttggttcactggg

SEQ ID NO: 2376 - DNA, 58 bp, Homo sapiens
tgaggcagagtctcacactgtcacccaggctggagtgcagtggcaagatctcggctca

SEQ ID NO: 2377 - DNA, 84 bp, Homo sapiens
tctggctctcggcttgactattgttggtgtatgggaatgttagtgatttctgcacattggtttagtatcctgagactttgctga

SEQ ID NO: 2378 - DNA, 73 bp, Homo sapiens
gagatgagagatggagagaatgggacagctctcgagtccctcgacccctagactcagtctctctctctctctc

SEQ ID NO: 2379 - DNA, 76 bp, Homo sapiens
tgtgtgtgcatatatatatgtatgtatgtatatgcatgtgtgtgtatatatatatagacatatatacacatacaca

SEQ ID NO: 2380 - DNA, 80 bp, Homo sapiens
gtgtgtgtgcatgcacgcatgtttgtgtatgtgtatatatgtctatatatatatacacacacatgcatatacatacatac

SEQ ID NO: 2381 - DNA, 58 bp, Homo sapiens
tgagatggagtctcactctgtctcccaggctggagtgcagtggtgcgatcttggctca

SEQ ID NO: 2382 - DNA, 72 bp, Homo sapiens
gctttataatgacagagaatttctatgaaaacttttttgtttcataatgaaattttctgtttgtattatagc

SEQ ID NO: 2383 - DNA, 104 bp, Homo sapiens
ccgctgcactccagcctaggtgacagagcacaactttgtcttttttttttttttttttttttagacagagtctcactctgtcatccaggatggagcacactggc

SEQ ID NO: 2384 - DNA, 103 bp, Homo sapiens
gccatgtgtgtctttgctgtttgtttttaggtgagtatttatggtctatgggttgttcagacatatatttttatttagaagcgaaattagcacctgctaggca

SEQ ID NO: 2385 - DNA, 83 bp, Homo sapiens
ttggccaatgatctgagacagcttatattcttttgaaaatatcaaacatgaaacatagctctcagggcgttttttaagggcag

SEQ ID NO: 2386 - DNA, 71 bp, Homo sapiens
ttgtttttgagttggagtctcactctgtctcccaggctggagtgcagtagtgcgatctcagctcactgcaa

SEQ ID NO: 2387 - DNA, 82 bp, Homo sapiens
gggacagattcatgggagtgagggtaagttccttattatctgtcttcctccctcactcagtcatgtcaaccaaaacctgccc

SEQ ID NO: 2388 - DNA, 58 bp, Homo sapiens; identical to SEQ ID NO: 605

SEQ ID NO: 2389 - DNA, 58 bp, Homo sapiens
tgagacagggtctcactctgtcactcaggctggagtgcaatggtgcgatcttggctca

SEQ ID NO: 2390 - DNA, 61 bp, Homo sapiens
tcgggccgccgggccgccgacggccgtaggggccgctcgctctgtcgctccgtgggtccga

SEQ ID NO: 2391 - DNA, 91 bp, Homo sapiens
gtatcttgtgctgacgtcctgtctcaccctgtgacttagaatgccttaaccatctgggaacgcagcccagtaggtctcagcctcattttac

SEQ ID NO: 2392 - DNA, 95 bp, Homo sapiens
ccaccctaacagctcctgccactgtcccactctccctctggctcctgacccaccccgagggtggccctgtggtcctgcacgctgtgccactgtgg

SEQ ID NO: 2393 - DNA, 151 bp, Homo sapiens
tatacacacatatacatatatgtatatgtatatatagatatatatacaggtatatatacgtgtgtgtatatatatatctatgtatatatatgtgtgtgtgtgtatatatctctatatatatacaccagtatgtgtatatatctatatatct

SEQ ID NO: 2394 - DNA, 78 bp, Homo sapiens
tatatatacacacacgtatatatacctgtatatatatctatatatacatatacatatatgtatatgtgtgtatatata

SEQ ID NO: 2395 - DNA, 109 bp, Homo sapiens
ttggtgctcaggatgtgtgtgtagagaagtcttttggttatgtagtctgtagatccgtttttgtatttgtgctgtccaagcagtgcttttccattcattcccccactga

SEQ ID NO: 2396 - DNA, 114 bp, Homo sapiens
tatatatatatccaagacaagggaaatgtagacttcataaacatggctgtataattttgattttttttgaatacattgtgtttctatattttttttgacgacaaaaggtatgta

SEQ ID NO: 2397 - DNA, 67 bp, Homo sapiens
tccttgagctcagtctgtcactgtgtagctcaagaattctctgagttaatgtgtggttgagaatgga

SEQ ID NO: 2398 - DNA, 85 bp, Homo sapiens
acacactccgtactgataaagtaatgtcattaacttttgattttttaaaaaaagcaaatgacagtcctctattcctggattgtgt

SEQ ID NO: 2399 - DNA, 108 bp, Homo sapiens
ctccccctgtccgaccctagaacacagattcagcagggcatcatggcttgtgctacccaggctggctggctgaatccctctgccaccgtacttcaggaagaaagggag

SEQ ID NO: 2400 - DNA, 104 bp, Homo sapiens
ggtactgtaagggcaggagtgctaggtagctgaagagctggaaactgaattaggagactgccagtgatgagagttgctgttctagtctagataggatcatccgg

SEQ ID NO: 2401 - DNA, 94 bp, Homo sapiens
tacattatggtgagttgtgtaactatttcattatgtattataatgtaatcataatagaaataaagtgcacaataaatataataaatataatgtg

SEQ ID NO: 2402 - DNA, 87 bp, Homo sapiens
attgacctctttctgtctgtctgtctgtctgtctgtctgtctttcttgagacggagtctcgctctgtcacccaggctggagtgcagt

SEQ ID NO: 2403 - DNA, 58 bp, Homo sapiens
gtgcaacagtgattctagttaagtgcttgctcacaggcactcactgtgtgtcttgcac

SEQ ID NO: 2404 - DNA, 60 bp, Homo sapiens
agaatcatggtggccagagcagaaaatgtgtgctcacatttctctctctgcagtgtttct

SEQ ID NO: 2405 - DNA, 105 bp, Homo sapiens
gagtgagcgtacttgtgactcaaccactcactccctgtgaccgtcagtggatttgaccatatacagtctttcattaagttagtctttgtcatatattgcttattt

SEQ ID NO: 2406 - DNA, 73 bp, Homo sapiens
tttcttgagaccaagtctcactctgtcacccaggctggagtgcagtggtgcgagcttggctcactgtaagaaa

SEQ ID NO: 2407 - DNA, 77 bp, Homo sapiens
tgctagccacatacactctcagtgtacacacatggtgctcatgcacacatggtagtgcatggtgaatccacatagca

SEQ ID NO: 2408 - DNA, 77 bp, Homo sapiens
ctttagcgtgggtgactccagtttgatttttttttttttttttgagacggagtctcgctctgtcacccaggctgttg

SEQ ID NO: 2409 - DNA, 89 bp, Homo sapiens
atgaacactggttcccatgctgagtgaaggcagagaagacaaattcctctggaggaagtcttgagtcttcctcttgccaggaaattcat

SEQ ID NO: 2410 - DNA, 75 bp, Homo sapiens
atgcatatgtgtgtgtatgtatgtatgtatgtatgtgagtgtatgtatgtatatgagtgcatgtatgtagtgtat

SEQ ID NO: 2411 - DNA, 112 bp, Homo sapiens
gcagctagcaaggacagtcagagtgaatctaggtccaattccaaagtttatattcttttaagaataccatactgtttggccaagtcactgattttctctatgctttagttcc

SEQ ID NO: 2412 - DNA, 96 bp, Homo sapiens
tactcgtggtggaggctgaggtagaaggatcatttgagcccaggagatcaagcctgcagtgagttgttatcatgcctctgcactccagcctgagtg

SEQ ID NO: 2413 - DNA, 104 bp, Homo sapiens
gcacctaatttttggaagtcagattcatatagctttggttaatctttgttctttttacattttattgtattttagacagggtctcgctgtgttctgcaggctgc

SEQ ID NO: 2414 - DNA, 108 bp, Homo sapiens
gcccattgtactacctggtgtgtgaatgtgagtgagttttaattttaattttaatttttttttgagatggagtcttgctctcttgcccaggctgaagtgcagtggtgt

SEQ ID NO: 2415 - DNA, 72 bp, Homo sapiens
cggggtgtggtggttcgtgcctatagtcccagctactcaggaggctgaggtaggaggatcacttgagcccgg

SEQ ID NO: 2416 - DNA, 119 bp, Homo sapiens
caggcctcccattgattctgcattatggtgaattgtatataattatttcattatgtattacaatgtaataataacagaaataaagtgtacgataaatctaatgcacttgaatcctcctg

SEQ ID NO: 2417 - DNA, 79 bp, Homo sapiens
gtggccatctctccgtgtgtgtgtgtgtgctgatgtgtgtctgcgttgctgtgtgtctacacaaaatgagggaggagac

SEQ ID NO: 2418 - DNA, 80 bp, Homo sapiens
ctgggtggatacacctagacctgtggcccatctgctttccctttttttattttgagacagtgtcccactctgtcacccag

SEQ ID NO: 2419 - DNA, 89 bp, Homo sapiens
tgagtacctgggactacaggcacactaccatgcctggctaatttttaaatttttgtacagatggggttttgccatgttacccatgctta

SEQ ID NO: 2420 - DNA, 114 bp, Homo sapiens
gatgcaacgtgtgtgcagaatgactctgttggatatgtcctggctgatcagagaacctgttgagccgtttgggcgtatggaacccaacgaaaagtcatcagaacgcagctgatc

SEQ ID NO: 2421 - DNA, 76 bp, Homo sapiens
tccagataaaaatttatgtatatatatatgtatcgatgtgtctgtgtgtgtgtgcatgcatgtgtgagtgtgtgga

SEQ ID NO: 2422 - DNA, 116 bp, Homo sapiens
ggggtagcagaggtacatcttgacttaccacagtttctttctttcttttttattttattctttactcctggcaagctgtgacacagttattttcaagagatgtaatatactacttc

SEQ ID NO: 2423 - DNA, 76 bp, Homo sapiens
gctcccacttggacagacagaacagtgtgtggagagtcacaccatggacttttgctccaggaaccaccacaggagc

SEQ ID NO: 2424 - DNA, 84 bp, Homo sapiens
gcaaacgtgtgtgtgtatgtgtgtgtgtgtatatatatgtacgtatgtatatatatatgtgtgtgtatatataacttttatata

SEQ ID NO: 2425 - DNA, 93 bp, Homo sapiens
ctccagcctgggctacagagcaaaccctatttcttttttctttctttctttctttttttgagatggagtctcactctgtctcccaggctggag

SEQ ID NO: 2426 - DNA, 93 bp, Homo sapiens
gcactccagcctggagaacaagagcaaaactccgtctcaaaaaaataaaaataagagacagagggtctcactctgtcatccaggctggagtgc

SEQ ID NO: 2427 - DNA, 67 bp, Homo sapiens
gacagagtctcgctcactcagtgctcaatgttgcccaggctggagtgcagtggcgtgatctccgctc

SEQ ID NO: 2428 - DNA, 108 bp, Homo sapiens
tggctgaggaggcctcaagaaacttacagtcatggtagaaggtgaaggagaagcagggcacgtcttacatggcagtaagaaagagagagagagaggggggatcggcca

SEQ ID NO: 2429 - DNA, 119 bp, Homo sapiens
agacagcgcaagatctcaaagaaaaaaaaaaaagggtatcaatgcatgcaacaatgtgctatttttattttacattatgggttatcttccttattttatttcttatctgctttttgtct

SEQ ID NO: 2430 - DNA, 100 bp, Homo sapiens
ggatgccgggtgtttggccagcctcaatcaccagctcaggtgccactgcctcacacagtcacttagggtcattggtttaggttatcattctacagcattt

SEQ ID NO: 2431 - DNA, 96 bp, Homo sapiens
ggatggctggctgaaggaatgaatagatgaatgttatatgcttttgaacaatcgtcttttccatttaattttctaattcaggagcagtaattatcc

SEQ ID NO: 2432 - DNA, 113 bp, Homo sapiens
ttgtacactagtgagaagaggatttggaaccagcttatttgagtaagaattaaaagtttgcttttttttttttttaattaggtgcatctagaagatgtttttcagttattcaa

SEQ ID NO: 2433 - DNA, 116 bp, Homo sapiens
aggcctgaagaggaacctgtggaaatggaattgtgacctctaactgtggctctgtcactaactagtagatctcaactaagtcccataatcccttagcagtggttagcaacagtcct

SEQ ID NO: 2434 - DNA, 79 bp, Homo sapiens
tgaggcacagtctcactctgtcacccaggctggagtgcagtggtgggatcttggctcactgcaacctctgcctcccggg

SEQ ID NO: 2435 - DNA, 93 bp, Homo sapiens
ggatgttttgtcagatctcaatataagtatgtttatatatggtagtttataacatgtataatgctaacatgttgatatggtttggctgtgtcc

SEQ ID NO: 2436 - DNA, 111 bp, Homo sapiens
ggcaaagtccacacaactggcaaatctggtatgactctctttctgtcacagcagtttgctggcaacagacctacagccagatgctcaggtgagttagttccagtggctgct

SEQ ID NO: 2437 - DNA, 95 bp, Homo sapiens; identical to SEQ ID NO: 68

SEQ ID NO: 2438 - DNA, 93 bp, Homo sapiens; identical to SEQ ID NO: 69

SEQ ID NO: 2439 - DNA, 95 bp, Homo sapiens; identical to SEQ ID NO: 68

SEQ ID NO: 2440 - DNA, 93 bp, Homo sapiens; identical to SEQ ID NO: 69

SEQ ID NO: 2441 - DNA, 58 bp, Homo sapiens
tgagatggagtctcactctgtctcccaggctggagtgcagtggtgcgatctcggctca

SEQ ID NO: 2442 - DNA, 58 bp, Homo sapiens
tgagatggagtctcactctgtcacccaggctggagtgcagtggtgtgatcttggctca

SEQ ID NO: 2443 - DNA, 93 bp, Homo sapiens
agaaagttaatccaaagattctgctgttgataacagtctgtgtctgtcaagtattaattgttagagacttcaggaatcacataggattattct

SEQ ID NO: 2444 - DNA, 119 bp, Homo sapiens
gtatatatgtatatgtgtatatatgtatatgtatatgtgtatatatgtatacatgtgtatatatgtgtatatatgtatatataagtatatatacacatatatacatatacatagatata

SEQ ID NO: 2445 - DNA, 88 bp, Homo sapiens
tatatctatgtatatgtatatatgtgtatatatacttatatatacatatatacacatatatacacatgtatacatatatacacatata

SEQ ID NO: 2446 - DNA, 58 bp, Homo sapiens
tgaggtggggtctcactctgtcgctcaggctggagtgcagtggcgtgatctcagctca

SEQ ID NO: 2447 - DNA, 96 bp, Homo sapiens
cctcactatgacttatgaaactggttaatctagtgtctgatatacattttttatattatagaacattagtacatttgacagaagtgactgctgagg

SEQ ID NO: 2448 - DNA, 80 bp, Homo sapiens
actagctgggcatggtgacacacctctgtagacccagacctgggaggctgaggtaggaggatcacttgaggccgggaagt

SEQ ID NO: 2449 - DNA, 105 bp, Homo sapiens
tattgaagcccttgaattcaactttggagaaaggcacacaccacagactgtttctgtgattctgtgtcattttcttctgggtgtgtctttaaccttggcaaaata

SEQ ID NO: 2450 - DNA, 71 bp, Homo sapiens
agggctttgggcaccaatctctgggcacccgggtctcactttgatcccaggactagtgattttcaagctct

SEQ ID NO: 2451 - DNA, 114 bp, Homo sapiens
acacatccatccagctccttcctgttttcttaagcattgacagtatacagtgaccacagatattgggatgtttttgggttacagtgtgaggataaagcacactggaatctgtgt

SEQ ID NO: 2452 - DNA, 68 bp, Homo sapiens
tccgtctctggattagaagatttaattgtgaaatatcgtgatgatgatttttttttttttgagatgga

SEQ ID NO: 2453 - DNA, 62 bp, Homo sapiens
tgtgtgtaggtatctatacatatgtatatatctatacatatatatgtatagatctacacaca

SEQ ID NO: 2454 - DNA, 93 bp, Homo sapiens
gttgatggttatatgtatatacatatacgtacattatatatatgtatttccatatagacaagtatctatatgtataagcttaaccatttagac

SEQ ID NO: 2455 - DNA, 111 bp, Homo sapiens
gtctctcacccattctgcagttttgataaggtggtgggagtgggggcatgtacgctccctcagtgtctctcgcccattctgcagttttgataaggtggtgggagtgggggc

SEQ ID NO: 2456 - DNA, 58 bp, Homo sapiens
tgagatagactctcactctgtcacccaggctggggtgtagtggtgtgatctcagctca

SEQ ID NO: 2457 - DNA, 87 bp, Homo sapiens
tataggcaggttccctttgttctgttgtaccctcaggagacctgactttgggggtaagcaatgaaaggaagaaaccacaagcaggta

SEQ ID NO: 2458 - DNA, 124 bp, Homo sapiens
ttgcaaaaattagccggctgtggtggcacatgcctgtagtaccagctacccaggaggctgaggtaggaggatcacttgagactgggaggtggaggttgcagtgagcaagtgaatgcaccactgc

SEQ ID NO: 2459 - DNA, 116 bp, Homo sapiens
gtcctcatccttccttaaggtcacaggatcccaacgcagcaaggtaaaactatatatatgtgtgtatttgtctgggtctgagtttcggtttcttgtgacatttacctttgttagac

SEQ ID NO: 2460 - DNA, 72 bp, Homo sapiens
ttgatatttataatgaactttatgaaatttatgaatattatataaattatataaagttcattatattattaa

SEQ ID NO: 2461 - DNA, 88 bp, Homo sapiens
gtacatatgtatgtatatgtatatatgtatatacatatataaatgtgtacatgtacatatatgtatatttgtaaatgtacatatatat

SEQ ID NO: 2462 - DNA, 70 bp, Homo sapiens
gagtggtgagagagggcattcttgtcttgtgccagttttcaaagggaatgcttccagtttttggccattc

SEQ ID NO: 2463 - DNA, 106 bp, Homo sapiens
tccgatttgcaggaaaggagccaggcttccaggtagtctgtgactctaactgagtccgattaggagaaataggattgagggcctcattacctggccgagaattgga

SEQ ID NO: 2464 - DNA, 69 bp, Homo sapiens
cagactacctggaagcctggctcctttcctgcaaatcggactcagagtcacaggctccctggaagcctg

SEQ ID NO: 2465 - DNA, 74 bp, Homo sapiens
gtctgtgctggcagctgattagatggtgcccacccccagtttgagggtgggtctgtctctccctgtccactgac

SEQ ID NO: 2466 - DNA, 81 bp, Homo sapiens
ggggtggagcagcagggggaggaagcagagcacggagagtctcctatgtccccttgcctgtctccctgtttgtctctgcct

SEQ ID NO: 2467 - DNA, 107 bp, Homo sapiens
agagagagagaaagagagagacagagagaaagtgtgtgtgtgtgtattttagagcagcatatttttcttttttttttttttttttttgagacgaaatctctctgtct

SEQ ID NO: 2468 - DNA, 108 bp, Homo sapiens
tatatatatatatgtatatacatatacatatgtatatatatgtgtatatatatgtgtgtatatatatacacatatatatacatatgtgtgtatacatatatgtgtgtg

SEQ ID NO: 2469 - DNA, 94 bp, Homo sapiens
atatatgtatacacacatatgtatatatatgtgtatatatatacacacatatatatacacatatatatacatatgtatatgtatatacatatat

SEQ ID NO: 2470 - DNA, 86 bp, Homo sapiens
accatgcccagctctatattttaaatttttctaaataagccaaaatctgttttttcagttgtttgaattctgagctgtccataggt

SEQ ID NO: 2471 - DNA, 73 bp, Homo sapiens
atgtgtgtgtgtgtgtgtctgtgtatgtgtgtgagaaaatgtgtatgtactgtatatgtatatatacacacat

SEQ ID NO: 2472 - DNA, 109 bp, Homo sapiens
gatttagttctgttgttgctggaaaatatactgggtatgatttcaattattttaaatttattgaaacttgccttatggcctagcatatggtctagtctggagaatgttc

SEQ ID NO: 2473 - DNA, 191 bp, Homo sapiens
tatatgcacacacatatatatacatatatacacacaaatatatatgtgtgtgtatatatatctgtactatatacacacatttatatattatatgtatatgtattatatatgtataatatgtatgtatatattatatatatgtcttatatatgtataattgtgtatatatacatatatatgcataattgtgt

SEQ ID NO: 2474 - DNA, 76 bp, Homo sapiens
ggtaactccaggttgttgatcctgagaagcctgggctactcagttagcctcactctcagacacaactccctgggcc

SEQ ID NO: 2475 - DNA, 118 bp, Homo sapiens
ggggcaggacgtgcaggggctgggaggctgtggtgagcttttggttttgtttttgtttgtttttttggaaacacagtctcactcggtcactcaggctgatgtgcaatggcatgatctc

SEQ ID NO: 2476 - DNA, 104 bp, Homo sapiens
gataagtaaataggattttatattttctttggataagtattttatattttatataaacacttttctttggataagtgtttaattatactatttacctttttatc

SEQ ID NO: 2477 - DNA, 85 bp, Homo sapiens
gggtgctcactctctcagtgcctctggacccaagagctgcctcctgcaagctccccagggcctctgtctgagggagttcttcccc

SEQ ID NO: 2478 - DNA, 62 bp, Homo sapiens
gattagactgaggctctgagtctctgggcggaagactacagaggtagaatgccattttaatc

SEQ ID NO: 2479 - DNA, 82 bp, Homo sapiens
tcacagccactttagaaagcagtttggcagtttctttttttttttttttgagacaaagcctcactctgtcgcccaggctgga

SEQ ID NO: 2480 - DNA, 99 bp, Homo sapiens
gtttatgtcatatatatgtttatatatatctatatagatagctatatatgtgtctgtatatatggctcaggccaatatataaatacgtatgtgtgtgtc

SEQ ID NO: 2481 - DNA, 74 bp, Homo sapiens
gtttgttttgatacggagtctcactctgtcacccaggctggagtgcagtggtgtgatcttggttcactgcaagc

SEQ ID NO: 2482 - DNA, 95 bp, Homo sapiens
atagaatttttagagactgtaaagagtgagcacatgtgaacatgaacgtggctactgttcacagggtcactgaaggctgtctctggacagggctg

SEQ ID NO: 2483 - DNA, 68 bp, Homo sapiens
ctgtgaatgtggatgtgatgtgcttaagcaataaattcctgacatatgacattcaatctcattcacag

SEQ ID NO: 2484 - DNA, 114 bp, Homo sapiens
ctaataatcctacaacctaaacaacattatatatgtatatacacatatatgtatataagtatatatgcttatttgtgtgtgtatccatattgttaattttaaagtaatcattag

SEQ ID NO: 2485 - DNA, 99 bp, Homo sapiens
atatatatgtatgtgtatatatatacatatgcttgtatatctacacataaaagcatatatatatttatgtacatgtatatgtatatacctctacacata

SEQ ID NO: 2486 - DNA, 88 bp, Homo sapiens
gctgcacagatatttctgaaatacacattttgttcaagtcattttatactgcgacttgctcatatggtaaagttaaatctttgctagc

SEQ ID NO: 2487 - DNA, 96 bp, Homo sapiens
gtcacaccagccccacagagctgtgcatccggatcgaatgagtgaacacatgaactagtgagaactgtgcctgcacatgggaagagctgctgtcac

SEQ ID NO: 2488 - DNA, 58 bp, Homo sapiens; identical to SEQ ID NO: 47

SEQ ID NO: 2489 - DNA, 58 bp, Homo sapiens
tgagacagagtctcgctctgacacccaggctggagtgcagtggtgtgatctcggctca

SEQ ID NO: 2490 - DNA, 117 bp, Homo sapiens
gtaaatgccttctttgagaagtgtctgttcatatactgtgcccactttttttattattatactttaacttctggggtacatgtgcagaatgtgcaggtttgtttcataggtatacac

SEQ ID NO: 2491 - DNA, 121 bp, Homo sapiens
gtgctattgatttgtgtacattgattttgtaacccgagcttttactgaatttgtttatcaaatatacaagtcttttgtaggagtctttaaggttttctaggtagacaatcatatcattggc

SEQ ID NO: 2492 - DNA, 80 bp, Homo sapiens
ttaagtcctttccacattttgttgcctcaaagttgctgagttgactgtgaggacactgatagagcagggaaaacacttgg

SEQ ID NO: 2493 - DNA, 58 bp, Homo sapiens; identical to SEQ ID NO: 1409

SEQ ID NO: 2494 - DNA, 97 bp, Homo sapiens
catgggaccatttccagagactgttaatgtttgttttttggtaattttctctagtatcactgaagaatgaatccatagaactccttatggtgtcatg

SEQ ID NO: 2495 - DNA, 111 bp, Homo sapiens
cagagttcttgggtagtaaggtcaatgagcagtaatattttgaaaagaatctttttttttctgaacagtaagtctcaaaagtgatcttaaaatattcggtaaattaggctg

SEQ ID NO: 2496 - DNA, 119 bp, Homo sapiens
gtagttttctggtggaactcatgtcagaggctctatttttattttattttattttattttattttattttattttatttttttgagatggagtctcgctctgtcaccaggctggagtgc

SEQ ID NO: 2497 - DNA, 129 bp, Homo sapiens
caggttgtgatgatgaggaaaggaggggagtaaatactttttttttttcagacaaactctcactctgtcaccaggctggagtgcagtggcacgatctcagctcactgcaacttccgcctcccgtgttca

SEQ ID NO: 2498 - DNA, 160 bp, Homo sapiens
agataaatatatatatatacacacacatatatatgtgtgtgtgtatgtatatatattgaactatatatatgtgtgtctgtatatatgtgtgtgtgtatatatattaaactatatatatacatatacataactgtatatatatatatgcatatatatgagt

SEQ ID NO: 2499 - DNA, 96 bp, Homo sapiens
catggacaatgactacttggtttatttcattttgtacatgtgacactaagtgcacaagaagtccagaggtgaccagatcaatgtggcaaggacatg

SEQ ID NO: 2500 - DNA, 92 bp, Homo sapiens
gtatcctccttctggtagctttcaggatgtgttgtgattgtgagctgttatttttcaatgctattacagacctggagagcaggagctgggac

SEQ ID NO: 2501 - DNA, 173 bp, Homo sapiens
atataaacatagatgtatatattttatacatctatatgtatatattttatacatctatatgtatatattttatatatataaatatatattttagatatgtttatatataaatacataaatatatattatatataaatatatacatctatatgtgtatatatatgtcactgtac

SEQ ID NO: 2502 - DNA, 113 bp, Homo sapiens
gaatttggaaaatataaacagtaggttaacagattatgggaagcttttttatttttaaggaagaatacaaaggtattcttatattttgccttactgtaaaactccccaaactc

SEQ ID NO: 2503 - DNA, 119 bp, Homo sapiens
cttaggttttatgggagaatatcaaatgcataattttaagtgtcataagaatatatttttttcttatgaagataatgccagtgatcttagaaagtacggttagatccaggaggcagagg

SEQ ID NO: 2504 - DNA, 83 bp, Homo sapiens
aggtgtttcttgggcaaaactttgggaaatgtgaattaaacatgtagtctactgtgctctttccaggtttgcagcctatacct

SEQ ID NO: 2505 - DNA, 91 bp, Homo sapiens
agatatcttgatgtgtgcatacatatgtgtgtgtatgtgtgtgtgtgtatatatatatatatctagtatgtgtgcacacatcttaatatct

SEQ ID NO: 2506 - DNA, 103 bp, Homo sapiens
cctggtgtgatgagtgaactcagaattgtggtgacatggaaagcctttctttttatttttatttttattttttttgagacggagtctctctctgtcacccagg

SEQ ID NO: 2507 - DNA, 108 bp, Homo sapiens
tatagttacctgagatgtgtccttagaatgtcagttcatgctctgtcagtctttctgaagtaagcattgagggctgtgaactttcctcttagcaccgcctttgctgta

SEQ ID NO: 2508 - DNA, 70 bp, Homo sapiens
catatgaagtatatatataaattatatagcatgtacgtgctttatatttatgtaaatatgctttaatatg

SEQ ID NO: 2509 - DNA, 73 bp, Homo sapiens
atatatgtatatgtatacatgtgtatatatgtatatacgtatgtgtgtatacatatatatatatatatatata

SEQ ID NO: 2510 - DNA, 77 bp, Homo sapiens
acacatgtatatatgtatgtgtacatatgtgtgcatatatgtatatatatgtgtatatatgtgtatatatagatata

SEQ ID NO: 2511 - DNA, 95 bp, Homo sapiens; identical to SEQ ID NO: 68

SEQ ID NO: 2512 - DNA, 93 bp, Homo sapiens; identical to SEQ ID NO: 69

SEQ ID NO: 2513 - DNA, 107 bp, Homo sapiens
ctccaactttgtatgagagcaagtttttggagatataatacttgaaatttcttttcatttattttattttattttagagacagagtctctctgtcaccaggctggag

SEQ ID NO: 2514 - DNA, 92 bp, Homo sapiens
gtgcatgcctccgtgtgtgtacatgcaagtgtgtgtgggtgcatgtctgtgtgtgtgtgtgtgtgtgtgtgtgtgtacatggacacatgtgt

SEQ ID NO: 2515 - DNA, 59 bp, Homo sapiens
tcctctctgtctctgtatctatctttttaaccaagatagaaccacaaagaaatagagga

SEQ ID NO: 2516 - DNA, 78 bp, Homo sapiens
tggaacctggcaggcacttccataggtgattatgacagaagacactatcctctctgggagttatctgacctagggcca

SEQ ID NO: 2517 - DNA, 65 bp, Homo sapiens
cacctcagtgtctctgaggaagttttctgattatcttttgtgaagcagatttcctccactgtgtg

SEQ ID NO: 2518 - DNA, 88 bp, Homo sapiens
gtgtatatatacacctgtgtgtgtatctatgtatgtgtacctatataggtgcatatatatatgtgtatatatctgtatgtatgtatac

SEQ ID NO: 2519 - DNA, 115 bp, Homo sapiens
ggctcccactgcttctacattatggtgaattgtataattatttcattatatattataatgtaataataatagaaataaacactttgggaggccgaagcgggtggattacaaggtc

SEQ ID NO: 2520 - DNA, 87 bp, Homo sapiens
tggaattctgacagacaggtaatcgtgaaggagaggaagattcatttagtatcttttttatttttatttctttgagacagaatctca

SEQ ID NO: 2521 - DNA, 73 bp, Homo sapiens
ccgggcatggtggtgggcgcctgtaatcccagctactcaggaggctgaggtaggaggatcacttgaacccagg

SEQ ID NO: 2522 - DNA, 88 bp, Homo sapiens
gggagagtctcccattttactgagacaagaaagtgtccaaacaggaatagaagctttgatgacagacagtaggagatgctcttctccc

SEQ ID NO: 2523 - DNA, 87 bp, Homo sapiens
tgcaaggtctttctcacactctgcctctcatcttcagatcccacaaggtccagtgttgggagctagaacatgagctttagtcaggca

SEQ ID NO: 2524 - DNA, 58 bp, Homo sapiens; identical to SEQ ID NO: 1101

SEQ ID NO: 2525 - DNA, 56 bp, Homo sapiens; identical to SEQ ID NO: 1102

SEQ ID NO: 2526 - DNA, 66 bp, Homo sapiens
ttgtagatggagtctcactctgtcacccaggctggagtgcaatggtgtgatctcggctcactgcaa

SEQ ID NO: 2527 - DNA, 117 bp, Homo sapiens
acagaatctgatcattttaccttttgttatgctatcctccatcctgggtcacactcacattcactgagtcttctgagcattgttggagaaaagcaggacattgtgccaggagtttgt

SEQ ID NO: 2528 - DNA, 98 bp, Homo sapiens
gaggtctcactatgttgcccaaatagtcctagaaataatatgtatatacatattttttggtggagcctacattatttggttgtaataactgtagcttc

SEQ ID NO: 2529 - DNA, 56 bp, Homo sapiens; identical to SEQ ID NO: 1392

SEQ ID NO: 2530 - DNA, 67 bp, Homo sapiens
ggagatcgaggtaactggagttctcaggacagaatttgtgagatgagagagaggtgcagtgatcttc

SEQ ID NO: 2531 - DNA, 58 bp, Homo sapiens
tgagacagggtctcactctgtcacccaggctggagtgcagtggtgtgatcacagctca

SEQ ID NO: 2532 - DNA, 80 bp, Homo sapiens
gaagcagcacagatctggagtcaggagacccacagtggcattacgcaaaacacctcctcagtcttactctctgcttcttc

SEQ ID NO: 2533 - DNA, 87 bp, Homo sapiens
agactctcagacactctctctccctggcacacatacacactcgtacacacgatgacagccatgggacggccaggcagctggacgtct

SEQ ID NO: 2534 - DNA, 105 bp, Homo sapiens
gtatctgtgtatatatttaggtatctatgtatgtatatgatttttaaatgaaattaagttcatagcatgtatatagatttgtgctctgatgtttacacttaatat

SEQ ID NO: 2535 - DNA, 110 bp, Homo sapiens
tatatgttatatatatgcacacatatatacagattatattacatgtatatatgtatacataatatataatcatgttatctgtatatatacatgaaattatattatatata

SEQ ID NO: 2536 - DNA, 58 bp, Homo sapiens; identical to SEQ ID NO: 47

SEQ ID NO: 2537 - DNA, 58 bp, Homo sapiens
tgagacagggtctcactctgtcacccaggctggagtgcactggtgtgatctgggctca

SEQ ID NO: 2538 - DNA, 84 bp, Homo sapiens
gtaatgaggggatagtgtttcctaataatgtggtattttattttattttattttatttttggaaacaagttctctctctgttac

SEQ ID NO: 2539 - DNA, 81 bp, Homo sapiens
gcgagaggctgtctgcagaaaaccagcaaggggtatctctttgtccaggagtgccctcactctgtctgtcgggtttgtcgc

SEQ ID NO: 2540 - DNA, 58 bp, Homo sapiens
tgagacggagtctcactctgtcacccaggctggagtgcagtggtgcgatctcagctca

SEQ ID NO: 2541 - DNA, 62 bp, Homo sapiens
ctgaactctagagtgtttcatctcgtggtatgaaccaagaattggaacagtcacttgggcag

SEQ ID NO: 2542 - DNA, 93 bp, Homo sapiens
atatgtatttacgtgtgtgtgtttgtgttatataaatacacacacacacatatgtgtgtatatatatataattcacatgcaaatgcaaaacac

SEQ ID NO: 2543 - DNA, 70 bp, Homo sapiens
ttgtttcgagacagagtcacgctctgtcacccaggctggagtgcagtggtgtgattttggctcactgcaa

SEQ ID NO: 2544 - DNA, 107 bp, Homo sapiens
tgagtattttgttgttgttgttgttaatacagcgtctcactctgtcacccaggctggagtgcagtggtgtgatcttgtctcagtgcaacatctacctcccaggctca

SEQ ID NO: 2545 - DNA, 96 bp, Homo sapiens
tttgtttttgaggtgaagtctcactctgtctcccaggctggagggcagtggtatgatctcggctcactgcaagctctgcctctggggttcaggtga

SEQ ID NO: 2546 - DNA, 70 bp, Homo sapiens
catatatatgcgtgtgtgtaagtatatatatatacacacatatatatacacacacatacatatatatatg

SEQ ID NO: 2547 - DNA, 68 bp, Homo sapiens
tatatatatgtatgtgtgtgtatatatatgtgtgtatatatatatacttacacacacgcatatatatg

SEQ ID NO: 2548 - DNA, 115 bp, Homo sapiens
taaaataattttgaaatattttatagagatgtaaattatttgtatatatttacatatatacatatactgtgtaatttatatttttgacattataaaatattttctgaacttttta

SEQ ID NO: 2549 - DNA, 74 bp, Homo sapiens
gttctctctctctcgctctctctatgtgtgtgtgttggggaggtggggaggtggggggagagagagagagagac

SEQ ID NO: 2550 - DNA, 71 bp, Homo sapiens
gacatgatgagactggactatttgacctcctggacccctgggacactgacagtctctgtttctataatgtc

SEQ ID NO: 2551 - DNA, 69 bp, Homo sapiens
acacacacacacgtgtgtgtatctatatatacatattgtatatatatgtgtatatatgtgtgtgtgtgt

SEQ ID NO: 2552 - DNA, 111 bp, Homo sapiens
gcttactgtagcttttgacttttacattttttaaaattattttattgtatgttttattttactttaagttctgggatacatgtgcagaatgtgcaggtttgttacataagt

SEQ ID NO: 2553 - DNA, 57 bp, Homo sapiens
tatacatatatatagtatatacatacatatatgtatatgtatatgtatatatgtata

SEQ ID NO: 2554 - DNA, 82 bp, Homo sapiens
ccacggtggcttctgttcattctgtgcaggacttttttttttttttttttttttgagacggagtcttgctctgtcacccagg

SEQ ID NO: 2555 - DNA, 58 bp, Homo sapiens
tgagacggagtctcgctctgtcgctcaggctagagtgtagtggcgtgatctcggctca

SEQ ID NO: 2556 - DNA, 58 bp, Homo sapiens
tgggactgagtctcgctctgtcagccaggctggagggcagtggcatgatctcggctca

SEQ ID NO: 2557 - DNA, 63 bp, Homo sapiens
tgagagctagactactgtgaatgctgttgctcctctaggtccagcaacacagtggagctgcca

SEQ ID NO: 2558 - DNA, 119 bp, Homo sapiens
actagcttttgatgtccagaggttttattttgtatatagtcaaatctatcaaactttttctttgaattctatatccattgcttttatatttagaacttttcctatcttcaagtgctagt

SEQ ID NO: 2559 - DNA, 83 bp, Homo sapiens
ttttggggataaggtttatatggatggatgagtacgtatatatttatatatacacacattttaataggctttatttttcagag

SEQ ID NO: 2560 - DNA, 73 bp, Homo sapiens
ctgggcaacatagtgagaccccgtcactaacaattttatctttattttttgacagtctcactctgtcgcccag

SEQ ID NO: 2561 - DNA, 114 bp, Homo sapiens
tactcttagttgtttttctttaaagtaacaggctctctttgctcattttatttgtttgtttatttatttatttattttgagacagagtctctctttgtcacccaggctggagtg

SEQ ID NO: 2562 - DNA, 60 bp, Homo sapiens
ttgagactgagtcacgctctgtcacccaggctgtagtgcagtggtgcgatctcggctcag

SEQ ID NO: 2563 - DNA, 89 bp, Homo sapiens
gaggagatttttcaaaatgggggtctctgggtcagaggtcagcttgaagcctgcccttaaactctccctctctgactcagtttcctcat

SEQ ID NO: 2564 - DNA, 91 bp, Homo sapiens
ccagtctctgggactataggcgtgagccactatactagactatttttgtatttttggtagaggtggggttttgccatgttgcccaggctgg

SEQ ID NO: 2565 - DNA, 58 bp, Homo sapiens
tgagacagagtctcgctctgtcacccaggctggagtgcagtggtgcgatcctggctca

SEQ ID NO: 2566 - DNA, 95 bp, Homo sapiens; identical to SEQ ID NO: 68

SEQ ID NO: 2567 - DNA, 93 bp, Homo sapiens; identical to SEQ ID NO: 69

SEQ ID NO: 2568 - DNA, 101 bp, Homo sapiens
gataagatcagatccagggtctatctgtctcaggaattctatcctacaattaacttttttttttttccacacgtatgaccactggtgtgtgtttctgtgtc

SEQ ID NO: 2569 - DNA, 94 bp, Homo sapiens
ggagcgcttttgctgctgtcctttaccacctctgagaagtctatgtggggtttcttgtctcagagggtaaagagagcagagctccccaaaatgc

SEQ ID NO: 2570 - DNA, 58 bp, Homo sapiens
tgagatggactctcactctgtcactcaggctggagtgcagtggtgtgatctcagctca

SEQ ID NO: 2571 - DNA, 73 bp, Homo sapiens
atatatatgaatatatatgtatatatgaatatatatgaatatatatgtatatatgaatgtatatgtatatatg

SEQ ID NO: 2572 - DNA, 64 bp, Homo sapiens
gtatatatatgaatatatatgtatatatatgaatatatatgtatgtatatgaatatatatgtat

SEQ ID NO: 2573 - DNA, 110 bp, Homo sapiens
cctccccactcagccctggtaaccagcgctctattctatttctataagttccacttttttttttttttgagatggagtctcactctgtaccgcaggctggagtgcagtgg

SEQ ID NO: 2574 - DNA, 58 bp, Homo sapiens; identical to SEQ ID NO: 315

SEQ ID NO: 2575 - DNA, 110 bp, Homo sapiens
tttatagtctagttattccacttagggttaatatgtatacgtctcattgcaaacatatttatgtatttgattatgggagctgcccttgacaccgctagcattgctataga

SEQ ID NO: 2576 - DNA, 73 bp, Homo sapiens
agtgctgggactacaggcgtgagccacggcgcccagccaaggcagtgaatctctctctgagtctcagataact

SEQ ID NO: 2577 - DNA, 115 bp, Homo sapiens
ggctgttagtgtcactttcagtcacttatacaaggcagtgaatcttttttttttttttttgagatgaagtctcgctctgtctcccaggctgacgtgcagtggcgcgatctcggct

SEQ ID NO: 2578 - DNA, 108 bp, Homo sapiens
aggtgatacacagtttattttttgcacattttatttatttttttcttatactttaagttctggggtacatgtgcagaatgtgcaggtttcttacattggtatacatgt

SEQ ID NO: 2579 - DNA, 115 bp, Homo sapiens
aggtctggttttcatttgtttccattgatatgtgtgtgtgtgtgtgtgtgtgtgtgtgtaaatatttaaacatatggagaatatatataatgagaaagaaatggagttcctttct

SEQ ID NO: 2580 - DNA, 99 bp, Homo sapiens
actgcactttcttccctttatttattttttatttttgttttattccactgtcttggaataataatgatgaaagttgaatagatgtgatgattgtcttgt

SEQ ID NO: 2581 - DNA, 95 bp, Homo sapiens
ggtgtcttctcagagcaggctgccatgggttactcccgctccttggtgatggtgagagatgaaagtgatacccagaaactgccagagtacaaacc

SEQ ID NO: 2582 - DNA, 87 bp, Homo sapiens
gttcaaaaaggaggacaaaagtgctgttaaaggtgctaaaaggctttccttttccttccacagtctttttctctctcgtcatgatgc

SEQ ID NO: 2583 - DNA, 77 bp, Homo sapiens
cctgccacataataggtgcttaatatttatttgttaaaatattgagccacccctattgtcaaaagagcagtggcagg

SEQ ID NO: 2584 - DNA, 119 bp, Homo sapiens
gtgtctctgttgcttatgattttagccccagtgcctgaccaaaagttgtgtgctcagtcagtatttctcaaagtgagttggattccaggtactttggcttcgattaccattgtcatcac

SEQ ID NO: 2585 - DNA, 71 bp, Homo sapiens
cagtgaatggtgatatggggatttttttttttttttttttgagacagagtctcactctgtcgcctaggctg

SEQ ID NO: 2586 - DNA, 66 bp, Homo sapiens; identical to SEQ ID NO: 474

SEQ ID NO: 2587 - DNA, 86 bp, Homo sapiens; identical to SEQ ID NO: 2169

SEQ ID NO: 2588 - DNA, 93 bp, Homo sapiens
cacttaggagggaaagttactgggaatgtcataaagggttaatttgtattttattttattttttgagacagtctcattctgtcacctaggctg

SEQ ID NO: 2589 - DNA, 68 bp, Homo sapiens; identical to SEQ ID NO: 2134

SEQ ID NO: 2590 - DNA, 58 bp, Homo sapiens; identical to SEQ ID NO: 2135

SEQ ID NO: 2591 - DNA, 56 bp, Homo sapiens; identical to SEQ ID NO: 2136

SEQ ID NO: 2592 - DNA, 88 bp, Homo sapiens
tatatatatgcatatgtaaagagagatagctgtttatatatatttatatagatctatctatagctatacctctctctgcatatatata

SEQ ID NO: 2593 - DNA, 59 bp, Homo sapiens
ttgagatgggctggagtgcagtggcatgttcacaactcactcactcagtgcagcctcga

SEQ ID NO: 2594 - DNA, 99 bp, Homo sapiens
aaactggattccttttcaatagagccattacaacaatgaaataggttgtaaaatctagtgtttttaatgaagtctatatttgaactaaggagtttgttt

SEQ ID NO: 2595 - DNA, 58 bp, Homo sapiens
tgagatggagtctcactctgtcacccaggctggagtgcagtggtgcgatcttggctca

SEQ ID NO: 2596 - DNA, 84 bp, Homo sapiens
tatatatatacacgtatatatatctagatatatatacacacgtatatatatctatctctagatatatatatctagatatatata

SEQ ID NO: 2597 - DNA, 157 bp, Homo sapiens
tatatatatacacgtatatatatgtatatacgtgtgtatatatgtgtatatatatgtacatgtctatctctctatagatatatatatatctagatatatatatctagatatatatatatctatagagagatagacatgtacatatatatacacatat

SEQ ID NO: 2598 - DNA, 127 bp, Homo sapiens
tggccgggctgtaatcccagcacttcgggaggctgaggagggtggatcacctgaagtcagaagtttgagaccagtctggccaacatggtgaaaccctgtttctactacaaatacgaaattaactggg

SEQ ID NO: 2599 - DNA, 88 bp, Homo sapiens
tagccaagcatggtggtgtgcacctgtggtcccagctactagggaggctgtggtaggaggatcacttgcgcccaggatgtcaaggcta

SEQ ID NO: 2600 - DNA, 119 bp, Homo sapiens
agatttggatccttatttcatcattactttaaacacggttttcatattcaattttaaactttgtttagaatatgccatttgaagtgtttaagttgagactgtgtggtaaggtgttatct

SEQ ID NO: 2601 - DNA, 80 bp, Homo sapiens
gtgtgtatgtatgtgtgtatgtgtatatatatatacacataacatatatatatacacacacacacacccaacatacacac

SEQ ID NO: 2602 - DNA, 86 bp, Homo sapiens
gaagagagtgggggccaatactcaacatccttagagaaaagaattctttttttttttttttttctgagacggagtctcactctgtc

SEQ ID NO: 2603 - DNA, 58 bp, Homo sapiens
catgttgggggcgaggcatacgtgtgcgcatgcacatgtgtctctgtatgtgagtgtg

SEQ ID NO: 2604 - DNA, 56 bp, Homo sapiens
tgagacagtctcgctctgtcacccaggctggagtgcagtggcgcgatctcggctca

SEQ ID NO: 2605 - DNA, 64 bp, Homo sapiens
tttaatgctaggttttgtttttttttttctatatgggagaagtggtgggacctggaaagttgga

SEQ ID NO: 2606 - DNA, 104 bp, Homo sapiens
gtggtggtgcactcctgtagtcccagctactcgggaggctgaggtaggaggatcccttgagcccaggcctttgtggctgcagtgagctatgattgtgccactgc

SEQ ID NO: 2607 - DNA, 58 bp, Homo sapiens; identical to SEQ ID NO: 1409

SEQ ID NO: 2608 - DNA, 123 bp, Homo sapiens
ggcgtgagccactgtgccaggcccttttttttttttttttttttaagacagggtctcactgtgtcacccagactggagtgctgcagtggcatgaccactgctcactgcagcctgacctcctgg

SEQ ID NO: 2609 - DNA, 96 bp, Homo sapiens
gatgtttgtcccaggaaaagttgtatttcttctgaggaactttttttgctttttaaaaaaatttgtgcagcgtggacaatatagcgggaccccatc

SEQ ID NO: 2610 - DNA, 120 bp, Homo sapiens
tatatgtatatatgtgtattacatgtatatacctatatgtatatatgtgtattacatgtatatacatatatgtatatatgtgtgtatatatatatatacttataaccatatgtgtgtata

SEQ ID NO: 2611 - DNA, 141 bp, Homo sapiens
ccaatttgcgtttcggttttggcttcgtgcaggaggccaggtttctgtctcattgctgttggtgtcatctctctgcctctgtccctgggtccctggtgcttggccacgtccccccgggaacggaaggctgtgggtctttcc

SEQ ID NO: 2612 - DNA, 110 bp, Homo sapiens
ttgcttgatgacactgggtgatcagacatatgagcgtctccaaagacatctggacatcaatttttttttttcagacggagtctcgctctgtcacccaggctggagtgcaa

SEQ ID NO: 2613 - DNA, 117 bp, Homo sapiens
ctgggcttgagggaggcagcagctccaacaccttagagccttgggaacagtccctgtgacagccacactgattgagaggaaaaagcacagcgggagaagttgatctctttccactgg

SEQ ID NO: 2614 - DNA, 108 bp, Homo sapiens
tagagactgcaaaagttcctataaggcattctgttctttatcacaatcatctttgaatctttatttatgatcatgttaatattgtgctttagtatttttgtgtttctg

SEQ ID NO: 2615 - DNA, 81 bp, Homo sapiens
ggttcctgtctctcagactctgcccatcattttcagcaatgtgataagctctagttatgtgcagtctgtccaaaagggatc

SEQ ID NO: 2616 - DNA, 80 bp, Homo sapiens
attttatcacagggaaagaagaaatgaggaagggtagagaaaccaatcttttttttttttttttttttttgagatagagt

SEQ ID NO: 2617 - DNA, 58 bp, Homo sapiens; identical to SEQ ID NO: 87

SEQ ID NO: 2618 - DNA, 56 bp, Homo sapiens; identical to SEQ ID NO: 88

SEQ ID NO: 2619 - DNA, 74 bp, Homo sapiens
tcttttttgtagagttagtgtttcaccatgttgcccaggctggcaacttgaaatatttttgatttcaaaaaaga

SEQ ID NO: 2620 - DNA, 88 bp, Homo sapiens
ttaactgcttgtatgtgtatatgtatatgtatatatattcaatatcagatatatgtatatgtatacaaacacacagacatatagttaa

SEQ ID NO: 2621 - DNA, 82 bp, Homo sapiens
gtgtgtgtatatatatgtgtgtgtgtatatatatgtgtgtgtgtgtgcatatatatatgtgtgtgtgtgtatatatatatgc

SEQ ID NO: 2622 - DNA, 103 bp, Homo sapiens
tctatatatctatctatatctatatatatgtgtgtgtgtgtgtatatatatatatatatatatatatatatatatatatatatatataaatagttcagagaga

SEQ ID NO: 2623 - DNA, 80 bp, Homo sapiens
gtctggccacagagccctggtttcattattttattttattttattttattttgagacagggtctcacttgtcactcaggc

SEQ ID NO: 2624 - DNA, 69 bp, Homo sapiens
ttgtttgagatggagtctcactctgtcacccaggctggagtgcagtggcgtgatctcagctcaccacaa

SEQ ID NO: 2625 - DNA, 58 bp, Homo sapiens; identical to SEQ ID NO: 47

SEQ ID NO: 2626 - DNA, 58 bp, Homo sapiens
tgagacagagtctcactctgtcgcccaggctggagtgcagtggtgtgatctcggctca

SEQ ID NO: 2627 - DNA, 58 bp, Homo sapiens; identical to SEQ ID NO: 1763

SEQ ID NO: 2628 - DNA, 109 bp, Homo sapiens
gccccaccaggagtacacattaacccagtcctctctcactcactgccactttcccggagtcttattgagaagcagggaggattgagtctctgctactcatgaaaccggc

SEQ ID NO: 2629 - DNA, 84 bp, Homo sapiens
gtgaggctgaggtaggaggttcgcttgagcccaggagtttaaagctaccgtgagctatgattgcgccactgcactccagcctcc

SEQ ID NO: 2630 - DNA, 95 bp, Homo sapiens; identical to SEQ ID NO: 68

SEQ ID NO: 2631 - DNA, 93 bp, Homo sapiens; identical to SEQ ID NO: 69

SEQ ID NO: 2632 - DNA, 72 bp, Homo sapiens
ttgttttttgagagggagtctcactctgtcacccaggctggagtgcagtggtgtgatctcggctcactgcaa

SEQ ID NO: 2633 - DNA, 58 bp, Homo sapiens
tgagagggagtctcactctgtcacccaggctggagtgcagtggtgtgatctcggctca

SEQ ID NO: 2634 - DNA, 72 bp, Homo sapiens
gtatacatatatatgtacctgtatagatatgtacccatatatatgcctgtatatatatatatgtgtgtgtat

SEQ ID NO: 2635 - DNA, 67 bp, Homo sapiens
gctgctcactctgagactctggcagacttgaatcaatcaagctttgagaatcagcggcaggggtggc

SEQ ID NO: 2636 - DNA, 57 bp, Homo sapiens
tgagatggagtctcactctgtctccaggctggagtgcagtggtgcgatctcggctca

SEQ ID NO: 2637 - DNA, 80 bp, Homo sapiens
tatgcttggtcctatttgtatttatttttgagacagggtcttgctctgttgcccagactgagtgcagtggcacaatcatg

SEQ ID NO: 2638 - DNA, 99 bp, Homo sapiens
gagaataaatcctgaggatttagttagatgctgtgggtattgtattttaaataatattttaatgggagcagctgattgactttcaaatggattgtttac

SEQ ID NO: 2639 - DNA, 70 bp, Homo sapiens
ggtggctgtggtggtacgcctgtagtccgagctactcaaggggctgaggtagcaggatcacttgaccccc

SEQ ID NO: 2640 - DNA, 115 bp, Homo sapiens
ctcaagcctgggtgagagtgagacaccatctcaaaaaaaataataatattaataacattaaagttacttttttttttttttgagacagagtctcgctctgtcgcccaggctggag

SEQ ID NO: 2641 - DNA, 75 bp, Homo sapiens
ctgggttgaatggtggttctatcttaagttctttttttttttttttttgagacagagtctcactctgttacccag

SEQ ID NO: 2642 - DNA, 108 bp, Homo sapiens
gccagggtgatagaatggaattttatttatttatttatttatttatttatttatttatttattacttttgggtttttttgagatggagtctcactctgtcacccaggc

SEQ ID NO: 2643 - DNA, 87 bp, Homo sapiens
actccagcctaggcaacaagagcggaactccgtctcaaaaaaaaaaaaaaaagagacgaggtctcactctgtcaccctggctggggt

SEQ ID NO: 2644 - DNA, 113 bp, Homo sapiens
tcttcaacaatttacagatagatttactgtggtttgtttgtttgttctttgttttttgtttttgacactggacaacacactgagtaattcatctgaagtttattttgatgtga

SEQ ID NO: 2645 - DNA, 106 bp, Homo sapiens
ttgcatgtcatagaaccagaagtgtgtacactgctggtacaaatcatcatcatcatcgtcatgattgactctcagagttcacaaagcaccttcatatctcatggaa

SEQ ID NO: 2646 - DNA, 115 bp, Homo sapiens
aacatttttcttatttttaaatatacattattttaaatatacaatttaaatatattaaatattgaaatatatttaaatggttgtaaatgttaattatttaacatagggaagagtt

SEQ ID NO: 2647 - DNA, 92 bp, Homo sapiens
tctatatctatatatttagatgtctatatatatagatatctatatctatatatatagacatctatatatatagatatagatatatagatata

SEQ ID NO: 2648 - DNA, 106 bp, Homo sapiens
aactgagaatgtactctagagttgcactcttcacagctcgggagaatgactgtttccctctctgtctctgccaagtgccactttctgtcatgcatgtcatgcagtt

SEQ ID NO: 2649 - DNA, 95 bp, Homo sapiens; identical to SEQ ID NO: 68

SEQ ID NO: 2650 - DNA, 93 bp, Homo sapiens; identical to SEQ ID NO: 69

SEQ ID NO: 2651 - DNA, 103 bp, Homo sapiens
gatatttattgatttatatatatagtaagagatatatatagtgagatatatatttattgatttattatatatattaaatattatatataatataatatatatt

SEQ ID NO: 2652 - DNA, 58 bp, Homo sapiens
tgagacagggtctcactctgtcacccgggctggagtgcagtggtgagatctgagctca

SEQ ID NO: 2653 - DNA, 111 bp, Homo sapiens
gatggtacaattctctggtgtcaactttcacagaagagctttgtctctgtgctaatgatgcagagagcagggaagtgatgagaaaattgtatagacctcaagaaatccaac

SEQ ID NO: 2654 - DNA, 113 bp, Homo sapiens
gggttccccaggcctgcatggacctacaatgtgctactgaaatgatcatttatgtgtctgtctctttctctaaacagtgggctcccccagactgggcacaaagttatttacct

SEQ ID NO: 2655 - DNA, 126 bp, Homo sapiens
ccagctttgttctttttgcttaggattgtcttggctatatgggctcttttttggttccaaatgaaatttaaagtagttttttctaattctatgaagaaagtcaatggtagcttggtgggaatagca

SEQ ID NO: 2656 - DNA, 99 bp, Homo sapiens
agagcttgaccccaatgcagtaatagttgaggcctccaccactccattttattatttattattttttggtatggggtctcactctgtcacccaggctgg

SEQ ID NO: 2657 - DNA, 69 bp, Homo sapiens
ctgggggcatgagagggtgcctcagaccctgggttcttccagggacccaaaggaccctcgggtcttgag

SEQ ID NO: 2658 - DNA, 78 bp, Homo sapiens
ggtgtatatatatattgggggtgtgtatatatatatataacattgggtgtatatacatattgggtatgtgtgtatatt

SEQ ID NO: 2659 - DNA, 160 bp, Homo sapiens
gtgtacatatatatatattgggtgtgtgtatatatgtatcatggggtgtatatatatatatatatatatcgggtatgtgtatgtatatatcactgggtgtatgtgtgtgtatatatatatggtgtgtgtgtatatatcactgggtgtatatatatatagg

SEQ ID NO: 2660 - DNA, 118 bp, Homo sapiens
ttcatgcccaggtttattaaaaagtgttcttctaaagataatgttactgaatgtttatatttatttattttatttaatagctttaggggtccaagtggtttttggttacgtggatgaa

SEQ ID NO: 2661 - DNA, 65 bp, Homo sapiens
gggagatcagagctcttggagctggcttgatacctggcaatcctcatccagcatctccatctctc

SEQ ID NO: 2662 - DNA, 117 bp, Homo sapiens
tctggtctggtacttgtatcagttagcttttttttccctctcatttgaggtttattattattattatactttaagttctggggtacatgtgcagaatgtgcaggtttgttacatagg

SEQ ID NO: 2663 - DNA, 110 bp, Homo sapiens
tacagccatatgtatgtatgtatgtatgtatatatacatgtatatatatgtatgtgtatatatgtatgtatatatgtgggtatatatatgtatgtatgtatatgtgtgta

SEQ ID NO: 2664 - DNA, 93 bp, Homo sapiens
cctgagaacaacggcacagttctgtctttcataaactagctctacgattgtactgtttaaaataaagacaggcttttgaaggacttctccggg

SEQ ID NO: 2665 - DNA, 102 bp, Homo sapiens
aggacgagcagcgggacatgattgaagggtttcagcaaaggaactgcgtggccagattttcttgttttttttttcctgcatgtttacaaatgttactgtttt

SEQ ID NO: 2666 - DNA, 58 bp, Homo sapiens; identical to SEQ ID NO: 1265

SEQ ID NO: 2667 - DNA, 58 bp, Homo sapiens; identical to SEQ ID NO: 1763

SEQ ID NO: 2668 - DNA, 118 bp, Homo sapiens
gggactagtgtagatgccagttagtggtcactggtacagggaagtcagtgcactcactttctgtttctgtcataacaaattaccacaaatcaatggctttaaaaaccacacacgtgtt

SEQ ID NO: 2669 - DNA, 113 bp, Homo sapiens
agatatcaatttgtgctcttctctttgcattgcctttctttttctcccacagatcagactctgctcagtgcctcaggggaggcatgtggcagtagagaaagcagaaaccatct

SEQ ID NO: 2670 - DNA, 68 bp, Homo sapiens
ttaggagcaagactcaaaaaagtgaggacagatgcgcgccttactttatccagtcaatgtgctgctga

SEQ ID NO: 2671 - DNA, 86 bp, Homo sapiens
cctcagtgatgatgatttaatctgtagaagagtagaacattgatagtttttatatatctccaggtaattttaatatataactgggg

SEQ ID NO: 2672 - DNA, 89 bp, Homo sapiens
tgaagaatctactctatgacaggagctcttgctgataacttttatatattttatataattctcaggaggaccttgtgagttaggtctca

SEQ ID NO: 2673 - DNA, 113 bp, Homo sapiens
gattagtgttagcacggtatatctttctccatccatgtacatttaatctatttatatgtaaaatgggtttcttgtggatgacatatggttgggttttgtgtcttgatccactg

SEQ ID NO: 2674 - DNA, 111 bp, Homo sapiens
gccaggtgtggtcgtgcacacctgtagtcccagctacttgggaggctgaggtgggaggatgacttgagtctgggaggttgaggttgtagtgagccgtgattgcactattgc

SEQ ID NO: 2675 - DNA, 108 bp, Homo sapiens
ccattctcttacatgcctaaggctttctacagtaagccacagccactctctgcctgagagtgttcactggctgggagcttgctgagacaggccagaaaccagagctgg

SEQ ID NO: 2676 - DNA, 120 bp, Homo sapiens
gagattctcatttaatttgtctggagtgtggctggagcatagaccttttttttttttttttttttttttgagacggagtcttgctctgtcacccaggctggagtgcagtggcatgatctc

SEQ ID NO: 2677 - DNA, 95 bp, Homo sapiens; identical to SEQ ID NO: 68

SEQ ID NO: 2678 - DNA, 93 bp, Homo sapiens; identical to SEQ ID NO: 69

SEQ ID NO: 2679 - DNA, 81 bp, Homo sapiens
ggtgtctctagcagtataactgatttgttgatgaaatttgtgttttatttatttgtttgttttctgagatggagtctcact

SEQ ID NO: 2680 - DNA, 58 bp, Homo sapiens
tgagatggagtctcactctgtcacccaggctggagtgcagtggtatgatctccactca

SEQ ID NO: 2681 - DNA, 72 bp, Homo sapiens
caggttgagtgctctctctctttgactgctagccctggaggaagccagctgtcatggtgtaaggcagccctg

SEQ ID NO: 2682 - DNA, 99 bp, Homo sapiens
tgtatatatatatatatacacacatatacttggaatatatatatttggactatatatatatatttggaattttatatatgtggaatatatatatgttca

SEQ ID NO: 2683 - DNA, 61 bp, Homo sapiens
gtatttagacacactcactgagcctgagcctgagcccaggcaggttttctgtgttaaatat

SEQ ID NO: 2684 - DNA, 59 bp, Homo sapiens
tatttaacacagaaaacctgcctgggctcaggctcaggctcagtgagtgtgtctaaata

SEQ ID NO: 2685 - DNA, 96 bp, Homo sapiens
gcactgcagcctgggggacagagcgagacctcatctctctctctcttttttttttttttttcagatggagtctctctgtcacccaggttggagtgc

SEQ ID NO: 2686 - DNA, 79 bp, Homo sapiens
gggcaggtcagttctctctgggtcagtgtgctgaagaagggaaggaaggagcattgagctagatggtccctgaaggcct

SEQ ID NO: 2687 - DNA, 69 bp, Homo sapiens
acaggcatgcaccataacacccacctaatttttgtattttttacagagatggtgttttgccatgttgcc

SEQ ID NO: 2688 - DNA, 147 bp, Homo sapiens
ctagtttgtctgatcaactgggtgtaggtatcagtttaaagtggaattttttttttttttttttttgagctggagtctcactctgtctgccaggctggatggagtgcagtggcgcgatctcggctcactgtaacctccacctcccgg

SEQ ID NO: 2689 - DNA, 122 bp, Homo sapiens
cagggaagctcagagggccagctccatctccaggacaccctctctgtctgagactctctggcagagcattcgtggggctgctccccggcctggcagtggcccggggtgctctggccgggaag

SEQ ID NO: 2690 - DNA, 70 bp, Homo sapiens
ttgttttgagactgagtctcaccctgtcacccaggctggagtgcagtggtgcaatcttggctcactgcaa

SEQ ID NO: 2691 - DNA, 58 bp, Homo sapiens; identical to SEQ ID NO: 315

SEQ ID NO: 2692 - DNA, 61 bp, Homo sapiens
gccatctgtgacagcttcttgatctgtccccagttgggtggctgtgttcaacaggtgttgc

SEQ ID NO: 2693 - DNA, 105 bp, Homo sapiens
gagttctctgttggttcacaggagagccgggtatttaagaggctggaccttcctcctcctctctctgactccctctctcaccatgtggcttgcctgttccccctc

SEQ ID NO: 2694 - DNA, 76 bp, Homo sapiens
gcagaggccactctcaaccactatagatgctatttttctttaaaataaagatagtacttcaagggctggctcctgt

SEQ ID NO: 2695 - DNA, 113 bp, Homo sapiens
tgttgccctttattctttattatttctgtctgttatttgcatagttcactttgaatgaaggagagagaactgtgataggacaatatgttgtaaccagtctgagggaggaagca

SEQ ID NO: 2696 - DNA, 58 bp, Homo sapiens
tgagatggagtctcactctgtcacccaggctggggtgcagtggtgcgatctcagctca

SEQ ID NO: 2697 - DNA, 77 bp, Homo sapiens
ttaaatattttttatttaagaaatatttctcttaaggccacagagattttgttttttaaatgaggatgtatatttaa

SEQ ID NO: 2698 - DNA, 78 bp, Homo sapiens
gtctgctgctggaacacatcacctgtttattcgtcctccatttcccgctttgcaggtgtgtcagtttcactgagtgac

SEQ ID NO: 2699 - DNA, 157 bp, Homo sapiens
tatatgtagtgtatagtatatatgtagtgtatatatactatatatgtgtatatatagtatatatgtatatatgcatacatatgtatatagtatacatgcatacatatgtatatagtatagatacatatataaatatatatgctatatgctatatata

SEQ ID NO: 2700 - DNA, 71 bp, Homo sapiens
tgtgtgtgtgtatatatgtgtgtgtgtgtgtatatatatatatgcgtgtgtatatatatatatacatatgt

SEQ ID NO: 2701 - DNA, 75 bp, Homo sapiens
tctcatctctgagcctctgcaggaatgtgaagggagttttctctttttcttgttgaatctcaaatgcctttgaga

SEQ ID NO: 2702 - DNA, 112 bp, Homo sapiens
caccagagtttcgtaactctgctttgtcatttctttttttttttttttaatatactgagcttctaaagataaaaataagaaagaaaacggaagtagcctgaaactgctgttg

SEQ ID NO: 2703 - DNA, 85 bp, Homo sapiens
gtttgtttgttttttgagactgagtctcgctctgtcactgaggctggagtccaatggtgcgatctcagctcactgcaagctctgc

SEQ ID NO: 2704 - DNA, 72 bp, Homo sapiens
gtgagtgaaaaggacgagcacccagttcagtggagggatgtcagcaaatgactgggtctgtctgtgcctcat

SEQ ID NO: 2705 - DNA, 86 bp, Homo sapiens
aggcacgagtcactgtgtccagctatatggatcttttttatttaaaaaaagccaggtggctccaacatgcagtcacatttttgctt

SEQ ID NO: 2706 - DNA, 116 bp, Homo sapiens
ggtcaggttcagtgtagactgagagcctgagtgtctcccggggcctgggcactctctcattctctgttgtgtaggcctccgcataaggcagctcataacactagagcttgctttcc

SEQ ID NO: 2707 - DNA, 59 bp, Homo sapiens
ttgagatggaatctcactcactttgtctcccaggctggagtgcagtggtgcgatcttga

SEQ ID NO: 2708 - DNA, 95 bp, Homo sapiens; identical to SEQ ID NO: 68

SEQ ID NO: 2709 - DNA, 93 bp, Homo sapiens; identical to SEQ ID NO: 69

SEQ ID NO: 2710 - DNA, 81 bp, Homo sapiens
tgcccattttacaagtgaggaaaccgaggctcagagaagtaagagtggcctgttcgaagttctgcacgtccaggtggtgca

SEQ ID NO: 2711 - DNA, 104 bp, Homo sapiens
tttgcccactttttgatggggttgtttgtttttttcttataaatttgtttgagttcattgtagattctggatattagccctttgtcagatgagtaggttgcgaa

SEQ ID NO: 2712 - DNA, 196 bp, Homo sapiens
gtgtgtgtatatatatgtatgtatatacatgtatatatgtgtgtatatacatgtgtatatatgtatgtatatacatatgtgtgtatatatgtatgtatatacatgtgtatatacgtatgtatatacatatgtgtgtatatatgtatgtatatacatgtgtatatatatgtatgtatgtatgtatgtatatacatat

SEQ ID NO: 2713 - DNA, 84 bp, Homo sapiens
ggctagaagctcatgttggggattgactttctcttttagttttctattttttaagggagagggtctcactctgtcactcaggcc

SEQ ID NO: 2714 - DNA, 101 bp, Homo sapiens
ctcattcattgggttaccattactgaggtaatttttaaattacctcagaatttaatttaatttaattttaaaattacctcagtagataaataatgtaagag

SEQ ID NO: 2715 - DNA, 62 bp, Homo sapiens
ttatatctgtatatatgtgtgtacatatatatgtgtgtgtgcatatatatgtgtatctgtaa

SEQ ID NO: 2716 - DNA, 119 bp, Homo sapiens
atgcttggggatggcatttttaaggagtctggatgagtgatgagctaacatgtggggattgctgattggtggagaagcgagtggtgaagtcataagacagggagatgaagactctgcat

SEQ ID NO: 2717 - DNA, 95 bp, Homo sapiens; identical to SEQ ID NO: 580

SEQ ID NO: 2718 - DNA, 93 bp, Homo sapiens; identical to SEQ ID NO: 69

SEQ ID NO: 2719 - DNA, 79 bp, Homo sapiens
tctagatgtcacatttattcacagatatgtatgtatatatgtatatatgcatatatgtatgtgtgtttgtggatctaga

SEQ ID NO: 2720 - DNA, 92 bp, Homo sapiens
gagttattggtatatatatatatatatatagatgtttggaaccctttatatttccagtataaatctgtgtctgtgtctgtgcaatataattc

SEQ ID NO: 2721 - DNA, 95 bp, Homo sapiens; identical to SEQ ID NO: 68

SEQ ID NO: 2722 - DNA, 93 bp, Homo sapiens; identical to SEQ ID NO: 69

SEQ ID NO: 2723 - DNA, 185 bp, Homo sapiens
atatatatatgtgtgtgtgtgtgtaaatgtgtgtgtgtgtatatatataaatatatatatatacatatatatatataaatatatatatacatatatatatatacatatatatatatacatatatatatatacatatatatatatacatatatatatatacatatatatatatatatatatatata

SEQ ID NO: 2724 - DNA, 110 bp, Homo sapiens
ggtatgttttgcacagcagagatttttatttttgtaaagtccaatgtataatttttttcatagaattagtgggcttttcttatgtattttctctacaaaaaaaatacgct

SEQ ID NO: 2725 - DNA, 78 bp, Homo sapiens
gctagtgctgatctgacaagagtcagagctcaggcagcaatgcctgctttctgctgacctcctgctgtgcagcctggt

SEQ ID NO: 2726 - DNA, 79 bp, Homo sapiens
ttacatatataactatattgcatatgtttatatacatatttacatactctatatttacatatgtaatatgtatatgtag

SEQ ID NO: 2727 - DNA, 119 bp, Homo sapiens
agcagtgatacccaggtaccacgttgaggaccttaggtgagcctctgagattactggctcacagatgagactcagcacattcccacatgtggtggctatggggtgaaactccttctgct

SEQ ID NO: 2728 - DNA, 116 bp, Homo sapiens
atacaagtcactgtcaggctctgggctagatctcatttagtcagttggttggtatgtatagaagtcactgtcaggctctgggctagatctcagctgggagcaactgaacagggtat

SEQ ID NO: 2729 - DNA, 78 bp, Homo sapiens
aggcacctgccaccatgcccgattaatctttgtatttttagtagagatgaggtttcaccatgttggccaggctggtct

SEQ ID NO: 2730 - DNA, 96 bp, Homo sapiens
acatatgaagatatatgagtatatatgaatatatgagtatatatgaatatgagtatatatgaatatatgagtatatatgaatatatgagtatatgt

SEQ ID NO: 2731 - DNA, 98 bp, Homo sapiens
ttgtatggtggggtggggtggggaggggaagccaggctacagtcagaacagactgtgagcatgcctggtaaacttcctgaagagttcttagaagacag

SEQ ID NO: 2732 - DNA, 98 bp, Homo sapiens; identical to SEQ ID NO: 2731

SEQ ID NO: 2733 - DNA, 110 bp, Homo sapiens
gatgttgttagagaggccaatattcaaattgagagcactgagagagaacacatttggtctcccctgtgagccctttgtcctcttgctcatcaccaggaagggcccccctg

SEQ ID NO: 2734 - DNA, 78 bp, Homo sapiens; identical to SEQ ID NO: 2729

SEQ ID NO: 2735 - DNA, 111 bp, Homo sapiens
gtgcatatatagttcgtgtatatatatacatataaatatacatgtatagtatatatatacatatatatgtatagttgtgtatatgtatacatacatatatatgtatatata

SEQ ID NO: 2736 - DNA, 71 bp, Homo sapiens
gtgcatgtcagcctgactccctcactgggttgctgaaaggcccgaatgaggtgagtgggggccaacatcac

SEQ ID NO: 2737 - DNA, 89 bp, Homo sapiens
gtcagtgaggaagaccaactccatgtggaagagatgcctggccaatcaaagctgggttgcagtgtttcagggaattggctgagaatgac

SEQ ID NO: 2738 - DNA, 74 bp, Homo sapiens
cctgggtgacagaacgagactctgtcctaaaaaaaaaaaaaaaaaagagagacagagtctctctgtcacccagg

SEQ ID NO: 2739 - DNA, 115 bp, Homo sapiens
ggacactctgatggtcagtgaccctgctagggaaggattctgctcacctgctcactttttttttttttttttttttctgagacggagtcttgctctgtcacccagtctggagtcc

SEQ ID NO: 2740 - DNA, 73 bp, Homo sapiens
ggtagagagaatcactatcaggaagacgagaataattctgtttttcttgaactgaaagtagtggttcttggcc

SEQ ID NO: 2741 - DNA, 110 bp, Homo sapiens
ccaccactttctggctgtgtagcctcaggcaagcttcttattctctgtgcctctgtgtcttcctctgtaaaatggagattttaatagcatctgatggctgggcatggtgg

SEQ ID NO: 2742 - DNA, 81 bp, Homo sapiens
gacatggtgagaccttgtctctacaaaaaaattttaaatttctttttttttttgttttttgagacggagtctcgctctgtc

SEQ ID NO: 2743 - DNA, 91 bp, Homo sapiens
cgggcaggattcaggaccaggacacagcggggcctgggggtccatgccccacactctctgggtgtcctggagactaaagtctctgtagatg

SEQ ID NO: 2744 - DNA, 133 bp, Homo sapiens
agacctggggacaggagatttcagttttagtttgtcaatactttttttttttgagacgcagtctcgctctgtcacccgggctgagtgcagtggcatgatctctgctcactgcaacctctgcttcctggtctca

SEQ ID NO: 2745 - DNA, 92 bp, Homo sapiens
gctagtagcacagtatatagtaagtgtgtgataaaatgcttcttgaatgaagtttatttcatcttattttgagaagttactgtgaagggagc

SEQ ID NO: 2746 - DNA, 95 bp, Homo sapiens
ccccagcagtcccagcccccagtgtcactgcctccctctgacagcctggagcatgagtccccttcaagggaggtgttgtgggagtacagcggggg

SEQ ID NO: 2747 - DNA, 71 bp, Homo sapiens
agggtctcactctgtcacccagactggagtgcattgcagcctccaactcctgggctcaagtgatcctccct

SEQ ID NO: 2748 - DNA, 86 bp, Homo sapiens
ataactgggaaaactgaggctcagagaggaccattgacctgcccagggtctcatgtgagtgagctcagagctgggattcccattgt

SEQ ID NO: 2749 - DNA, 79 bp, Homo sapiens
ggtggtgtggctgtatgagaaagagacctggatttggagtcttgtttgtgtctgattctcactcacttgctgtgtgacc

SEQ ID NO: 2750 - DNA, 58 bp, Homo sapiens; identical to SEQ ID NO: 2595

SEQ ID NO: 2751 - DNA, 119 bp, Homo sapiens
ggcaacgagagcaaaactccgtctcaaaacaaacaaacaaacaaaaaccccacgccatattatttatttatttatttatttatttatttatttttgagatggagtctcactctgtcgcc

SEQ ID NO: 2752 - DNA, 90 bp, Homo sapiens
ggtggcttacagggtccccagagccctttgatggaattacagctgctcctctgtgccgtcgctgtctctctgcctctgtctcgctcaacc

SEQ ID NO: 2753 - DNA, 70 bp, Homo sapiens
ttgttttgagacagagtctcactctgtcgccccggctggagtgcggtggtgtggtctcagctcactgcaa

SEQ ID NO: 2754 - DNA, 77 bp, Homo sapiens
gccaccatgctgggtcccattgagattttgttgctgttattagacagagtctcactcagtcacccaggatggagtgc

SEQ ID NO: 2755 - DNA, 86 bp, Homo sapiens
ggcagtggaacactgaggacatttatgcataaggacagtaatcacgaaattatctttgtatatattgtccgttaatgactactgct

SEQ ID NO: 2756 - DNA, 117 bp, Homo sapiens
gaaataataggatgtgacagattttcaggaggaggtcaaccagtagttaaaattttttcaatatttggagacccacctttgttaatactgcttaaatatatccaaaccatttatttc

SEQ ID NO: 2757 - DNA, 56 bp, Homo sapiens
gagacagggtctcactctgtctcccaggctggagtacagtggtgaaatcactgctc

SEQ ID NO: 2758 - DNA, 58 bp, Homo sapiens
tgagacggagtctcactctgtcacccaggctggagtgcagtggtgcgatcttggctca

SEQ ID NO: 2759 - DNA, 79 bp, Homo sapiens
tgagacagggtctccctctgtcacccagtctggagtgcagtggcctgatcaaaactcactacagcttcagactcctggg

SEQ ID NO: 2760 - DNA, 69 bp, Homo sapiens
gtcctcctccagccacaggattctcctaacctagagccttgggagtctctctctgtggctcagagggac

SEQ ID NO: 2761 - DNA, 111 bp, Homo sapiens
cacagttggaagccttcagaagccaacgccagatgtcaggctctcagtgggtccctctaaggacactggggccagagcacagggcaagggttgggtgggcccacaactctg

SEQ ID NO: 2762 - DNA, 85 bp, Homo sapiens
gcttggaatcgcttgaacctgggaggcggaggttgcagacctagttctaggaggttctagtttctatggtttaggggtcagagac

SEQ ID NO: 2763 - DNA, 160 bp, Homo sapiens
gtcttctagcatgcagttctgtcagttgaagatctgatgcagtctgtgtctcagtcctttatttctggaaactttgattgctgactattatcctttttttttttttttttggaggcagagtctcactcgatcccctaggctagagtgcagtggcacagtc

SEQ ID NO: 2764 - DNA, 85 bp, Homo sapiens
cctggactcgaagtcagcagacccggttctaggccagctctgcctctcaccctctgtgaccttgggcaaatcatacaactctggg

SEQ ID NO: 2765 - DNA, 87 bp, Homo sapiens
gctctgaaaaatatatgtgtgacctgccttgaatcccctgagaatggcagagggggttaatagtaattaccatttttttaattgagc

SEQ ID NO: 2766 - DNA, 82 bp, Homo sapiens
aggagacggggtgccaggagtgaggatgtgaggtgcacccgctctgcttgggtcctcactgagtgcctctctgcttctctgg

SEQ ID NO: 2767 - DNA, 73 bp, Homo sapiens
ctgaccgactgatagagcccgcagtttattatttttttttttcttttgagctgaatctcgctctgtcgtccag

SEQ ID NO: 2768 - DNA, 99 bp, Homo sapiens
gcccctgcacaggtggattaatccctctgccctgctccaccatatcttttttttttttttttttttttttgagagggagtctcactctgtcgcccaggc

SEQ ID NO: 2769 - DNA, 115 bp, Homo sapiens
tcccaggcccacggtaggagctcacacagggcttgctgagggcagggctgctgctccgcagagaacagacttagctctctgtgttgctccctggtacgtctgtgtttatgttgga

SEQ ID NO: 2770 - DNA, 77 bp, Homo sapiens
gcaagcaacttcgcatctctctgtctctgaggcctcctctgtgaagtgggcatgggaacagcgagggcagcgtgttg

SEQ ID NO: 2771 - DNA, 65 bp, Homo sapiens
caggggtgcctggagggcagggggagctgtcactatgcccctgcctctctcagtgtctatctctg

SEQ ID NO: 2772 - DNA, 58 bp, Homo sapiens
tgagacagggtctcactctgtcacccagcctggagcacagttgtgtgatctctgctca

SEQ ID NO: 2773 - DNA, 81 bp, Homo sapiens
cagagtaagtccacctggagcactggggtttgagaagttcctaaggcctccctcacctctctaaggctctctcttactctg

SEQ ID NO: 2774 - DNA, 83 bp, Homo sapiens
gcacagtgggaagaccctaggctcagggtctgagtaggcttaggttctaatcctggctctgtccctgactgtgtgaccttggg

SEQ ID NO: 2775 - DNA, 87 bp, Homo sapiens
ctcttctctgcacagcagcaagacgcatattttatttttatttttatttttttgagacagggtctggctctgtcgcccagacgggag

SEQ ID NO: 2776 - DNA, 86 bp, Homo sapiens
ctgctaaagtctctggctctctgggtgactttgggcttctcccctatcttcacacctctgcccagagcagccctggaagaaggcag

SEQ ID NO: 2777 - DNA, 109 bp, Homo sapiens
tcccgaagtgctgggattacaggcatgaaccactgtgcccagcctacaattttttttttttaattagttgagtgtggtggcatgtgcctatagtcccggcaattcagga

SEQ ID NO: 2778 - DNA, 58 bp, Homo sapiens
tgagactgagtctcactctgtcgcccaggcttgagtggagtggcacgatctcggctca

SEQ ID NO: 2779 - DNA, 108 bp, Homo sapiens
agttctgggaatcacaggcatgagccactgcgctgggacttttccttttttttttttttttgtctcagggtcacttaggctctcacactgggtgattatacttggact

SEQ ID NO: 2780 - DNA, 70 bp, Homo sapiens
ttgttttgagaccgagtctcactctgtcacccaggctggagtgcagtggtgcgatctcggctcactgtga

SEQ ID NO: 2781 - DNA, 74 bp, Homo sapiens
gccagatgtggtggtgcgtgcctgtagtcccagctactcaggaggctgaggtaagaggatcacttgagttgggc

SEQ ID NO: 2782 - DNA, 71 bp, Homo sapiens
gctgtcgtctctgtcagtgacagctaatccttgacggttttggctcctggttcactgtcactcttcccagc

SEQ ID NO: 2783 - DNA, 112 bp, Homo sapiens
gaggaggtggccctcgcaggcgtggctgaggatggggctgggcagaggaatgagacaaagagcagacagagcccagagaacatcctctccagctgctcgccctccctccctc

SEQ ID NO: 2784 - DNA, 119 bp, Homo sapiens
tgtgtgtgtgtatatatatatgtgtgtgtatatatatgtgtgtatatatatacatgtatatatgtctatatatacacatatatctatatacatacatatatacacgtatatacatatat

SEQ ID NO: 2785 - DNA, 130 bp, Homo sapiens
ccaacctggacaacatagcgagaacctgtctctacagtaatttttttttttttagacagagtctcgctctgtcaccaaggctggagtgcagtggccgcactcatggctcactgcaagctccgcctcctgg

SEQ ID NO: 2786 - DNA, 58 bp, Homo sapiens
tgagacagagtctcactctgtcgcccaagctggagtgcagtggtgcgatctcggctca

SEQ ID NO: 2787 - DNA, 81 bp, Homo sapiens
gcctggtaaccagactgaagggctttgtttttgttttttgttttttgtttttgagacagagtctcactctgtcacccaggc

SEQ ID NO: 2788 - DNA, 82 bp, Homo sapiens
tatatgtatgtgtgtgtatgtatacatgtgtgtatatgtgtatacatatatacatataaaatatacatgtttgtacatatat

SEQ ID NO: 2789 - DNA, 58 bp, Homo sapiens; identical to SEQ ID NO: 637

SEQ ID NO: 2790 - DNA, 78 bp, Homo sapiens
ctgggagacacagaaagaccctctctctctcttttttttttttttttttttgagatggagtctcactgtgtcacccag

SEQ ID NO: 2791 - DNA, 91 bp, Homo sapiens
tatatatgtgtgtgtgtatatatatacatatatgtgtgtgtatatatacatatatgtgtgtatatacatatgtgtgtgtgtgtgtgtgtgt

SEQ ID NO: 2792 - DNA, 58 bp, Homo sapiens
tgagatggagtctcactctgtcacccaggctggagtgtagtggtgtgatcttggctca

SEQ ID NO: 2793 - DNA, 71 bp, Homo sapiens
ttgagacagggtctcactctgtcacccagaccgaagtgcagtggtgtgatctcagctccctatagtctcga

SEQ ID NO: 2794 - DNA, 57 bp, Homo sapiens
tgagacagagtctcacactgtcgctcaggctggagtgcagtgtgccatctctgctca

SEQ ID NO: 2795 - DNA, 60 bp, Homo sapiens
ttgagacagagtctcactctgtcacccaggctggagtgcagtggtgtgatcttggctcaa

SEQ ID NO: 2796 - DNA, 58 bp, Homo sapiens; identical to SEQ ID NO: 1101

SEQ ID NO: 2797 - DNA, 56 bp, Homo sapiens; identical to SEQ ID NO: 1102

SEQ ID NO: 2798 - DNA, 78 bp, Homo sapiens
gggcaaggggtgggggttaagcaggtgtcaaagatgaacattttttttttttgagacagagtttcactcttgttgccc

SEQ ID NO: 2799 - DNA, 76 bp, Homo sapiens
gcctcccaaagtcctgagattacaggtgtgagccactgcgcccagcctttatttttagtttttaactttggtaggt

SEQ ID NO: 2800 - DNA, 117 bp, Homo sapiens
agtgatagatacactgacatttgctatatcatgagtctttagagtttacatatatttttaatttttaaatttttgtttttattttaattttttgagatggagtcccactctatcact

SEQ ID NO: 2801 - DNA, 111 bp, Homo sapiens
gttatgtaataccccagagaggtcagggcagcactttttaaatcagatgtattttattatttctgtagtaaaatgtctggatgttcatactaactgggataaatactgtac

SEQ ID NO: 2802 - DNA, 146 bp, Homo sapiens
ggcttgtgcatttaggggctcaggtttgggctctgtgcctatgagccagtctatgtgtgcactgtctgtctgtctgtccgtctgccagcagccttcaggcgccaggaggggaggcagcagtggaaggtgggggcagggaaggaggt

SEQ ID NO: 2803 - DNA, 85 bp, Homo sapiens
ctctttgtcccagcctgcctctgtgcctggtctcccccatcagactccccagggcagggttgtatttctcctgttggactagggg

SEQ ID NO: 2804 - DNA, 77 bp, Homo sapiens
gtctttgtctgtgtccgggtgtgcacgcctgtgctcgtgtgagtaccactggctgtgtgtctgtgcctgtctttgtc

SEQ ID NO: 2805 - DNA, 90 bp, Homo sapiens
acattccagactggacagaattaagtgagctcaaaggcaagaaatgagactgctcagggagttacaattaggtaggtgtgctaggaatgt

SEQ ID NO: 2806 - DNA, 86 bp, Homo sapiens
ctagagaggtaggcagaggcagattctgccaggcttttttttttttttttttttgagttggagtctcgctctgtctcccgggctgg

SEQ ID NO: 2807 - DNA, 70 bp, Homo sapiens
tctggctgtgtctgtctgtgaggctgtttctgggtgagattgacatttgaacaggtagacagggtaaaga

SEQ ID NO: 2808 - DNA, 88 bp, Homo sapiens
gccttagggaacacagagatgagagactggtccctgctcttgggggatccccccaatctatcatgctcgctctgtcatccttcaaggt

SEQ ID NO: 2809 - DNA, 107 bp, Homo sapiens
tcactgtgtcctcgcatggcagagagagagcaagctctttgatgtctcttaatttttttaaatttaagactgtgtctcgctctgtcacccaggctggagtacagtga

SEQ ID NO: 2810 - DNA, 116 bp, Homo sapiens
gctaggagttcaagaccaccccgagcaacatagcaagaccccatttctactaaaaaaaaattttttttttttgagatggagtttcactcttgttgcccaggctggagtgcaatggc

SEQ ID NO: 2811 - DNA, 103 bp, Homo sapiens
cctccaaggtaaactcaggagctatgaagtgtgggcatcaagctgccaccctctgccaggctgcctgtctgcctgtaaatctcatgttctgagagccaggagg

SEQ ID NO: 2812 - DNA, 61 bp, Homo sapiens
tgagacagggtctcactctgtcacccagcaggctggagtgcaatggtgtgatctcagctca

SEQ ID NO: 2813 - DNA, 101 bp, Homo sapiens
ggagtgatgaaaatgttttggaactagatagaggtaacggttgttcaacatggtgaatatactttttttttttttttttttttgagacagagtctggctct

SEQ ID NO: 2814 - DNA, 58 bp, Homo sapiens
tgagactgagtctcgctctgtcatccaggccagagtgcagtggcgcaatctcggctca

SEQ ID NO: 2815 - DNA, 335 bp, Homo sapiens
atatagtatataaatatatctataatatatataaaatataaatatagtatataaatataaaatatatagtatataaatatataatatatatctatatatgtatatatctatatatgtgtatctatatatgtatatacatatatatgtatctatatatgtatatacatatatatgtatctatatatatgtatatacatatatatgtatctatatatatgtagatacatatatatgtatctatatatatgtagatacatatatatgtatctatatatatgtagatacatatatatgtatctatatatatgtagatacatatatatgtatatatatat

SEQ ID NO: 2816 - DNA, 112 bp, Homo sapiens
gagtctcgctctgtcacccaggctgcagtgcagtggcgcgattttttttttttttttttttgagagggagtctcgctctgtcaccccggctggagtgcaatggcacaatctc

SEQ ID NO: 2817 - DNA, 85 bp, Homo sapiens
tttgacctctctgtgcctctcaccttctcaactgtgaagcaggacaccggtgtgtaactcagaagcactgtgagaattggttggg

SEQ ID NO: 2818 - DNA, 100 bp, Homo sapiens
tgggcgacagagcgagactccatcttaaaaaaaaaaaacaaaaaaacacctaatttctttttttttttttttttgagatggagtctcgctctgtcaccca

SEQ ID NO: 2819 - DNA, 66 bp, Homo sapiens
cctgggtgacagagcgagacttttttttttttttttttgagacagagtctcgctctgtcacccagg

SEQ ID NO: 2820 - DNA, 94 bp, Homo sapiens
tgtttatttttcgagatggagtctctcactctgtcacccaggctggagtgcagtggtgccatctcggcttactgcacgctctgcctcctgtgat

SEQ ID NO: 2821 - DNA, 58 bp, Homo sapiens
tgagacagactctcgctctgtcacccaggatggagtgcagtggcttgatctcgtctca

SEQ ID NO: 2822 - DNA, 76 bp, Homo sapiens
ggaggctgaggtggaaggatcacttgagcccaggagaatgaggttgcagtgagccttgatcacaccacagcactct

SEQ ID NO: 2823 - DNA, 89 bp, Homo sapiens
tgggtgtggttaggtggggtgggagattccaggaccatttttattttttgtttttttgagatggagtctcactctgtcgcccaggctgg

SEQ ID NO: 2824 - DNA, 121 bp, Homo sapiens
ggtgtggtagcgtgtgcctgtaatcccagctacttgggaggctgaggtaggaggttggcttgagcccaggaggtggaggttgcagtaagccaagattgtgccactgcactccagtctgggt

SEQ ID NO: 2825 - DNA, 77 bp, Homo sapiens
acagatgtagagtttcagtcatgcaagatgaaaacattcttttttgtttgtttgtttgaaatgaagtctcactctgt

SEQ ID NO: 2826 - DNA, 83 bp, Homo sapiens
ctggtgtgcagtggcaagatcactgtgtgaattatttatttatttatttattttttgagacagagtctcgctgtgtcacccag

SEQ ID NO: 2827 - DNA, 82 bp, Homo sapiens
tatgtatatatatgtgtatatatgtgtatatatgtgtgtgtatatatatatatgtgtgtgtgtatatgtgtatatatatatg

SEQ ID NO: 2828 - DNA, 85 bp, Homo sapiens
ttgaacatgttaagataaagatgtctgttaggcatccaagtgaggaaactgagtaggaagttggatgttttcatctgtagttcag

SEQ ID NO: 2829 - DNA, 69 bp, Homo sapiens
tgggtgacagagtgagaccttgtctcaaaaaaaaaaaaaaattgagacagagtcttactctgtcaccta

SEQ ID NO: 2830 - DNA, 65 bp, Homo sapiens
ggtgacagagtaagactctgtctcaatttttttttttttttgagacaaggtctcactctgtcacc

SEQ ID NO: 2831 - DNA, 110 bp, Homo sapiens
cctggatgtcccgtttggctgtgcggtgacttttctgtgtgagctgctctgagctgtgttctgcaactgcaactggaagagtcccatacggtgcaagcatggggtcgggg

SEQ ID NO: 2832 - DNA, 72 bp, Homo sapiens
ccaggcatggtggtatgcgcctgtaatatcagctacttgggaggctgaggtaggaggatcatttgagcttgg

SEQ ID NO: 2833 - DNA, 89 bp, Homo sapiens
ccagggaagggcaggggatggagggccaccttcttttttttttttttttttttttctgaggtggagtctcgctctgtcgcccagtctgg

SEQ ID NO: 2834 - DNA, 87 bp, Homo sapiens
tctgccttaatataatatgtatatctatctatctatatatacacacacatagatatagatagatatatatagatatattttttgaga

SEQ ID NO: 2835 - DNA, 85 bp, Homo sapiens
ggccaagtaactagctcaaggtcacaaaagagagttaagtgactatgcttttttctttttttatgagacggagtgttgctctgcc

SEQ ID NO: 2836 - DNA, 94 bp, Homo sapiens
attgctggtgtgaatgtaaaatggtatagtttttcttgaagacagtttggtagtttcttctaaagttaaatgtatgcttatatgactcagcaat

SEQ ID NO: 2837 - DNA, 58 bp, Homo sapiens; identical to SEQ ID NO: 47

SEQ ID NO: 2838 - DNA, 110 bp, Homo sapiens
tccagcctgggcgacagagtgagattcgtctctcaaaaaaaaaaaaaaaagtctttatggaatggtttttttttttttttagacaagttttgctctttcaccaggctgga

SEQ ID NO: 2839 - DNA, 91 bp, Homo sapiens
gtttccaatctcagagagctttcaacaattcaccatcatggttgatatttgttataagttttgtttatttactttgtcagattaaggaagc

SEQ ID NO: 2840 - DNA, 96 bp, Homo sapiens
agaatctagtgcctgatgatctgtcactgtctctcatcacccctagatgggaccacctagttgcaggaaaacaagctcaggagccccactgattct

SEQ ID NO: 2841 - DNA, 81 bp, Homo sapiens
gtggtgttgggcaggtctctgtccctctctgggcctctgcacgatggaggggtaggagttgatggttctgaaggctctgcc

SEQ ID NO: 2842 - DNA, 124 bp, Homo sapiens
ccagacttggtggtgcgtgcttgtagtttcagctacttaggaggctgaggtagaaggatggtttgagccggggagatggaggttgcagtgagctgagattatgccattgcactccagcctgggc

SEQ ID NO: 2843 - DNA, 58 bp, Homo sapiens; identical to SEQ ID NO: 1101

SEQ ID NO: 2844 - DNA, 56 bp, Homo sapiens; identical to SEQ ID NO: 1102

SEQ ID NO: 2845 - DNA, 58 bp, Homo sapiens
tgagacggagtctcactctgtcaccccggctggagtgcagtggtgtgatctcggctca

SEQ ID NO: 2846 - DNA, 93 bp, Homo sapiens
cactttgtgccaggcactcaacatgtgaaccctttcttaaattttttttttttttttgagaccgagtctcactttgtcacccaggctggagtg

SEQ ID NO: 2847 - DNA, 109 bp, Homo sapiens
gagtgtctcttgccctcctggagtttgtgatctagttgctagtgatgaaggcaaagtggatattcagagaacagagtcagaacttcatctgggatcagaggtagcactt

SEQ ID NO: 2848 - DNA, 68 bp, Homo sapiens
gcaggcggaacacacttgacactcagctgtgtggccagttgggttcatggcaatggattccgcattgc

SEQ ID NO: 2849 - DNA, 131 bp, Homo sapiens
ctcagtgagcacgggtaagtcatccacctcctccaggtggccttgatggccctccctcctctgagactaaagagaggccacaatgcccagagcagcctccttcctgtctcaagaaaggaaaggatctcagg

SEQ ID NO: 2850 - DNA, 66 bp, Homo sapiens
ttttagacagagtctcactgtgtcacccaggctggagtgcagtgacacaatctcggctcactaaaa

SEQ ID NO: 2851 - DNA, 64 bp, Homo sapiens
agaacagccctggtaagcacagttagcctagagagtatgagtctgtgtgtgtcaggggatgtct

SEQ ID NO: 2852 - DNA, 78 bp, Homo sapiens
cacagctagtgagtggtaaagaaaggacgcaaatctcagcctgtctgtgtctctaaagcctttgctgctgtgaggctg

SEQ ID NO: 2853 - DNA, 112 bp, Homo sapiens
tgtattaaaaatccccagcctaggcaacatagtgagaccccatctctctctctcttttttttttttttttttttgagacagggactggctctgttggtcagtctggagtgca

SEQ ID NO: 2854 - DNA, 72 bp, Homo sapiens
gctgccctagccactgatgagagatgtgaggggcccatcagtcactgtcactcagcttggtggatggaatgt

SEQ ID NO: 2855 - DNA, 86 bp, Homo sapiens
gcctctgcctgagagtgtgtcctgtgagcgtccccctctctctctgagattgtgcctctttctcatttatatcctctcacaacggc

SEQ ID NO: 2856 - DNA, 83 bp, Homo sapiens
atgggaactacaattcaagatgagattagggtggggacagagcgagatcgtatcacttcactctctgagtctcagtttcccat

SEQ ID NO: 2857 - DNA, 90 bp, Homo sapiens
cattgtcacttaccaactgtgtgaccttgggcaggttgctgaagctctctgtgcctcagttttctcacctacaaaatggggatgatattg

SEQ ID NO: 2858 - DNA, 66 bp, Homo sapiens
cacacatatgtgtgtgtgtgtgtacatatatataaccacatatacatatatatagatatatgtgtg

SEQ ID NO: 2859 - DNA, 76 bp, Homo sapiens
gcttgactgaagtcacagagctgggacctgaacccaggctcattgtgtcccggagtctgtgctctaaccaccaggc

SEQ ID NO: 2860 - DNA, 77 bp, Homo sapiens
cctggtcctctgttgtcactgtgtctgtggatggcacctccacccactcacccagttacccaagttggacactcagg

SEQ ID NO: 2861 - DNA, 73 bp, Homo sapiens
cagcgattcagagtctgaaaacccttcctgttactctctctgtctttggggctgtgggacaggcactgtgctg

SEQ ID NO: 2862 - DNA, 113 bp, Homo sapiens
tttccacctgcacaactcattgcccagaactagccagaaggtctcactttctgtctctccagggggacgggaggagagtcccagcgtggttcctgaagggggcagatgtgaaa

SEQ ID NO: 2863 - DNA, 110 bp, Homo sapiens
gctttcagtttccataaggcaagcttgcaaaggctgttggctttagttgagtgaaaactgaatgcaaataaactttttaaagttaataagcttgttaaaaatagatctgg

SEQ ID NO: 2864 - DNA, 62 bp, Homo sapiens
cgtatgaattttaggatgagtttttctatttctgaaaaacacatcattggaattctgatatg

SEQ ID NO: 2865 - DNA, 96 bp, Homo sapiens
gccaacactggggtggctgagggcagagaaggatgccaaccagttggatcacctacttggttgtttcgtgttgcccccgcctgccttggggaatgc

SEQ ID NO: 2866 - DNA, 116 bp, Homo sapiens
gggtaacaatggaacaagtgtgggctctggttcattccaccttggaaacttttcacactgatgttgaggaggaaggagagtataatgaagtaacagagcaggtttgtttgtcagct

SEQ ID NO: 2867 - DNA, 117 bp, Homo sapiens
gggttgtttttccttgatgtttttttatctcgtagtttttgaataaattctggacattgtgaacatgacagtagagactgaggtaagcagcatttatgcccagagatgaacacacct

SEQ ID NO: 2868 - DNA, 99 bp, Homo sapiens
aggagatgagactctcactcagggcaatcttagcagatttgaggctcagtgtctgcctctgaagcctggagaacggaatccctgagttcatcattttct

SEQ ID NO: 2869 - DNA, 66 bp, Homo sapiens
gctgtagactgactctgtgtctggcagcctgatggggcaggcactggcatggggacagcagggggc

SEQ ID NO: 2870 - DNA, 74 bp, Homo sapiens
ccctcaagcacagccaagtgagaactgatggaagagtaacaggctctacagtctcactctctgaatgccaaggg

SEQ ID NO: 2871 - DNA, 74 bp, Homo sapiens
ttctgtctgactctctcttccaggccaggccacatcctctcttggtctctggtctctgaaagtgaaagacagag

SEQ ID NO: 2872 - DNA, 116 bp, Homo sapiens
ctgttagtctttcaactttgttcttgtgtttaaaattgtcttagctattctaggtcttacatttacatatagatattagaacagtttttctcaatttctgcaaagcagactgctgg

SEQ ID NO: 2873 - DNA, 100 bp, Homo sapiens
tctctttcatagtagttatgacagttggaaattcatgctaatttatgatattctgtggcatctgtctgtctgtcatactagacctatctaccccatgaga

SEQ ID NO: 2874 - DNA, 93 bp, Homo sapiens
cgggtggcctggcctgcaccctccacactccctcgctcactgccttcatccggagcaaatgcaggaggctcaggttggcccgggaggtgtagg

SEQ ID NO: 2875 - DNA, 61 bp, Homo sapiens
ggcttcttttccacagtctactctctgctcaagtgaagcagagagtagagtgtgtctagcc

SEQ ID NO: 2876 - DNA, 130 bp, Homo sapiens
tgtcctctctggacctcagtcaaatggggaggacggagagagctgtgaggctccctttcactctggcactcagtctctctgctccatttgaaggcagctgcagacccgacatatctttcatacccttccc

SEQ ID NO: 2877 - DNA, 93 bp, Homo sapiens
tggactccacagtgacagcctcacagtctctctctttttttttttttttttttttttgagacagagtcttgctgtttcccaggctggagtgca

SEQ ID NO: 2878 - DNA, 93 bp, Homo sapiens
gtgcccagtgaaaatagcctgatgtaggagaacatattggagttctgtgaaaaactctctctgtgtattctgtttttcagaagcactctgcac

SEQ ID NO: 2879 - DNA, 76 bp, Homo sapiens
actcgctgccccagtggacagggttgactgtcaccacacagcctttaactgtctccactttaggggctgccccagt

SEQ ID NO: 2880 - DNA, 88 bp, Homo sapiens
ggggtcattgaagttaattgtttctctctgtgtctcaaaggcctacttgaaagatgaggcgattggacccttggaggctgttgaccct

SEQ ID NO: 2881 - DNA, 83 bp, Homo sapiens
ccaaggctcagtgaggtaagtgactgtccctgactcccacagccagctggtggcagagctatctcaaacccatgtacctctgg

SEQ ID NO: 2882 - DNA, 83 bp, Homo sapiens
ccacgcccagggcacagtgtctgcaagtgaggagagtgaggtcagggagccgccaaagcctcgttgctgctgtggctgtgtgg

SEQ ID NO: 2883 - DNA, 80 bp, Homo sapiens
ctgtgtgccttacaggcctcgtgatgtttttgttgaaagctggaccttttggctcagacagtagagactgaggaacatgg

SEQ ID NO: 2884 - DNA, 59 bp, Homo sapiens
gtgactgtgcctctcagtgtcacatgagaaaactgaggcacagagaggttaagttcaac

SEQ ID NO: 2885 - DNA, 69 bp, Homo sapiens
cccgcagtcacactcacccagtgggacaccttagacagggctggctttgctggtgctggggtttggggg

SEQ ID NO: 2886 - DNA, 61 bp, Homo sapiens
ggctctgtccctggggtgccctgtggccgtggtcatgtgactgcctctctggggctcagtt

SEQ ID NO: 2887 - DNA, 68 bp, Homo sapiens
gggctgggatggaaagcaggatggtcatccccagcagggctgtatctcctctgtcactgtctgtgccc

SEQ ID NO: 2888 - DNA, 79 bp, Homo sapiens
ggtggggtccaggtgtgtgtgcatgtgcatgtgaggtcagcaaagccctctctgctcccccaggccctggacccaggcc

SEQ ID NO: 2889 - DNA, 132 bp, Homo sapiens
gtgtgttcatgtgtgtgtgcatgcgcgtgtgtgcgtgcgtgcgtgtctgtttacactgcgtgtgtgcgtgtgtgtgcgtgtgcgtctgtttacacctggtgtgtgcatgtgtgtgcgtgtgtgtgcgcgtgc

SEQ ID NO: 2890 - DNA, 88 bp, Homo sapiens
ggggctctgcgtggtgtgtgtgtgtgtgtgtgtgtgtgtgtgtgtgtgtgtttctcactccctgggtgggtgcctccatcacactcat

SEQ ID NO: 2891 - DNA, 85 bp, Homo sapiens
gaggagtaaatgagacagtgcagaaagaggacagaaccccatgaacccagctgtgaggctctgtcaccttctccagccacgcctc

SEQ ID NO: 2892 - DNA, 95 bp, Homo sapiens; identical to SEQ ID NO: 580

SEQ ID NO: 2893 - DNA, 93 bp, Homo sapiens; identical to SEQ ID NO: 69

SEQ ID NO: 2894 - DNA, 65 bp, Homo sapiens
ccagactgtgagcagtgagaggccagggccatgtaggtcttgtcctcttgtgtcccttgcactgg

SEQ ID NO: 2895 - DNA, 102 bp, Homo sapiens
caggaggtagcagggaagatgggaacagaggaggatatggtggaagaggactcggatacacacggtctcactcaccctcctctgtgcatcagacacctcctg

SEQ ID NO: 2896 - DNA, 95 bp, Homo sapiens; identical to SEQ ID NO: 68

SEQ ID NO: 2897 - DNA, 93 bp, Homo sapiens; identical to SEQ ID NO: 69

SEQ ID NO: 2898 - DNA, 65 bp, Homo sapiens
gctggaggccgaaagaccctgtggagctgagctgactctgcccctctgtctttgctatgaccagc

SEQ ID NO: 2899 - DNA, 95 bp, Homo sapiens; identical to SEQ ID NO: 68

SEQ ID NO: 2900 - DNA, 93 bp, Homo sapiens; identical to SEQ ID NO: 69

SEQ ID NO: 2901 - DNA, 72 bp, Homo sapiens
cctggagatatgaggtagtttttctttttatatctcagagaagtgagacttatgctaaacgtcatctctagg

SEQ ID NO: 2902 - DNA, 71 bp, Homo sapiens
gcgtctgtgtgtatctgtgtgtgtctgtacatgtctgcgtgtgctgtgcacatatgtgcacacctgcatgc

SEQ ID NO: 2903 - DNA, 119 bp, Homo sapiens
gggatggggaatctggtggatcagggaagaattccactgctggtatagagacccagttgacagaagtgtgagtgggttccacgcagagtgagtgcccgtgatctccacctcccttgcct

SEQ ID NO: 2904 - DNA, 82 bp, Homo sapiens
cctggcctctctctgtccctccctgactcctgcccacggagctgatgggcgagtgtggggtgagggacctgttcagcttgcc

SEQ ID NO: 2905 - DNA, 96 bp, Homo sapiens
tgggcccaaggtggtcagagcacagtttggttttatacattctagggagacatgagatatgaatatatgaatatatgtaggatgaacatgggttca

SEQ ID NO: 2906 - DNA, 74 bp, Homo sapiens
gggccttccctctgtgtgtctgtgtcctcatctcctcttcatacaaggacaccagtcagattggatcagggccc

SEQ ID NO: 2907 - DNA, 87 bp, Homo sapiens
tgtggttgatctgaaaggtaaagtttactgggtgtcctgtattttctctggcactctgagtctggacactcctttcgcctgagccca

SEQ ID NO: 2908 - DNA, 90 bp, Homo sapiens
gtgtgtgtgaagttgggtggggaaggagaccctcagtgcctgtgtcttgcgatcaaggcagggtctcagctgttccagtctcagaagggc

SEQ ID NO: 2909 - DNA, 81 bp, Homo sapiens
tactaacacacaccattgcaagcccagtgggctccctggtggcggcctaagagtgtgtgtgtgtgtgtgtgtgtgtgtgtg

SEQ ID NO: 2910 - DNA, 72 bp, Homo sapiens
agcctgagtgcctctctgccccaaaaaggagatctcagtgagcactgtgggtgccaagtcagggctcaggct

SEQ ID NO: 2911 - DNA, 77 bp, Homo sapiens
cctggacccttgacctctctggctgcctgtgtggcttcgatggtcgcacaggcgtcaccaggtccctgccacacagg

SEQ ID NO: 2912 - DNA, 61 bp, Homo sapiens
acagaggagactccatcttctttttttttttttttttttttgagacggagtctcactctgt

SEQ ID NO: 2913 - DNA, 94 bp, Homo sapiens
atgatttggggactggcaaggatgatacacacttgccctcacttagactatagttcactgatgagagcattgttctgagccagtcttaagtcat

SEQ ID NO: 2914 - DNA, 86 bp, Homo sapiens
tgtggactgtccctgcctccctccgtgtctgcgacaaaggcgagtgtgtgtgaaggtagccaggctgggggtttgcatctggtcag

SEQ ID NO: 2915 - DNA, 117 bp, Homo sapiens
ccaaagtgctaggattacaggcgtgagccaccgcgcccagcacaaaagttctttttaattaaaaacatgatttacagctggacttggtggcttacgcctgtaatcccagcactttgg

SEQ ID NO: 2916 - DNA, 111 bp, Homo sapiens
gcaggccagggctcccctgggtgtctgatcagcctcgggtgatgccagctgctcagcctgtcactgcctgtctgctggtcagcagccccacgagtcatctgagcgcactgc

SEQ ID NO: 2917 - DNA, 58 bp, Homo sapiens; identical to SEQ ID NO: 1391

SEQ ID NO: 2918 - DNA, 56 bp, Homo sapiens; identical to SEQ ID NO: 1392

SEQ ID NO: 2919 - DNA, 123 bp, Homo sapiens
cctccgtgctggtgggacaccgggtggggaagagcaagggctctggatccaggtgccttctctgccactcactggctctgaggccccgggcagggcacttacgcttcatgatcctcaagttgc

SEQ ID NO: 2920 - DNA, 63 bp, Homo sapiens
tgagatgggagtctcactctgtctgttgctcattctggagtgcagtggcgtgatctccgctca

SEQ ID NO: 2921 - DNA, 58 bp, Homo sapiens; identical to SEQ ID NO: 884

SEQ ID NO: 2922 - DNA, 56 bp, Homo sapiens; identical to SEQ ID NO: 885

SEQ ID NO: 2923 - DNA, 93 bp, Homo sapiens
taggctgaggggaggtggcacagggtgtccactgcagctgcagcaaggtgtctgggggctgtgcctctctgtgtgtctgtgtgtctgtatgtg

SEQ ID NO: 2924 - DNA, 93 bp, Homo sapiens
gctgtgctgtggggcacgtccagcaggccactcctacacccagatttgactgtgtgtgcgctcagccactgtgcgtctctcccacccacatgc

SEQ ID NO: 2925 - DNA, 76 bp, Homo sapiens
ggaggtggggggacagagtctcactctgtcactcaggctggagtgcagtggtgcgatcttggctcactcaacctcc

SEQ ID NO: 2926 - DNA, 104 bp, Homo sapiens
tttccagaggttctaggtggcatagacaccactgtccgtgtgtctggctcccagctcctaagagagtgattctcacctgaagaagcagggcagcatcacatgga

SEQ ID NO: 2927 - DNA, 91 bp, Homo sapiens
cctaggctctgaccccatctttgtccctgactctctgggtgattcatcctttccccgatctgggctgtgggaagcagattgggagtgtggg

SEQ ID NO: 2928 - DNA, 83 bp, Homo sapiens
ctctgtcagtccctcactctgtctacctatgcttccttgggcgtacatttttgtggctgatagaagggatcaagaagtcagag

SEQ ID NO: 2929 - DNA, 79 bp, Homo sapiens
cttctaacagcaactgcaactgtcaagcgtttcatgtggggtgtacctcgagagagctgcatctgcggactgatggggg

SEQ ID NO: 2930 - DNA, 97 bp, Homo sapiens
gtatctttatttctggcttgacagttttcttgtttttattcattaaaatttttttcttgtggggaagggagaatggggagttggtgtttatgggtac

SEQ ID NO: 2931 - DNA, 89 bp, Homo sapiens
gagaataaaatccttttaaatatatgtgtgtatatatatatatatatatatatatatatatatatatatataaaataattattattttt

SEQ ID NO: 2932 - DNA, 69 bp, Homo sapiens
gagctgctctgaatgcaggagcctccctcttaactcatccccgtggctctctgatactcagactgtctc

SEQ ID NO: 2933 - DNA, 66 bp, Homo sapiens
gaggaggaagtgagccaagcactaagcctgtgattgcatcaggactgacgcactctctgccttttc

SEQ ID NO: 2934 - DNA, 72 bp, Homo sapiens
ctactgaaggatgtttagattctgtctctgttttttttttttttgaaacagagtttctctcatctagggtag

SEQ ID NO: 2935 - DNA, 94 bp, Homo sapiens
acagagtgagaccctatctcaaaaaaaaaaaaaaaattcggctcctccttttttttttttttttttttttttttgagacagagtctcgctctgt

SEQ ID NO: 2936 - DNA, 71 bp, Homo sapiens
gttgttgttgagacagtctcactctgttactcaggctgcagtgcagtggcacgatctcaattcactacaac

SEQ ID NO: 2937 - DNA, 85 bp, Homo sapiens
tgacagtttttttttttttttttgagactgagtctcactctgtcgcccagcctggagtgcagtggtgcgatctcggctcactgca

SEQ ID NO: 2938 - DNA, 68 bp, Homo sapiens
gggtctgcagaccatactttgagaaatgctgttttttttttttgagacagggtctcactctgtcaccc

SEQ ID NO: 2939 - DNA, 87 bp, Homo sapiens
tgatgtcttatccaagtgggagcagctggtagtaaggaagtctgggttctggtgcctgctctgccactgtctcactatatgatctca

SEQ ID NO: 2940 - DNA, 110 bp, Homo sapiens
gcttgcttctccccagcagaaaaccctccagtgactctgttggccataactttttttttgtttatttgcctgttttagcagtggaaattttttgtctgatgaaatcaagc

SEQ ID NO: 2941 - DNA, 58 bp, Homo sapiens; identical to SEQ ID NO: 715

SEQ ID NO: 2942 - DNA, 129 bp, Homo sapiens
gggcagaactgggctcacccagctctcgccttttctggctgtgtcacttgggtgagctcctgagcctctctgtgcctcggtttccctgttgattaggtcaggccaaggattaaatgatggcaaagtcgt

SEQ ID NO: 2943 - DNA, 56 bp, Homo sapiens
tgagacggtctcactctgtcacccaggctggagtgcggtggcatgatcccagctca

SEQ ID NO: 2944 - DNA, 77 bp, Homo sapiens
ttcccgctagactgtgagctctgagcagacaaacatgaacatacgttgccctcaagcaggtcacagtctactgggga

SEQ ID NO: 2945 - DNA, 57 bp, Homo sapiens
tgagacagagtctcgctctgtcacccaggctggagtgcagtggcggatcttggctca

SEQ ID NO: 2946 - DNA, 93 bp, Homo sapiens
aaaaaaagtatttttataaggataccagtcatattggattaggggttcactctatgccagtatgacttttttttttttttttttttttttttt

SEQ ID NO: 2947 - DNA, 115 bp, Homo sapiens
gttacataggggtataatctgtttaaataagctttatttatgccaaggattttttttttaatatcaagacttggttagaccaaagtttgctcttgcaggaatgccatttatcagc

SEQ ID NO: 2948 - DNA, 57 bp, Homo sapiens
tgagaccagtctcgctctgtcacccaggctggagtgcagtggcatgatctcggctca

SEQ ID NO: 2949 - DNA, 88 bp, Homo sapiens
gattagtctagctgtgtctgacagctgacagtgtggaaattagaattctttcctcccacagaggctggaagacagacaaaggcccatc

SEQ ID NO: 2950 - DNA, 57 bp, Homo sapiens
gagacagtctcgctctgtcacccaggctggagtgctggagtgcagtggcacaatctc

SEQ ID NO: 2951 - DNA, 100 bp, Homo sapiens
atatattttatatatataaaatttatatgtatatataaattatatatattacacacaatataaatatatacacatgtagttttacatatataatttatat

SEQ ID NO: 2952 - DNA, 99 bp, Homo sapiens
tgccttgctgtatgcaatctgggcacatgtgtgtctgtctccctgagtagactggggctcctgagaggtgagtggcccaggcctagcacacagcaggca

SEQ ID NO: 2953 - DNA, 66 bp, Homo sapiens
tgtgctagcctctgtgtgtctgtgagggtgtctctgaatgttccagagtgcacaggagtgtgtaca

SEQ ID NO: 2954 - DNA, 117 bp, Homo sapiens
ctaagcgtctgtgtgtattcttttcttatattggtgaatgtctgtgcatctggaaatgtatgcatttgtgtatgtgtgtctgtgtgtctctgtataagtgagtatatgcttgggtgt

SEQ ID NO: 2955 - DNA, 97 bp, Homo sapiens
tacatctgtgtgcctaagacgctgggcaactgtacccacatgaccgatgtgtgtgaacgactgtgtgcctgtgtgtctggatctgcgcgtgggtgta

SEQ ID NO: 2956 - DNA, 110 bp, Homo sapiens
tgggcaacagagagagaccttgtctcaaaaataaaataaaataaatcttaaagactttactaccattttttttttaatttttctgagactgagtctccctctatcaccca

SEQ ID NO: 2957 - DNA, 99 bp, Homo sapiens
caggcctggcatgtcataagtgacagtcactgttttatttatttattttaatttaattttattttttgagacagggcttcactctgtctcccaggctcg

SEQ ID NO: 2958 - DNA, 99 bp, Homo sapiens
tatgtcatctgtctttttctctctggaagttctttttgtttgtttgtttgtttttgagacagtctcgccctgttgcccaggctggagtgcagtggcgta

SEQ ID NO: 2959 - DNA, 114 bp, Homo sapiens
cctgttggcagtagggagccaagagttagagaattgttagagtgattgggtctttattcacactggcactgttctagaggttgtttgacttggacttaagggctactggagagg

SEQ ID NO: 2960 - DNA, 102 bp, Homo sapiens
gcttgactgcaagttctgtagaagtggagagttttcttttcttttctttttttttttttgagatggggtcttgctctgtcacccagtctagagtgcagtggc

SEQ ID NO: 2961 - DNA, 112 bp, Homo sapiens
gcctccactagttgctatctgttctagacaagttacttcatacgtaagcctcatttctcaatttgtaaatgaaaataacttacctggttactgtggttaccatgtgtcaggt

SEQ ID NO: 2962 - DNA, 110 bp, Homo sapiens
atatacatatacatatacatacatgtgtgtgtgcatatatatgtatatgtgtgtatatatatatatatatatatatacacacatatatgtatgtgtgtgtgtgtatatat

SEQ ID NO: 2963 - DNA, 62 bp, Homo sapiens
gatcagagaagagggatctgggtcaggctgtgccctatagccctggctctctcactgtctgg

SEQ ID NO: 2964 - DNA, 120 bp, Homo sapiens
tatgtgtatatatatatatgtgtatgtgtgtatgtatatatatacgtatatatgtgtatatatatatacgtatatatatacatatatatatatatatatatatatatatatatatatatg

SEQ ID NO: 2965 - DNA, 82 bp, Homo sapiens
tgcatcctctctcacacagtgaccctggcccagcccccttgctgagcgctgccctgaggtattgtgtgtcccctggacagca

SEQ ID NO: 2966 - DNA, 70 bp, Homo sapiens
gcaggcactggggactcagtctgtgtctccatccctggggaaggagaccagctgaggcacctgtgcatgt

SEQ ID NO: 2967 - DNA, 114 bp, Homo sapiens
gctggtactctataaatgattgatgaattgctccttgtgtgagagggtgacagaaatgtgtttgaactcatgcatcaataaggttgtggttcaaaaagaaatttcatgaaaggc

SEQ ID NO: 2968 - DNA, 125 bp, Homo sapiens
gtctgtttgcctgcctatcttcctgtctgtccgcctgcctgtgtgtctgcctgtctgtctgcatgtgtgctcaaacacggctcattcagttcctggtttctttggaaatgcagagacttttgcag

SEQ ID NO: 2969 - DNA, 99 bp, Homo sapiens
gtaaagaaattagccaggagtggtggtgtatgcctgtagtcttagctattcagaaggctgaggtaggaggttcacttgagcccaggatttggaggttac

SEQ ID NO: 2970 - DNA, 107 bp, Homo sapiens
gccaggttgatttttccagctatgagatgtggattacgtttgttatttttatatacagatatcttggtccacaaagtctctcctatcagtgagaggttgagttgagt

SEQ ID NO: 2971 - DNA, 93 bp, Homo sapiens
gtgtaatttgcacctgcgtctgtcactgtgactaagtatattttacaaccgagattcttgttcctgagggaggtaaccatgtggatacagcac

SEQ ID NO: 2972 - DNA, 78 bp, Homo sapiens
tccaagtcagacaggtctgtccctttctctctggcccaggctgtacaggtcagaaggaggacagtgggtcatcttggg

SEQ ID NO: 2973 - DNA, 100 bp, Homo sapiens
tggtaggaaagcctttgcagaatcatccctgtcaggatcacacacaccaacttcagggactgtggctctgacagcccatgatggtgtctaccgaacaggc

SEQ ID NO: 2974 - DNA, 95 bp, Homo sapiens; identical to SEQ ID NO: 68

SEQ ID NO: 2975 - DNA, 93 bp, Homo sapiens; identical to SEQ ID NO: 69

SEQ ID NO: 2976 - DNA, 109 bp, Homo sapiens
taagtttgaggtgcccctggggtgatggcatcttaagtttgaggtgcccctgggatgccagaggtagaaggatgtaaggatctaaagttttggggaggagtaaaggttg

SEQ ID NO: 2977 - DNA, 114 bp, Homo sapiens
caaaggcagtcccatctgactccaaagccactgtgctggctggctccttagatgaatgaatgaatgaatgaatgagtgagtgagtgtgtatgcttcagatggtgaagaaaggtg

SEQ ID NO: 2978 - DNA, 112 bp, Homo sapiens
tggagctaatcagaagtcaatatggtagatttgtattcatgaaactttttattttgaaataataatagattcacaggagaggttccatgtacccttctcccagtttcctcca

SEQ ID NO: 2979 - DNA, 78 bp, Homo sapiens
gaaccagagaggctgagatgtaggaaagaggggcccccaaagaatcttctagctctcgctctttgtcactctctgttc

SEQ ID NO: 2980 - DNA, 79 bp, Homo sapiens
gagtcagggtctcactctgtcacccaggctggagtgcgatggcatgatcactcctgggctcaagtgaatctcccacctc

SEQ ID NO: 2981 - DNA, 66 bp, Homo sapiens
attctaaagtctgtgctcagagaatgcaccgcctagtgcttctcagactctcacaggcacaggaat

SEQ ID NO: 2982 - DNA, 108 bp, Homo sapiens
ggcattcatttgtagtgcctcagcagctaactctgtctcttgctcactgagtctccatgggcaagttgggctgggttgtctcactagcttctcactaaaataagtgcc

SEQ ID NO: 2983 - DNA, 122 bp, Homo sapiens
tggcacaaaaaagggatgtcacttctgagatgaggttactcaagatggagagttcggcctcactcactccctcacgccagctcttctcacttggtggccactgtcacgttgagagcagccct

SEQ ID NO: 2984 - DNA, 118 bp, Homo sapiens
agactgagggtcagaaaatgccagactgagtgggcttcctctgttgggtgagaagacagaagacactgtgctattcctccagtcctgggttagcacaccagctcaccttcttcttact

SEQ ID NO: 2985 - DNA, 103 bp, Homo sapiens
tgggtgtaactccagctgggttaaggcagacaactctgacagtgaaggccaccttctcagaaaagagagtgcaccaatgccacattcaccttgtgttgctcca

SEQ ID NO: 2986 - DNA, 91 bp, Homo sapiens
gagcattgggctggaaatgtgtgaaattgatgcaaacttagaaaactaggatttgggtttctctctcttcctctcagcatgctttttgctc

SEQ ID NO: 2987 - DNA, 65 bp, Homo sapiens
tgggtccagaattccctggggatctatgaggacttcctgatttgtctcccactctgtgtttccca

SEQ ID NO: 2988 - DNA, 111 bp, Homo sapiens
cttctagagtttctgagtcagtaggtctagtgtgggcctgataatttatttgtatttctgacaagttcccaggtgatgctgatgctgctggtccagggaccacactttaag

SEQ ID NO: 2989 - DNA, 71 bp, Homo sapiens
cctaccacctgggcatttatctgagcatttgtgtctttcacactgaatgtctgagtgtgtcattctgtagg

SEQ ID NO: 2990 - DNA, 66 bp, Homo sapiens
ttccttcagtgctactgtgggtggtgaacagaaggcatcacagaagtcacagaggtgtttgaggaa

SEQ ID NO: 2991 - DNA, 95 bp, Homo sapiens; identical to SEQ ID NO: 68

SEQ ID NO: 2992 - DNA, 93 bp, Homo sapiens; identical to SEQ ID NO: 69

SEQ ID NO: 2993 - DNA, 59 bp, Homo sapiens
cacccacacactgtctctcaatctgtcttttccacagctccagtgacagtcaacgggtg

SEQ ID NO: 2994 - DNA, 60 bp, Homo sapiens
gttgtagggtctgtctgtctgtctgcattgtttccagaaaaaggatattggccctgcagc

SEQ ID NO: 2995 - DNA, 67 bp, Homo sapiens
ggaagtggacgaggtccagccaacacccccaactgctgtgtgtgtctgtccctcagtgctcacctcc

SEQ ID NO: 2996 - DNA, 64 bp, Homo sapiens
ctggcagccactcccagagcccctggaactctggcccaaggctctctgactgactgcttcccag

SEQ ID NO: 2997 - DNA, 112 bp, Homo sapiens
tgaggactgtgcttctggtcatcccatcagctcctcgacttccttggtctcctttgaggcagacatgtgagagagctcactgaggcagtggcttgagaagcatgcagcctgg

SEQ ID NO: 2998 - DNA, 84 bp, Homo sapiens
gggatttgagcccacagagtctgatgacagagtccacaccaacaactgctttaatcaagagagtttgtgacttgcctaggtctc

SEQ ID NO: 2999 - DNA, 162 bp, Homo sapiens
gtatatatgtatatgtatacatatatacttacgtatatacatacatatatacgtatgtaagtatatatattacatatatatacgtatgtaagtatatatattacatatatatacgtatgtaagtatatatgtatacatatatacatatagatatgtatatat

SEQ ID NO: 3000 - DNA, 74 bp, Homo sapiens
gtggtaagtgctaagtgctctctctctatatatatacatatgtatatatgtatatagggtttggtatgattcat

SEQ ID NO: 3001 - DNA, 108 bp, Homo sapiens
tgggagacagagcgagactccatctcaaaacaaaacaaacaaaaaccaagtctttttctcttttttttttttttttttttttgagacaagatctcgctctgtcactca

SEQ ID NO: 3002 - DNA, 111 bp, Homo sapiens
gggtgacatagttcatcacttattttcatagatttcatattgtctttttgtacttctgtactggaaccaattgcatgctgactgaatactgatgaagatggtgaaacgctt

SEQ ID NO: 3003 - DNA, 133 bp, Homo sapiens
cgctttgccaagggaggctattgacgatgctgcaagatctgctatccgctctgtggttttgtcaccctctctgcctgtgttgtggcctgtgttggcttggtgtggatgcaggttgctctcaaggaggatctgg

SEQ ID NO: 3004 - DNA, 87 bp, Homo sapiens
agctcggactacagaggtgtgcaccgccacctctggctaatttctatttttttagtagagatggggtttcaccatgttgcccgggct

SEQ ID NO: 3005 - DNA, 93 bp, Homo sapiens
ggctgggattacaggggtgaaccaccacacctggcctgcaaaatttttttttaaatttgccagatatggtagtgagcacctgcggtcccagct

SEQ ID NO: 3006 - DNA, 58 bp, Homo sapiens; identical to SEQ ID NO: 2051

SEQ ID NO: 3007 - DNA, 58 bp, Homo sapiens; identical to SEQ ID NO: 1763

SEQ ID NO: 3008 - DNA, 81 bp, Homo sapiens
ggcagcctcctcttccttgatagttatagaaattgttattattattattattattttgagatggagtcttgcaatgttgcc

SEQ ID NO: 3009 - DNA, 77 bp, Homo sapiens
tgggttttccatgtccatctttcatggctggataattgcaatccagctttggcagagattgttgactggctccccca

SEQ ID NO: 3010 - DNA, 112 bp, Homo sapiens
gattttttgtatgttgattttgtatcctgaaactttactgaatttgtttatcagttctaacagtttttttggtgtagtgtttgggatcttccaaatatcagatcataacatc

SEQ ID NO: 3011 - DNA, 78 bp, Homo sapiens
ggtttccacttgaactgtctggtaaactactatagagtgagtggtttggtgggattagggttggagtggtaaggagcc

SEQ ID NO: 3012 - DNA, 100 bp, Homo sapiens
gagccaggcctttgtgctcgtagtccagcactttctcctctcctcgtgactgatgagagagggctcagagtgcttgggaatctgagcatgggaatagctt

SEQ ID NO: 3013 - DNA, 94 bp, Homo sapiens
actctgtggagtgggatattcgggcccttaatgttcttctgaaaagaaaatgggagtacagagatatttgaaatcccttctgttgttctagagt

SEQ ID NO: 3014 - DNA, 58 bp, Homo sapiens
tgagatggagtctcactctgtcacccaggctggggtgcagtggtgcaatctccactca

SEQ ID NO: 3015 - DNA, 125 bp, Homo sapiens
tattgctaacaattgctgagttttatttatgtacctgggagtaggctaagccctttgcatgaatattttatttaatactcacaatcctgttaagaggtactgtcatttccattttatagatgaag

SEQ ID NO: 3016 - DNA, 115 bp, Homo sapiens
attcactcaggcccagttcactcagcagacgtgtgtggagggcctggctcactctgtgccagtcccttgtgtgcgtccctaccacatgctaggtgctgggttcatgggacagaat

SEQ ID NO: 3017 - DNA, 111 bp, Homo sapiens
ccgtgtctccctctttggctgtgggtgtctgcttgggtccctctgtccctgcctgttccctgtgccccatctgtcaggttggaggagctgagcagatgcctgggaacaggg

SEQ ID NO: 3018 - DNA, 88 bp, Homo sapiens
tcccaggcaagtctctctctctgtctggccagcttctgtctccaactccctcagagcctggcttggcttggaagttttcagcccagga

SEQ ID NO: 3019 - DNA, 123 bp, Homo sapiens
actgcactccagtctgggcgacagagcgagactctgtctcaaaataaataaataaataaataaataaatacaaattccaatgggtcagggagtcttgtctgctcactgctctagtatagtagt

SEQ ID NO: 3020 - DNA, 56 bp, Homo sapiens
cagtgtctcactctgtcacctaggctggagtgcagtggcaggatcatggctcactg

SEQ ID NO: 3021 - DNA, 80 bp, Homo sapiens
gaagtaatagttttactgctttggattgttgagaggatcatcagtgcatacatattaattctcagcaatcccagcacttc

SEQ ID NO: 3022 - DNA, 92 bp, Homo sapiens
tatatatgtgtatgtatatatgtgtgtacatatgtgtgtgtgtgtgtatatatatatatatatatatatatatatatatatatatatattca

SEQ ID NO: 3023 - DNA, 84 bp, Homo sapiens
ggggtaggaatggacagagaagggtgtgtctcatggttcaatatgtagacttccagtggctcgctctctctcttaaggctcccc

SEQ ID NO: 3024 - DNA, 109 bp, Homo sapiens
tagagtcaacaggtaaggattagaaacagtggatttctgtatatttaagtgcatataatttatttatgtatcatattgttctctaaattcatccaacatgtaggctttg

SEQ ID NO: 3025 - DNA, 92 bp, Homo sapiens
gtcttacactcaaatgccaatgagcagagggattttttttttttttttttgagacgtagtctcgctctgtcgcccaggctggagtgtagtgc

SEQ ID NO: 3026 - DNA, 73 bp, Homo sapiens
gcacacctgtagtctcagctactctggaggctgaggtggaaggatcgattgagctgggaggtcaaggctgtgc

SEQ ID NO: 3027 - DNA, 66 bp, Homo sapiens
caggatatatatatatattttgccaaaattgtagcaaaaattgtatatgtgtatgtatatatcctg

SEQ ID NO: 3028 - DNA, 84 bp, Homo sapiens
aggcaggaacagcaactggagctggacagggtacaggaccaccaaggtcacaatggatcctaggctccatgctactccaggtct

SEQ ID NO: 3029 - DNA, 84 bp, Homo sapiens
ctcatctgtcagcctgtgagctgtcccctcccaaggctaaggtgggacaaagacagagagagacagagacagagagacagagag

SEQ ID NO: 3030 - DNA, 127 bp, Homo sapiens
ctaaattgttggagttcttttgttctgagtcagggtctcactctgttgcccaggctgaactacagtagtgtgatcatagctcactacagcctccaactcctgggcccaaactatcctcctgcttcag

SEQ ID NO: 3031 - DNA, 120 bp, Homo sapiens
gccttactctccctccatggcactacatcagagtggttaggagctcggggttctttttttttttttgagacagggtctcactctgccacccaggctggagtgcagtggtgcaatcacggc

SEQ ID NO: 3032 - DNA, 86 bp, Homo sapiens; identical to SEQ ID NO: 2169

SEQ ID NO: 3033 - DNA, 88 bp, Homo sapiens
tccagctcccagattctgagctcctctttggctttggggcagtccttatctgcacagtagatagagagctcagctcgtgggcactgga

SEQ ID NO: 3034 - DNA, 118 bp, Homo sapiens
ctggttgtcatggtgagggctaggggccagaatgcagctgctacagtcaggctaccaggcctaagtgaacagagagtgctcagggaccccccagcccagcttcctcagagttgaccag

SEQ ID NO: 3035 - DNA, 99 bp, Homo sapiens
gcttagggagcagggccggcatctgtgggaagcttcatctaaggaaacatttttctttttttttttttttgagacggagtctcgctctgtcaccccggc

SEQ ID NO: 3036 - DNA, 73 bp, Homo sapiens
ggcgtgagcaactgcgcctggctttttttttttttttttttttgagacagagtctggctgtgttgcccaggct

SEQ ID NO: 3037 - DNA, 104 bp, Homo sapiens
caaaccacttataagcaacattagcagcttgccacaatcagcattctatttttgtttttagagatggggtcttactgtcacccaggctggaatgcagtggcatg

SEQ ID NO: 3038 - DNA, 116 bp, Homo sapiens
gcactccagcctgggcaataagagtgaaactccatctcaaaagaaaaaaaaaaaagaagacttttttttttttttttttgagacagagtcttgctctgtcacccaggctggagtgc

SEQ ID NO: 3039 - DNA, 69 bp, Homo sapiens
gttgctcacctcagggctggggttcagctggatggggctggctctcctctctgtctctgtggtagtctc

SEQ ID NO: 3040 - DNA, 58 bp, Homo sapiens
tgagacagagtctcactctgtcacccaggctggagtgcagtggtgtgatctgggctca

SEQ ID NO: 3041 - DNA, 56 bp, Homo sapiens
gagacagagtctcactctgtcacccaggctggagtgcagtggtgtgatctgggctc

SEQ ID NO: 3042 - DNA, 83 bp, Homo sapiens
ggcagtctgtgtgagtctcagtctctattgtccatggagacccatccccagcaggaccagggcaggtgaggcccctggctgtt

SEQ ID NO: 3043 - DNA, 64 bp, Homo sapiens
gagaccggatctcactctgtcactcaggctggaatgcagtcagtggcaggtgtgatcatggctc

SEQ ID NO: 3044 - DNA, 76 bp, Homo sapiens
ctgcttctcctcttagggccttcgcatccccatcagtaaaacgggcctaagaacacctgagagaggacagaaagca

SEQ ID NO: 3045 - DNA, 70 bp, Homo sapiens
ggggccagcgtgcttgtcctccacagcacagagaaagccactctgcttctgtctgactcacagctgccct

SEQ ID NO: 3046 - DNA, 98 bp, Homo sapiens
ccatatatatattctaaaatgtatatggaatatacattatatatatattctaaaatgtatatggaatatacatcatatatattctaaaatgtatatgg

SEQ ID NO: 3047 - DNA, 92 bp, Homo sapiens
catatatattctaaaatgtatatggaatatacatcatatatattctaaaatgtatatggaatatacatcatatgtattctaaaatgtatatg

SEQ ID NO: 3048 - DNA, 70 bp, Homo sapiens
ttgttttgagactgagtctcgctctgtcacctaggctggagtacagtggcgcaatcttggctcagcacaa

SEQ ID NO: 3049 - DNA, 116 bp, Homo sapiens
gtatatgtatgcagcatcatatgtgtattttgtcagtgtcgggtgtacgtgcgtcagtactgtttgtgtagatttttgtcaaagtaggttcatatgtgtgtcagtgatgggtgtat

SEQ ID NO: 3050 - DNA, 98 bp, Homo sapiens
taaccttctctgagcctcagtttccacagctataaaatgggctgccactctcccagtttgcctcagggttgttgtggggatttattgagaaaaagttg

SEQ ID NO: 3051 - DNA, 89 bp, Homo sapiens
aggtgcccagagtaaattcataggcttgtaaatatgtgtgagatcagaggatttatgagtatttatgtttcttatttcagagggcattt

SEQ ID NO: 3052 - DNA, 90 bp, Homo sapiens
tcattaatattctggattccttcaactctgtggctctgtgtcattcacagcaggaacatgggggctcgtgacagactccagtcccaatgg

SEQ ID NO: 3053 - DNA, 102 bp, Homo sapiens
tggtttttggtttttggtttttttttgagaccgagtctccctctgtcacccaggttggagtgcagtggcgtgatctcggctcactgcaacctccgcctccca

SEQ ID NO: 3054 - DNA, 75 bp, Homo sapiens
gggtatgtgtgtaggtttgttacataggtaaactcctgtcatggggggtttgttgtacagatcatttcatcaccc

SEQ ID NO: 3055 - DNA, 76 bp, Homo sapiens
acttaggcaagtgacttagctgtgcctcaatctttttatttgtaaaatggggcttgtgatggtgcctgcctcctgt

SEQ ID NO: 3056 - DNA, 75 bp, Homo sapiens
gcctgggcaacatggggaaaccccatttctttttttttttttttttgagatggagtctcactctgtcacccaggc

SEQ ID NO: 3057 - DNA, 123 bp, Homo sapiens
ccagtggcctggctgcagcagacacccacactgtcactctgtgagtaagggtcattggggatgcctaacctcggaagcataacaaaggcccatggggtggatggactgtctctgagtccctgc

SEQ ID NO: 3058 - DNA, 69 bp, Homo sapiens
gtggttctgggtttgagtgatgtgcggggcctcccagagagggcctgtgactcagtgcctgtgttccac

SEQ ID NO: 3059 - DNA, 119 bp, Homo sapiens
ggctgggcctgagagtaccactttgcctcttgttggatgtacatactgttttatttctatttagatatggagtattgttctgtcacccaggctggagtgcagtggtgctataacagctc

SEQ ID NO: 3060 - DNA, 66 bp, Homo sapiens
cctgcccagtgccatggagtataggggggccagctccctctctctgtgtttgtcattgagctctgg

SEQ ID NO: 3061 - DNA, 66 bp, Homo sapiens; identical to SEQ ID NO: 474

SEQ ID NO: 3062 - DNA, 108 bp, Homo sapiens
ggtgcagttgcagagtgaccacacatgggcataatatatttttttttaggtggtggaaacgttcagagattaaatgtggtgatggttgtgcaactctgtcaatacact

SEQ ID NO: 3063 - DNA, 72 bp, Homo sapiens
aggcctggcagaatagacagtgcattttgactctgtgtgcccagggtccagtgactttcactctctgggtct

SEQ ID NO: 3064 - DNA, 98 bp, Homo sapiens
tctgtcttctctgctggactggaagttacaccagggcgagagccatgtctctcactcactgccatccctctaatgcccggcccagacactggtacaga

SEQ ID NO: 3065 - DNA, 63 bp, Homo sapiens
acacagggcactcacatagcctgtgggtctggaggctggaggactgtgtgtgtgtgtgtgtgt

SEQ ID NO: 3066 - DNA, 104 bp, Homo sapiens
cctggccgacctcatctatcttttaaccccaatagctgcctctgtgcctggctctgtgcaatgacgaagagagagtgagaggtgaaaagagataggaaatcagg

SEQ ID NO: 3067 - DNA, 105 bp, Homo sapiens
gtcctgagggtttctgtcacttttctgtgtactctgtgatgcatttcaaactctgagagagagagagactgacagacagacagagggacagacagacagagggac

SEQ ID NO: 3068 - DNA, 107 bp, Homo sapiens
attataggaaaatgggaagaatagtatatgaacacttgataccctcctacctatattcacaaattgttaatgtgttgtgacatttgctttctcttactttctataat

SEQ ID NO: 3069 - DNA, 71 bp, Homo sapiens
ctgggtccctccctgattccctgctgccagttctctcctctgggggaatgggggcagggtgggtcttccag

SEQ ID NO: 3070 - DNA, 61 bp, Homo sapiens
gcggctcacaccagtaatctcagcactttggaatgccaaggtggaagaatcacttgagccc

SEQ ID NO: 3071 - DNA, 73 bp, Homo sapiens
aaagcacatctgtgtgtgcacacatgtatacacacatatgcatgtatctgtgagcacatacacatgtaccttt

SEQ ID NO: 3072 - DNA, 61 bp, Homo sapiens
gggcgggaggaaggggcttggccccgcgcaagcgccggccctgaccgtctgtctctcgctc

SEQ ID NO: 3073 - DNA, 87 bp, Homo sapiens
gctgaaattggatcccacgtctaatgggcagctccgcctgctgcatatgggggccctgaccgaagagactgtggttactaatgtggt

SEQ ID NO: 3074 - DNA, 67 bp, Homo sapiens
ctctccctctgtctctgccacgtggggacacagcaagaaggcagccatctaccagccaggaggagag

SEQ ID NO: 3075 - DNA, 85 bp, Homo sapiens
gggaggtcatttgcctgaagttacacagctcagctggtttgtatctgacacagtctggctttgagcttaggtttatctggctcct

SEQ ID NO: 3076 - DNA, 73 bp, Homo sapiens
tgttacatgggagaggaatgaggtttgtgctgttgcatgaacatgtgtgcctctgtgtgtgtccctgtgtgca

SEQ ID NO: 3077 - DNA, 95 bp, Homo sapiens
gaagaggctgtagtgcaagtgaggttgtcgacgccacctctgtctccatcagtgtgtgtggctctgaggtggatcctgattggtttagccaattc

SEQ ID NO: 3078 - DNA, 68 bp, Homo sapiens
gagggatctgagaagagggaccaggccccccggttcccaggccctgactctcccactgtttgtccttc

SEQ ID NO: 3079 - DNA, 58 bp, Homo sapiens
tgagacagggtctcactctgtcacccaggctggagtgcagtggtgcagtcttggctca

SEQ ID NO: 3080 - DNA, 70 bp, Homo sapiens
tctacctctgtctgtgacactggcttttccacaccgtgttgcactggtttgtaagctccagaagggtagg

SEQ ID NO: 3081 - DNA, 84 bp, Homo sapiens
ggggtgggtgattgtttgggaagtcataatcagtttgggttttcttttttttttgagatggagtctcactctgtcacccaggct

SEQ ID NO: 3082 - DNA, 100 bp, Homo sapiens
gctgtcttgggctacggggtgcatggctgagacagattatttctttttttttttttttttgagacggagtcttgctctgtcacccaggctggagtgcggt

SEQ ID NO: 3083 - DNA, 107 bp, Homo sapiens
ccagcagcagataaattattgacttcaggaatattcctcagtggatggttttccactgttacactctctctgatacagggcatttatgctgcctgagacccggctgg

SEQ ID NO: 3084 - DNA, 89 bp, Homo sapiens
gtgtgtgtatatgtatgtgtgtgccctctgtgtgtatgtgtctgtgtgtgtatgtgtctgtaagtgtgtgtatgtgcgtgtatatgtgt

SEQ ID NO: 3085 - DNA, 58 bp, Homo sapiens
tgagacagggtctcactctgtcacccaggctggagtgcggtagtgtgatcttgcctca

SEQ ID NO: 3086 - DNA, 76 bp, Homo sapiens
tgtttctgtatctcactctggggctctcactctgtcttctgggaggctggaagtgctgggtttggtgcatgaagca

SEQ ID NO: 3087 - DNA, 67 bp, Homo sapiens
gagagtaaaaaggaagtctgggaggtacgtgggcatccctctctgtgtctctggatttctgggtctc

SEQ ID NO: 3088 - DNA, 103 bp, Homo sapiens
tctgggtgaaaatttcaagagaattctgagtaaatgatggaagggcaattgtgggtttttttttttttttttttttggacacagttttactctgtcacccagg

SEQ ID NO: 3089 - DNA, 122 bp, Homo sapiens
ccatcacactctgaactaagctcaaggccgggtgaggccttggtggaggctgaggtggaaggatcacttgagcccaggagttcaagaccagcctgggcaacatggtgaaaccttgtctctac

SEQ ID NO: 3090 - DNA, 116 bp, Homo sapiens
cctaatggcccatgcactcggacaaagcttcagatgattttcaaaagcaatgcaaagtatagaactttgcaaggactttgggatctagaggatgtcttttgagaaggcctggcagc

SEQ ID NO: 3091 - DNA, 105 bp, Homo sapiens
gccccttctgtgcctccttctgtgccttggtaggggtcttggttttttttttttttttttgagacaaagtctcgctctgtcacccaggctggagtgcagtggtgc

SEQ ID NO: 3092 - DNA, 134 bp, Homo sapiens
aggcaacataaatccttcttagagatagataccctcattcttgtcctgttcactcctgcaaataataattttttttttttttgagatggagatttgcttgttgcctaggctggagtgcaatggtatgcaatctt

SEQ ID NO: 3093 - DNA, 115 bp, Homo sapiens
ggggtctttcacagagcaaaagtttgtaattttgatgaagtccaattatgtatatattttttcttttatggttcttgcttttggcatcatgtctgagaacttttccctgagccct

SEQ ID NO: 3094 - DNA, 93 bp, Homo sapiens
gagtttaatttaggttacattgcggtcgaggcttctgagggatgctaggtagagatgtccaggaggtagttggttgtaatgaacatgaaactt

SEQ ID NO: 3095 - DNA, 68 bp, Homo sapiens
ggctagtgaggacagaggacaggaaatctggacagccagattcctgtcccagtctgtgtcactcagtc

SEQ ID NO: 3096 - DNA, 67 bp, Homo sapiens
tttggtggggggtgaaatgacttttttttttttttaatttgagacagagtctcactctgtcaccagg

SEQ ID NO: 3097 - DNA, 71 bp, Homo sapiens
tacctggaaggttttcagtgaagtttgaatgcagagcagccgagtcttccctgtaaggagacccatgggtg

SEQ ID NO: 3098 - DNA, 107 bp, Homo sapiens
gtatacgatatatatgtgtgtgtgtgtatatatgtgtgtatatacatatgtgtgtgtgtgtgtgtgtatatatatatatatatatatatatatatatatatatatat

SEQ ID NO: 3099 - DNA, 80 bp, Homo sapiens
tgagactgagtatcactctgtcacccaggctggagtgcagtggtgccatcttggctcactacaacctccatctcttgggt

SEQ ID NO: 3100 - DNA, 160 bp, Homo sapiens
ggatttcataacagataaatgctataaaataacatataagggaaacttacaccaacaaaatggtttcttttaatttttattatttatttatttatttatttttgagatggagtctcgctctgtcacccaggctggagtgcagtggtgcgatctcagctca

SEQ ID NO: 3101 - DNA, 119 bp, Homo sapiens
ctgagatcatactggcacctccaattccagtccagtgtggggtttccttttcttttttttttttttttgagacagtctcactctgtcggccaggctggagtgcagtggcgtgatctcag

SEQ ID NO: 3102 - DNA, 80 bp, Homo sapiens
gcatctgcagctcacagcctccctgtctcagcagctcttgtccatgctcgtgagagggagggagcctctcctgccagtgc

SEQ ID NO: 3103 - DNA, 84 bp, Homo sapiens
gagactcactctgtcactcaggctggagtgcagtggcaccatcggctcactgtagcctcagcctcccgggttcaagtgattctc

SEQ ID NO: 3104 - DNA, 114 bp, Homo sapiens
caggatgcagctgtgtttctgcactgggagtccagacacctggggtctggcagagagcagcctgacactcactgactgtaagcccttaggcaaaccacttccttccagccctca

SEQ ID NO: 3105 - DNA, 122 bp, Homo sapiens
tttgacagctgagggctaaaatcatctggggacattgtcacacacatcatcaggtgtttgacactggctgttgatgttgacaccggtgctgttgaggtatggaatgtaactgagatctgacc

SEQ ID NO: 3106 - DNA, 80 bp, Homo sapiens; identical to SEQ ID NO: 3102

SEQ ID NO: 3107 - DNA, 118 bp, Homo sapiens
gtggagctttgatgtgaacccctgtctgtgtgactgcaaagcaggtgctctttttttttttttttttccccagacggagtcttgctctgtcacccaggcttgagtgcagtggcaccat

SEQ ID NO: 3108 - DNA, 61 bp, Homo sapiens
cggagtctcgctcactcagtgctccatgttgcccaggctggagtgcagtggcgtgatctcg

SEQ ID NO: 3109 - DNA, 70 bp, Homo sapiens
tgggactcactttctctgtctgctcaattatgtggctaatctggatcagagattttcaaagtgtgtccca

SEQ ID NO: 3110 - DNA, 109 bp, Homo sapiens
tgaggatttttgcattcatgttcatcaggaatattggccatacaaatatatagttttctatatttgtatgtccttccctgcttttggttttagggtgatactggcttca

SEQ ID NO: 3111 - DNA, 111 bp, Homo sapiens
aatcctgcctcaatagtctgtatggactgaactttatttatttatttatttatttatttattgagatggagtctcactctgtcacacaggctggagtgctaaggcttgatt

SEQ ID NO: 3112 - DNA, 75 bp, Homo sapiens
gctcactgtcttgtctctctgtctcttatgtttgggatattgtccaaacatacaaaggggttacagattctgagt

SEQ ID NO: 3113 - DNA, 112 bp, Homo sapiens
gcactttgggaggctgaggtgggcagatcatctgtggtcagaagtttgagaccagtctggccaacgtggtgaaatcttgcctttactaaaaatacaaaaattagccaggtgt

SEQ ID NO: 3114 - DNA, 73 bp, Homo sapiens
ggcagagaactgagatgtattatcttaaaactctttttttttttttttttttaagatggagtctcgctctgtc

SEQ ID NO: 3115 - DNA, 107 bp, Homo sapiens
tgtctccctagccaaccttgactctgtggaaaggtgggagatgattcttgccttctgtctgactcacctgctctctgccatttccaactgactcaatgttggagata

SEQ ID NO: 3116 - DNA, 58 bp, Homo sapiens
tgagatagggtctcactctgtcactcaggtcggaatgcagtggggagatcttggctca

SEQ ID NO: 3117 - DNA, 71 bp, Homo sapiens
cttgagtcactctcagtgtccctctttgtgaacctttttgggggaggagccacattgagtgggtctgcagg

SEQ ID NO: 3118 - DNA, 90 bp, Homo sapiens
cacagggcaagtagggcagggtggactcacagactggaagttgtaatttaaagtttttcatttatgattcatcctgtgccaggtgctgtg

SEQ ID NO: 3119 - DNA, 84 bp, Homo sapiens
tggtcctagtgatggtacagtttctgcctcactcacattcactttaaggaaaagctgcccagaccacaaaccctgctggggcca

SEQ ID NO: 3120 - DNA, 116 bp, Homo sapiens
gcgtctccgttctttctgggcagtctttgctactgtaaacatccttgactggaagctgtaaggtgttcagaggagctttcagtcggatgtttacagcggcaggctgccacggtcgt

SEQ ID NO: 3121 - DNA, 104 bp, Homo sapiens
ccatgctgtagtgtgtgtaaacatcctacactctcagctgtgagctcaaggtggctgggagagggttgtttactccttctgccatggaaaacatcagctgaaga

SEQ ID NO: 3122 - DNA, 117 bp, Homo sapiens
ggcatcctgggcatgggaccccttctcctctgtcattgtccagagaggtgagtgctgacacagggcagctggaacaaatgagtaggtaatgggaagagtccctgttcccaggcatcc

SEQ ID NO: 3123 - DNA, 70 bp, Homo sapiens
ttgttttgagacagggtctctctctgtcgcccaggctggagtgcagtggtgcgatcttgactcactgcaa

SEQ ID NO: 3124 - DNA, 86 bp, Homo sapiens
agccaggcatgatggtaaaagtctttagtcctagctacttgggtggctgaggtaggaggatcacttgagcccaggaggtcaaggct

SEQ ID NO: 3125 - DNA, 78 bp, Homo sapiens
cagcctctcagagcctcagttttctcaaatttttttttgttttttttgagacggagtctcggtctgttgctgaggctg

SEQ ID NO: 3126 - DNA, 64 bp, Homo sapiens
ggcgctggcaggcagcctgaatccgacatccctgcgggtgggcaggtgaggcttggtgggagcc

SEQ ID NO: 3127 - DNA, 87 bp, Homo sapiens
cggcccagcgactgggtagaacctggctgtggctaccacccccgctctctgaccatctccctcagtcactctgccttagctatgccg

SEQ ID NO: 3128 - DNA, 83 bp, Homo sapiens
tactgagcattgttgtgagaactcattgtgctgagttgtttttctacactatcccactgaaacctcacaacagtcctatagta

SEQ ID NO: 3129 - DNA, 92 bp, Homo sapiens
tgtgcctgagtttcctccgcagcaaaataaagacaataatagcaattatctcatttagttgttgagaggattaaataggagacacacacaca

SEQ ID NO: 3130 - DNA, 58 bp, Homo sapiens; identical to SEQ ID NO: 605

SEQ ID NO: 3131 - DNA, 90 bp, Homo sapiens
ttgtttttgagacgaagtctcactctgtcacccaggctggagtgcagtggtgtgatctcgactcactgcaacctctgcctcctggtttca

SEQ ID NO: 3132 - DNA, 87 bp, Homo sapiens
gggggccaggtctgactcacactgaggcaccagggaggagatgcaatctgggcagcagagagggagcaggctgggcagttggcccct

SEQ ID NO: 3133 - DNA, 89 bp, Homo sapiens
taggctatgaggtcttctagtagtaggtagtaggtagaatagcattattctactactcctagctagtgggagggaattcatgacgtcta

SEQ ID NO: 3134 - DNA, 107 bp, Homo sapiens
gccatttcacttaatctgcaacaactttgagacacagcactatgattattctcattttctagatgagaagactgagccagagaggttaaacaacttttgtgtgaggc

SEQ ID NO: 3135 - DNA, 66 bp, Homo sapiens
gtctcacagtgatgggtcttggtgtgggtcagttttctcactcagtggctctttcagtctggtgac

SEQ ID NO: 3136 - DNA, 96 bp, Homo sapiens
ggtgcaaggagaacagagtcagaagagtcagagggctggaaaggcctttaaaggtaatctggtttttttttttttttttttttttttttttgcagt

SEQ ID NO: 3137 - DNA, 79 bp, Homo sapiens
ctgccttcctcctctctgtcactctcaggcatgactctccttctcccctggctgtctgagtgccagcaacagaaagcag

SEQ ID NO: 3138 - DNA, 85 bp, Homo sapiens
gggttagagaaagtcaccatctctgagtcatttgggcccaaagtccagagagaagaaactgagggaaaggaaccatctctctccc

SEQ ID NO: 3139 - DNA, 86 bp, Homo sapiens
ccaaggtacctgaaagtcaaggagcaaatgaaatgattcttgctacaaaagggaaccatttggtgtgtgatttttagctgcttagg

SEQ ID NO: 3140 - DNA, 56 bp, Homo sapiens
cagtctctcaggcaccctgtgtgtcactaggtcttgccagtgtgtttgggaggagg

SEQ ID NO: 3141 - DNA, 95 bp, Homo sapiens; identical to SEQ ID NO: 580

SEQ ID NO: 3142 - DNA, 93 bp, Homo sapiens; identical to SEQ ID NO: 69

SEQ ID NO: 3143 - DNA, 119 bp, Homo sapiens
atctctttattgtttgtcctccaaacgtgttacttgtaagatttgttccttaataatttatatttttataatgtcaggggccaatatgtttcaagaggaacacatttcaatgtcatgat

SEQ ID NO: 3144 - DNA, 119 bp, Homo sapiens
ccttaaaaaataatttgtgggaattatttgaggcctaagataacatgcttctctccagagaggattttttttctttatttttatttttttcttttattattatactttaagttttaggg

SEQ ID NO: 3145 - DNA, 78 bp, Homo sapiens
gccaggggttggggaggaggagggagggctggagcagaggaggccactttcttcagcatcactcactctctgtttggc

SEQ ID NO: 3146 - DNA, 81 bp, Homo sapiens
gtttgttttgttttttgagttggagtctctctctgtcacccaagcttgggtgcggtggtgcaatctcggctcactgcaagc

SEQ ID NO: 3147 - DNA, 68 bp, Homo sapiens
gcctcaggaggggaggtggagtccaggaacaatgtaatgtgtctagtctctatctctctctctgctgc

SEQ ID NO: 3148 - DNA, 121 bp, Homo sapiens
ctgcactgggggctgagctctggagaatgggtggaagttttcccagagaagggactgaggacagaaggccatttcatgccaaagggacagccaggaggtgagacgggcctggaatattcag

SEQ ID NO: 3149 - DNA, 70 bp, Homo sapiens
tctgtgtctgtgcaaggaggtgtgcatatatacatcgaggtgtgtgtgtgtcagtgtgtatatacacagg

SEQ ID NO: 3150 - DNA, 114 bp, Homo sapiens
gcaacgttactgaatttgtttacaactttactgaatactgttctgtttttgttgaagtctttaggatttggtctatataagagcatgtcagcagagacaatttcacttcattgc

SEQ ID NO: 3151 - DNA, 73 bp, Homo sapiens
tggtcttctggtaacagagctagacaaaatttttttttttttgagatggagtctcgctctgtcacccaggcta

SEQ ID NO: 3152 - DNA, 114 bp, Homo sapiens
ttgtattttttaaacctcttttgtttagttttgctctgacctttattctgttttcttaatttttttagattcaaggtcttgctgtattgcccagtctggagggaagtgacacga

SEQ ID NO: 3153 - DNA, 121 bp, Homo sapiens
ggccacggtaagtggaagaaagagagatcagttctttctgaccctctctgtctctgcctgggtgtggcttctcggcagctgctctgtcccttctgcagggcaccttcagtccgggatgcca

SEQ ID NO: 3154 - DNA, 118 bp, Homo sapiens
gtgagtggcagggctggccatttaaccccagacgagggagcccacatttttttttttttgagacaaagttttgctcttgttgcccaggctggagtacaatggcgtgatcttggcttac

SEQ ID NO: 3155 - DNA, 56 bp, Homo sapiens
tatatatacatatatatgtgtatatatgtgtgtatatatgtatatatgtatgtata

SEQ ID NO: 3156 - DNA, 58 bp, Homo sapiens; identical to SEQ ID NO: 1215

SEQ ID NO: 3157 - DNA, 95 bp, Homo sapiens; identical to SEQ ID NO: 68

SEQ ID NO: 3158 - DNA, 93 bp, Homo sapiens; identical to SEQ ID NO: 69

SEQ ID NO: 3159 - DNA, 104 bp, Homo sapiens
cttgctttatgtgggatgatgtaagtgaaaggattattagagtcaatataaagctttattttctaattttagaaatccacacaaacttcagtctagatgacaag

SEQ ID NO: 3160 - DNA, 136 bp, Homo sapiens
gtgtgcatgtatatgtatgtgtgtgtgtatatatatgtagttataatatgtatatatatgtgtatatatatgtgtgtatatatatacacatatatatacatttacatatataatatctgtatatatgtatatatat

SEQ ID NO: 3161 - DNA, 184 bp, Homo sapiens
gtgtgcatgtatatgtatgtgtgtgtgtatatatatgtagttataatatgtatatatatgtgtatatatatgtgtgtatatatatacacatatatatacatttacatatataatatctgtatatatgtatatatatgtgtatatatatgtatgtatatgtatatatatatatttttttgagatg

SEQ ID NO: 3162 - DNA, 93 bp, Homo sapiens
gatacatgtgctttttttacagctttattcaggatttttgttttttttgagacagagtctctgtcactcaggctgaagtgcaatggcatgatc

SEQ ID NO: 3163 - DNA, 98 bp, Homo sapiens
cacataagcatatctaagtgtatgtatgtgtgtgtatatatatttatacacagttatatatgacacacataatcaaatacattgttgctattatgctg

SEQ ID NO: 3164 - DNA, 118 bp, Homo sapiens
aggttagtatgtggattcaatttctttaatagatatagttctattcaattgtctatttcttcttgtgtgaattttggcagactatatcaaggaattggtccattttatttaggttatc

SEQ ID NO: 3165 - DNA, 102 bp, Homo sapiens
agagtgagactccgtctcaaaaaaagcaaaaaacaaaaacaaaaaccctcctataataccataagcttttttttttttttttgagacggagtctcttactct

SEQ ID NO: 3166 - DNA, 103 bp, Homo sapiens
cacatctcaaaaagtgtgtgtgtgtgtgcgcgtgtgtgtgtataaaatatatatttatacataaacacacgtgtatatgtattagtatatgtatgtgtatgtg

SEQ ID NO: 3167 - DNA, 93 bp, Homo sapiens
ggtgcagagctgcagatgtccatccattgatttattctttttttctttcttttttttttttttttttttgaagtggagtctcactctgtcgcc

SEQ ID NO: 3168 - DNA, 116 bp, Homo sapiens
gtgcccactcccttttatgttgatctgtcatgtcagaggtttgcaaggttttttttagtattttcaaggaaccatctggcagtcttggtgatcctctctattgtaggtttggttgc

SEQ ID NO: 3169 - DNA, 110 bp, Homo sapiens
ctaggaaggttgcataacatctctggacctcgggttcttaatctatgaagggaaactgtcctcacagatgagtgtgagggttcaaaaagatactgcctgccaagcactgg

SEQ ID NO: 3170 - DNA, 130 bp, Homo sapiens
atgtatacatgtgtatatacatgcatacatgtgtgaatatgtattatacatacatatgtatatatgtgtatacatatacacgtgcatacatgctaaatacatatacatatatatacacctatgtagtaca

SEQ ID NO: 3171 - DNA, 83 bp, Homo sapiens
gagacccagagtgggtagctcctatctgcaggcaggttgtcccaacatctgtgtgactctgagtctggctgagtctgggtttt

SEQ ID NO: 3172 - DNA, 105 bp, Homo sapiens
atatgtgtatatatgtatatatgtgtatatatgtgtatatatacacatatacatatacacatatatgtatatatatacgtgtgtgtatatatatatatatatata

SEQ ID NO: 3173 - DNA, 107 bp, Homo sapiens
tatatatatatatatatatacacacacgtatatatatacatatatgtgtatatgtatatgtgtatatatacacatatatacacatatatacatatatacacatatat

SEQ ID NO: 3174 - DNA, 76 bp, Homo sapiens
ctctttccacctcactacctcactgtctctttcttcttccaaaggaaaagccaggagttgagagcagtggcatgag

SEQ ID NO: 3175 - DNA, 109 bp, Homo sapiens
gctgggtgggtctggccagtcccatggcactgagagtgtggtgagtgtgctcaggcagaacgggtgctgcctgcctaccacatccgtgggagctggccagggtgggggc

SEQ ID NO: 3176 - DNA, 79 bp, Homo sapiens
gctgtggagacagggcctggctcagactgtgtctcaggcagctccctgagggccagcatgtgcctgctgtgttcacagc

SEQ ID NO: 3177 - DNA, 61 bp, Homo sapiens
gcacagtgaggacacagtgacctcatccccacagccatgagcactgttgtcagcaccatgc

SEQ ID NO: 3178 - DNA, 114 bp, Homo sapiens
cttgtttcttggttaaagccagagttctaaatgacgccccatgataaactctgtatttgttgttgagagttaggtggcgttattagtctcagtttataaatgaaggaatgtgag

SEQ ID NO: 3179 - DNA, 95 bp, Homo sapiens; identical to SEQ ID NO: 580

SEQ ID NO: 3180 - DNA, 93 bp, Homo sapiens; identical to SEQ ID NO: 69

SEQ ID NO: 3181 - DNA, 70 bp, Homo sapiens
cagctcctacaactgtaagagccgagattttttttttttagacagggtcttgctgttgtcacccaggctg

SEQ ID NO: 3182 - DNA, 58 bp, Homo sapiens
ctgtatctatatgtatgtatatatactatgtatatatacatgtacatatagtatatgg

SEQ ID NO: 3183 - DNA, 76 bp, Homo sapiens
tttgactgtggaaaaggggatcattgggtggtttctgtcacacccagtgacagtcttctttctcctccccagcaga

SEQ ID NO: 3184 - DNA, 58 bp, Homo sapiens
tgagacggagtctcactctgtcacccaggctggagtgcagaggcgtgatctcggctca

SEQ ID NO: 3185 - DNA, 58 bp, Homo sapiens; identical to SEQ ID NO: 1673

SEQ ID NO: 3186 - DNA, 92 bp, Homo sapiens
ttttggcagtaaaagttacctaatcagttgtcagtactgtgtctggaaaccagtcttggaagtgtgatgatgtgcttttaaaatagctgaaa

SEQ ID NO: 3187 - DNA, 96 bp, Homo sapiens
ggccctgacctctctgcctctggctctctcagtcgctggtcccatcccggctggctgagggagctggtgccacggtggacgatgggacgaacagcc

SEQ ID NO: 3188 - DNA, 100 bp, Homo sapiens
ggcaacagagcgagactccgtctcaaaaaaaaaaaaaagtttgccaatttctttttttttttttttttttttttttgagacagagtctcactctgtcgcc

SEQ ID NO: 3189 - DNA, 98 bp, Homo sapiens
agggaatgaatccagtgttccagacagaacaaacattggagtgtttgaggaaactgcagcaccctttgttgaacctgcccaccactgacttccctccc

SEQ ID NO: 3190 - DNA, 104 bp, Homo sapiens
gtgagataaggtaccccctttgttctgggatagaagtgaggcctctctcagtctgtgaggcaaattatcttctagtccgggagtaaggggatgcccaaggaagc

SEQ ID NO: 3191 - DNA, 59 bp, Homo sapiens
cagagcagagccagtgacctgggacacagcttcactgacactcagtctggctctgcctg

SEQ ID NO: 3192 - DNA, 81 bp, Homo sapiens
gctgttgagaattgcagcggggagaccaggaaggaatctggtttttttttttttcatagggtctcgctctgtcactcaggc

SEQ ID NO: 3193 - DNA, 98 bp, Homo sapiens
gtctcacgcagcagctgactgtggctgtgtgaccacacacaggacgcccagcagcaaccacagagtcacacacacacacagtctactgtctggggggc

SEQ ID NO: 3194 - DNA, 67 bp, Homo sapiens
gactgtgtgtgtgtgtgactctgtggttgctgctgggcgtcctgtgtgtggtcacacagccacagtc

SEQ ID NO: 3195 - DNA, 98 bp, Homo sapiens
atatatatatatatatatatatatatatatatgtgtgtgtgtgtgtgtgtgtgcgcgtgcacacgcatgtatgtatacatgtatgtatatatgtatgt

SEQ ID NO: 3196 - DNA, 116 bp, Homo sapiens
gctgggattacagacatgagccactccgctcagcctagagtgattctttttttttttttttttaagacggagtctcactctgtcgccaggctggagtgcagtggtgtggtcttggc

SEQ ID NO: 3197 - DNA, 82 bp, Homo sapiens
gaggtggatctgtgtgatggaggtgctgcaggagggcaggagagaccctcagtcagtgcctctagccagcagtggttgtgtc

SEQ ID NO: 3198 - DNA, 89 bp, Homo sapiens
gtctctcatggttgagtgcctgatactcttattaaatttaattaattaattaatttttttgagacagtgtcccactctgtcacccaggc

SEQ ID NO: 3199 - DNA, 98 bp, Homo sapiens
ttgcacatagcagttgcccagtgcatatttattggacatttgattgaatgaatgaatgaatgaatgaatgaatgccttgtgggtactgaatcttgtaa

SEQ ID NO: 3200 - DNA, 98 bp, Homo sapiens
ctccagtgtacatgcccagcgagcaggccggctggagtttctccgagaaccccttgccacctggctgtctcactgagagtgtgttggattcactggag

SEQ ID NO: 3201 - DNA, 86 bp, Homo sapiens
ctatctgaaggggctgagcagcaaagccaaaggtgtcattttgtttttccaatcatctggttttttttcttttttttttgagatgg

SEQ ID NO: 3202 - DNA, 116 bp, Homo sapiens
ctctctgaggctacggggctccatctctgatgccaggtctgtctgtttctctcaggggaatagctcacctctgggaggctgtctctggcactaaggtctgtctgtgtttctgttgg

SEQ ID NO: 3203 - DNA, 118 bp, Homo sapiens
gtaaaacagtccatttgaaatgacttatgggaggccctttttttttttttttttttttttttttttttttttttcccgagacggagtctcgctcagtcacaggctggagtgcagtggc

SEQ ID NO: 3204 - DNA, 70 bp, Homo sapiens
tcctgtcttagtctctgaaatccagttttggcaaaccacggagagagaagttagagatcagaatgcagga

SEQ ID NO: 3205 - DNA, 62 bp, Homo sapiens
ggaggctgaggtggtaggatcacttgaacccaggcgttacagtgagctatgatcatgccacc

SEQ ID NO: 3206 - DNA, 79 bp, Homo sapiens
gcttcctgagtagctgagattacaggcatgcaccaccacacctggctgcaatatgccattttttacctatcagattggc

SEQ ID NO: 3207 - DNA, 111 bp, Homo sapiens
tctctagatacttacaacacctaacataatgcaaatgctatgtaaatagttcttatatttatatttatatttatttttgtattgttgtttttgtttttattttttcggaga

SEQ ID NO: 3208 - DNA, 86 bp, Homo sapiens
gtgaaacccacagagaagaattttgcttgttatcagccctggaagcctctgatagacgggtgacattttttttctttttctttctc

SEQ ID NO: 3209 - DNA, 64 bp, Homo sapiens
ttttttgagacagggtctcactctgtcacccaggctggtgcagtggcgatcctagctcactgaa

SEQ ID NO: 3210 - DNA, 88 bp, Homo sapiens
tttcctttaaacagtacagtcttagcattttggctgcatggcaaggaaggcatgagagagagtgaagtgtgtgtgcaggctagggaga

SEQ ID NO: 3211 - DNA, 107 bp, Homo sapiens
cagagggagtgcaggcagaaggagcaagtatcaatggttttaaacggcgtctgtctctctgcgtctctcctgacgtgaggcagtgaaacgcgttatcgaggaggccc

SEQ ID NO: 3212 - DNA, 82 bp, Homo sapiens
tccatggagtgtgagtggctaggacctcacatctgttttttgtttttttgagatggagtctcactctgtcacccaggctgga

SEQ ID NO: 3213 - DNA, 58 bp, Homo sapiens; identical to SEQ ID NO: 1705

SEQ ID NO: 3214 - DNA, 93 bp, Homo sapiens
agtttggtctaggcactagtttctctttttttttttctgagatggagtcttgctctgtcacccaggctagagtgcagtggcacgatcttgact

SEQ ID NO: 3215 - DNA, 85 bp, Homo sapiens
aggatgagaagaaagaaagaaaaagaagcttgcttggtttcaagtcctccccagctttttctttttctttttttgtttttgtttt

SEQ ID NO: 3216 - DNA, 97 bp, Homo sapiens
tcgcgctgatgcggcttggcgacgcggctctgcgggatgactttgacagcgtaggcgctgccagtctctgtgtcagtggcctcgtagcagcgggcga

SEQ ID NO: 3217 - DNA, 82 bp, Homo sapiens
tgcttctcacgggctcacttcccgccctgcctcacacacactctggcctggagaggaacgtgtgcccacacagagagaagta

SEQ ID NO: 3218 - DNA, 118 bp, Homo sapiens
gtttctgcttcctcagtctctgtcagataatcagtgctatgtaaatgttaagtaaatgactttatttatttatttatgacacaaccttattctcacccaggctggagtgcagtggtgc

SEQ ID NO: 3219 - DNA, 74 bp, Homo sapiens
tgacagaacgagaccctatctcaaaaaataataataataattttttttttttgagacagggtctcactctgtca

SEQ ID NO: 3220 - DNA, 99 bp, Homo sapiens
gctgagggaagatgattagttaaggtcctaggttgcaagtctcaaaacctcttctaaggattgtagacaggaaattaaatgacttctagtccctagagt

SEQ ID NO: 3221 - DNA, 115 bp, Homo sapiens
atttaaaaatatgatcaataagatcttatggctatatatacatatatgtatatatgtgtgtatataaattgactcagcttgggaatttagtatatgataatcgtgaaacttaaat

SEQ ID NO: 3222 - DNA, 118 bp, Homo sapiens
ggcccaagactccatagtaaatatcaggttctagctgcctaattcctagtgtaatgtgctctttgctatatattactctgctggcaatgtctggtgggtataggtctggagaggagct

SEQ ID NO: 3223 - DNA, 58 bp, Homo sapiens; identical to SEQ ID NO: 2626

SEQ ID NO: 3224 - DNA, 58 bp, Homo sapiens
tgagatggtgtctcactctgtcacccaggctggagtgcagtggtgtgatctaggctca

SEQ ID NO: 3225 - DNA, 119 bp, Homo sapiens
ggtgtgtagtggtttaaatttgcattttactggtgagtaatgaggttgagcactttttcttgttcatattggcctttcatatatcttgctttgtgaagtgtctgttcaaatattttgcc

SEQ ID NO: 3226 - DNA, 85 bp, Homo sapiens
ggcttgcactggcatgaagaggagacagcactggtcagttgactcactgagtgacaccctgtcatgtctaattaaactacaggct

SEQ ID NO: 3227 - DNA, 84 bp, Homo sapiens
gtgcatctctcattccaagtgtctggaaggagtaactgaatcagaggcatctgtctctctcacagataaaggtagcaggtgtgt

SEQ ID NO: 3228 - DNA, 105 bp, Homo sapiens
tatagttgaatcatgtggtttttaattgttttattttgttttagaaacagagtcttgctctgtcactcaggctggagagcagtggcatgatcatagctcactgta

SEQ ID NO: 3229 - DNA, 95 bp, Homo sapiens; identical to SEQ ID NO: 68

SEQ ID NO: 3230 - DNA, 93 bp, Homo sapiens; identical to SEQ ID NO: 69

SEQ ID NO: 3231 - DNA, 115 bp, Homo sapiens
ttataagatgtacttcttgccaattaaactatgacaattcccattacttagaagtttaattttttatttaagaggcctttatggacttgatgcagcatagttgtgggttttgtga

SEQ ID NO: 3232 - DNA, 117 bp, Homo sapiens
gtcattttatatgtgtgcaaggatatttgtgggataaattcacagaagtgagatttcttttttttttttttttggagactgagttttgctctgttgcccacactggagtgcagtggc

SEQ ID NO: 3233 - DNA, 65 bp, Homo sapiens
ggtgtcagggtctcactctgtcgcccaggctggagtgcagtggtgcagtctcggatcctcccacc

SEQ ID NO: 3234 - DNA, 77 bp, Homo sapiens
agagactgcaaccctgtgcagagtcctcctcctctattctggagttctgtctctgtcagggatgggtggcagtttgt

SEQ ID NO: 3235 - DNA, 60 bp, Homo sapiens
gtgagatggagtctcactctgtcacccaggctggagtgcagtggtgtgatctcggctcac

SEQ ID NO: 3236 - DNA, 58 bp, Homo sapiens; identical to SEQ ID NO: 1409

SEQ ID NO: 3237 - DNA, 57 bp, Homo sapiens
gagacagagtctcgctctgtcacccaggcctggagtgcagtgatgccatctctgctc

SEQ ID NO: 3238 - DNA, 73 bp, Homo sapiens
ccgggcgttgtggcttgtacctgtggtcccatctgcttgggaggctgaggttgcaggatcacttgagcccagg

SEQ ID NO: 3239 - DNA, 57 bp, Homo sapiens
gggtctctctccctgtcacccaggctgaagtgcagtggtgtgattggggcggggctc

SEQ ID NO: 3240 - DNA, 117 bp, Homo sapiens
gactctaccttgacccctggtttcggcaatgatcttgtccactagtgaatgagacatgtgagtgagcagtttttaatttaacctgtggttccagaccactggcaaggaccagttaag

SEQ ID NO: 3241 - DNA, 86 bp, Homo sapiens
ttgaagacggagtctcactctgtcacccaggctggggtgtggagtgcagcggcgatctcgactcactacaacctctgcctcccggg

SEQ ID NO: 3242 - DNA, 83 bp, Homo sapiens
tgtgtgtatatatatatattccattgtatgtattatatatgtgtgtatgtatgtatgtacatacacacatatgtgtatatata

SEQ ID NO: 3243 - DNA, 94 bp, Homo sapiens
tgggtgacaaagcgaggctctgtctcaaaacaaacaaaaaaaattatttatttatttatttattttttgagacagagtctcactctgtcaccca

SEQ ID NO: 3244 - DNA, 119 bp, Homo sapiens
actttgcagaagagtttctttttgggtgtgtggttttgtttttgttttttgtttgtttgttttttgctttctttacgagacacggtctcattctgtcacccagactggagtgcagtggt

SEQ ID NO: 3245 - DNA, 60 bp, Homo sapiens
tgagacagagtgtcactcactgtcgcccaggctggagtgcagtggtgtgatctcagctca

SEQ ID NO: 3246 - DNA, 115 bp, Homo sapiens
tgtgtgtgtgtgtgtgtacttatagatacatatataaatatgtatacaatatataaatatatatgtatacttatataagtatataaatatatataatatatacatatatatttat

SEQ ID NO: 3247 - DNA, 70 bp, Homo sapiens
ccagcactttggggaggcccaggcaggcttttttttttgagagagagtctcactctgtcacccaggctgg

SEQ ID NO: 3248 - DNA, 94 bp, Homo sapiens
aagggaagaaaggggagtgggcacgaaatactacagaacctgcagggaacgaagtccctctgtctgtgtgtgcctatatcaataacttaaactt

SEQ ID NO: 3249 - DNA, 59 bp, Homo sapiens
ggctcaggctctgtctgtgactagagttgtgctgacatcaacagactggaccaggggcc

SEQ ID NO: 3250 - DNA, 114 bp, Homo sapiens
tgggcacgctggagctgggggagctgctctgtgatgaattccctcccactttgtacagagacagacagacagacagacaaaagcagagcagtgttagctgttagaagtgactca

SEQ ID NO: 3251 - DNA, 58 bp, Homo sapiens
tgagacagggtctctctctgtcactcaggctagagtacagtgatgtgatcatagctca

SEQ ID NO: 3252 - DNA, 76 bp, Homo sapiens
gactgcttttcctgctaccctcaggtactgaagcccaagtaagagttttcagtagagagggagtagactgagtgtt

SEQ ID NO: 3253 - DNA, 86 bp, Homo sapiens
tgaaaaaagagctagattcatgtgctgtctacaagagggattttatttttagttttagttttttgaggcagtgtctcactctgtca

SEQ ID NO: 3254 - DNA, 89 bp, Homo sapiens
ggtcattacctattcacaatgctggtgagctcccgcagccgctcctctcctagctgcctgtctgcctcactagcagcagcgtctcgacc

SEQ ID NO: 3255 - DNA, 91 bp, Homo sapiens
tagggattttactttctcacttttatcatgagacaacatttttcactttactggggatttttgtgtatttcatgatgtgtccaaatcctta

SEQ ID NO: 3256 - DNA, 98 bp, Homo sapiens
ggtgtgagccacaaagcccggccaaaaccctgtcttttgaaaaataaattttttttttaatttttatttttttgagatggagtctctgtctctcaccc

SEQ ID NO: 3257 - DNA, 81 bp, Homo sapiens
gggaggctttttaaggtgccaggcactggaccagggtctttccctgcttgggtccagtgggcctgtctctctcagcctctc

SEQ ID NO: 3258 - DNA, 94 bp, Homo sapiens
tctgcgtgcctgtcagcctctgtatgtgtgtctgtgtgtgaccgtcaatctagacagctggcaaatatgtgtgcgcacacagaattcgttcaga

SEQ ID NO: 3259 - DNA, 116 bp, Homo sapiens
gcccctggtggctggagtgtgggagagggaggtaacaaggcagacagaagaatgactgctttttcagttattcttctatgtatctatggcttccacccaacccagcagggtggggc

SEQ ID NO: 3260 - DNA, 110 bp, Homo sapiens
ccatgaaacgtgttccttgctcctctcaaagtctaaggctgagggcgactctctcacaccctcaccaagatagaagctcttggggccgcgttttccacctcgcactatgg

SEQ ID NO: 3261 - DNA, 95 bp, Homo sapiens; identical to SEQ ID NO: 68

SEQ ID NO: 3262 - DNA, 93 bp, Homo sapiens; identical to SEQ ID NO: 69

SEQ ID NO: 3263 - DNA, 97 bp, Homo sapiens
gaggccattgcagcattattattattatttgagacacagtttcactctgtcacccaggctggagtgcagtggtgtgatctcggctgactgcaacctc

SEQ ID NO: 3264 - DNA, 112 bp, Homo sapiens
cagctcccctcatgaccctggagggaattctgcccactcacagactctttcttattctgggcctctgctgttatctgggtctagctccctgtcacagtcagtttggggactg

SEQ ID NO: 3265 - DNA, 97 bp, Homo sapiens
ccttttagtatgtttctcagttctgttgctatggtgttgagtacattcttgtctgcctctttccacattgatggcttctgagattacatgctctagg

SEQ ID NO: 3266 - DNA, 95 bp, Homo sapiens; identical to SEQ ID NO: 68

SEQ ID NO: 3267 - DNA, 93 bp, Homo sapiens; identical to SEQ ID NO: 69

SEQ ID NO: 3268 - DNA, 98 bp, Homo sapiens
ggatgacctgccccttctttctagctgcatttcatatgttttcttttgtgttgaccgtggacaacctgatgacttatgtgtcttggggatggccatct

SEQ ID NO: 3269 - DNA, 80 bp, Homo sapiens
aagatttaaaagatattctatgtatatgtatatatacatacacacgtttatatgcgtgtatgtatgcatctgatggtctt

SEQ ID NO: 3270 - DNA, 58 bp, Homo sapiens
tgagactgagtctcgctctgtcacccaggctggagtgcagtggcgcgatctcggctca

SEQ ID NO: 3271 - DNA, 87 bp, Homo sapiens
ctccaacctggatgacagagcaagactgtctcaaaaaaaaaaaaaaaaaaaaaaagaaacagtctctctctgtcacccaggctggag

SEQ ID NO: 3272 - DNA, 101 bp, Homo sapiens
tctggcctaggcgacagagtaagatcctgtcttaaaaaaaaaaaatcttatttatttatttatttattgagatggagtctcactgtgtcacccaggctgga

SEQ ID NO: 3273 - DNA, 69 bp, Homo sapiens
tgggcatggtggcaccctcctgtcgtctcagctacttggaggctgaggtaggaggatcatttgagacca

SEQ ID NO: 3274 - DNA, 92 bp, Homo sapiens
catgcatgagccaccgtgcccagcctaaagtgccattttaatcacatcatatcaagtgtgcatagtagtctgggtgctgtggctcacgcctg

SEQ ID NO: 3275 - DNA, 64 bp, Homo sapiens
tgagacaagagagtgccaaggttctctagcctgggggtgacagactgagtgagtctctgtctca

SEQ ID NO: 3276 - DNA, 58 bp, Homo sapiens; identical to SEQ ID NO: 2442

SEQ ID NO: 3277 - DNA, 116 bp, Homo sapiens
ggagggatggtaactgatgcagcagggcagagaaagcctcagtagagtgtgtgcagagaggatgatacaggccaggaaggaggcagcacctgggcagaaccagcaagacagagctt

SEQ ID NO: 3278 - DNA, 75 bp, Homo sapiens
gccttgccagccctcagtatcctgatggggaggtgtcaggcccactcacagacattagggaacctgggccaaggt

SEQ ID NO: 3279 - DNA, 80 bp, Homo sapiens
ggagcagacctttccctagtgccttcagagggtgcccagccctagtgccttcagagggtgcctggctctgtccctctgga

SEQ ID NO: 3280 - DNA, 76 bp, Homo sapiens
ggcatcttccctgtgtgtgtgtctgtgtctaaattttcccttttaataaggataccagtcatgcgggtttggggcc

SEQ ID NO: 3281 - DNA, 60 bp, Homo sapiens
tctagtgacagggagtttctaccttataataagctgaaatctgtctccctgtcactctga

SEQ ID NO: 3282 - DNA, 116 bp, Homo sapiens
agggctctgcagaagtggagactgaggtctagagaatggctatctctcacccaccttctcacagtcactgaggagccttctggtcacagatgggcacactgaggcctgtgactagg

SEQ ID NO: 3283 - DNA, 73 bp, Homo sapiens
gttatgaaaattatttgttgtctttgtcatgagagtgagctctgtgatggcagggactctgatttttctctgc

SEQ ID NO: 3284 - DNA, 89 bp, Homo sapiens
ttacaggtgtttcagactcactgtctaaatagggagggcctctggttccacctttcctgctacagatagggaaactgaggtccaggtag

SEQ ID NO: 3285 - DNA, 94 bp, Homo sapiens
gtatatacatatacacgtatatatacgtatatatacgtgtatgtatatatgtatatatacgtatatatacgtgtacatatatatacacacacac

SEQ ID NO: 3286 - DNA, 67 bp, Homo sapiens
gcaggcagtgccgaagacacgcttgatttctcaaatcgagaggcacattttcagcatctgcatgtgc

SEQ ID NO: 3287 - DNA, 86 bp, Homo sapiens
gcagggttagctccctccaacacatcttcccacctgtcccgaccatctctggctctgagtgtgtgagcggcaggtatgagccttgc

SEQ ID NO: 3288 - DNA, 115 bp, Homo sapiens
gcatggaacgcggataccaggtcaaaacaggggctatgagagaacagagtggggagtcgctaggttttagacatcaaggggaactgtccggggaggtgtcatggggaagcaatgt

SEQ ID NO: 3289 - DNA, 87 bp, Homo sapiens
aggaaaagacaagagggaggtgagaacactagtttctcttgctcttttttttttcttttcttttttgagacagtgtctcactctgtc

SEQ ID NO: 3290 - DNA, 89 bp, Homo sapiens
tgaaccagagactggggagtcagggacctgctgtgcagtctccaagctgagggctcacagcaagtcactgactctctctctaaggttca

SEQ ID NO: 3291 - DNA, 68 bp, Homo sapiens
gtgtccctgtctcatagggctgttgagaggactaaaagagaactcagacagaacagagaacatggcac

SEQ ID NO: 3292 - DNA, 97 bp, Homo sapiens
tctcagcacctgtcacccactcctggactcacatgtgtctgtctatctctcccactagactgtgtgtccctcaagggcgtaatacattgtgcagaga

SEQ ID NO: 3293 - DNA, 82 bp, Homo sapiens
ctgtgtgtgtgtctgtatgtgtgtgcctgtgtgttgcggagaatggatttcagcagaggggccaggctggacgaagttgcag

SEQ ID NO: 3294 - DNA, 78 bp, Homo sapiens
agcccattctgtacaaaagatggctcttggtcctttggtctctcacacactgagcatcatccagtgcagggatgggtt

SEQ ID NO: 3295 - DNA, 68 bp, Homo sapiens
ccctgggcaaactttctctctcacattcacatcctctcttatgtctccggaggaaggatgctctgtgg

SEQ ID NO: 3296 - DNA, 95 bp, Homo sapiens; identical to SEQ ID NO: 68

SEQ ID NO: 3297 - DNA, 93 bp, Homo sapiens; identical to SEQ ID NO: 69

SEQ ID NO: 3298 - DNA, 108 bp, Homo sapiens
ttctctttctattgtgctgtggcccaagactgtttttggtgtaatttttttttttttacatttgttgaggatggttttatgtccaattatgtggtcgattttagagga

SEQ ID NO: 3299 - DNA, 113 bp, Homo sapiens
taattgccaaatgctattccattgtgtatatgtaccacattttcttttttctttttttttttttattatactttaagttttagggtacatgtgcacattgtgcaggttagtta

SEQ ID NO: 3300 - DNA, 110 bp, Homo sapiens
tgcttaggattgccttggctacataggctcttttttggttccatatgaaatttaaagtagttttttctaattctgtgaagaaagtcagtggtagcttgatggggatagca

SEQ ID NO: 3301 - DNA, 85 bp, Homo sapiens
catggccttaagcaagtcccatcccttctagaagtctccagtgtctctttctgtgaaatatgggggtctgattagctggtcactg

SEQ ID NO: 3302 - DNA, 109 bp, Homo sapiens
tgcttaggactgtcttggctatgcaggctctttatggttccatatgaaatttaaagtagttttttctaattctgtgaagaaagtcaatggtagcttgatggggatagca

SEQ ID NO: 3303 - DNA, 95 bp, Homo sapiens; identical to SEQ ID NO: 68

SEQ ID NO: 3304 - DNA, 93 bp, Homo sapiens; identical to SEQ ID NO: 69

SEQ ID NO: 3305 - DNA, 86 bp, Homo sapiens
gcaagatttctatactctgccctcaccctggtctatatgtatataagtatttgtctagacttttgtcttggtagtatggagggagc

SEQ ID NO: 3306 - DNA, 62 bp, Homo sapiens
agccagagtctcactctgtcacccaggctggagtgcggtggcatgatcatggctcattggct

SEQ ID NO: 3307 - DNA, 124 bp, Homo sapiens
ggatggatggatggatggatggatggatggatggatggatggatggtaaatcatttctgcactgttactcactctgtgtcttctccccgaaatgccccttcagttgtccagcctttatagccca

SEQ ID NO: 3308 - DNA, 101 bp, Homo sapiens
actaccgcacctggcctgctcaatagactttctatgatggtgttagatttcctttgcgttgtctatcacagtggctgttgagcacctacaatgtggctagt

SEQ ID NO: 3309 - DNA, 114 bp, Homo sapiens
gtataaggactccatgacagggagtggatcttgtttcttttcttttcttttcttttttttttttttttttttgagaccgggtctcgctctgtcacccaggctgagttcagtggc

SEQ ID NO: 3310 - DNA, 74 bp, Homo sapiens
ggcctggtcacacacatgggcatggatgaagaatactttgagtaaagtgctgagatgtgagtcagctcaggacc

SEQ ID NO: 3311 - DNA, 113 bp, Homo sapiens
tcatagcatggtagaaggcatcacatggcaagacagatgagagagagagacaaaataatttttttctttttttcagatataaggtcttgtaatgttgcccaggctggtcttga

SEQ ID NO: 3312 - DNA, 83 bp, Homo sapiens
gatttgttcaattctatcaatttttgctttatgtatcttcaagctctggtattagatgcataaatatttagaattgttaaatc

SEQ ID NO: 3313 - DNA, 95 bp, Homo sapiens; identical to SEQ ID NO: 68

SEQ ID NO: 3314 - DNA, 93 bp, Homo sapiens; identical to SEQ ID NO: 69

SEQ ID NO: 3315 - DNA, 58 bp, Homo sapiens
tgagatggactctcgctctgtcacccaggttggagtgcagtggcgtgatctcgcctca

SEQ ID NO: 3316 - DNA, 109 bp, Homo sapiens
catcttggtaattcttgcaatatttcaaactttttcattattattatatctgctatggtgatttgtaatcagtgatctttgatgctactattgtaattgttttggggtg

SEQ ID NO: 3317 - DNA, 84 bp, Homo sapiens
gcatttaccactgtaaggagaattatatgtctgcctgtctgtattcctgcaaaattgtgattttcttgaagacagggtcaatgt

SEQ ID NO: 3318 - DNA, 98 bp, Homo sapiens
catggatggtggcaggcagagagagcttgtgcagggaaactcccattttttggggggtttttttttttagttttttttagacgtagtctccctctgtg

SEQ ID NO: 3319 - DNA, 81 bp, Homo sapiens
ctcattcttgaaccacaacagctctgggggaatggagtcacccactctcactaccagcctctggaactctggcaggaggag

SEQ ID NO: 3320 - DNA, 95 bp, Homo sapiens; identical to SEQ ID NO: 68

SEQ ID NO: 3321 - DNA, 93 bp, Homo sapiens; identical to SEQ ID NO: 69

SEQ ID NO: 3322 - DNA, 68 bp, Homo sapiens
agctggcatgtctgagtgtgtgcagtggtcggactccatgctcactcactcacacactccttgccact

SEQ ID NO: 3323 - DNA, 109 bp, Homo sapiens
ataatagccattctgactggtatgagatggtacctcattgtggttttgatttgtatctgtttgatgattagtgaggttgagcattttttcatgtttgttgactacttgt

SEQ ID NO: 3324 - DNA, 95 bp, Homo sapiens; identical to SEQ ID NO: 68

SEQ ID NO: 3325 - DNA, 93 bp, Homo sapiens; identical to SEQ ID NO: 69

SEQ ID NO: 3326 - DNA, 70 bp, Homo sapiens
tctggtacatagaaagtattctttattattattattcatagtagtaaggagatgaatgtgtgtgcttaga

SEQ ID NO: 3327 - DNA, 79 bp, Homo sapiens
cctagtcttctgtctctctgtcaactgatcatagggaactccccatgaggccatcagtgcagactggggaagagaaggc

SEQ ID NO: 3328 - DNA, 89 bp, Homo sapiens
gggatggataaattggcatgtgagtgtgtgtgtctgtctgtgtaagtggatggatggatgctcagatggatatgttagtgtatgtgcgc

SEQ ID NO: 3329 - DNA, 116 bp, Homo sapiens
ggatcctgcaattttccaaggtcccactggttccctgtagttgccaaagtcagagaagagtctgtggtatatttgcaggggatctggtgatatggtgacacaatggctgaggatcc

SEQ ID NO: 3330 - DNA, 97 bp, Homo sapiens
tcatgcgaggacgtggcaagaagaaggtcaggaaggtagctctcacaagaaactgagcactgccagaattttgatcttggactctgcagcctccaga

SEQ ID NO: 3331 - DNA, 95 bp, Homo sapiens
catctcggtgtccatctgtattgatggagtttttttcttttcatttttctttgtatatctagaaatattttgttataaattggacattgtagatg

SEQ ID NO: 3332 - DNA, 86 bp, Homo sapiens
cattcccacacagtactgtgtgtttctgtgtgtgtatgtacacacacacacacacacacacacacacacattatgcagccttaatg

SEQ ID NO: 3333 - DNA, 110 bp, Homo sapiens
tgcttgggattgtcttggctatgcagacttttttttggttccaaatgaaatttaaagtagttttttctaattctgtgaagaaagtcaatggtagtttgatggggatagca

SEQ ID NO: 3334 - DNA, 115 bp, Homo sapiens
cacacagtagagactcagaatatgttgaaaatattagtgagaaaggtaaacataattttattttacaaataattattaattttcattggttctgaataatgtgtatgcatgtgtg

SEQ ID NO: 3335 - DNA, 79 bp, Homo sapiens
tagatgtttcagcaggcctatttataagagtgaaatgagattataattatattatttcaccaggtacatgctacatcta

SEQ ID NO: 3336 - DNA, 109 bp, Homo sapiens
tgtgatatatatatatatatacattgtgtgtatatatatacattgtatatatatatatgtgtatgtatatatatatacattgtgtgtatatatatacattgtatatata

SEQ ID NO: 3337 - DNA, 117 bp, Homo sapiens
tgggcatccttgtcttgttccagatcttagaggatagactttcagtttttttaaattaagtttgatactagctgtgggtctgttgtatgtggattttattgtattgaggtatgttca

SEQ ID NO: 3338 - DNA, 88 bp, Homo sapiens
gtatatatgtgggtatgtatatgtgtgtgtgtgtatgaatgtatatatttaacaagctcttacataactcttaccatatgccagatac

SEQ ID NO: 3339 - DNA, 95 bp, Homo sapiens; identical to SEQ ID NO: 580

SEQ ID NO: 3340 - DNA, 93 bp, Homo sapiens; identical to SEQ ID NO: 69

SEQ ID NO: 3341 - DNA, 102 bp, Homo sapiens
tatgattttatacacatgaagtgattatatatatgtctgtatatgtggtatgaccacatgtgtatatatatatatatgcacactaagtgtaaaatatttata

SEQ ID NO: 3342 - DNA, 122 bp, Homo sapiens
gtcaaggctgtttttaatatcttctataaaattctgtggtttctttttcctcttaggtagatttgctaagtatagaagtgtgcagggaatagctagactagcatagaattgatatatttgcc

SEQ ID NO: 3343 - DNA, 115 bp, Homo sapiens
ggggtttttgccattaaatcgaatgtagtagtccggcctcctgaatggataaattctgattttcatgttcattatcgagttggcagtgcttcttatgtttgttgcctggacacct

SEQ ID NO: 3344 - DNA, 94 bp, Homo sapiens
atatatgtatataggtatatatatgtgtgtatatatgtatatgtgtgcatatacatatatacacacatatacatatatacttatatatgtatat

SEQ ID NO: 3345 - DNA, 76 bp, Homo sapiens
tatgtgtgtatatatgtgtatatatatgtgtatatgtgtgtgtgtatatatatatgtgtgtgtgtatatatatata

SEQ ID NO: 3346 - DNA, 117 bp, Homo sapiens
gtttcttaaaatggttatacaaatgtagtttttgagaagtgcatgggtaaaaataatatattattttaatttgcattttactaaggactattctaattaagtcagtatgtgagagat

SEQ ID NO: 3347 - DNA, 124 bp, Homo sapiens
atatgtatgtgtgtgtgtatatatatgtatgtgtgtgtgtatatatatatgtgtgtgtgtgtatatatatattatagtcatacatatatatatatatatatatatatgtatacatatggtgtca

SEQ ID NO: 3348 - DNA, 58 bp, Homo sapiens; identical to SEQ ID NO: 87

SEQ ID NO: 3349 - DNA, 131 bp, Homo sapiens
acctagcacagtgcctggcacagagtgtttactgctattattattatttattattattattattattattttttgagacggagtctcactctgtcacccaggctggagtgcagtggtgtgatctcggctca

SEQ ID NO: 3350 - DNA, 56 bp, Homo sapiens; identical to SEQ ID NO: 88

SEQ ID NO: 3351 - DNA, 74 bp, Homo sapiens
ggcaacatagtgaaatctcatctctaaaaaaaaaaaatttttttttgtttaaagcagggtctcactctgtcgcc

SEQ ID NO: 3352 - DNA, 58 bp, Homo sapiens; identical to SEQ ID NO: 884

SEQ ID NO: 3353 - DNA, 56 bp, Homo sapiens; identical to SEQ ID NO: 885

SEQ ID NO: 3354 - DNA, 88 bp, Homo sapiens
tagtagtaagtttattttttaataacttcagtgaagaaggcaggactttctgcacaagtccagtggagttggtaatagcttaactcta

SEQ ID NO: 3355 - DNA, 98 bp, Homo sapiens
atgacttgaccattctctctagctgcctttaagattttttcttttacattgaccttggtgaatctgatgagtacatgccttggggatggtcgtctcat

SEQ ID NO: 3356 - DNA, 119 bp, Homo sapiens
cactaaacataagaaatttgggatgactgtgacatcagaaaagatacagaacaaggatttttttttttttttttttctgagacaaagtgtcactttgttgcccaggctgaagtgcagtg

SEQ ID NO: 3357 - DNA, 58 bp, Homo sapiens
tgagacagagtctcgctctgtcacccaggttggagtgcagtggcgtgatctcagctca

SEQ ID NO: 3358 - DNA, 70 bp, Homo sapiens
ccaggcgtggtgcacatctatagtcctagctacttagaaggctgaggtagaagcatcacttgagtctagg

SEQ ID NO: 3359 - DNA, 185 bp, Homo sapiens
atactatatatatatatatatgtatatatatatatgtatatatatgtatatatatatacgtatatatatatgtatatatatatgtatatatatgtatatatatatacgtatatatatatgtatatatatatgtatatatatatacagagagagagtgtgtgtgtgtgtgtgtgtgtgtgtgtgtg

SEQ ID NO: 3360 - DNA, 116 bp, Homo sapiens
agcctatagatgagagaaaatacgtaaatgttgaagacaaaattttatatatatgtgtcaagggcatttaggaatcagtcatcagcaaggatctttttcattcgttatcatgtgct

SEQ ID NO: 3361 - DNA, 116 bp, Homo sapiens
attgtggttttgatatgcatttgcctgatcattagtgatgtcaagcattttttcatttttttttgccatttgtatgtcttcttttgagaattgtctattcatgtccctagcccagt

SEQ ID NO: 3362 - DNA, 116 bp, Homo sapiens
gtctaggatgaccatttggacattactttgatagcgagatagaagggatatgttaagtatagcacattgtcccttctattgctttttcagttatgtgggagggatcagaaatagac

SEQ ID NO: 3363 - DNA, 133 bp, Homo sapiens
ccagcctgtgcaacatagtaagacctccacatcaatttatttatttatttatttatttttttaattttattttttttgagacagagtctcgctctgtcgcccaggctggagtgcagtggcgggatctcggctc

SEQ ID NO: 3364 - DNA, 75 bp, Homo sapiens
tagcctgacaaagacatggtgaaaagaattttttttttttttttgagatagaatctcactctgtcacccaggctg

SEQ ID NO: 3365 - DNA, 97 bp, Homo sapiens
aggaaggtgtggtagcacagcaggagcatgacacagagcacagagcggaagctgtgccctgacgctccctcctccagctgcagcagcccatagtcct

SEQ ID NO: 3366 - DNA, 119 bp, Homo sapiens
atgtaataaatgtatcctaatcttatgtatgtttaactggattacatagatttttatcttttgttaaaatgtgtataccccgtggaccaacataatattaaagtatgtatatattatat

SEQ ID NO: 3367 - DNA, 56 bp, Homo sapiens
gggaatggcatttgatagtgctgagtctgtgcacagacccaggaaaggatgttccc

SEQ ID NO: 3368 - DNA, 58 bp, Homo sapiens
tgagatggagtctcactctgtcacccaggctggagtgcagtggtgcgatctctgctca

SEQ ID NO: 3369 - DNA, 102 bp, Homo sapiens
tagtgtgagccactgcgcccggccaaatcactggtttagatatatacttatttatttattattattttttgaggcggaggtctggctctgtcgctcaggctg

SEQ ID NO: 3370 - DNA, 58 bp, Homo sapiens
tgagacagagtctcactctgtcatccaggctggagtgcagtggtaagatctctgctca

SEQ ID NO: 3371 - DNA, 74 bp, Homo sapiens
ggggtttcagcatgttggccaggctggtctcgaactcctgacaggcgtgagtcaccacacccggctgggtcctt

SEQ ID NO: 3372 - DNA, 80 bp, Homo sapiens
ggaaatgggtgttcgagtttcagatttcttcttcttcttttttttattttgagacggagtctggctctgtcacccaggct

SEQ ID NO: 3373 - DNA, 110 bp, Homo sapiens
gcctggtgtggcagtgtgcacctgtagtcccagctacttgggaggctgaggtgggaggatggtttcagcctaggagtcagaggatgcagtgagctgaatcatgccattgc

SEQ ID NO: 3374 - DNA, 94 bp, Homo sapiens
aaagaaaccctatacctattaagcaaatattttctatatagattttctatatagatggtccctgacttaataatggttttacttaggattcttt

SEQ ID NO: 3375 - DNA, 116 bp, Homo sapiens
tgactgtaattgtctgggattcaaaatcctaaaggccagtaatttttgaaactttatttcattaagtctagttccatgctactccttccttttgacttcctagcctcttaaactca

SEQ ID NO: 3376 - DNA, 106 bp, Homo sapiens
ccttgctttctgttctgtaagtttgaatttccatataataaaggagatactgaattttgttttattatgtgtttatttaaaattgacagaatatcaacttgcaagg

SEQ ID NO: 3377 - DNA, 72 bp, Homo sapiens
gaacaatccagaggattgagctcacctaggactctgggtcctggattctagtttttgtttttttgtttgttt

SEQ ID NO: 3378 - DNA, 105 bp, Homo sapiens
ggtctggtcagtggtggatgatgtgagaccaaggaagaactttgtgcctagggtgagcacaatttttttttttaagatggagtctagctctgtcacccaggctgg

SEQ ID NO: 3379 - DNA, 58 bp, Homo sapiens
tgagaccaagtctcgctctgtctcccaggctggagtgcaatggcgtgatcttggctta

SEQ ID NO: 3380 - DNA, 58 bp, Homo sapiens
tgagacggagtctcactctgtcacccaggctggagtgcagtggcgtgatctcggctca

SEQ ID NO: 3381 - DNA, 79 bp, Homo sapiens
tgcacctctgcctgatgattccatttgtttttttgttttttaagacagaatctcactctgtcacccaggctagagtgca

SEQ ID NO: 3382 - DNA, 61 bp, Homo sapiens
gtgagcatccgttgtggccaacatttattttatttgaatgtgctgcatctcggttgtgcac

SEQ ID NO: 3383 - DNA, 70 bp, Homo sapiens
tttttttgagacagagtctcgctctgtcacccaggctggagtgcagtggcatgatcttggctcactgaaa

SEQ ID NO: 3384 - DNA, 104 bp, Homo sapiens
tccagtgtattgtgcttgccatcggtgcctgtgtcactctctggtaaaggtgtgtcattgttggccgcaacctctgggctgggatgagccatgctcctggtgca

SEQ ID NO: 3385 - DNA, 58 bp, Homo sapiens
tgagacggagtctcactctgtcacccaggctggagtgcagtggtgtgatcttggctca

SEQ ID NO: 3386 - DNA, 56 bp, Homo sapiens
gagacggagtctcactctgtcacccaggctggagtgcagtggtgtgatcttggctc

SEQ ID NO: 3387 - DNA, 103 bp, Homo sapiens
tacagatggacatttttgctgtttccagttattcttatatatacatattatatatgtaatgtgtaaaatgatgatgggataaagctatttgtgtgtacatgta

SEQ ID NO: 3388 - DNA, 92 bp, Homo sapiens
aatgatgggcatgttagtccttttgttattgtgagagtcctgcatagtttgttctgtgactcacttaatttacaagtccctagccccacatt

SEQ ID NO: 3389 - DNA, 182 bp, Homo sapiens
catatatgtgtgtatatatatatgtatatacatgtatgtgtatatatatgtatatacatgtatgtgtatatacatgtatatacatgtatatgtgtgtatatatatgtatatacatgtatgtgtgtatatatatgtatatatgtgtatatatatatgtgtgtgtgtgtctgtgtatatatata

SEQ ID NO: 3390 - DNA, 70 bp, Homo sapiens
gttgttgagatggagtctcactctgtcacccaggctggagtgcagtggtgggatctcagctcactgcaac

SEQ ID NO: 3391 - DNA, 66 bp, Homo sapiens
gattgtgagatccttgagaagagaggcttttttttttttttttttgagacagggtctcactctgtc

SEQ ID NO: 3392 - DNA, 112 bp, Homo sapiens
gtgtgagccacagtgctcgggcaaattcattgtacttttttttttttttttgagacagggtctcattctgtctcccaggctggagtgcagtggcgcggtctcggctcactgc

SEQ ID NO: 3393 - DNA, 58 bp, Homo sapiens
tgagacagactctcgctctgtcatccaggctggagtgcagtggcgcgatcctggctca

SEQ ID NO: 3394 - DNA, 77 bp, Homo sapiens
ctgggattacaagcgtgagccactgcgccctacctttatttttatttttagtgacagggtctcactctgtctcccag

SEQ ID NO: 3395 - DNA, 96 bp, Homo sapiens
ccaaagtgctgggattacaggcgtgagccacttcgtccaggcttaatttgattttttaaaaacagagacaagttctcactatgttgcccaggttgg

SEQ ID NO: 3396 - DNA, 110 bp, Homo sapiens
tggcttcatttagtagcattcatttaagttcctctgtgacttcttatagcttgataactcataatttgtcatagcttgatttaagcactgaataatgactacatgcacca

SEQ ID NO: 3397 - DNA, 58 bp, Homo sapiens
tgagagagaatctcactctgtcacccaggctggagtgcagtggtgtgatctcttctta

SEQ ID NO: 3398 - DNA, 124 bp, Homo sapiens
tatatatgtgtatatatacacatatgtatatgtaaatatatgtgtatatatacatctatgtatacataaatatatattgcatgtgtatatacatacattatatgtgtatatgtaaatatataga

SEQ ID NO: 3399 - DNA, 72 bp, Homo sapiens
atacagatctctgtagattcactgctgtctatatgaatggctgttagctgaattgtgcagtacaatctgtat

SEQ ID NO: 3400 - DNA, 80 bp, Homo sapiens
agaggttgcagtgagccaagagcacaccattgcactcaagcctggatgacaacggtgaaactccatctctctctctctct

SEQ ID NO: 3401 - DNA, 106 bp, Homo sapiens
tcctgcctcagcctccctagtagctgagagtacagatgtgtgccacaacccacagctaattttttgtatttttagtagagatggggtttcaccatgttagccagga

SEQ ID NO: 3402 - DNA, 71 bp, Homo sapiens
tacaggagtgagccaccacgcttggccaggaatttcttaccagtcaaatttctggcttctctctctctgtg

SEQ ID NO: 3403 - DNA, 86 bp, Homo sapiens
tcccttcttgtctctggggttctctgctccatctgacctgtagaacaacatagcagaagtcagagagctctcttccaagctggtga

SEQ ID NO: 3404 - DNA, 116 bp, Homo sapiens
ccctcctctggtaccaaggctacatcttaagctatgcctttgcagtcattctccaactggatctgagcgctggctaagctgagcctcagcctggcctagagtcactaaaccatggg

SEQ ID NO: 3405 - DNA, 88 bp, Homo sapiens
tatatatatgtatgtgtatatatatgtatatatgtgtgttgtgtgtatatattatgtgcgtgtgtgtgtgtgtgtgtgtgtgtgtata

SEQ ID NO: 3406 - DNA, 58 bp, Homo sapiens; identical to SEQ ID NO: 3380

SEQ ID NO: 3407 - DNA, 68 bp, Homo sapiens
ggtgtggtggtgtgtgcctgtggtcccagctacttggggggctgaggtaggaggatcacttgaaccca

SEQ ID NO: 3408 - DNA, 112 bp, Homo sapiens
tctgtcgctcagattctagactggtaaaatgtataatctttcacactcactcattgatgtcacacttggtgaaaagccctgactttgaggtctggtagaatgtagttgcaga

SEQ ID NO: 3409 - DNA, 79 bp, Homo sapiens
ctgagggtttgttctgtgccaggtgccctgccagaacctggggaggatctacagatgggaaagcaggccacgccctggg

SEQ ID NO: 3410 - DNA, 114 bp, Homo sapiens
catgactgccctacccacaaagacctctccctccactgagttccctgtgtgtctcactccgtgtgtatctcagtgactagacagtgagggccatgagggtaggggcaggacatg

SEQ ID NO: 3411 - DNA, 74 bp, Homo sapiens
tggtcagtggctaacttgtgatggaactcaggctgtaagatgtatatccaatgtccatacctctggcctggcca

SEQ ID NO: 3412 - DNA, 130 bp, Homo sapiens
gcacaggccatagcccaagccgagtggtgcagactggtccacacgtgtgctcccagagacacacacactgtgcctgggcagtgcctagtcctccaccagcactcgggggctggcatggcgtgggcacagt

SEQ ID NO: 3413 - DNA, 109 bp, Homo sapiens
gaagggtgaaggtggaggctccggagcccgatgcccgggtttgaacccagctctaccactcacaggctgtgtcacgtgggcaagttccttaacttcactgtccctcttt

SEQ ID NO: 3414 - DNA, 107 bp, Homo sapiens
ctcagggctgactctcagctgctgtgtgatgtggggcagggctctcaccctctctgggtctgttttgtcctggggaagatgagcatttggctgagccaagctttggg

SEQ ID NO: 3415 - DNA, 111 bp, Homo sapiens
gagggcactgggctgggagtctggagccctggctctctgtctctgtgtcaccactgacatgtactgggcagccttgagcaggtcttttcgccttacccagccccagtcttc

SEQ ID NO: 3416 - DNA, 83 bp, Homo sapiens
gacaggtgatgctcagggtgagctgagaggtgacagtgatgagtgggctggggtcagagaagcctgggtgtgggtgtcagctc

SEQ ID NO: 3417 - DNA, 119 bp, Homo sapiens
gaagaccttggcgtcatctggtccaaattgttccttctgccctccactccctgccccagtttgtgcatgaggaagtccagaccacaagagggactgtgattgtctgaaaccttcaggtc

SEQ ID NO: 3418 - DNA, 117 bp, Homo sapiens
tgccccttgcactcccactagcctgactgcactggtgctgctcacatgcctggctccctgtcagccactcactgctgcatccatggtgcacagcaggaggtaggggtgtagaggaca

SEQ ID NO: 3419 - DNA, 113 bp, Homo sapiens
gttgcaattattttggacctagagaattgtgtggtttcttttggtggggggtagtttatttttatatttaaagaaacaaagacattcagttcaagggggagaagaaatgaaac

SEQ ID NO: 3420 - DNA, 116 bp, Homo sapiens
gctatgagatttaaacagggaagtgccatggtcagatctatatttttatttatttatttatttacttatttatttagagacagggtctctctctgtcacttagcctggagtatggt

SEQ ID NO: 3421 - DNA, 85 bp, Homo sapiens
aggaatgtaatatagtatatgatgtgtgtgtgtatatacacacacacacacacacacacacacacacacacactgtcacattttt

SEQ ID NO: 3422 - DNA, 96 bp, Homo sapiens
ttatttagtggtacgtcagtctctgctagttgtttgtggtagaatgatgaataagacatagcacagcctagtagaaaatacagacgcccaaaataa

SEQ ID NO: 3423 - DNA, 101 bp, Homo sapiens
ggtttaatctgtatttgccgaataaaagtcagtctctctcagtgtttgttcttattgtatattccactgtgagggtttttgtttcatatatggaattcact

SEQ ID NO: 3424 - DNA, 97 bp, Homo sapiens
ccaaggcacattgctagtacatggtagggctgggatttatcattattattattagagacaggttctctctctatcatccaggctagaatgcagtggc

SEQ ID NO: 3425 - DNA, 57 bp, Homo sapiens
tttgagaccgagtctcgctctgtcacccaggctggagtgcagtgacatgatctcaga

SEQ ID NO: 3426 - DNA, 60 bp, Homo sapiens
agctgccaccttgctgtgtgctcacacgagctctttgtgtgtgtgtgcagagagtgcact

SEQ ID NO: 3427 - DNA, 116 bp, Homo sapiens
atatatgtgtgtgtatgtatacatactatatacagtatatatatatatttgtacatatgtatattgtatatatacatatatgtagttgtatacaataaaatgcacagatcttgtgt

SEQ ID NO: 3428 - DNA, 108 bp, Homo sapiens
tgttttatgctttcattcttttagtgtcttcttgtatatggtattaacaattaaggaactttatatatttatgaagacccttctatcagtgtgagagcatttcatgca

SEQ ID NO: 3429 - DNA, 84 bp, Homo sapiens
tgcacccattggccccagctcagactgtctctctgggatctcaggcttgtgcagtgtgaacacatggccaagagagggcaggca

SEQ ID NO: 3430 - DNA, 93 bp, Homo sapiens
gccttgcagggttgtcgtgagggttacatgggagagctgtgtgatggctaccatcatcacatcttcatcttcatcatcatcaagtgtttaggc

SEQ ID NO: 3431 - DNA, 84 bp, Homo sapiens
ttccctggtgtctgaacagagtcaggctcctgacaggcccccgctatttggagctgagtcaataggatgtgcaaactgagggag

SEQ ID NO: 3432 - DNA, 66 bp, Homo sapiens
cagtcactaatggagtccctgttctgtgcctggcatcatgctaagcactgaagagagagtgctgag

SEQ ID NO: 3433 - DNA, 115 bp, Homo sapiens
cagctccctgtgagtccctctgaaccacactggccacactgtgctgctgtcacctgtctgtgtgtctgactcccccagcagactgtgagcttctggagaacaggggactcatctg

SEQ ID NO: 3434 - DNA, 114 bp, Homo sapiens
tgagccagagcacagccagggtgccctggggtggggccagtctgggattcttttctgtttttctttttgagacaaggtctcactctgtcactcaggctggagtgcagtggtgcg

SEQ ID NO: 3435 - DNA, 70 bp, Homo sapiens
tgtcctccctgtgtctgtggctccctcccaggactggggagtaagagaccagggtctcagggtcagttca

SEQ ID NO: 3436 - DNA, 88 bp, Homo sapiens
gctgaggaaaggggacttgaggttttaggttgttaagagataaaacactccacacatcctcgtccctcctgactcctaggacaccggc

SEQ ID NO: 3437 - DNA, 106 bp, Homo sapiens
gtgtaacatagacaaattttgcataatacagagtactagagtctatttttttttattatactttaagttctagggtacatgtgcacaatgtgcaggttagttacat

SEQ ID NO: 3438 - DNA, 84 bp, Homo sapiens
gggtgatggggatggtggcgttgcccttctgttctcagacagttttttgtttgttttttgagacaaagtctcactctgtctccc

SEQ ID NO: 3439 - DNA, 76 bp, Homo sapiens
agcctgggcgatagagcaagaccttttttttttttttttaaattaaaaaaaagttgtcttaatttatactgaggct

SEQ ID NO: 3440 - DNA, 112 bp, Homo sapiens
gcgctaggtgacagagccaggatttgaacctaggctgtgcgacagaggtatgcccaggccctccctgactcactgcttctcttctgctggacttctccctaggcccccatcc

SEQ ID NO: 3441 - DNA, 96 bp, Homo sapiens
ctagggggatgcagacttgagccaggattgtgttgattgttgtctggaacggcagacagactaattgacaaggtaggtggtggtcagtgctcatgg

SEQ ID NO: 3442 - DNA, 58 bp, Homo sapiens; identical to SEQ ID NO: 2224

SEQ ID NO: 3443 - DNA, 56 bp, Homo sapiens; identical to SEQ ID NO: 335

SEQ ID NO: 3444 - DNA, 108 bp, Homo sapiens
acacgcacacactatatatatgcatatatatatgcatatatatgcatatatatgcatatatatatagtgtgtgtgtgtgtatacatgtatatatgtatatatctccat

SEQ ID NO: 3445 - DNA, 108 bp, Homo sapiens
tatacatgtatacacacacacacactatatatatatgcatatatatgcatatatatgcatatatatatgcatatatatagtgtgtgcgtgttttgatatacatatgta

SEQ ID NO: 3446 - DNA, 83 bp, Homo sapiens
tgaataaattgtaatatatatgtatgtatatagatatatatgtatatctgtatatgtatctttatcaaatgaatggttattca

SEQ ID NO: 3447 - DNA, 76 bp, Homo sapiens
gggtctcactctgtcacacaggctggagtgcagtggagcgatgatagctcactgcagtctcaaactgctgggatcc

SEQ ID NO: 3448 - DNA, 100 bp, Homo sapiens
ccagcctgggcaacatggcaagacttccatctctaacaaaaaaaaaaaaaaaaaatttttttttttttgagacggagtctcgctgtgacacccaggctgg

SEQ ID NO: 3449 - DNA, 110 bp, Homo sapiens
ccacatggttggatgacatgccagtggctgtcttgagttggtggcagtatttttatttatctatttggaagcaagatgcctgccaagggcactgttgttcatctgtcatg

SEQ ID NO: 3450 - DNA, 119 bp, Homo sapiens
gacttacctcttattattgctttgaggtggcagggttttagctttctggcagctgtcacatcattgagagcagaacgaaaattgcctaacaaaacaccgtttagtaaaagagagaagtt

SEQ ID NO: 3451 - DNA, 76 bp, Homo sapiens
aggcctgagggattgagcgcccggactagaaaactgccacactgaggtagctgtcttctgtttctctcagaagcct

SEQ ID NO: 3452 - DNA, 81 bp, Homo sapiens
agggcctgctctgtgggtagactgggcgggcgtggctgtcacagctctgaccacactctgactcagtcccacataggccct

SEQ ID NO: 3453 - DNA, 74 bp, Homo sapiens
ggttcagggccaaggttgactgccttttttttttttttttttttttttttgaggcagagtcttgctctgtcacc

SEQ ID NO: 3454 - DNA, 58 bp, Homo sapiens; identical to SEQ ID NO: 1745

SEQ ID NO: 3455 - DNA, 94 bp, Homo sapiens
ggattacaggcatgagctactgtgaccgggccttcacttttttttttttttgagatggagtctcgctctgtcatccagactggagtgcctgtcc

SEQ ID NO: 3456 - DNA, 108 bp, Homo sapiens
ccgccgaaagagggggaatctgtttattttattttattttattttattttattttatttatttatttatttattttgagacggagtctcgctctgtcacccaggctgg

SEQ ID NO: 3457 - DNA, 107 bp, Homo sapiens
atatatatatatatatatacacacacatatatgtgtgtgtatatatatatgtgtgtgtgtatatatatgtgtgtgcatatatatgtgtgtatatatatatatatata

SEQ ID NO: 3458 - DNA, 124 bp, Homo sapiens
ggcttcagttctcaaggaatattgttggatatttggaagtgattttgatgactctatttgaatttttattggagtagctgaaaaaatagttcctatatcagtggaggactttgactataattga

SEQ ID NO: 3459 - DNA, 74 bp, Homo sapiens
gtgactgtcagtcactcacaccctgcaggggcactaattccgagagccttaggggtgggtggggagcagttcat

SEQ ID NO: 3460 - DNA, 72 bp, Homo sapiens
tgcctaactcacagaattgagagttgaaaacagtccataatttctaatacattctcagtaagtgagaaggca

SEQ ID NO: 3461 - DNA, 70 bp, Homo sapiens
ttgttttgaggcagggtctcactctgtcacccaggccggagtgcagtggtgcgatctcggctcactgcaa

SEQ ID NO: 3462 - DNA, 86 bp, Homo sapiens
ggctaactgcagagtgaacagtgacaggtcagtgctgagcagagggaagcacggcggggatctgaccccacctggagagtcggcag

SEQ ID NO: 3463 - DNA, 97 bp, Homo sapiens; identical to SEQ ID NO: 1307

SEQ ID NO: 3464 - DNA, 88 bp, Homo sapiens; identical to SEQ ID NO: 1308

SEQ ID NO: 3465 - DNA, 81 bp, Homo sapiens; identical to SEQ ID NO: 1309

SEQ ID NO: 3466 - DNA, 77 bp, Homo sapiens; identical to SEQ ID NO: 1310

SEQ ID NO: 3467 - DNA, 79 bp, Homo sapiens
gctacctgcgaggacactgctctctctcacatctctctgtttctggctgatctagggacagccagtggcctcctgtggc

SEQ ID NO: 3468 - DNA, 90 bp, Homo sapiens
caggctgttttttggttccatatgaaatttaaagtagttttttccaattctgtgaagaaagtcaatggtagcttgacggggatagcactg

SEQ ID NO: 3469 - DNA, 82 bp, Homo sapiens
agggtccagacagagcacagtgagtttccttcgctcaaaaagtggagattggagctcagggagatggacgtggctgggcttt

SEQ ID NO: 3470 - DNA, 80 bp, Homo sapiens
ccctggcttctagccgcagtgctccagtctctgccactgtgtctcatggccttctccctctgtggctgtgtctccatggg

SEQ ID NO: 3471 - DNA, 85 bp, Homo sapiens
gttcctaaggatgtcgtctgtgttctgaacagtgaccgtatacagtgcagtttctctcactgacagaatacctcagcatgggaat

SEQ ID NO: 3472 - DNA, 115 bp, Homo sapiens
agtggctagaaaagtacctggctggtagcaggtaccccaaacaaatatcctgctgaggatatttatatctatattattgggaatctactgtgtgccaggcactgttctagaccct

SEQ ID NO: 3473 - DNA, 85 bp, Homo sapiens
gtccttctaagattttttgtatttaaggagaaccgcaaatgcatcactgcagttctccttaaacacagaagagctttggtcagga

SEQ ID NO: 3474 - DNA, 83 bp, Homo sapiens
ggactgggtgacactggcattagagtcagaaaagccacattatatattttttcatgcacctaatccatggctgcccactgtcc

SEQ ID NO: 3475 - DNA, 126 bp, Homo sapiens
gcttcactctcagtctgggtgccagcatctgcgcaaaagccatgttgagccatgcccaagagtgcctgcacagtgtcagctgggcagtggtaccttctacagacaacagtaactctgagccaggcg

SEQ ID NO: 3476 - DNA, 87 bp, Homo sapiens
ctgtgccttgctctgtgtctctctcattccttaaaaaactagcccgaacatggtcttatgaaaatggcagaggtacaagtgagccag

SEQ ID NO: 3477 - DNA, 68 bp, Homo sapiens
atactgtatatagtatatataatatataatatatattatgtatacactatatatactgtatatagtat

SEQ ID NO: 3478 - DNA, 72 bp, Homo sapiens
atacatatgtactatatgtatatatatactgtaccatatacagtatatatacaccatatgtgtacatagtat

SEQ ID NO: 3479 - DNA, 115 bp, Homo sapiens
aattaccttcctagtgcataattcagtgtctaactaatgtatatttaaatatattatgtttaaatatatttaaaatattctagaaatgctgaaatatatggatttgaattgaatt

SEQ ID NO: 3480 - DNA, 62 bp, Homo sapiens
taattatctccagtttggggaggggattgtctgatcctctcactctctttggctgttaattg

SEQ ID NO: 3481 - DNA, 89 bp, Homo sapiens
gcccttctttaacctcaaacagccaagacagcactctaaggtcagaggaaggttgtctgggaagcattgttttgtcatcttaaaggggc

SEQ ID NO: 3482 - DNA, 90 bp, Homo sapiens
gctagactgtgagatactaaagggcaaaaaacacattgtatacatatatttttgtattacgaatgctcagcttggtagctgacatctagt

SEQ ID NO: 3483 - DNA, 109 bp, Homo sapiens
actgtaagaagctatgcaaactagaacacaataaaatagtataattaaagaataataataattttttattatactttaagttctggggtacatgtgcagaatgtgcagt

SEQ ID NO: 3484 - DNA, 91 bp, Homo sapiens
ttccaataaatttttgcatatggtatgaggtaggaaacttattttttttatctgaaagtatatacaattgcatttatactatttattggga

SEQ ID NO: 3485 - DNA, 92 bp, Homo sapiens
cttgtgctagaaactactctgcagtatgaatctaaagatgaatctttttaaatcatactttccagggctacagttattatgtcttgtacaag

SEQ ID NO: 3486 - DNA, 82 bp, Homo sapiens
ggaacaataggccataccatatagcctaggtgtgtggtaggctataccatctagggttgtgtaagtacgttctatggtattc

SEQ ID NO: 3487 - DNA, 101 bp, Homo sapiens
gtgtgcctgtgtgtatatattcactttgtacacacacacacacatatgtgtatatatatatatgtgtgtgtatatatacatatatatacacacacacacac

SEQ ID NO: 3488 - DNA, 110 bp, Homo sapiens
ggtgacaggactaacgtgcagctcccacttggatggacagaacagtgtgtggagactcacactgtgaagttttgctccaagaaccactgcagggacataccaggaaaacc

SEQ ID NO: 3489 - DNA, 89 bp, Homo sapiens
ggaagtggggaaaagccggcagtgacaggcctcacttagttcccacgcagccagcaaggccagtctcactctcactgtgccccactaac

SEQ ID NO: 3490 - DNA, 83 bp, Homo sapiens
ctgtgacagggtcactgttactctctccttgcccgactttatcaaagaggaacctggggatgggagtccagtgttctgtccag

SEQ ID NO: 3491 - DNA, 78 bp, Homo sapiens
ctcaaatgtttttcttattctgagagtcagaagcagatgtccttgaagtacctctgttctcagggaaaggctgatgag

SEQ ID NO: 3492 - DNA, 82 bp, Homo sapiens
ttctctgagcctcagattcctcaaatgtgaagtagggtgataacgttacctacttcagaggattgtagtggggattacggaa

SEQ ID NO: 3493 - DNA, 95 bp, Homo sapiens; identical to SEQ ID NO: 68

SEQ ID NO: 3494 - DNA, 93 bp, Homo sapiens; identical to SEQ ID NO: 69

SEQ ID NO: 3495 - DNA, 117 bp, Homo sapiens
ttcatatctgcttatacttgtgaccctaagctatggggaactcacaggcaggaactctctctgtctcattatccccatggtccagtactagggctgtttattgcatgagtgaatgaa

SEQ ID NO: 3496 - DNA, 96 bp, Homo sapiens
caagcattattctcttttgtacattgctctgtgtccaaacacaactctgaatttgtatttgtctggcacatagtagttgctcagtaaatatatttg

SEQ ID NO: 3497 - DNA, 58 bp, Homo sapiens
tgagacagagtctcactctgtcgctcaggctggagtgcagtggcgggatctcggctca

SEQ ID NO: 3498 - DNA, 119 bp, Homo sapiens
tgcttaggattatcttggctatatgggctcatttttgcttccatatgaaatttaaagtagtttttttctaattctgtgaagaaagtcaatggtagcttgatggggatagcattgaatct

SEQ ID NO: 3499 - DNA, 70 bp, Homo sapiens
gagaaggatcataccaatatccactattctttatttttatttattttagtggatattcactatccttttt

SEQ ID NO: 3500 - DNA, 115 bp, Homo sapiens
gaatctaagtacttaatttcacatgctccactggacaaggtgctgaaggtggtatttctttttttttttttttatactttaagttttggggtacatgtgcacaatgtgcaggttt

SEQ ID NO: 3501 - DNA, 136 bp, Homo sapiens
gtgacgaatatgtgaattagcttggttgtggcaattgtattttttttttttttttttgagacagtctgtcactccgatgcccaggctggagtgcagtggcacaatcttggctcactgcaacctcctcctcctgggt

SEQ ID NO: 3502 - DNA, 67 bp, Homo sapiens
tttcagcaggcagtgagctctcaccattgcaggagaccaagctgaggctggctgtttgcctgtgagg

SEQ ID NO: 3503 - DNA, 84 bp, Homo sapiens
gtgttgacagatatggaaattctgtgtcctttattatgtatatttctgtatataaagaatggatatctatttatctgtggacat

SEQ ID NO: 3504 - DNA, 89 bp, Homo sapiens
gtcgatggtgtggtagaagtcacaggggtcaaattcaactgggagatgtcaaagtcatcacagtcgtctgtatcctgtgccaccccgac

SEQ ID NO: 3505 - DNA, 118 bp, Homo sapiens
gcatataataggcagcactctatattatgttgagatgcttgatgggttgattttttttttttttttttttaatgaaacagagtctcagtctgtcacccaggctggagtgcaatggtgc

SEQ ID NO: 3506 - DNA, 74 bp, Homo sapiens
caaatgatgatgatgatcatgatcatgatgctttgttggtagacaggcaatgggtcactcatactcattatatg

SEQ ID NO: 3507 - DNA, 83 bp, Homo sapiens
tttgcagattgttaagtgtacatgcttctggcttgaatacctgggcaaagagaagggagcatttaggggacagagtctgagag

SEQ ID NO: 3508 - DNA, 58 bp, Homo sapiens; identical to SEQ ID NO: 315

SEQ ID NO: 3509 - DNA, 75 bp, Homo sapiens
ggttttgttgaaataagagtctccctctgtcacccaggctggagggcagtggcatgatctcggttcactgcaacc

SEQ ID NO: 3510 - DNA, 114 bp, Homo sapiens
tctgagaaaagacaagtccttctgcctgtgagcctgtaaaatcaaaacaagttagttatttccaagatacaatgggggtacaggcagtgggtaaatgttcccattctaaaagga

SEQ ID NO: 3511 - DNA, 78 bp, Homo sapiens
ctctatctctccctctgtgtgtatgtctctggagagatagatacagagaaaaacagacacagagaaacagagacagag

SEQ ID NO: 3512 - DNA, 63 bp, Homo sapiens
atcctgcaactctactgaaattgtttattagctctaacagttttttggtagagtctttagggt

SEQ ID NO: 3513 - DNA, 80 bp, Homo sapiens
tgtcctaatttacttcagaaatgatttaagcctagaatcgcaggtttgaattaatattaatatttgatttaattaggaca

SEQ ID NO: 3514 - DNA, 104 bp, Homo sapiens
tttggctattccaagtccctttgcattctcatgtatattttttaatttacttgtcagttttttcaaaaagtgtgctaggaattttattgggattgtgctgaatg

SEQ ID NO: 3515 - DNA, 110 bp, Homo sapiens
ggtacagaactaatgaaatatatatatatacacacacacatatatatgtatacatatatgtgtatatatatgtgtgtgtgtatatatatataagccatttattaagtatt

SEQ ID NO: 3516 - DNA, 84 bp, Homo sapiens
gtggaggttgcagtgagccgagatcgtaccattgcactctagcctgggcaacaagggtgaaaatctgtctctctctctctctat

SEQ ID NO: 3517 - DNA, 99 bp, Homo sapiens
ttctttgctctagtagaaaggggataatagtgtttcattttcaggttgatgtgaagtttagaagtatgtatctaaatacctgtatatcggtagcaggaa

SEQ ID NO: 3518 - DNA, 70 bp, Homo sapiens
ttaaggatgctaactgcctagccagtggaccgtcattctgtcactctgtgtcagtagtggacattcttgg

SEQ ID NO: 3519 - DNA, 85 bp, Homo sapiens
attcacaatttcactgaagaaattcagcaccaggcagacacagacagaggaaggttggggtggagttgaaacagtggggaggagt

SEQ ID NO: 3520 - DNA, 84 bp, Homo sapiens
actttataaagttctttataaagaactttagtaaataactttataaagttctttataaataactttagtaaataactttaaagt

SEQ ID NO: 3521 - DNA, 88 bp, Homo sapiens
agctgggactacaggtgcatgccaccatgctctgctaagtttttaatttttcttagtagacacggggtatcactatattgtccaggct

SEQ ID NO: 3522 - DNA, 88 bp, Homo sapiens
gacaaagggggctcctgagcagcaactggagggggatgctacctctcagccaccctctctcagccctgatgactcttcagttccagtc

SEQ ID NO: 3523 - DNA, 118 bp, Homo sapiens
tctgggagatccataaacagtgagaagtccttgtctgccaaatgatgaagatttacaccactacagtagtctgttcattgcttttacctgtttcactgatttcggctctaccttaaga

SEQ ID NO: 3524 - DNA, 121 bp, Homo sapiens
tatgcacacagttttttatatatatatgtgcacacagttatatatatacatacacagttttatatatatataaaactgcacatatacgtatgtgtacatatatatgtgtatagatatatat

SEQ ID NO: 3525 - DNA, 74 bp, Homo sapiens
atacgtatatgtgcagttttatatatatataaaactgtgtatgtatatatataactgtgtgcacatatatatat

SEQ ID NO: 3526 - DNA, 116 bp, Homo sapiens
ctttagcatgcagtttatttccttgttacagcatttcctgatcttaattattttatttccttatatgtttacttgtctcttgctggcctttcttgatagactgtatgcttcctgag

SEQ ID NO: 3527 - DNA, 117 bp, Homo sapiens
gtgaaatatatatgtgtgtgtgtgtgtgtgtgtgtatatatatattatatatatataacaatgttattaatgtgtatgtgtatatatatatatacacataccttctaggtttatgta

SEQ ID NO: 3528 - DNA, 70 bp, Homo sapiens
tctatctatatctatgtgtgtgtgtgtgtgtgtatatatatatacatatatacatgtagagagagagaga

SEQ ID NO: 3529 - DNA, 74 bp, Homo sapiens
catgcctagtcatatgtatgtatagtaagtggttcatacatttttgaatgattgtatgtatgaatgaaaggctg

SEQ ID NO: 3530 - DNA, 101 bp, Homo sapiens
cacctgtacatctgtggccatctgctctacctcagttcctttaagacaactggactggctcacagaggaaagtgaggactgtaccagggccatctgcagtg

SEQ ID NO: 3531 - DNA, 84 bp, Homo sapiens
tgctccatcacttgccagctgtgtgaccttgggcatatgactcagtctctgtgcctcagtttccacatttgtgaagtgggggta

SEQ ID NO: 3532 - DNA, 87 bp, Homo sapiens
aggtaatgtagtgaggtggaatctggacttcctgtgtggtttggggtaaataacttagactctctgagtcacgatttcctcactcct

SEQ ID NO: 3533 - DNA, 86 bp, Homo sapiens
ccattgtaacagtgttgagaggtgggactttttttttttttttattgagacagtctctctccgtcacccaggctggagtgcagtgg

SEQ ID NO: 3534 - DNA, 113 bp, Homo sapiens
cttgggctttgttgtagaggtgggttttttctaagcacaaggaaggcagggtcaggtctgcaattttctgtggctccaggaacaaatactcctcctgctcctctaagcctggg

SEQ ID NO: 3535 - DNA, 95 bp, Homo sapiens; identical to SEQ ID NO: 68

SEQ ID NO: 3536 - DNA, 93 bp, Homo sapiens; identical to SEQ ID NO: 69

SEQ ID NO: 3537 - DNA, 84 bp, Homo sapiens
gctaccctgcctctctctctcagttcccccaacctggcttctccagtcacacagagccacatgagaagagagctggtattaagc

SEQ ID NO: 3538 - DNA, 91 bp, Homo sapiens
ccaaatccacattgaggggatcagggaagagcaaactaggctttctaaagatgtcagttgatctgaattgtgagcaaggtgtgggtattgg

SEQ ID NO: 3539 - DNA, 110 bp, Homo sapiens
tgcttaggtttgtcttggctatgcaggctcttttttggttccatatgaaatttaaagtagttttttctaatcctgtgaagaaagtcagtggtagcttgatgaaactagca

SEQ ID NO: 3540 - DNA, 115 bp, Homo sapiens
aagaaaaaaagtggatgctttgcttcttactgttgagatttgagacttctttatatttttctgaatataagtcttacactgagtatgtgagctgcaaatattttcttccagtctt

SEQ ID NO: 3541 - DNA, 56 bp, Homo sapiens
gtgtatgacagtgggcagacgacatcacttgtctctgcctcacttgcgtcatctat

SEQ ID NO: 3542 - DNA, 207 bp, Homo sapiens
ggatgtgtgtgtctacgcatgtgggggtgtgggtgtgacagggtgtgttctgtgtgagaacatgtgtgtagtgtccacatgtcctctgtgcgtgagtccctgtgtgtgatgttgtgttctcggtgtgagttcatgggtgtgatggggtgtgtgctgtgtgagaacgtgtgtgtagtgtccacatgtcctctgtgcgtgagtccctgt

SEQ ID NO: 3543 - DNA, 113 bp, Homo sapiens
tatagatatgtatttatatgtgtataaacatgaataatatttatgtttgttatatacatttatcttgtatattcctgtttatatacatataaacatgtatatccatatctgtg

SEQ ID NO: 3544 - DNA, 95 bp, Homo sapiens
ggtgtctagggtcctgtctggtccatctggtccatatgctgggtcctatcagtgctacaagacagatgagacagaagccagtcccttggacagcc

SEQ ID NO: 3545 - DNA, 95 bp, Homo sapiens; identical to SEQ ID NO: 68

SEQ ID NO: 3546 - DNA, 93 bp, Homo sapiens; identical to SEQ ID NO: 69

SEQ ID NO: 3547 - DNA, 79 bp, Homo sapiens
ctcctcagcccaatacagacctggcacctgggaggcactcagtgaggatgcctgcctgcctgcctgcctggctgaagag

SEQ ID NO: 3548 - DNA, 82 bp, Homo sapiens
gaagggaaatcattagactcaagttgttatttggttttatttatttttaaaatcattctgcagctttagagtccgtctgttc

SEQ ID NO: 3549 - DNA, 89 bp, Homo sapiens
cagtgtgtaagtggcagagctgggatttaaactcaagaattcttttttttttttttttgagatggagtctcactctgtcacccaggctg

SEQ ID NO: 3550 - DNA, 78 bp, Homo sapiens
tgtatgtgtgtgtttttgtgtgtgtgtgtgtgtgtgtgtatatatatatatacacacagacagatgtatatatttata

SEQ ID NO: 3551 - DNA, 72 bp, Homo sapiens
agtctctgcctctcagagtggctgtgggaattaaattcagaaatgccagcctgcctgtgaggctttgagact

SEQ ID NO: 3552 - DNA, 95 bp, Homo sapiens; identical to SEQ ID NO: 68

SEQ ID NO: 3553 - DNA, 93 bp, Homo sapiens; identical to SEQ ID NO: 69

SEQ ID NO: 3554 - DNA, 107 bp, Homo sapiens
gacagcatgtttcttgatttgcctctgtaataaacagggagacctgggtttgagtcaggctctgtcactcacaagctgggcagccactcctctgggccttggtttcc

SEQ ID NO: 3555 - DNA, 69 bp, Homo sapiens
tatatatatacacacatatatatacatatatatgtatgtatattgtatgtgtatatgtgtatgtatata

SEQ ID NO: 3556 - DNA, 63 bp, Homo sapiens
gcttgaagatgacagagaggactctgcctggcaaggtagaacccttctgctccccttccaggc

SEQ ID NO: 3557 - DNA, 61 bp, Homo sapiens
ggggaccaggtgaaacagaggggttgggattgcctggaagacttgtctcgctctgtcaccc

SEQ ID NO: 3558 - DNA, 85 bp, Homo sapiens
ctgatgagacagctgcagtttggggagtgtgatatcaaggaaagcagtgtcttgagtctgtcactttctctctctgtcccattgg

SEQ ID NO: 3559 - DNA, 58 bp, Homo sapiens; identical to SEQ ID NO: 1215

SEQ ID NO: 3560 - DNA, 93 bp, Homo sapiens
tcacacattgaagcctatctggtgtctgtctgtttctcagagaacccagatgagtggtccctggagtgatctgagaaaacaataagaggatgc

SEQ ID NO: 3561 - DNA, 59 bp, Homo sapiens
gctcagccacactcagtgaggctacttaagctttctgtacctactgtgtgtgtgtgtgt

SEQ ID NO: 3562 - DNA, 63 bp, Homo sapiens
atctatatgtgcatgtatgtatatgtatatattatgtatgtatgtacatacctgcttataggt

SEQ ID NO: 3563 - DNA, 75 bp, Homo sapiens
acttgaccctgtgactttcagtgtttctctggaggagggatgtacttctccatattactgacaccagacttgggt

SEQ ID NO: 3564 - DNA, 90 bp, Homo sapiens
caggctctttttgggttccatatgaaatttaaagtagttttttctaattctgtgaagaaagtcaatggtagcttgatggggatagcactg

SEQ ID NO: 3565 - DNA, 72 bp, Homo sapiens
ctgctaatgaattacttgctgtcagactcactgtcattctgtggtaggtaatttgtccattttctatagtag

SEQ ID NO: 3566 - DNA, 66 bp, Homo sapiens
agatgcatgtgtgtatatatatatctgtgtatgtgcatatatttgtatgtgtgtacatatgtatct

SEQ ID NO: 3567 - DNA, 112 bp, Homo sapiens
cagctcccctcatgaccctggagggaattctgcccactcacagactctttcttattctgggcctctgctgttatctgggtatagctccctgtcacagtcagtttggggactg

SEQ ID NO: 3568 - DNA, 102 bp, Homo sapiens
gggatgtgagactgttttgcaactgtagggacccctgagcctttttaccatcagatattctagttcagttgatataaatacatgtacttacttatcaatccc

SEQ ID NO: 3569 - DNA, 84 bp, Homo sapiens
caagcctgctcatttcacgtggtcttttattttttattattatactttaagttttagggtacatgtgcacaatgtgcaggtttg

SEQ ID NO: 3570 - DNA, 67 bp, Homo sapiens
gggtcatgtgaagtgtctctgttctggagaatcttgattcccaagagccccagataattcctggccc

SEQ ID NO: 3571 - DNA, 81 bp, Homo sapiens
tactatatgatatatatgtgtatatatatgtctgtgaatacataaaaaatgtaagacagacatacaaaacgcataatagtg

SEQ ID NO: 3572 - DNA, 110 bp, Homo sapiens
ggaatatactgttatcctcatttttgtagatgaatactttgttatttatttaaccaagatgttaaataaataaattaccagtggtctcagagccagtaaatagtgaagcc

SEQ ID NO: 3573 - DNA, 109 bp, Homo sapiens
ttgtaattcttgctttttagagacaaacatctgtggattaaatgattagacactcactatgtgtcactgtttggtctttgttttaaaaacctgcttacatggattagaa

SEQ ID NO: 3574 - DNA, 72 bp, Homo sapiens
ttgttttttgagatggagtctcactctgtcacccaggctggagtgcagtggcgggatctcagctcaccacaa

SEQ ID NO: 3575 - DNA, 86 bp, Homo sapiens
ttgttctctgctcttagtttctctcaaacaaatagagtctctctctctctgttccaagctgcctagagttgggggtggagtgacaa

SEQ ID NO: 3576 - DNA, 101 bp, Homo sapiens
tagcatatgacatgcactgatagtttattcttcctctgctccccacactagaatgtgagctccatgaggggaaaggtttttgtctgttttgttcactgcta

SEQ ID NO: 3577 - DNA, 74 bp, Homo sapiens
atatgtatatatatgtatatgtgcatatatgtatatacatatatcacacacatatatatcacatatatacatat

SEQ ID NO: 3578 - DNA, 141 bp, Homo sapiens
tgggtgattcaattggcctctttgagactcaggtttttttttttttttttttttttgagactgagtctcgctctgtcacccaggctggagtgcagtggcgtgatcttggctcactgcaacctccacctcccaggttcaagc

SEQ ID NO: 3579 - DNA, 117 bp, Homo sapiens
atcatttgagtgtgtttgtctggcaaagccccagttctgtgtgagcctcactgtctgccttctctgcatgtctgtgaggactactgggtgaagtgccattcacgctctcaaattgat

SEQ ID NO: 3580 - DNA, 94 bp, Homo sapiens; identical to SEQ ID NO: 3248

SEQ ID NO: 3581 - DNA, 74 bp, Homo sapiens
tggtagatatatatatatatatctggtagatatatatatatatatctggtagatatatatatatatatatctca

SEQ ID NO: 3582 - DNA, 124 bp, Homo sapiens
agactctgtttcaagaaaaagaaaaattgctgaataaaaataaaattgtctctagactttttctttttgagatggggtctcactgtctcgcccaggctggagtgcagtggcgtgacctcggctc

SEQ ID NO: 3583 - DNA, 116 bp, Homo sapiens
tttaaattatgcatacaattttcttaatagtgaaatggctattccaattacctagcttatgtaaggtagtttgtaatagtttgtgacttttgagaaactggtttatttcatttagg

SEQ ID NO: 3584 - DNA, 60 bp, Homo sapiens
tatgcatgtatgtatgtatgtatgtatgtatgtatatacatatacctacatgcatgcata

SEQ ID NO: 3585 - DNA, 75 bp, Homo sapiens
tatatttatataacacatacacacatatatatgtatacatatgcatatgtgtgtatgtatatatgtatgtgtgtg

SEQ ID NO: 3586 - DNA, 81 bp, Homo sapiens
tcattcatgttgcatatgcaatgtcatcatctggagatgcccctgtgtgtcctcattgtatgtgttcactacacagactga

SEQ ID NO: 3587 - DNA, 114 bp, Homo sapiens
gtgagaaatactgtagcagagtaaagaagtctttagctttcaggagtgacttgccaactgttttttttttttaacttcttggtctgcagactgtctgttctctgccactctcac

SEQ ID NO: 3588 - DNA, 90 bp, Homo sapiens
caggaagctctgtacactgacacaacatccccttatggccaaatctcatgaaaagttgtatgctgtttggtatcacagagagccatcctg

SEQ ID NO: 3589 - DNA, 84 bp, Homo sapiens
tttaaggaagtacaaatgctaggcactcagtaaatgttagctattatgattatttctctgtcactagtttgtgagctccttaaa

SEQ ID NO: 3590 - DNA, 95 bp, Homo sapiens; identical to SEQ ID NO: 68

SEQ ID NO: 3591 - DNA, 93 bp, Homo sapiens; identical to SEQ ID NO: 69

SEQ ID NO: 3592 - DNA, 76 bp, Homo sapiens
ggaaaggagaactctgttccagttcaaggacaaaacagattttttttttctttggagacggagtttctcttttgtc

SEQ ID NO: 3593 - DNA, 95 bp, Homo sapiens; identical to SEQ ID NO: 68

SEQ ID NO: 3594 - DNA, 93 bp, Homo sapiens; identical to SEQ ID NO: 69

SEQ ID NO: 3595 - DNA, 99 bp, Homo sapiens
gatgaaagtacagaacattcaaggaattgatgccaggaaattatactttattaaatatgattttttggctcttttttctgaacatggtgtctaacaatc

SEQ ID NO: 3596 - DNA, 95 bp, Homo sapiens; identical to SEQ ID NO: 68

SEQ ID NO: 3597 - DNA, 93 bp, Homo sapiens; identical to SEQ ID NO: 69

SEQ ID NO: 3598 - DNA, 89 bp, Homo sapiens
caggcgcccgccaccgtgcttggctaattttttgttttttagtagagatggggtttcactgtgttagccagtatggttttgatctcctg

SEQ ID NO: 3599 - DNA, 116 bp, Homo sapiens
tttttgcttaggattgtcttggctatatgggctcttttttggttccatatgaaatttaaagtagttttttctaactctgaagaaagtcagtggtagcttgattcggatagcattga

SEQ ID NO: 3600 - DNA, 95 bp, Homo sapiens; identical to SEQ ID NO: 68

SEQ ID NO: 3601 - DNA, 93 bp, Homo sapiens; identical to SEQ ID NO: 69

SEQ ID NO: 3602 - DNA, 119 bp, Homo sapiens
agatttgagtagcagaggttgaataatgagcattactctttgaaggtcatattgtggtcagacacacagacagacacagagatccagtggtttccagtttatccttactcttctattca

SEQ ID NO: 3603 - DNA, 58 bp, Homo sapiens; identical to SEQ ID NO: 3380

SEQ ID NO: 3604 - DNA, 59 bp, Homo sapiens
cacaactgtgagctcatggtgagtgctgttttaagccactaagtttgcagtaatttgtg

SEQ ID NO: 3605 - DNA, 71 bp, Homo sapiens
tctgacactcagcaggctcaaaatatatatatatatgcatgtgtgtatatatatgtttgttggatgaatga

SEQ ID NO: 3606 - DNA, 58 bp, Homo sapiens
ttgagatggagtctcactctgtcacccaggctggagtaatggaggggctttatctcgg

SEQ ID NO: 3607 - DNA, 87 bp, Homo sapiens
agcccactgtctccaagaggaatgcagggtcagtgaagacatccttttgttttgttttgttttttttctttgagactgtgtctcgct

SEQ ID NO: 3608 - DNA, 112 bp, Homo sapiens
tgctttataaaggggattgccagtctaattcatttgctatgcatgcaggtacaggactccatctgcaacagcatctgcacaacaagagctaacaattatccattgtacagca

SEQ ID NO: 3609 - DNA, 83 bp, Homo sapiens
ggcttaggatcggtggcctctgacactcagtgcttctggcttcaggcagctgttgggtagagcagaggttaaaagcctgagcc

SEQ ID NO: 3610 - DNA, 113 bp, Homo sapiens
ttgttttcagttgtcagactacgtgatgttaaaatggcagttgattttttgtattaacacagtgcctctaattttaaaaactgcttcagcaatcatgtatttaatgaaaacag

SEQ ID NO: 3611 - DNA, 83 bp, Homo sapiens
ggttgctcagtcggtctgacagagcccacccctaccccaggtgccggggcttcactcctctgcctccctcccgacttggtacc

SEQ ID NO: 3612 - DNA, 64 bp, Homo sapiens
tatatacatgtgtatatatatctctgtatatatatgtatatatatgtgtatatatatgtgtgta

SEQ ID NO: 3613 - DNA, 64 bp, Homo sapiens
tgtgtctcagagtcaagggctgggccttcaaatgctgatagctctcagtctgtctgtctacaca

SEQ ID NO: 3614 - DNA, 102 bp, Homo sapiens
ccaagtagctgggaccacagatgcacaccaccatgctcagccaatttttaaatttttaaatttttggtagagatgggggtctccctgtgttacccaggctgg

SEQ ID NO: 3615 - DNA, 149 bp, Homo sapiens
catctatatatatatatatatatatatatatatacacacacacacatatgtatgtgtgtatgtataacgtttatgtgtgtatatatatgtgtatgcattaatgcttatgtgtatatatgcgtatgtatatatatatgtgtatttgtgta

SEQ ID NO: 3616 - DNA, 73 bp, Homo sapiens
catcaagtgtgtgactcagtgagactgtcccttttctgtatgaagagaattagcccaaggagcaaccttgatg

SEQ ID NO: 3617 - DNA, 73 bp, Homo sapiens
catcaaggttgctccttgggctaattctcttcatacagaaaagggacagtctcactgagtcacacacttgatg

SEQ ID NO: 3618 - DNA, 112 bp, Homo sapiens
ttggaaggagtcaggtagaacagcagaggtggccatcaaacagtgtctctctggctctgccctgtctgctctgtgagtatgtccaccatctttttctatctgacagttctgg

SEQ ID NO: 3619 - DNA, 102 bp, Homo sapiens
ggtgtggtggcccatgcctgtagttccagctacttgggaggctgaggtgggaggatgacttgagaccaggaggtggtggttacagtgagctgacatcacacc

SEQ ID NO: 3620 - DNA, 122 bp, Homo sapiens
tgttgaaaaattttagatgtctgtttaaatgtgtgagggcatatatagtttataaaaatttaatttatagcaggtatatgtgcagaatttttttgaagatgactaatctatagcagggtttc

SEQ ID NO: 3621 - DNA, 58 bp, Homo sapiens
tgagacagagtctctctctgtcacccaggctggggtgcagtggagtgatctcggctca

SEQ ID NO: 3622 - DNA, 75 bp, Homo sapiens
atatgtatgtatgtatgtatgtatatatgtgtgtatatatatatacacatatacacacatatatgtatatatata

SEQ ID NO: 3623 - DNA, 99 bp, Homo sapiens; identical to SEQ ID NO: 3220

SEQ ID NO: 3624 - DNA, 83 bp, Homo sapiens
ggctggaaacccagacaagtgttgatgttgtagtcttgtgtttgagatctatagggcaggccggcagaatgtctgaggaagct

SEQ ID NO: 3625 - DNA, 83 bp, Homo sapiens
agcatcaaaaagcatgacatgcggtgtgtgtgaaggcaccagtcgtctgtttcactcactctgtcatttcagcacttgctgct

SEQ ID NO: 3626 - DNA, 58 bp, Homo sapiens; identical to SEQ ID NO: 2263

SEQ ID NO: 3627 - DNA, 113 bp, Homo sapiens
gttgtgggcctgtgttttctatgtgggaaaaattttaaatactgatttagttctttaatagttattgaatcatttggattttctatttctcctagtcatttttggtcattgac

SEQ ID NO: 3628 - DNA, 58 bp, Homo sapiens
tgagatagagtctcactctgtcacccaggctggagtgcaacggtgtgatctcagctca

SEQ ID NO: 3629 - DNA, 73 bp, Homo sapiens
tcctcagctgaggaaactgaggtttggtgaggtcaagtgacttcttcaagacacttttttttttttagacgga

SEQ ID NO: 3630 - DNA, 57 bp, Homo sapiens
tgagccaagtctcgctctgtcacccaggcaggagtacagtggtacgatcttggctca

SEQ ID NO: 3631 - DNA, 70 bp, Homo sapiens
cctagatggcagaaatgaaaagaggaatgggaccgacttttctttctttctttttttttttgagtccagg

SEQ ID NO: 3632 - DNA, 96 bp, Homo sapiens
taggtgggtgatgagatgggatcaacttagagtttaaaagcataattttttttttttttttttttgagacggagtctcgctctgtcaccctggctg

SEQ ID NO: 3633 - DNA, 100 bp, Homo sapiens
gagggtgtgaagaaactcctgaaattacttagggtattatgtgtccatgaatataggcatttttacttatttattttagggatgactctctcatagcttc

SEQ ID NO: 3634 - DNA, 87 bp, Homo sapiens
tccagcctgggtgacaaagctagaccctatttctttttatttatttatttttttgagacggagtctcactctgtcgcccaggctgga

SEQ ID NO: 3635 - DNA, 90 bp, Homo sapiens
aagtccagtaaggataatctgtgcattgtagaaaggctctttgaattgataacttgctccccaacttacaggaaaaccccatctgggctt

SEQ ID NO: 3636 - DNA, 106 bp, Homo sapiens
tttcttgatggtattgttcgtagcacagaagttttaaattttgaggaagttacatttttctatttttttcttttgtcactgtgcttttggtgttttatctaagaaa

SEQ ID NO: 3637 - DNA, 107 bp, Homo sapiens
gctgccttctggggcttatggaggagacgtcacatccgttctcacttctgacactgaccctgactccctgccatttagaggaaaggccctggtccttcatcagtagc

SEQ ID NO: 3638 - DNA, 73 bp, Homo sapiens
cactagacaggaagttatggatctgactaattgaggctttcacctctgactcagtgtgtgactctggcaagtg

SEQ ID NO: 3639 - DNA, 78 bp, Homo sapiens
ggagcatagggaatggttcctttttttcaggcatgggcttttttttttttttgagacggactctcactctgtagctcc

SEQ ID NO: 3640 - DNA, 109 bp, Homo sapiens
gcaatataatatggaatctctctaggcaggaaagtggggtgatcactcgctctctctctagggatcattgtcctccacctcctgatagccaatgtctgaaaaccattgt

SEQ ID NO: 3641 - DNA, 106 bp, Homo sapiens
ctatctttgagaaagttctatgtgctgttgaatagaatgtgtattctgtggttgttggatgaaatgttctgtatatgtctgttaagtccattgttccaaggtatag

SEQ ID NO: 3642 - DNA, 86 bp, Homo sapiens
tgtatgtacatttagcccagctcaaatttcttttttttttttaagacggagtctcactttgttgcccaggctggagtgcagtgaca

SEQ ID NO: 3643 - DNA, 182 bp, Homo sapiens
atattattaaatattatatattacattaagtgatatataattatacattataattatataattataattgtagactatatattatatacactatatatgtctatatgtatttatatatacatgtgtacatatacatatgtatttttaaatatatgtgtgtttatatacacatatgtatataa

SEQ ID NO: 3644 - DNA, 116 bp, Homo sapiens
ggaatgtatataattctaatctttgttttatttggtcatactttttatatgtgtttagcttatcccagtaatactgtaaatgattatgaaggtagggaccatgtcttatacatttt

SEQ ID NO: 3645 - DNA, 107 bp, Homo sapiens
aatatagaaggtttgcaatttttttctgttaaatgagtagtgatgattttgtagttgtacgttgtacgttgtaaagtttgacattagagattttaaattttggtatt

SEQ ID NO: 3646 - DNA, 90 bp, Homo sapiens
gtcgtttctcctgatgtatagatggacgcatacatatatatgtgtacatatatatattttttaccagctgagcatttctggagccttgac

SEQ ID NO: 3647 - DNA, 101 bp, Homo sapiens
gggttaagtgctttgtatttggagtcaggcatacctgggattgaattccagctttaacactatcaaactcactgtgtgactttgggcagctcttccaacct

SEQ ID NO: 3648 - DNA, 106 bp, Homo sapiens
gctaggcttggaagggaaaaatgcattataagtgaggaagacaagagatattcttaaataaaaggtcaaaaggtgtcacgagatcatttattttctaggtttaagc

SEQ ID NO: 3649 - DNA, 89 bp, Homo sapiens
gcttagtaagctgggaatactgatctagctataaagaacttgaggattataattctttatttatgcttgtggttccagttaggctgggc

SEQ ID NO: 3650 - DNA, 60 bp, Homo sapiens
tgtatacatatacatatatacatatatatacatatatatgtatacatgtatatgtttgga

SEQ ID NO: 3651 - DNA, 100 bp, Homo sapiens
gtgtctcagaactgctgtgtatatgtcttttatatttcatgtgtataaatataaatattatatatataatagaaatgggcataaagtaagtggcctgaga

SEQ ID NO: 3652 - DNA, 86 bp, Homo sapiens
gaggccagagattgactgtgaggtccctccagtcatgcctccaggccttactagactgggacgctcacactgtcgctctctgcttt

SEQ ID NO: 3653 - DNA, 89 bp, Homo sapiens
tggtgacagagcgacactccctcttaaaaaaaaaaaaaaaaaaaagatatctttttttttttttgagacggagtctcactctgtcacca

SEQ ID NO: 3654 - DNA, 87 bp, Homo sapiens
atacatacatactatgtatgtatatatacatactggatgcttctttggccttgtatgtatatgtatatgtcatatatgtatacgtat

SEQ ID NO: 3655 - DNA, 81 bp, Homo sapiens
ccctctctctctatatatatgtgtatatacccatatatgtatacatatatatgggtacatatgggtatatgggtatatggg

SEQ ID NO: 3656 - DNA, 101 bp, Homo sapiens
tgcccagcccagaataggctgtcagtcatgtttgtcaaatgaatgttttgtgtttattttttattttccttttgagttttgatttccttctggtttgggca

SEQ ID NO: 3657 - DNA, 80 bp, Homo sapiens
gcttctaacttccagaactatcagagaatatatgtgtgttgttttaaaccactcatttggtggtagttcattacagaagc

SEQ ID NO: 3658 - DNA, 95 bp, Homo sapiens; identical to SEQ ID NO: 68

SEQ ID NO: 3659 - DNA, 93 bp, Homo sapiens; identical to SEQ ID NO: 69

SEQ ID NO: 3660 - DNA, 72 bp, Homo sapiens
tccctgtgtccatgctctcctgccagggaccctcactgtctctctctggaagggtgcaacaggaacttggga

SEQ ID NO: 3661 - DNA, 78 bp, Homo sapiens
caagtgcatcataaatcactttcatcatcttcatcatcctcgtggtgtggatagggtggggatatgtagatgtatttg

SEQ ID NO: 3662 - DNA, 108 bp, Homo sapiens
tgagaagatagagtagtcaacaaggtcaggtgctctgagatatatatttattatatgaatttgtttttccagagacagggtctcattctgttgtctaggctggactca

SEQ ID NO: 3663 - DNA, 79 bp, Homo sapiens
gaggcagaggttgcagtaagccaagatctcaccattgcactccagcatgggaaacagagggagactgtctcactgtctc

SEQ ID NO: 3664 - DNA, 107 bp, Homo sapiens
tggtcccagctactcagggggtcccagctgcacctgtggtcccagctactcagggggctgaggtggtaggatcacttgagctgggaggtcaaggctgcagtgggcca

SEQ ID NO: 3665 - DNA, 72 bp, Homo sapiens
ctctgtcacccaggttggagtgcagtggcttgagctcggctcactgcagtctctgtctcctgggttcaagtg

SEQ ID NO: 3666 - DNA, 82 bp, Homo sapiens
tggcttctagaatagtgaatgctttccaatgtaaatttttcaatttacattgcccagatcagaagaaccactatggcagcca

SEQ ID NO: 3667 - DNA, 84 bp, Homo sapiens
ttgcaaaacaggaaatatgaataagatcagtggattgagtcaatgtcaatttcctggttgtgatattgtactacagttttgtaa

SEQ ID NO: 3668 - DNA, 102 bp, Homo sapiens
gattcaatgaggagttcatactctgtgtgaaaataaaatgttacacaaggagaggtgatttattattatttttttacaagatgtgtaggcttgcatttgttc

SEQ ID NO: 3669 - DNA, 58 bp, Homo sapiens; identical to SEQ ID NO: 3380

SEQ ID NO: 3670 - DNA, 58 bp, Homo sapiens
tgagacagagtctcactctgtcacccaggctggagtgcagcagcatgattttggctca

SEQ ID NO: 3671 - DNA, 68 bp, Homo sapiens
gcctgtggcctgaatttagccagccagagacctcatatttgtctcactgtctggctcagacctcctgc

SEQ ID NO: 3672 - DNA, 90 bp, Homo sapiens
tttgtgttgctataaaggtatatctgagactgggtaatttattttttttaaagaggtatatttggctctcagttctgcaggctgtacagg

SEQ ID NO: 3673 - DNA, 76 bp, Homo sapiens
gccctgggcacaaagcccaaactatttttttttttttttttttttttgagacggagtctggctctgtagcccaggc

SEQ ID NO: 3674 - DNA, 80 bp, Homo sapiens
ctcctgcctcagtctcccgagtagagaagggtttttttttttttttgagacggagtctcactcagtcgcccaggctggag

SEQ ID NO: 3675 - DNA, 104 bp, Homo sapiens
ctgggagagagagagtttagctcttgtcctgtatgtatgtgcatatttatatgtgtgtagtattgtcttatatgggaaaggacgatgggatttttttttttcag

SEQ ID NO: 3676 - DNA, 119 bp, Homo sapiens
gtggctgtatttatgggtatcatgtttttggtcttttttttgagacagagtctcgctctgtcacccaggctggagagcagtggcatgatctcggcttactgcaacttctgtctcctggg

SEQ ID NO: 3677 - DNA, 79 bp, Homo sapiens
atatgcatactattattctttttcagattgtgttatggctggtgttttgaaagtggttaaaggatgactggttgcatgt

SEQ ID NO: 3678 - DNA, 76 bp, Homo sapiens
aaggaaaaatgtgtgtgggctcaccatttgtacgagtaaaacttttaatatatttgtgtgttcactcatagtcctt

SEQ ID NO: 3679 - DNA, 112 bp, Homo sapiens
taataactatcttgtacttagagagtatcttgcccatttttaaatgtttttacataaacaagaaactggcatcagcatcatggttctctctgagcgacgagaccagttctta

SEQ ID NO: 3680 - DNA, 83 bp, Homo sapiens
gaattattttgtatatagagatcttatatgagcatgggaaaatttattttttaaatgctactctctgggaaacaaagtcattc

SEQ ID NO: 3681 - DNA, 95 bp, Homo sapiens; identical to SEQ ID NO: 68

SEQ ID NO: 3682 - DNA, 93 bp, Homo sapiens; identical to SEQ ID NO: 69

SEQ ID NO: 3683 - DNA, 107 bp, Homo sapiens
aagtggactgcgtaaagccagtttgtttctctgaacacttgagttatagttgaactaggaaaattcaagatgtaagagaaatgccaggaccttattagttctttctt

SEQ ID NO: 3684 - DNA, 98 bp, Homo sapiens
gccgggaagacaaagcccctggcctcattagtcagggacagatgggatgaaaacacacatctgtctgtgtgatgaagggcctggctggaaattcgggc

SEQ ID NO: 3685 - DNA, 65 bp, Homo sapiens
tccacatctgtgtgtgtcactcattggggcccttttctcccatggtggggcacccttcaggtgga

SEQ ID NO: 3686 - DNA, 57 bp, Homo sapiens
ccgcctcactctccctcactgagctgggcctagttgggggcagctgcgatggggtgg

SEQ ID NO: 3687 - DNA, 117 bp, Homo sapiens
cactttttgttagtcttaagagaaaaatcataggaagccaggctctctctttgctactaggtgagaagagggaagtgtgtacccttgattgctaatgacagctgccctacaaagatg

SEQ ID NO: 3688 - DNA, 68 bp, Homo sapiens
gggtctctctctgtcactcaggctggtgtgcagtggcatgatcatgtctcatggcagccttgaacccc

SEQ ID NO: 3689 - DNA, 72 bp, Homo sapiens
ggatatgtgtgtatatatgtatatctgtgaacacatacatgtacatagatatacatacatatgtgtatgtgt

SEQ ID NO: 3690 - DNA, 105 bp, Homo sapiens
agggatccttgttctgagcagcacactttgagaaatgtttttctagaacttgtattctttttttttttctagaacttttggtcctgtggactcaaggcaaaccct

SEQ ID NO: 3691 - DNA, 93 bp, Homo sapiens
tcagcctgagcaacatagcaagaccctgtatctacaaaaaaaaaaaaaaaattttttttttaagacagagtctcgctctgtcacccaggctgg

SEQ ID NO: 3692 - DNA, 157 bp, Homo sapiens
tatatatacaaatacatatacatatatatgcatgtgtgtatatgtatacgtgtatatatgtatatatacatatgtgtatatatgtgtatatatacatatgtgtatatatacacatatatacatgtgtatgtatatacatacacatatatacacgtgt

SEQ ID NO: 3693 - DNA, 80 bp, Homo sapiens
tgccaagaactatagctttattttaatattaaaagactctggggaggtagggatcatgttgaaatagctgttcatgggca

SEQ ID NO: 3694 - DNA, 75 bp, Homo sapiens
cttctgatggctgcaaggtgggggatttcctttttttttttgagacagggtctcactctgtcacccaatctggag

SEQ ID NO: 3695 - DNA, 118 bp, Homo sapiens
acctctaaattggatataataatagctgctttgtgatgttgcttgagaactaagtgggataaagtttgtaaagtacttagcagagtatccaatgtattataagcgccaaataaatggt

SEQ ID NO: 3696 - DNA, 110 bp, Homo sapiens
tttgccaaaggagttagtttgtggtagcaaaactgactttgtttttagtgtttgagtctcagtcactatgatgctgtcagaattaacaagctacttaccttctgggcaga

SEQ ID NO: 3697 - DNA, 112 bp, Homo sapiens
gtgggtaagtggggtagttaagaaacctggccatggactaaggtgcatttgaattgagacttgttggggtgaaaagagtggttatttttcttaagaggcaaagagaacacac

SEQ ID NO: 3698 - DNA, 82 bp, Homo sapiens
ctcagtgtctgcgttggagagagtccccgcctgggtgtgctgggccagggagggggccctgtcagtgtcagtctcactgcag

SEQ ID NO: 3699 - DNA, 58 bp, Homo sapiens
tgagacagagtctcgctctgtcacccaggctggggtgcagtggcacgaccttggctca

SEQ ID NO: 3700 - DNA, 81 bp, Homo sapiens
ggctgccctggctcagttatcacagtgctgatgctgtctattctaaaggtacagtactgtgataactgaaggatggcagcc

SEQ ID NO: 3701 - DNA, 58 bp, Homo sapiens
tgagacagagtctcactctgtcgcccaggctggagtgcagtggtgtgatcttggctca

SEQ ID NO: 3702 - DNA, 99 bp, Homo sapiens
ggacaggcagtgtgagtactgttggtttcagacattcacgttaaagcccagtgttttgttttttgtttttaattgaggcagggtctcactctgtcgccc

SEQ ID NO: 3703 - DNA, 58 bp, Homo sapiens
tgagacggagtctcgctctgtcacccacgctggagtgcagtggcgcgatctcggctca

SEQ ID NO: 3704 - DNA, 56 bp, Homo sapiens
gagacggagtctcgctctgtcacccacgctggagtgcagtggcgcgatctcggctc

SEQ ID NO: 3705 - DNA, 57 bp, Homo sapiens
gagctcactatctcactctgtcacccaggctggagtgcagtagtgtgattgtagctc

SEQ ID NO: 3706 - DNA, 67 bp, Homo sapiens
tgtggtagtgcatacctgtagtcccagctactcgggaggctgaggtgggaggatggattgtgccaca

SEQ ID NO: 3707 - DNA, 86 bp, Homo sapiens
tttgtgtttggctgtcagtagactgtgagcagcttgatgtcagacattatgctttcttattctgttttcccaccacctatcacaga

SEQ ID NO: 3708 - DNA, 58 bp, Homo sapiens
tgagacacagtctcactctgacactcaggctggagtgcagtggtgcaatgttgtctca

SEQ ID NO: 3709 - DNA, 105 bp, Homo sapiens
ctgagccacaggagctgcccagggggtgaggagtggtgggctacactttgaacaaaaggagacagtcttattctctctcccaaatgggatgatgctatgtcacag

SEQ ID NO: 3710 - DNA, 97 bp, Homo sapiens; identical to SEQ ID NO: 1307

SEQ ID NO: 3711 - DNA, 88 bp, Homo sapiens; identical to SEQ ID NO: 1308

SEQ ID NO: 3712 - DNA, 81 bp, Homo sapiens; identical to SEQ ID NO: 1309

SEQ ID NO: 3713 - DNA, 77 bp, Homo sapiens; identical to SEQ ID NO: 1310

SEQ ID NO: 3714 - DNA, 74 bp, Homo sapiens
agggttttctgtgttttggctcctccctgaactttcagccatccctgcagggctgagccacacacagtgactct

SEQ ID NO: 3715 - DNA, 97 bp, Homo sapiens
ttcatcacaaattttatattctttacattctttgtatatgtgtgactatgtgcacacatacattatttctaatgttttttccaagatttatggtgga

SEQ ID NO: 3716 - DNA, 99 bp, Homo sapiens
tcagctacttgggaggctgaagtgggaagatcacataagcccagatgacagtgagctgtcattgttccactgctcccactctgcctgccccacccctga

SEQ ID NO: 3717 - DNA, 63 bp, Homo sapiens
agagtttctatgaatcaggaatccagctgtggcttagctgtgtgcctctgactcagagtctct

SEQ ID NO: 3718 - DNA, 66 bp, Homo sapiens
agctttgaagagatggagcctatgccgttaggtccattcatagactctgtctctatcactgtggct

SEQ ID NO: 3719 - DNA, 61 bp, Homo sapiens
gactgagtctcgctctgtcacccagtgacaatactagagggcagtggtgtgatctcggctc

SEQ ID NO: 3720 - DNA, 117 bp, Homo sapiens
tgaaggtcttctggactcccaattcttttaatgacacttttaaatcagtgacacaacagagtgttcacttataaacagttgtgaagagggtgggaagtaatttctcggtaacactca

SEQ ID NO: 3721 - DNA, 72 bp, Homo sapiens
tataggtactatatatagcatatatgtgtatatatagatatatacacatgtatatataaatatgtatatata

SEQ ID NO: 3722 - DNA, 58 bp, Homo sapiens; identical to SEQ ID NO: 2595

SEQ ID NO: 3723 - DNA, 70 bp, Homo sapiens
gtaacagaacagctgagagcaggtgctatccaggacctattctgtctctgtgtctctccagctttgtgac

SEQ ID NO: 3724 - DNA, 104 bp, Homo sapiens
atgtagattgaataacccactgatgtgaaagtgatttgagaaccaaatactctatatgaatattttatctggtttccttttcacatacagtcttggttctatat

SEQ ID NO: 3725 - DNA, 115 bp, Homo sapiens
tttcagggaaggaaaggatagatctatgtagtccaaagctttcttttatttttttgataggccctagagttgatcttgaaaattgccagattaataggctgtcccagccctgaga

SEQ ID NO: 3726 - DNA, 109 bp, Homo sapiens
ctgaatcatgacatttttggctgatggatacaggtactattgtcagtcctgtgtgagcacagggctttgttacttcttatcctttctagcagttctttgccttgagtag

SEQ ID NO: 3727 - DNA, 90 bp, Homo sapiens
gaatttatggtactttgagtttcatgggaggaggttagcacccagttcagggctatgttgcatcttattcagctttgagtgctcagattc

SEQ ID NO: 3728 - DNA, 110 bp, Homo sapiens
acatatatgtgcatataggaatgtacacttatgtatatacatatgtatatgtatgtatacatgtatgcatgtatcagtttgtatacatatatgtacatacttatacatat

SEQ ID NO: 3729 - DNA, 171 bp, Homo sapiens
tatacacatatgtgtgtatatatgtgtgtgtacatatagagggtacatgtgtgtatatatacatatatgtatatatgtgtatatatacatatatacgtatatatgtgtataaatgtatatgtgtatgtatatatacgtatatatgtatatgtgtacatatatgtacatgta

SEQ ID NO: 3730 - DNA, 93 bp, Homo sapiens; identical to SEQ ID NO: 69

SEQ ID NO: 3731 - DNA, 97 bp, Homo sapiens
catgtctctgtatgcccattaaaatgtgtttaagtgtgtatatatatatatatatatatgagttggattactgaattatagggtatgcttagttttg

SEQ ID NO: 3732 - DNA, 66 bp, Homo sapiens
ttttttgagacacagtctcactgtcactcaggctggagtgcagtggtgtgatcatggctcactgaa

SEQ ID NO: 3733 - DNA, 147 bp, Homo sapiens
acaagtatatatatatatctgtgtgtgtgtataggtatctgtgtatgtctatttatatatatgcatgtgtgtgtatgtatgtgtgtatgtatatatgtgtgtacatatacatacacacatatatacatacacacatacatacacaca

SEQ ID NO: 3734 - DNA, 118 bp, Homo sapiens
gtgaacagtttactgaatgttgggtttctaacaacaaatcttgcacccagagcttgtaggttgtctactttttctctaaggaggcattttctctagggcccacagcagtgaatgacac

SEQ ID NO: 3735 - DNA, 144 bp, Homo sapiens
tgggttggcataacgtagcaagactccatctttaattaaaaaaaaaaatttttttttttttttttttgagagagtctcgctctgtcacccaggctggagcgcagtggcacaatctcggctcattgcaagctctgccatctgggt

SEQ ID NO: 3736 - DNA, 100 bp, Homo sapiens
gtttcttaattggtgcaaacttggatggacccagaaaagtgaattcctagatgatatttagtaactttttctagtccttaaccaattcatattaagaaac

SEQ ID NO: 3737 - DNA, 56 bp, Homo sapiens
gagacggagtctcgctctgtcaccctggctggagtgcagtggcgtgatctcggctc

SEQ ID NO: 3738 - DNA, 76 bp, Homo sapiens
ggtaggtgagagacaaatggctgcagtcttttgagtttctttttttttttgagacacagtcgcactctgtcgcccc

SEQ ID NO: 3739 - DNA, 78 bp, Homo sapiens
tgtctagttgtgcaaaattcagtacataactgtgttgctaccggcatgacagaagtgtgtgagaaaacgcaaatgaca

SEQ ID NO: 3740 - DNA, 69 bp, Homo sapiens
tgtgtgtgagactgagtctcattctgtcacccaggtgggagtgcagtggtgtgatctcagcttaatgca

SEQ ID NO: 3741 - DNA, 72 bp, Homo sapiens
atatatacacgtatatatgtgtgtatatatatacatatatatgtatatatacacgtatatatgtgtgtatat

SEQ ID NO: 3742 - DNA, 89 bp, Homo sapiens
atatatatatatatgatatatatgtgtatatatatacacgtatatatgtgtgtatatatatacacgtatatatgtgtgtatatatatac

SEQ ID NO: 3743 - DNA, 95 bp, Homo sapiens; identical to SEQ ID NO: 68

SEQ ID NO: 3744 - DNA, 93 bp, Homo sapiens; identical to SEQ ID NO: 69

SEQ ID NO: 3745 - DNA, 102 bp, Homo sapiens
tcttggatttggttgggagcaatgaggaaagaggtgtttggatttggaatctatttcaaagaaagacacagtatttgctgataggttgggagtggaaaaaga

SEQ ID NO: 3746 - DNA, 58 bp, Homo sapiens
ttgagacggtctcactgattctgtcacccaggctggagtgcagtggctgcgatctcag

SEQ ID NO: 3747 - DNA, 117 bp, Homo sapiens
gcttcaagccctgtgtattccgtcactctgatttcagtgctcaaatttttcttttaaaaaaattacttttgggggcagggagaaatcacaacttgaggctgagatatcacaggcttg

SEQ ID NO: 3748 - DNA, 110 bp, Homo sapiens
tgcttatgattgtcttggctattcaggctcttttttggttccatatgaaatttaaagtagttttttccaattctgtgaagaaagtcactggtagcttgatgggaatagca

SEQ ID NO: 3749 - DNA, 61 bp, Homo sapiens
tgagacagggtctctcactctgttgcccaggctggagtacaagtggcatgatcttggctca

SEQ ID NO: 3750 - DNA, 66 bp, Homo sapiens
aacagcagtgtgtgtgtgtgtgtgtgtgtgtgtgtctatacacacacacacacacaaactgctgtt

SEQ ID NO: 3751 - DNA, 80 bp, Homo sapiens
gggagcagacagactccttggattactctttttttttttttttttttttttttttgaggtggagtctcactctgtcgccc

SEQ ID NO: 3752 - DNA, 97 bp, Homo sapiens
gctgggattacaggcatgagcccccgcgcctggccgaaaaatcttataaatttataaggtctgcttctgtctgtgtgtctgttatgtttatccaagt

SEQ ID NO: 3753 - DNA, 107 bp, Homo sapiens
ccgcaggagagagttgggctagtactcagttatttctatcagtcattcagtcagacagtccatatttactgaatagtaacaatgtacaaggccttatgaaactgggg

SEQ ID NO: 3754 - DNA, 60 bp, Homo sapiens
ttgagacagagtgtcactctgtcacccaggctggagtgcagtggcacgatctctgctcag

SEQ ID NO: 3755 - DNA, 119 bp, Homo sapiens
aggcacgatgcctaggatgctaagcaaaactggactgagaggtcgtatctacagttttttctttttaaaaaatagtaaaggtgctaagtagtaaaggtgctaagattcaggcgcggctt

SEQ ID NO: 3756 - DNA, 99 bp, Homo sapiens
ggagcagagctgccattccagctcagacttttacatgagaggtaaatgtctaccttgttttttgttatttgttttttgttgttgttgtttatttgtttt

SEQ ID NO: 3757 - DNA, 113 bp, Homo sapiens
tatctttggttttctaagtgtataaatatgtggtttataatgtaggatgaataatctaaaattttatttaatactgcagccaaacaaaaaagatatttttaggactgaaaata

SEQ ID NO: 3758 - DNA, 70 bp, Homo sapiens
agttgctgggtcatatggtggttgcatgtttagttttataacaaactgccaaatgttttccagaatagct

SEQ ID NO: 3759 - DNA, 118 bp, Homo sapiens
tctagattttctagtttatttgcataaggttgctcataatattctccgatgattatttgtatttctgtacagttagtggtaatatcctccttgtcatttctgattgtgtttatctgga

SEQ ID NO: 3760 - DNA, 87 bp, Homo sapiens
gtggagcaggagaggaaggcatctgtgctgggggtcaagggacgtggagtggtctcagccactgtctgtcttcatcctgtatttgcc

SEQ ID NO: 3761 - DNA, 81 bp, Homo sapiens
gttttattttgagacagggtctcactctgttgctcagactagagtgcagtggcgtgatctcactctgtctcgctctgtggc

SEQ ID NO: 3762 - DNA, 86 bp, Homo sapiens
agtgctgggattacagatgtgagccaccgtgcccagccctttttttttttttttaagagacatggtctcactctgtcacccagact

SEQ ID NO: 3763 - DNA, 65 bp, Homo sapiens
cacatatacaaatgtaacatgtatgtgtatgtgtatatacatatatataattgcacgtaagtgtg

SEQ ID NO: 3764 - DNA, 86 bp, Homo sapiens
gctctgggctggtactgggggttgtctgcacagagtcgtgtgatgtgaactgtctgtgggtctctcagtcatggataccagccagc

SEQ ID NO: 3765 - DNA, 83 bp, Homo sapiens
gatggagtctcgctctgtcactctgttgcccaggttggagtgcagtggtgtgatctcggctcactgagacctctgcctcaggg

SEQ ID NO: 3766 - DNA, 110 bp, Homo sapiens
tatatatttatgtaaagttatacatgtacacataaacatttatattttttaatctaaatatatgtacacataaatttacataaatatatgcatgtgtgtgtgtgtgtata

SEQ ID NO: 3767 - DNA, 115 bp, Homo sapiens
gcctccagctttgttctttttgcttaggactgtcttggctatatgggctgttttttggctccatatgaaatgtaaagtagttttgtctaattctgtgaggaaagtcaatggtagc

SEQ ID NO: 3768 - DNA, 58 bp, Homo sapiens; identical to SEQ ID NO: 1868

SEQ ID NO: 3769 - DNA, 66 bp, Homo sapiens
tgcacacatatgttccatgtttttaatatacgtatgtgtatatttgtatatgttcatatgtgtgta

SEQ ID NO: 3770 - DNA, 78 bp, Homo sapiens
ttctcagaatgtatctctgttggtaagttaaaaatgtgactatgtcacattttctttatcaatttatacactgatgaa

SEQ ID NO: 3771 - DNA, 90 bp, Homo sapiens
gcagaactcagtgtgaactggaattctgacttgtatttttctcttttcttttggaaaagacagtcacgaagcagtttctatgacttttgt

SEQ ID NO: 3772 - DNA, 73 bp, Homo sapiens
ggaagaactcttagtgtggcttgaggtactgggctttaagatggagtcagtggtgagtgaccagagagtagcc

SEQ ID NO: 3773 - DNA, 95 bp, Homo sapiens; identical to SEQ ID NO: 68

SEQ ID NO: 3774 - DNA, 93 bp, Homo sapiens; identical to SEQ ID NO: 69

SEQ ID NO: 3775 - DNA, 128 bp, Homo sapiens
gtgtggtatatatatgtgtgtgtgtatatatatatgtgtttatatattatatatataatatatatgtattatatttgtatcatatatgtgtatatataatatatatataatataatatgcattatata

SEQ ID NO: 3776 - DNA, 102 bp, Homo sapiens
atacatatatatgtatgtgtatatatatatgcatgtgtatatatatacatatacacatatatgcatttatgtgtatatatcatatgtgtgtgtatatgtata

SEQ ID NO: 3777 - DNA, 64 bp, Homo sapiens
tgcatatatgtgtatatgtatatatatacacatgcatatatatatacacatacatatatatgta

SEQ ID NO: 3778 - DNA, 75 bp, Homo sapiens
atatattatatatttacatatagatgtgtgtgtatgtgtgcgtatgtgtatatgtgtgtgaatgtgtatgtgtgt

SEQ ID NO: 3779 - DNA, 72 bp, Homo sapiens
gttgttttgagacagggtctctctgtgtcacccaggctggagtgcagtgttgagatcttggctcactgcaac

SEQ ID NO: 3780 - DNA, 101 bp, Homo sapiens
tgagacaagtgtgtaagatctatcagtgcatttcattaggagtaaaagctcacagatgagattcagcaaagtgattttaaatctaaagcgtttacctctca

SEQ ID NO: 3781 - DNA, 95 bp, Homo sapiens; identical to SEQ ID NO: 68

SEQ ID NO: 3782 - DNA, 93 bp, Homo sapiens; identical to SEQ ID NO: 69

SEQ ID NO: 3783 - DNA, 86 bp, Homo sapiens
tctgtgcttggacactctcactcagagtggcccctgggcagtctgctctgggccgagcagggcatgagaaggtgccacagggcaga

SEQ ID NO: 3784 - DNA, 119 bp, Homo sapiens
tttctttgaaagtttaggttatataggtttttaaaatataggctttggaatcagactgacatagatttatattttatcttgtcacttattatagcttaattgtttttatatttaagaag

SEQ ID NO: 3785 - DNA, 114 bp, Homo sapiens
tgcttaggattgtcttggctatacgggctcttttttggttccatatgaaatttaaagtagttttttcttattctgtgaagaaagtcaatggtagcttgatggggacagcattga

SEQ ID NO: 3786 - DNA, 86 bp, Homo sapiens
gaactccattttctgaaaaaattcaggtgggttccaatgggcttaaccctgattttttggtttttttgtttttgaaatggagtctc

SEQ ID NO: 3787 - DNA, 80 bp, Homo sapiens
tttgagatggagtctcactctgtcacccaggctggagtgcagtggcactatctcgggttcaggtgattctcctgcctcag

SEQ ID NO: 3788 - DNA, 74 bp, Homo sapiens
ccccgtctcttctctgcctcgagctgtgccctctcgcccaacccgctcgctttatgacttgatggggaagagac

SEQ ID NO: 3789 - DNA, 66 bp, Homo sapiens; identical to SEQ ID NO: 474

SEQ ID NO: 3790 - DNA, 88 bp, Homo sapiens
aaaactggcagatctaaattttgtcaccaaaaattatgattattttatcagtttttaaagggaaggcatgttaggcatagtcagtttt

SEQ ID NO: 3791 - DNA, 82 bp, Homo sapiens
cctgtctcggctactaacagaatacagagaggcaatgaatcttttttttcttttccttttttttttcttcttttgagacagg

SEQ ID NO: 3792 - DNA, 82 bp, Homo sapiens
ggaacttactcttacttgataactatgcatagattaatatatatatataatatatatatttcttatattatcaagtaattcc

SEQ ID NO: 3793 - DNA, 83 bp, Homo sapiens
caaagctcttgtttttttcttaaattgtgtaaatttagagcattgtttcaaattttctcaaaggagaaaggaaaggggtgttg

SEQ ID NO: 3794 - DNA, 80 bp, Homo sapiens
aaaagaatatagactgaagtcagataggtgactagatttattcaagaatctacacagccaacatcagtgtatggtctttt

SEQ ID NO: 3795 - DNA, 107 bp, Homo sapiens
gtctctgttatcaggcttaggatggactctgtacaatagacctggccatagtttatcactcacagtgtcttactcatttttatgtccccagcacttagtacaatgac

SEQ ID NO: 3796 - DNA, 58 bp, Homo sapiens
tgagacggagtctcgctctgtctcccatgctggagtgcagtggcgcgatctcggttca

SEQ ID NO: 3797 - DNA, 77 bp, Homo sapiens
tgaaatatgtgtgtgtatatatatatgtgtgtgtgtatgtgtatatatatatatatatgtgtgtgtatatatattca

SEQ ID NO: 3798 - DNA, 92 bp, Homo sapiens
gtatgtatatgaaaaatgtgttagaatcaggaggaaactagcgtgtatatatgtatatattttccccgatgcacatttttccatgttcttat

SEQ ID NO: 3799 - DNA, 108 bp, Homo sapiens
attcttcttgggaaggagattcagcaaaagcagatattttagaggaaatgggaaacttctcattttttatatttctttactgtttgatccttttataaaacacagagt

SEQ ID NO: 3800 - DNA, 82 bp, Homo sapiens
atagatacatatatgtatctatctatatagatgtatatatatatgtatctatctctatagatgtatgtatatatgtatctat

SEQ ID NO: 3801 - DNA, 86 bp, Homo sapiens; identical to SEQ ID NO: 2169

SEQ ID NO: 3802 - DNA, 92 bp, Homo sapiens
ccaacattgtattcatggaataaatctcatttgatcgtgatgtataattctttttacatatagctggatttgtttttctagtattttgttgg

SEQ ID NO: 3803 - DNA, 69 bp, Homo sapiens
tgtgtctcagtccgtctgtcactgtagagccccgtacagttcctgtgtctgaagatgactgctgacaca

SEQ ID NO: 3804 - DNA, 69 bp, Homo sapiens
ttacatggcttggcagctgtgccgtctattatagatctgatagactgcttgacagaactgagacagtaa

SEQ ID NO: 3805 - DNA, 90 bp, Homo sapiens
tatatctagctatctatatagatatctatatctatatctatatctagctatctatatagatatctatatctatatatccagctatctgta

SEQ ID NO: 3806 - DNA, 99 bp, Homo sapiens
cattcagtttatgaaagcatatcaagctgtatatttattacaggtgctttttttgtatttatgttacactacaggttactgttttcttaaaaaggaatg

SEQ ID NO: 3807 - DNA, 108 bp, Homo sapiens
gttccctgccctctggtgaaagggacctgctcccctgcagtggtgtgccactcttccacactgcctgtgactggggggctaactccaattcagagggcagtgtagaac

SEQ ID NO: 3808 - DNA, 92 bp, Homo sapiens
ggggaagagaacagagaaagtaggtcacagaaagaaggagatatatataatttttatttttttttttgagacggagtctcactctgtcaccc

SEQ ID NO: 3809 - DNA, 60 bp, Homo sapiens
atcatttgtggtgaaggactagttttatatatatatgactaatccttcaacacaaatgat

SEQ ID NO: 3810 - DNA, 103 bp, Homo sapiens
tatgtatataattatatacagctggttttagatataattatatataatatgtaacataaatatataatacatttaatatagctagctatatataattaacata

SEQ ID NO: 3811 - DNA, 66 bp, Homo sapiens
atatatatgtatatatttgcatatgtgtgtatatttgtatataagcatctatgtgtatgtgtatat

SEQ ID NO: 3812 - DNA, 86 bp, Homo sapiens; identical to SEQ ID NO: 2169

SEQ ID NO: 3813 - DNA, 86 bp, Homo sapiens
ttgatccttacattaattttatgaaggttgtattcttatgtgttttacagatgaatacattgaacccatagtgggtaagtgattaa

SEQ ID NO: 3814 - DNA, 75 bp, Homo sapiens
tggctgatggtgtttgtgactttattttttattttattttatttttctagaaatggagtctcactctgtcagtca

SEQ ID NO: 3815 - DNA, 101 bp, Homo sapiens
tatttatatatatatatttatagacatatatatttttatagacatatatatttatagacatatatttatatatatgtctacataaatgtgtgtaagagata

SEQ ID NO: 3816 - DNA, 88 bp, Homo sapiens
gatgggactaatactttgacacagtcagtctctgtctcttccgatcatgagggttgagaatagctggtagaaagtattgatgcctgtt

SEQ ID NO: 3817 - DNA, 60 bp, Homo sapiens
ttgagatggagtctcactctgtcacccaggctggagtgcagtagcgtgatctcggctcag

SEQ ID NO: 3818 - DNA, 58 bp, Homo sapiens
tgagatggagtctcactctgtcacccaggctggagtgcagtagcgtgatctcggctca

SEQ ID NO: 3819 - DNA, 120 bp, Homo sapiens
gcaggagtgtgaagagtggaggtggccttatagaagatggaagccagcactgtctctttctgagactctaacttcagcttcttgctatgtatcagaatccccacttcaggctctgctcct

SEQ ID NO: 3820 - DNA, 84 bp, Homo sapiens
gcttgtaactttccaaagaattctccttttgggctttctggttttattttaagcccaaaggtgaattttttgggaagtttgagc

SEQ ID NO: 3821 - DNA, 86 bp, Homo sapiens; identical to SEQ ID NO: 2169

SEQ ID NO: 3822 - DNA, 82 bp, Homo sapiens
tgccagtaatacctttacttttacaaccttcaaaatagagaagtcattttttttctattagaaagttaaggtttgtatggca

SEQ ID NO: 3823 - DNA, 91 bp, Homo sapiens
ggagaaatggcacaagtaaaagaaatacgtccactttactttttgtatataaaaaagtgttctttaaggggaggtgtgtgcctttttctcc

SEQ ID NO: 3824 - DNA, 111 bp, Homo sapiens
cttattgtaatgcaagtctatcaaattataatgacacttcaaatgtgatgaatcccagaatcttcattttttttgtatgtcgtgctgaaagctactctgcataataataag

SEQ ID NO: 3825 - DNA, 82 bp, Homo sapiens
gctggtacgtaagaagacgcatattggggctttctatttttatttaaagtcatatgcattttctaggtcttattttcccagc

SEQ ID NO: 3826 - DNA, 90 bp, Homo sapiens
agagagcatttcacagaagattgtcaactctgtagtataaattgtgggctaaccttaagccggttcttacacagatctggaaagctttct

SEQ ID NO: 3827 - DNA, 95 bp, Homo sapiens; identical to SEQ ID NO: 68

SEQ ID NO: 3828 - DNA, 93 bp, Homo sapiens; identical to SEQ ID NO: 69

SEQ ID NO: 3829 - DNA, 77 bp, Homo sapiens
tctatatctgtgatcctagtgtccctatattatatatatatatataatagaagggccacaggatgagaatcagtgga

SEQ ID NO: 3830 - DNA, 69 bp, Homo sapiens
tttagacactgtcagtctgtcatcatagtctgctaagtcctaggcagatgacaagaaagactctctaga

SEQ ID NO: 3831 - DNA, 114 bp, Homo sapiens
atgcctacctaaatattgtcacatgcatgccacatttctttttttttatttttattattattattatactttaagttttagggtacatgtgcacaatgtgcaggatagttacat

SEQ ID NO: 3832 - DNA, 84 bp, Homo sapiens
ctccgagctctacagaatttgtttctcttttttttttttttttttttgtggcagggaggggcagggtttggcaggggctataag

SEQ ID NO: 3833 - DNA, 92 bp, Homo sapiens
gtctctaggaaagaaaactctagatcttgcagaaataaactctgttcctctctgacagggtctctgacagcttcatgttcccagttaaagac

SEQ ID NO: 3834 - DNA, 116 bp, Homo sapiens
acctgacttttttccatgcatattcttgccatgatgttaggcttgtcaacatatctacagaacacagttaccagagaacattaatgcaacgtatttgggcaggagagaccttatgt

SEQ ID NO: 3835 - DNA, 71 bp, Homo sapiens
gtgcattattcatagacatgtatatgaatgtatatatatgtgtttatgtatatgtatgtgtatatatgtac

SEQ ID NO: 3836 - DNA, 98 bp, Homo sapiens
cagagttttatatcctcagggctgcaactgctcatagaaagtatgtttttgtaattcattcaatgtgttcacataagctagatgaggctctgattctg

SEQ ID NO: 3837 - DNA, 88 bp, Homo sapiens
aggtatatatagatgtagatatatagctatagatatatacaaatatagatatagatatatgtgtatatctatatatctatatgtatct

SEQ ID NO: 3838 - DNA, 127 bp, Homo sapiens
tctttctctctctctctcactctctatataaagagagagagagagtgagagagggagatacatatagatatatagatatacacatatatctatatctatatttgtatatatctatagctatatatct

SEQ ID NO: 3839 - DNA, 70 bp, Homo sapiens
tacattttatatacttaattatatgtatacccacgatgtgtgtgtatatatgtgtgtgtgtttatgtgta

SEQ ID NO: 3840 - DNA, 113 bp, Homo sapiens
cctcgcatggactgagtaacaaaagaagtggtctctgcctggctcccttttaccctccgcttggaactgatgccccgctgagcgcagcttgcttcccacagtcagacatgagg

SEQ ID NO: 3841 - DNA, 98 bp, Homo sapiens
gaagatacacatatatcactacaatttcatttctaagtatttgaatgccctagaggaaatacttagaaatgaaattgtagagatttgaaagtgtagtc

SEQ ID NO: 3842 - DNA, 78 bp, Homo sapiens
cagctggctgaaaagagaccagactttttttttttttttttttttttaagacagagtctcactctgtcagccaggatg

SEQ ID NO: 3843 - DNA, 115 bp, Homo sapiens
tcacatacattctcttacgaatccaaggaagattgtggttcaattttttttttttttttttttttttttttttgagacaggatctcactttgtcacctaggctggagtgcagtgg

SEQ ID NO: 3844 - DNA, 95 bp, Homo sapiens; identical to SEQ ID NO: 68

SEQ ID NO: 3845 - DNA, 93 bp, Homo sapiens; identical to SEQ ID NO: 69

SEQ ID NO: 3846 - DNA, 95 bp, Homo sapiens
taccctggtgtctggcaggtagtaatgactacaacagccatagcatatatattatatgtctgtggctgttgtaacaaattatcagatactttgtg

SEQ ID NO: 3847 - DNA, 89 bp, Homo sapiens
atatatatatattcttgtactgtatctattctatatatataatattctatatatattcttatactgtatctataagaatatatatgtat

SEQ ID NO: 3848 - DNA, 142 bp, Homo sapiens
tatatacgtatatacatatgtgtgtatatatacatatgtgtgtatatatacatatgtgtatatatacatatgtgtgtatatatacatatatgtacatatgtgtgtgtgtatatatatacgtgtgtgtgtgtgtgtgtgtgta

SEQ ID NO: 3849 - DNA, 101 bp, Homo sapiens
gctgtgaggatccggggtgatgctcatgaggtgcccggcaccctgtgtggcacagaaatgaccagaaaataccaactcacccaatgccaagtcttcactgt

SEQ ID NO: 3850 - DNA, 111 bp, Homo sapiens
tattaaatttccaagcaaatgaggttttcaaaatgtaatattttatttttgatttcaaatggattcgtagtcagaatgtggtcattatgaaatttgtcaggacttttagta

SEQ ID NO: 3851 - DNA, 94 bp, Homo sapiens
ttagccaaatgtggtggtgcctgtgtatagtctctctccctcttttttttttctaactttttgtgacatggtctggctctgtcacccaggctga

SEQ ID NO: 3852 - DNA, 70 bp, Homo sapiens
agagagagatgtagatatatagatgtgtgtgtatatatatatatatatatatatatatatatattctcct

SEQ ID NO: 3853 - DNA, 103 bp, Homo sapiens
tggctacactcccttcttcttgggcacatgatttagaggagcatgagctggttttcagctcctactcactcactcagtcattgttcttatgggaggataacta

SEQ ID NO: 3854 - DNA, 135 bp, Homo sapiens
acatgtgaatatatattcatgtttatatatatatctcactatatgagtatatatgtatatatatttattcatgtttatatatgtatatatatctcactatgagtatatatatgtgtacatatatattcatgttta

SEQ ID NO: 3855 - DNA, 119 bp, Homo sapiens
atgttataactttggggcagatttggggcagatatgactaagcaaagtgaaatttgtatgtatataaatagtaacttgcatgtagaacccaatatttagtgccctgcaggagtgaacat

SEQ ID NO: 3856 - DNA, 103 bp, Homo sapiens
acttaagagagcattcattttcctccaataatacttttactactggtaagtatatgtatttacattttaatgaagactccaggtattgaatgcttcttcaagt

SEQ ID NO: 3857 - DNA, 110 bp, Homo sapiens
tgttgctgggatagttttgctgggccgtttgctgaggattttgtatctgtatttataagaaatattgatctgtggttttctggtgatgtgtttgacaagttttggtatca

SEQ ID NO: 3858 - DNA, 109 bp, Homo sapiens
tgctgtcttctaccaaggtgtcctctgagacagataaattcaagttgtatatgtgatactttttattttaatagacttgcttttttagagccactttaggttcacagta

SEQ ID NO: 3859 - DNA, 156 bp, Homo sapiens
tatatatatataggtatacatatgtatatatatataggtataggtatacatatgtatatatatataggtataggtatacatatataggtgtacatataggtgtatatatatatatatactcatatatctattatatatataattcttttatgttta

SEQ ID NO: 3860 - DNA, 114 bp, Homo sapiens
tctgtgcatagtttcactcccatggctgggaggggcactggcaggaacggaacagggctggctggctctgtgcctgccaaagctctgagtgtgatggtgtggtgctggggcggg

SEQ ID NO: 3861 - DNA, 82 bp, Homo sapiens
tgagaataagtttgcatacctctaggtaaatatccgggagtgcaattgctgggttgtatgctagttgtatgtttagttctga

SEQ ID NO: 3862 - DNA, 91 bp, Homo sapiens
agaggcagagattgcagtgagctgagataatgccactgtgctccagcctgggtgacacagcaagactctccctctctctctctctctctct

SEQ ID NO: 3863 - DNA, 95 bp, Homo sapiens; identical to SEQ ID NO: 68

SEQ ID NO: 3864 - DNA, 93 bp, Homo sapiens; identical to SEQ ID NO: 69

SEQ ID NO: 3865 - DNA, 84 bp, Homo sapiens
gtttgagatgttgaatattgttaatttatttgtactattggtacaggtaggataacacaattaggatgaaggcatatgtcaagc

SEQ ID NO: 3866 - DNA, 119 bp, Homo sapiens
gcatgattcagtctaatgtacactgaatttgtaaatgttgtgcatgtgtatatttatatatgaacatgtataaatagatgttgaagaataggaaggtgcataaatagatgttgtaggtc

SEQ ID NO: 3867 - DNA, 96 bp, Homo sapiens
tcatccatattggatccaattcatatatatcatatggatcattttttatatatatatatatatatatgaattggatcatttcaacaattaggctgg

SEQ ID NO: 3868 - DNA, 88 bp, Homo sapiens
gctgacagttactctgtgtaaggaggttagagataggaccccaatcccttctagcttgtaatgttttactgaggagtctgctgttagt

SEQ ID NO: 3869 - DNA, 77 bp, Homo sapiens
tgtacatatatatacacatatatgtatatgtatatatatatattccatgtatatatatgtgtgtgtatatatgtata

SEQ ID NO: 3870 - DNA, 72 bp, Homo sapiens
tgtatatatgtatatatgttatgtagctatatatagtatatatacacatataatacatatatatatacatgt

SEQ ID NO: 3871 - DNA, 159 bp, Homo sapiens
atatacatacacatatatcaataatgtgtgtatatactatatagatatatgtgtgtgtgtgtatatatatatatatatatatatatatatatatatatatatatataatctgtatcctgtatcctgctcaaagtattatgtgtgtgtgtgtgtatatat

SEQ ID NO: 3872 - DNA, 111 bp, Homo sapiens
aatattcaccaaggaaaagatgtatttttagtattacttatgaggttgttggtagaattcatttcctttgtgggctattgaaacaagtgcctcagttcctagctggttgtt

SEQ ID NO: 3873 - DNA, 67 bp, Homo sapiens
tgtcatcaaaatccataatgcaaatgaattgttaaaataagaattccagttgcatttggagatgtca

SEQ ID NO: 3874 - DNA, 95 bp, Homo sapiens; identical to SEQ ID NO: 68

SEQ ID NO: 3875 - DNA, 93 bp, Homo sapiens; identical to SEQ ID NO: 69

SEQ ID NO: 3876 - DNA, 88 bp, Homo sapiens
cctggttttgaatgtgaacatcttattattttgtttatttttgctgtatgcttacagatcagagagatgttcacagtataaacttagg

SEQ ID NO: 3877 - DNA, 87 bp, Homo sapiens
ctgtgtaggactgtctcacacactgcatgttgtgtattgtccttgacaacaacatactaacatctctggtccccagtcactggacag

SEQ ID NO: 3878 - DNA, 89 bp, Homo sapiens
gaacttctaattttcatctggtagcatgtacctttagtcccagctactagggaggctgaggtaggaggatcacttgaggccaagagttc

SEQ ID NO: 3879 - DNA, 69 bp, Homo sapiens
gtagtattggaaatatacacataaacacacatatgtgtgtgaatatatgtatatattatgctttgctac

SEQ ID NO: 3880 - DNA, 95 bp, Homo sapiens; identical to SEQ ID NO: 68

SEQ ID NO: 3881 - DNA, 93 bp, Homo sapiens; identical to SEQ ID NO: 69

SEQ ID NO: 3882 - DNA, 83 bp, Homo sapiens
gaagtaaaatgtatatatacacatatgtatatgtatgtgtgtatatacgtatatatatatatgtgtatgtgtatgtatgactc

SEQ ID NO: 3883 - DNA, 86 bp, Homo sapiens
catatgtgtatgacttcaaatacttatatatatgtgtatacatatgggtgtatatatatgtatatgtgtgtatgtatatgtatgtg

SEQ ID NO: 3884 - DNA, 96 bp, Homo sapiens
agccccagtgagatgaacccggtacctcagttggaaatgcagaaatcacatgtcttctgcgtcactcacactgagagctgtagactggagctgttc

SEQ ID NO: 3885 - DNA, 119 bp, Homo sapiens
gagtattccatatgtgttggttagatctagttggtatataaaattttttaaattttaaatttcattttattttccacatagttgatctaatttttattacaattaggtatggtaatttc

SEQ ID NO: 3886 - DNA, 75 bp, Homo sapiens
ggagagagactgacgcaatagtcctattagaaggtcctggctagtttggactacctgctgttggaagatttgacc

SEQ ID NO: 3887 - DNA, 92 bp, Homo sapiens
gtatatatatgtgtgtgtatatatatgtgtgtgtatatatatatgtgtgtgtgtgtgtgcatatatatatatatatatatatatttatttat

SEQ ID NO: 3888 - DNA, 73 bp, Homo sapiens
taagacactggcagactcactgtctatgaggacctgcttcctggttcatagatggctgtcttcttgctatgtc

SEQ ID NO: 3889 - DNA, 64 bp, Homo sapiens
atgtatgtatgtgtgtatttatatgtatgtgtatgtagatatatagatatatatatatatatat

SEQ ID NO: 3890 - DNA, 73 bp, Homo sapiens
cacatacatacatacatatacacacatacatccacatttttaatgcatgtgtatatatgtatatattgatgtg

SEQ ID NO: 3891 - DNA, 105 bp, Homo sapiens
tatatatacacacacacacacatacacacacattatatatataactatacaaattttatagttatatatatatataggttgttaggtaaattgtttgtatgtata

SEQ ID NO: 3892 - DNA, 107 bp, Homo sapiens
tgagtacctatctacggacctttaagtatatgagcaaaactgattttttaattataaagaccatcatatttgcattatactgtgtggccgaacagtgggataaatca

SEQ ID NO: 3893 - DNA, 112 bp, Homo sapiens
atttagcaaatgtggaactggtcaccttcttttataatatggaatgctaaaaaatatgtttaagtatttttatttattttgggggtcaatttatgtcattgttttgtgaaat

SEQ ID NO: 3894 - DNA, 86 bp, Homo sapiens
ctgccacaactggtgactgaggactggcctgactggtgtctctgtcaccagcaaagtcttgctacagcctctaccagcaactgcag

SEQ ID NO: 3895 - DNA, 101 bp, Homo sapiens
ttatactataattttatatgtgtgcatatatactatatataatacaatgtatacattacataaatatatatacatatatacaatacatatatgtagtttaa

SEQ ID NO: 3896 - DNA, 83 bp, Homo sapiens
tgtatgctgtgcactttgggtgagactctgagacttgctggattcagatgagactcagcacttttccagctgtggtagctaca

SEQ ID NO: 3897 - DNA, 114 bp, Homo sapiens
taggattagagtaatttgtagaactaagtggttaaggagccccttctgttgggtgtggtacaaggttctctaaatacagtggccatagtctttttattttaatgtttactcctg

SEQ ID NO: 3898 - DNA, 90 bp, Homo sapiens
gtgtcttctgtgtcacaaaaaattaggcattttggagtactttcactggttactctttttttttttttttttctcgagacagagtctcac

SEQ ID NO: 3899 - DNA, 62 bp, Homo sapiens
gggggagaagaggaggagaggggaactaggggcgaggatatctctctctgtctctctctctc

SEQ ID NO: 3900 - DNA, 74 bp, Homo sapiens
caggtgatgagggcccctgaatgtcacactaaggagtttgaactctgtcatactcagtgggtctttaccacgtg

SEQ ID NO: 3901 - DNA, 121 bp, Homo sapiens
ttgtgtggggttttttttgtagttgttttgttttgtttttttattacaggggtttattactgcatgtgcaagtgcagtagggaacagagagacaaaactcctctcctcataaagcttccat

SEQ ID NO: 3902 - DNA, 60 bp, Homo sapiens
tatacatatatgtgtgtgtatatatgtgtatacatatatatacacacacacatatgtata

SEQ ID NO: 3903 - DNA, 58 bp, Homo sapiens
gtatacacatatatacacacacatatatgtatatatgtatgtgtatatgtgtgtatat

SEQ ID NO: 3904 - DNA, 82 bp, Homo sapiens
catatatacacacatatatgtatatatgtatatacgtgtgtatatatgtgtgtatatgtgtatatgtgtgtgtatgtgtatg

SEQ ID NO: 3905 - DNA, 76 bp, Homo sapiens
atatacacacatatatgtatatatgtatatacgtgtgtatatatgtgtgtatatgtgtatatgtgtgtgtatgtgt

SEQ ID NO: 3906 - DNA, 87 bp, Homo sapiens
cagtgcttgacatatgtaggtgctgaatgaatctttaatataatttttttgtaaaaggtattaatcacctattaatatgtagcaatg

SEQ ID NO: 3907 - DNA, 96 bp, Homo sapiens
taaatgtggtggccctgtagtttcacttcagtttttcttgtattaaattcaaataagaccatactgaatgatttatttatacaagcatgacattta

SEQ ID NO: 3908 - DNA, 58 bp, Homo sapiens; identical to SEQ ID NO: 315

SEQ ID NO: 3909 - DNA, 103 bp, Homo sapiens
tcaaaatgatagcagatgctcagttggctcactgaatggactgtctcagtctctgaacttggattacttgagtctttgaagtaatattgctaacatgttttgg

SEQ ID NO: 3910 - DNA, 95 bp, Homo sapiens; identical to SEQ ID NO: 68

SEQ ID NO: 3911 - DNA, 93 bp, Homo sapiens; identical to SEQ ID NO: 69

SEQ ID NO: 3912 - DNA, 82 bp, Homo sapiens; identical to SEQ ID NO: 2170

SEQ ID NO: 3913 - DNA, 86 bp, Homo sapiens
tggagacaagggatctggtgcgagccgggctgggcccctgggtgacccccaggcactcactgtccctctctagacctttctttcca

SEQ ID NO: 3914 - DNA, 100 bp, Homo sapiens
atcagagactgttgcagctaatatagtgtgtgccatatacacatgcacaaactcacacacacactaatacaaatagccaatgtgtattcagtattttggt

SEQ ID NO: 3915 - DNA, 62 bp, Homo sapiens
gtgtatatatacgtatatatatgtgtgtgtgtatatatatatatatttatttatatatatat

SEQ ID NO: 3916 - DNA, 104 bp, Homo sapiens
tgctggataacattctactgtgtggatatacaaatatttgtttttcatctaacgatggagaatttttaatattttattacatgaagtatctgtcttccacagca

SEQ ID NO: 3917 - DNA, 91 bp, Homo sapiens
gggactagaccccagggctgggatcccacagaaagtcacaggccctgcccattggcaaggtctctctctgcctctcagccaggaaaatccc

SEQ ID NO: 3918 - DNA, 101 bp, Homo sapiens
agattgttggctggaatgctactgatttttgtatgttgtttttatatcctgcaactttactgaatttgtttatcagttctactagttttttgctaacatct

SEQ ID NO: 3919 - DNA, 76 bp, Homo sapiens
tcactctctctcccagactggagtgcagtggcccaatctcagctcactgcaacctccgtctccgagattcaagtga

SEQ ID NO: 3920 - DNA, 62 bp, Homo sapiens
tgagacagggtctcactcactctgtcgcccaggtagcagtgcagtggtgtgatctctgctca

SEQ ID NO: 3921 - DNA, 111 bp, Homo sapiens
cagaagaaaagtagagggggaagtaaaaacaagcaaaaaaagccattttatatttttttaatgaagcgataatagcatgtttatatttctctttgacccaagcgtcttgtg

SEQ ID NO: 3922 - DNA, 92 bp, Homo sapiens
tagatttctctcaaagattcttggcatctttcattcattttaattaaatctgctgatgtaaagctgtaagaatttttcactttagaaatctg

SEQ ID NO: 3923 - DNA, 85 bp, Homo sapiens
tctcttctcctttttatgtctccctgtttgtctctggaatctggttttgtgtgagcaggagatggacataaataggtggctgagg

SEQ ID NO: 3924 - DNA, 62 bp, Homo sapiens
tctctttctatatgtgtatgtgtgtgtatatatatacatatatgtatgtatagtgccagtga

SEQ ID NO: 3925 - DNA, 102 bp, Homo sapiens
gtggtgatgagtgagttcatgcaagatctgattgtttaaaagtatgtagaacctctcctctctcttgcttccagtcttgccatgtgacatgcttgatcccac

SEQ ID NO: 3926 - DNA, 82 bp, Homo sapiens
ggtggagccatgggtctctctctgagccagtcgatgtggcccaaagaatgcggcttggccagcctgagtgacaagctccacc

SEQ ID NO: 3927 - DNA, 77 bp, Homo sapiens
gaagatgaagctctgtgtcagtctttctcagttctgagtcattagttctagggagggaaggcattagaaaacttttc

SEQ ID NO: 3928 - DNA, 119 bp, Homo sapiens
actataatctctatattgttttttcaatttaattttcatgaggtagagactgaactgagtcacctgaaaatattcattctctatagtcataagattaaagatcaaatctggagcatggt

SEQ ID NO: 3929 - DNA, 111 bp, Homo sapiens
acatatatgtatatgtttatgtgtatatatatatatatatatatatatatatatatatatatacacacacacatatgtttatgtgtatatatatatatatatatatacaca

SEQ ID NO: 3930 - DNA, 93 bp, Homo sapiens
ttcctgtgtctccatctgtctcattctctctgccttcctgtatctgtcaggatgttggtggggcgggtccagatgggggagggggcgcggggg

SEQ ID NO: 3931 - DNA, 156 bp, Homo sapiens
gtttgataaaatcacaaagaagcaatgggtagggactcatcaatgtgtgaagtgactgagcactgatacacataacacagttgacattgtctttaatatttattattgaataaatgacagcatgtgaacaaaagtgtatgcttttcacactagtga

SEQ ID NO: 3932 - DNA, 117 bp, Homo sapiens
tgatgagttaggttttcaccatgtgtaggttattctaagggtttcaggtctaatggcatcccctgaggtagtaggtagataagctggtcatcaggttagagcctgtattttgaatca

SEQ ID NO: 3933 - DNA, 99 bp, Homo sapiens
ccatgtgtgtttgtgtgtgtgtgtgtatatgcatgtatgtacgcgcgtgtgtgtgtgtatatatatatatatgtctgtatatatatggcacaaaataac

SEQ ID NO: 3934 - DNA, 89 bp, Homo sapiens
catgtgtttcagagtcaacacagagtgcagttagaattggagtgaggatatctggtttcatattgcagctctgctgctactcgaacatg

SEQ ID NO: 3935 - DNA, 111 bp, Homo sapiens
aggtacaagagttggaaaatctctcaatttcagtctagccagacactgactctctatgatgagtccctttatggattggggcctgctgtgggtggtacagcacttgctcct

SEQ ID NO: 3936 - DNA, 85 bp, Homo sapiens
gggctaatgacagtggaagaattctgtgctgggtgtccgtttttccctgtgaactttggcaagttgtttttccctctgtctgccc

SEQ ID NO: 3937 - DNA, 86 bp, Homo sapiens
ggtcctgcactgaccctcactggatgcagagcctctcaagctgtcttgcaggatttctgtctttgtacatgtcttaggtgtgggcc

SEQ ID NO: 3938 - DNA, 85 bp, Homo sapiens
tgccctctccctgctgcctgacctctcagtctctctgaatacaccaagctatattagacagattgataacagaagggtttgggca

SEQ ID NO: 3939 - DNA, 58 bp, Homo sapiens
tgagacagggtctcactctgtcacccaggctggagtgcagtggtgtgaccatggctca

SEQ ID NO: 3940 - DNA, 68 bp, Homo sapiens
cccgtgtgctaagcaaagatttgagtctttttttttttttgagacggagtctcactctgtcacccggg

SEQ ID NO: 3941 - DNA, 77 bp, Homo sapiens
ccaaggctctctgactgactccttcccagatcttcttagcttagcggctgaagactgactctgtccgattgcctcgg

SEQ ID NO: 3942 - DNA, 95 bp, Homo sapiens; identical to SEQ ID NO: 68

SEQ ID NO: 3943 - DNA, 93 bp, Homo sapiens; identical to SEQ ID NO: 69

SEQ ID NO: 3944 - DNA, 76 bp, Homo sapiens
gggcctgagggcctgggaaatctggctaggagctggtttcctggcatagacactttctcactcacagcagacgccc

SEQ ID NO: 3945 - DNA, 63 bp, Homo sapiens
gcttttcttcttgtttcaggtgatcttctcctgcagggggagggagagagagagagagagagt

SEQ ID NO: 3946 - DNA, 103 bp, Homo sapiens
ttccactggcgggtatagcggctctttcactctctttcttcttcttcttttttctttttttttttttttgagacagagtctcgctctgtcacccaggctggag

SEQ ID NO: 3947 - DNA, 110 bp, Homo sapiens
ctagtggctgaattacactgtataatttattaatgaaatgatttgtagatattctatatatatttcatgtgtatataaatatgtgtgtaaaagcaaaataaaatgactgg

SEQ ID NO: 3948 - DNA, 90 bp, Homo sapiens
tgatgttatatcctaaaactttactgaatttgttcatcagttctaagaatgttttggtggactctttaggtttttttaagtgtaagatca

SEQ ID NO: 3949 - DNA, 114 bp, Homo sapiens
ttttaagattttttgaactatgaccttttctcagaaatcttaaagatgactaaataaagtattagtgtaaggttaagaagagggggcattgaatatagttgagttgatagagaa

SEQ ID NO: 3950 - DNA, 95 bp, Homo sapiens; identical to SEQ ID NO: 68

SEQ ID NO: 3951 - DNA, 93 bp, Homo sapiens; identical to SEQ ID NO: 69

SEQ ID NO: 3952 - DNA, 114 bp, Homo sapiens
aaaattcaccagtgaacctagagctttctgttttgggagattattagttattgattcaatttatttaataatatatacctattcagatagtttgtttcttcttgtatgagtttt

SEQ ID NO: 3953 - DNA, 116 bp, Homo sapiens
caccacctatgattgagtgtgtctgtgagatccttagaggccttgcatcagaaggtcatcttgacagttctgtgagaggacaggggaattggactctatcttacccaaaggctgtg

SEQ ID NO: 3954 - DNA, 117 bp, Homo sapiens
gtcttaatgaaatttacttaattcagatattttgcaaatgcaaagagtgtaaacacttttaaatttttagatttgcatttaaatgctaaggatattattaaatgtgatcagcaaggc

SEQ ID NO: 3955 - DNA, 96 bp, Homo sapiens
atatatatagatatatctatataaatctatatatatctatatataaatctatatatatctatatgtaaatctatctatatatatatctatatctat

SEQ ID NO: 3956 - DNA, 113 bp, Homo sapiens
attttacttatgaatagcagtttgttctctattactagtaattcttaatgaatctatttctttttaagaatgatacagtgtagtggttttcaaatctagctgcatattagaat

SEQ ID NO: 3957 - DNA, 91 bp, Homo sapiens
catgaatggggacacacacgtttagtccatataagtatttatattattattattctttgagatggagtctggctctgtgtcgcccaggctg

SEQ ID NO: 3958 - DNA, 58 bp, Homo sapiens
tgagtcaaggtctcactctgtcacccaggctggagtgcagcagcatgaccatggctca

SEQ ID NO: 3959 - DNA, 83 bp, Homo sapiens
atcagtagggggtcctattagtagaaaaatgaagctttctacttgaagtttttttttttcaactcctagtccagcctaaggat

SEQ ID NO: 3960 - DNA, 70 bp, Homo sapiens
gggctctgctcccttcctcggtctccccactcaggcttgccagtccctctcagtgggtgactgaaagccc

SEQ ID NO: 3961 - DNA, 71 bp, Homo sapiens
tttgaggcagagtttcactcactctgtcacccaggctggggtgcagtggcatgatcttggctcaactcaaa

SEQ ID NO: 3962 - DNA, 100 bp, Homo sapiens
tttaatttttagctttcttctggttcttgactgtagatactgagagttgtaagaagagctcagttgctgacacctcagaattataaagttaacccttaaa

SEQ ID NO: 3963 - DNA, 76 bp, Homo sapiens
ttcagaaggctgaggtaggaggttcgcttgagcctgaaaggtggaagttgcagtgagccaagatcatgccactgga

SEQ ID NO: 3964 - DNA, 58 bp, Homo sapiens
tgagatagagtctcactctgtcacccaggctggagtgcagtggtgtgatctcaactca

SEQ ID NO: 3965 - DNA, 84 bp, Homo sapiens
ttgacaaggtcaggaaccaagcctgtttcaggggtgtgtgtaccaggaaccattcatggcactggctgaattgactcttggcaa

SEQ ID NO: 3966 - DNA, 58 bp, Homo sapiens
tgagactgagtctcactctgtcacccaggctggagtgcagtggtgccatcttggctca

SEQ ID NO: 3967 - DNA, 118 bp, Homo sapiens
atccttgcctaagccaatatctagaagggtttttccgatgttatcttctataatttttatagttttaggtcttagatttaagtccttaatccatcttgagttgattatggtgagagat

SEQ ID NO: 3968 - DNA, 95 bp, Homo sapiens; identical to SEQ ID NO: 68

SEQ ID NO: 3969 - DNA, 93 bp, Homo sapiens; identical to SEQ ID NO: 69

SEQ ID NO: 3970 - DNA, 63 bp, Homo sapiens
tgctagtgggtgccagcctttatgtgggtgatcacagatacaacagaggcagcacagcttgca

SEQ ID NO: 3971 - DNA, 90 bp, Homo sapiens
cagaaatgtgctttcctatcagcatttacagatgatgaaattttatagattttcattaacagtctttagaagtgctgtgaatgtgctctg

SEQ ID NO: 3972 - DNA, 95 bp, Homo sapiens; identical to SEQ ID NO: 68

SEQ ID NO: 3973 - DNA, 93 bp, Homo sapiens; identical to SEQ ID NO: 69

SEQ ID NO: 3974 - DNA, 133 bp, Homo sapiens
gtgtctgtctgtctgataccatcatccccctgtgtcctcccacagcggtccctctgtgtgtctgtctgtccgataccatcatccccctgtgtcctcccacagcggtccctctgtgtgtctgtctgtccgatac

SEQ ID NO: 3975 - DNA, 79 bp, Homo sapiens
ttagtttctgtttcttgttgggccagtaaagccctttcctcatccctcttttctgcttatcactagagacagaaactga

SEQ ID NO: 3976 - DNA, 119 bp, Homo sapiens
gtcatggcataagcttccgaaacagttgaaggatgagtaatacacagaaaattgtcaggagaaaattatgtggggtataaccattgcactagattgttttgtagaggagacagattggc

SEQ ID NO: 3977 - DNA, 108 bp, Homo sapiens
ttaggataatggcctctagctgcatccatgttgctgcaaatgacataattttgttattttttatggttgtgtagtattctgtggtgcatatgtagcacattttcttga

SEQ ID NO: 3978 - DNA, 107 bp, Homo sapiens
ggtaaaaaactagaaatggaattgatgggtcctagagtgaatgtttatgtatttaagaattgtcatatttattcaccaaagaagatgtgtgattttccacttctgcc

SEQ ID NO: 3979 - DNA, 92 bp, Homo sapiens
gctttcagagaatcttgtttagtccttagcccagtaattcagttgtctgtgtctgactgtcttcttgagtatacagcactctctttgagggc

SEQ ID NO: 3980 - DNA, 85 bp, Homo sapiens
tgagatggagtgtctctctgtcacccaggctggagtgcagtggtgcaatctctgcctcccaggttcaagcgattctcctacttca

SEQ ID NO: 3981 - DNA, 113 bp, Homo sapiens
agattagtatagggaaaggttcagaggcatggacatattttttaaataaatttatgtatttatttatttattatttggacactagtgtctcactatgttacccaggctggtct

SEQ ID NO: 3982 - DNA, 80 bp, Homo sapiens
gtgttggtcagagctgaagtcatctggaagcttcacgagggaaagacctgcttccaggctcactgtgtgactgtcaacat

SEQ ID NO: 3983 - DNA, 115 bp, Homo sapiens
gcatgtctttgtctcatttccattctcagggggaaagctttcaatatttcattattaactatgaagtttgatacagctttatctgatctgaataagggattttctttagatattc

SEQ ID NO: 3984 - DNA, 108 bp, Homo sapiens
aaagaaaaaccagcttgatatatagattatctatctatctatctacctacttatctatctatctaccaatctatctactagatctatacatcaagctgatttttcttt

SEQ ID NO: 3985 - DNA, 76 bp, Homo sapiens
tgtctaatatatatttatatgtacacataatcatgtgtatatgagtgtgtgtgtatatatatatatatatatgaca

SEQ ID NO: 3986 - DNA, 95 bp, Homo sapiens
ggagcatttgtgtttctttggaagtggtgtgctcatatttctgggtagtacagattttgaatatatatacttgtcagaagaacaagaactgttct

SEQ ID NO: 3987 - DNA, 64 bp, Homo sapiens
gttttctgagaagtaggcccactgttttatttttttaacaatgggcttaacgtattcggtaaac

SEQ ID NO: 3988 - DNA, 116 bp, Homo sapiens
ctgaaatgttcaagaatatcaagcaaatcaagaactaaattgactgaactcagaaagctgaagcaatctttttgacttttgattggaatattgctgatctttgttttgtttttcag

SEQ ID NO: 3989 - DNA, 82 bp, Homo sapiens
tatatgtatgtgagtatatgtatatatatacacacacatatgtatgtacatatatacatgaaaatatgtgtgtatatataca

SEQ ID NO: 3990 - DNA, 82 bp, Homo sapiens
gtatatatgtgtgtatatatacacacatattttcatgtatatatgtacatacatatgtgtgtgtatatatatacatatactc

SEQ ID NO: 3991 - DNA, 79 bp, Homo sapiens
aggctgaggtgggaggatgatttgagcccaggaggtggaagttccagtgagctgagatcatgccactgcactccagcct

SEQ ID NO: 3992 - DNA, 91 bp, Homo sapiens
gtagatgtgtatatatgtataggcatatgtatatatgtatatacatacatatgtaggtataggcatatttatatacatatatacaaaatac

SEQ ID NO: 3993 - DNA, 118 bp, Homo sapiens
gtattatttgaaagatatagtatgtattcttttgttatttgattcagcaaaataatttttaaatttatgcatactcaggtgatttagtagtgcttttcttttgttgtcttcaaattac

SEQ ID NO: 3994 - DNA, 64 bp, Homo sapiens
gagctgcgtctgtgactgggtgtctggcgcacggtgctggcatagggatgcattaactcggctc

SEQ ID NO: 3995 - DNA, 56 bp, Homo sapiens
tgagacagtctcactctgtcgcccaggctggagtgcagtgatgtgatctctgctca

SEQ ID NO: 3996 - DNA, 108 bp, Homo sapiens
ggtaggctatttattactgcctgtgatggttaatattgtcaacttgattggattgaaggatgcaaagtattgttcataggtgtgtccgtgatggtgttgccaaaggag

SEQ ID NO: 3997 - DNA, 121 bp, Homo sapiens
tgtgtgtgtatgtgtgcatgtgtatgtatgcatgtgtgtgtatacttatatatatgtatgtatgcatgtgcatatgtatacatatgcatacgtacatacatacagtaacatatgcatacat

SEQ ID NO: 3998 - DNA, 84 bp, Homo sapiens
tataaatgtgacaactctgtctgtgactgtctagtagaaaaataacactggaacctagtaccagacttggttgaaaaaattgta

SEQ ID NO: 3999 - DNA, 88 bp, Homo sapiens
aagacaggcttttttgatccagtctgcgtggtaaactttttttttgagtctctctgtcacccaggctggagtgtgggggcatgatctt

SEQ ID NO: 4000 - DNA, 100 bp, Homo sapiens
tgacagagcaagactctgtctcaaaacaaaaacaaaaacaaaacaaagaaaataaacgtgattttttttttttttttgagacaagagtctcgctctgtca

SEQ ID NO: 4001 - DNA, 58 bp, Homo sapiens; identical to SEQ ID NO: 315

SEQ ID NO: 4002 - DNA, 83 bp, Homo sapiens
atcctcttttgagggcttttaagaatataggttgtaaaagtaataaaactctacaactgtatttttgattctttagaaaggat

SEQ ID NO: 4003 - DNA, 82 bp, Homo sapiens
tcaagaagcataggtcctccaatttagtttttctttttcaagattgttttagctatttggagccccttgccattctctgtga

SEQ ID NO: 4004 - DNA, 119 bp, Homo sapiens
caaagtgttaggactacaggcgtgagccactgcactgtccttagacccatttcttttttcttctttttttttttttttgagatggtgtctctctgtgtcgctcagcctggaacgcagtg

SEQ ID NO: 4005 - DNA, 108 bp, Homo sapiens
tctctgcctgcatcttcccatggctttctcctatctgtctctgtgtcttctcctcttataagaacaattgtcattagatttagggctagcctagattgcctaagatga

SEQ ID NO: 4006 - DNA, 95 bp, Homo sapiens; identical to SEQ ID NO: 580

SEQ ID NO: 4007 - DNA, 93 bp, Homo sapiens; identical to SEQ ID NO: 69

SEQ ID NO: 4008 - DNA, 117 bp, Homo sapiens
gaattcatttatcaaatctaggagtatttcggagaagtctctaaggttttctaggtataagattatgccatcagcaaacagagattgatttcatcttttcctatttgaatgcctttc

SEQ ID NO: 4009 - DNA, 112 bp, Homo sapiens
tatacttaggctatgtacatatataatatagtaattatattataaataaaatattaatattttgtatataatataaaattaatatagatgtagatgtatatagagagatata

SEQ ID NO: 4010 - DNA, 115 bp, Homo sapiens
gtaaatgcataaaccagtaacatagtcatttattgctactatctggtattaggtactatacataattttgtgtgctatacttttagacagctggcaatgtggtaggtttgtttac

SEQ ID NO: 4011 - DNA, 190 bp, Homo sapiens
gatatatatacatatatatcacatgatagatgatatatatacatatatatcacatgatagatgatatatatacatatatatcacatatgatagatgatatatatacatatatatcacatatgatagatgatatatatacatatatatcacatatgatagatgatacatatacatatatatcacatatgat

SEQ ID NO: 4012 - DNA, 98 bp, Homo sapiens
atagatgatacatatacatatatatcacatatgatagatgatatatatacatatatatcacatatgatagatgatacatatacatatatatcacatat

SEQ ID NO: 4013 - DNA, 112 bp, Homo sapiens
tattctgtttaaaaatataatattttaagctgaaagatgcatatgttagtatttattatactattctccatacttttctgtgtgcttgaagtatttcataattacacaaata

SEQ ID NO: 4014 - DNA, 99 bp, Homo sapiens
catgaaaccgataggagaaacagtctcactctgactgtgtacccctcttccttttccaagtctgcatagtgccgtagagagaattttccagggttcatg

SEQ ID NO: 4015 - DNA, 96 bp, Homo sapiens
ccctaagtatgtctttaagggagatctagtgcagatggactgccacagtttagtttgtctgagaaagtttttttttttaattctatatatttaagg

SEQ ID NO: 4016 - DNA, 102 bp, Homo sapiens
caggggccatgctaataatctgtgttgttccatttttagtatatgtgctactgaagtgtgcactttgcccagttttgaatcgggtttttgttgttgctgctg

SEQ ID NO: 4017 - DNA, 85 bp, Homo sapiens
gtggatatctggccggttagagagttactggttaggttgagccaaagaatggaatcaatggatctctagctgttaaaatgtccac

SEQ ID NO: 4018 - DNA, 58 bp, Homo sapiens
tgagacggagtctcactctgtcacccaggctggagtgcagtggcacgatctccgctca

SEQ ID NO: 4019 - DNA, 101 bp, Homo sapiens
gatacataactatcttcaactatatatttacagttggatataaatatatattatatatatataaaactgtattattaatgtagttaagcagaaaatgtatt

SEQ ID NO: 4020 - DNA, 96 bp, Homo sapiens
ctagatttggctgaatagttgttttgctgtctggctggtggtctattggatggacatattcagggagtaagatggctagagactcagctttgctag

SEQ ID NO: 4021 - DNA, 70 bp, Homo sapiens
tgcttgaacagtgctttaaatatatatgtgtatatatataatacacacatatatatatatatgcacagca

SEQ ID NO: 4022 - DNA, 95 bp, Homo sapiens
ggttttgaaaggttgtgtcaatattgtcatttagttcaaagaattttttaatttccatattgatgtcattgttgacccaatcatcattcaggagc

SEQ ID NO: 4023 - DNA, 71 bp, Homo sapiens
gaggcccagatagaacaaaaaggtagaggagtagtgaagtctctctctgtctgtctgtcttctgaagctgc

SEQ ID NO: 4024 - DNA, 194 bp, Homo sapiens
acatctatatatatatatatatatatatatatatatatatatatatatatgtatatatatatgtgtgtgtatatatatatatatgtgtgtgtatatatatatgtatgtgtgtgtatatatatgtatatatgtgtatatatacacatatatatgtgtatatatgtgtatatatacacatatatatgtgtatatat

SEQ ID NO: 4025 - DNA, 62 bp, Homo sapiens
gacagagtggggctaaatggcctattttattttatttttttgagatggagtctcactctctc

SEQ ID NO: 4026 - DNA, 109 bp, Homo sapiens
tagtatgtgctaaatgaatgcatgaataatgaagctcttgctttttaaaaataaaaaggaactgtatatctttatttgttatggtttattccaaaggcacacaaagcta

SEQ ID NO: 4027 - DNA, 94 bp, Homo sapiens
gccataccgggatctttccattttcagaggcttctctctgacagtgaagtgtgatgacagacttgggggcagggcaatggctagcttctgaaag

SEQ ID NO: 4028 - DNA, 58 bp, Homo sapiens; identical to SEQ ID NO: 315

SEQ ID NO: 4029 - DNA, 59 bp, Homo sapiens
agctgttacagtaggtggttcacggacagctgtgagtcacactgactgaagtggcagct

SEQ ID NO: 4030 - DNA, 68 bp, Homo sapiens
caggggtggctggggaaagaggctgagtggtgtctacaaaataagtcactgtcacagacacacccagg

SEQ ID NO: 4031 - DNA, 114 bp, Homo sapiens
gcaaaattcttggtcagaaggaatcatatgcggatattttagagtgaagaatgaatgcagtaaacttaggaatgttgtttgtagaatcactgtgggcaaagaagacaaatctgc

SEQ ID NO: 4032 - DNA, 93 bp, Homo sapiens
aaagctttattgatttacctttcacattttgatctgctatcaatctttaattgatttttcataatgtacgaggtaggaatccatatacgtttt

SEQ ID NO: 4033 - DNA, 75 bp, Homo sapiens
ggctcagtcagtctggtaattttctttattatctatattagagctgaagaaattgaggctcagaatgattaagcc

SEQ ID NO: 4034 - DNA, 117 bp, Homo sapiens
gagtattgtaatgaggaacacatacttctccggggaactgtgaactgtctcagtcagagggtgttataaaggagttacaggatttgaaatgtgttaggtaatttcaggggagtattc

SEQ ID NO: 4035 - DNA, 95 bp, Homo sapiens; identical to SEQ ID NO: 68

SEQ ID NO: 4036 - DNA, 93 bp, Homo sapiens; identical to SEQ ID NO: 69

SEQ ID NO: 4037 - DNA, 95 bp, Homo sapiens; identical to SEQ ID NO: 68

SEQ ID NO: 4038 - DNA, 93 bp, Homo sapiens; identical to SEQ ID NO: 69

SEQ ID NO: 4039 - DNA, 115 bp, Homo sapiens
tctttttgcaaatatatatatgtatacatatatgtgtatatatatgtgtgtgtgtatatatatatatatatatatacacacatatatatatacacatatatatattttaaccaga

SEQ ID NO: 4040 - DNA, 82 bp, Homo sapiens
atatatatatgtgtatatatatatgtgtgtatatatatatatatatatatacacacacacatatatatacacatatatgtat

SEQ ID NO: 4041 - DNA, 126 bp, Homo sapiens
agctcagcctcccaagtagctaggaatagaagtatgcaccaccacatccagctatttttgaaaactttttttttttatagagatggggtcttgttttgttatccaggctggtcttaaactcctggg

SEQ ID NO: 4042 - DNA, 101 bp, Homo sapiens
cataacactgaaactgcagagaactgtttttgttaatattttacaggtatatttttatatgcaaaaatgctgaggaggactttatgtagattagatttatg

SEQ ID NO: 4043 - DNA, 100 bp, Homo sapiens
agtcacctgtaaattgaagatagtgaaaagttacatgagtatatatatatatatatatatatatatatatatattcttcctatgtttccaacagtgtact

SEQ ID NO: 4044 - DNA, 83 bp, Homo sapiens
ggtgtgctgtgtctgtgtcacacacaatgttaagggaccagcctatcccctgtgcattctgaatgtggtgtggatcaagcatc

SEQ ID NO: 4045 - DNA, 104 bp, Homo sapiens
atatatacacacacacacacatacatatatatacatatatataacacactatatatatgtgtggatatatatgtatataaatgtgtgtgtgtgtgtatatatat

SEQ ID NO: 4046 - DNA, 132 bp, Homo sapiens
tatacagtgtgtgcgtatatatatatgtatatgtatatgtatatacatgtacatatgtgtgtatgtatatgtatatatatgtacgtgtgtgtgtgtatatatatatgtgtatatatatatatatatatatat

SEQ ID NO: 4047 - DNA, 78 bp, Homo sapiens
cagtgttctggaaatctgactgtcactaactaagtctagttccactcacagacacagtcagtttcacagtctgcattg

SEQ ID NO: 4048 - DNA, 58 bp, Homo sapiens
tgagactgagtctcactctgtcacccaggctggagtgcagtggtgcaatctcggctca

SEQ ID NO: 4049 - DNA, 69 bp, Homo sapiens
gcttgtccacacattatctgattctgtctttttttttttttagacagagtctcgctgtgtcacccaggc

SEQ ID NO: 4050 - DNA, 114 bp, Homo sapiens
cataatcttctattgctctatattgccactgacagtatgtgctgtataatcttatatttataaaaaatacagtgcatgaatgtttatgtataaaatacaatgaagggacatatg

SEQ ID NO: 4051 - DNA, 97 bp, Homo sapiens
ggctattggggccctgaaacactgtaagaattgagtgaacaaaacatgaatgaatatcactaaaggcagtttcttgcaatggaggcttcagaatgcc

SEQ ID NO: 4052 - DNA, 97 bp, Homo sapiens
gagctcagtcagttctgggaacctcatgtatttcatatggttagaagaatagtgagatcttgactgatgagactggggtgaaaccaggagacaactc

SEQ ID NO: 4053 - DNA, 74 bp, Homo sapiens
gccaagaacacagacactggagtccaaaatacctgatttcaagtgttggttctgtggctcactgtctgtatgtc

SEQ ID NO: 4054 - DNA, 70 bp, Homo sapiens
ggcaggttgtgtctttgaaggaattggtctttttttttttttcttttcttttttgagacagagtcttgct

SEQ ID NO: 4055 - DNA, 58 bp, Homo sapiens; identical to SEQ ID NO: 3385

SEQ ID NO: 4056 - DNA, 56 bp, Homo sapiens; identical to SEQ ID NO: 3386

SEQ ID NO: 4057 - DNA, 58 bp, Homo sapiens; identical to SEQ ID NO: 1101

SEQ ID NO: 4058 - DNA, 56 bp, Homo sapiens; identical to SEQ ID NO: 1102

SEQ ID NO: 4059 - DNA, 81 bp, Homo sapiens
gctttctgtatactatatgaaaatggcttatttgtgcatgtgtgtgaatatatatatatcatatatactgtatatgaaagt

SEQ ID NO: 4060 - DNA, 57 bp, Homo sapiens
tgagcagagtctctctctgtcacccaggctggagtgcagtggtgtgatctcagctca

SEQ ID NO: 4061 - DNA, 56 bp, Homo sapiens
gagacagagtctctctctgtcactcaggctggagtgcagtggcgttatctctgctc

SEQ ID NO: 4062 - DNA, 134 bp, Homo sapiens
acacgtatgtatacacgtgtatatacgtatatatatgtatatacgtatatacacatgtgtatatatgtatatatgtgtatatacgtaatatatacatatatgtgtatatatgtgtatatatgtatatatgtata

SEQ ID NO: 4063 - DNA, 93 bp, Homo sapiens
ggacccccagtgacttctgagctgcccaacccaatggcctttctgccccttggtctctgggtctctgtccccctgtctcggtctgtgtctctg

SEQ ID NO: 4064 - DNA, 56 bp, Homo sapiens
gagacggagtctcactctgtcacccaggcctgagtgcagtggtgtgatctcggctc

SEQ ID NO: 4065 - DNA, 95 bp, Homo sapiens; identical to SEQ ID NO: 68

SEQ ID NO: 4066 - DNA, 93 bp, Homo sapiens; identical to SEQ ID NO: 69

SEQ ID NO: 4067 - DNA, 99 bp, Homo sapiens
cagctgcgcccatttgtttgcatattgtccaaggctgctttccgggtacaacagcagagttgagagactgcacagagaatggatgacctgtaaaggctg

SEQ ID NO: 4068 - DNA, 95 bp, Homo sapiens; identical to SEQ ID NO: 68

SEQ ID NO: 4069 - DNA, 93 bp, Homo sapiens; identical to SEQ ID NO: 69

SEQ ID NO: 4070 - DNA, 119 bp, Homo sapiens
aggatgcaaatatttttggttttaatttcatatcactaatgtagtcatcagagtttgcacattttgttattcactatttccctgattggcgattacctgaccagaagtggaaaagccct

SEQ ID NO: 4071 - DNA, 106 bp, Homo sapiens
gatctcttgacatgagctgtaaccctgagatgactgtgtgcacacgccccctccttctgtgagctgtgactatgttgacattttattttactatggaaagagaggc

SEQ ID NO: 4072 - DNA, 85 bp, Homo sapiens
gttgttgttgttgttttgagacagtctcgctctgtcacccaggctggagtgcagcagcgtgatctcgattcactgcaacctccgc

SEQ ID NO: 4073 - DNA, 64 bp, Homo sapiens
gtgtgcatatatatatatatatatatatatatatatgcctgtatatatgtgtgtgtgtgtatac

SEQ ID NO: 4074 - DNA, 72 bp, Homo sapiens
cagcctgggtgacagagagagactctgtctcaaaaaaaaagaagacagggtctcactctgtctcccaggctg

SEQ ID NO: 4075 - DNA, 67 bp, Homo sapiens
acagatgtgtgtgtgtgtgtgcacctgcatgtgttcatgtggtgtgtttgcacgtgtgtatgtgtgt

SEQ ID NO: 4076 - DNA, 58 bp, Homo sapiens; identical to SEQ ID NO: 2595

SEQ ID NO: 4077 - DNA, 58 bp, Homo sapiens; identical to SEQ ID NO: 605

SEQ ID NO: 4078 - DNA, 95 bp, Homo sapiens
aattagctgagatgagagatattttgagtgaaatactttgcataaaaaatgctgagtagatagttggatatatagttgtaaatttcagtgtgatt

SEQ ID NO: 4079 - DNA, 62 bp, Homo sapiens
tgagacagggtcttactcactctgtcacccaggctggagtgctgtggtgtgatctcagctca

SEQ ID NO: 4080 - DNA, 95 bp, Homo sapiens; identical to SEQ ID NO: 68

SEQ ID NO: 4081 - DNA, 93 bp, Homo sapiens; identical to SEQ ID NO: 69

SEQ ID NO: 4082 - DNA, 70 bp, Homo sapiens
tgagacagggtcccactctgttgctcactctgttgcccaggttggagcacagtggtgcgatcatgactca

SEQ ID NO: 4083 - DNA, 110 bp, Homo sapiens
aagtccatgatcttaaccgctactgtaatatatatatacgcacatatagatagctatatatctatatatgtatatatagacagatattactaataggaaatccactactt

SEQ ID NO: 4084 - DNA, 117 bp, Homo sapiens
ctgtgaggaataaatttctgttatttataaattactcagtctgtggcactgtgttacagcagcacaaacagactaaggcaatattctaaaatggcaagggatggtatgctagagcag

SEQ ID NO: 4085 - DNA, 88 bp, Homo sapiens
gatttctatgtcattctatggattagtatctgtgactatttatattcattttgatgcttaaatttcttggatttggccagtgggagtc

SEQ ID NO: 4086 - DNA, 84 bp, Homo sapiens
tataaatttgaagattgttgcagacggtaatcatcagacttattagatataatgttcttgtgattgtatctgcacaggtttata

SEQ ID NO: 4087 - DNA, 62 bp, Homo sapiens
tgaaactgagtctcactctgtcgcccatgctgcagtgaggtgagtggtgagatttaggctca

SEQ ID NO: 4088 - DNA, 115 bp, Homo sapiens
gctatatatgtgtatacatagctacatatattttaggaccctgctatatatgtgtatatatagctatatatattttaggaccctgctatatatgtgtatgtatgcatatgtctgt

SEQ ID NO: 4089 - DNA, 110 bp, Homo sapiens
tgcttaggattgttttggctatacgggctcttttttggttccatatgaaatttaaagtagttttttccaattctgtgaagaaagtcaatggtagcttgatggggatagca

SEQ ID NO: 4090 - DNA, 73 bp, Homo sapiens
tctctctatttataggtatataaatatatacatatgtgaaaatatgtatatgtacatgtatatttatgagaga

SEQ ID NO: 4091 - DNA, 96 bp, Homo sapiens
tggttgttctgcatttttttaaatcagttatgtgataaatctatatatattgatagaggttagaaaggagtggttataaattcaagtgcatggcca

SEQ ID NO: 4092 - DNA, 95 bp, Homo sapiens; identical to SEQ ID NO: 68

SEQ ID NO: 4093 - DNA, 93 bp, Homo sapiens; identical to SEQ ID NO: 69

SEQ ID NO: 4094 - DNA, 89 bp, Homo sapiens
ctatgaaaagtatgagtgtagactgagggcacaataattaaggttagtattgatgaagctcttactgtgtcctgggtactcttttatgg

SEQ ID NO: 4095 - DNA, 94 bp, Homo sapiens
agtggcaagatttcccgcggctgtcggattatgaaaggccttccaagttatactatgaaattttttcttttatctggacggattggaagccact

SEQ ID NO: 4096 - DNA, 113 bp, Homo sapiens
agtaccttatatggcacatagttagaatttcaatgagagttttatgaataaatgaatcttgaactcactgaatttaacttttgactcccagcctcaccaaatctttaggtact

SEQ ID NO: 4097 - DNA, 86 bp, Homo sapiens
tgcacattgaagcacatggaggcactgctttctattttctttttttaagagatagggtctcgctctgttgcctggattgaagtgta

SEQ ID NO: 4098 - DNA, 60 bp, Homo sapiens
tgcctaaaactgcatgcatgcatgttttatatttttatgtacagtgtatgtatttaggca

SEQ ID NO: 4099 - DNA, 58 bp, Homo sapiens
tgagatggagtctcactctgtcacccaggctggagtgcagtagtgcaatcttggctca

SEQ ID NO: 4100 - DNA, 101 bp, Homo sapiens
gttatttaatagtgcattgcctcaggtaatatatagtttagacataataattatatctttattataggattaaatgataaagtgcatacatactgcttagc

SEQ ID NO: 4101 - DNA, 87 bp, Homo sapiens
tctaacttggttaagtttctcgggcatggattgaaatatatacttttatatttgagatcatgtagccatagaatgaaccaatgcaga

SEQ ID NO: 4102 - DNA, 104 bp, Homo sapiens
agcttatgtatgtatgttttttctttagaaaacagaattaggaagcaagaagttttttttttttaactttgggagtcaagaaaaaaaatatatacagccttgct

SEQ ID NO: 4103 - DNA, 58 bp, Homo sapiens
tgagactgagtctcgctctgtcacccaggctagggtgaaatggcccgatctcggctca

SEQ ID NO: 4104 - DNA, 108 bp, Homo sapiens
tgtacatatatgagatatattagtattagctatatatatatatatgtatatacacacacataacaagcaatctatatttggctaatactgatatctcacaaaagtaca

SEQ ID NO: 4105 - DNA, 109 bp, Homo sapiens
aggttgggatggacacaaaagattttactagttgggaccccactggtcattggaaactaatgaaatatgacctggtcaaatagaatgagacctggtgcctcagcaatct

SEQ ID NO: 4106 - DNA, 104 bp, Homo sapiens
tagtggccgcgcacattgatgcacctgtttgttgttgagatatgaagtgaaaatcacagatacctgtaaaaatagcaaatttttcgatgtatagcaaggccctg

SEQ ID NO: 4107 - DNA, 105 bp, Homo sapiens
tacaaagtttaggttaaagtgaaggagatgttctataaagagactgaagatacagaggaatctgtgcttcatttgataggatacagtgcaaaatttggggtggta

SEQ ID NO: 4108 - DNA, 116 bp, Homo sapiens
gaataaaagcatttcttgttttatatttagagacaggatcccattttcttcctttcattctttttttgttgttttttttcctcctgactcacatatagaatcaagatgttgggttc

SEQ ID NO: 4109 - DNA, 115 bp, Homo sapiens
ctctatagaagatggttcttatttatcatagagtcttctgagagaagattctgagcaagcagtatactaaactctgagaagattccacgataaataagaaccatcttctatagag

SEQ ID NO: 4110 - DNA, 128 bp, Homo sapiens
atgttcatatatatgttcatatatatgttcatatatattcgtatatatattcatatatattcgtatatatattcatatatattcgtatatatattcatatatacatatatattcatatatattcgtat

SEQ ID NO: 4111 - DNA, 82 bp, Homo sapiens
gaagtggggtcttgtgaagagtcttgagtttgattcctaaaagtcatttcattttgttctttacatggctataacctatatc

SEQ ID NO: 4112 - DNA, 86 bp, Homo sapiens
attggcacacctgtagtcccagctgctagggaggctgaggtggaaggatcacttgagcccagaagttcgagattacagtgaacgat

SEQ ID NO: 4113 - DNA, 98 bp, Homo sapiens
gagccaagatcgtgccactgcactccaccctggcgacagaccaagactctgtctcattctgtgtcccaggctggaacgcagtggcacaatcatggctc

SEQ ID NO: 4114 - DNA, 95 bp, Homo sapiens; identical to SEQ ID NO: 68

SEQ ID NO: 4115 - DNA, 93 bp, Homo sapiens; identical to SEQ ID NO: 69

SEQ ID NO: 4116 - DNA, 66 bp, Homo sapiens
aacagtgtgaagtgagccagcagacctatgacctcatttgggctgttccagcttctcgcagctgtt

SEQ ID NO: 4117 - DNA, 218 bp, Homo sapiens
tatatatgtgtatatgtgtatatatatacaccacatatatgtgtatatatgtgtatatatatacacatatgtgtggtgtgtgtgtatatatgtatatgtgtatatatacatatatattcatatatatgtgtatacgcatatatgtatatatgtatatgtgtatatatacatatatgcgtatatatacacatatatacgcatatgtatgcatatatata

SEQ ID NO: 4118 - DNA, 110 bp, Homo sapiens
ctgaactttttaaatttttattgctgcatactatttttatatattcatgaagtacatgttatattttaatatatgcgtagtatgtgtagtgatcaaagctgggtatttag

SEQ ID NO: 4119 - DNA, 70 bp, Homo sapiens
atttctcacagttctagaggctggacatctgagatcagagtgtcctcacagtcagattctggtgaggggt

SEQ ID NO: 4120 - DNA, 83 bp, Homo sapiens
cctgtctatatctgtgtgctatacctgtgatccagatgttatgatgtaccgcatggatgcaaggatatacagtgtggtccagg

SEQ ID NO: 4121 - DNA, 116 bp, Homo sapiens
ctatctaatttatctttgtatccttcgtatgctgccagagacataatcaccattcaatgaatgaatgaatgaatgaatgggtggggacgtgggtagatggacagatggatggatgg

SEQ ID NO: 4122 - DNA, 67 bp, Homo sapiens
tatatatatatatatatatatgcacatgaatatgtatatatgtatatgtgcatgtagtatatatgta

SEQ ID NO: 4123 - DNA, 101 bp, Homo sapiens
acttgtaagtgttttcagtatcatcttgggatagctccttcataattatattttatatttttggagtacttaggaaaggtataagttggggaattccaggt

SEQ ID NO: 4124 - DNA, 85 bp, Homo sapiens
tcgtacatagaaaatgtatattttaggattatatatatatgatatatatatgatatataaatatatatatatttttttgagatgg

SEQ ID NO: 4125 - DNA, 68 bp, Homo sapiens
ctatgccatctggacgcatggtctccaacatcgccaaatcagagcgagcagactagcagatggtgtag

SEQ ID NO: 4126 - DNA, 117 bp, Homo sapiens
gatcattggctaaaaagaaaggttcccttatagaagttgctgggttgttttattatttatagaatagttaaggggtcaaagctatttccatatgaaatctaaataaagtgggtgttc

SEQ ID NO: 4127 - DNA, 77 bp, Homo sapiens
agacgaagtctcactctgtcactcaggctggggtgcaatggtgtcatagtgactcactgcagtctcaacctcctggg

SEQ ID NO: 4128 - DNA, 104 bp, Homo sapiens
attgatgacagatgctcagcaaaattgcagaatgggtttttttttttttttttttaaagacaggatctcattgtatcgcccaggctggagtgcagtgttacgat

SEQ ID NO: 4129 - DNA, 90 bp, Homo sapiens
gtaaggcagagaggccgtttctcactgtgtgtgtggctgcagcaatggggactgttgctgagagagattcaggagtacatttctgtctac

SEQ ID NO: 4130 - DNA, 81 bp, Homo sapiens
gttttggtttttgagactgagtctgactgtgtcacccacaatggagtgcaacggcagatcttggctcactgcaacctgtgc

SEQ ID NO: 4131 - DNA, 89 bp, Homo sapiens
atacactagattggcgtgtgtgcatgtatatatatatataaaatatgtattatataacatatgtgtatgtattgtatatgtgtgtgtat

SEQ ID NO: 4132 - DNA, 91 bp, Homo sapiens
gtatatgtatctacatggcatatgtatatagatatatatatacatctatatgtatatctatatacatatctatatagctgtatatatatgc

SEQ ID NO: 4133 - DNA, 85 bp, Homo sapiens
gggtggcggggagtgggatagaggcaagaggtaaacagttcattaaatttttttttttttgagacaggatctcactctgtcaccc

SEQ ID NO: 4134 - DNA, 56 bp, Homo sapiens
gagacagggtctcactctgtcacccaggctggagtgcaggggcatgatcatggctc

SEQ ID NO: 4135 - DNA, 116 bp, Homo sapiens
gtgtgtgtgtatatatacacatctatatgtagagatgtgtatatatatgtgtatatatatatcagcagtgtgtatatatatatatatatatatatatatacacatccatatgtaga

SEQ ID NO: 4136 - DNA, 106 bp, Homo sapiens
ttatggattgttgctagcttaaaaattgttttatagagttaaatgttatgtaaagaagaattaactaagctttgtggttgataacgttgtatagcattatccatag

SEQ ID NO: 4137 - DNA, 79 bp, Homo sapiens
tcaaagcctgaaactatatatatatgtgtatatgcatataatatatatgtatatatgcatatgtgtataccaactttga

SEQ ID NO: 4138 - DNA, 90 bp, Homo sapiens
agtcaatgtctttggttactcttttgttatatatatatatatatatatatatatatatatatagattaaagtacaagagaatgcttgatt

SEQ ID NO: 4139 - DNA, 94 bp, Homo sapiens
ccagcttagacaacatagcaagaccctgtctctacaaaaaaaaaaaaattttttttttttttgagacggagtcttgctctgtcacccacgctgg

SEQ ID NO: 4140 - DNA, 79 bp, Homo sapiens
tgtgtttttagtagttggtttgtctggagcatggaatgaaatactccagacgaaccagtttttttttaaatcaagtgca

SEQ ID NO: 4141 - DNA, 61 bp, Homo sapiens
tgttttgagacagtctcgctctgtcacccaggttggagtgcagtggtgcgatctcagctca

SEQ ID NO: 4142 - DNA, 88 bp, Homo sapiens
ctccaggtggggttcgatggcaagcataattccagaaaataactttttttttttgagacagggtcttgctctgttgcccaggctggag

SEQ ID NO: 4143 - DNA, 109 bp, Homo sapiens
gaaatctgttaatttatgcttggagtctagaagacaatttaaatatatatgtatatataattaataatgtattaatgattctaaaactttaaaagtagaaacagctttc

SEQ ID NO: 4144 - DNA, 87 bp, Homo sapiens
aggccaagaaaaagttgctgttgaagggcaactgtgttgtcatcagcaacacacaacacagtctgcccaaacacagacacagggtct

SEQ ID NO: 4145 - DNA, 116 bp, Homo sapiens
tgcaataaagccaaccgtgatctttaaaactaaatctattgtaattttgttcttgaaatgcccaagtggactcaaatatttttttctttggagaatcttggccttgttttgctgca

SEQ ID NO: 4146 - DNA, 64 bp, Homo sapiens
atatatatacatacacatatatgtatatgtatatatgtgtacatgcatgtgtgtgtgtatatat

SEQ ID NO: 4147 - DNA, 56 bp, Homo sapiens
acatgcatgtacacatatatacatatacatatatgtgtatgtatatatatgtatgt

SEQ ID NO: 4148 - DNA, 76 bp, Homo sapiens
aggctatgtgtcttgactttaggaaccagagtcctggttaccgtggaaccatctctgggtctgtaactcactgcct

SEQ ID NO: 4149 - DNA, 85 bp, Homo sapiens
gtagatcccatgtattccaacttaacacgtatggtttataagtataaatttttgcatattgagctggattaaaataggggcctat

SEQ ID NO: 4150 - DNA, 98 bp, Homo sapiens
ttgccacatggatttgaaaaaaggtattgcatataagtgtaagacattattcattctacagtgtttggtatgcaaatcaatttgcagatccttagcaa

SEQ ID NO: 4151 - DNA, 87 bp, Homo sapiens
tgacatgtttttatttttaatctgtttaaaagactttctaatttcctttttgattttttttgactcaggttatttagaagtgtgtta

SEQ ID NO: 4152 - DNA, 78 bp, Homo sapiens
gttcgagagtgcctgagtgcctctcagcctggctgggtgtgcctgcgccctaaggagggaggcaaaggtgttagagtc

SEQ ID NO: 4153 - DNA, 96 bp, Homo sapiens
tatttatttatttttgagacagagtctcactctgtcacctgggctgcagtgcagtggcatgatctgggcttgcattgtctgaaaagtggaaaaata

SEQ ID NO: 4154 - DNA, 95 bp, Homo sapiens; identical to SEQ ID NO: 68

SEQ ID NO: 4155 - DNA, 93 bp, Homo sapiens; identical to SEQ ID NO: 69

SEQ ID NO: 4156 - DNA, 95 bp, Homo sapiens; identical to SEQ ID NO: 68

SEQ ID NO: 4157 - DNA, 93 bp, Homo sapiens; identical to SEQ ID NO: 69

SEQ ID NO: 4158 - DNA, 117 bp, Homo sapiens
gagtttggataagtatatgtttaatgtggggcttcaattatatgtatatatatatgtagatatatatatatatatatacacacacacacacacatagacatacacatatattggttc

SEQ ID NO: 4159 - DNA, 104 bp, Homo sapiens
gcaagtagtctaaaatttagcaaccattttttttttcttttttaagacagagtctcgctctgtcgcccaggctagagtacagtggtgcaatcttggctcactgc

SEQ ID NO: 4160 - DNA, 101 bp, Homo sapiens
ttttcctgaatattgaaaaatcctctcagtttagtgagaattataaatcagtgtgaatttttattttattttgagagaatttgttcaattattttttaaaa

SEQ ID NO: 4161 - DNA, 71 bp, Homo sapiens
tgatggaaagaacaatagatgaaaattgagtagacttaagtaactcaatctctgtctccatttttccatca

SEQ ID NO: 4162 - DNA, 103 bp, Homo sapiens
tatggatttctttggaagttgattgtgaagaaaatgactaagaaaacttttttttttcttttaggttgatggaaatcacaatcttctgacaaagctttctctg

SEQ ID NO: 4163 - DNA, 82 bp, Homo sapiens
ttcattcaaataggcatgtgtgtgtgtatatatgtatatatgtgtatatacatatatatacacacccacatatttgaatgaa

SEQ ID NO: 4164 - DNA, 82 bp, Homo sapiens
ttcattcaaatatgtgggtgtgtatatatatgtatatacacatatatacatatatacacacacacatgcctatttgaatgaa

SEQ ID NO: 4165 - DNA, 115 bp, Homo sapiens
tcacccactgactcccctcggacctcagttagaacctgacaattctttatttattttttaatttattattgagataaggtctggttctgttgcccaggctggagtacaggggtga

SEQ ID NO: 4166 - DNA, 68 bp, Homo sapiens
gaagctgctgcaggtaatcttttggcgagtgtgtccctgtcactgccactgtttatctgtatgagttc

SEQ ID NO: 4167 - DNA, 84 bp, Homo sapiens
agtgatggagtgagaaaatgatgatatttcagctaggtcttaaagaattggtagaattttaatattttattttactctgttatt

SEQ ID NO: 4168 - DNA, 105 bp, Homo sapiens
taaatcatgagtcaattacatgctaagagagtaatagtcattttctttatgagaaaatttggattcttactgaggtagatgtgtggtcgatgatttcatttttta

SEQ ID NO: 4169 - DNA, 94 bp, Homo sapiens
cctgtaatcactgtgctctgcctcccttaagcacacagattctctctctgtgccatgaagctgctgccagggaattggggacgggaggtgcagg

SEQ ID NO: 4170 - DNA, 94 bp, Homo sapiens; identical to SEQ ID NO: 4169

SEQ ID NO: 4171 - DNA, 95 bp, Homo sapiens; identical to SEQ ID NO: 68

SEQ ID NO: 4172 - DNA, 93 bp, Homo sapiens; identical to SEQ ID NO: 69

SEQ ID NO: 4173 - DNA, 111 bp, Homo sapiens
gccaggcatggtggtgcacgcctgtagtccaagctacttgggaggctgaggtggaaggatcacttgagcctgggaggtggaggctgcagtgagctatgattgtgccactgc

SEQ ID NO: 4174 - DNA, 108 bp, Homo sapiens
ttttgagcttgcctgggatattgcaacttctgaactgtttttgaagttttcataaaggctttggacagtatgttgttgttaaatcaatgtctccatggaggaataaag

SEQ ID NO: 4175 - DNA, 103 bp, Homo sapiens
aggcaagacaatggtatgttccagagtttcgttgtgagaaatcactgttatcatacttagcagcgtggcaacaaaatgggcatattcagttgcttccaggcct

SEQ ID NO: 4176 - DNA, 107 bp, Homo sapiens
tcacatactggatcatacatttttcttggcttaacaaatctaatgattttatttgtaatcagtttagaattaggctgggttcctgaaacttcaaatccattagttgg

SEQ ID NO: 4177 - DNA, 100 bp, Homo sapiens
tgttcagaggactgcaaatcaaggtaaggtgattgtagtggagatctcttttttccagccttaatttctttattttataattaaagtaaatatttgaata

SEQ ID NO: 4178 - DNA, 110 bp, Homo sapiens
tcctgagtagctggcactacaggcgtgcaccaccatgcccagctaaatttttttttttttgtatttttagtagaggcagggtttcaccatgttggccaggatggtctcga

SEQ ID NO: 4179 - DNA, 95 bp, Homo sapiens
tattcaaacaaatgggaagagtttgacttattttgactttttttttaaacaactttttaaaacaaagttaaaattagatgcctcatttgtgaatg

SEQ ID NO: 4180 - DNA, 58 bp, Homo sapiens; identical to SEQ ID NO: 3939

SEQ ID NO: 4181 - DNA, 65 bp, Homo sapiens
tatacatagagctgtatatataatacatatttgtaagtgtgtatatatatatgtgtgtatgtatg

SEQ ID NO: 4182 - DNA, 74 bp, Homo sapiens
gctaggatgatgtgacgatcttgtatggagtctctgtcttcagaactatcatcagtgaatgttaatgacttagc

SEQ ID NO: 4183 - DNA, 74 bp, Homo sapiens
ggaagaagaaaacctgagtactgctgggaatgccacgtccgggtctctctctgtgtgcctcagtttcttcatct

SEQ ID NO: 4184 - DNA, 58 bp, Homo sapiens; identical to SEQ ID NO: 1847

SEQ ID NO: 4185 - DNA, 112 bp, Homo sapiens
tcctgacctgccttaattcgacctcatttattcatttcattgtaactaactaaaatatatatttttaacatttgcaggggattagatgaaagtgcatagaaatggcagtgga

SEQ ID NO: 4186 - DNA, 127 bp, Homo sapiens
atatataagttatttgccagatattttacatacatttccaaatacatgtacatatataaaaatacatgtgtatatatatgacatgtatatgtgtagatatgtagatatgtgtatatatatgacgtgt

SEQ ID NO: 4187 - DNA, 64 bp, Homo sapiens
acacacacacatataaatataaatatagatgtatactgcatacatgtgagtatgtgtgtgtgtg

SEQ ID NO: 4188 - DNA, 102 bp, Homo sapiens
tagaataatttatttgtttaatgtgttatacaatgtatttatgtatgcatatatgcatgtatgtatgtgcagatgttgagaaggcaaaatagagttattttg

SEQ ID NO: 4189 - DNA, 95 bp, Homo sapiens
tatttattactttcagtttaaaactttcaaatcaggatatattttaaataatttatagatttgaattagttttggccaaaatgaaagtgtaaata

SEQ ID NO: 4190 - DNA, 116 bp, Homo sapiens
tgatcctctatctatcactgtctctcttctgccttccttcacttttttattatcaataaaatataaatcaagatactaagaaggaactctaggagaagatgcaggtggaagggaca

SEQ ID NO: 4191 - DNA, 57 bp, Homo sapiens
caccttccacttcactctgtgtgtatgtctgttgctggcgggggggcggggggggtg

SEQ ID NO: 4192 - DNA, 120 bp, Homo sapiens
tgtgcagggctcttcctggagagtagaggatggtttgttttcatgatttcagaaacaggtactcagtctctctgtttgaatctcacacccagttctctgcccccaggatttccattcata

SEQ ID NO: 4193 - DNA, 58 bp, Homo sapiens; identical to SEQ ID NO: 1305

SEQ ID NO: 4194 - DNA, 95 bp, Homo sapiens
tctggggatctttaatgccttcattttgctgctggccagggcatctggttctgggggtacaggatcaaggtagcatagcaaaaaatccctcaaga

SEQ ID NO: 4195 - DNA, 56 bp, Homo sapiens
gagaaagagtctcgctctgtcacccaggctggagtgcagtggcgcgatctcggctc

SEQ ID NO: 4196 - DNA, 82 bp, Homo sapiens
gaccaggtcccatggcctctgctgtgcctcgtcccagcatctgcggtgacacaggagagagtgttgacaaggatgtgctgtc

SEQ ID NO: 4197 - DNA, 81 bp, Homo sapiens
gcttttttttgagacagagtctcactctgtcacccaggctggagtgcaatggagtgcaatggtgcgatctctgctcgctgc

SEQ ID NO: 4198 - DNA, 113 bp, Homo sapiens
aagaagagcagaattgcaggatggtttttgattcaggtggccctgggatgtcagtagtttcagagcagaggttcctgagtcttcaggatgttctcttcatttctgtgtatctt

SEQ ID NO: 4199 - DNA, 110 bp, Homo sapiens
tccatatcatattggttctgtattgattctatatatctatatttttatctagctagctagctacagagagaaaaggatattttaaggaattggctcactcaatgataggg

SEQ ID NO: 4200 - DNA, 111 bp, Homo sapiens
tctggttattaatctcttgtcagatgggtagtttgtgaatattttctccatcctgtgggaagtcttgtaattttgttgtttccttagctgtgcagaagctttttaacctga

SEQ ID NO: 4201 - DNA, 101 bp, Homo sapiens
tgtgattcacccaccttggtaaaatgctaggattcttttttttttttttttttttttgagatggagtcttgctctgttgcctaggctggagtgcaatggca

SEQ ID NO: 4202 - DNA, 56 bp, Homo sapiens
tgagacagtctcgctctgtcacccaggctggagtgcagtggtgcgaactcggctca

SEQ ID NO: 4203 - DNA, 56 bp, Homo sapiens
agagtctcactcactctgttgcccaggctggagtgcagtggaatgatctcggctct

SEQ ID NO: 4204 - DNA, 90 bp, Homo sapiens
atgctggtaatgtttctccattaatcatagtactttctttgggcagaggagagtggttttctaatgtaaagaagtactcatttgtagcgt

SEQ ID NO: 4205 - DNA, 81 bp, Homo sapiens
gcttcatcttgaatttatgtatatctgtaataatgatgattatttcattaatttacagaaagacagcacactggatgctgc

SEQ ID NO: 4206 - DNA, 74 bp, Homo sapiens
gggtacatgtgaagatttgttacataggtagactcatgtcacaggggtttgttgtacagatcatttcatcaccc

SEQ ID NO: 4207 - DNA, 73 bp, Homo sapiens
gaggcagagtctcgctctgtcacccaggctggagtgcagtggcacaatcttggctgactgcaacctctgcctc

SEQ ID NO: 4208 - DNA, 97 bp, Homo sapiens
ggatgaccttctcctttgcagcccttctctaaaagactctcaaactcacacagtcactcttttaaactttctcgctgccaaagggcatagagtttcc

SEQ ID NO: 4209 - DNA, 92 bp, Homo sapiens
aagataactgcatgaggtgcagatatattagcttgattataataatcatttcacaatgtatacatgtatcaaaatatcatgctgttcctctt

SEQ ID NO: 4210 - DNA, 58 bp, Homo sapiens; identical to SEQ ID NO: 605

SEQ ID NO: 4211 - DNA, 101 bp, Homo sapiens
agcatgtttgcatggtgggtggtgtgagagcctgtcctcaggacacagaacagtgtctgggtagaccagctccaggaccattggaggcacatgcagatgct

SEQ ID NO: 4212 - DNA, 58 bp, Homo sapiens
tgagacagagtctcactctgtcacccaggctggagtgcagtggtgcaatctcgtctca

SEQ ID NO: 4213 - DNA, 95 bp, Homo sapiens; identical to SEQ ID NO: 68

SEQ ID NO: 4214 - DNA, 93 bp, Homo sapiens; identical to SEQ ID NO: 69

SEQ ID NO: 4215 - DNA, 75 bp, Homo sapiens
agggacaattgtgcatctctctgtgagtgacactcagtttaaagaactaagtgttcagtggatgcagatgtcctt

SEQ ID NO: 4216 - DNA, 106 bp, Homo sapiens
gccagagggaaggaacaagagtaaatattcaggtgtatgtgtatgtagaggggaatgaaatgtgcatgtatatataatcatatttttttgctctgcttctgtaggc

SEQ ID NO: 4217 - DNA, 100 bp, Homo sapiens
ttggaggtgagcacatttggagggatttctgcaggttctcatgataaattgtttatgtagttctcacacagatttatataattgtgccaggtacttttgg

SEQ ID NO: 4218 - DNA, 114 bp, Homo sapiens
acagcggggccgcagagacctcgcacagccgaatagcagtggagcaggtgtgtgtgtgtgcatgtgcatgtgtgcacgctgtgagggtgtggtgtgtgtaacatgctcccatgt

SEQ ID NO: 4219 - DNA, 96 bp, Homo sapiens
cttgtcttcctgctccggtactctgtcagtgtggttaggatagggatttatctctcttgttctctactgattttctagtgccttgcacgtggcagg

SEQ ID NO: 4220 - DNA, 82 bp, Homo sapiens
gcacatgcaacaggattttctgggaaggaggtctctggcactcacattcacttcctggtctctgcaaaacctgaaccatggc

SEQ ID NO: 4221 - DNA, 109 bp, Homo sapiens
ggcttggcagattgagagataagtgaattttgaaagtcagtgtactgaggacattggttatttgtcttttacaccatgattattacaactggtctttctgctgccagtc

SEQ ID NO: 4222 - DNA, 63 bp, Homo sapiens
gtctctgtcactgggtggctgttttcttctggcggcctctatcttcccagtgaattaggaggc

SEQ ID NO: 4223 - DNA, 70 bp, Homo sapiens
gcctttaggtggcagactcttttctttttttttttcttcttgagacagagtctcactctgtcgcccaggc

SEQ ID NO: 4224 - DNA, 58 bp, Homo sapiens
tgagacagagtctcgctctgtcacccaggctggagtgcagtggtgagatctcagctca

SEQ ID NO: 4225 - DNA, 71 bp, Homo sapiens
ggtcttccctctgtgtgtgtctgcgtcctaatctcttttgataaggacacaagacattttggattagggcc

SEQ ID NO: 4226 - DNA, 111 bp, Homo sapiens
tctacagagaatcaagttcttctgctggaatactcaaggcatgttgagtaggttcccctgcctgactgtgtctctcccagtagttaagataatgagccacttgaaggtgga

SEQ ID NO: 4227 - DNA, 111 bp, Homo sapiens
cctactactctgcagtgaattgagtgctttttttctccctttttcatgtgtttgcttttttttttttttaagacagggtctcactccgtcacccaggctagagtgcaacgg

SEQ ID NO: 4228 - DNA, 72 bp, Homo sapiens
tatatatatatatgtatatatatatgaacatatatacatatatgttcatatatgtgtgtgtatatatatatg

SEQ ID NO: 4229 - DNA, 76 bp, Homo sapiens
cagtggtcattgtggatcttgggcaagactcagtgctgtgccagctttgggtctgaccctcgcacagtcccagtgg

SEQ ID NO: 4230 - DNA, 142 bp, Homo sapiens
tatatacaatatgtatgaccactacgtgtgtgtatatatatgtatgtgtatatatatatgtatgtgtgtatatatatgtatgtatgtgtgtgtatatatatatttatatatatatatgcaaacacacatatacacacataca

SEQ ID NO: 4231 - DNA, 79 bp, Homo sapiens
atgaatgtatgaatgtatgcgtgtgtgtgtatatatatatatgcaccacacacatgcagacatagagttaggcattcat

SEQ ID NO: 4232 - DNA, 82 bp, Homo sapiens
attatctcaggtttttttggccagactgtccctgtcacagctacctaatttggccattgtagtcagagagcactcagataat

SEQ ID NO: 4233 - DNA, 64 bp, Homo sapiens
tatacacgtatacatatatgtatgtatatatacatatacacacatgcatgtacatatgtgtata

SEQ ID NO: 4234 - DNA, 104 bp, Homo sapiens
tgattttcatatgttgattttgtatcctataactttactgaatttgtttatcagttataatggttttttggtagagtctttaggtttttccaaatgtaagatca

SEQ ID NO: 4235 - DNA, 112 bp, Homo sapiens
ggattgacttggcaatgcgggctcttttttggttccatatgaaatttaaagtagttttttccaattctgtgaagaaagtcattggtagcttgatggggatggcattgaatct

SEQ ID NO: 4236 - DNA, 95 bp, Homo sapiens
caatgcgggctcttttttggttccatatgaaatttaaagtagttttttccaattctgtgaagaaagtcattggtagcttgatggggatggcattg

SEQ ID NO: 4237 - DNA, 76 bp, Homo sapiens
gttgtgtttgattctgtttcctcacaggtccttgtttacaatctaatttagagttgtgtgcagagtgaaataaaac

SEQ ID NO: 4238 - DNA, 60 bp, Homo sapiens
ccatgtcacaaattgggtttctcatgaaacagtctctgagactctgagatttgtgtgtgg

SEQ ID NO: 4239 - DNA, 58 bp, Homo sapiens; identical to SEQ ID NO: 285

SEQ ID NO: 4240 - DNA, 82 bp, Homo sapiens
tgagatggagtctcgctctgtctcccaggctggagtgcagaggtgcgatctcggctcactgcaaactctgcctcctgagttt

SEQ ID NO: 4241 - DNA, 102 bp, Homo sapiens
attttgtgtgaggtagggagccatcagtggattctgagatgatatgatttattttacattatatagagtcctctgctgctctgtggattggctatatgaagt

SEQ ID NO: 4242 - DNA, 89 bp, Homo sapiens
ctaactttcctcctggtcagccctctcctagagggtggctatcttggcttattgctgctctcaagagagagagctcaggatcagattag

SEQ ID NO: 4243 - DNA, 106 bp, Homo sapiens
aagtagaagttttcctgaagcacataagactgtttttgttttgtttttttagaaaatgactatagcttttactagcttactggaaatgacaaatatgcatttactt

SEQ ID NO: 4244 - DNA, 69 bp, Homo sapiens
agagagtggatcatggagacttctcagcctccataatcacatgagctgactcccacaatctctctctct

SEQ ID NO: 4245 - DNA, 106 bp, Homo sapiens
gtgataaggattaaggtgagagatgtaggaacatccacagaacctcttacagtagaatgtgaggagtgtagcgggcttgggagatttctgtcctcatcctcatcat

SEQ ID NO: 4246 - DNA, 73 bp, Homo sapiens
aaaaatcataggaatcttgtgggaaggctagtaatcactagagcccctttccactctaattcttttttttttt

SEQ ID NO: 4247 - DNA, 94 bp, Homo sapiens
atatatgtaaatatatgtacacatacttatgtatattatatttatatataaatatacatacataaatatttgtatatacataatttatatgtat

SEQ ID NO: 4248 - DNA, 92 bp, Homo sapiens
catataaattatgtatatacaaatatttatgtatgtatatttatatataaatataatatacataagtatgtgtacatatatttacatatatg

SEQ ID NO: 4249 - DNA, 250 bp, Homo sapiens
atatatatatatgcatatatatatatgcatatatatatatgcatatatatacgcatatatatatgcatatatatatgcatatatatatgtgtgtatatatatgcatatatatgtgtgtatatatatgcgtatatatgtgtgtatatatatgtgtatatatgtgtgtatatatgtgtatatatatgtatatatatgtgtatatgtgtgtatctatatatgtatatatatgtgtgtatatatgtgtgtgtgt

SEQ ID NO: 4250 - DNA, 110 bp, Homo sapiens
ttcttttttgataagtgtgaattagaatcatatgctaattttacagaggagattaagttatttatttaattttaatgtcctttcagcactctggttcaattgttggtgaa

SEQ ID NO: 4251 - DNA, 121 bp, Homo sapiens
tatatatatatatatacacacacacacacacacatatatatgtgtatatatgtatatatacacatatatgtgtgtgtatatatacacatatgtgtgtgtatatatacacatatatgtgtgt

SEQ ID NO: 4252 - DNA, 87 bp, Homo sapiens
tttgagactgagtctcgcactgtcaccctggctggaatgcaatggcgcgatcttggctcactgtgacttctgcctcttgggttcaag

SEQ ID NO: 4253 - DNA, 200 bp, Homo sapiens
gtagacgtatatacatatgtatattcgtacatatatgtctctgtagacgtatatacatatgtatatatgtatatatgtctatgtatatatgtatatatgtgtatatatgtatatgtgtatgtacatatacacatacatacgtatatatgtatatatacatatacacatacatacgtatatatgtatacatatatgtatac

SEQ ID NO: 4254 - DNA, 85 bp, Homo sapiens
ggtctgagtcattagaggttcgctcagatttgttttcttttctttttttttttttagatggagttttgctcttgttgctcaggct

SEQ ID NO: 4255 - DNA, 144 bp, Homo sapiens
tggaccggccagctgtgagtgtttctttggcagtgtcttagctggttgttgtgagcaatagtaaggaagcaatcagcaagtatactgccctagaagtgctgcacgttgtggggcccaagagggaagatgaagcgagagatgccc

SEQ ID NO: 4256 - DNA, 115 bp, Homo sapiens
tgtggttttgatttgcatttctctaatgaccagtgatgatgagaattttttttctttttttttgagatggagtctcgctctgtcacccaggttggagtgcagtggcacgatctcg

SEQ ID NO: 4257 - DNA, 104 bp, Homo sapiens
gttaatcaccccctcgtagagttgttgctcaagtcaagtaattaataaatgtgtattgtttagaagagtgcttggcatgtggtgagctctatgtcactgttagc

SEQ ID NO: 4258 - DNA, 93 bp, Homo sapiens
ggcctcccaaagtgctgggattacaggagtgagtcaccacacctggcctgccaggtggtgtttactctcctccctggcactcccttgaggacc

SEQ ID NO: 4259 - DNA, 94 bp, Homo sapiens
cactgtgcccggccttataatgtgatttttaaaaggagttataatcaaattttgatcttcactttaaaattaaggtatgtgtccaggcacagtg

SEQ ID NO: 4260 - DNA, 58 bp, Homo sapiens
tgaggcggagtctcagtctgtcactcaggctggagtgcagtggtgtgatctcagctca

SEQ ID NO: 4261 - DNA, 109 bp, Homo sapiens
ctgagcatgtttaaagtaggctggactaagctgtgttgttcggtactttaggtgtattaaacacattttcaacttagtgatattttcagtttacagtgggtttgtcaag

SEQ ID NO: 4262 - DNA, 86 bp, Homo sapiens
tactttcatctcttgtcacactcacacacttagactcacttacctgtaggggttagagttgggggtgattagctcgatgatgtgta

SEQ ID NO: 4263 - DNA, 119 bp, Homo sapiens
tactgtaatgagcaagggaaagatttttaattattgctgaaaatttttgtcaatttatgtatatcacaaatttaaaaatgcatgatttctgagaatttttctgctctaatgtatatgtg

SEQ ID NO: 4264 - DNA, 114 bp, Homo sapiens
gtgctgggattacaggcatgagccaccgtgcccagcccaatacaactttttaaaactccaatagaaatctgtgatgaagccaggcacagtggctcatgcctgtaatcccagcat

SEQ ID NO: 4265 - DNA, 112 bp, Homo sapiens
tagctgggcatggtggcacacatttgtggtcccagctacttgagaggctgaggtaggaggatgacttgagcccaggcggttgaggctgcagtgagccatatttgcgccactg

SEQ ID NO: 4266 - DNA, 116 bp, Homo sapiens
gtgactggtaaacagatgtttcaaaacctaatttaagtgagaaaacaataattaaaacttttttgttatctaataataagctaagtctttggctttggaaaggggatggtggtcat

SEQ ID NO: 4267 - DNA, 113 bp, Homo sapiens
gctggatgtggtggtgtgcacctaatagtcctggctactcagaaggctgaggtaggaggatcacttgagcccagaggcagagtagttagctgagatcatgccacagcaccagc

SEQ ID NO: 4268 - DNA, 61 bp, Homo sapiens
tgagatgagtctcactcattcagtcacccaggctggagtcaagtggcgggatctcagctca

SEQ ID NO: 4269 - DNA, 58 bp, Homo sapiens
tgagacagagtctcactctgtcacccaggctggagtgcagtggtgcaatctctgctca

SEQ ID NO: 4270 - DNA, 79 bp, Homo sapiens
accccttcacttgtctcagtagagagtgaagagctggaaaagccccaaatcccgccttctacttggggcaggaaggagt

SEQ ID NO: 4271 - DNA, 112 bp, Homo sapiens
cagtaacccaaaatagcaagaaaagaaatggattattactcaattatgaatcactttgttgtctttgtatttgaatgtgattctcttcttaatcttcctgttcatatttctg

SEQ ID NO: 4272 - DNA, 108 bp, Homo sapiens
ctgggaaatgtaattttcctttctgttaaggaagaaaaaatggtgagcctctagtgagtcttttttttttttttttttaaagagacaggatcttgttttgtcacccag

SEQ ID NO: 4273 - DNA, 84 bp, Homo sapiens
gcggatctttgggagaatgggttcaagattttttttttttttttttttttttgagatggagtctagctctgtcgcccaggctgc

SEQ ID NO: 4274 - DNA, 83 bp, Homo sapiens
gtgacagaccacagagatgatatgcccttttcaggacatcttttttcttttaaaaaaatggtttatcactttctgggcgttgc

SEQ ID NO: 4275 - DNA, 73 bp, Homo sapiens
ccaagcactgatgacaaagtagaacaatgagactttttttttagacagggtctcactctgtcactcaggctgg

SEQ ID NO: 4276 - DNA, 218 bp, Homo sapiens
atatatatacacgtgtgtatatatacatgtatatatacgcgtgtatatatatgtgtatatatatacgcgtgtatatatatatgtatatatatacgcgtgtatatatatataagtgtgtatatatacgtgtatatatatgtgtgtgtgtgtatatatatatatacacctatatatatatatatatatatatacacacgtatatatagtgtgtgtgtgtg

SEQ ID NO: 4277 - DNA, 189 bp, Homo sapiens
tatatatacacatatatatacacgcgtatatatacatgtatatatacacacgtgtatatatatgtgtatatatacatatatattcgtatatacgtgtatatatacatatatattcgtatatacgtgtatatatatatatatatacgaatatatattcgtatatatacgtgtatatatatatatatatat

SEQ ID NO: 4278 - DNA, 91 bp, Homo sapiens
gtagccttttttttttttttttttttttttgagaccgagtctcgctctgtcacccaggctggagtgcagtggcatgatctcggctcactac

SEQ ID NO: 4279 - DNA, 58 bp, Homo sapiens
tgagaccgagtctcgctctgtcacccaggctggagtgcagtggcatgatctcggctca

SEQ ID NO: 4280 - DNA, 83 bp, Homo sapiens
ggaaggagtctcactctgtctcccaggctggagtctcagttcactgcaacctccgcctcctaggttcaagtgattctcctacc

SEQ ID NO: 4281 - DNA, 58 bp, Homo sapiens
tgagacaaggtctcactctgtcacccaggctggagtgcagtggtgcgatcttggctca

SEQ ID NO: 4282 - DNA, 116 bp, Homo sapiens
tatatatacacacacacacatatatatacatatatatgtatatatacatatatattaaatataaaaaatatatgtgtatatacatatgtgtatatatacatatacatgtatatata

SEQ ID NO: 4283 - DNA, 110 bp, Homo sapiens
agcatgtgctcactttgtgtctctgtcacattttggtaattcaggcaatatttcaagctttttcattattattatatctgttacggtgaccagtgatcttttacagtgct

SEQ ID NO: 4284 - DNA, 116 bp, Homo sapiens
gccaggtttggtagtgtgcacctctagtcccagctaccctggaggctgaggtggaaggatggcttgagcccaggaggcagaggtagaaatgagctgagattgcaacactgcactgc

SEQ ID NO: 4285 - DNA, 94 bp, Homo sapiens
agatcaagtggttaagatgctgtctgaagaggccatgacttgagatcccggtcctgccctgcctcactcactggctgagcaatccacttgagct

SEQ ID NO: 4286 - DNA, 80 bp, Homo sapiens
gcaagaaatattctggaaatactaaattttataatttaatgttaataggcttttagtgttgagagtaatgtatttcttgc

SEQ ID NO: 4287 - DNA, 58 bp, Homo sapiens
tgaaatgaggtctcactctgtcacccaggctggagtgcagtggtgtgatctcggctca

SEQ ID NO: 4288 - DNA, 91 bp, Homo sapiens
ccagccagggcaatacagtgaaaccttgtctctaaaaaaataataattttttttttttttagatggagtctctctctgtcacccaggctgg

SEQ ID NO: 4289 - DNA, 117 bp, Homo sapiens
gaaattaatcatctcctttgatttatgttatgagtaggatgtcatgatgagccagtcagattctagatatttatttatagttctacttaagtgaattttattttggattaggttttc

SEQ ID NO: 4290 - DNA, 62 bp, Homo sapiens
tgagacagggtctcactcactctgttgcccaggctggagtgcagtggcaccattatggctca

SEQ ID NO: 4291 - DNA, 97 bp, Homo sapiens
atatatatatataaatggctgggttttggggagaataatatatttaataatttaatatatatatttgggttttatgtgagtctgtgtgtgtgtatat

SEQ ID NO: 4292 - DNA, 58 bp, Homo sapiens; identical to SEQ ID NO: 637

SEQ ID NO: 4293 - DNA, 99 bp, Homo sapiens
agataatacagagtagatgacaaattccataagtgggacaagttttttttgttttttgcaaagcagttttggaaattgtattctaattttggtttctct

SEQ ID NO: 4294 - DNA, 90 bp, Homo sapiens
gcatgagccactgtacctggactggggtctatttttttttttttttaaacgaagtctcgctctgttgtccaggctgcagtacaatggtgt

SEQ ID NO: 4295 - DNA, 83 bp, Homo sapiens
ccctgagtcccggtgtcttcatctgtaaagtggagataagcacagactctctgtctcagggtgaggactgcagggatgagggg

SEQ ID NO: 4296 - DNA, 90 bp, Homo sapiens
atggatagataggatctggatagggttggtgttcaaaagaagatttttttttttttgatgatagaattcaataggagactatcttgccat

SEQ ID NO: 4297 - DNA, 112 bp, Homo sapiens
gctttgtcttgggcctccgagaggatgtattttcaatgaatgttcaattataataaaggttattattattattttttgaaatggagtctcactctgtcacccaaggcagagt

SEQ ID NO: 4298 - DNA, 71 bp, Homo sapiens
cccaaactctcccactcactctgaggaacaagggttcacactgggagatgaagtgggcagtggagtcaggg

SEQ ID NO: 4299 - DNA, 58 bp, Homo sapiens
tgagactgagtctcactctatcacccagactggagtgcagtggtgcgatctcagctca

SEQ ID NO: 4300 - DNA, 95 bp, Homo sapiens; identical to SEQ ID NO: 68

SEQ ID NO: 4301 - DNA, 93 bp, Homo sapiens; identical to SEQ ID NO: 69

SEQ ID NO: 4302 - DNA, 98 bp, Homo sapiens
gctcccagtgatggcctgacccagtatgtgcctgacagcctgacagccatgccagctgcagcagttgtcatttgggtcatcagacctggctgtggggt

SEQ ID NO: 4303 - DNA, 79 bp, Homo sapiens
ttatgtcaatcgcaattccttttcttttatttaagacagagtctcactctgtcttccaggttggagtgcagtggcgtga

SEQ ID NO: 4304 - DNA, 108 bp, Homo sapiens
tgatttttgtctgttgattttgtatcttttctataactttactgaatttgtttatgagatctaagagttttttggtggagtccttagggttttttagacataagatta

SEQ ID NO: 4305 - DNA, 72 bp, Homo sapiens
gttgttttgagatggagtctcactctgtctctcaggctggagtgcagtggtgtgatctcggctcactgcaac

SEQ ID NO: 4306 - DNA, 75 bp, Homo sapiens
tgtacatatgtatagatagagaatagatatatatacagtcatatctatatttatttctctatatattaatgtata

SEQ ID NO: 4307 - DNA, 90 bp, Homo sapiens
gcaggaagaactctaggcctgaaggtgaaattggggagggagtcccagctctgccactgtctctctgggtgacctcaggcaggtctcctc

SEQ ID NO: 4308 - DNA, 92 bp, Homo sapiens
ccctcttcactccttcctctccattttttcttttccttacttcttctcagaagtgtgagtgaagtctgagccccaggtccccgtgaagctgg

SEQ ID NO: 4309 - DNA, 98 bp, Homo sapiens
taattatgaccttgttattgtctttatttgaatattatgtatgatctcaggagatgtgtatgggttcaagttgacaagcagtagacttgtgatggtta

SEQ ID NO: 4310 - DNA, 71 bp, Homo sapiens
ttgtttttgagatggagtctcactctgtcacccaggctggagtgcagtggtgggatgacagctcactgcag

SEQ ID NO: 4311 - DNA, 58 bp, Homo sapiens; identical to SEQ ID NO: 1435

SEQ ID NO: 4312 - DNA, 132 bp, Homo sapiens
tatgtatatatttatacacatttctgtatgactacatatagaaatatttgtgtatatacttaaatatatatacatacatatgtacatatatacatacaaatgtatgtgcacatatgtatatatgtatatata

SEQ ID NO: 4313 - DNA, 58 bp, Homo sapiens
tgagacggagtctcgctctgtctcccaggctggagtgcagtggcgtgatctcccctca

SEQ ID NO: 4314 - DNA, 59 bp, Homo sapiens
tgagacagagtctcgctctgtctcccaggctggagtgcagtggcgcgattctcggctca

SEQ ID NO: 4315 - DNA, 101 bp, Homo sapiens
tccctttcacctgtcccctagatgctttgattatttttcaaataattctgaaaatttgccaaataatttactggtaatagtggtaggcgtggagcatggga

SEQ ID NO: 4316 - DNA, 95 bp, Homo sapiens; identical to SEQ ID NO: 68

SEQ ID NO: 4317 - DNA, 93 bp, Homo sapiens; identical to SEQ ID NO: 69

SEQ ID NO: 4318 - DNA, 92 bp, Homo sapiens
tggttagaggtggcgagagacaaatgcagggatgctcccagattctagcttgccctggctctccctgactctgtgactctatttctaactca

SEQ ID NO: 4319 - DNA, 58 bp, Homo sapiens; identical to SEQ ID NO: 315

SEQ ID NO: 4320 - DNA, 116 bp, Homo sapiens
agaaagaaaattgtagtatctactgttttgtgcctggtttatttctctcacattcactctgtgagtgagattcatcacggtgtttcacagagttggaattaagattcattcgttct

SEQ ID NO: 4321 - DNA, 109 bp, Homo sapiens
gaggtctggcttggtgatatggatttaggggactctggcatagtagctgtagatggtgtcacagaagtatgtgaggtctcccaaagggaggatgcagaagcctgatgtc

SEQ ID NO: 4322 - DNA, 136 bp, Homo sapiens
gggaaggacaacaggcagaggaaagctgatcagcctaatggtaagattggccctgctctgtctcccagtggctctctgtttatcttggactcgcttagcaacgtccaacaggctggacggagccattccctggagg

SEQ ID NO: 4323 - DNA, 179 bp, Homo sapiens
atgtacatatatatatatatatgtgtgtgtgtgtgtgtgtgcatatgtgtgtgtgtgtgtgcatatgtatgtgtgtgtatatatatgtgcgtgtgtgtatatatatagtcatatatatgtatatatgtatgtgtgtgtatatatatgtgcgtgtgtgtgtatatatatatataatgaca

SEQ ID NO: 4324 - DNA, 116 bp, Homo sapiens
gcccacaccaacagttatttgatgtggctgcattcctagtcttaatttttaattgatcatatggggctttgagttttgcatgcttgtacatacgaatttcttctgtgcacgtggtc

SEQ ID NO: 4325 - DNA, 72 bp, Homo sapiens
ccaggcatggtgatgcacacctatagttccagctacttgggaggctgaggtggtaggatcacttgagcctgg

SEQ ID NO: 4326 - DNA, 88 bp, Homo sapiens
agctcacagttgcagataacaaattttccaatattctgattttcatttgaaagttcagattttgttgttggtatcaaaactgtcagtt

SEQ ID NO: 4327 - DNA, 58 bp, Homo sapiens; identical to SEQ ID NO: 2442

SEQ ID NO: 4328 - DNA, 115 bp, Homo sapiens
cttggacttctcataaaatgactttcgttggatttagtgtacaatttttaagttaattactgattttgtatatatgtggtattgtatctttgaaagctcatatgagtttattagg

SEQ ID NO: 4329 - DNA, 95 bp, Homo sapiens; identical to SEQ ID NO: 68

SEQ ID NO: 4330 - DNA, 93 bp, Homo sapiens; identical to SEQ ID NO: 69

SEQ ID NO: 4331 - DNA, 71 bp, Homo sapiens
tcttttttgagacagattctcactctgtcacccaagctggagtgcagtggtacgatctctgctcactgaga

SEQ ID NO: 4332 - DNA, 119 bp, Homo sapiens
cagctgttgactgggagcaggtggtaggaagtgaggcctccatgtgaatgtggtgatagattacagagagcagacactggacctattgctcaattttgcaccttgccagcagagatctg

SEQ ID NO: 4333 - DNA, 94 bp, Homo sapiens
ttcttagtcatgcccactttatagatttttatatatgccccaacttaataggtacattttgaacaccaactatggataaagcatgtgctaagaa

SEQ ID NO: 4334 - DNA, 94 bp, Homo sapiens
aggagtgggctcccaaggccttgggcatctctgcctctgtggctctgcagagtacaccttctgtggctgctttcatgggctggtattgagtgcc

SEQ ID NO: 4335 - DNA, 63 bp, Homo sapiens
tgagacagagtctcactctgtcacccaggctggactggagtgcagtggtgcaatctcggctca

SEQ ID NO: 4336 - DNA, 115 bp, Homo sapiens
tttggagccagtttccaagtttaaatcaatatttaacggtaagcctgcttttatttatttattttttggcaggcttttactggcaaatatcactttaaactgaaagccagaagcc

SEQ ID NO: 4337 - DNA, 94 bp, Homo sapiens
ggctatttgtcttatcacataatagggagcaaagcaaattttatttttaaattagctttgttccatttggtgaatttctgtgagaaaatgtgcc

SEQ ID NO: 4338 - DNA, 93 bp, Homo sapiens
ttgtggagcccttgctgtatggagtccactctgctgtgaatttcaattaatagatgacacagattctgcttcttggcacatactgttccatga

SEQ ID NO: 4339 - DNA, 77 bp, Homo sapiens
gccagtgtcactctcactgtgctcccccaacagcactgagtgtatttccaggcagccagtgactaaatgactagggc

SEQ ID NO: 4340 - DNA, 126 bp, Homo sapiens
gccagctttgttcatttgcttaggattgtcttggttataagggctcttttctggttccatatgaaatttaaagtagttttttctaattctgtgaagaaagtcaatggtagcttgatggggatagca

SEQ ID NO: 4341 - DNA, 73 bp, Homo sapiens
gtatacaatttgatagatgtgtttctatgtgtatatgtatgtatatacatcggtacatatgtagtattgtatc

SEQ ID NO: 4342 - DNA, 118 bp, Homo sapiens
cattatactcttgtgttaatgtgttattgtggcaagtaattgcatttgtaatttttttcttacagatcatagactattctacacacagaaattgttgacttaaaatgagttattaatg

SEQ ID NO: 4343 - DNA, 115 bp, Homo sapiens
tctttgatgttttattggagtatatagtctgtttacatttatttaatttttgatatcaactttattgaggttgtattagtctgttctcacactgctaataaagacagaactgaga

SEQ ID NO: 4344 - DNA, 115 bp, Homo sapiens
tgaatgaatttaatgtttccaaatgtattggaacttgttttattccctaacatattgtttgtaatggtgaatgatccatatgcacttgttattattgggggcagtgctccattta

SEQ ID NO: 4345 - DNA, 107 bp, Homo sapiens
ttatacatatatatgtatcacatacatacaaacataattgaatttttattaaattaaataataacagtttaattatgtttgtgggtatataatatatatgcatataa

SEQ ID NO: 4346 - DNA, 58 bp, Homo sapiens
ggctcactcactgtgtctgggtcctgtacaaaggctatggagatatgggagctgagtc

SEQ ID NO: 4347 - DNA, 95 bp, Homo sapiens; identical to SEQ ID NO: 68

SEQ ID NO: 4348 - DNA, 93 bp, Homo sapiens; identical to SEQ ID NO: 69

SEQ ID NO: 4349 - DNA, 58 bp, Homo sapiens
tgagacagggtctcactctgtcactcaggctgaagtacagtggtgtgatcttagctca

SEQ ID NO: 4350 - DNA, 95 bp, Homo sapiens; identical to SEQ ID NO: 580

SEQ ID NO: 4351 - DNA, 93 bp, Homo sapiens; identical to SEQ ID NO: 69

SEQ ID NO: 4352 - DNA, 75 bp, Homo sapiens
ttatggttcctttctgtatttgtatttgttatggactataaaccatgatgatgcaataaagggctagggccatga

SEQ ID NO: 4353 - DNA, 94 bp, Homo sapiens
tctgttgagatcaatatcaagatttgttgacccaaagaagttaaaattgactgaagagtgagacaataaatcttgttattgactagaaagcaga

SEQ ID NO: 4354 - DNA, 92 bp, Homo sapiens
gtgtgtacatatgtatatatgtgtgtatatacatgcatatgtatatatgtatatacatgcatatgtatatatgtatatatctatatacatat

SEQ ID NO: 4355 - DNA, 85 bp, Homo sapiens
gtcaagagggagaactaggatgcaaactaaggtagtttactatcagagcctgcattatattatttttatagattcttcagaggat

SEQ ID NO: 4356 - DNA, 119 bp, Homo sapiens
actgacagagatactgtgagaatttatgtatatctagtcaagatagagcaaaaatgttataattttttaaaagtggcaattgttaactagcagtatataaacagtgtccacaatttggt

SEQ ID NO: 4357 - DNA, 114 bp, Homo sapiens
gacagtgtttataatgtactagcgagttatttgtttatcggtgactccccaggtggactgtgagctcacagaggacagcactcacatgtataagatggtatctagcacagggtc

SEQ ID NO: 4358 - DNA, 77 bp, Homo sapiens
tctctctgtgcccctgtctctatcaaaagtaggaaaataagagaagtccatgtatttgaagaaacatgcaagagaga

SEQ ID NO: 4359 - DNA, 114 bp, Homo sapiens
attttgattgatggctgtaaatttccatttgttttgctatacaatcagtgagttgagtctgatctctcacctctgctgtaatagtcttgacattgcaatagccttgaataaagt

SEQ ID NO: 4360 - DNA, 86 bp, Homo sapiens
gggacttagagtgatgagagtctgcaccccaagtgccaatcggtgggaaatgtgcttttagggctgtttgaccctcatcctgaccc

SEQ ID NO: 4361 - DNA, 109 bp, Homo sapiens
ttttctcaaaatagctattttgaattctctgtctgaaaggtcaaatatctctgtctctctgggactggtctttcatgtctcagagactttatttagtttgtttggaaag

SEQ ID NO: 4362 - DNA, 72 bp, Homo sapiens
cttctcaaggagtccctaggtggggccgttctgtgtcttcagagagctggcagtcactgtctcagtaagagg

SEQ ID NO: 4363 - DNA, 58 bp, Homo sapiens; identical to SEQ ID NO: 87

SEQ ID NO: 4364 - DNA, 56 bp, Homo sapiens; identical to SEQ ID NO: 88

SEQ ID NO: 4365 - DNA, 114 bp, Homo sapiens
gcctcggcaccttcggcaatttccgtcgggccccagccgccattttctcgccgcttgtgtggctcgctggctgcgtggctcggttcttgtgagcgaagctttgtccggttcggc

SEQ ID NO: 4366 - DNA, 98 bp, Homo sapiens
ggggggaatactgaacttctctggatttgtttcatctggaaaataatctttaggtaacatctaggatgatttgaattctgtgagactgtgttaacttt

SEQ ID NO: 4367 - DNA, 96 bp, Homo sapiens
ggtggccatggtgctaagcagcaatgtaggtgaggcagggaaaggaaggactttctctgtatttctctgtcattggagctgatctccatctctacc

SEQ ID NO: 4368 - DNA, 108 bp, Homo sapiens
ggcagagactttgctctcttcattttctccttaagaaccaaaatctctctctctctgttttgagccatctggagctggggataaagtgacaccagtacttctagggcc

SEQ ID NO: 4369 - DNA, 61 bp, Homo sapiens
gcttctgtgtgtgtatgtatatgtatatatatacatatatacacacacacagttttatagt

SEQ ID NO: 4370 - DNA, 95 bp, Homo sapiens
atttccggcttatatcagaatatatcactcagtatcatatatatatatatatatatatatgtatatatgtatcttattcagtataaacctgaaat

SEQ ID NO: 4371 - DNA, 89 bp, Homo sapiens
accctgtcactttttgaagcttttctctgttgattttaatctatttattgtagaaatgggaacacttcaagtagtgaaagttacagggt

SEQ ID NO: 4372 - DNA, 110 bp, Homo sapiens
gtgtatttttacgtgacattaatattataatttaatagatatatttatagatattaactatatctgcatgtatttgtgtatatattcaatgtgtttatgtaagtgtgtgt

SEQ ID NO: 4373 - DNA, 95 bp, Homo sapiens; identical to SEQ ID NO: 68

SEQ ID NO: 4374 - DNA, 93 bp, Homo sapiens; identical to SEQ ID NO: 69

SEQ ID NO: 4375 - DNA, 71 bp, Homo sapiens
tggatggctgtgtatagtcagtgtatatttataattttatgagtagctgggactacagacacatgccacca

SEQ ID NO: 4376 - DNA, 158 bp, Homo sapiens
tatatatatatgcatatatatgtgtgtgtgtttatgtataggcatatatatgtgtaaatatatatgtatatatacatatcatatatacacgtatatatatccacatatgtgtatacatacatatgtatatatgtatacacatttatatacttatatac

SEQ ID NO: 4377 - DNA, 58 bp, Homo sapiens
gcatctggtgatcagtgagctataattgtttttatattgcttatcttgaggccagtgc

SEQ ID NO: 4378 - DNA, 84 bp, Homo sapiens
gaaagaaactatattttgtttactattacatgcccagcttccagcctggcctttagtggtgctaaaataaagtactgtatcttc

SEQ ID NO: 4379 - DNA, 104 bp, Homo sapiens
gttcctcaaattgtgttatgtgaatagggagtagagtgtgaccacagagattttccttaaagtcattttaagtctctcaccacagtcaatacttacatatgaac

SEQ ID NO: 4380 - DNA, 102 bp, Homo sapiens
tagagtggcacctatgcttgtctttctattgagaaataaaagttgcacagaaattttatatttctatgtgcaatttcagagagaatacaagagagcattttg

SEQ ID NO: 4381 - DNA, 117 bp, Homo sapiens
gtggggtcatggaattatagcagagacatttggatgtgtaatgattatgttgttgggaaaaagtaactcacatggtaagtatacatcccagtggcattttctcctgatttgctttgc

SEQ ID NO: 4382 - DNA, 96 bp, Homo sapiens
gatgacatatggttttagggccatttttaatcatttgtaaatacgtttatattttttaaagaaggcatattctaatgctaagccatgtgattcatc

SEQ ID NO: 4383 - DNA, 90 bp, Homo sapiens
ctcttttaaagtgtacaagtgattttcatgtagacatcattggttttccttaacggggtggatgtcagtcagtggttctcaagggaggag

SEQ ID NO: 4384 - DNA, 112 bp, Homo sapiens
ggaaatgaaagcggaactggaaaatatcaggagtagaagtaaaatctttctttatttggtggttagaaagtcttttatatctgatctgtcactttttgtttcttctatctcc

SEQ ID NO: 4385 - DNA, 113 bp, Homo sapiens
gttatatacagttctatggattataaaatgatatctccattgctatatatatatatatatatatatatatatatatgcgatggatattaaaatctgtttttgaatttcatgac

SEQ ID NO: 4386 - DNA, 57 bp, Homo sapiens
tgagactgagtctcactctgtcgccaggctggagtgcggcggtgtgatctcggctca

SEQ ID NO: 4387 - DNA, 116 bp, Homo sapiens
ttattagtggttgagcaatataaatgtgaaatgctttgaagtaatctgcattatatttttattagcttcagagcttctatatacgtattttatattcttttcaaaagcttaaatag

SEQ ID NO: 4388 - DNA, 100 bp, Homo sapiens
ggtgctcaaaatatttatgaattttgtgaaagcagtgatatccttttggggcatacgtgaatataaattttacattttttcataattatttaaagtcact

SEQ ID NO: 4389 - DNA, 119 bp, Homo sapiens
gcagcttggtcctctgactctcttcggtgacgggtattcttgggtggataatacggattacgttgttattgcttaagaatacgcgtagtcgaggagagtaccagcggcaggggggcagc

SEQ ID NO: 4390 - DNA, 87 bp, Homo sapiens
ccaaacaccatgcagaatctttattgtttcaatataaaaagtagttgctgaggaaaaaacagtgaagacaaaaatgcaagtctttgg

SEQ ID NO: 4391 - DNA, 110 bp, Homo sapiens
ggcttttaagataatttccagacaaagaggtttttttcttcttttttatctacagagaaaaaaattgagtaagaacttcctactctgtgtatattcttttaaaatatgcc

SEQ ID NO: 4392 - DNA, 114 bp, Homo sapiens
aaatatatatatatatatctctacacacacatatatatacacacacacacactcacatatatgtgtatatatacacacacctatatgtatgtgtatgtttatatatggtaagag

SEQ ID NO: 4393 - DNA, 98 bp, Homo sapiens
tgggttcatccactgtcagttaaacatatctattttttataaaatgccaatttataaaaacactatagatattgttgcaaacaaactcctggctccca

SEQ ID NO: 4394 - DNA, 102 bp, Homo sapiens
cattcatgcttttctgagactgtacttcctaagaaagtagtagcatgtaaagatttgccccacttaggctgcttttgaggaactcaggaatggtagtgattg

SEQ ID NO: 4395 - DNA, 92 bp, Homo sapiens
gaaaaccaatgattctttgatttggctttttgaagtaattttctatattttgtaggaaatcttcattgcttttcattctgtcttcttttttc

SEQ ID NO: 4396 - DNA, 85 bp, Homo sapiens
gaggctggacggctgtggctccctgtatgggtctctgtctgggaaatgcaacccattctaataaagagctttgaaagctggcctc

SEQ ID NO: 4397 - DNA, 95 bp, Homo sapiens; identical to SEQ ID NO: 580

SEQ ID NO: 4398 - DNA, 93 bp, Homo sapiens; identical to SEQ ID NO: 69

SEQ ID NO: 4399 - DNA, 80 bp, Homo sapiens
gacagatgcagggcctctccccatcgccttacattaccatttcttaattttttttttttttgaggcagtcttgctctgtc

SEQ ID NO: 4400 - DNA, 102 bp, Homo sapiens
actctctctctatatatagttaagaactatatgtatatatgtatatatatgtttatacacatatgtatatatatgtttcttaactatatatagaaagagtgt

SEQ ID NO: 4401 - DNA, 99 bp, Homo sapiens
ttgaaattctcttttgcattctactggaaatgtatactttttttatttatttgattaatgtatgtctttcctatagaattgcaagctctatgaagccag

SEQ ID NO: 4402 - DNA, 100 bp, Homo sapiens
tgtatgtatatatatgtgtttgatacatatatgttttaatacatacagatatacacctatttttaatacatatatatatacacacctatatacacatata

SEQ ID NO: 4403 - DNA, 72 bp, Homo sapiens
acacagtgtgtgtatatatatatagtgtgtgtgtatatatatatatagtgtgtgtgtatatatacagtgtgt

SEQ ID NO: 4404 - DNA, 76 bp, Homo sapiens
atatatacgtatatgtgtatatatatatgtatacgtatatgtgtatatatatatatatatacgtatacatatatgt

SEQ ID NO: 4405 - DNA, 105 bp, Homo sapiens
cccatgtggctagcctcatgtcaattaaaacctttctctactacaatgtcactgtctcagtgaattgatcattgtctatggagtggacaggaagaacccattggg

SEQ ID NO: 4406 - DNA, 98 bp, Homo sapiens
gactctgtctcaaaacaaacaaaaaacatgttttaataagttacctggaaagttttgtggtttgttttttgttttttgtttttttttgagtaggagtc

SEQ ID NO: 4407 - DNA, 129 bp, Homo sapiens
cctggacaaaactgttttggtctgatgtgtatatttgtgaagaaataatgcatttttttattattatactttaagttctgggatacatgtgcagaaagtgcaggtttgttacatggtatacacgtgcca

SEQ ID NO: 4408 - DNA, 95 bp, Homo sapiens; identical to SEQ ID NO: 68

SEQ ID NO: 4409 - DNA, 93 bp, Homo sapiens; identical to SEQ ID NO: 69

SEQ ID NO: 4410 - DNA, 112 bp, Homo sapiens
cttttcaattattatttgtttatttctttttattgccttagtagtttggctaggatttctggtagaatgttatatagtaatggtgagaatggacatctttatagatggaaag

SEQ ID NO: 4411 - DNA, 110 bp, Homo sapiens
gttgctactccagctcctagcagagtctatgaggaggcattcaataacaatttttttttttttttttgagatggagtctcactctgtcgcccaggctggagtgcagtggc

SEQ ID NO: 4412 - DNA, 125 bp, Homo sapiens
catatatatgaaatagaaaatgaatgtatggatacattcatacatatatattcatgtatattcatatgtatgtacatatatattcatgtatattcatatgtatgtacatatatattcatgtatat

SEQ ID NO: 4413 - DNA, 92 bp, Homo sapiens
gagatagtgaggttgatgaactaggttttttttttttttttcttttgagggagaggatggataccaagttttggaaaagtcaattggttctc

SEQ ID NO: 4414 - DNA, 62 bp, Homo sapiens
ctcacaggctctcagagtgtctttgcctctgataagtattgaattctgcctagagtggtgag

SEQ ID NO: 4415 - DNA, 89 bp, Homo sapiens
tctccagggtctagcacagtgcctggtaagtactcaataaatgtttgttgactgactgactgactggctatgaccttttccaagggaga

SEQ ID NO: 4416 - DNA, 101 bp, Homo sapiens
tatgtctataggtaattgacagagattttattattcggcagagctgagtcaaccttttaatatttttactttgatcagtgttaccatctctgtggcacata

SEQ ID NO: 4417 - DNA, 119 bp, Homo sapiens
gggccatgttttcccatcttctgttaatgagtttgatgacctccaacctcagaatctttttattttatgaccttttggaggatgacaaaggatttgacaaaagagaaagaggagttcat

SEQ ID NO: 4418 - DNA, 114 bp, Homo sapiens
gccacagctcccagtcagccacacaatcagaagggtaaacaactgggtactctacagtgtactgtgtttccagatgatttggcctgatagtgggctaatgtaagtgttccaagc

SEQ ID NO: 4419 - DNA, 115 bp, Homo sapiens
ctcaaaggaagcactgttgctctctctctcttggtctgacatatcctattaatctaatacaaatgttattttgttattttattattttatggctaagaaagaaaggaagtgtgag

SEQ ID NO: 4420 - DNA, 97 bp, Homo sapiens
ggcagcagtgagtaatgggagacagaaaggatcctctaagaacaagtctttttcttgtttagatgggatcattcgtctgatacatgaagggaatgcc

SEQ ID NO: 4421 - DNA, 117 bp, Homo sapiens
aggccctttcagaatttcgtgcatgtatctggcatccatgcataagaaatgtaaagatatttgttagtcatggagttagttagcaaaatatgtatgttgtagtatggtaacgagcct

SEQ ID NO: 4422 - DNA, 75 bp, Homo sapiens
gctgtgcgctgtgtgtcacagtggtgactgtgctctgagtctgcagagctgtttccttggtggcccctgtgcagt

SEQ ID NO: 4423 - DNA, 108 bp, Homo sapiens
aaaaaaaaagttcacagatgtttggaatcagaaatacctgtgtttagatccaagctctgacttttttttttttttttaagacggagtcttgctctgtcaccaggctga

SEQ ID NO: 4424 - DNA, 100 bp, Homo sapiens
gagcatggtgaacctgttgctccagatggcttgtttatgctgttcaacataagagatcattgagagctcatgcttctgtctggatcactagacacaatgc

SEQ ID NO: 4425 - DNA, 98 bp, Homo sapiens
ctgtggaagtttgcctgtataactggagtgctatggagccctgtctgtgtgactctcagggagaattggcctgccacagatcaacaacggcttgcact

SEQ ID NO: 4426 - DNA, 102 bp, Homo sapiens
acagcagactgagttgaagcacagctttgccacagggcctttgtctcattgtcactctgtgtgactaacctgtgtaatcattgtgttgtcatcagtacctgt

SEQ ID NO: 4427 - DNA, 114 bp, Homo sapiens
ggcaccatgcaggctcaggctggcactcatcccaggaaactgtcccagttctcagcggtcctggctgtggacggtatctgaaatggtcgctgcggcttgccctgcaccagggcc

SEQ ID NO: 4428 - DNA, 90 bp, Homo sapiens
taggtttttgtttttgtttttttttagtataagtatatgtaatatttgggacatactttatactaaaaaaattaactgaaattaaatcta

SEQ ID NO: 4429 - DNA, 62 bp, Homo sapiens
tgaggcagtgtgtctctctgtcaccccggctggagtgcagtggtgcaatcttggctcactgc

SEQ ID NO: 4430 - DNA, 110 bp, Homo sapiens
gacctctttctggattctctattctgtttccttgacctctgtgtttatctctctgctgatgccacacattctagattgccaaagctaaataagaagtctagagattggtt

SEQ ID NO: 4431 - DNA, 58 bp, Homo sapiens
tgagacaggatctcactctgtcactcaggctggagtgcagtggcacgatctcggctca

SEQ ID NO: 4432 - DNA, 98 bp, Homo sapiens
gtgagagtgtgagtgtgtgcaagtgtgtgcacgtgtgtgtcagtccctctgtctggctcccactgctagccacctctgtcatatcctgactatttcgc

SEQ ID NO: 4433 - DNA, 86 bp, Homo sapiens
ccaagatcagggtggcagatggttgggttctggtgggggccctcttctgggttgcagactgacagcttctctctctctctgtctgg

SEQ ID NO: 4434 - DNA, 84 bp, Homo sapiens
ccacctgaggctctgtttctcagtgccaccttgagctttgctctgtggcttgaggtgaagctggtgatgccagcctgaggatgg

SEQ ID NO: 4435 - DNA, 225 bp, Homo sapiens
acatatatatacgtatatatgtgtgtacatatatacgtatatatgtgtgtacatatatatgtatatatatgtgtgtacatatatatgtatatatatgtgtacatatatatgtatatgtatatgtgtacatatatatgtatatgtgtacatatatatgtatatatatatgtgtacatatatatgtacatatgtatatatatacatgtacacacatatatacatatg

SEQ ID NO: 4436 - DNA, 84 bp, Homo sapiens
acaaatatatatatatgtatatatatgtgtacatatatatacgtatatatatgtgtacatatatatacgtatatatatatgtgt

SEQ ID NO: 4437 - DNA, 122 bp, Homo sapiens
gcaaaaactttagtgtgacaatgctttctctgctcagcgaggaaattaaagtaactaatagaagtgagagtgcacgctggaaggagtttgtttttctctgcagttttttaagcattaaagca

SEQ ID NO: 4438 - DNA, 90 bp, Homo sapiens
gcattcccctatgtccacggaaggttgtttggcagcagctgagacaagcagcctgtgacagaagacagcctccagggaccaggtcagtgc

SEQ ID NO: 4439 - DNA, 96 bp, Homo sapiens
catttgaaaaattctgaaatgtttgaagatgtgagcaaagattatttatttattgagacggagttttgctcttattgcccagactagagtgcagtg

SEQ ID NO: 4440 - DNA, 84 bp, Homo sapiens
gcgtgggcactggagccagcctgtggcaccacttcccagacctgtgatggtggtgagttacacagcctctcagtgcctcgctcc

SEQ ID NO: 4441 - DNA, 73 bp, Homo sapiens
gctgactcactgtatgtgtctgggcatgggtatatatatacagagtcttagtttgcattcaagtgggtccagc

SEQ ID NO: 4442 - DNA, 58 bp, Homo sapiens; identical to SEQ ID NO: 315

SEQ ID NO: 4443 - DNA, 85 bp, Homo sapiens
gggcagtgtatctttatttatggtgcatttagcagggttcctggtctataaatgtttcatttagtagagagtgaggacaaggcct

SEQ ID NO: 4444 - DNA, 102 bp, Homo sapiens
ggactcttcccttcactgaagtccaaactgactctgctttatgctcctgctctttcagagcagagagacagcagagttcacatgcatcatgggaagaaatct

SEQ ID NO: 4445 - DNA, 86 bp, Homo sapiens
ctgcaagttatcccagttgattttttcattttaactgtgttgtatttgctctctatattaaaatgaaatcacaggatagtctgggg

SEQ ID NO: 4446 - DNA, 60 bp, Homo sapiens
tgagatggagtctcgcactctgtcacgctggctggagggcagtggtgagatctcggctca

SEQ ID NO: 4447 - DNA, 213 bp, Homo sapiens
atatataatatatgataagatgtagcatatatacgtatatgggtatatatatgtatgtgtatatatgtatgggtgtatatatgtatgtgtagatatgtatgggtatatataggtatgtgtatatatgtatgggtatatatgggtatatatgtatgtatatatgtatgtatatgtatgcatatatatgtgtgtatatatgggtatgtatgtata

SEQ ID NO: 4448 - DNA, 223 bp, Homo sapiens
tgtatgtgtatataatatatatgggtatatatatgtatgtgtatatatgtatgggtatatatatgtatgtgtatatatatgggtatatatgtatgggtatatatgtacggatatatatatgtatgtgtatatatgtatgggtatatatatgtatgtgtatatatgtatgggtatatatgtatgggtgtatatatgtatgggcatatatatattttatattgca

SEQ ID NO: 4449 - DNA, 132 bp, Homo sapiens
gtatatatatgtaggtgtatatggttatatgtatgggtatatatgtgtgggtatatatatgtatgtgtatatatgtatgggtgtatatatgtatgggtatatatgtatggctatataagtatgagtatatat

SEQ ID NO: 4450 - DNA, 77 bp, Homo sapiens
gtatatatgtatgtgtatatatgtatacatatacacatttattgtttatgcatacatatgtgtgcatatgtgtatgc

SEQ ID NO: 4451 - DNA, 165 bp, Homo sapiens
tgtatatgtatgcatatacacatgtgtatgtatatgtatgcatatacacatgtgtatgtatatgtatgtgtatatgggtttatatatgggtatatatatgtatgtgtatatatgtatacaaatacatacccatatatacccatacatatataggtgtatatatgt

SEQ ID NO: 4452 - DNA, 58 bp, Homo sapiens
tgagacagagtctcactctgtcacccaggctggagtggcatggtacgatctcagctca

SEQ ID NO: 4453 - DNA, 68 bp, Homo sapiens
ggtcctccctcagtgtgtgcctgtgtcctgatctcgtctaaggacaggagtcatattggattagggcc

SEQ ID NO: 4454 - DNA, 66 bp, Homo sapiens
tcaaagtgctgggattacaggcatgaaccactgcccctggtctgcctgtctgtctgtgtcttttga

SEQ ID NO: 4455 - DNA, 95 bp, Homo sapiens; identical to SEQ ID NO: 68

SEQ ID NO: 4456 - DNA, 93 bp, Homo sapiens; identical to SEQ ID NO: 69

SEQ ID NO: 4457 - DNA, 67 bp, Homo sapiens
gctatctcaccatgaatagagcttgaggggctggaggttgctctgggtgagtcagtgagtgagtggt

SEQ ID NO: 4458 - DNA, 70 bp, Homo sapiens
gtcttagggtcttggtggctctaagcccagaggtgcttccattgtgtgaagaaacacaggagaccgagac

SEQ ID NO: 4459 - DNA, 128 bp, Homo sapiens
aggaggctggtgacttccaggtggtggaagctcatttattgggtcatgtcactcactctgtgagtctttttcctctcctagttccatgaagcagcaggctagagagaagcgattcacgtagttggtga

SEQ ID NO: 4460 - DNA, 71 bp, Homo sapiens
tcctgttgtgcctctctctgtgtatctggatgaatcctaaccataccacacacatgggtgggaactcaggg

SEQ ID NO: 4461 - DNA, 86 bp, Homo sapiens
tgtatatgcctttttgtatatgtatatacatatatgcatgtatatatacacatatttgcaaatgtatatgcatatacatacaaggt

SEQ ID NO: 4462 - DNA, 114 bp, Homo sapiens
gggactcacagaaatattagcaagtgggttgaggtgcatagttttgagagaagagagagagcactggattgacatttgtctgggtttgcagctgggctccatcaattattttgt

SEQ ID NO: 4463 - DNA, 132 bp, Homo sapiens
tacaaaaagtagccgggtgtggtggcgtgggcctgtaatcccagctactcaggaggctgaggtaggaggatggcttgagcccaggaggcggaagttacagggagctgaggttgcaccactgcactccagcct

SEQ ID NO: 4464 - DNA, 92 bp, Homo sapiens
atggaagtctcaaagcaaatgaaatgatattttcaaatgaatggaaatgaaaatgcaacatatcaaaatttgcaagatgagactaaagccat

SEQ ID NO: 4465 - DNA, 86 bp, Homo sapiens
ccattttcttcagtggaaatgttggtttatgtgtccattctaagtaaacaacatagttcatgtttcaacgttgccaagaactgtgg

SEQ ID NO: 4466 - DNA, 93 bp, Homo sapiens; identical to SEQ ID NO: 69

SEQ ID NO: 4467 - DNA, 74 bp, Homo sapiens
cagtgttttcagaggccttttctgtgttaatatatttctatgtttagcacttaagaagcactccatgaatattg

SEQ ID NO: 4468 - DNA, 94 bp, Homo sapiens
gagttgaaggagtaccttgtatagtttggatattaactctttatcagatgtatgatttgcaaatcgtatccactgtgcaggttactttttgctt

SEQ ID NO: 4469 - DNA, 97 bp, Homo sapiens
ttagtctagattatttgtttaaatatttagtctagattatttgactttataaatttgagaataatcttgtctatatatctacaaaaaatcttgctga

SEQ ID NO: 4470 - DNA, 117 bp, Homo sapiens
gtagaaagtcggattaacttgtctatgtgtacctataaccacatacctaggcatgtatatgtatatatatgtctgtggtatgcatgtatatgtatatatggatttggataaaactat

SEQ ID NO: 4471 - DNA, 95 bp, Homo sapiens; identical to SEQ ID NO: 68

SEQ ID NO: 4472 - DNA, 93 bp, Homo sapiens; identical to SEQ ID NO: 69

SEQ ID NO: 4473 - DNA, 77 bp, Homo sapiens
ttgcacatcccaaaaacatgcacattaggtgaatccatgtgcctacatgggcccagtctgtgtgtgtgtgagtgcaa

SEQ ID NO: 4474 - DNA, 128 bp, Homo sapiens
taggtgaatattgtctcaatgccatcattctgcttttactgcatgttaacagtgctcctggctgaagagagtgatgtcagtgtttcttgcctataaaccaaatgaggtcttgctgtcattctggccag

SEQ ID NO: 4475 - DNA, 109 bp, Homo sapiens
taaatatatatgtttttcacattacaatgacttttttctgaaaaataatgagaaatattcttaatattttacaaaatgagagatccttgtatatgaaatcaaatgtttg

SEQ ID NO: 4476 - DNA, 98 bp, Homo sapiens
gtgttatttttttactttgtattaatacccattctgtctggggtaagatggtatctcaatgtggttgtgatttgcatttagctaaagatcagtgatac

SEQ ID NO: 4477 - DNA, 101 bp, Homo sapiens
ggcatagtggtgcacagctgtggtctcagttccttgggaggctgaggtaggaggatcacttgaacctgggagtggaggttgcagtgagccaagatcatgcc

SEQ ID NO: 4478 - DNA, 84 bp, Homo sapiens
gtaggtgtgaaatggtgtcaaattatagttttaatttaattttcctaatgacttatgatgttgaacatcttttcatatgcttac

SEQ ID NO: 4479 - DNA, 83 bp, Homo sapiens
gacagatagaatttatatagtatatatatataaaattctattatatatattctatatatgtattctatatatattcatctatc

SEQ ID NO: 4480 - DNA, 97 bp, Homo sapiens
gacaaagttagtcaggtgcattttttttgctttctagttcatataaaagttatgttcatactatattatagtttattaaatgtgctatagcattgtc

SEQ ID NO: 4481 - DNA, 87 bp, Homo sapiens
tttgtcccagctgttgtcaccacttcagatggctacagtgttaaaatattgccactggatgttttcagcaaatgcttcttggataaa

SEQ ID NO: 4482 - DNA, 113 bp, Homo sapiens
gtgggctgcattccaaggaggtcaggaggtcaggcattcttttttattttttttatttttttattttttttgagatggaggtctgctctgttgccaggctggagtgcagtggc

SEQ ID NO: 4483 - DNA, 74 bp, Homo sapiens
tttgtttttttgagatagagtctcgctctgtcacccaggctggagtgcagtggctcgtctcggttcactgcaag

SEQ ID NO: 4484 - DNA, 117 bp, Homo sapiens
catacatgtattatacacaaaaatactgcatgtatataggtagataggcatatatatgtatatacatatatatacacaggcatatatacacatatattatgtataatatatgttatg

SEQ ID NO: 4485 - DNA, 171 bp, Homo sapiens
tatatacgtatacgtatacatatatgtatatatacgtatatacgtatacgtatacacgtatatatgtatatatgtatatgtgtgtgtatacatatatgtgtatatatgtgtgtgtatatatatgtgtatatatacacatatatatatagaatgagagagagagtatatttg

SEQ ID NO: 4486 - DNA, 86 bp, Homo sapiens
gaaagaacctgaataaactgtttttctgcagaagtgttttttttaattattatttgacagtgatgtggaaatcttttcaggctttc

SEQ ID NO: 4487 - DNA, 69 bp, Homo sapiens
atacattgatactcatacatatgtgtatatgtattatgtgtgtttgtgtgtgtgtgtgtgtgactgtgt

SEQ ID NO: 4488 - DNA, 113 bp, Homo sapiens
gaatatttgcattattataataatatgcattatatgcataatatatgataatatattatgataatataatataataatatgatatgataatatgcattagaaggagaatattt

SEQ ID NO: 4489 - DNA, 107 bp, Homo sapiens
tcgggccattgcacatgtatttattggtgctcatacttgtttatattattttgttttgatcataagtgtagagagtggagcttctagtagaaagtcaaggcaattga

SEQ ID NO: 4490 - DNA, 79 bp, Homo sapiens
cctatgtggaaagacataaatagagttttagtagttatgtttaactatattgactcccttgagaatccatccacaatgg

SEQ ID NO: 4491 - DNA, 119 bp, Homo sapiens
gctagagatgcctgctttggtgtgaatgatgattaccccttaaaataattcaacaattttttttttttttttttgagacagggtctcagtctgcctctcaggctggagtgcagtggcgt

SEQ ID NO: 4492 - DNA, 94 bp, Homo sapiens
tataaatatctatatgtatatctagatagagatctataaatacctgtaaagatatagatctatacatttatatatatataaaaagatatatata

SEQ ID NO: 4493 - DNA, 118 bp, Homo sapiens
gctttttttaaccttggatttcaaaactaacatttctccaggtgaaaaagaataaagtttattttactttacttttcaactaaaagaagttgttcttttttctaagtctcccttgagc

SEQ ID NO: 4494 - DNA, 67 bp, Homo sapiens
tgtttgagaccaggtctcactctgtcacccaggctggagtgcagtggtgtgatctcagctcactgca

SEQ ID NO: 4495 - DNA, 98 bp, Homo sapiens
attgtaaatgtatccatatcaatattccaggactgatattgtactatatatctatatgatattacattgaggggaattagatgtagggtatatgcaat

SEQ ID NO: 4496 - DNA, 114 bp, Homo sapiens
ccttgtatctgtggaagaaatctctctcaatcatattgtataattatttttatatattgctgagttctatatgctaatatgttgttgagaatttctgcccctatatttatgagg

SEQ ID NO: 4497 - DNA, 93 bp, Homo sapiens
ttgatttctctgcatatgtatgtaagtatatagatatagatataggtgtattggtatatgttttatatgtatgtatatatagagagaaattaa

SEQ ID NO: 4498 - DNA, 67 bp, Homo sapiens
ttctctttcactctctgtttatcttagggaactccctatgaggccatagatacaggctgggagagag

SEQ ID NO: 4499 - DNA, 83 bp, Homo sapiens
gaaaaggtggtcacagaagatagagatgccttcattagtcaacatgaatggcatactcttctttttaatgttctttccttctc

SEQ ID NO: 4500 - DNA, 116 bp, Homo sapiens
ccacttttatcatcatcagagagttttaggaaggttttttttttgttttttttttttttaaagcgagacaaaggaagtgagaactcagagacctgtttacttgacttataaaaggg

SEQ ID NO: 4501 - DNA, 103 bp, Homo sapiens
tcgtgccactgcactccagcctgggcaacagagcaagatgcggtctgaaaaaaaaggggggtgggtctcactctgtcacccaggctggagcacagtggcgcga

SEQ ID NO: 4502 - DNA, 63 bp, Homo sapiens
ttgagatggagtctcactctgtgtcccaggctggggtacagtagtacagtggcaccatctcag

SEQ ID NO: 4503 - DNA, 88 bp, Homo sapiens
tcactgaatgccacataaatgggagggactgtaatgacacacacacacacatgctctctgcctccctctctgcatgttctcgcagtga

SEQ ID NO: 4504 - DNA, 69 bp, Homo sapiens
ggtcatgtctgagtctctgtctgataggttctctgtagacgtggaatatgtcaggtggggagtgtgccc

SEQ ID NO: 4505 - DNA, 76 bp, Homo sapiens
tgtggattacaggaggcctcttttttaaatttaaattaaaaattttttttgagacagggtctcactctgtcacgca

SEQ ID NO: 4506 - DNA, 88 bp, Homo sapiens
gtatatgtgtgtatatgtatatatatgggtttgtgagtgtgtatgcacacacacatattttttccattttatataatacatcacttac

SEQ ID NO: 4507 - DNA, 102 bp, Homo sapiens
ggttttgatttgcatttttctgatgagtagtgatgttgaacatcttttaatatgtttattggccatttgtatataatctttggagaaatgtctactcaagcc

SEQ ID NO: 4508 - DNA, 97 bp, Homo sapiens
tggcaaagagtggcttttatgagctgccccactcctgattataaacacactctctatgagtcagaggcctgggtgatcatggataagtcacttgcca

SEQ ID NO: 4509 - DNA, 119 bp, Homo sapiens
tcagcagaaatacagattctggaatgtaaaggtgaagacggttgtgagaagacagagtccactactggcctctggttctttttcactgagttaatttcctgaatgcatgtggttgctgg

SEQ ID NO: 4510 - DNA, 62 bp, Homo sapiens
tctctctttgtgtgtgtgcatgtgtgtgtatgtatatatatatatatatatatggagagaga

SEQ ID NO: 4511 - DNA, 114 bp, Homo sapiens
aggtgtgagccactgtgcccagcccctggggactttttattaagagagaggattcttctctcctcctggccagttaagcccagctctggatatgcagccacaggaggccagcct

SEQ ID NO: 4512 - DNA, 58 bp, Homo sapiens
tgagatagagtctcactctgtcacccaggctggagtgcagtggtgtgatcttggctca

SEQ ID NO: 4513 - DNA, 94 bp, Homo sapiens
ttttttttttctgagacaaagtctcactctgtcacctaggctggagtgcagtggtgtgatctcagctcactgaaacctctgcctcccaggttca

SEQ ID NO: 4514 - DNA, 75 bp, Homo sapiens
ggcctgtttagggcactgtcagccgagggctcagtctagccactggtctctctgcgtgtctctgcctgagtggcc

SEQ ID NO: 4515 - DNA, 73 bp, Homo sapiens
ggttatatgacttttatgtgtatatacatatgtatttatgtattaacatgtatgttgcatggatgttggaacc

SEQ ID NO: 4516 - DNA, 114 bp, Homo sapiens
agtagtggtgcatgtctgtggtcccagctacttgggaggctgaggttggaggatcgcttgggagcagcagccgaggttacagtgagctgtgatggcagcactgaactccagtct

SEQ ID NO: 4517 - DNA, 117 bp, Homo sapiens
gctgttgtctgtcttttcattgcatgtcatggcactggatgtcaacagctgtcagcagtaaatatttttcattgtatccattttgttcatttgatgtagaagagaagagagattagc

SEQ ID NO: 4518 - DNA, 100 bp, Homo sapiens
gctccatgccactgcagagcatactcctgtccactcattttttttttttttttttttttttttttgagacggagtcttgctctgtcacccaggctggagt

SEQ ID NO: 4519 - DNA, 91 bp, Homo sapiens
cactcaaattagagcaatttgaggagggttcgtttatttatttattatttttatagagacagggtctcactctgttgctcaggctggagtg

SEQ ID NO: 4520 - DNA, 113 bp, Homo sapiens
gtttcatagtgtcaggtctgaaggtttaagtctttaggtagtagttagtattaatatcattagcattattattactacttctgccacccagaaatgcctcctgccattgatgc

SEQ ID NO: 4521 - DNA, 107 bp, Homo sapiens
gaaatcaagtctgatatatgctgagcatatgtgaaatcagtttcttaatctgagtgttagtcactgttagaatgtttgataatgtctggaatgagtcttttggtttt

SEQ ID NO: 4522 - DNA, 56 bp, Homo sapiens
gagacagggtctcactctgtcacccaggctggagtgcagtggtgcgatcctggctc

SEQ ID NO: 4523 - DNA, 131 bp, Homo sapiens
gtatatatacacgaatatatatatacgtatatatacgtatgtatgtacatatacatgtatatatgtgtatatatacgtgtatatatacacgtatatatacatatatacatatacacatatacacacatata

SEQ ID NO: 4524 - DNA, 131 bp, Homo sapiens
atatatacatacagatacatatatacatatacatacatgtgtatatgtgtgtatatgtgtatatgtatatatgtatatatacgtgtatatatacacgtatatatacacatatatacatgtatatgtacata

SEQ ID NO: 4525 - DNA, 85 bp, Homo sapiens
tgtttgacattcttcctgctccacactgactcactctcacagtcttggggatgggtgagatgtgagggagggtgcctgcctgaca

SEQ ID NO: 4526 - DNA, 80 bp, Homo sapiens
gagtggctaagttcagcagcagcagacaggaagtttattttctggagaaagtaacctgaggctgtctgaacttgggcacc

SEQ ID NO: 4527 - DNA, 95 bp, Homo sapiens; identical to SEQ ID NO: 68

SEQ ID NO: 4528 - DNA, 93 bp, Homo sapiens; identical to SEQ ID NO: 69

SEQ ID NO: 4529 - DNA, 64 bp, Homo sapiens
tgtccttggggaggagggagcttggtgctggtgtctgaagtctgtctctctctctgctttgata

SEQ ID NO: 4530 - DNA, 105 bp, Homo sapiens
gtagatgagtgtgtggatgttggtaatttccccattctgattgtatttgtatatattcttgcaggcaagaaagggatatttatcactttataaaacactcaccac

SEQ ID NO: 4531 - DNA, 89 bp, Homo sapiens
ggggttcagtctgtctcttctgtagtctggactctggaatctagagattcgctgaagctcatgtcccagggtcttgacgtagtgtgaag

SEQ ID NO: 4532 - DNA, 114 bp, Homo sapiens
gtctccgtgactctcaccgtggcagcctgcacgctgttagaagctggactcatctactttggattgtagccagctctaagggtctcatttgtgacgtgtgtgtgttctagagac

SEQ ID NO: 4533 - DNA, 132 bp, Homo sapiens
gttcaaaacaacaatcagggctgggcacgatggtttatgcctgtaatcccagtgctttgggaggctgaggtagaaggatcagttgaggccacgaatttgagaccagcctggggaacatagcaagacttcatc

SEQ ID NO: 4534 - DNA, 81 bp, Homo sapiens
gcctcactaactttacaacctagtctcagaagtaacatagcatccactttgggagggcaaggtgtgcagatcacttgaggt

SEQ ID NO: 4535 - DNA, 63 bp, Homo sapiens
ccaggctcactcatcagagcagcggtgtccactcacacaccgtctctcagagaggagccatgg

SEQ ID NO: 4536 - DNA, 99 bp, Homo sapiens
cccctgcacctctcagctgggagattcagcaacaggagctgcactgtgaccttgtcagtttatagttctaaatgtgtgatcttttgagatagtttgggg

SEQ ID NO: 4537 - DNA, 84 bp, Homo sapiens
gcaaaaagtatgtgtatgtatatatgtatgtgtgtgtatatacatacaagtgtgtgtatatatatataagtatgtgtatgtata

SEQ ID NO: 4538 - DNA, 75 bp, Homo sapiens
agatgagagtgaaacaacaggaactgagctcccgctgttcagcagagagagtgctctgtgtgcttcagctgatct

SEQ ID NO: 4539 - DNA, 113 bp, Homo sapiens
cctgagtagctgggattacaggcgagcgctaccatgcccatctaatttttgtgttattagtagagagagtttcaccatgttggccaggctggtctcaaactcctgacctcagg

SEQ ID NO: 4540 - DNA, 87 bp, Homo sapiens
ggcatcgatgatgcagttgctattggaccatttccatggcatgtacaggcctatgaactcaccagtgtcattctgcatctcaaagcc

SEQ ID NO: 4541 - DNA, 102 bp, Homo sapiens
ctcttttctttataaactacccagtctcaggttgttctttataatggactaatacagctggttctttgaaaagataaatagcactgattctgagatgcagag

SEQ ID NO: 4542 - DNA, 72 bp, Homo sapiens
tgagactagaaatattctgaattataaagcctactagaaggtcattgaaatagactgtgtttctctgtctca

SEQ ID NO: 4543 - DNA, 58 bp, Homo sapiens
tgagacagagtctcgctctgtcacccagcctggagtacagtggcgcaatctcggctca

SEQ ID NO: 4544 - DNA, 95 bp, Homo sapiens
tgtatgtttgcattatatgaatgtccaccacacatgcatgtatatttctgtatattgagtggcattgtgaaaggcattctttattgcaggttgca

SEQ ID NO: 4545 - DNA, 65 bp, Homo sapiens
cccaagtcacagtctctgacacagccaggcctcatcagggctgtgagaggaggaggaggaggagg

SEQ ID NO: 4546 - DNA, 58 bp, Homo sapiens
tgagatggagtctcactctgtcacccaggctggagtgcagtggtgtgatctcaactca

SEQ ID NO: 4547 - DNA, 99 bp, Homo sapiens
ccatcatgctatgacaggtcactgtcttctccgatgaaaacctctccctgatactcagtaggatcattagaaaagattcaagtgggccgggcatggtgg

SEQ ID NO: 4548 - DNA, 72 bp, Homo sapiens
gaacatttccacaatcacaaaacttcagcaactaaatattggcctgctgtgtgtgactgtgtgtgtgtgttc

SEQ ID NO: 4549 - DNA, 61 bp, Homo sapiens
cctctagactgtgacagtctctcagagtctccttgctctgatgaccttggcagttctgagg

SEQ ID NO: 4550 - DNA, 111 bp, Homo sapiens
ttgctttggctatttgggtcttttgcagttccatacaaattttaggacattttttttctatttctgtgaatgtcactggtatttttgagaaggagcacattgagtctgtaa

SEQ ID NO: 4551 - DNA, 78 bp, Homo sapiens
tatatatatatatatacacgtatatgtgtatatatatgtgtgtatatatatgtatatatgtgtatatatgtatatgtg

SEQ ID NO: 4552 - DNA, 72 bp, Homo sapiens
ttcaatgggttgaggggctcagatttttttcttttattgagatagagttttgctcttgtcacccaggctgga

SEQ ID NO: 4553 - DNA, 114 bp, Homo sapiens
tatgctgatacctggtgtgttcctgctgagagctcacagctcagtccctctccgagaactgacacagctgaaggaattcagctcacctataattacgctcagggaaatggcatg

SEQ ID NO: 4554 - DNA, 92 bp, Homo sapiens
tctcagatgatcctgagaaagggaatcggttggggcagataattcttctcaccacttttttttttttaagataaaaagatgtaaatctgaga

SEQ ID NO: 4555 - DNA, 118 bp, Homo sapiens
tggctgtctcaccatgaggagcttggctggagcgaggtgactgcctgagtcactgtctctggactgccaccactcggtgctcagcagttgccagcagcagggtccttagtgtgtcagt

SEQ ID NO: 4556 - DNA, 95 bp, Homo sapiens; identical to SEQ ID NO: 68

SEQ ID NO: 4557 - DNA, 93 bp, Homo sapiens; identical to SEQ ID NO: 69

SEQ ID NO: 4558 - DNA, 121 bp, Homo sapiens
cagtgagagtcagtatggaacccagaaagagtggcccctgggctggcagatgagagggaccacagagaggcctggccagcctgagcagggcttccaatctgtgttttactgaatgggcatt

SEQ ID NO: 4559 - DNA, 149 bp, Homo sapiens
atgtgtatatatatacttatagatgtatacatacttgtatatgtatatatagatgtatatatacatctataagtatatatatgtctatatgtatatgtacacatatatacacatatacatatatacatatatatacttatagatgtgta

SEQ ID NO: 4560 - DNA, 116 bp, Homo sapiens
gtatggatatatatacacatctataagtatatatatgtatatatgtatatgtgtatatatgtgtacatatacatatagacatatatatacttatagatgtatatatacatctatat

SEQ ID NO: 4561 - DNA, 82 bp, Homo sapiens
cagcaggcccagcatgggtggtaccagccagttccatagagcctgggatttgccctcagaccactcactctgtcactctggc

SEQ ID NO: 4562 - DNA, 71 bp, Homo sapiens
cttgacagtagagtgggtgcagagctgcgggagcaagtacctcccatggctgagcattcgagcctgtgggg

SEQ ID NO: 4563 - DNA, 86 bp, Homo sapiens
gcaaatctgaatgagtttctcctaattccaagccctaaaacaactactgtttttatttctatttgtgaggactcattgaggagtgc

SEQ ID NO: 4564 - DNA, 72 bp, Homo sapiens
tatacatgcacacatatatgtatatatatagatctatatatctatctcttacactgtatgtgtgtatgtgtg

SEQ ID NO: 4565 - DNA, 71 bp, Homo sapiens
cagcaacttctagtactgctagctccatttatggtaagtacatatgataagtgagaggtgacagtgtgctg

SEQ ID NO: 4566 - DNA, 102 bp, Homo sapiens
tgtatatgtaatatatacattgtatatgttgtgtatatgtaatatatacacataatatatgtatatatatgtatataatacatgtatatagtaatatgtaca

SEQ ID NO: 4567 - DNA, 73 bp, Homo sapiens
tatatctgaaatgtgtttatatatatgtcatatatactatgtatgcatatatatgagatatatatcatatata

SEQ ID NO: 4568 - DNA, 77 bp, Homo sapiens
gtgttcatgctgtgttctgtctcagactccctctgcctggatcatgcaggctcctctgtgctgaagataagcaacac

SEQ ID NO: 4569 - DNA, 112 bp, Homo sapiens
gtctgcagttaccattttattagctttattatgtatctatcaatgtattcatccttctctccaatcatcaatctatattatttttagatgcatttcaaagggccttgcaggc

SEQ ID NO: 4570 - DNA, 196 bp, Homo sapiens
tatatatagtatatagagtatatatatatgtatactatatatatggtaggctgtattatatactctatatacatatatactctatagatatactctatatatactctatatactctatatgtgtatatatgtatatatgtgtatatatgtatatatgtgtatatatgtgtatatgtgcatatatgtatatatgtat

SEQ ID NO: 4571 - DNA, 73 bp, Homo sapiens
accaatgccctagggataccgagggatgactatacatgactgatttgaagacttttgtatttctagtattggt

SEQ ID NO: 4572 - DNA, 58 bp, Homo sapiens
tgagacagagtctcactctgtcatccaggctggagtgcagtggtgtgatcttggctca

SEQ ID NO: 4573 - DNA, 69 bp, Homo sapiens
caggtgagtattcacagtactctgtgtgtattgttacacatcgatgtgctggcagggtgatgcaacctg

SEQ ID NO: 4574 - DNA, 58 bp, Homo sapiens; identical to SEQ ID NO: 4543

SEQ ID NO: 4575 - DNA, 113 bp, Homo sapiens
cctacctatctatcatctatctatctctgactgtctatctacacacacacacacacacatacataaatagatacgtagctattgagatatatatccccttgtgtgtgggtggg

SEQ ID NO: 4576 - DNA, 80 bp, Homo sapiens
ctcacctattctaaatatgtgatcgtttggtgctggtgggaattcagatcacttagatggttacatagtagtgcagggag

SEQ ID NO: 4577 - DNA, 71 bp, Homo sapiens
tgtcagtgccctgctctagacaacctgggaaaggacagcatcttggtctgtgggtgagagaggggcagata

SEQ ID NO: 4578 - DNA, 74 bp, Homo sapiens
gcatacatatgtatgtatatatgtatgtatgcatatatatgtatatatgtatgtatgcatatatatgtatatat

SEQ ID NO: 4579 - DNA, 102 bp, Homo sapiens
aggcagagccatcctgagggttgctgtgcactctggctcagttctgcagtgctggccctgcgacttggccttgtgacctccctcttctttctgtctctgctt

SEQ ID NO: 4580 - DNA, 113 bp, Homo sapiens
cccagcactttgggaggttgagacaggcagattacctgaggtcagtagttagagaccagactggccaacatggtgaaaccctgtctctactaaaaatacaaaaattagctggg

SEQ ID NO: 4581 - DNA, 134 bp, Homo sapiens
gttttccctcttgaaaacatgaggagactttttttttttttttttttttttttttttgagacagtctcactctgttacccaggctggagtgcagtggcgcgatctcagctcaccgcaacctctgcctatcaggt

SEQ ID NO: 4582 - DNA, 58 bp, Homo sapiens
tgagtcaggatctcactctgtcactcaggctggagtgcagtggcataatctcggctca

SEQ ID NO: 4583 - DNA, 99 bp, Homo sapiens
tgttcaggcttccaagcctatgggtgcactgcggggaagagtgttatgaaatgcacactggctgtcagtctctgtgggaaagcagtttggcctcgagcg

SEQ ID NO: 4584 - DNA, 110 bp, Homo sapiens
tgcttaggattgtcttagctatgtgggctctcttttggttccatatgaaatttaaagtagttttttccaattctgtgaagaaagtcaatggtagcttgacggggatagca

SEQ ID NO: 4585 - DNA, 59 bp, Homo sapiens
ctggggacactcacacactctgggggagtcctctgaggctggtgtggaggaggctccag

SEQ ID NO: 4586 - DNA, 91 bp, Homo sapiens
tatgtatattgtatatcatatacaatatacagatatatctgtatatatgtatatgatatacaatatacatatatacacatatactgtatat

SEQ ID NO: 4587 - DNA, 64 bp, Homo sapiens
tatatatactacacgtatagtatatatatgaaactatatatatactatacgtgtagtatatata

SEQ ID NO: 4588 - DNA, 71 bp, Homo sapiens
ccaatgggtgtgtgtccctgtttgcctctttgctggggtcacagaggaacccaggagctcacattgagtgg

SEQ ID NO: 4589 - DNA, 77 bp, Homo sapiens
aaccaataggggcaaggcagttagttactctgtttatagaatggagactgtctacctgtctgtctcactagttggtt

SEQ ID NO: 4590 - DNA, 78 bp, Homo sapiens
ctgaacaatgacctgagtgagtgcacactgtggaggagacaggcttcctgcatggagtccagccaggagacagtacag

SEQ ID NO: 4591 - DNA, 75 bp, Homo sapiens
gtttttgttttgagacacagtctcactctgtcactcaggctggagtacagtgttgggatcttggctcgctgaaac

SEQ ID NO: 4592 - DNA, 107 bp, Homo sapiens
agtaggtcattaaccaccatgcctggctattttgttttttattttttaatttttagtagagatgaggtatcattatgttgtccaggttggtctcaaactccctggct

SEQ ID NO: 4593 - DNA, 87 bp, Homo sapiens
ttgagacagggtctcactctgtcacccaggctggtgtgcagtgatgagattgcagctcaatgcacccttgacttgctgggctctagc

SEQ ID NO: 4594 - DNA, 95 bp, Homo sapiens; identical to SEQ ID NO: 68

SEQ ID NO: 4595 - DNA, 93 bp, Homo sapiens; identical to SEQ ID NO: 69

SEQ ID NO: 4596 - DNA, 119 bp, Homo sapiens
gtcatttaggataatggcatccagctgcatccatgttgctgcaaagaacattatttcattattttttatggttgtatagtattccatggtgtatatgtatcacattttctttatctgat

SEQ ID NO: 4597 - DNA, 88 bp, Homo sapiens
cttcctcttacgaggctgtcacgctgtgtcacagaggaggatcacaggagtcttggcaggccggtgtgactagctccatgaaaggctg

SEQ ID NO: 4598 - DNA, 100 bp, Homo sapiens
agttctttgtgaccatttgctaagttcagagtttcttcaatacctgtacagtagtgtggtcattggaattacatggcattggcctggtcaaatgcagaag

SEQ ID NO: 4599 - DNA, 74 bp, Homo sapiens
tttggcacgcagagaatggcaaaggtttctaccgggtgtgactgaagggagagagccctctctgtgctgctaag

SEQ ID NO: 4600 - DNA, 82 bp, Homo sapiens
cctgagagcagcgagcagattgcggagtcgaagggcaaagccatcttcagatttctatagtgtctctctgtctttctcatgg

SEQ ID NO: 4601 - DNA, 95 bp, Homo sapiens; identical to SEQ ID NO: 68

SEQ ID NO: 4602 - DNA, 93 bp, Homo sapiens; identical to SEQ ID NO: 69

SEQ ID NO: 4603 - DNA, 105 bp, Homo sapiens
gagagctgtaacactaccaatgagcttgacatagaggtgaagggcatctttctttctttttttttttttttctgtcaccaggctggagtacagtggcacaatctc

SEQ ID NO: 4604 - DNA, 82 bp, Homo sapiens
gctgagtggggtgtcacaggcctatagtctcagctactcaggaggctgaggttggaggatggattgcttaagcctgggaggc

SEQ ID NO: 4605 - DNA, 78 bp, Homo sapiens
gctcagtactgagatacattatcagtgaaggcaccctgaatgcctctggtctctgatgggtatcgctcagtaatcagc

SEQ ID NO: 4606 - DNA, 95 bp, Homo sapiens; identical to SEQ ID NO: 68

SEQ ID NO: 4607 - DNA, 93 bp, Homo sapiens; identical to SEQ ID NO: 69

SEQ ID NO: 4608 - DNA, 78 bp, Homo sapiens
gccttcggctggggttgctaaggcatgagggatgcatgctgtctccccaccctcactctctgtctccgccgtgaaggc

SEQ ID NO: 4609 - DNA, 124 bp, Homo sapiens
atataagttcacaagtgtgtgtgtgtgtgcgcacaggtgtgtatgtgtatacgtacgtgtgtgtgcatgtgtatctgcaggtgtgcacctggaggggtgtatgtgtaaatgcacctgtacgcat

SEQ ID NO: 4610 - DNA, 114 bp, Homo sapiens
ctgagaatgtctgggagcttgcagttccataccagaaatagatgccctttcactccgaagtttccagatgacatcagctcacacaagaggaacactctggaaatggggcttttc

SEQ ID NO: 4611 - DNA, 119 bp, Homo sapiens
atagttttgcattttacatttgggtccacaattcattctgagtgtgtgcatttgtgtgtctatatctgtgtgcatgtctatacttgtgcatgtgtgtatctatatgtgtgtatgtctat

SEQ ID NO: 4612 - DNA, 99 bp, Homo sapiens
atatatacacacatatatatgtgtgtgtatatatatacacacacatatatatgtatatatatacacacatatatatgtatgtatatatatacacacata

SEQ ID NO: 4613 - DNA, 112 bp, Homo sapiens
atatttacatctgtatgtgtgtatatatatacatacatatatatgtgtgtatatatatacatatatatgtgtgtgtatatatatacacacacatatatatgtgtgtatatat

SEQ ID NO: 4614 - DNA, 98 bp, Homo sapiens
ggagtggcgttaaagcttgctctggctcagtccctgtgtgcatccatgaggtcatagttccatgaggttccatccagctcaagctctgtggccgggcc

SEQ ID NO: 4615 - DNA, 117 bp, Homo sapiens
caaaattctgagttcttaaatgaattgtgggctaaagggttctttttagaaattttttaattttatttttgtgggcatgtagtaggtacatattcatggagtatgtgagatgttttg

SEQ ID NO: 4616 - DNA, 113 bp, Homo sapiens
tgatgtactgggtgaaaggaactgagttaaataaggctttagtatgagattttgtatttctctggctaggagttaggctttgtttactctttgctatatagtcatggatgtca

SEQ ID NO: 4617 - DNA, 71 bp, Homo sapiens
tctaaaacttggtaattaaaggtaagtaaagaataatgtattctttctctgcagtggaactaagttttaga

SEQ ID NO: 4618 - DNA, 77 bp, Homo sapiens; identical to SEQ ID NO: 4589

SEQ ID NO: 4619 - DNA, 90 bp, Homo sapiens
agcaatctctgtatcccattcatatatatacatatatatacacacacatatatatatatatgtgtatatatatttgttgttgtcgttgtt

SEQ ID NO: 4620 - DNA, 115 bp, Homo sapiens
ctaactggatatttgataattttaaaggattattacatttttagatgtgataatgatgttgttattacattttataaagaagtcttactttttagagatgatcatatctttttag

SEQ ID NO: 4621 - DNA, 96 bp, Homo sapiens
gactcccagtctccagcttgagccctaggaagccatccctgactgtatctcacacagccactcagggaaggcagccagtggaactggagaggagtt

SEQ ID NO: 4622 - DNA, 90 bp, Homo sapiens
gctaatggagtactgttctagagtggatcttggccctctgctgtgttatatagttttccaggaaagcattggatagcccttaatacgagc

SEQ ID NO: 4623 - DNA, 67 bp, Homo sapiens
gagacagaagtgggggtgcacagagggccggaaggatgctgggacccctgtcagctctgcttctctt

SEQ ID NO: 4624 - DNA, 74 bp, Homo sapiens
gggtattagaatttttagttcttcaggtgattgtgatggtcacctgaggttgaaaactactgtttttgaagctc

SEQ ID NO: 4625 - DNA, 115 bp, Homo sapiens; identical to SEQ ID NO: 4620

SEQ ID NO: 4626 - DNA, 89 bp, Homo sapiens
ggccaatgggaacagagggtgcagtccggtgcaggaaggctgggtgatgcccacctctctctgccacactgtctcctgcccccggtgcc

SEQ ID NO: 4627 - DNA, 82 bp, Homo sapiens
gcaggtctcagtgatgtctgagccacccctggggaccagacaggcctggcctccccctctctcactgaccctctcccagacc

SEQ ID NO: 4628 - DNA, 70 bp, Homo sapiens
ggcacatgagacagaagtgggggtgcacagagggccggaaggatgctgggacccctgtcagctctgcctc

SEQ ID NO: 4629 - DNA, 63 bp, Homo sapiens
tgtgagccaccatgcctggctgaattttttttttttttgagttataagagcatgggcctcaca

SEQ ID NO: 4630 - DNA, 96 bp, Homo sapiens; identical to SEQ ID NO: 4621

SEQ ID NO: 4631 - DNA, 115 bp, Homo sapiens; identical to SEQ ID NO: 4620

SEQ ID NO: 4632 - DNA, 77 bp, Homo sapiens; identical to SEQ ID NO: 4589

SEQ ID NO: 4633 - DNA, 71 bp, Homo sapiens; identical to SEQ ID NO: 4617

SEQ ID NO: 4634 - DNA, 113 bp, Homo sapiens; identical to SEQ ID NO: 4616

SEQ ID NO: 4635 - DNA, 117 bp, Homo sapiens; identical to SEQ ID NO: 4615

SEQ ID NO: 4636 - DNA, 72 bp, Homo sapiens
gcagtcaggactgtctggctcagtgaatcttgttaactacacagatctttgaagtaaaaatattctggctgt

SEQ ID NO: 4637 - DNA, 95 bp, Homo sapiens; identical to SEQ ID NO: 580

SEQ ID NO: 4638 - DNA, 93 bp, Homo sapiens; identical to SEQ ID NO: 69

SEQ ID NO: 4639 - DNA, 85 bp, Homo sapiens
gctgagactgggagaggagactgtaggcacaggtcatatttcaagtatgaaaaaatgtttctttattggctccctagggtttagt

SEQ ID NO: 4640 - DNA, 65 bp, Homo sapiens
tgggcagcatccttagggagactaaactgctagtgcctctgcatccctccctgcctgttagccta

SEQ ID NO: 4641 - DNA, 117 bp, Homo sapiens; identical to SEQ ID NO: 4615

SEQ ID NO: 4642 - DNA, 96 bp, Homo sapiens
aagctgctgatggtgtctgtggttcagaagctacaaagcatccattttgtagagtggtctttttgttgttgactgtacatttcagaatgcttgaag

SEQ ID NO: 4643 - DNA, 98 bp, Homo sapiens
tcagaggtgttaggtagaaaaagcagaaaataagtcttatttatgtagaacgttctattgtattcatatttatgtgttttcatacacaataagtctgg

SEQ ID NO: 4644 - DNA, 98 bp, Homo sapiens
cacaaaaacaaccaacctctttgctgccaaccactctctctgtcagagtcgcctccaagtgcgttcggcatggggctggttggaaggtgaaatcttgg

SEQ ID NO: 4645 - DNA, 90 bp, Homo sapiens
gccttactgatttttgttatcaaatttaagagtcttttggaggagtctttaaggttttctaggtgtatgatgatatcattggtgagcagc

SEQ ID NO: 4646 - DNA, 107 bp, Homo sapiens
tattccaccatggtctgagaatatattaatacttgatatgatttcaatatttttaaatgtattgggacttgtttggggagttatcatataatctatcttggagaata

SEQ ID NO: 4647 - DNA, 125 bp, Homo sapiens
tccagactctgaaagtcagtgactaataagatgtggccccctgatcactggcatctgtagactgctgaatggtgtcttggataaagtatgtgcccatttatttttcttgcatgatgaataatcgg

SEQ ID NO: 4648 - DNA, 69 bp, Homo sapiens
gtttagacatccatgtggcactttgtgcactcgtgtggtaaatgcacagagtgctagtaggttctatac

SEQ ID NO: 4649 - DNA, 196 bp, Homo sapiens
atatatatatatatatatgtatgtgtatatatatatatacagaaaagatatatatgtatgtatatatatatacaggaaatatatatgtgtgtttgtatatatatatacagaaaatatatatatgtatgtatatatatatatatacagaaaatatatatatgtatatatatatatatatatatataagagctgggta

SEQ ID NO: 4650 - DNA, 99 bp, Homo sapiens
ttgtttgttttggagtttttttgagacagggtctcactgtgtcacccaggctagagtgcaatggcatgatcttggctcagtatacccaggctcaagcaa

SEQ ID NO: 4651 - DNA, 112 bp, Homo sapiens
tacagaaacctaagcaagactgacagactgacaaatctgacttctttttttttttttttttttttttttttgagacggagtctcactctgtcgcccaggctggagtgcagtg

SEQ ID NO: 4652 - DNA, 101 bp, Homo sapiens
ccgaggtgggtggatcacttgaagtcagaagtttgagaccagcctggccaacatgaagaaactgtgtctctactaaaactacaaaaattagccggacttgg

SEQ ID NO: 4653 - DNA, 80 bp, Homo sapiens
gccctgctctcacactcagagactcagctccaccacgcctctctggcagccagttggggtcactgaggcagaaacagggc

SEQ ID NO: 4654 - DNA, 58 bp, Homo sapiens; identical to SEQ ID NO: 2595

SEQ ID NO: 4655 - DNA, 92 bp, Homo sapiens
gtctatttgtttacttctcatttggaatgaaatggagtatgttccatttggagcagcaatttctaatttttttccagctgcagtttgacaaa

SEQ ID NO: 4656 - DNA, 94 bp, Homo sapiens
tggggattataatttggtgtgagatttgagtggggacacagatccaaatcatataagtccctcccctgaccatctccctaagttcctctcccta

SEQ ID NO: 4657 - DNA, 80 bp, Homo sapiens
cggagaaagaagaatgagggatgtcatgtgctgcaaactgcaggcaaacaaggacatattctctcaactctgtctctctg

SEQ ID NO: 4658 - DNA, 74 bp, Homo sapiens
gccatttaggaggaagacagtgtgcacactgcttacacagagaatgcacagttgtcttccttaaagttttcagc

SEQ ID NO: 4659 - DNA, 59 bp, Homo sapiens
ttgagacacagtctctctctgtcgcctgcccaggctggagagcagtggcgtgatctcgg

SEQ ID NO: 4660 - DNA, 84 bp, Homo sapiens
gaataaatggctgtgtctccctcactcaccgacccatgaagaggcatcagtggtcaagggggctggtgaccaggagttgttcac

SEQ ID NO: 4661 - DNA, 88 bp, Homo sapiens
ttgagcactactgtgtcacacacggcctgagtgcctgcccccatcttcagagaatggcacccgggtctggttggctcacctcactcaa

SEQ ID NO: 4662 - DNA, 119 bp, Homo sapiens
ggtctaaggcactgctcacttactctgattgccatcttcagcatcatcgtgatgatgataatgatgatgatgatgatgatataacaagatagtagcaataacaagagctgcctcctccc

SEQ ID NO: 4663 - DNA, 99 bp, Homo sapiens
tccgtcctctgccccatccccgtctcacacagtctcagccactttctctcctagacccctggctggactgttctcaggcctgtgctaagtaaaggtgga

SEQ ID NO: 4664 - DNA, 69 bp, Homo sapiens
gcactctctctctctatctgctcaaacactgagaagaggtcatgtgagcatacagtgagatgtggctgc

SEQ ID NO: 4665 - DNA, 117 bp, Homo sapiens
gaggattacatttaataagcagagacaataaaaggatctaaatgaaagtaagatttctacacttgtgttattgattttctgcattgtctttctgttttaatttccttgatttctgct

SEQ ID NO: 4666 - DNA, 70 bp, Homo sapiens
cacacagcttgacatatggacactgtctggcagcaggttagattagaggtggacggggtacggatgtgtg

SEQ ID NO: 4667 - DNA, 58 bp, Homo sapiens; identical to SEQ ID NO: 315

SEQ ID NO: 4668 - DNA, 108 bp, Homo sapiens
gcttctgcagacctctgtccccgctcctgcttcatcaccctgacctgcccctgtgctgagagaggacagatgagagggtggggccagaggctctgcaaactgtgaagt

SEQ ID NO: 4669 - DNA, 73 bp, Homo sapiens
tatgagaggaggcaagtgtgatggagttttccatgaggaccaagtcagcccttctaagtgtctctctctcata

SEQ ID NO: 4670 - DNA, 77 bp, Homo sapiens
caggggtagtgcagagagcacagaattgagaatccagagaactgggttcttgtctaggctctgaccctaccttcctg

SEQ ID NO: 4671 - DNA, 70 bp, Homo sapiens
ttgttttgagatgaagtctcacactgtcacccaggctggagtgaagtggtgtgatctcggctcattgcaa

SEQ ID NO: 4672 - DNA, 58 bp, Homo sapiens
tgagactgagtctcgctctgtcacccaggctggggtgcagtggcgcgatcttggctca

SEQ ID NO: 4673 - DNA, 99 bp, Homo sapiens
gcttaatggcatgggtgagccaaccctcaggtgcccgggagggagccctgattactctccctctggcactctgggcattggctaacccgtgaccggagt

SEQ ID NO: 4674 - DNA, 90 bp, Homo sapiens
gctctaaaagacaatattgggacactggtgaactttttttttttttttttttttttgaagacaaggtctcactgtctcccaggctggagt

SEQ ID NO: 4675 - DNA, 80 bp, Homo sapiens
gaggacagtgaatcagaaggacgtagatcccctcactgtatcactgtgtgtgtatctactcactgtgcgtgcgtgttctc

SEQ ID NO: 4676 - DNA, 98 bp, Homo sapiens
cagttgggagcaaggccagaggaggaagtgagaggaggaaagctgacccgcgctctctccgactcactgcccgccagctctcctccccactgacttcc

SEQ ID NO: 4677 - DNA, 83 bp, Homo sapiens
gtaatccctggttccttctagtgggggatggtaattagacatcaaggtctgagtgctcagagtgctcattggtagtggttaca

SEQ ID NO: 4678 - DNA, 86 bp, Homo sapiens
actgggtggtgagtgagtaggctgtgtggataggaggttttccagcagtgtaacaattctcagtccactttgtgccatgcaccccc

SEQ ID NO: 4679 - DNA, 113 bp, Homo sapiens; identical to SEQ ID NO: 4616

SEQ ID NO: 4680 - DNA, 114 bp, Homo sapiens
tttcatgagaattgcaataaatttctgttttttttcctcttaagaactgacagttttatagtttttgaatataatattttctttttctgggggggggttgtttgttgtttgaga

SEQ ID NO: 4681 - DNA, 56 bp, Homo sapiens
tgtttgtctgtttgttttgcgacagagtctcactctgtcgcccaggctggagtgca

SEQ ID NO: 4682 - DNA, 133 bp, Homo sapiens
tgacagatgtaagagattttaaaatatctatactatgagtttgcgtgtgtgtgtgtgttggagtctcactctgtcacccaggttggagtacagtggcacgatctcagctcactgcaacctccgcctcccgggt

SEQ ID NO: 4683 - DNA, 95 bp, Homo sapiens; identical to SEQ ID NO: 68

SEQ ID NO: 4684 - DNA, 93 bp, Homo sapiens; identical to SEQ ID NO: 69

SEQ ID NO: 4685 - DNA, 83 bp, Homo sapiens
tcagcttatcagctttaattctctgtttccttttttttttttttttttttgagacggagttttgctcttgttgcccaggctgg

SEQ ID NO: 4686 - DNA, 94 bp, Homo sapiens
gaatgtgggccttggatgtcttctggttcaggccactgtggtacacccctcagggtctctgtctgacagccacctggcctctgttggaacattc

SEQ ID NO: 4687 - DNA, 117 bp, Homo sapiens
gctctggaatcttaagctgtatggtgggaaccaaagtgttcattattttattctttctttttttttttttttctgagatggagttttgctttgccacccaggctggagtgcagtggc

SEQ ID NO: 4688 - DNA, 118 bp, Homo sapiens
gagcccaggtcaccttcttatcaatgctctgccttgtctctgtgccttcctgtctgtctgtatgtgtatgtgcctgttgacagtaaggcatagtttaacccagtagaactaccggttt

SEQ ID NO: 4689 - DNA, 116 bp, Homo sapiens
atatatatatatgatacatatatatatatatacctgtatataataggatattatatatctgtatataataggatattatatatctgtatataatatacaataggatatatatatat

SEQ ID NO: 4690 - DNA, 66 bp, Homo sapiens
gtagctgctattgtctgcctcacttcactagtaatggtccagggaggcctttaatgtgcatggtgc

SEQ ID NO: 4691 - DNA, 100 bp, Homo sapiens
tttgagagagatgctatgttcatagattagaagaatcaactgaataaagacatcagttctttttaaattaatgtataggcataatgcaattcttatcaaa

SEQ ID NO: 4692 - DNA, 115 bp, Homo sapiens
gggtaggattgactcacgtgacttgcttcattgggaggggttggaggagatatatttatatatataaattctgcacaccctatctcagttgaccgagagctttcaacatcagccc

SEQ ID NO: 4693 - DNA, 70 bp, Homo sapiens
gttgttgagatggagtctcactctgtcacccaggctggagtgcaatggtgtgatcttggctcactgcaac

SEQ ID NO: 4694 - DNA, 105 bp, Homo sapiens
gtgtttgctcatttactagggcagtgattggcacatggtatgaatgaatgaatgaatgaatgaatatgggggttggccatttggtgggtctagttgggattacac

SEQ ID NO: 4695 - DNA, 99 bp, Homo sapiens
agcctgtgggtctctaggtgtgccagtcatccagatgggggcaaagctgccagtcccactgactgtttgagtgattctcttgggaggctccatcctggc

SEQ ID NO: 4696 - DNA, 81 bp, Homo sapiens
ggaaccatgcgccaaattctgaccctctctgtcactctctgctcgtgtgcgttagtcataggaggtcatggaaaatcatcc

SEQ ID NO: 4697 - DNA, 65 bp, Homo sapiens
ttgagagtgagtctcactctgtctcccaggctggagtgcagtggtgtgatctcgactcactgcaa

SEQ ID NO: 4698 - DNA, 103 bp, Homo sapiens
gccagatcccacaggcaccccagtggcaagacagggtgcatttttttttttgagacagtctcactctgtcacccaggctggggtgcagtggtatgatctcagc

SEQ ID NO: 4699 - DNA, 96 bp, Homo sapiens
gaccccagaccatccaccttccggtctgcagctctctctgccctttccctgctccagtatgaagagagtgagcccaggtggcctcgtccagggctc

SEQ ID NO: 4700 - DNA, 60 bp, Homo sapiens
ggaggctctctctctcaggctcacgcaagggcagggttggccctgagagcaagtgcctcc

SEQ ID NO: 4701 - DNA, 81 bp, Homo sapiens
ggacattctcagtctggcagacaattggcagaggcagatgcagcttctgcaatgcttgactgaagggactgaggacagtcc

SEQ ID NO: 4702 - DNA, 89 bp, Homo sapiens
gggtagcaaattatttctatgaggctcatattgttagcaaggaaggacttttttttttttttttgagatggagtctcactctgtcgccc

SEQ ID NO: 4703 - DNA, 74 bp, Homo sapiens
attctgggttggaattcttttctctctcttttttttttttttttgagacggagtctcattctgtcacccaggat

SEQ ID NO: 4704 - DNA, 76 bp, Homo sapiens
aatatgtgctcatatatatatatgctatacatatatatatatgtatgctgatatatgtatgtggaagcaatatgtt

SEQ ID NO: 4705 - DNA, 102 bp, Homo sapiens
gatttaaaattgtcaatgaaatagttgattgatcatttatatttctataaatatatggaaaataatctattttttaattgtaagacattacaattttagatt

SEQ ID NO: 4706 - DNA, 118 bp, Homo sapiens
tctggaggcctaggaaagtgttattgaaagtattttaaatcttagtatcttatatttatcatttatagggtatagtagattaagaaatacttcacgtattttgaaagattgggctgga

SEQ ID NO: 4707 - DNA, 81 bp, Homo sapiens
ggtatggtggcctgtgcctgtaatcctagctactcgggaggctgaggtaggaggatcacttgggcctgggaggtcaagact

SEQ ID NO: 4708 - DNA, 95 bp, Homo sapiens
gcactatgcctgcctcaagatgtttctgactttttctttttcttttttctttttttttgagatggagtcttgctctgtcacccaggctagagtgc

SEQ ID NO: 4709 - DNA, 105 bp, Homo sapiens
gtttagttttctgctttgtggttacaatattgttttttaaatattcaacatgaatacactttcttgtttggataacgtgtaaaacgtctacaaggagggatagat

SEQ ID NO: 4710 - DNA, 104 bp, Homo sapiens
ctgtgtacaagcgcattctggtttcagtggaaagtgaggcctctccagatggttagtgccccgctcactcagtcactgactaacaaccctgcctctactcacag

SEQ ID NO: 4711 - DNA, 78 bp, Homo sapiens
tccccaacatgtctagtaaccaaggagtggacataggagcgccccgctcgctagcactctcagtgacacacttgggga

SEQ ID NO: 4712 - DNA, 117 bp, Homo sapiens
gagtctagatggtaaaagtgaactagtgaaagggaagaatgagttttgttttggatggcatctcattattttttattttctttttatttatatatttgtttttcttatttttttttc

SEQ ID NO: 4713 - DNA, 106 bp, Homo sapiens
cttgggacctttgaatgcttcttatctaagtgatctgtttttatttatttaccttgcattagcatggaccagtgaggttgtttggaaaatgagcacaatatttaag

SEQ ID NO: 4714 - DNA, 108 bp, Homo sapiens
tactcagtatatttctacagaatttctggttgtattatttatagtttctttttaaagatagaaactgaaaactgtgcttaagatttcacatagaataatgatggagta

SEQ ID NO: 4715 - DNA, 93 bp, Homo sapiens
gaatttcagatgtgatgatagtccaggagagaaggtatttttttttaaaatcacagttgcctttcctgttgtctcaaataatcctgtgtgttc

SEQ ID NO: 4716 - DNA, 58 bp, Homo sapiens
tgagatggagtctcactctgtcacccaggctggagtgtagtggtgcgacctcagctca

SEQ ID NO: 4717 - DNA, 72 bp, Homo sapiens
tatacacatatatttgtatacttctgtatatgtttatatacatatatttgtatacattggtatatgtatata

SEQ ID NO: 4718 - DNA, 80 bp, Homo sapiens
cagtgacagctgaaagagtggtatacgggggcattagcttacctcttcctaaactctgtaacactcaccctcaatcactg

SEQ ID NO: 4719 - DNA, 99 bp, Homo sapiens
tttgtcatccatctagaatctgtttttatatataagaaaaggtgtatatgtttgcgcaagtgtgtgtgtgtgtgtttgggggggcggggtgggggcaga

SEQ ID NO: 4720 - DNA, 58 bp, Homo sapiens
ggagacagagtctcgctctgtcactcaggctggagtgcagtgacgtgatcttggctcc

SEQ ID NO: 4721 - DNA, 104 bp, Homo sapiens
tcagaaaatatgtgtaggagatgagtatgtttatttgtactacacatatgataatatcctaacaaatttttcttccagcttaatttcctaattttattttctga

SEQ ID NO: 4722 - DNA, 75 bp, Homo sapiens
gattttgtgtagacatatgtttttatttatcttgggcatatacctaagagtagaatatatgtacttaggagggtc

SEQ ID NO: 4723 - DNA, 63 bp, Homo sapiens
gccttggtagtagagttgtgagcactttcttttttttagacagtctcacactattgcccgggc

SEQ ID NO: 4724 - DNA, 71 bp, Homo sapiens
cagaggggagaagtacaatcctactgtgtctaaaggaggacaggaggaaatactgtctttctcactctctg

SEQ ID NO: 4725 - DNA, 105 bp, Homo sapiens
gatatctagttgagaataatagaatactagtttagtacttttttatacttaaatagtgttttagtacttaattataagttttaattaaagcttagcgcaggggtc

SEQ ID NO: 4726 - DNA, 97 bp, Homo sapiens
ggccacgtttagcaccatttacatgtgagattatttctgccctgggactatcactcactccctactcagatttcagcaccaaaatgtcaaactggcc

SEQ ID NO: 4727 - DNA, 61 bp, Homo sapiens
tgagtcagagtctcgctctgtcaccaggcaggctggagtacaggggcgcaatctcggctca

SEQ ID NO: 4728 - DNA, 77 bp, Homo sapiens
gttctaggtgagcagaaattctatttttttaactacaactctctaaaagatatcagaagtcactgctaatctggggc

SEQ ID NO: 4729 - DNA, 95 bp, Homo sapiens; identical to SEQ ID NO: 68

SEQ ID NO: 4730 - DNA, 93 bp, Homo sapiens; identical to SEQ ID NO: 69

SEQ ID NO: 4731 - DNA, 65 bp, Homo sapiens
cataataaatcatgtatatatatataagacttatatatgtatatgtgtgtatgcatgtatgtgtg

SEQ ID NO: 4732 - DNA, 80 bp, Homo sapiens
atatgtatatatatatacgtatatatacgtatatatatatgtatatatatacgtatatatacgtatatatacgtatatat

SEQ ID NO: 4733 - DNA, 121 bp, Homo sapiens
ttcctggctgggtttggtggctcatgcctataattccagcacactgggaggctgaggtaggaggatcacttgaggccaggagcttgagaccagcctgggcaacatagtgagaccctgtctc

SEQ ID NO: 4734 - DNA, 82 bp, Homo sapiens
tggtgttctctctctgtgtgtgtgctcctggtatctctccctcttcctacaaggacagcaattatatagaattagaatccca

SEQ ID NO: 4735 - DNA, 93 bp, Homo sapiens
aggatgccttgagagatgtcagtgtgcacccatggatagaagcagctggtgactgggtacttgggaagccacatggacacacacaaagctcct

SEQ ID NO: 4736 - DNA, 232 bp, Homo sapiens
atatgtatatatgtatatgcacatatacatacatatgtgtgtatatatgtatgtacataaatatatgcatgtataaatatatgtatatatgtacatatatgtgtatatatgtacatatgtgtatatatgtacatatatgtgtatatatgtacatatgtgtatatatgtacatatatgtgtgtatatgtatatatgtgtatatatgtacatatatgtgtatatatgtatgtat

SEQ ID NO: 4737 - DNA, 102 bp, Homo sapiens
tatgtgtgtataggtatatatatatatgtattcattttatctgtaacatataaatatatatatgaatacatatatatgtattcattttatctgtaacatata

SEQ ID NO: 4738 - DNA, 107 bp, Homo sapiens
ctcaggttctgaccttcctgcttccctcatgcggggactcttgtgattatattgtacctaacagtacaatccaggataatccccccatttcaggatccttacctgag

SEQ ID NO: 4739 - DNA, 94 bp, Homo sapiens
gtctggcatgtagtaaattgaaacaagtggaaatcatttttattattacaatgactatgattatacttacaatggggacttttctggctcagac

SEQ ID NO: 4740 - DNA, 114 bp, Homo sapiens
tttggatttcacctggctctctcactatatgtgtgtgtacacacacacacacacacacacacacacacatatgtatatatatacacacacatatagatatttaggttctttaaa

SEQ ID NO: 4741 - DNA, 90 bp, Homo sapiens
tcatagtcttttgaaaggatattcaaaacttattcattggtgtccactgagggttttttttattttgaatattttaaaaagttactatga

SEQ ID NO: 4742 - DNA, 89 bp, Homo sapiens
cgtccaaattttatcaagttacatagatatgtatgtatatttgtatatatgtacacatacgtacatacatatggtcttatagtatggtg

SEQ ID NO: 4743 - DNA, 56 bp, Homo sapiens
gtgacctcttgaggcttaagagaaagaaaacatttttttttttgctaagaggtggc

SEQ ID NO: 4744 - DNA, 118 bp, Homo sapiens
aacatatcctttaaggtagaagtagataggtgatcatcattcaaattttatattttattacttaattgcatggtgttttccatttgcctatgattttattttttagctaagatatgtt

SEQ ID NO: 4745 - DNA, 68 bp, Homo sapiens
gtgcctggctgagttagtatttttaagtacttatttttaaggtatttttaatgtacagagcctggcat

SEQ ID NO: 4746 - DNA, 107 bp, Homo sapiens
ccagtccttcttgacaggatgtgcctcatgctgaggatgtctgtctgtctgtctgtctgtctgcctgattcattggcacatgtctttttgtctggacttagtactgg

SEQ ID NO: 4747 - DNA, 79 bp, Homo sapiens
ggaggctgttcactgcaccatcattagagcacacaggctctctctgtctctgagatctcccaatgccagtgaaatctcc

SEQ ID NO: 4748 - DNA, 95 bp, Homo sapiens; identical to SEQ ID NO: 68

SEQ ID NO: 4749 - DNA, 93 bp, Homo sapiens; identical to SEQ ID NO: 69

SEQ ID NO: 4750 - DNA, 66 bp, Homo sapiens
tgtatctatatctatatataaacatgtgtgtgtatatatatatatttatatatagctgtagataga

SEQ ID NO: 4751 - DNA, 93 bp, Homo sapiens
tttcccagaggttttgttcattttttaaaattatttttttaatttgtttgtgtttgagttgatttgaagaagtggtctttgagctctgagaag

SEQ ID NO: 4752 - DNA, 99 bp, Homo sapiens
ctgcatgtgcccgaggacgtgtggggtggtccgtgtagctgggcctgtccaggcagagccatcagagtcagcacagccccgctcaggatgccggcagca

SEQ ID NO: 4753 - DNA, 104 bp, Homo sapiens
acatgtacatacacacatacgtatatacaaatatatgtgtgtatatatataattcttatatattcctttatatatatttcatatgtgtgtgtgtgtgtgtgtgt

SEQ ID NO: 4754 - DNA, 108 bp, Homo sapiens
ttttgccccaggaagcatacacaaaaacagggctggaactgggaaataccagaatttctgtgctcagaactgtgactgtatatcaatgtaaggccatggtggacaaag

SEQ ID NO: 4755 - DNA, 63 bp, Homo sapiens
gtggaggtgtatacatatgtatttgtatatgtgtgtttgtgtgtgtgtatacacttacggaac

SEQ ID NO: 4756 - DNA, 78 bp, Homo sapiens
caagaagccagtgtgcaagttcaagcctccattctgcaacagcaccatgtggttgtgatgattgatggctggctggtg

SEQ ID NO: 4757 - DNA, 93 bp, Homo sapiens
agtttggcagtgtacattttgggagctagtacgtagaaatgttaagtgcttcagatttgacaatatgattggtttttgttattctctgtggct

SEQ ID NO: 4758 - DNA, 108 bp, Homo sapiens
gtctgagagtagggccaatgacttaattcttacctttgggctcagaatgtaatatgatatgactgaaatcagagaggattagaagcatgttttgtctctagctgagac

SEQ ID NO: 4759 - DNA, 108 bp, Homo sapiens
tatctgtgttttactgtctgctcattctggctgcttgttgttaaaagagaagtgatttccttgaaatgcacgaggttagaaagggagctggaacttaaaacagtggta

SEQ ID NO: 4760 - DNA, 95 bp, Homo sapiens; identical to SEQ ID NO: 580

SEQ ID NO: 4761 - DNA, 93 bp, Homo sapiens; identical to SEQ ID NO: 69

SEQ ID NO: 4762 - DNA, 97 bp, Homo sapiens
tggtttgtaggatgggacttaacctttgccttgcatggccttttatttgtttttaattagccacaaagggactgttttgttattcttgtgatctcta

SEQ ID NO: 4763 - DNA, 87 bp, Homo sapiens
tatattctagggggccaagctctgtgactcactcttataaacctagtgctttgtgaggccaccagaggaggatcacttgaggatata

SEQ ID NO: 4764 - DNA, 95 bp, Homo sapiens; identical to SEQ ID NO: 68

SEQ ID NO: 4765 - DNA, 93 bp, Homo sapiens; identical to SEQ ID NO: 69

SEQ ID NO: 4766 - DNA, 73 bp, Homo sapiens
ttacctaccgcatttcctcatatttaataatttaaaaatgaatgagtagatatgtgaaagaaatgcaaggtaa

SEQ ID NO: 4767 - DNA, 92 bp, Homo sapiens
ataatttttggaaattatttcaaagaattaagagagggatatgctttatgtgtatttctttcaaagtaattttttaaataaccagtaattat

SEQ ID NO: 4768 - DNA, 74 bp, Homo sapiens
gtgcctggtagacgaagaggagcacagatcatcccccaggggcatctgtctatctgtctggctttgtcaggcat

SEQ ID NO: 4769 - DNA, 112 bp, Homo sapiens
cctaccgtgtaatggcaaaaacctcaattacttttgcactaatctcatatttacatacttatgtatgtatgtatgtatgtagttctctgtaatgtaagccccatagggcagg

SEQ ID NO: 4770 - DNA, 95 bp, Homo sapiens; identical to SEQ ID NO: 68

SEQ ID NO: 4771 - DNA, 93 bp, Homo sapiens; identical to SEQ ID NO: 69

SEQ ID NO: 4772 - DNA, 86 bp, Homo sapiens
catatatatgtacatatatatacatatacatatacatatacatgtacatgtgtatatatatgtatgtgtatatatgtatgtgtata

SEQ ID NO: 4773 - DNA, 96 bp, Homo sapiens
gcttctctgttttctggtgatggcctctctctgtgtctcatattcaaaagtcaggagcaggactaagattggcttcattagtcacaatagagatgt

SEQ ID NO: 4774 - DNA, 98 bp, Homo sapiens
cctagaggaaaataaacggggagagcctctttttaaaaattattttatttttattcatttatttaatttttaaacagtgtctcactctgtcactcagg

SEQ ID NO: 4775 - DNA, 74 bp, Homo sapiens
gtttttgttttgagatggagtctcactctgtcaccaagctagagtgcagtggtgcgatctcggctcactgaaac

SEQ ID NO: 4776 - DNA, 76 bp, Homo sapiens
ggcgtgagccactgtgctggccttttcattttttttttttttttttaagagacaaggtctcactgtcactcatgct

SEQ ID NO: 4777 - DNA, 113 bp, Homo sapiens
agtgagacttgggcatatttgggggatggatgggcttttattttgtctactgtaaacactgaagacagagagagcactaccttagaaatctgaaagaagctcatgtaaatatt

SEQ ID NO: 4778 - DNA, 104 bp, Homo sapiens
agaagttggcttattcactcatacgtattaagggccattgaatgagtttgagaaactcagagcatgttctttatttaagtatcgaggcttagctttgcgtgtct

SEQ ID NO: 4779 - DNA, 137 bp, Homo sapiens
acatatatacacatgtatacatgtaaacatatatatacatgtatacatgtaaacatatatatatctatatatgtttatatatgtatatatgtgtatatatgtatgtgtgtgtgtgtatatatacatatatatataga

SEQ ID NO: 4780 - DNA, 102 bp, Homo sapiens
acatatatacacatatatacatatataaacatatatagatatatatatgtttacatgtatacatgtatatatatgtttacatgtatacatgtgtatatatgt

SEQ ID NO: 4781 - DNA, 93 bp, Homo sapiens
ttgtcttggctatgcaggctcttttttagttccatatgaaatttaaagtagttttttctaattctgtgaagagagtcaatggtagcttgatgg

SEQ ID NO: 4782 - DNA, 103 bp, Homo sapiens
gatagcacaactctattatttgacatgtaattctgaaattgttcatgtgttctaagaaggatataatcagagttttgacccaaatgatagagggtaacacatc

SEQ ID NO: 4783 - DNA, 98 bp, Homo sapiens
tatatgtgtatatgtatatgtatatatacatatgtatatgtatatgtatgtatatgtatatatacatatgtatatgtatatgtatgtatatgtatgta

SEQ ID NO: 4784 - DNA, 109 bp, Homo sapiens
agttacaatgaccagagtctttttgattagtttttttttttttttttttgaaatttttaagttagaaaagcagggatttactatcagaaatattttgttctttataact

SEQ ID NO: 4785 - DNA, 111 bp, Homo sapiens
agtaattcttctctgtttttctcgtgtatttttatgatttttatttttttaatgttcaaatatgtgatgcatttggaatcattgtgatattatgtacaaagaagaatggct

SEQ ID NO: 4786 - DNA, 121 bp, Homo sapiens
tgctgctattgtcaatgtttgccctctttgctctaattttgtctccaggactggaaactaaatggctatggtagaactgagaatcaagtagtaatgtacagggtctgagcatgcctcaata

SEQ ID NO: 4787 - DNA, 98 bp, Homo sapiens
tttgtgctaatctggctaggagttggcataaatttaatttttaataaaaaatttaaatgtttaatattttatgtagccctagttgccagaacctcaaa

SEQ ID NO: 4788 - DNA, 83 bp, Homo sapiens
tgagagagagagagtctcactctgtcacccaggctggagtggagtggcgtgatctcgactcactgtaacctgggtctccaggg

SEQ ID NO: 4789 - DNA, 63 bp, Homo sapiens
ctttcacagtctctcattgagtgcctgtggcttttccaggcacatgatggaagctgttggtgg

SEQ ID NO: 4790 - DNA, 81 bp, Homo sapiens
tccgacaacaagtgtattcttccaaagagcatcaccagacactgtgtctgtgtcttagttgtaagaatgcgagatgcagga

SEQ ID NO: 4791 - DNA, 133 bp, Homo sapiens
agatccccttcattcatatctaatgtagataatatttggaattttgatctgataaaatttagaagtgattttgttgatgtttaatggattgatgcttttggggatcttgggatgtggtgaatgtcttctgcat

SEQ ID NO: 4792 - DNA, 90 bp, Homo sapiens
aatttcccatctatgcagaactacaaggtaggataggaaatgtagggttttagattttaatcctctgtagtcaaaagtagcagggaaatt

SEQ ID NO: 4793 - DNA, 116 bp, Homo sapiens
gatgaaaggatttcctttaagtttgaatagcattccattgtgtatgcatgtatgtgtgtgtatatatatatgtgtgtgtgtgtgtgaatatttcacattttctttatccattcatc

SEQ ID NO: 4794 - DNA, 114 bp, Homo sapiens
gttctttttgcttaggattgtcttggttgtatgggctcttttttgattccacgtggaatttaaagtagttttttctaattctgtgaagaaagtcagtggtagcttgatgagaat

SEQ ID NO: 4795 - DNA, 93 bp, Homo sapiens
aagttttcttgtaaaaatagaaagggtaagtttcttttagcttactgcaaagagagagtatagagagtggtgccttttggtaagaggaaattt

SEQ ID NO: 4796 - DNA, 92 bp, Homo sapiens
tgactttttaaatttaatatatatagtgtatatatagtatatatatgtgtgtatgtgtgtatatatatatgactttttaaatttaattgtca

SEQ ID NO: 4797 - DNA, 107 bp, Homo sapiens
tcctagtttctatgagtgctgcctagagtttgccaccacctacctgtgcattgttgataggtccatatgtattattcctaggacagttttaatcattctaggaatta

SEQ ID NO: 4798 - DNA, 66 bp, Homo sapiens
ttgagcctgtgtgtgtctctgcatgtgagatgggtccccagaacacagcacactgatgggtcttga

SEQ ID NO: 4799 - DNA, 79 bp, Homo sapiens
gtatatgtacatatatatgtagtatgtatatatatacatatatacacactatagtatatacatatatatactatatata

SEQ ID NO: 4800 - DNA, 131 bp, Homo sapiens
atatatactgtatatagtgtatatactatttatatagtacatatatactgtacatagtgtatatatttatatagtacatatatactgtatatagagtatattctatttatatagtacatatatactgtata

SEQ ID NO: 4801 - DNA, 72 bp, Homo sapiens
agcatgttctggtcagttgtctgcctgtgactggctgaagctcagttgcttgtgattgactaaaacctggct

SEQ ID NO: 4802 - DNA, 66 bp, Homo sapiens
tgtgtgtgtgtttactgagtcggtgggtataatgactgacccactgactcagtgaacgcacacaca

SEQ ID NO: 4803 - DNA, 77 bp, Homo sapiens
tgactgtgttctctggctcctcgaggttaagaatctactgcactgtggagatcgaggtgctactggaccaatggtca

SEQ ID NO: 4804 - DNA, 67 bp, Homo sapiens
tttatgtgacggagtctcactctgtcacccaggctggagtgcagtggtgagatcttggctcactgaa

SEQ ID NO: 4805 - DNA, 76 bp, Homo sapiens
atgacatataatttgtataactatagatataaaactttataactgtagttatataaatttatatataactagtcat

SEQ ID NO: 4806 - DNA, 99 bp, Homo sapiens
tcaatttctggggagctagtgtgatcttttgggggtatcataggacctttttttttattatattaccagaagttacttttctggttccttctcatttgg

SEQ ID NO: 4807 - DNA, 105 bp, Homo sapiens
attgctacagttgctatcaccacagggaaagcttatggcctgggacaggtggagttcttaactcaggctgcttagagcttagctgggtgcttttattggagtaat

SEQ ID NO: 4808 - DNA, 58 bp, Homo sapiens; identical to SEQ ID NO: 1215

SEQ ID NO: 4809 - DNA, 115 bp, Homo sapiens
tatatattatatgtgcaatatataatagtatatatcatatatatgtaatatataatataaatatataatatgtgtgtgtatgtatatctatataatatatatgtgagtatgtata

SEQ ID NO: 4810 - DNA, 86 bp, Homo sapiens
tatgtgcatatatatatatgtatgtgtatatatatatatgtatgtgtgtgtgtatatatatgtatgtgtatatatatatgtatgtg

SEQ ID NO: 4811 - DNA, 97 bp, Homo sapiens
cataactaacaacctccatgatttcagaaacttgcaacaatatagatttattttctatgaatgctatatgtttgccatgggtcagctgtgagttctg

SEQ ID NO: 4812 - DNA, 95 bp, Homo sapiens; identical to SEQ ID NO: 68

SEQ ID NO: 4813 - DNA, 93 bp, Homo sapiens; identical to SEQ ID NO: 69

SEQ ID NO: 4814 - DNA, 65 bp, Homo sapiens
gtgagagagagtgagagagacagagtgagggaggtaccacacacttttaaatgactagatctcac

SEQ ID NO: 4815 - DNA, 85 bp, Homo sapiens
gtgtgcagtggggctgtgctgtcaactgtgtgtgcagtcatgctgtggtgcagttagcacacagtcaaggcactggcagacatgg

SEQ ID NO: 4816 - DNA, 89 bp, Homo sapiens
tggaaaattcgtagtctgatgatgcaatagaaaagaataactattttttttttctgaggagaaagtctagctggctgcagaaatttgca

SEQ ID NO: 4817 - DNA, 72 bp, Homo sapiens
aatccttagtccacactctgtttcagtgtccctttctaactgtgggctcctcgagggtggagactaagtgtt

SEQ ID NO: 4818 - DNA, 110 bp, Homo sapiens
agtggtgtagtattctgacctggaaactgtctcgggtcagccttcttctttcacagagatgagagtgaagagccagagagatgaaattccttgttaaaaattacacagct

SEQ ID NO: 4819 - DNA, 95 bp, Homo sapiens; identical to SEQ ID NO: 68

SEQ ID NO: 4820 - DNA, 93 bp, Homo sapiens; identical to SEQ ID NO: 69

SEQ ID NO: 4821 - DNA, 113 bp, Homo sapiens
gtgttcctatttctccacagcctcgccagcgtgtattgtttcctgactttttttttttttaattatactttaagttttagggtacatgtgcacattgtgcaggttagttacat

SEQ ID NO: 4822 - DNA, 117 bp, Homo sapiens
acacatgcacccaatttcagagcatgcatatatatatgtgtatatatatatgtgtatgtatatatgtgtatgtatatatatgtgtgtgtgtgtgtgtgtgtgtgtgtgtgtgtgtat

SEQ ID NO: 4823 - DNA, 56 bp, Homo sapiens
tgagacagtctcactctgtcacccaggctggggtgcagtggtgtgaccttggctca

SEQ ID NO: 4824 - DNA, 114 bp, Homo sapiens
ttcttgatatccataatatgtgcttgtgtatgtgtgtgtgtatgtatgtatgtatgtatatcccaaaacattacattgttcattcagaggcagagcaaagatggccaaatagaa

SEQ ID NO: 4825 - DNA, 97 bp, Homo sapiens
gcacaaggaggcctgcctgcctgcctgcctgcctgcctctatagagtccacctctgggggcaggcatagccaaacaaaaggcagcagaatcctctgc

SEQ ID NO: 4826 - DNA, 76 bp, Homo sapiens
gggaaggtgagcctgataggctgggtggggcacagagaagaactcacagtgtcactcagtaaatagctcctgcccc

SEQ ID NO: 4827 - DNA, 71 bp, Homo sapiens
ctgctatgttaagcagtatgcttgaaaaatgacagcctgctatgttaagcagtatgcttgaaaaataacag

SEQ ID NO: 4828 - DNA, 92 bp, Homo sapiens
gggctaggatattacctcccactgccttttttttctgaaacaaagtctctctctgtcgcccaggctggagtgcagtggcgcgatctcagctc

SEQ ID NO: 4829 - DNA, 84 bp, Homo sapiens
ggatttttattgcttcaagagagggtctttcattcccagcagatcagacagtggcccttttccatttgatttcagtgttaatct

SEQ ID NO: 4830 - DNA, 88 bp, Homo sapiens
actatatatatatacgtgtatatatatatatgtgtgtatatatatatacgtgtatatatgtgtgtatatatatacgtgtatatatata

SEQ ID NO: 4831 - DNA, 90 bp, Homo sapiens
tcacaaattgtgtctcccaagtgtgatatctgaggactagaaatcagtcattctgtctctcttctgtacactgagtacagagttgtgtga

SEQ ID NO: 4832 - DNA, 95 bp, Homo sapiens; identical to SEQ ID NO: 68

SEQ ID NO: 4833 - DNA, 93 bp, Homo sapiens; identical to SEQ ID NO: 69

SEQ ID NO: 4834 - DNA, 107 bp, Homo sapiens
catacagctgaaagccaaaactaggaacatttgagaacttgatttaattttttttcaaggggtggtctcaagctctcagccagatttcttctctggactcagccatg

SEQ ID NO: 4835 - DNA, 80 bp, Homo sapiens
acacatacatgcacacacacatgtgcgtgcatagattaatatacatgtctatatatgtgtgtagatgtatgtatgtgtat

SEQ ID NO: 4836 - DNA, 96 bp, Homo sapiens
taatcctgtctatcctttcccaggcatgcagtgagggaaaaatgaggtcacagatgaaagaatgctctgggaagtaaaaaggattaaatgaggaca

SEQ ID NO: 4837 - DNA, 111 bp, Homo sapiens
tatagaataatatatggtatatagtatattatacatgattatatatataacacacatgttatattatataatatagtatattatgttatatactatatatgatatactatg

SEQ ID NO: 4838 - DNA, 113 bp, Homo sapiens
ggtccgctggctgctgtgagcaggagtgcacaatgagggcagagagtagagtatgtggtcacacataccttattgaccacagcacagcctactgacgcggtcagaggggaacc

SEQ ID NO: 4839 - DNA, 125 bp, Homo sapiens
aggcttcagtccttgaccttcagtgcttgtgggaaaggctcaaaaaagggacacacactcactccttcactctgggccgtggctttcactggttttctttcttgaactgtgcctgtgtgcctccc

SEQ ID NO: 4840 - DNA, 109 bp, Homo sapiens
tactattccattgtgtgtgtgtgtatatatatatatatatatattgtatatgtatatattcagtatatatgtatatgtgaatatacatatatatgtatatatgtgaata

SEQ ID NO: 4841 - DNA, 140 bp, Homo sapiens
accatatatatatatgtatgtgtatatatatgtgtatatatatgtatatatgtatatatgtacatatgtatgtatgtatatatacatataagtatatctatatatgtgtatatatatctatatatgtatatatgtacata

SEQ ID NO: 4842 - DNA, 77 bp, Homo sapiens
gacagagaatgggttgagagacaatgagctagtgtctagggtggactatagctacatatgaactcaataaatatgtc

SEQ ID NO: 4843 - DNA, 64 bp, Homo sapiens
cttctgtcactctgtttccctgttcaatacccccagatggggaagggaagcagagcggtagggg

SEQ ID NO: 4844 - DNA, 84 bp, Homo sapiens
taggcataatctcatttgagcctcatcttttattatgatctcattttatatattaagaaactggggttcaactgaggtttctta

SEQ ID NO: 4845 - DNA, 95 bp, Homo sapiens; identical to SEQ ID NO: 68

SEQ ID NO: 4846 - DNA, 93 bp, Homo sapiens; identical to SEQ ID NO: 69

SEQ ID NO: 4847 - DNA, 80 bp, Homo sapiens
gatgtgtatgagtgtgtgtgcatgcacacgtgtgtgtgagtctgtgtatgtgtgcttgtgcatgtgcatctgtatatctc

SEQ ID NO: 4848 - DNA, 96 bp, Homo sapiens
gtctggaatacagggatgcatctgaaaatcaaacaaaattaaaaatttctttttttttctttttttttgagacggagtctcgctgtgtcaccaggc

SEQ ID NO: 4849 - DNA, 111 bp, Homo sapiens
gaccacaatggcatctcggagcagcaagggcagggcagtctttttttttttttttttttttttttttttgagacagagtcttgctggttgccaaggctggagtgcagtggc

SEQ ID NO: 4850 - DNA, 103 bp, Homo sapiens
ttggcagacacttctagaagagaaattatgagtcaagcattaggaatgttttgaagtctctaggtacctactgcaaaattgttttccagaaaggtaatgccag

SEQ ID NO: 4851 - DNA, 126 bp, Homo sapiens
ccatcttgatgcacaatgttctaaaaattcacgtttcttggtatgtgcatgtatgtgtgcatgtggatatatgtgtgcatgtgtgtgtgtgtgtggtgcatgatgtgtgctgtatgtggtgtgtgt

SEQ ID NO: 4852 - DNA, 97 bp, Homo sapiens
cagtgaaaactaaagaagatgtcataaaggcgaattaaggaatatttttaattaaaaattatttgttaatagtaaaaatgacattttgttctcagtg

SEQ ID NO: 4853 - DNA, 73 bp, Homo sapiens
ttgggaactctgtgtgagcgcattggcgtcttgtcaagcatgcgagtgaagtgtgtgagggctgagtgaacaa

SEQ ID NO: 4854 - DNA, 131 bp, Homo sapiens
gtgtgtgtgtatatatatacatgtgtatatacacatatatatacacgtgtatatacatgtatatatatacatgtgtatatacatgtgtatatatacacacacatctctatgtatacacatatatatacata

SEQ ID NO: 4855 - DNA, 69 bp, Homo sapiens
gagacgggggcctggggagtggggaggcatactggggatcttttcagatgactgagagctctccttctc

SEQ ID NO: 4856 - DNA, 109 bp, Homo sapiens
agcacagatcaccagatatctccatcaatgcttcgatcagatgtgcaactttctcagtctctgccacacgtctgcagccaggccactttggagacactggatatgttct

SEQ ID NO: 4857 - DNA, 74 bp, Homo sapiens
aatggggataagaccagttgtcttgcagggttttgtaaagaattcctgtcagtctctgagtgacttgcctgatt

SEQ ID NO: 4858 - DNA, 108 bp, Homo sapiens
gatcatcagggattagattttcataaggagtatgcaacctagatcctttgcatgcacagttcacactagagtttgtgctcctatgagaatctaatgctgctgctgatc

SEQ ID NO: 4859 - DNA, 76 bp, Homo sapiens
gaccacatattatatgattctatttatatgaaatgtccaaaataggcaaatccaaatagaacgtagaatagtggtt

SEQ ID NO: 4860 - DNA, 90 bp, Homo sapiens
ccatctccctcaggaaaatccacatagctcagcagacctcccagctgctggggagggaaatgttgtatcgctggtggaaaagggaaatgg

SEQ ID NO: 4861 - DNA, 89 bp, Homo sapiens
caattttaatacacttttcaagatataaagtcaatatacataaaaagtttttttgtctattgactatgtctaggaaaaatttgaaattg

SEQ ID NO: 4862 - DNA, 76 bp, Homo sapiens
gctttgaggttggcagacagaaaatagagtggagctgtcatcccattcatttctgcatccatgcacagctcacagc

SEQ ID NO: 4863 - DNA, 80 bp, Homo sapiens
gtttgtctacgtcagcatcaccacaaacacgtgagtcatatctttcactgtgaggttacgatggttgatgtcaccaggca

SEQ ID NO: 4864 - DNA, 69 bp, Homo sapiens
ttgttttgaggtgagtctcactctgtcgcccaggctggagtgcggtggtgcaatctcagctcattgcaa

SEQ ID NO: 4865 - DNA, 72 bp, Homo sapiens
atgctatatatatgtgtgtatatatatgtatacatacatatcatatatatgtatacatacatatatatgtat

SEQ ID NO: 4866 - DNA, 75 bp, Homo sapiens
tataaatatatatatatgatatatatgtgtgtgtacacatatatgtatacatacatacatatatatgtatgtata

SEQ ID NO: 4867 - DNA, 58 bp, Homo sapiens; identical to SEQ ID NO: 1763

SEQ ID NO: 4868 - DNA, 76 bp, Homo sapiens
ggaggagaggacagttctgtgcctggagccctgctcactcccccagtgactccacgcaggccctgccactcctgcc

SEQ ID NO: 4869 - DNA, 174 bp, Homo sapiens
atatatgtatatatattcgtacgaatatatgtatatatattcgtacgaatatatgtatatatattcgtacgaatatatgtgtatattcgtacgaatatatgtatatatattcgtacgaatatatgtgtatatatattcgtacgaatatatgtgtatatatattcgtacgaatat

SEQ ID NO: 4870 - DNA, 80 bp, Homo sapiens
tgtggtcacagccactcagaggctgaggtaggaggatcactccagcctgggaggtcaaggctgcagtgagctgtgatcca

SEQ ID NO: 4871 - DNA, 57 bp, Homo sapiens
tggtgagttgttatgtgaaatgatgtcttaaaagacagtacagtcacagctcacaca

SEQ ID NO: 4872 - DNA, 58 bp, Homo sapiens
ggtgaagacacagctggtagtgacccccactggtgggtctgtgactgcctgtctcact

SEQ ID NO: 4873 - DNA, 77 bp, Homo sapiens
tctatgaaatcagaaagtctgggaactattgggttagataatttcttcagttgtcactgactctctgattttatgga

SEQ ID NO: 4874 - DNA, 110 bp, Homo sapiens
gcccacaggagacaccagcagaagatggaaggctgggaggagaggctgggatctgtctcctccactctctgcctgtctcagggcctccaggactgcagcttccactgggc

SEQ ID NO: 4875 - DNA, 114 bp, Homo sapiens
gtgacaatgccaggaattctggctctctctctctatatatatatattatatattatatattatatatatttatatatatatatatttttttgaggcagagtctcgctctgtcac

SEQ ID NO: 4876 - DNA, 106 bp, Homo sapiens
ggtggatgagggtagtgattggaaaggggcaggagggcagcttctgggatacaaggaatgttctctgtttcttaatctgagtcatgggtacttgggtgtgttgacc

SEQ ID NO: 4877 - DNA, 96 bp, Homo sapiens
ggcccctccccgttccagcacatctctatctccctctcacacacagcatttccactgtgtgtcacagttgacagagagctgtcatgtatgagaccc

SEQ ID NO: 4878 - DNA, 134 bp, Homo sapiens
tatgaaacattcaatttctggtggaagtctcatatgatctttggttggaggatgactggatgttgacagatgacaatgaggtgaagagcattttagcagagggaatggcatgatcaaagacaaaatggagagtc

SEQ ID NO: 4879 - DNA, 70 bp, Homo sapiens
gccaatcactgtcattttagtttcttagagacagggtttctgtctgtctctgacactggggtacagtggc

SEQ ID NO: 4880 - DNA, 86 bp, Homo sapiens
ctagtatagtgatctctgaggttcctttcatatttctttcttttttttttttttgagacggagactcactctgtcacccaggctgg

SEQ ID NO: 4881 - DNA, 58 bp, Homo sapiens; identical to SEQ ID NO: 1409

SEQ ID NO: 4882 - DNA, 70 bp, Homo sapiens
cttggaagatgttccatgtgcttatgaaaataatgcatattctgcattgttcagtggaatgttctgtaag

SEQ ID NO: 4883 - DNA, 100 bp, Homo sapiens
tcacgtagtagaccaatacaacagagctgattcaaagactttctttatttttcaagaggcagtggtgtcctgctctgttgcccatgctggactacagtgg

SEQ ID NO: 4884 - DNA, 56 bp, Homo sapiens
tgagacagtctcgctcagtcacccaggccggggtgccgtggtgcgatcttggctca

SEQ ID NO: 4885 - DNA, 93 bp, Homo sapiens
ttgtcttggctatacgggctctttttcggttccatatgaaatttaaagtagttttttctaattctgtgaagaaagtcagtggtagcttgatgg

SEQ ID NO: 4886 - DNA, 68 bp, Homo sapiens
caggcctatagtcccagctacttctacttttgggaggctgaggtggaaggatcatttgagcctgggat

SEQ ID NO: 4887 - DNA, 67 bp, Homo sapiens
ggttttttgagacacagtctcactctgttgcccaggctggagtgcagtgtcgtggtctcagatcact

SEQ ID NO: 4888 - DNA, 75 bp, Homo sapiens
gttggctgggattgagctcgctgtctgagggagctcgctctgtctctctcacactggcagtttacaccagccggc

SEQ ID NO: 4889 - DNA, 114 bp, Homo sapiens
tggcgaggagctaggggcgggcaggggcccagaacaaagggtacaagcagatacggggttttgttttctttttatttttttaaagacagggtctctctctctctctctctgtca

SEQ ID NO: 4890 - DNA, 88 bp, Homo sapiens
tggctgcaggtgcacaggctaaacatcagagccagacagatcttggcttctatctgactcactgtttctggctgggcactcttggcca

SEQ ID NO: 4891 - DNA, 104 bp, Homo sapiens
agtgagtcatctgttttggtctgggtcctgttggggacactgcctctctcaatccctggccaagtgacctggctcttccccagcaaatcatgagaagcactcac

SEQ ID NO: 4892 - DNA, 75 bp, Homo sapiens
gcaaagcagggagcactctgtcataggcagtgttcagggagagaatgagtgatcacagtgagcccttggctctgc

SEQ ID NO: 4893 - DNA, 67 bp, Homo sapiens
cagagtgtttgctttgtgttgtttgggtacagtgattggagatagacacacagagacacacacactg

SEQ ID NO: 4894 - DNA, 131 bp, Homo sapiens
cccaaagtctcttcggcagggtggaaggtacagagccagggcccaccatgccaggcacactctgaccctctcccggtgcggtcagacgcttgggacctggcaatgtgaggtggcagagctttcactgaggc

SEQ ID NO: 4895 - DNA, 112 bp, Homo sapiens
ttctgggcttgcgggtggaatagtgggtgtcggctggagcctgctgtagtgaccaaagggagactgcagacagtggccacatcccttacttctccctgactgtagtcaagga

SEQ ID NO: 4896 - DNA, 71 bp, Homo sapiens
ctgcttctgcagctgttttgtcaccatgaggagtcatctatctgagaacagagccagcacagaagaagtgg

SEQ ID NO: 4897 - DNA, 73 bp, Homo sapiens
gactcccgatggtggagccaggcctggaattcacgtcctgactcccagcctgtgctctgtctgtgtctgagtt

SEQ ID NO: 4898 - DNA, 56 bp, Homo sapiens
ttccctgactcctccagacaaagtgaggcagtccctcactctgtctctttagggag

SEQ ID NO: 4899 - DNA, 87 bp, Homo sapiens
catgggttggtggtttccttattgcttagttttgagaattctttatatattttggatagaagtcttttgcagatatcccagcctgtg

SEQ ID NO: 4900 - DNA, 75 bp, Homo sapiens
gtgcatgtgtttgggagtgtgcgtctctgcctgtttgggagtgtgttgggaatgtgtgtctgcttgtgcatgggc

SEQ ID NO: 4901 - DNA, 59 bp, Homo sapiens
caccaaacactgtttgttagggaacatggccctcacggcctgtgtgtctctcactggtg

SEQ ID NO: 4902 - DNA, 71 bp, Homo sapiens
tgggactttgtctctctcagtgaggcccaggcctgcctgggggctctcagggggagggtcactagcaccca

SEQ ID NO: 4903 - DNA, 113 bp, Homo sapiens
gctaggtggccatgggactttggggaaattatgtcccttctctgggtctcacactccttgtacaacagggattagaggagctatgaggtcccttcctactggcacattcctgc

SEQ ID NO: 4904 - DNA, 119 bp, Homo sapiens
ctccagcaccttgtatactgttagaaggctatagtcagtgtccattctctctctgtgaccccagaggtcctggcatggtgattcggccaaagcaccagtgtgaactatgggattgaggg

SEQ ID NO: 4905 - DNA, 76 bp, Homo sapiens
caactttctctcagtatctctgacacctcactgtggcttgtgggagcaccgtgtagggctgctgagaggagagggg

SEQ ID NO: 4906 - DNA, 118 bp, Homo sapiens
ggctggagtgtgcccctttgctgcagcatctgcatcctggctggtgtatgcccctctgttacagcatctgcatcccggctggagtgtgcccctctgttgcagcatctgcatcctggct

SEQ ID NO: 4907 - DNA, 106 bp, Homo sapiens
gggctgttacaggtgtggatgcaagtgtgtgtgttacaggtgtgtgtgcacacacacaacacatgcatgcagacacacacacacacacacacacactcatcagcct

SEQ ID NO: 4908 - DNA, 69 bp, Homo sapiens
acgtgtccctctctcagtgtgtcatatcaagagattcatgatattgacatgtcttattactggtcacgt

SEQ ID NO: 4909 - DNA, 100 bp, Homo sapiens
gtgtactatatatatgtgtatgtgtgtatatatatatatacacgtgtatatatatatacacacatgtatatatgtatatatacacacacacatatatata

SEQ ID NO: 4910 - DNA, 102 bp, Homo sapiens
cataggcctaggactgtgacccctctaggggccccaaaagtgttttatttgtttattttttttccctagaaggagtgtcactctgtctctcaggctggagtg

SEQ ID NO: 4911 - DNA, 74 bp, Homo sapiens
gtctgtccacagatgtgtgtgtgtgtaatagaagccatccttctctggacaatgcttatctctggaggagagac

SEQ ID NO: 4912 - DNA, 92 bp, Homo sapiens
agttatacttagctgtatatatatatatgtgtgtgtgtgtatatatatatatatacacacacacacacatatatatacacatatgtgtatct

SEQ ID NO: 4913 - DNA, 115 bp, Homo sapiens
taattcctgctttcatgttaatgtacgatatatattttatgtgcatgtcatatgtatatgtgtgtatatatatatgtgcgtgtgtatatataatgtgtgtacacattaagaatta

SEQ ID NO: 4914 - DNA, 120 bp, Homo sapiens
tccaggttagggtcaggatcagatctagcccccaagataaagttcaggtttatttttatttttatttttatttatttgtacttttttgagacagagtatctctctatcacccaggctgga

SEQ ID NO: 4915 - DNA, 84 bp, Homo sapiens
cagagctagcagtgccgtggggaccctgctgtgcaggcttacagttgccctcattgctccagtggctctgtgtgcgtctctgct

SEQ ID NO: 4916 - DNA, 77 bp, Homo sapiens
cgcactggtaaagcccccctctcctctcaagttgcctgcacgtccctgtgagaggagcagagggtgtgcacagtggg

SEQ ID NO: 4917 - DNA, 83 bp, Homo sapiens
gttctgcaccatctgagagacaaaagagagaacatgttccttcaaccacgagttcatcatttggaaagcctcggtggcagagc

SEQ ID NO: 4918 - DNA, 59 bp, Homo sapiens
tctggcttccctccccgcaagtcatgtttcacggtgcatttgtgtggaatgtagtcaga

SEQ ID NO: 4919 - DNA, 58 bp, Homo sapiens; identical to SEQ ID NO: 285

SEQ ID NO: 4920 - DNA, 58 bp, Homo sapiens
tgggacggagtctcgctctgtcactcaggctggagtgcagtggcgcgatctcgactca

SEQ ID NO: 4921 - DNA, 89 bp, Homo sapiens
caggcacctgccatcatgcccagccaatttttgtatttttaatagagacggggtttcaccatgttggccagggtggtttcgaactcctg

SEQ ID NO: 4922 - DNA, 87 bp, Homo sapiens
agcgttcctctgcccgtctgctctgcccattgaaagtagaggggtatcataccagtcaggggtagagcagacacacagtcctttgct

SEQ ID NO: 4923 - DNA, 65 bp, Homo sapiens
gtccggatggattgagttgtgtgctgtttgctttgattaagaaatagtcacaattccatcatgac

SEQ ID NO: 4924 - DNA, 95 bp, Homo sapiens
gaagcatttacctaatgcctgtagttccactgtgtcttagaagtcactaacttgttttttattttacaggctcataggcggaagggacttgcttt

SEQ ID NO: 4925 - DNA, 196 bp, Homo sapiens
gtgtgtgtgtgtgtgtgtatatatatatatgtgtgtgtgtgtatatatatatacatatatatgtgtgtatatatatatacatatatatgtgtgtatatatacatatatatgtgtgtgtgtatatatacatatatgtgtgtatatatacatatatatgtgtgtgtgtgtgtgtgtgtgtgtatatatatatatatat

SEQ ID NO: 4926 - DNA, 77 bp, Homo sapiens
gtgtgtgtatataaatgtgtaactctgccttattactatatatattagagtgtatatattattgtgtgtacatatat

SEQ ID NO: 4927 - DNA, 91 bp, Homo sapiens
agaagaaatgctagctcaccagtcaccacacagtgtgctgtgtcatcacggccacaggaagggaagggtcatgtacggcctgcaggattct

SEQ ID NO: 4928 - DNA, 95 bp, Homo sapiens; identical to SEQ ID NO: 580

SEQ ID NO: 4929 - DNA, 93 bp, Homo sapiens; identical to SEQ ID NO: 69

SEQ ID NO: 4930 - DNA, 74 bp, Homo sapiens
acagagtctcactgtcactcaatcctccctccttggcctctcaaggtgctaggatgacaggcatgagccactgt

SEQ ID NO: 4931 - DNA, 95 bp, Homo sapiens
ttggccaaatatattggactctgttacagcttctccatcactttctagaaatggaatgataagaactctaccgggtcatggtgtccagtggccaa

SEQ ID NO: 4932 - DNA, 88 bp, Homo sapiens
ggagtctcactctgttgcacaggctggagtgcagtggcgcgatctaggctcactgcagtctctgtctcccgggttcaagcgattctcc

SEQ ID NO: 4933 - DNA, 76 bp, Homo sapiens
gcagatctttgccaggctctgtgactcactcacagcccaacacgggtcaagttcacagttcgtctgtgcactcagc

SEQ ID NO: 4934 - DNA, 89 bp, Homo sapiens
cttattctcctgtgactttttttttccatttaatttattatctgaataggtaatacatgcaaatggtatgaaaattcacatggcttgag

SEQ ID NO: 4935 - DNA, 92 bp, Homo sapiens
tggcgagtgcaacacacacacacactgtatttgtgtatggaataactgttcaagaacacacacacagtatgtgtgtatgaaataactcttca

SEQ ID NO: 4936 - DNA, 102 bp, Homo sapiens
tcacatcacctgacttttgaagctgtcgtgtgacccattctgtgactcattctgtgtgactcctggggttgatggcttgtgtctcagacagttggaggagga

SEQ ID NO: 4937 - DNA, 116 bp, Homo sapiens
agaatggtgtcacatggccgccctctcctgcaagggagtcctggaagacgagctttttttttttttaagacagagtctcgctttgtcgctcaggctggagtgcagtggcacagtct

SEQ ID NO: 4938 - DNA, 94 bp, Homo sapiens
gttcttcgcctaattgggatggatttgttaggaataaaaacatagaagatagatctatggttttgtagctcttcttcctgaacttggtgaaagc

SEQ ID NO: 4939 - DNA, 95 bp, Homo sapiens; identical to SEQ ID NO: 580

SEQ ID NO: 4940 - DNA, 93 bp, Homo sapiens; identical to SEQ ID NO: 69

SEQ ID NO: 4941 - DNA, 95 bp, Homo sapiens; identical to SEQ ID NO: 580

SEQ ID NO: 4942 - DNA, 93 bp, Homo sapiens; identical to SEQ ID NO: 69

SEQ ID NO: 4943 - DNA, 93 bp, Homo sapiens
ggcacaggtgggggtaagctgggatttgtagtctggctccagagtcaggactctttaccacgaccgcgacatggcgctggctctcaaacagcc

SEQ ID NO: 4944 - DNA, 115 bp, Homo sapiens
atatatatttatgttatgtatattatgttagatatatttatattatatttatatttaaattatataatttagatatattaaattatatataatttacatattatatattatatat

SEQ ID NO: 4945 - DNA, 95 bp, Homo sapiens; identical to SEQ ID NO: 68

SEQ ID NO: 4946 - DNA, 93 bp, Homo sapiens; identical to SEQ ID NO: 69

SEQ ID NO: 4947 - DNA, 72 bp, Homo sapiens
gtatatgtgtatatatgtatatatgtgtatataggtgtatatataggtgtatataggtatatataggtatat

SEQ ID NO: 4948 - DNA, 95 bp, Homo sapiens; identical to SEQ ID NO: 68

SEQ ID NO: 4949 - DNA, 93 bp, Homo sapiens; identical to SEQ ID NO: 69

SEQ ID NO: 4950 - DNA, 106 bp, Homo sapiens
tcctctgtggttctgatgggacttttgctctgagatcctggcctctctctctctgtgatcctggcctgactctctgtgatccttatcagccttcatataacaggga

SEQ ID NO: 4951 - DNA, 71 bp, Homo sapiens
tatatgtgtgagtgtgtgtatatatataatatatgtgtgtgtatatatatacacacacacacacacatata

SEQ ID NO: 4952 - DNA, 112 bp, Homo sapiens
agtagattcccatctatgttgaatgatgaaagggcttttaaataactgacagtctcactgttaggaaagaaatgtttaagccttgatgttaaccttccatatagtttctact

SEQ ID NO: 4953 - DNA, 105 bp, Homo sapiens
taggcatcagggtcagacagacttcctggcatgaattcagtggatttttcttaattatgagagaagaaacattgcacagatagagggtctatctcttaatgcgtg

SEQ ID NO: 4954 - DNA, 91 bp, Homo sapiens
gcttattagttggttctaggtgccacaagatgaagatatatatatatatatcttcatctctcacagtcttggcaactaccactgatgatgc

SEQ ID NO: 4955 - DNA, 112 bp, Homo sapiens
tcccataagtctcttaggctctattcatttttttcaatcttttttcttttattttgttaaagataataaggcagaatttattcaagggatactatggagataaggataggga

SEQ ID NO: 4956 - DNA, 56 bp, Homo sapiens
tatatgtacatatatgtatgtgtgtatatatacatacatatatatgtatatatata

SEQ ID NO: 4957 - DNA, 108 bp, Homo sapiens
ctggaggtctattcaaccacagagggaagagcttgtaagaatgggggagttgcaataactgtggctgcctgcctctttgcacctctgtgatcagtgattatagcacag

SEQ ID NO: 4958 - DNA, 86 bp, Homo sapiens
ggtgctccagtgttgggtgtaagtatttttaaaattgttatatccacttactgagttgacagcttcatcattgcattgcgagcctc

SEQ ID NO: 4959 - DNA, 87 bp, Homo sapiens
tatatatatatatatatatatatatatatagcatatatatagcatatatatatagcatatatatagcatacatatggcatatatata

SEQ ID NO: 4960 - DNA, 108 bp, Homo sapiens
gttattgtattctgtttgctactattgaggatttgtatctatgtttgtatctgcattatattttcttgtgatgtctttatctgtgttttatagcagggtaacactaac

SEQ ID NO: 4961 - DNA, 100 bp, Homo sapiens
tggtggcacatgcctgtagtctcaattacttgggaggctgaggtggaaggatcacttgaacccaggatgtcagggatgcagtgagcatgtgattgtgcca

SEQ ID NO: 4962 - DNA, 75 bp, Homo sapiens
gtccctgtctctgtgtcttagtttaagttcagtttattttagactgaaaatgtttgctgagcactttattggtgc

SEQ ID NO: 4963 - DNA, 140 bp, Homo sapiens
tatatatatacatatatacacacacacatatacatatacgtatatgtgtatatatatgtatatgtgtatatatatgtatatgtatacatatacgtatatgtgtgtgtgtgtgtatgtatgtgtgtatatatatatatata

SEQ ID NO: 4964 - DNA, 127 bp, Homo sapiens
gtgtgcgtgtgtgtatatatatgtatatatatgtatgtgtatatatatgtatatatatgtatgtgtatatatatgtatatatatgtatgtgtatatatatgtatatatatgtatgtgtatatataca

SEQ ID NO: 4965 - DNA, 84 bp, Homo sapiens
agtggagtgaaaaaaatctttttttaatggagtgaaaaatagttttactttattattatgaagttatgttgaattttacctact

SEQ ID NO: 4966 - DNA, 143 bp, Homo sapiens
acacatatatacacatatatacatatacacacatatatacacatatatacatatacacacatatgtgtatatatatatatatatacacatgtgtatatatgtgtatatacacatgtgtatatatgtgtatatacacatgtgta

SEQ ID NO: 4967 - DNA, 266 bp, Homo sapiens
acacatatatacacatgtgtatatacacatatatacacatgtgtatatatatatatatatacacatatgtgtgtatatgtatatatgtgtatatatgtgtgtatatgtatatatgtgtatatatgtgtgtatatgtatatatgtgtatatatgtatgtgtatatgtatatatgtgtatatgtgtatatatgtatatacatgtgtgtatatatacacatatgtgtatatgaatgtatatatatgtatatatgtatgtgtgtgtgtgt

SEQ ID NO: 4968 - DNA, 114 bp, Homo sapiens
gaaaataattttgaatgaaaagatcttccatatagtgttgacattcttgatcttcgtgctgatgacatgggtgtgcacctgttatggacatcacttcactttacatttataatc

SEQ ID NO: 4969 - DNA, 90 bp, Homo sapiens
tcatggtacatgcatgagcatatacatacatacatatatatacacacatatatacatatatatatgtatatgcccatgcatgtaccttga

SEQ ID NO: 4970 - DNA, 73 bp, Homo sapiens
ggggcttgcttggggagagagaggaaaaatacaacagaagattccccacactctctctttcagttatggctcc

SEQ ID NO: 4971 - DNA, 88 bp, Homo sapiens
ctttaggggaggaaggtagttagcattttttgttgttcaatttcatgtaaaatgaggagccctgagagctagcatttctgtcctgaag

SEQ ID NO: 4972 - DNA, 106 bp, Homo sapiens
gtatttctactataataaaccatgtatatgtgatatatatgtgtatataatatatagagtaaaatgtatatatatatacacacacatatgtagttgaatatataca

SEQ ID NO: 4973 - DNA, 73 bp, Homo sapiens
acagcctctgagacagtgtgtgaacctggcttcacactggtgtgtctgtcagtgtctatagtgagaaagctgt

SEQ ID NO: 4974 - DNA, 99 bp, Homo sapiens
gtgaacatgtctcacattttctgtttggaggggtcacacacacacacacaggctcaacacacaaatacccacacacataaaatgtgagaaatacttcac

SEQ ID NO: 4975 - DNA, 78 bp, Homo sapiens
acgcacacgcatatatatatatatatatacatgtatacatatatatatgtatgtgtatatatatagttgtttgtttgt

SEQ ID NO: 4976 - DNA, 114 bp, Homo sapiens
accaggagctcttgcatcaaatagtcaattatgagtaagtactggagctaagtgattatatttcttatattcttaatttacaagtggtgcctgggatgcatttttaaggtcatg

SEQ ID NO: 4977 - DNA, 117 bp, Homo sapiens
ggaaacagaattattgggttgaagagcatttgtttccagttttgaataacatcactgtttcttttatatattattaattatagtgccatcaacagtgtataaaatatttctgttttc

SEQ ID NO: 4978 - DNA, 160 bp, Homo sapiens
atgtatgtgaaaaatttgcaaatccaaaatagatcttttctttttttttacatttttaaattttatgttaagttcaggggtaaatgtgcaggatgtgcaggtttgtcacataggtaaacatgtgtcatagtgattagctgcacagagcatccaatttcct

SEQ ID NO: 4979 - DNA, 114 bp, Homo sapiens
gctgtgtttgagtcttgccacctggtgcagtggctgtggctgtggtagttggaagtagtgtcgggatccacaggctggagttgtggtgaaagaaaggaagtggaaaagccaaat

SEQ ID NO: 4980 - DNA, 85 bp, Homo sapiens
gtgtgtgtgtatgtgtatatacgtatgaatacacacattcattatatatatgtgtctatatatatgtatgtatacacacagacat

SEQ ID NO: 4981 - DNA, 95 bp, Homo sapiens; identical to SEQ ID NO: 68

SEQ ID NO: 4982 - DNA, 93 bp, Homo sapiens; identical to SEQ ID NO: 69

SEQ ID NO: 4983 - DNA, 87 bp, Homo sapiens
gggagaaggctgttggatggtgaggcagagagtttcatgtacatgaaacctatgtatcagtcagactctctaagtccttgtccttgc

SEQ ID NO: 4984 - DNA, 89 bp, Homo sapiens
ggaatgtgggctagtggcagtgactttttcttttttttttttttttgagataaagtcttattctgtcaccaaggtgtgccctcccttcc

SEQ ID NO: 4985 - DNA, 107 bp, Homo sapiens
ctgtataatatatgcccccatgcccacaacatggctgtctcaacttttttttttttttttttttgagatggagtctcacactgttgctagggctggagtacagtggc

SEQ ID NO: 4986 - DNA, 80 bp, Homo sapiens
ggggtgttcagaaggaaattgtaagagatgccaaaaggggaagttctgttctccctcacactctttctgttttacaactc

SEQ ID NO: 4987 - DNA, 76 bp, Homo sapiens
gattgagtgatgagcagttagactaaataagagtgaaggtggccccttgagtctttctctgtttcttattcagatc

SEQ ID NO: 4988 - DNA, 58 bp, Homo sapiens
tgagactgagtctcactctgtcatttaggttggagtgcagtggtgtgatctcagctca

SEQ ID NO: 4989 - DNA, 109 bp, Homo sapiens
tcatatatgtaaaagtctgaaacacatgcatagacacacacatacagtcacacacacatataagaattgtatgcagttggtgcaaatgttttgcgatttttgcctttga

SEQ ID NO: 4990 - DNA, 69 bp, Homo sapiens
ttgcagattgatcactgttagcatacagacacactactcttttttgtatgttgattttgtatcctgcaa

SEQ ID NO: 4991 - DNA, 125 bp, Homo sapiens
tatagtttgtatgtgtttgtgtggttagcatggattatattgtatgtatataaggatattatatatatatataaaatatccttaagacttaacaatcttgtatgaattcatatgaaattaacgta

SEQ ID NO: 4992 - DNA, 98 bp, Homo sapiens
tacaggtgtaatgttttgatatatgtgtgcattgtagaatggctgaatcaagctaattaacatatgtatgacctcatatacttaacattttatttgta

SEQ ID NO: 4993 - DNA, 103 bp, Homo sapiens
tatacatatatatgtatatgtgtatatatgtatacatatatatgtgtatatatatgtgtgtatacatatatacatacacatatatatgtatacatatatacac

SEQ ID NO: 4994 - DNA, 110 bp, Homo sapiens
atgataaaatttgccctcactcagcaacaagaaagctgatctcaggaggattttttttttttaactttaagttctgggatacaagtgctgaatgtgcaggtttgttacat

SEQ ID NO: 4995 - DNA, 100 bp, Homo sapiens
agcccggagaacaggagcagtcacttcatttatttatttatttatttatttatttatttatttatttattgagacggagtctcgctctgtcacccaggct

SEQ ID NO: 4996 - DNA, 95 bp, Homo sapiens; identical to SEQ ID NO: 580

SEQ ID NO: 4997 - DNA, 93 bp, Homo sapiens; identical to SEQ ID NO: 69

SEQ ID NO: 4998 - DNA, 116 bp, Homo sapiens
tctgtagttgtcttttccctcattgcttttgaattgatgagcttatatctttttaaatataattaattttgggagacagttttaggttcacagcaaaatttagtggaagacacagg

SEQ ID NO: 4999 - DNA, 86 bp, Homo sapiens
catttcctgtctctggttcttgttgtgctgacaacacaagtaaatcactatgacactcagacacaggcacacagtgattaggattg

SEQ ID NO: 5000 - DNA, 58 bp, Homo sapiens; identical to SEQ ID NO: 2626

SEQ ID NO: 5001 - DNA, 84 bp, Homo sapiens
agcattgatggtgatagcagaaggtaaatacagagaagatggtgtcctcaggactcactctcattcaccctgtctttcagtgct

SEQ ID NO: 5002 - DNA, 68 bp, Homo sapiens
tgctcactctctttctgagaagccagctgccatgttttgagcttccttagggagaggctattgtggca

SEQ ID NO: 5003 - DNA, 77 bp, Homo sapiens
ggcttcactggaggttcaggaagctctatcagtacccttctctcagagtcactcactgttgaatctgtaatgaggct

SEQ ID NO: 5004 - DNA, 65 bp, Homo sapiens
cttgtgcaggaaaagtatgccttatgaagccttcaggtcttgtgagacttactcactgtcacaag

SEQ ID NO: 5005 - DNA, 102 bp, Homo sapiens
catgccagtttataatgaaataagcccaattcaatagagacaatataagatagtttttagtatatattgaaactggtttggtagcattttgctttggtcatg

SEQ ID NO: 5006 - DNA, 93 bp, Homo sapiens
aggttatatatataaaagagcctgtgatgtgtgagtttctttatttttctaaaatcctcacattttctttggtttcatatatatatatgatct

SEQ ID NO: 5007 - DNA, 64 bp, Homo sapiens
gtcacatacctatgatgtggcggaggtggggctggagctcacactgtctgtctctgtggttgat

SEQ ID NO: 5008 - DNA, 121 bp, Homo sapiens
agtatatatatatatatatgtatatatatgtatatatgtatatatatgtgcatatatgtatatatgtatatatatgtgtatatatgtatgctatatatatatgtatatacacacacacaca

SEQ ID NO: 5009 - DNA, 91 bp, Homo sapiens
gcaacacatcctgcatcactcactgatactctctttctctttttctgctggccccttgaagggtacggtgcatgagctagcagcatggtgc

SEQ ID NO: 5010 - DNA, 102 bp, Homo sapiens
taaatatctgagaagtatctctgtctttctctctctctcttcatatatatgtatatagataggtagataggtgatagatatacatataaacagaaatattta

SEQ ID NO: 5011 - DNA, 114 bp, Homo sapiens
ggtttagtttttttctcctagttcttgaggtacaaagttcagctgcttagttgagatcttttttctttattaatgtaggtatttttggtataaactctgagtgatgattttgct

SEQ ID NO: 5012 - DNA, 104 bp, Homo sapiens
aatatattcttataggaacagatcttaaaatatgatgcatagtataatttgatttttaaaaatcatgtatagtgtattagttttctgttgattgataatgtatt

SEQ ID NO: 5013 - DNA, 84 bp, Homo sapiens
gtgtgtgcatatatatgcatatatatgtatatatgtatatgtatctatatgcatatatgtatatgtgtatatatatgcatatat

SEQ ID NO: 5014 - DNA, 97 bp, Homo sapiens
gtaaaatcgtatatcctctgtattcccggttccaggttctatgtagtaaagttatatggaaataggtttcaggtagatacaggattacaggtattat

SEQ ID NO: 5015 - DNA, 95 bp, Homo sapiens; identical to SEQ ID NO: 68

SEQ ID NO: 5016 - DNA, 93 bp, Homo sapiens; identical to SEQ ID NO: 69

SEQ ID NO: 5017 - DNA, 66 bp, Homo sapiens
caccatcctcacatgtctctgagactgctccccttggctctctcagagggcagagtgagatctgtg

SEQ ID NO: 5018 - DNA, 93 bp, Homo sapiens; identical to SEQ ID NO: 69

SEQ ID NO: 5019 - DNA, 118 bp, Homo sapiens
agaggctcagtggatcttcctggttggtgaatggattcatgtgctgagacagtgacacactctgattccatgaggtgagggcacgaaggatccattccctacccccagatcttgccct

SEQ ID NO: 5020 - DNA, 87 bp, Homo sapiens
cagtgatttttgatataaagttttttattataatagtttttcttgttagagaaatctgttaagattttgatctttcgaaatttactg

SEQ ID NO: 5021 - DNA, 94 bp, Homo sapiens
aggctctttttggttccatatgaaattaaaagtagtttttttctaattctgtgaagaaagtcagtggtagcttgatgtggatagaattgaatct

SEQ ID NO: 5022 - DNA, 101 bp, Homo sapiens
gtgggcatacatataagtgcatatgcataactgtgagggtgcacaaaaatgtatgtatgtatcttcatgtgtgtgctgtgcccatgtgtatgtatgcttat

SEQ ID NO: 5023 - DNA, 93 bp, Homo sapiens
cagatagggggcagctggatttggcagtgggtctcagtttgcagccctcctgttgaagtctccctgtctctgagtctttctggtccctccctg

SEQ ID NO: 5024 - DNA, 84 bp, Homo sapiens
gggtcctgtgtgctctgtggactgcaggtgctgaggggacaggggacccacactcacactcattccctgcagggccaggcaccc

SEQ ID NO: 5025 - DNA, 77 bp, Homo sapiens
cgggaagaatcaagtgctctctctctctgtctggtggtatcagcaggggtgctgggcgatggggtgtatttttcctg

SEQ ID NO: 5026 - DNA, 74 bp, Homo sapiens
tctgggctggacgtggggggcatggtgactttttttttttttttcatgaagtctcactctgtcaccagtctaga

SEQ ID NO: 5027 - DNA, 81 bp, Homo sapiens
ctttttttaaggagaagtgaaggaaggctggcgatgcagcggctggctctgcctgcctggctcccactctgctatggaaag

SEQ ID NO: 5028 - DNA, 82 bp, Homo sapiens
gttgttgttttggtttttgtttttttgttttgacggagtctcactctgtcgccaggctggagtgcagtggcatgatctcggc

SEQ ID NO: 5029 - DNA, 58 bp, Homo sapiens
tgagactgagtctcgctctgtcgctcaggctggagtgcaatggcatgatctcggctca

SEQ ID NO: 5030 - DNA, 118 bp, Homo sapiens
gttgggaggttttttattacctattcaaactcttgttataagtctgtccagaatttatattttttcttgagtcaaattttgtaattttgtatgtttctaggaatttttccctttcaac

SEQ ID NO: 5031 - DNA, 112 bp, Homo sapiens
attatcttgcctttgtgttacctgctcttactcttgcatcagagaaatggggtggatgagtagtgacagattcaggagtgaggtgatagcagtgataatcaaggatgataat

SEQ ID NO: 5032 - DNA, 77 bp, Homo sapiens
cagtggccaggtggagatgcaggccaggtccatcaggaggggactttgtcgttcttggatgtgcggcttggggagtg

SEQ ID NO: 5033 - DNA, 58 bp, Homo sapiens
tgagacagagtctcgctctgtcacccaggctggagggcagtggcgcggttttggctca

SEQ ID NO: 5034 - DNA, 66 bp, Homo sapiens
gcgggctgcgtgcccaggcttggagggtctcatgggctctccgagtctctgtgtgactgggccggt

SEQ ID NO: 5035 - DNA, 113 bp, Homo sapiens
agattgagaaatcggatggttgctgtgtctgtgtagaaagtagaagacatgggagacttttcattttgttctgcactaagaaaaattcctctgccttgggatcctgttgatct

SEQ ID NO: 5036 - DNA, 118 bp, Homo sapiens
gcatcctgaagtatttaagggcaaagcactatggtgacacactcaaatggctcagaaaacagtgtctgtgtctgtgtgtgtagatatgggaggaggtgaagctcatgtatctggatgt

SEQ ID NO: 5037 - DNA, 145 bp, Homo sapiens
attgggttcctgagaacaaagaaaaataagagctctcattttttcctttaaaaagtgtggagttttttttttttttgtctttttcttgctagtgttcgtgagtacatatacatgcttgctgagatggaaaatctggaagggctcc

SEQ ID NO: 5038 - DNA, 123 bp, Homo sapiens
gccttggcctcccaaagtgctgggattacaggtgtgagccactgtgcctggcccatgatttttttttttttttttcagagtctcaccctgtcacccaggctggagtgcagtggcgcaatctcg

SEQ ID NO: 5039 - DNA, 87 bp, Homo sapiens
aatcccatctccttaagagctatgtgatcttggataggttagttaatctctctgtgtctcagtttcctcttctttcaggtgtggatt

SEQ ID NO: 5040 - DNA, 83 bp, Homo sapiens
atccagtgaactagacgagagacagacaaactcacagacatatgtgagtgtgagatgcacctttttgtacttgttcatcagat

SEQ ID NO: 5041 - DNA, 128 bp, Homo sapiens
gcatggagtgctggggagatgatgatgctggggaatgactgagtgggcagtgtcagagtctctctctcatgctagggtggtgccgcagggactctcgtgtggccatgagctctgtggcaactctgagt

SEQ ID NO: 5042 - DNA, 61 bp, Homo sapiens
tctatttttcttatatgttggcagttattctttttaattgtttttataaaagggagatgga

SEQ ID NO: 5043 - DNA, 58 bp, Homo sapiens; identical to SEQ ID NO: 2758

SEQ ID NO: 5044 - DNA, 85 bp, Homo sapiens
tgatagggttccacggcatagacaggtggctccgcgccagtgcctgggacgtgtgggtgcacagtctccgggtgaaccttcttca

SEQ ID NO: 5045 - DNA, 84 bp, Homo sapiens
ccatttgagtgagcattcttgagtggttttgcattgtgtcttcacacagttgtaccataattgaagctgcttttggccttgctc

SEQ ID NO: 5046 - DNA, 57 bp, Homo sapiens
tgagatggagtctcactctgtcacccaggctggagtgcagtggcggatctcaactca

SEQ ID NO: 5047 - DNA, 57 bp, Homo sapiens
gaggggaggaagccaatgcgtagagtgacagcacagtgcctggcacagtctctgctc

SEQ ID NO: 5048 - DNA, 58 bp, Homo sapiens; identical to SEQ ID NO: 2224

SEQ ID NO: 5049 - DNA, 56 bp, Homo sapiens; identical to SEQ ID NO: 335

SEQ ID NO: 5050 - DNA, 131 bp, Homo sapiens
ggctggtggctggggctatcacgtgtagagctgagcggctgggcccaggcctctgccggcctctctgtgtcacactgcctctcttcctcccctgcaggagtcaggaagcgtgttctctcatggtgctgtgt

SEQ ID NO: 5051 - DNA, 78 bp, Homo sapiens
ctggtgggggagctggctctggaggacagcctgtttgtggcatctctgcctctgtccgtctctgcctctgcccactgg

SEQ ID NO: 5052 - DNA, 96 bp, Homo sapiens
atatgtgtatatatatgtatgtatacatatatatgtatgcatacatatatatgtatgcatacatacatatatatatatatatatatatatatatat

SEQ ID NO: 5053 - DNA, 89 bp, Homo sapiens
cagggagaaccaagaagtcctgggagagagatgtcagtctgaactccatagaaatagctgcatttagtcttaggcctcttatttgcctg

SEQ ID NO: 5054 - DNA, 84 bp, Homo sapiens
agcagaatgagaccctatctcaaaataattaatttattaatagctttttattttttactttttgagagacagtctcactctgtt

SEQ ID NO: 5055 - DNA, 58 bp, Homo sapiens
tgagacagggtctcactctgtcacccaggctggagtgcagtggtgtgatctcggctca

SEQ ID NO: 5056 - DNA, 85 bp, Homo sapiens
cctccaggtttcctctcctctgacacactcacagagaacaacttccccttagctctgtgcgtgtgtgatttgccaacctgacagg

SEQ ID NO: 5057 - DNA, 116 bp, Homo sapiens
atgctcttgagagatcaaggaagatgaggtctgagcagtgacctttggatttggcaaacagaagtcacagaggtcttgagaaaagcagtttttctgtaatgatggggtaaaagcat

SEQ ID NO: 5058 - DNA, 123 bp, Homo sapiens
ccattgtatgaagctgctgttttggcgtccctaatgcagggtgagatggtagtgtgattcttgttgtgacatctcgtgactgggcaggacgctgaatactgattgctgcagatggaggatgct

SEQ ID NO: 5059 - DNA, 102 bp, Homo sapiens
acttaggtagtttagataatgtctgcatttatattgatcccaagttattgtttttaaataaatgatgcagcatttgcttttccaagggactatctcataggt

SEQ ID NO: 5060 - DNA, 87 bp, Homo sapiens
agagtgagactctgtctcaaaaaaataaaaaaataaaaaatttacagagtttggcttttttttttttttgagattgagtctcactct

SEQ ID NO: 5061 - DNA, 61 bp, Homo sapiens
cctggagacatgtaagattttttttttttttttgagacggagtctcgctctgtctcccagg

SEQ ID NO: 5062 - DNA, 109 bp, Homo sapiens
gcatctggtcatctctacgaaagatttcttcggtcagtcttgttgattatttcattatatatgatgaatgaattggtcagtgttcttatttagagaggaaaggttttgt

SEQ ID NO: 5063 - DNA, 77 bp, Homo sapiens
cagccactttctcagtgactgtcagaaagggccttctgaatggagcctccctgaattgactgaaggaaatgtggatg

SEQ ID NO: 5064 - DNA, 103 bp, Homo sapiens
caatttaaatagtcacagatgttgaacatttaggttgtttccaattgtaaattcctgctataatggacattcttgtatgtacatctttgtgcactggttattg

SEQ ID NO: 5065 - DNA, 99 bp, Homo sapiens
aggcagtgattggaggaaaaataaaattgttttgcacttgagccactgagatgagattcttaggcaggctcaccgcacgtgtttaacctcccagctcct

SEQ ID NO: 5066 - DNA, 117 bp, Homo sapiens
agctggatctgagtcctgtctggctgatgccctctgactgtgggtggtgactggctcactgagcctcagtttcttcacctgtaaagcgggcgtggtaacagtacggcctcaggggct

SEQ ID NO: 5067 - DNA, 90 bp, Homo sapiens
ccgctgagcatgggtcctatgtagcctgatggtggcttgtccagcctgttcccctcacttctcgcacactgtctctcacctgcccagtgg

SEQ ID NO: 5068 - DNA, 104 bp, Homo sapiens
tttctataccatggctgcagggctctgtctgtgactgtgacagttcgttttaatcaatgacctacatcatggcagacggatggaaaaaaaagctgggggagaga

SEQ ID NO: 5069 - DNA, 76 bp, Homo sapiens
tcgcacagctctgagcgggtactagggatttctgtctttgcgctgaaggctgtcttctctggctcccgctgtgtgg

SEQ ID NO: 5070 - DNA, 106 bp, Homo sapiens
agtgttgatggatgtaatcggttagggccagaatagaagtttgggagatttcacagtgttgttgggacaaacttcacataggcatgagtatattacttctagcagt

SEQ ID NO: 5071 - DNA, 115 bp, Homo sapiens
ctgactggcagaacaatgttgagccaaccatggatacctggaagaaatctcatttagttgtggtgtataattccttttatatggtgttggatttgttctgctaatattttctcag

SEQ ID NO: 5072 - DNA, 87 bp, Homo sapiens
tgtcctctctgggtcctttctcaggcattcaccgccgccatctccatctcaagcctgtctgcctctgtgtcaggaactcactggaca

SEQ ID NO: 5073 - DNA, 63 bp, Homo sapiens
ggaggggggcgcatggcacacaaaggcctggagaagagtgtgactctgtgagtccctcactcc

SEQ ID NO: 5074 - DNA, 64 bp, Homo sapiens
ggaagcagaggagctctgtctcctttttttttttttttttgagacggagtctctctctgtcgcc

SEQ ID NO: 5075 - DNA, 95 bp, Homo sapiens; identical to SEQ ID NO: 68

SEQ ID NO: 5076 - DNA, 93 bp, Homo sapiens; identical to SEQ ID NO: 69

SEQ ID NO: 5077 - DNA, 93 bp, Homo sapiens
gtatgtatttcgtatgtatagtagcaggagctatatatgtatagtatttctaatatatatagtatttcttttatataatatatacatatatac

SEQ ID NO: 5078 - DNA, 83 bp, Homo sapiens
gacctggtctctcagtctctctatctccagagtgtcttcctgaagtggaggagggctgggtgattggctgcctgattctggtc

SEQ ID NO: 5079 - DNA, 103 bp, Homo sapiens
ttgcttctgagtgggggattactaatgctttgtttgtttatttctgcttttctgagactttaaattttttaataagcatgtattagtttcattcttaagacaa

SEQ ID NO: 5080 - DNA, 60 bp, Homo sapiens
tacatatgtgtatatatatgtttatatataaccaataggatatatatgtatatgtgtgtg

SEQ ID NO: 5081 - DNA, 85 bp, Homo sapiens
tcacgatctatagcagttatagcattgtcaagttgatttattgtataataagacttgaatgtcaaaattgctcctggatctgtgg

SEQ ID NO: 5082 - DNA, 124 bp, Homo sapiens
tgctttattttgatgaagtcattattttctagtgtgacattttaatttaataattatgtattttaattattattttagtggtcactgtaagacttaatatatgtatcgtatcttactttatcaa

SEQ ID NO: 5083 - DNA, 77 bp, Homo sapiens
tgtggaggaagagagactgccattccttttttttttttttttttgagggaaaggaagggttgagtcgagcctgtgca

SEQ ID NO: 5084 - DNA, 115 bp, Homo sapiens
ttgattataataccatatttaagtatgaatctcttttagtttattatacttggagtttattgagcttcttggatgtttagattaatagtcttcattaaatttggaaaattttcag

SEQ ID NO: 5085 - DNA, 116 bp, Homo sapiens
acctccaagacttctatatatagtgtctgatgaagctctcaaagtaattttttttgacttttttttttttttaattttactttaagttctgggatacatgtgctgaaagtgcaggt

SEQ ID NO: 5086 - DNA, 110 bp, Homo sapiens
gaaccgttccatttctattgccccagtgtttgttgtcccaaagtttctttttttctttttcaagaagactgagctctacaatgatgagactgaggtcttgccacaggttc

SEQ ID NO: 5087 - DNA, 109 bp, Homo sapiens
tgtgttgctttgtttcttgaattagatgcttagttcattaattagcagtgtttttttcattgctaatgtaggtatttgagacattctctttctaggtactattcagcca

SEQ ID NO: 5088 - DNA, 95 bp, Homo sapiens; identical to SEQ ID NO: 68

SEQ ID NO: 5089 - DNA, 93 bp, Homo sapiens; identical to SEQ ID NO: 69

SEQ ID NO: 5090 - DNA, 92 bp, Homo sapiens
tcctccagaatcttatgcccatgggacatatgcacagagaggaccagcactttctgtcactgggtctgatggagggaggaggttttgctgga

SEQ ID NO: 5091 - DNA, 91 bp, Homo sapiens
tgatagttatgcagtgatatctctttgtgattttaacctgcattgctgatcactaaatgatgttgaaatcttttcatgtgcatatctgtta

SEQ ID NO: 5092 - DNA, 113 bp, Homo sapiens
tgacttttgctacttcaatttttcaattttttttttttttttttttttttgccatttggtaaatattctgggaaaacaagccaaataatgaagaaataggtttccaggggtca

SEQ ID NO: 5093 - DNA, 89 bp, Homo sapiens
gagttgtatagtcttacattttatatttaagtctgtgatccactgtgagttaattttttgtgaagtgtataagatctgtgtctaaattc

SEQ ID NO: 5094 - DNA, 115 bp, Homo sapiens
ctaggtaaagggtacatgggatctttgtataatttctctttttatttatttatttatttttgtttattttattttatttttttcatacagggtctcactctgtcaccctggctgg

SEQ ID NO: 5095 - DNA, 94 bp, Homo sapiens
tgcacttgtaaatgttagagtttgactgtattagtaaaattatattcattaatgtaaattgcatgcagtgaaaactctgtctttcccatgtgta

SEQ ID NO: 5096 - DNA, 93 bp, Homo sapiens
cctgcaggaacaccaggcattcaacaggcacttaatgaacacctgctggtcactggttgagttctgcttgaaacacctggcaacaatcccagg

SEQ ID NO: 5097 - DNA, 101 bp, Homo sapiens
gcctgacctgtccccatgcgtccacagagagagcagacacagagcagggtccccatccacagagcctgacctgtccttatgtgtccgtagggatggtgggc

SEQ ID NO: 5098 - DNA, 67 bp, Homo sapiens
gcctctctctctccctgagggcgtgggttacacaccccattcaagctccctcggtgacatgggaggc

SEQ ID NO: 5099 - DNA, 95 bp, Homo sapiens; identical to SEQ ID NO: 68

SEQ ID NO: 5100 - DNA, 93 bp, Homo sapiens; identical to SEQ ID NO: 69

SEQ ID NO: 5101 - DNA, 112 bp, Homo sapiens
ttgatttttaagttttttactttgtttttacttgatacataacaattgtacatatttatagattcagtgtgatgttgtgatgcaagtgtacattgtgctatcatcaaatcag

SEQ ID NO: 5102 - DNA, 70 bp, Homo sapiens
gagtcttggagtcaggaacttaccaatggggcccacaaggtgtcatgggttgtgtctctgtctggggctt

SEQ ID NO: 5103 - DNA, 78 bp, Homo sapiens
gcacactgaacactcacagcactctgctgggggtcctcgcccgaccttgcagatgagcaaactgaggctcagataggc

SEQ ID NO: 5104 - DNA, 130 bp, Homo sapiens
gggctgcctggccccacgttctccatggtgacccatggttcttgcccttgggagctcacagatgaggcagtggactcaggtgcccacatgtcttggtgtgagaggctgtgactgaggtgaccagagtgtg

SEQ ID NO: 5105 - DNA, 81 bp, Homo sapiens
gtttagatggagtctcactctgtcacccaggctggagtgcattggcgctatctcagctcactgcaacctctgcttcctggg

SEQ ID NO: 5106 - DNA, 66 bp, Homo sapiens
agatagaacgaaagtgtggagtaagggagaattctctccctctctgcctgacactgtcttttattt

SEQ ID NO: 5107 - DNA, 115 bp, Homo sapiens
ggtagccctgtttgtcactgtgcctggctgccctgtgtatctgtcactgtgtctggttgtcctgtctgtctgccactgtgtctgcctgccctgtctgtcactgtgcctggttgcc

SEQ ID NO: 5108 - DNA, 85 bp, Homo sapiens
gcccctgtgcttgtggtggtggagcgttagcttgtctgagtgagcacacttccagctgcttccatcccagtggcagtggtcgggc

SEQ ID NO: 5109 - DNA, 99 bp, Homo sapiens
gcatattatttcaattattctggttataatatgggggcaggatgaaattgtttttattcttttagaattttttttatcaggaaaacagaggtaaagtgc

SEQ ID NO: 5110 - DNA, 103 bp, Homo sapiens
gtgtgcttcgtatgagaatctaatgcctgatgatctgtcactgtctcactttgcccccagaagggaccatctagttgcagaaaaatcagctcagagcttccac

SEQ ID NO: 5111 - DNA, 96 bp, Homo sapiens
agaatctaatgcctgatgatctgtcactgtctcactttgcccccagaagggaccatctagttgcagaaaaatcagctcagagcttccactgattct

SEQ ID NO: 5112 - DNA, 96 bp, Homo sapiens
agaatctaatgcctgatgatctgtcactgtctcactttgcccccagatgagaccatccagttgcagaaaaataagttcagagcttccacggattct

SEQ ID NO: 5113 - DNA, 74 bp, Homo sapiens
gtcactctctgtctgtggcccccatcggtgcctctgccacctggcccagagggggcagggactctggggaggac

SEQ ID NO: 5114 - DNA, 109 bp, Homo sapiens
ctttcttgagtttatatatatatacacacatacacatatatatacacatacatatatatgtatatatgtgtatatgtatgtgtatatatatatatatagagagagagag

SEQ ID NO: 5115 - DNA, 84 bp, Homo sapiens
tatatatatatatatacacatacatatacacatatatacatatatatgtatgtgtatatatatgtgtatgtgtgtatatatata

SEQ ID NO: 5116 - DNA, 95 bp, Homo sapiens; identical to SEQ ID NO: 68

SEQ ID NO: 5117 - DNA, 93 bp, Homo sapiens; identical to SEQ ID NO: 69

SEQ ID NO: 5118 - DNA, 77 bp, Homo sapiens
tggagagtgctacgattttttcaatatcattttgtgttaaagcacagattgctgtaaaaaagtggtaatagctccta

SEQ ID NO: 5119 - DNA, 58 bp, Homo sapiens; identical to SEQ ID NO: 1725

SEQ ID NO: 5120 - DNA, 83 bp, Homo sapiens
gaggaagacataggctaatatttgagcttttggcatttcccatgtaacgtgccaagactcacacattctctcattttatcctc

SEQ ID NO: 5121 - DNA, 81 bp, Homo sapiens
tgtatgtgtatatatatatatgtatgtatgtgtatatatatacacacacatacacacacacatatatatatatattaggca

SEQ ID NO: 5122 - DNA, 96 bp, Homo sapiens
agaatctaatgcctgatgatctgtcactgtctcactttgcccccagaagggaccatctagttgcagaaaaataagctcagagcttccactgattct

SEQ ID NO: 5123 - DNA, 96 bp, Homo sapiens
agaatctaatgcctgatgatctgtcactgtctcactttgcccccagatgagaccatccagttgcagaaaaatgagttcagagcttccacggattct

SEQ ID NO: 5124 - DNA, 157 bp, Homo sapiens
tatatatatatatacatatatatacacatatatacatatatatacatatgtatatatacatatatatgtgtgtgtatatatatacatatatatgtgtgtgtgtgtgtgtgtgtatatatatatatatatatatatatatatatatatatatatatat

SEQ ID NO: 5125 - DNA, 74 bp, Homo sapiens
gagatggagtctcactctgtcacccaggttggagtcaaccccaacctcctgggctcaagcgatcctcctgcctc

SEQ ID NO: 5126 - DNA, 96 bp, Homo sapiens; identical to SEQ ID NO: 5122

SEQ ID NO: 5127 - DNA, 87 bp, Homo sapiens
tatatatatatatatgtgtgtgtgtgtgtgtgtatatatatatatggatatatatatagagagagagagaccatatatatatatata

SEQ ID NO: 5128 - DNA, 137 bp, Homo sapiens
ataaactccatatatatatatatatgtgtgtgtgtgtatatatatgtgtgtgtatatatgtgtgtgtatatatgagtgtatatatatatacatatatacacacatatatacacacacatatatatacacacacacac

SEQ ID NO: 5129 - DNA, 76 bp, Homo sapiens
ttgttttttgagatggagtctcactcactctgttgcccagactggagtgtagtggcatgatctccactcactgcaa

SEQ ID NO: 5130 - DNA, 65 bp, Homo sapiens
ttgagacggagtcttgctctctctctgtcacccaggctggagtgcagtggcgcaatctcggctca

SEQ ID NO: 5131 - DNA, 117 bp, Homo sapiens
tcacccaggctggagtgcagtggtgtgagattacaggcccggtctttttttaaattatttttagtagacacggggtgttgctatgtcacccaggctggtctcaaatgcctgggctga

SEQ ID NO: 5132 - DNA, 81 bp, Homo sapiens
gtgagacagagtctcactctgtcgcccaggctggagtgcggcggtgtgtcctcagctcactgcaacctctgcctctcaggc

SEQ ID NO: 5133 - DNA, 110 bp, Homo sapiens
attgggtgtagggttggggaaagggaggactctgtttttgtttttgttttttcttttcttttttttttttgagacagagtcttactctgtcacccaggctggagtgcagt

SEQ ID NO: 5134 - DNA, 82 bp, Homo sapiens
tgggggacagaaatcagggacacgttggaaacagaatcttttttttttttttttttgagacggagtctccctctgtcaccca

SEQ ID NO: 5135 - DNA, 69 bp, Homo sapiens
gtctgtctggtgagctctggctgctgccgctgccgtagccggctggctgcctgtttcccaggtcagcac

SEQ ID NO: 5136 - DNA, 108 bp, Homo sapiens
ccagcactttgggaggctgaggtgggtggatcacttgaggtcacaagtttgagaccagactggacgtggtgaaacactgtctctactaaaaatacaaaaattagctgg

SEQ ID NO: 5137 - DNA, 76 bp, Homo sapiens
gctaggtaagccgtggtgaacatcagagtgtgctcaggggctccctagaagcatatctgcagtcatgggtgtcagt

SEQ ID NO: 5138 - DNA, 76 bp, Homo sapiens
ggctgaagctcaggaggctgaggaattcacacacagtcacacagatagtgacagaccccagtttccagcctaggcc

SEQ ID NO: 5139 - DNA, 78 bp, Homo sapiens
gaggcagactcattgattgtggaacaggaagcttttatggaactaagatttaagtctctgactcactgtgagctcctc

SEQ ID NO: 5140 - DNA, 91 bp, Homo sapiens
gagacagatatgtatatatcactttttttttttttgagagggagtctcactctgtcgcccaggttggagtgcagtggtgtgatcttggctc

SEQ ID NO: 5141 - DNA, 58 bp, Homo sapiens; identical to SEQ ID NO: 3079

SEQ ID NO: 5142 - DNA, 87 bp, Homo sapiens
gcattggatgctttcagtctgcagcaattgcaaatagtatgaaatgaagagcactgcaagaaatgaggctagagacaggccggctgc

SEQ ID NO: 5143 - DNA, 59 bp, Homo sapiens
cctaggtgcggggagttggtctgaagagaggctgaaagaccaagtccaagtcatgaagg

SEQ ID NO: 5144 - DNA, 88 bp, Homo sapiens
gggctgctgagggagtggagacagagagcagggaggcccaggcagcctcccccactgacccgcctgcccgtggctctctcggcagctc

SEQ ID NO: 5145 - DNA, 76 bp, Homo sapiens
gcacttgtgggacatcagaaagactttttcttttttctttttttgagacagagtctcgctctgtcacacaggctgc

SEQ ID NO: 5146 - DNA, 58 bp, Homo sapiens
tgagccagagtctcgctctgtcacccaggctggagtgcagtagtgtgatctcggctca

SEQ ID NO: 5147 - DNA, 65 bp, Homo sapiens
accatgcccagctaatttttgtatttttatcagagatggggattcaccatattggccaggctggt

SEQ ID NO: 5148 - DNA, 106 bp, Homo sapiens
ggttgattagttgtaaaaacattatatctttttttgttgttgacttgcatagtatcgtagcttggcacaaaagataatatagtgccttaataatatttgaatgacc

SEQ ID NO: 5149 - DNA, 110 bp, Homo sapiens
gtcctccgtcgtggggcatgttggcgcgcttctgcagtatgtgtgatgttgccgcgagtgtttatatatatatctgtgttggtgaacctctgcacatatctcagtgaggc

SEQ ID NO: 5150 - DNA, 115 bp, Homo sapiens
cctgactttttaatgctcaccattctaactggtgtgagatgctacctcattgtggttgtgatttgcatttctctgatggccagtgaggatgagcattttttcatgtgtcttctgg

SEQ ID NO: 5151 - DNA, 96 bp, Homo sapiens; identical to SEQ ID NO: 5112

SEQ ID NO: 5152 - DNA, 96 bp, Homo sapiens; identical to SEQ ID NO: 5111

SEQ ID NO: 5153 - DNA, 105 bp, Homo sapiens
atggtcatgcactgccttccagccttggtggtaagagcaagacagatgttactataatttttttaaaaaagtctgtcctctgcctcaaatggactttgctgttat

SEQ ID NO: 5154 - DNA, 119 bp, Homo sapiens
ctcgacagctgttcctggatgtcctaattaattttgaattaacaaataataagtatgactttttctgtttttttaaaaaaacttcattccttaattgcatgcaaaaggtatctgttgag

SEQ ID NO: 5155 - DNA, 96 bp, Homo sapiens
gcatatagagcatatatatatatgtgtgtgtgtatatatatatgcactttatatatatatattttatatatatgcactttaaagtacacatacaca

SEQ ID NO: 5156 - DNA, 107 bp, Homo sapiens
cctttttatgactaaatagtattccataagatatatgtatgtatgtatgtatacgtttatatatatatatcacaatttcttaatctactcattgatgggcatttggg

SEQ ID NO: 5157 - DNA, 81 bp, Homo sapiens
gaggttagaggcaggtgagtaagtgaagcttcatctgtttacagccactctctgtcactcgcattaccgcccgagctcctc

SEQ ID NO: 5158 - DNA, 84 bp, Homo sapiens
gacaatgtggtgatgtctcttgtgtgtctgtgtgtccctgtggtagtgtgacggtgtgtccatgtggtgatgtctccgtgtgtc

SEQ ID NO: 5159 - DNA, 86 bp, Homo sapiens
gcagagatacttaactcagggtggggacaacagcaatgaccttgtttgaaacgcagctcctgtctctgtggctctctgtgctctgc

SEQ ID NO: 5160 - DNA, 115 bp, Homo sapiens
gagtggccactgtctttctcctgagtggtttgtatgcttatctaccagcatttattatttttatttttttgcatgataagtttccaaggaaccttagtgatggggactgtctctc

SEQ ID NO: 5161 - DNA, 77 bp, Homo sapiens
ttggtggtgttttgaaaaatgtgttcattccatataaatttttgtttattattgagcacattcattttgctcactgg

SEQ ID NO: 5162 - DNA, 95 bp, Homo sapiens; identical to SEQ ID NO: 68

SEQ ID NO: 5163 - DNA, 93 bp, Homo sapiens; identical to SEQ ID NO: 69

SEQ ID NO: 5164 - DNA, 71 bp, Homo sapiens
tctgaagtatttcattgataatactttttttttgaatgaggaaggtagtgttatcactagaatgcttaaga

SEQ ID NO: 5165 - DNA, 134 bp, Homo sapiens
tatatgtatatgtatatgtatatgtatatgcatatataatatacatatacatatatgtatatgtataaatatattatgtatatatatacacacatgtatatatgtatatatacaaaatgtatgtatagatatta

SEQ ID NO: 5166 - DNA, 245 bp, Homo sapiens
acatatatatgtatatgtacatatatatctgtctaatatatatacacatatacatatatatgtatatgtgtatatatacatacatatatgtatatgtatatatgtatatatgtgtatatatacatatacacatatgtatatatgtgtatatatacatatacacatatgtatatatgtgtatatatacatatacacatatgtatatgtgtatatatacatatacacatatgtatatgtgtatatat

SEQ ID NO: 5167 - DNA, 96 bp, Homo sapiens
taggtgcagattttattttattttatttcattaacttatttttatttgacaaataattgtttatatttatggggtacaatgaaatattctgatcta

SEQ ID NO: 5168 - DNA, 56 bp, Homo sapiens
ttccagtgacagtgagcacagaccctgggtggtggtgacagtggctgtcatgggaa

SEQ ID NO: 5169 - DNA, 58 bp, Homo sapiens
tgagccggagtctcgctctgtcacccaggctggagtgcagtggtgcgatctcggctca

SEQ ID NO: 5170 - DNA, 79 bp, Homo sapiens
gtagtgtagctgaacatcacgtttactgaaaatattgcacttgtgtgtgtgtgtgtgtgtgtgtgtagctactctttac

SEQ ID NO: 5171 - DNA, 82 bp, Homo sapiens
ccctcgtaacagtcttttgaatcctatgtgagggaaaaacattcagaccctcatagcagtgttctggaatcttatttgaggg

SEQ ID NO: 5172 - DNA, 118 bp, Homo sapiens
tggaaaatcccctgggacagggaatgttaaagctccattttgtcactaaaagttgtccagatatttctttttatttttttgagatggagtctctctctgtcacacaggctggagtgca

SEQ ID NO: 5173 - DNA, 101 bp, Homo sapiens
ggttggtagttatcttttactagtttcttacttcagaagtgtttttgttttaaagatgagaggaaaatcttcaattgagattcattcctagtactccaact

SEQ ID NO: 5174 - DNA, 77 bp, Homo sapiens
gcatatatatgtatatgtgtgtatatgtgcatatacatgcatatatttgtatatatatgcatgtttatgcattttgc

SEQ ID NO: 5175 - DNA, 90 bp, Homo sapiens
tacattatttcactgttttcttgttgatattaaatgctgctgactcagtaaagtttattatttgaatataacaagaatgtgtgaattgta

SEQ ID NO: 5176 - DNA, 95 bp, Homo sapiens; identical to SEQ ID NO: 68

SEQ ID NO: 5177 - DNA, 93 bp, Homo sapiens; identical to SEQ ID NO: 69

SEQ ID NO: 5178 - DNA, 114 bp, Homo sapiens
gctcgggacacacagccgccatccacctcactgctttcgggagagaatgctgagagcctctctcagactctctcttgacttgagttcttcatgggtgtgtggttaagacgtagt

SEQ ID NO: 5179 - DNA, 94 bp, Homo sapiens
ctgctgctattacaggcgtgagacactgcacctggctcattctatatttgcctgcctgcctgcctgtctatcaatcatcttgtttttagtacgg

SEQ ID NO: 5180 - DNA, 87 bp, Homo sapiens
ggcttcactgattgcccatcacggtgaagaaagggaaatgggagcttgtgggattctgctgatgacagaggtgagtgtggtgaagcc

SEQ ID NO: 5181 - DNA, 59 bp, Homo sapiens
gattcagaggacaggacagaacacttggctaagtgaatctgtgtctgtctgtctgtctc

SEQ ID NO: 5182 - DNA, 64 bp, Homo sapiens
gcctggaactgagaggactgtgtggccagggccacccaaaccatgacctgttgtttagaagggc

SEQ ID NO: 5183 - DNA, 111 bp, Homo sapiens
actctgctttattgttcatcatagtactcacctctacttggcattatgttgtacagttatttgtttataacgtgtctttccaattaaatgtaagctctttgaaggcagagt

SEQ ID NO: 5184 - DNA, 87 bp, Homo sapiens
ccaagatgatgaaggcagaaattgcaagacgtcttcagtcctaggttctgaaactcacacagtgtcacttctgccacattctattgg

SEQ ID NO: 5185 - DNA, 98 bp, Homo sapiens
ggtttttcccattcctgacactgtcattaactgactcctactggagacccctgtctgccacatgggcctcagtattgcaggtgtttgtgagctggacc

SEQ ID NO: 5186 - DNA, 95 bp, Homo sapiens; identical to SEQ ID NO: 580

SEQ ID NO: 5187 - DNA, 93 bp, Homo sapiens; identical to SEQ ID NO: 69

SEQ ID NO: 5188 - DNA, 129 bp, Homo sapiens
ggggacagagccttcatgactcaatcaccttttaaaggctccactttttttttgagactgtctccctctgtcccccaggctggagtgcagtggtgcaatctcggctcaccgcaacctccacctcccggg

SEQ ID NO: 5189 - DNA, 95 bp, Homo sapiens; identical to SEQ ID NO: 580

SEQ ID NO: 5190 - DNA, 93 bp, Homo sapiens; identical to SEQ ID NO: 69

SEQ ID NO: 5191 - DNA, 80 bp, Homo sapiens
tttgggttgggggaacatggtctcactctgtcacccaggctggagtacagtggtgtgatcacggttcactgcagcctgga

SEQ ID NO: 5192 - DNA, 95 bp, Homo sapiens
ccctgccttattaaggaatactgtgggttcttgggacacttttattctgaagaaatcaaagtgcttctgaaatgcacccagattcttgggtatgg

SEQ ID NO: 5193 - DNA, 99 bp, Homo sapiens
gaggttgccagtggatttgctacagggcttgagttgaatgccaagaaattattattttatactgtcaatgtgaaagtcatatggctgaatactgacctt

SEQ ID NO: 5194 - DNA, 92 bp, Homo sapiens
agagagaaacagtacaggagaaaaagcaaaagcagatgagtgattttatttatttttgttgttgttgttgtttttagagacagagtctctct

SEQ ID NO: 5195 - DNA, 110 bp, Homo sapiens
catgtgactccaggtggacaagagaaagtataaatgccatccagaaagaatacactgtgcaaaggcatgagaaattctcttcctcacaatctggtttctaaattcatatg

SEQ ID NO: 5196 - DNA, 111 bp, Homo sapiens
tgagctcctctgcctcctgtcagataagtggcagcattagattttttttttttttttttttttttgagacggagtctcgctctatcacccaggctggagtgcagtggcaca

SEQ ID NO: 5197 - DNA, 95 bp, Homo sapiens; identical to SEQ ID NO: 68

SEQ ID NO: 5198 - DNA, 93 bp, Homo sapiens; identical to SEQ ID NO: 69

SEQ ID NO: 5199 - DNA, 97 bp, Homo sapiens
atggagcattctttgcttttgaaggaaggagggatgctgttttctctgcaaaactttacattcttttttttttttttgagatggagtctcgctctgt

SEQ ID NO: 5200 - DNA, 102 bp, Homo sapiens
gtagccattctgactggtgtgagatggtatcttactgtggttttgacttgcatttctctgatgactagtgatattgaacatcttttcatgtttgttggctgc

SEQ ID NO: 5201 - DNA, 84 bp, Homo sapiens
ggcgtctttaggtgaacagaagcagtctagtattaaaactctatttatttttctagtttatgctttctgtattctaggaacgtt

SEQ ID NO: 5202 - DNA, 80 bp, Homo sapiens
tctgcccaaaatacatcacactttgcttggagcacccattatatcttcccaggctatgtgtatatgtatatttgtataga

SEQ ID NO: 5203 - DNA, 95 bp, Homo sapiens; identical to SEQ ID NO: 68

SEQ ID NO: 5204 - DNA, 93 bp, Homo sapiens; identical to SEQ ID NO: 69

SEQ ID NO: 5205 - DNA, 71 bp, Homo sapiens
ggattcaaagcctggctctgtgacttaatggtcgtttgacctagaccaagtctctcagtcactttgtgtct

SEQ ID NO: 5206 - DNA, 95 bp, Homo sapiens; identical to SEQ ID NO: 68

SEQ ID NO: 5207 - DNA, 93 bp, Homo sapiens; identical to SEQ ID NO: 69

SEQ ID NO: 5208 - DNA, 75 bp, Homo sapiens
gaatgcaatggattatacagagtgagcagagaccaactgtgctctgttctcttctgtgtgatctattccgtgttt

SEQ ID NO: 5209 - DNA, 96 bp, Homo sapiens
cttcctattgttttcagtatgttaattggttttaaagtttaatctcttaatcttgatttggcttttagcatttcacatcgggattattttgggggg

SEQ ID NO: 5210 - DNA, 58 bp, Homo sapiens; identical to SEQ ID NO: 315

SEQ ID NO: 5211 - DNA, 95 bp, Homo sapiens
gcccactttttgatggggttgtttgtttttttcttgtaaatttgtttgagttcattgtagattctggatattagccctttgtcagatgagtgggt

SEQ ID NO: 5212 - DNA, 100 bp, Homo sapiens
gtgtcctgtgtaacaatagatttcctcttggtgcagcatgctcagtactgtgtgtgaaagtggcttataagggtaagacaaggaattagaacttgggcac

SEQ ID NO: 5213 - DNA, 58 bp, Homo sapiens; identical to SEQ ID NO: 4572

SEQ ID NO: 5214 - DNA, 122 bp, Homo sapiens
ttaggtgtttccattgctccctgtcaaaagtgttttgaattgaatatgaggataaagacttttttttttaaacatgtgtttataaatgttatcaaaatgacagcagcgtgcagcttgatgcc

SEQ ID NO: 5215 - DNA, 60 bp, Homo sapiens
gtgtatatatgtatatttatatatgtatgtacatatatgtatatatgtttatatagacac

SEQ ID NO: 5216 - DNA, 174 bp, Homo sapiens
tatataacgtattatatatgatataacgtattatatatgatatatcatatatgtatatgatatatatgtgtatataatatatgcatatatgtatgtacatatgtatatgtatgtatatatgtatgcatatatgtatgtatgtatacatacatgtatgtatatatgtatacatac

SEQ ID NO: 5217 - DNA, 160 bp, Homo sapiens
tacatgcatgtatgtatatatgtatacacatgtatgtatacatacatgtatgtatatatgtatacacatgtatgtatatatgtatacatatatgtgtatgtatgtatatatgtatacgtatgtgtgtatgtatatatgtatacgtatgtatgtatatatg

SEQ ID NO: 5218 - DNA, 58 bp, Homo sapiens
tgagacagggtctcactctgtcacccaggctggagtgcagtggtgtgatcatggctca

SEQ ID NO: 5219 - DNA, 72 bp, Homo sapiens
ctgggcatagtgacgtgcgcctgtagtcccagctacttgggaggctgaggtaagaggttcacttgagcccgg

SEQ ID NO: 5220 - DNA, 86 bp, Homo sapiens
ggtaggatggggtgccattcacattgtatttctatatgaatggcaatgccattcatgccattagagttttgcagtgaaatatccca

SEQ ID NO: 5221 - DNA, 97 bp, Homo sapiens
cccgtgctttattctgcacagggtctaggtgggctacaaagccatgtagcgtggttctgctcccagaacattctgagcactgttttctatgcatggg

SEQ ID NO: 5222 - DNA, 95 bp, Homo sapiens; identical to SEQ ID NO: 68

SEQ ID NO: 5223 - DNA, 93 bp, Homo sapiens; identical to SEQ ID NO: 69

SEQ ID NO: 5224 - DNA, 65 bp, Homo sapiens
atttttacatgtatatgtgtgtgtgtatatatttgtgtatatatataattttgcatagtgaagat

SEQ ID NO: 5225 - DNA, 86 bp, Homo sapiens
gactgtgagagtaaggtggttgttttttatggagctgaatagctttttttttttttttgagacagtcttgctctgtcacccaggtt

SEQ ID NO: 5226 - DNA, 60 bp, Homo sapiens
ggtccaggggttggtaggagcaggaagaactatcttttgttctctttgagctggtggact

SEQ ID NO: 5227 - DNA, 95 bp, Homo sapiens; identical to SEQ ID NO: 68

SEQ ID NO: 5228 - DNA, 93 bp, Homo sapiens; identical to SEQ ID NO: 69

SEQ ID NO: 5229 - DNA, 88 bp, Homo sapiens
cctgtaactctgcgcagtgttcagagttgttcttcacgggtcccatgactgcagagaaagcttggagcttgcaggcagtggttccagg

SEQ ID NO: 5230 - DNA, 104 bp, Homo sapiens
gtatttgtgtgtgtatgtgtatgtatatatatatgtgtgtgtatatatatatgtgtatatatgtgtatatatatgtatatatgtatatatatgtatatatatat

SEQ ID NO: 5231 - DNA, 109 bp, Homo sapiens
tgtaagatttcattttgatgatgctcaagaacaggcaaaattaacctatggtgattgaaatcagagtagagagtgcctatgggggatgcagactgaatggaaagaggca

SEQ ID NO: 5232 - DNA, 94 bp, Homo sapiens
aaattttttgttaattctaaaagttttgaactcaaacctgacactatacttcaggatcaggtgtttttaaattttttttattttcagaaaattt

SEQ ID NO: 5233 - DNA, 133 bp, Homo sapiens
ccgggccctgtttgaccccatgacacatccgtatgaagtttttttttttttttttgagacggagtctcactctgtcacccaggctggagtgcagtggcgctatctcagctcactgcaagctccacctcccggg

SEQ ID NO: 5234 - DNA, 82 bp, Homo sapiens
tcatatatatatgcatatatatgcatatatatgaatatatatgtatatatgaatatatgcatatatatgcatatatgtatga

SEQ ID NO: 5235 - DNA, 76 bp, Homo sapiens
tatgcatatatatgcatatatatatgaatagatatatatgtgcatatctattcatatatatatgcatgtatgtatg

SEQ ID NO: 5236 - DNA, 78 bp, Homo sapiens
cactgtctgtgtgtctgaatgactgcctcatgtgcacattcataggctgtgattgctacaggaaaacataagattgtg

SEQ ID NO: 5237 - DNA, 95 bp, Homo sapiens; identical to SEQ ID NO: 68

SEQ ID NO: 5238 - DNA, 93 bp, Homo sapiens; identical to SEQ ID NO: 69

SEQ ID NO: 5239 - DNA, 107 bp, Homo sapiens
ttccagctcttgttttgtggatcttttttgaaaattttttttatttttaattaattaatttattttttatttttagacaggatctctctctgccacccaggctggag

SEQ ID NO: 5240 - DNA, 64 bp, Homo sapiens
ggagctgctgactagctcagtgaccttggtcatttcactcactcactgagcttttcctcactct

SEQ ID NO: 5241 - DNA, 62 bp, Homo sapiens
gagctgctgactagctcagtgaccttggtcatttcactcactcactgagcttttcctcactc

SEQ ID NO: 5242 - DNA, 58 bp, Homo sapiens; identical to SEQ ID NO: 1763

SEQ ID NO: 5243 - DNA, 89 bp, Homo sapiens
acagagcttacagactattgagaaagagaaacagggttaataacaaattacatttttttttttttttttgagacagagtctcgctctgt

SEQ ID NO: 5244 - DNA, 87 bp, Homo sapiens
ttcagcctgggcaacagagcaagacctgtctcaaaaaaaaaaaaaaaaaaaggcaagacagagtctctctctgtcacccaggctgga

SEQ ID NO: 5245 - DNA, 70 bp, Homo sapiens
cccctgccctagtgggagggtctgaggccagaagagagccagagtcagtatctgtctgctaagcatgggg

SEQ ID NO: 5246 - DNA, 71 bp, Homo sapiens
atatatatatgtatatgtacacacacataaataatatatatatatgtgtgtatatatatgtgtatatatat

SEQ ID NO: 5247 - DNA, 103 bp, Homo sapiens
ctagactgaggggaaggtctgggcctgggccatggtgcagcatagaggtgtttgtgtctctgtctgtgcctggggtctgcctcaacagcttcttaaggtttgg

SEQ ID NO: 5248 - DNA, 117 bp, Homo sapiens
cccgatgcccacaatccccacaggtttccgacctgacttttaaatacagttgtcagcacactggctgtcaaaaccagaggagccaaggcttggaagactgttggcttaggagttggg

SEQ ID NO: 5249 - DNA, 56 bp, Homo sapiens
tgacagggtctcactctgtcacccaggctggagtgcagtggcgtgaccctagctca

SEQ ID NO: 5250 - DNA, 95 bp, Homo sapiens; identical to SEQ ID NO: 68

SEQ ID NO: 5251 - DNA, 93 bp, Homo sapiens; identical to SEQ ID NO: 69

SEQ ID NO: 5252 - DNA, 97 bp, Homo sapiens
ggaatccagaattagggacagacagtatctctgtatcatttaaaaagatttactgcaaacttgaaaaagggatttctctctccttttctggactttc

SEQ ID NO: 5253 - DNA, 118 bp, Homo sapiens
aatgggcatttttcactttttttttgctaatgacttattacctgctgtttattttatgtttattttagactgtggaaatgatgttagacaaaaagcaaacttgagagattttcttatt

SEQ ID NO: 5254 - DNA, 89 bp, Homo sapiens
tcagttctgaatcttaggtgttctgtggcaaataaaaggcagatatcatatcctcattttgccactggaagaattgagacatttgctgg

SEQ ID NO: 5255 - DNA, 58 bp, Homo sapiens
ttgagacaggctctcactgtcacccaggttggagtgctgtggcctggcctgatcacag

SEQ ID NO: 5256 - DNA, 75 bp, Homo sapiens
ttggaggctgaggtggtaggatcattagaggtcaaggctgcagtgagccgtgattgtgccactgccctctagcct

SEQ ID NO: 5257 - DNA, 70 bp, Homo sapiens
ttgagacagggtctcactctgtcacccaggttggtgtgcagtggcatgatagggcttaccacagtctcaa

SEQ ID NO: 5258 - DNA, 82 bp, Homo sapiens
tataataaaacatatatgctatatagtataatcaaatatggtatgctatatttgattatatagcatagtttgttttattata

SEQ ID NO: 5259 - DNA, 99 bp, Homo sapiens
ggccttgttcctgagctgttggattcggggccgtagcactgtctgagaggtttacatttctcacagtgaaccggtctctttttcagctgcttcctggct

SEQ ID NO: 5260 - DNA, 154 bp, Homo sapiens
atatatatatacatatatacattatatatatacatacatacatatgtatatatgtgtatatataatgtatatatgtgtgtatatatgtatatatacacgtatctatatatacacatatatattatacatatgtatatatatgtgtatatatgca

SEQ ID NO: 5261 - DNA, 108 bp, Homo sapiens
ctgcccctgtttggatcatgtggccaccttcagagtagtcagtgtccacatgtgtgggccctctggttggaggaggtgacatgcccaatcttgtggtgaaggaggtgg

SEQ ID NO: 5262 - DNA, 94 bp, Homo sapiens
ctctgcaagaagggaggaaggggcagagaggaatgtgcctgagggccctgatattcactcttgtctgtctgtcactcttgtccataggccagag

SEQ ID NO: 5263 - DNA, 106 bp, Homo sapiens
acatttttaaaataaattttgtatatatactgaattcaatttgataattttatttaaatttttttcattttgttcaggtatacacaacaaaattaattttaagtgt

SEQ ID NO: 5264 - DNA, 105 bp, Homo sapiens
attgcattagattagttcttcagtagagtgttgaataaaagcagtgatggaggcatgcttgtattgtttttatttaaatactaaagtcttgagattaagtgtgat

SEQ ID NO: 5265 - DNA, 103 bp, Homo sapiens
ctgaggcagaagaattgcttgaacccaggagacagaggttacagtgagcagagatcgtgccactgcactcctgcctgggtgacagaacgagactccatctcag

SEQ ID NO: 5266 - DNA, 113 bp, Homo sapiens
gaactccataaggatctagatgcagttcaggcttaactaaattgtgacttgatttttttttttttaagcaaaggacatgcagctatttttagtccctttaaaaaatggacttt

SEQ ID NO: 5267 - DNA, 76 bp, Homo sapiens
ttcatgtctgtgcgtataggttttttttgtttgtttgttttttgagacagagtctcgctctgtcgcccaggctgga

SEQ ID NO: 5268 - DNA, 58 bp, Homo sapiens
tgagacagagtctcgctctgtcacccaggttggagtgcagtggcgcaatctcggctca

SEQ ID NO: 5269 - DNA, 77 bp, Homo sapiens
atatatatgagcattacatatatatatataatgctcatatatgagcattatatatatatatgtgtgtgcgtgtgtgt

SEQ ID NO: 5270 - DNA, 152 bp, Homo sapiens
accactgcactccaggctgggcaacagagtgacagtctgtttatttaatttaatttaatttattattattttttgagacaaagtctctctctgtctcccaggctggagtgcactggtacaatctcggctcactgcaacctgtgccacctggg

SEQ ID NO: 5271 - DNA, 186 bp, Homo sapiens
gggagagtgaagttgccctctagaaattcagacacaggaatgccagataatcctatttttcttttttcttttgttttttttttttgagatggagtttcgctcttgtcgcccaggctggagtgccatggtgtgatctctgctcattgcaaactccacctccagggttcaagtgattctcctgctcag

SEQ ID NO: 5272 - DNA, 83 bp, Homo sapiens
ggtaatcttcacagtatttcaaactgtttcattattattatatctgttatgatgatctgtggtcagtgatctttgatgttacc

SEQ ID NO: 5273 - DNA, 86 bp, Homo sapiens
agtgaagacctcacatggagaaggagcagaatgtcaagcctcaagtgtttgtttctttttttttttttttgagacagagtctcgct

SEQ ID NO: 5274 - DNA, 57 bp, Homo sapiens
tgagactgagtctcactctgtgcccaggctggagtgcagtggtgccatctcagctca

SEQ ID NO: 5275 - DNA, 81 bp, Homo sapiens
gaaaattttttttgagatggagtctcactctgtctcccaggctggagtgcagtggtgtgatctcggctcactgaaaccttc

SEQ ID NO: 5276 - DNA, 58 bp, Homo sapiens
tgagatggagtctcactctgtctcccaggctggagtgcagtggtgtgatctcggctca

SEQ ID NO: 5277 - DNA, 57 bp, Homo sapiens
tctggcagaaggttctattctttggagaccccatcccaggaaaggcctcaggccagg

SEQ ID NO: 5278 - DNA, 95 bp, Homo sapiens; identical to SEQ ID NO: 68

SEQ ID NO: 5279 - DNA, 93 bp, Homo sapiens; identical to SEQ ID NO: 69

SEQ ID NO: 5280 - DNA, 96 bp, Homo sapiens
ttccacttgggagagagcatcaggcgagggatgtcagaattttttatttttattttttttctgagacagtgtctcactctgtctcccaggctggag

SEQ ID NO: 5281 - DNA, 96 bp, Homo sapiens
aaagtacttaaatctaggattgtggcaggcaggattattaaaattgaagttcaggggacttttctctctgtcacaggatatttggagtgtcacttt

SEQ ID NO: 5282 - DNA, 96 bp, Homo sapiens
catggccaaaggtggggtcatgtgtgtctgtgtctgcgtgcatgtgtgtgcatgaaagacagaaggggagacaaagaatcacctgatgtgctcatg

SEQ ID NO: 5283 - DNA, 211 bp, Homo sapiens
gtgtgtgtgtgtgtgtgtgtgtgtgtgtatatgtatatatacatatatatgtgtgtgtatatgtatatatacatatatgtgtgtgtatatgtatatatacatatatgtgtgtgtatatgtatatgtatatatactagtgtgtatatgtatatatacatatacacacacatatatgtatatatgtgtatatatatgtgcgtgtgtgtgtata

SEQ ID NO: 5284 - DNA, 106 bp, Homo sapiens
tatatacacatatatacatatatgtgtgtgtatatgtatatatacatatacacactagtatatatacatatacatatacacacacatatatgtatatatacatata

SEQ ID NO: 5285 - DNA, 150 bp, Homo sapiens
gttattggagaacagtggtgtttggtgacatgagtaagttcttttttcttttttctttttttacttttttttgagaccgactctaactctgtcacccaggctggagtgcagtggcacaatcttggctcactgtaacctctgcctcccggg

SEQ ID NO: 5286 - DNA, 95 bp, Homo sapiens; identical to SEQ ID NO: 580

SEQ ID NO: 5287 - DNA, 93 bp, Homo sapiens; identical to SEQ ID NO: 69

SEQ ID NO: 5288 - DNA, 115 bp, Homo sapiens
agggataggcaaggacatcttgagggcaggaagcatgatggagtttgttgggttggatctctttcactgtctcagtcacaattttgcaatgatgttttcaaaacctgcttaccct

SEQ ID NO: 5289 - DNA, 79 bp, Homo sapiens
gatgtgcattttagaaaggataatagtaatcagatttttcttttttaagaaagtaactatcattttttcttatgctatc

SEQ ID NO: 5290 - DNA, 64 bp, Homo sapiens
actcacagggagaagagtgaagtgatattcatgatcaatcatgaatgtcatttctagccagagt

SEQ ID NO: 5291 - DNA, 115 bp, Homo sapiens
tgataatctattttctttcaccatgatataaattacaggaggtaaaagagtttaattttgtttattactatagttcagtatctagacctggtgtttatgatatagtaggtgatca

SEQ ID NO: 5292 - DNA, 101 bp, Homo sapiens
ttctgcttaaaggagtgcaattactttcagttgagaatgtctgcactaaaagacatgtttatttgttttagaagagagcacatttccatatgtaggctgag

SEQ ID NO: 5293 - DNA, 116 bp, Homo sapiens
gggtctggaacggatagcaagtctcatttggaaaatacacattatttgaatacattgaaaacaagtatgctgatgtttatataccatagaaacattgagtccaagttctatgactt

SEQ ID NO: 5294 - DNA, 95 bp, Homo sapiens; identical to SEQ ID NO: 580

SEQ ID NO: 5295 - DNA, 93 bp, Homo sapiens; identical to SEQ ID NO: 69

SEQ ID NO: 5296 - DNA, 176 bp, Homo sapiens
gtatgtgtgtgtatatatagtatctgtgtatatatatagtgtgtgtatataaatatatagtatgtgtgtatatatatattgtgtgtgtatatacatatatgtgtgtgtgtgtgtgtgtgtgtgtgtgtgtgtatatatatatatatatatatatatatatatatatatatatatat

SEQ ID NO: 5297 - DNA, 87 bp, Homo sapiens
ggataaaatctcctgcctgagggtggaagaaactcagggactctggccctaacttacctttctctctctcagtgattcttcaaatcc

SEQ ID NO: 5298 - DNA, 80 bp, Homo sapiens
gacaaaatatatttagcactggattaatcaaagtggggactatctcaaggattaaatatccaagtttatttatatttgtc

SEQ ID NO: 5299 - DNA, 85 bp, Homo sapiens
cagggctctgttgcccaggctggagtgcagtggcacactcaggctcactgcattctcaaactcttgggctcaagtgattctcctg

SEQ ID NO: 5300 - DNA, 83 bp, Homo sapiens
gttaaaggaagtctgtgtgtgtgtgtgtgtgtgtgtgtgcgcgcacacacacacacatacatgtgcacgggcagttatttaat

SEQ ID NO: 5301 - DNA, 94 bp, Homo sapiens
tagtttaattactgccatctttaaaactagactgtgtgctccctgagggcagggctaggatcatatttttttaaatattgtagtctcaatacta

SEQ ID NO: 5302 - DNA, 113 bp, Homo sapiens
taggcagagcataaaagactgacatgagaaggaattgggcatctgggtagttaatttttattcttgaatgccctgctgcttttttgacttttgtgggtgtttttggtcctcta

SEQ ID NO: 5303 - DNA, 115 bp, Homo sapiens
agctggtgactcaggacaattatggctgagatataagccacatatatatatatatatatatatatatatatgtggcttatatatatatatatctcagacttaagatgagtttgtt

SEQ ID NO: 5304 - DNA, 113 bp, Homo sapiens
atgactttggacttaactacagtggcactttcaaattaacattttattgagcaacatttttttttgtttattcagtggttttagtggttgccataaaggaagtaaatagttat

SEQ ID NO: 5305 - DNA, 76 bp, Homo sapiens
tgctgcctatgggggactggcacgtttcaagggactggatcttgtaaacactctctctctcattttggtgtaagta

SEQ ID NO: 5306 - DNA, 111 bp, Homo sapiens
gctttctggatgaacttagcggatgcttgcgaaaagttttatgttttaatataagaatgtctttctccaagcaaagaagtttcctaggctataattaaaaatgtggaaagt

SEQ ID NO: 5307 - DNA, 109 bp, Homo sapiens
ggaaaacagacccacaaagcattatttcatatctccatgcagtgattttttttttctctaacttggggaatgaggtagaatttctattgccccccactttctgttggct

SEQ ID NO: 5308 - DNA, 104 bp, Homo sapiens
gtttttatctatggctcctggcttatgattcccatagcccttgttaatagtcttttattataattttatggtgcttttggcctcaggagcagacctcagaaaac

SEQ ID NO: 5309 - DNA, 132 bp, Homo sapiens
tatatagtaaatgtgtgtgtatatatgtgtatatatgtatataatgtgtatatgtacatatatgtatatatgcatattttttctcttttatatatatatatacatatatgtgtgtgtatatatatatataca

SEQ ID NO: 5310 - DNA, 85 bp, Homo sapiens
tcctgtctcagactcccaagtagctgagattacaggtgcgcactaccacgcccagctaattttcatatttttagtagagacggga

SEQ ID NO: 5311 - DNA, 80 bp, Homo sapiens
gacagccaaaaaactgagtgcccaaagtgtgagaggggaaagtccaccttctaacacacactctcactggggaacctgtc

SEQ ID NO: 5312 - DNA, 86 bp, Homo sapiens
cagcatgttgggtttcctcagacacctttttatttatttatttatttatttatttgagatggagtctctctgtgtcacccaggctg

SEQ ID NO: 5313 - DNA, 67 bp, Homo sapiens
tgttgtgacccaaatgtatgtctgtgtacatgtatgtacgcaggtatgtatatatttttaagcaaca

SEQ ID NO: 5314 - DNA, 67 bp, Homo sapiens
atgagatttgtgtgaggacacagagccaaaccatatcattctgcccctggcccctctcaaatctcgt

SEQ ID NO: 5315 - DNA, 115 bp, Homo sapiens
gatatttactgatgcttgttttagtactcagcatgtagtttctcttggtaaatgtttcaaatgcattgaaaagaatataactgtcagttgttttctgtagcaatccacaaatatc

SEQ ID NO: 5316 - DNA, 93 bp, Homo sapiens
tgtctccgaccctgttttctggtgatctagagggcttactttttttttttgtttcagagaaggagtctctctctgtcgccaggctggagtgca

SEQ ID NO: 5317 - DNA, 85 bp, Homo sapiens
ttgttgtgcttcagtttatttatttgtaaaaacattggaatggtataggctaggggcgatgtataaaaagtgactggcacaccag

SEQ ID NO: 5318 - DNA, 95 bp, Homo sapiens
tcattatggtcatcccttggtctgtattgtctgtgtcataattgcttcctcttacaagaacactagtcatattggactagggcctgcccatatga

SEQ ID NO: 5319 - DNA, 65 bp, Homo sapiens
tgagcccaggagacagaggttacagtgagctgagatcatgcaactgcactccagcctgggtgaca

SEQ ID NO: 5320 - DNA, 118 bp, Homo sapiens
tctcaaggttttatggttttcatggtatagatatttcacttctttggtaaatttacaccaaagtattttatttttatgctattgtaagtgggattgtttccataatttcttttttgga

SEQ ID NO: 5321 - DNA, 74 bp, Homo sapiens
gactagcagtatcctaattgaagaataattttatttacttattttttttttcagacagggtctcactgtcagtc

SEQ ID NO: 5322 - DNA, 73 bp, Homo sapiens
atatatatatacatatatatgtgtgtctgtatatatatatatagtgtgtgtatatatatgtgtgtatatatgt

SEQ ID NO: 5323 - DNA, 87 bp, Homo sapiens
tagctatgaggaataagttgtggtgttttatagctctctagggtgactataataaacaacaatctattttatattttcaagtagcta

SEQ ID NO: 5324 - DNA, 82 bp, Homo sapiens
ttgctttttttttttttttgagatggagtcttgccttgcagcccaggttggagtgcaatggtgtgatctcagctcactgcaa

SEQ ID NO: 5325 - DNA, 105 bp, Homo sapiens
ttctatggcagtgaatatactctgtatgatattatagtggtgtatatgtcatcacacacacccacacacacaaatccaaatctgcagaatattcaatatcaagag

SEQ ID NO: 5326 - DNA, 118 bp, Homo sapiens
tctgtatatctataaatatgtagatatatctatatctatatatgtgtgtatatatcactatatctatattatccatatataatgtagtatatctatataatatatagtatatagatat

SEQ ID NO: 5327 - DNA, 118 bp, Homo sapiens
tctagtatctatgtatatatactgtctatattgtgatagatgtaggtatctatgttatatctatataaattagtctgtctatactatagatgtactacacaaaggaaagtttactaga

SEQ ID NO: 5328 - DNA, 80 bp, Homo sapiens
tagaatttatatagtgggtcaggctgtcccagatggcacactgccctatgtttaatagtctgaatatttttaaaattcta

SEQ ID NO: 5329 - DNA, 105 bp, Homo sapiens
taaacagagcacctgtaaggaaataaaaagatagtcttaacataatgttcttttatatcaatatttgtagacgtctttctcctccctttcagcctttcatgtttg

SEQ ID NO: 5330 - DNA, 86 bp, Homo sapiens
attgattctcagtgattgatctttttcaatatatggttcttgaacaacctggatgtttttcagaagtgagatgcctgggactcagt

SEQ ID NO: 5331 - DNA, 79 bp, Homo sapiens
gagacaagagacttgagagagtacacagaggagggagctatggctatctatgctctgcattctaattggcagtctcctc

SEQ ID NO: 5332 - DNA, 64 bp, Homo sapiens
tagtgagacggagtctcactctgtcacccaggctggagtgcagtggtgcaatctctgctcactg

SEQ ID NO: 5333 - DNA, 95 bp, Homo sapiens; identical to SEQ ID NO: 580

SEQ ID NO: 5334 - DNA, 93 bp, Homo sapiens; identical to SEQ ID NO: 69

SEQ ID NO: 5335 - DNA, 96 bp, Homo sapiens
gtatgagagaggcagagagcctccctctgtgactcacctctccactggagatctgagcaacccaggacagaggagaacactttgtttctcccaagc

SEQ ID NO: 5336 - DNA, 115 bp, Homo sapiens
tccagctttgtttttttgcttagtattgtcttggaaatatggactcttttttggttccatatgaaatttaaagtagttttttctaattctgtgaagaaagtcaatggtagcttga

SEQ ID NO: 5337 - DNA, 115 bp, Homo sapiens
gtttgtttgctttagaaattctggtaaatgttgtctccctaatcagtaatgatgttgaaatcatttcatgaccttattggccatttgtatatctccttttgtgaagtgatcattc

SEQ ID NO: 5338 - DNA, 78 bp, Homo sapiens
gtatacacatgtatgtgtatatgtatatgtatacacgtgtatgtgtatatgtatatgtatacgcgtgtatgtgtatat

SEQ ID NO: 5339 - DNA, 95 bp, Homo sapiens
catatatatacatatatatatatatacttgtgtgtgtatgtatgtatatatatgtatatatacatacacacgtatatataaatgtgtatatatgt

SEQ ID NO: 5340 - DNA, 172 bp, Homo sapiens
acatttcaacccaacaaatatatatatatgtgtgtgtatatatatacatatatatatgtgtgtgtatatatatacgtatatatatgtgtgtgtatatatgtatatatgtgtatatatgtatatatgtgtatatatgtatatatgtgtatatatatacatatatatgtctata

SEQ ID NO: 5341 - DNA, 73 bp, Homo sapiens
tagactcctcttgactgtgagtttctcaaactttcattgtttttgatgacctcgttagttttgaggagtactg

SEQ ID NO: 5342 - DNA, 66 bp, Homo sapiens
tgagactgaatctcactttatcactctgtcacccaggctggagtgcagtggtgcgatatcggctta

SEQ ID NO: 5343 - DNA, 106 bp, Homo sapiens
taggcactcaataaatgatagttgttgttattgctatttttattaatttttttgcagaacaagtggcaatggtaatggcatatgtgcatttagagatagttgtctg

SEQ ID NO: 5344 - DNA, 76 bp, Homo sapiens
tatgtatatatctatctatatctatatatggatatctatatacctatatacctagatatacctagatatctatata

SEQ ID NO: 5345 - DNA, 116 bp, Homo sapiens
gtatcatacaaagaaaaagaaccgatatatatgtgtgtgtgtatgtccatatatatatatatatatatatatatatatatatatatatgaaggagatttataattggaattggtac

SEQ ID NO: 5346 - DNA, 119 bp, Homo sapiens
atatatatatatgtatatatatatatacacatacatatgtatatatacacatatatatgtgtgtatatatacatatgtatgtgtatatatatatatacatatatatatatataatacat

SEQ ID NO: 5347 - DNA, 103 bp, Homo sapiens
ttgagacagaatcttgctttgttgcccaggctgaggtgcagtggtgcaatcttggctcactgcagtctctgtctccagggttcaagcgactctcctgcctcag

SEQ ID NO: 5348 - DNA, 77 bp, Homo sapiens
ggcaggccattggagagatgactgacagaactcattttaacaagcggagttcgcagcattatttctgacaaattgct

SEQ ID NO: 5349 - DNA, 119 bp, Homo sapiens
ctatagtatagattttaactaaaattatattcctgcatttgtgtatatatatatatgagagagagagtatgtatatatatatattgagagagagagtgtatatatatatagagagtgta

SEQ ID NO: 5350 - DNA, 67 bp, Homo sapiens
gtcttgtttgtgattatactactgtcaatttttgttttaaattgaccctagttagctattgcaagac

SEQ ID NO: 5351 - DNA, 58 bp, Homo sapiens; identical to SEQ ID NO: 315

SEQ ID NO: 5352 - DNA, 58 bp, Homo sapiens
atgtatatcaatgcaatgcaatggtatatgtatatcaatgcaatgcaatgatatatgt

SEQ ID NO: 5353 - DNA, 110 bp, Homo sapiens
cccagtgactttttttgtttgttttttttcttgagacagagtctcgctctgtcacccgggctggagtgcagtggcgagatctcggctcactgcaaactctgtctcctggg

SEQ ID NO: 5354 - DNA, 97 bp, Homo sapiens
atatatatacatatatatgtgtatatgtatatgtgtatatgtgtatatatatacacatatatatgtgtgtgtgtgtgtgtgtgtgtgtgtgtgtata

SEQ ID NO: 5355 - DNA, 101 bp, Homo sapiens
agtttgcttataatgtgtgttggtgtagacttctttgaatttatcccacttggggatggttgagcttcttggatgtatatattcatgtatttcatcaaact

SEQ ID NO: 5356 - DNA, 78 bp, Homo sapiens
tatatatgtatatatatgtgtgatatgttaagtgtatatatacacacacacatatacatacatatacctatatatatg

SEQ ID NO: 5357 - DNA, 70 bp, Homo sapiens
gtttttgatatggagtctcactctgtggctcaggctggagtgcagtggcgagatccagactaattgaaac

SEQ ID NO: 5358 - DNA, 69 bp, Homo sapiens
ttccagttacctgtgtagggaccagccccacagggtcggtgggtctctccctgtgtgcggcgacgagag

SEQ ID NO: 5359 - DNA, 56 bp, Homo sapiens
tgtgagtgtgtgtgtacatgcacgtgcgcatgtgtctgtgtgtgtctgtgcttgca

SEQ ID NO: 5360 - DNA, 95 bp, Homo sapiens; identical to SEQ ID NO: 68

SEQ ID NO: 5361 - DNA, 93 bp, Homo sapiens; identical to SEQ ID NO: 69

SEQ ID NO: 5362 - DNA, 82 bp, Homo sapiens
atgtgtgtctatgtagtgtgtgatttaaaaattgatctggatggcacttgggaaatataatcacacacacacacacacacat

SEQ ID NO: 5363 - DNA, 88 bp, Homo sapiens
ttcttcttagctcagctaggtctgggttcttgtctcatgaccaggaaaaattaggcacacagacactcagagagtgagtggagtagaa

SEQ ID NO: 5364 - DNA, 76 bp, Homo sapiens
tttgattgtcttttttatttttatttgtttgctgtagctacagcaacatcttaaacaggaaagtgactcaatcaga

SEQ ID NO: 5365 - DNA, 58 bp, Homo sapiens; identical to SEQ ID NO: 3385

SEQ ID NO: 5366 - DNA, 56 bp, Homo sapiens; identical to SEQ ID NO: 3386

SEQ ID NO: 5367 - DNA, 114 bp, Homo sapiens
aggtatgtgagtacatgtatatgtgtgtggtttccttgttcaggtgtgtgtgtgtgtgtgtgtgtgtgtgtgtggtttccttgttcaggtgtgtgtgtgtgtgtgtgatttcct

SEQ ID NO: 5368 - DNA, 95 bp, Homo sapiens; identical to SEQ ID NO: 68

SEQ ID NO: 5369 - DNA, 93 bp, Homo sapiens; identical to SEQ ID NO: 69

SEQ ID NO: 5370 - DNA, 88 bp, Homo sapiens
ggactcagtctcaggttcagcttctcctgctacactcagagaactgcctgtgcagagacttactagaagatatgtgcttatttgagcc

SEQ ID NO: 5371 - DNA, 95 bp, Homo sapiens; identical to SEQ ID NO: 68

SEQ ID NO: 5372 - DNA, 93 bp, Homo sapiens; identical to SEQ ID NO: 69

SEQ ID NO: 5373 - DNA, 97 bp, Homo sapiens
gttactaaatttcctccctggttgtgactagaattggtgatttttttttttgtaaaatgcctgtatttttctgtttgccagtaagaagttcagaaac

SEQ ID NO: 5374 - DNA, 103 bp, Homo sapiens
agttattatggtctgcaaccttagtaactctgtgcaaagattatataaatattacatagatgtgtatttcttgttaataagggtgtagttggacactgtagct

SEQ ID NO: 5375 - DNA, 94 bp, Homo sapiens
gggggcgggtgggtgggggcatacagagtctcactctgtcttccaggctggagtgcaatggtgcgatcttggctcactgcaacctctgtctccc

SEQ ID NO: 5376 - DNA, 82 bp, Homo sapiens
gtttgtttgtttgagacagtctcactctgtcgcccaggctgcaggctggagtgcagtagcgcgatctcgactcactacaagc

SEQ ID NO: 5377 - DNA, 91 bp, Homo sapiens
agaggtgtattgaagtatgtgtacatggatacaatccagtatttatttttattagtgtatttaaatgcattttgatctttaagatatcttt

SEQ ID NO: 5378 - DNA, 69 bp, Homo sapiens
tttatttgctctttttctcacagagattttatttttcttaagactgttgtggggtggggggagggtgga

SEQ ID NO: 5379 - DNA, 95 bp, Homo sapiens
cgatgtgggctcttttttggttccatatgaaatttaaagtagttttttccaattctgtgaagaaagtcattggtagcttgatggggatggcgttg

SEQ ID NO: 5380 - DNA, 115 bp, Homo sapiens
ttctgtgcatcacttgaaagtggcatgatttatttcttttagtgtgttaatgtagtaaagtatattaattactttttaagagacagggtctcatgttgctttggctggccttgaa

SEQ ID NO: 5381 - DNA, 95 bp, Homo sapiens; identical to SEQ ID NO: 68

SEQ ID NO: 5382 - DNA, 93 bp, Homo sapiens; identical to SEQ ID NO: 69

SEQ ID NO: 5383 - DNA, 104 bp, Homo sapiens
tggagtggataaagaagtttcacaaatcataatgaaaatttatcattttaaagtaaattagtttggtattactgataggtgaaattcttaacacatctatttta

SEQ ID NO: 5384 - DNA, 81 bp, Homo sapiens
tcctttcattcacagctgcaataggaggctacaaacatgcatgcacaatttttctttttattgaacagctgcctgataggg

SEQ ID NO: 5385 - DNA, 64 bp, Homo sapiens
gtcccactgtttctcagtctcagactgacccgagcaggagtcaggaggttgggtccgtgaggat

SEQ ID NO: 5386 - DNA, 88 bp, Homo sapiens
tagatattagatctatcgcctagactagagtaaggttgagcatttctgggcggaatgttttctgggtggtgttaggcatctgtatatt

SEQ ID NO: 5387 - DNA, 111 bp, Homo sapiens
tagttataggataatgggttccagcctttcagtcttgaccctgaaattcacctgggaaatatcagtgatgaaagagagcactggggtaggatccaaaaaatctggtttctg

SEQ ID NO: 5388 - DNA, 77 bp, Homo sapiens
tagatatatctgtgtatatactttcacatatgacaaagtcatatatgactttgtatatacatatatatgcatatcta

SEQ ID NO: 5389 - DNA, 115 bp, Homo sapiens
tctttgtatccaaaggtgtatatatatatatatacgtgtgtgtgtgtatatgtatatatatatatatatgtttatatatatatgtgtatatatatatattgcttggatgcactga

SEQ ID NO: 5390 - DNA, 58 bp, Homo sapiens
tgagcagagatcacaccactgcactccagcctgggtgacacagtgagactctgtctca

SEQ ID NO: 5391 - DNA, 96 bp, Homo sapiens
ccagaagctgggattacagatgtgtgccaccacacccagctaatttttttatttttagttgagacaggtttcaccatgttggccaggcttgtctgg

SEQ ID NO: 5392 - DNA, 95 bp, Homo sapiens; identical to SEQ ID NO: 68

SEQ ID NO: 5393 - DNA, 93 bp, Homo sapiens; identical to SEQ ID NO: 69

SEQ ID NO: 5394 - DNA, 98 bp, Homo sapiens
gtagtgtacagtaatgtcctaggcctttgggttcactcactacacactcagtgactcacccagagcaacttccagtccattcatggtaagtaccctac

SEQ ID NO: 5395 - DNA, 95 bp, Homo sapiens; identical to SEQ ID NO: 68

SEQ ID NO: 5396 - DNA, 93 bp, Homo sapiens; identical to SEQ ID NO: 69

SEQ ID NO: 5397 - DNA, 121 bp, Homo sapiens
aggaaaaaatatattttctataatcaattttagtcaaacaattttttattgttttttactacataatgatgtatagaaacaattattatggctgtgattttgtagataacattatgttctt

SEQ ID NO: 5398 - DNA, 58 bp, Homo sapiens; identical to SEQ ID NO: 3270

SEQ ID NO: 5399 - DNA, 96 bp, Homo sapiens
gcaattttcagatatgcaatgcatttttatttattatagtcaccattctgtgcaatagataactcaaatgtattccatctgtctgaaactttatgc

SEQ ID NO: 5400 - DNA, 104 bp, Homo sapiens
gatttgttctttgctcaattaaactccgttaaatttagtttggctcatgatttttttttttaacagtgtgttctgcacgtgatggggtttgttgtaaggtgatc

SEQ ID NO: 5401 - DNA, 104 bp, Homo sapiens
gctctctttccacagtattgtcttgtctatatatatatatgaatttgccatttatagtcaattatgtagactacagagacagaggccatatatatatatatata

SEQ ID NO: 5402 - DNA, 90 bp, Homo sapiens
gaaaagtgcagatgtaggatcttcagttcagattttgtaggacttcttaaccagacaacattgcttctgaaaatcttaacagtatttttt

SEQ ID NO: 5403 - DNA, 60 bp, Homo sapiens
ttgagatcaaatctcactctgtcacccaggctggagtgcagtggtgtgatcttggctcaa

SEQ ID NO: 5404 - DNA, 103 bp, Homo sapiens
ggtttttatttaaaatctcagtaagtttatgtagagtattagaacatcattggtgtaggtttattctattttttaaattaattgagaaaacttcataagaatt

SEQ ID NO: 5405 - DNA, 99 bp, Homo sapiens
agtgagatgtcaaaggaagcaaagaactagagatagcatatatgaaatgctgtattccttttcttttttttttttttttttttgagacggagtctcact

SEQ ID NO: 5406 - DNA, 75 bp, Homo sapiens
gttgttttcttgagatggagtctcactctgtcacccaggctggagtacagtggtgcaatctcggctcactgcaac

SEQ ID NO: 5407 - DNA, 70 bp, Homo sapiens
ctgttttgagactgagtctcgctctgtcacccaggctggagtgcagtggcgcgaacttggctcactgcag

SEQ ID NO: 5408 - DNA, 57 bp, Homo sapiens
gtctgctctctcactttctgccctctgccatgtgaggatacagtgagaagacaggac

SEQ ID NO: 5409 - DNA, 71 bp, Homo sapiens
tgcttacaaggcatcatgatgtagtggaaatctaggctttggagccactcactatctgagtcctttaagca

SEQ ID NO: 5410 - DNA, 88 bp, Homo sapiens
ataattatagtgctctgagactctcacatatttaataagggggtatctccttggacattggggaattttttagagatacatcagttgt

SEQ ID NO: 5411 - DNA, 75 bp, Homo sapiens
ggaagtgtaggatgtgcacaggactgaactgagtgtgcatacatatgagtgacactctccctgtggcctatggcc

SEQ ID NO: 5412 - DNA, 83 bp, Homo sapiens
tccatatatatgtatatacatatatatctagacggatgtatatagatacatccgtccatgtatgtattatacatacatatgga

SEQ ID NO: 5413 - DNA, 112 bp, Homo sapiens
ggattgtcttggctatacaggctcttttttggttccatatgaaatttaaagtagttttttctaattctgtgatgaaagtcaatggtagcttgataggaatagcattgaatcc

SEQ ID NO: 5414 - DNA, 58 bp, Homo sapiens
tgagactgagtctcgctctgtcatcgagactggagtgcagtggcgcgatctcggctca

SEQ ID NO: 5415 - DNA, 114 bp, Homo sapiens
tatagcaaatctaattatgtttgtttctcgtacttcttaaatgtttctttttataattttaataatggtttatttatactggcagagaaacattacattgtacattgtgctttg

SEQ ID NO: 5416 - DNA, 142 bp, Homo sapiens
gtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgt

SEQ ID NO: 5417 - DNA, 109 bp, Homo sapiens
gtatgtgtgtgcatatatacacaaacaaaaataaatgcatgctctctatgtgtatatatatatgtgtgtatatatacacatatacacatacacatgtgtgtgtatatat

SEQ ID NO: 5418 - DNA, 82 bp, Homo sapiens
gactattgatgaagcatgtattgttttctagctgcttaagaaaatgtattggcattagtaaataatgctgaacacagaggtc

SEQ ID NO: 5419 - DNA, 122 bp, Homo sapiens
ttctaccctgctctgtccattactgcctatacatgtcttctatgaactctagtcttcacattggtacgatgaagataaacctagcttataagagagtggtagagagtaaacaagataatgca

SEQ ID NO: 5420 - DNA, 143 bp, Homo sapiens
tgtgtgtgtatatatgtgtatgtgtgtatgtatatctgtgtgactttattttatatatataaatgtatacgtgtgtatgtatatacatatgtgtgtatatatatgtatgtaaaggtgtgtctatatatatgtgtgtgtatata

SEQ ID NO: 5421 - DNA, 81 bp, Homo sapiens
tgcaatttatatatatgcaatttgcatatatatgcaatttattatttatatatatgcaatttattaagatatatatatgca

SEQ ID NO: 5422 - DNA, 95 bp, Homo sapiens; identical to SEQ ID NO: 68

SEQ ID NO: 5423 - DNA, 93 bp, Homo sapiens; identical to SEQ ID NO: 69

SEQ ID NO: 5424 - DNA, 104 bp, Homo sapiens
agctttattgaggtataatcggcacataataatatatatttaaagtatacaatataatgttttgatgtatgtacacattatgaaatgattaccacaatcaagct

SEQ ID NO: 5425 - DNA, 68 bp, Homo sapiens
cttagatatatctgtatatgtatattatatgctatatatatattacacatatacacatatttgctagg

SEQ ID NO: 5426 - DNA, 60 bp, Homo sapiens
tatatgtgtacgtgtgtgtatgtgtgtgtatatatatgtatatatgcatgtatatgtgtg

SEQ ID NO: 5427 - DNA, 59 bp, Homo sapiens
gtgtgtgtgtgtgtgtgtttaaccaagtaggggttggttaaacatatatatatatatgt

SEQ ID NO: 5428 - DNA, 117 bp, Homo sapiens
tcagcctccagagtagctgggagtacagttgtgtgccaccacagctggctaatttttttgtatttttagtagagagggggtttcacaatgttggccaggctagtctcaaactcctga

SEQ ID NO: 5429 - DNA, 82 bp, Homo sapiens
atagatagctatattacatgattggtgaagaaatgataacatatttttattaattctgtatgttaggtgtatgggtatctat

SEQ ID NO: 5430 - DNA, 95 bp, Homo sapiens
agggatagtggtggtgatggtagttccctttgtgggcagaagcattctctgtatctgttatggaactctactgttttagattctctacttcctct

SEQ ID NO: 5431 - DNA, 91 bp, Homo sapiens
tatgtgaaactcttccatgaatgagaaatctgttctgtgcttctttaaagacacagggaggtttgaagtgaatcctggaaggtatctcata

SEQ ID NO: 5432 - DNA, 97 bp, Homo sapiens
ctgttgagagacatttaggttgtttctaagtttttgttattacacacattgtcttggtaagtctcctggatcaatttaaatcgtcattgtttggcag

SEQ ID NO: 5433 - DNA, 89 bp, Homo sapiens
tcaggcttccaggagtgcttccatctcatcagcccttgtttccatacttaaaagaacacagagaggtgagaattgctggtcttgcctga

SEQ ID NO: 5434 - DNA, 70 bp, Homo sapiens
cacactgcctctctgcctccctgactcccaagtctcaaaggtgtcattgagaaaggcagagagccagttg

SEQ ID NO: 5435 - DNA, 101 bp, Homo sapiens
ttctgtttctctgagtgaatagtgagactaagtggggtgtaaggatgtttcatcctcaaaatttattttttctttcattactatgtcagtttgaaaaagaa

SEQ ID NO: 5436 - DNA, 58 bp, Homo sapiens
tgagacagagactcactctgtcgcccaggctagggtgcagtggcatgatctcagctca

SEQ ID NO: 5437 - DNA, 110 bp, Homo sapiens
ttttagaaattcagcatattgactgccattactgtatcacagagaattttacaaatatttttatattatcatgctggtcaaaaatgtgcagcagtgatgtctgtctggaa

SEQ ID NO: 5438 - DNA, 82 bp, Homo sapiens
cgtctcctgtcttccctgtgtgtctgcctgtgtctcctctttttataaagacactagactagtcacattggattagggtacg

SEQ ID NO: 5439 - DNA, 86 bp, Homo sapiens
ttcagagatgaaggtgatgtgtgcaattactatcattaaaatgtaatgaccctctcaagtatgtttttattatttttatctgtgag

SEQ ID NO: 5440 - DNA, 86 bp, Homo sapiens
catttttgccatcatcacaagcctgaaagaaagggcagatgagtctgaacaaattttctgaggtcacttgtgtgtgtgtatgaatg

SEQ ID NO: 5441 - DNA, 91 bp, Homo sapiens
tagtgaacagttctactctggagtttccactcttgcttcaaaatatttatttttgatacaagagaggtaaatcttagctaagatagcatta

SEQ ID NO: 5442 - DNA, 120 bp, Homo sapiens
gctttgtgttactcttctcttacatgaatgcatagttgaccattcttgggaatgtcagagtagacagagagcttcctaaggaaagggatttttaatgtattcatttttgtatgcttagta

SEQ ID NO: 5443 - DNA, 86 bp, Homo sapiens
gatgaagatgacatctcaatttgttcttcagtggttgatcattttttataccagaaaggaggagctagattgtgtcatgattcatc

SEQ ID NO: 5444 - DNA, 111 bp, Homo sapiens
gtagtgacaaaaaggctgtagggaggtgccagtttctatggaaatggaatcttatttaagaggctatgggatagaaacaaaggttttttgatttagcatttttggcaatgc

SEQ ID NO: 5445 - DNA, 95 bp, Homo sapiens
ttggggtgtgtgactacttttgttagccctgaatcatagcagaggcagctacctctactagtcagaacagagtgagcctgtagtttctaccctga

SEQ ID NO: 5446 - DNA, 81 bp, Homo sapiens
tttgagtattggaagtggaagaatttttattaattatccattcccattggaagaattctcttttccactctggatctcaaa

SEQ ID NO: 5447 - DNA, 195 bp, Homo sapiens
tatatatatgtatgtcctattagttctgtctctctagagaaccctgactaatacagtatatgtatatatctatattcatgtgtgtatatatacaagtatatatttgtgtgtatgtgtgtatatatatatgtgtgtatatatatatatatatataggtataggtatatatgtacatgcatgtgcttaaaaattata

SEQ ID NO: 5448 - DNA, 78 bp, Homo sapiens
agatgaccagagcaggaggaagagagagaagggggaggtgctacatacttcttttgttttttttttgagatggagtct

SEQ ID NO: 5449 - DNA, 95 bp, Homo sapiens
atgccatttctctggaaataactgtctctctctctaacgatgtttaggttcttagatgtatgagagagaaggcactgaataattagatgaagcat

SEQ ID NO: 5450 - DNA, 110 bp, Homo sapiens
taaagaaatgtagtcagtggtgttggtgtggagtcaaaagacttaaatatatatatatatattgcatttttgtgacttatatttctctccaccatcttccaaaaccttta

SEQ ID NO: 5451 - DNA, 86 bp, Homo sapiens
ttctctccttctctgccactctgcctctccactggtagggcctggggtttttaagggtataggatgggggcgggggcaggggggaa

SEQ ID NO: 5452 - DNA, 113 bp, Homo sapiens
gactggaggagagggaaggaggggaatggacagttggtggagaagtcagaacatacaatatttattgattaaattcaccatgtgggtgcagtttgtggtgccctaaaatagtt

SEQ ID NO: 5453 - DNA, 104 bp, Homo sapiens
ggctctgtgattcattaaagcctgtgattccattaaatggggggcagctcaatgggaaactctgactgtctctgattgttccaccaccttaccttgaatctgcc

SEQ ID NO: 5454 - DNA, 113 bp, Homo sapiens
gagtaaaaatctgacttaggaacagaggacagaattagctcaactgatttaaaaagaagtatgttgataagttttagttaagctagtatttcctcaatgccttggccttattc

SEQ ID NO: 5455 - DNA, 56 bp, Homo sapiens
tgagacagtctcactctgtcacccaggctggagtatagtggtgagaccttggctca

SEQ ID NO: 5456 - DNA, 118 bp, Homo sapiens
cctgctgcttgtttatatcaacactgaccatgactattaatataagtagtgtttatgatgtttttcagcattcaaactcttttcatatactgtcatatcagctgtaagcaatacctgg

SEQ ID NO: 5457 - DNA, 81 bp, Homo sapiens
aagagataatgtgtgtgaggcatttggcacatagcagaggctaaatacgtgttagttgttttatttatttatttatttttt

SEQ ID NO: 5458 - DNA, 106 bp, Homo sapiens
ttatgtcacacaagtggcttcagaaacgtgtctatttttgtgtttacattccataaagaatgaacagctgtgtagaaatgtgattggaccaaagaatatgatctaa

SEQ ID NO: 5459 - DNA, 118 bp, Homo sapiens
agtggcaaggaccatgaaatcatgccatatatttggtcgattggaggaataatatttatcatttattgaacttctatgccaatgaccatgctgggtatttttcatgcataacctcact

SEQ ID NO: 5460 - DNA, 94 bp, Homo sapiens
gggaaagatttcctggtagagaagacagcctgacccaagatatggtgatgaaattggttaacatatttgtttatttaatcacttaatctatccc

SEQ ID NO: 5461 - DNA, 58 bp, Homo sapiens; identical to SEQ ID NO: 1265

SEQ ID NO: 5462 - DNA, 117 bp, Homo sapiens
ttttccacataggcatttcactctcactctgagtaatcagttattttagaatttgattttatttaattcttcttttctgaactcattgattagtagggatatgcaccagctggaaag

SEQ ID NO: 5463 - DNA, 103 bp, Homo sapiens
gagagaagaagtaaggaaattataaataaagtttatatgtatttcatataaatacacaatagaatgtatataaattgactgtgggcacatacattgttctctc

SEQ ID NO: 5464 - DNA, 59 bp, Homo sapiens
ctgggaggtggaggctgcagtgagctgagatcacgccactgtcagtcactgtgatctgg

SEQ ID NO: 5465 - DNA, 73 bp, Homo sapiens
tgagatggatgctaccaagagggattgatagaaagtattttttcatttatcagtaagtcccttatctttctca

SEQ ID NO: 5466 - DNA, 108 bp, Homo sapiens
tgtagcgagttttgaaatgtgaatccttcaacattgtttctatttttcaagattattttgactttgctggatgcactgaatgttcacattaattttaagatcagctca

SEQ ID NO: 5467 - DNA, 107 bp, Homo sapiens
catattacatatcccatgtcaatatttacacatgcattatgtaaatagatttatgccatatatttatatagatataagcatgtatatgcgatggaaatgtacacatg

SEQ ID NO: 5468 - DNA, 86 bp, Homo sapiens
taatgtgtagtgtatatataataatatatttcaggtataacacatgatatattgatatatatgttaggtgtaacacatacatatta

SEQ ID NO: 5469 - DNA, 83 bp, Homo sapiens
agtttcattttattgaaggagtttgagaaagtcttgagatctctatgattttctgcagtgaggttcttggatgatttggtact

SEQ ID NO: 5470 - DNA, 116 bp, Homo sapiens
tgccactttaaatggggacattgaagctactgctccactttaaccaatcaaaaattttctttccttttttttttttttaagatggagtcttgctcagttgcccaggctggggtgca

SEQ ID NO: 5471 - DNA, 86 bp, Homo sapiens
cagactcagctagactcagacactcactgggactacctgcctgcagaaaggaacgatcaactttgggtcacctgagagctgttctg

SEQ ID NO: 5472 - DNA, 84 bp, Homo sapiens
acattgtaccaggaaaatttttctgttaatcaaatgttcaaaactctagtatatgaatatatataacagttgctggtatcttgt

SEQ ID NO: 5473 - DNA, 77 bp, Homo sapiens
tgactgagtctcgctctgtcacccaggctggagtgcagaggcatgatctcagctcactgcaacttctgcctcctggg

SEQ ID NO: 5474 - DNA, 62 bp, Homo sapiens
tgagacagggtctcactctgtcacccaggctggctggagtgcagtggtgtgatctcagctca

SEQ ID NO: 5475 - DNA, 153 bp, Homo sapiens
tgtatgtattatacttatatatgtataagtatgtatgtattatacttatatatttataagtatgtatgtattatacttatatatttataagtatgtatgtataagtatgtaatatacatacttatacatacatatgtaaatgtatatacatat

SEQ ID NO: 5476 - DNA, 115 bp, Homo sapiens
gaatgttggtaggttgtgaaggcatttattagaacaaagagtgtatgtgtgtatatatatatatacacacacacaaatatgtgataagtagaaaaatataaaaatgtatccattt

SEQ ID NO: 5477 - DNA, 96 bp, Homo sapiens
accaacagtgtaagatcatccttgccaacatttgttagtttttttctttttgataataaccatattaactgaggtgagatgatatctcactgtggt

SEQ ID NO: 5478 - DNA, 110 bp, Homo sapiens
atgtttgtgctttgaatatgagtatcttctttgaagtactttaccattttattttatatttttgatggttataggtaccatagcatactcgattttctggataatttcat

SEQ ID NO: 5479 - DNA, 108 bp, Homo sapiens
agcagttgctgggcaagaaagtgccattgtgctgggggaatctttttttttaattttattattatactttaaggtttagggtacatgtgcacaatgtgcaggtttgtt

SEQ ID NO: 5480 - DNA, 98 bp, Homo sapiens
ttttgaagctatcaaacaaatatatatatgtatatatattcatatatgttatgtatatattatgtataaatatatatgttatatactatgttttgagg

SEQ ID NO: 5481 - DNA, 110 bp, Homo sapiens
tgcttaggattgtcttagctatacgggctcttttttggttccatatgaaatttaaagtagttttttctaactctgtgaaaaaagtcagtagtagtttgatggggatagca

SEQ ID NO: 5482 - DNA, 88 bp, Homo sapiens
agagtgggggcggtggtgaaggaggggaagtgtagattaaagtgacttaaaatatgtattttttttttttgagacagagtctctctct

SEQ ID NO: 5483 - DNA, 115 bp, Homo sapiens
tagtccataggagaatttttaaggagttacggtaagcaaaataaactaaacaagtttgattaagtttgtagatagtctctcatgtcagtggaattgtcttgtctatttgggactg

SEQ ID NO: 5484 - DNA, 86 bp, Homo sapiens
aggtatctaatttgttggcatacagttgttcataacagtctctaatgagactttgtatttctgtggtatcaatagtaatgtctcct

SEQ ID NO: 5485 - DNA, 97 bp, Homo sapiens
gtgaatgagtttgagtgaataagtagaatttgaatagagaagagagcagcgaatactatttgtttttctgtatcaaatattcagttaagcccgtagc

SEQ ID NO: 5486 - DNA, 95 bp, Homo sapiens; identical to SEQ ID NO: 68

SEQ ID NO: 5487 - DNA, 93 bp, Homo sapiens; identical to SEQ ID NO: 69

SEQ ID NO: 5488 - DNA, 101 bp, Homo sapiens
tgcttccatacaattttaggattttttttttctatttctgtgaagaatgtcattgctcttgatagggatggctttgaatctgtagattgctgtgggaagta

SEQ ID NO: 5489 - DNA, 121 bp, Homo sapiens
cagtaggggggaatatatatatgtatgtatgtgtatatgtatgtatgtgtatatgtatatatctgtgtatattatatatatatgaatatatcatatatgtatttatgcatgtatatgtaca

SEQ ID NO: 5490 - DNA, 119 bp, Homo sapiens
actttaggaaatatttgacagcttggatgaactgaacaatttatacatatatttatatttgtttgtattatatgcataatatatattagctacatatttaagtttgtgttttctctggt

SEQ ID NO: 5491 - DNA, 88 bp, Homo sapiens
gctgtagtcccccagtggctgagtctgtttttggttttttttttttttttttttgagacggagtctcgctctgtgcccaggctacagt

SEQ ID NO: 5492 - DNA, 94 bp, Homo sapiens
taacttttgcatctacttcatcaggtttttatgtataaaagttatatatataacttttgactcactaaacttagttttagatgacatttagttg

SEQ ID NO: 5493 - DNA, 95 bp, Homo sapiens; identical to SEQ ID NO: 68

SEQ ID NO: 5494 - DNA, 93 bp, Homo sapiens; identical to SEQ ID NO: 69

SEQ ID NO: 5495 - DNA, 193 bp, Homo sapiens
gtatatgtatgtgtatatacatatgtatatgtgtatgtgtatatacatatgtatatgtgtatatatgtatatgtatatgtgtatatatgtatatgtatatgtgtatatgtgtatatgtatatgtgtatatgtgtatatgtatatgtgtatatacatatatatatatatgtgtgtgtatatatacccaaaacac

SEQ ID NO: 5496 - DNA, 103 bp, Homo sapiens
tacatatatacacacacatacatttatatatgtatatacatatgtatatgtatacgtgtatatacatatgtatgtgtatacgtgtatatacatatgtatgtgt

SEQ ID NO: 5497 - DNA, 108 bp, Homo sapiens
ggtaggcttttactgttaccttatgttatttttactgttctgggtttatatttttatttacctgcagaaggaattacatgtgaaaattgtaaccccaaaatcactact

SEQ ID NO: 5498 - DNA, 117 bp, Homo sapiens
catgcagggctacacagaatttgcatttgggaacagagtgaaccaccagaggctgtgcagtgtcaagacagtgaggtgacccctggctcccacacaaagatgtgattgtcatgtttg

SEQ ID NO: 5499 - DNA, 79 bp, Homo sapiens
aaggggaagcaaaaaagtccttgttcacatggtggcaggagagagaagaatgacagccaagtgaagggggaagcccctt

SEQ ID NO: 5500 - DNA, 58 bp, Homo sapiens; identical to SEQ ID NO: 637

SEQ ID NO: 5501 - DNA, 74 bp, Homo sapiens
gaagtagggaagggttcattttcaaccctcttctgcaaacagtcagaagtaagagtggaatctttctccttttc

SEQ ID NO: 5502 - DNA, 116 bp, Homo sapiens
tccagctttgttctttttgcttaggattgtcttggctgtatgggctcttttttggttccatatgaaatttaaagtagttttttctaattctgtgaagaaagtcagtggtagcttga

SEQ ID NO: 5503 - DNA, 95 bp, Homo sapiens; identical to SEQ ID NO: 68

SEQ ID NO: 5504 - DNA, 93 bp, Homo sapiens; identical to SEQ ID NO: 69

SEQ ID NO: 5505 - DNA, 75 bp, Homo sapiens
gttttggcttgactattgttggtgtataggaatggtagtgatttttgtgcactgatttttttttaattctgagac

SEQ ID NO: 5506 - DNA, 58 bp, Homo sapiens; identical to SEQ ID NO: 1240

SEQ ID NO: 5507 - DNA, 85 bp, Homo sapiens
tatatgtctgtgtgtgtatgatgtatgcgtgtgcagtatgttatgtggtgtgtctgtatgtgtgtgatatatatgtctgtgtgtg

SEQ ID NO: 5508 - DNA, 90 bp, Homo sapiens
gtggtgtctgtgtctgtatgatgtatgcagagtgtgtgtgtgtgtgtgtgtatgcgtgtgtgttgtgtgtgtgatatatgtgggttctgc

SEQ ID NO: 5509 - DNA, 110 bp, Homo sapiens
tattgctttttcctctcaatttcagtttgaatcagaaactgcaactggaacaggagaagcttagttctgattataacaagctgaaaatagaggaccaagagagagaaatg

SEQ ID NO: 5510 - DNA, 56 bp, Homo sapiens
gagactgagtctcactctgtcacccaggctggagtgcagcagcatgatctcggctc

SEQ ID NO: 5511 - DNA, 79 bp, Homo sapiens
gatatactgttagcaagacaaggaatataaaagcacaatgtgcagtatgatcctattttgttttttttaactatgtatc

SEQ ID NO: 5512 - DNA, 91 bp, Homo sapiens
gcatgtcctgtcgggtcagtgtgagataggacctggttgcaggtgggagcagccactctgggactctcagataaggcctgaatggaaaggc

SEQ ID NO: 5513 - DNA, 112 bp, Homo sapiens
agggcctgaacagaacgaaaaggcagaggaggattgaattagctctctctgcctgactgcttgagctgagacatggatgttctgccttcagtgctcctggttctcaggcctt

SEQ ID NO: 5514 - DNA, 119 bp, Homo sapiens
ccaataccttttaataagcatatatatatatatatatgcgcttatatatatgtgtgtgtacatatatgtatatatattcacatatttatatatatgttctatgggttgaatttctctgg

SEQ ID NO: 5515 - DNA, 96 bp, Homo sapiens
tgccttggctatatgggctgttttttggttccatatgaaatttaaagtagtttttatctaattttgtgaagaaaatccatggtagcttcatgggca

SEQ ID NO: 5516 - DNA, 116 bp, Homo sapiens
ggtactgtattttctcacctggtttccttagctcttgtgagtgtattttcatgcatagatactttttcaaattgatgttcctgcagggagatggacctggagaatgctattatgcc

SEQ ID NO: 5517 - DNA, 89 bp, Homo sapiens
gaaactctcccctaggcttagcggttctctttttttttttttttttgagacggagtctcgctctgtcacccaggccggagtgcagtggc

SEQ ID NO: 5518 - DNA, 174 bp, Homo sapiens
ctgtcacccaggctggagtgcagtggcacaatcttggctcactgcaacctctgccttccaggttccagtgattctcatgtctcagcctcctgagttgttgatgcccagctaatttttttatttttagtagagatggggtttcaccattttggccaggctggtcttgaactcctg

SEQ ID NO: 5519 - DNA, 68 bp, Homo sapiens
gggtgtctcagtgagaatccttactctctttttattttttttaaagatggagtctcactgtgttgctc

SEQ ID NO: 5520 - DNA, 58 bp, Homo sapiens; identical to SEQ ID NO: 2263

SEQ ID NO: 5521 - DNA, 95 bp, Homo sapiens; identical to SEQ ID NO: 580

SEQ ID NO: 5522 - DNA, 93 bp, Homo sapiens; identical to SEQ ID NO: 69

SEQ ID NO: 5523 - DNA, 122 bp, Homo sapiens
cttaacacactgcaccccaaccccaatttcttcctatcttattaaatagcatcattttctttttctttttttttttggcggggtgcggtggggggagcgggtgcagggaggtaggggagggg

SEQ ID NO: 5524 - DNA, 95 bp, Homo sapiens; identical to SEQ ID NO: 580

SEQ ID NO: 5525 - DNA, 93 bp, Homo sapiens; identical to SEQ ID NO: 69

SEQ ID NO: 5526 - DNA, 86 bp, Homo sapiens
tcttcttctctcaactcgtcaaagtcattctccatccagctttgttccattgctggtgaggaactacgttcttttggaggaggaga

SEQ ID NO: 5527 - DNA, 76 bp, Homo sapiens
cctatttttgtactactgaattgccactcattttaaatagagtggcaatttaatgacacaaaatctttatactagg

SEQ ID NO: 5528 - DNA, 83 bp, Homo sapiens
tggtataaatactttggaaaactgacagttctaaggctcaatgtgccctaggacctggcactttcactctgaggtatagacca

SEQ ID NO: 5529 - DNA, 108 bp, Homo sapiens
gtgtagtgattgccacagcatttagaagaacatttattgaagtgtatatatatatatatatatgcacatcatatgtgctcaataaatttttatgtgtgtaaccagcac

SEQ ID NO: 5530 - DNA, 81 bp, Homo sapiens
acagagcaaggaaatatttgtggatatgctaacctgactaaatacgcatatctgtaagtatttatatatgtatccatctgt

SEQ ID NO: 5531 - DNA, 86 bp, Homo sapiens
gctgtgaacatcagcaaagtttgaggtcactgaattcttcatatttaagatttttttattctatggtgattccaattgtacacagc

SEQ ID NO: 5532 - DNA, 92 bp, Homo sapiens
ggcccatgatatagctttgaagttgaatgtgtttagcagcatttttaagtaaggtgatgactagagaattagaagaagtgatggacagggcc

SEQ ID NO: 5533 - DNA, 84 bp, Homo sapiens
ctacttctgtaactacaactggatctggttaaattatgtgtagagagggttagcagaggtcttgtagtgtggtggcatgagtag

SEQ ID NO: 5534 - DNA, 79 bp, Homo sapiens
tgagatagagtctcactctgtcacccaggctggagtgcagtggtgagatctccacttactgcaagctctgcctcctggg

SEQ ID NO: 5535 - DNA, 95 bp, Homo sapiens; identical to SEQ ID NO: 68

SEQ ID NO: 5536 - DNA, 93 bp, Homo sapiens; identical to SEQ ID NO: 69

SEQ ID NO: 5537 - DNA, 118 bp, Homo sapiens
gtggttccagatctgaagcatttcaacaatggctgcttcttgagccaggggaagtacgtagccatgtctctctctctctctgaggttccccagtgaaaatggctgttgattatctcac

SEQ ID NO: 5538 - DNA, 117 bp, Homo sapiens
ctatgttaagacattcaagcaatggatgggaatgggaagtaagttgttcagagatacttttttttttaagcatatgctttttgtttatgctttgttgaccttgatgtatggaagggc

SEQ ID NO: 5539 - DNA, 91 bp, Homo sapiens
attgtagtagtgaagcggagtgaaagtaaattttgagcaaacatctttttttttttgagacagagtctcgctctgttgcccaggctggagt

SEQ ID NO: 5540 - DNA, 78 bp, Homo sapiens
gcatcacattttgcatatgtattacccagctgttggacatttaggtgctattcagtttttctacatgtcaattgatgc

SEQ ID NO: 5541 - DNA, 95 bp, Homo sapiens; identical to SEQ ID NO: 68

SEQ ID NO: 5542 - DNA, 93 bp, Homo sapiens; identical to SEQ ID NO: 69

SEQ ID NO: 5543 - DNA, 109 bp, Homo sapiens
ctagcattgttctttttgcttaggattgtcttggctatacagctcttttttggttccatatgaaatgtaaagtagttttctctaattctgtgaagaaagtcaatggtag

SEQ ID NO: 5544 - DNA, 70 bp, Homo sapiens
ggtgacatggaaatccctctctgctctctaacatctgagaatacagtgagaagatggccatctgcaaacc

SEQ ID NO: 5545 - DNA, 76 bp, Homo sapiens
aggaaagagcctgtggaagtacacacacaggagagacggggcctcttaggtgtcaccacattccatttcttatcct

SEQ ID NO: 5546 - DNA, 77 bp, Homo sapiens
catatatgtatatgtgtatatatattggtgtatttattggtatataaattgcaatatatgtatgcatatatatattg

SEQ ID NO: 5547 - DNA, 115 bp, Homo sapiens
tgctagttaagtctttgttggcacattttgctgtttctttccattgtttaaaactgcaatattttatttattttaagaaatgttgcaaaatttctatgcaaaactgaatctggta

SEQ ID NO: 5548 - DNA, 67 bp, Homo sapiens
tgtttgagatggagtctcactctgtcacccaggctggagtgcagtggtgtgatctttgctcactgca

SEQ ID NO: 5549 - DNA, 100 bp, Homo sapiens
tctatctgtctatgtatctatctatctatctatctatctatccattttccgttgggcgtgtggggattggatggttgggagaggattgaggaaggggaga

SEQ ID NO: 5550 - DNA, 113 bp, Homo sapiens
gggcatggcaacatgtgcctgtggtcccaactacacaggaggctgaggtggaaggatcacttgagcacaggaggttgaggctgcagtaagccatgttcacgccattgcactcc

SEQ ID NO: 5551 - DNA, 69 bp, Homo sapiens
gatggagagagatttgaagatgctatgctgctggatttttttttttttggcagagtctcactctctgtc

SEQ ID NO: 5552 - DNA, 118 bp, Homo sapiens
ttgatttttaccagacaactgaagagtcatcttcttcctaggaaaattgattatttttatctagaagagattatttttctaaagaagagttcactctgcgtttgctctgctgaattgg

SEQ ID NO: 5553 - DNA, 75 bp, Homo sapiens
gcagggtctagtgtaacaattctgtgaaatgtcttcagcgtccatagcgtgtacagagaaggttgagaactctgc

SEQ ID NO: 5554 - DNA, 80 bp, Homo sapiens
tgatagtactatgagtgaacagagatagctgtgccccctaactcctattaggaggtattaatgtctaggttttgctatga

SEQ ID NO: 5555 - DNA, 57 bp, Homo sapiens
agacaggttagataggcatagttaataagtggtcaactatgtttgtttatattgtct

SEQ ID NO: 5556 - DNA, 96 bp, Homo sapiens
atgtgttcatggcatcaaaaatgtatttctaaattttgtttttttaaagtcactctttaaaggacctaggaaattgagatgatgccagtgtgcata

SEQ ID NO: 5557 - DNA, 102 bp, Homo sapiens
gggttgagtgtagggtaagttttatgtcaggttgctttcttgtgctcttcaaagcaggttagacatcacactattcagaggcggggaccaaagacccagccc

SEQ ID NO: 5558 - DNA, 83 bp, Homo sapiens
gggttcagcaaaaagagatcaatttcttacaatgtatatttttttctgctacctattgattaagagcttgatctctggactcc

SEQ ID NO: 5559 - DNA, 73 bp, Homo sapiens
gggaactcaggagaagtatttttgtttttgatggtggcagatcctcatcatggagttgttctattgtgttctc

SEQ ID NO: 5560 - DNA, 75 bp, Homo sapiens
gctgggacacagaagaaagagggcagtagaatgttctgtatacgtcttgctaggcccatttatttggtctatagt

SEQ ID NO: 5561 - DNA, 72 bp, Homo sapiens
gcatccagtatactaaatagaagctctgtcaggagtgactgaacagtcagtttttgttaagacagcttgagc

SEQ ID NO: 5562 - DNA, 58 bp, Homo sapiens
tgagacagagactcactctgtcacccaggctggagtacagtggcgtgatctctgctca

SEQ ID NO: 5563 - DNA, 56 bp, Homo sapiens
ccatcattaccatcatcatcattatgttgatgataatgatgatgatgatgaactgg

SEQ ID NO: 5564 - DNA, 97 bp, Homo sapiens
tagagtatatatatacatatatgtgtatatatatgtatgtatctatatatgtacatatagagagtatatgtacacatatatgtatatatatactcta

SEQ ID NO: 5565 - DNA, 62 bp, Homo sapiens
gatcgcatgagactcattcaccatgccaagaacagcatgggaaagacccggcctcatgattc

SEQ ID NO: 5566 - DNA, 114 bp, Homo sapiens
caaggcaggggagggagctgaggtatttatgtagcaccttctgtcagtcactgattgagggctgctgaggggaggggtgacttgttaattgtctgggacttcctgccagccctg

SEQ ID NO: 5567 - DNA, 66 bp, Homo sapiens
cttgatatagatatatgtgtgtgtatatatgtgtgtgtgtgtgtatatatatatgtgtgtgtgagg

SEQ ID NO: 5568 - DNA, 82 bp, Homo sapiens
gtatctatgtttatcaaggctattggcctgaagttttgttttttttgtctttctctgccaggttttgatatcagaatgatgc

SEQ ID NO: 5569 - DNA, 58 bp, Homo sapiens; identical to SEQ ID NO: 1391

SEQ ID NO: 5570 - DNA, 56 bp, Homo sapiens; identical to SEQ ID NO: 1392

SEQ ID NO: 5571 - DNA, 58 bp, Homo sapiens
tgagacggagtctcgctctgtcgctcaggctggagtgcagtggcgcgatctcggctca

SEQ ID NO: 5572 - DNA, 105 bp, Homo sapiens
tctgccaggctctgggctggtactgggggttgtctgcacagagtcctgtgatgtgaaccgtctgtgggtctctcagccgtggataccagcacctgttctggtgga

SEQ ID NO: 5573 - DNA, 76 bp, Homo sapiens
ggctgaggcaggaggataacttgaggccaggagttggagaccaacctgggcatcactgtgagactctgtctctacc

SEQ ID NO: 5574 - DNA, 58 bp, Homo sapiens
tgagtctgagtctcgcactgtcacccaagctggagtgcaacagcgtgatctcggctca

SEQ ID NO: 5575 - DNA, 137 bp, Homo sapiens
ctaggctgaatcactgaagctagtcacatttttaagttgtttttttttaatttttaaataagactgtctcactgtcacccaggctggagtgcagtggcacaatctcagctcactgcaacttctgcctcctgggttca

SEQ ID NO: 5576 - DNA, 112 bp, Homo sapiens
ttggcctaattgacacagcaatgagactgttaaagaatatttgcttatttatttttatttttttatttgagtttctttttttatttgagtcttgctctgtcacccaggctgg

SEQ ID NO: 5577 - DNA, 59 bp, Homo sapiens
ttgagatggagtctcactcactctgttgcccaggctggagtgctgtggcgcgatctcgg

SEQ ID NO: 5578 - DNA, 62 bp, Homo sapiens
tgagatggagtctcgctctgtcactcgcccaggctggagtgtgatggcgcgatctcagctca

SEQ ID NO: 5579 - DNA, 99 bp, Homo sapiens
cgagacaaatacaaagtggtgcttgacactccagaatacagaaaagtgcaagaactgaagacacatctgagtgaggtaaggacgctttacttgtcattg

SEQ ID NO: 5580 - DNA, 99 bp, Homo sapiens
atgtaatgctttttatgagattgaatatatatattgaatatttatatatattgaatatttatatatatatataaaatatatatataaaagtatatatat

SEQ ID NO: 5581 - DNA, 76 bp, Homo sapiens
ccaggcatggtagtgcatgcctgtagtcccagctactcaggaggctgaggtgggaggatggattgtttgagcctgg

SEQ ID NO: 5582 - DNA, 101 bp, Homo sapiens
aagcagtatgtgctatgagggattccttcaacttctgtctggaaaagaacaaaacaatcccagcagttgaggaatcacttacagatgctgacattctgttt

SEQ ID NO: 5583 - DNA, 60 bp, Homo sapiens
agtcaggggctggctggcctggtatgaatctcaactgtgccactcactagctgtgtgact

SEQ ID NO: 5584 - DNA, 95 bp, Homo sapiens; identical to SEQ ID NO: 68

SEQ ID NO: 5585 - DNA, 93 bp, Homo sapiens; identical to SEQ ID NO: 69

SEQ ID NO: 5586 - DNA, 64 bp, Homo sapiens
tgggggtgcatgcctgtagtctcagctactcaggaggctgaggtaggaggatcacttgaaccca

SEQ ID NO: 5587 - DNA, 87 bp, Homo sapiens
tttgttcagagttgggactgtgcagaaaggtttttttttttttttttaagaaacagaatctttctctgtagcccaggctggatcaag

SEQ ID NO: 5588 - DNA, 91 bp, Homo sapiens
tatatatatatagtatgtatatatagatatatatgtatatatagatatctatgtgtatatatagatatctatgtgtatatatagctatcta

SEQ ID NO: 5589 - DNA, 112 bp, Homo sapiens
gcacatacttaaatttacatgtacgtacacattattataagaatagctttgtgttaaactatttattttctataagctgtggaactatgtatgtttgtctcaatgtctgtgc

SEQ ID NO: 5590 - DNA, 112 bp, Homo sapiens
tttcataaatggattcattgtgtattttgatgtttgtggaattattctggaaatagatttattttttcattcatcaggtttattacacaaaccgagggatgttcttatgggg

SEQ ID NO: 5591 - DNA, 82 bp, Homo sapiens
tgcatgtgtatatatacatatatatgtatatatacaatgtaaaattacatatgtgtgcatgtatgtgtatgtgtatagtgta

SEQ ID NO: 5592 - DNA, 105 bp, Homo sapiens
catacatacatatatatatacacacacacacacacacacacacatatgtgtatgtatgtgtgtatatatatatatacacttatgtatgtgtgtctgtgtgtgtgt

SEQ ID NO: 5593 - DNA, 80 bp, Homo sapiens
tacacacacacagacacacatacataagtgtatatatatatatacacacatacatacacatatgtgtgtgtgtgtgtgtg

SEQ ID NO: 5594 - DNA, 58 bp, Homo sapiens; identical to SEQ ID NO: 1847

SEQ ID NO: 5595 - DNA, 113 bp, Homo sapiens
agactggggatggggaggtaggtagggggagagggacagaaagcacctgtgtttttgttgtggtggtggtggttgttttgttttagatagggtctcactgtgtcgctcaggct

SEQ ID NO: 5596 - DNA, 71 bp, Homo sapiens
aggagcacagagaacaaaggagaccagggggtttttatccttaatgcagtccctatctctgtgtcactcct

SEQ ID NO: 5597 - DNA, 127 bp, Homo sapiens
tccagctttggtctttttgcttaggattgtcttggctatatgggttcttttttggttccatatgaaatttaaagtagttttttctaattctgtgaagaaagtcagtggtagcttgatgaggatagca

SEQ ID NO: 5598 - DNA, 71 bp, Homo sapiens
tgtttttttgagacagggtctcactctgtcacccaggttggagtgcagtgttgtgatcttggctcaatgca

SEQ ID NO: 5599 - DNA, 66 bp, Homo sapiens
tttcagacagactctcgctctgtcacccaggctggagtgcactggtgtgatcttggctcactgaaa

SEQ ID NO: 5600 - DNA, 100 bp, Homo sapiens
tagttttgagagttctttatgcattctgggaacaagtcctttatcaaacatataatttgtaaatactttttcttagtctgcagtggatcttttcattcta

SEQ ID NO: 5601 - DNA, 113 bp, Homo sapiens
gcctcctggccccagagacaggtaagggagtgtctgaatgattatttttcttactaacaataattaggccggacgcggttgctcacgcctgtaatcccagcattgtgggaggc

SEQ ID NO: 5602 - DNA, 57 bp, Homo sapiens
tagatggagtctcactctgtcacccacgctggagtgcagtggtgcgatctccaccta

SEQ ID NO: 5603 - DNA, 84 bp, Homo sapiens
gtttcccttctgattaacataacgaagtgaggacagagccagctcagttctctccttttgcagtgttccgtggagcgtggagac

SEQ ID NO: 5604 - DNA, 112 bp, Homo sapiens
agctgaactgggtcaaaaacctcttgaatacacaaggaaaaactagtagatttctgtcactttatttttttttttaatgtgtctgtaattctggttatggaaatagttggtt

SEQ ID NO: 5605 - DNA, 88 bp, Homo sapiens
cacacgagtctgctcattctttgagagtctatatttactaagtcagaagatttttttttttaaaccctgaagcatgagagattttgtg

SEQ ID NO: 5606 - DNA, 78 bp, Homo sapiens
gcaaatgggcaccgattttttatttttagagacagggtctcactctgttactcagagagtgcaatggctgctcactgc

SEQ ID NO: 5607 - DNA, 105 bp, Homo sapiens
cacataaattgatattccagatgccgaactttatgacacaattatgacaatattttttttgttataaacagtattggtcgaaaggtgttgaaaatgtactgtgtg

SEQ ID NO: 5608 - DNA, 139 bp, Homo sapiens
atcagggtgccaatgtggtcaggggatgtgtgacctctttcggctttgtagagcctactctctctctgtgtgctcacataggcttccttggtgtgcatatatatatatatacatatatatatatatagctctggtgcct

SEQ ID NO: 5609 - DNA, 107 bp, Homo sapiens
ggaattttaggactacgtaggtactctaggtttggtattgtgctaagacttttgcactaattattttgttttaaactctcgactacctttaatgtggactgatttcc

SEQ ID NO: 5610 - DNA, 106 bp, Homo sapiens
gcagaatgagtaatttgcccatggtaccagagctcataaggaaagacttggagctcagtgtctctgactctaagtcccatgcctgtcccattgttattcactctgc

SEQ ID NO: 5611 - DNA, 110 bp, Homo sapiens
tgcttagcattgtcttggctatatgggctcttttttggttccatatgaaatttaaagtagttttttctaattctgtgaagaaagtcaatggtagcttgatgaggatagca

SEQ ID NO: 5612 - DNA, 82 bp, Homo sapiens
gggtttgtattcctatgagaatctaatgccactgctgatttgacaggaggcagatggagctcaggcagtaatgctcattccc

SEQ ID NO: 5613 - DNA, 58 bp, Homo sapiens; identical to SEQ ID NO: 47

SEQ ID NO: 5614 - DNA, 80 bp, Homo sapiens
atgagttgcaacattctagggtgtttaaagattttgggcagtgactaattttaaatactttttgaattgatgatactcat

SEQ ID NO: 5615 - DNA, 68 bp, Homo sapiens
ccactgtcactctaatgccacctgacccaaacatgatggagggaaatcagagtgaacagagacagtgg

SEQ ID NO: 5616 - DNA, 95 bp, Homo sapiens; identical to SEQ ID NO: 68

SEQ ID NO: 5617 - DNA, 93 bp, Homo sapiens; identical to SEQ ID NO: 69

SEQ ID NO: 5618 - DNA, 104 bp, Homo sapiens
aaacttcatttgcataaatatgatgctacatctttggcatcctgagaattttttttttatgttttgcttggccagggaagggggatcttgttgtggaaaagttt

SEQ ID NO: 5619 - DNA, 89 bp, Homo sapiens
gtgtggcatagtggaaagacgtgggcttagagtcagaaaatatgttgaaatcaggctgggccacactctatcactgtgaccttaggcac

SEQ ID NO: 5620 - DNA, 99 bp, Homo sapiens
ggactatattgcttgatgcctcctttggttgatgtacttctctcgcctcttgagggatgcttgtttttatccatatttcaaggtctaggaaattggtcc

SEQ ID NO: 5621 - DNA, 88 bp, Homo sapiens
cctccctgtgagtcaaatgttctctggttcatggacagaaaataggaaacttccatttgaagtctagactatttttctcacttcatgg

SEQ ID NO: 5622 - DNA, 100 bp, Homo sapiens
atcacctgggagtttctctgtgagaaatgcagaatcttgagaaaaattccagacatactggatcaggatctgcatcataagaagattctcagggatttac

SEQ ID NO: 5623 - DNA, 93 bp, Homo sapiens
tgagcaaaaatggattctcaatttttttttatcaaggaaaagcattgatttactcatgttaaatgtttttctttaaaaaaaattccctgctta

SEQ ID NO: 5624 - DNA, 116 bp, Homo sapiens
atatatatatatgaatatgtatgtatatatatatatgaatatgtatatattcatatgtatatgtatatattcatatgtatatgtatatattcatatgtgtgtatatatatatatat

SEQ ID NO: 5625 - DNA, 79 bp, Homo sapiens
gtactgttagaattcatactactgtgttgcctatgtctaatccctggcataagaactttagatatgcatcttccagtat

SEQ ID NO: 5626 - DNA, 56 bp, Homo sapiens
gtgtgtgtgtgtgtgtgcgcgcgcacatatgtgtgtgtgcatgtgtatgtgcattc

SEQ ID NO: 5627 - DNA, 100 bp, Homo sapiens
ttgaaatgacaaatatatgtacattagaaggcacaaacgtgggctgataaatgggtcaacagatgtgtttttcttgcatagtatttaaaacttgtttcag

SEQ ID NO: 5628 - DNA, 84 bp, Homo sapiens
gctttgacaatacaatgttagcagaagtgccaggatcaaaggcctgaaatgtgtttgtgcaactggatttgtattcttgtgtgc

SEQ ID NO: 5629 - DNA, 95 bp, Homo sapiens; identical to SEQ ID NO: 68

SEQ ID NO: 5630 - DNA, 93 bp, Homo sapiens; identical to SEQ ID NO: 69

SEQ ID NO: 5631 - DNA, 103 bp, Homo sapiens
ggtttcagaagtggggatcaagtgtgaaaaaaatgatatacaatgtaatgaattgttacaggcagtgtatgtgttcaggtctggaacagcctcaattcttgcc

SEQ ID NO: 5632 - DNA, 81 bp, Homo sapiens
tatgtatgtattattatgtatgtaattatatgtatatgatacatatgtatataattatatgtgtgtgtgtatatatataat

SEQ ID NO: 5633 - DNA, 96 bp, Homo sapiens
atcttgcattttgaatgaatttttaaatttcttcatgattttgtaacattctgcattagtcatttggaaaatactggttatttgggctatgcagat

SEQ ID NO: 5634 - DNA, 105 bp, Homo sapiens
gtgtgtatgtatatatgtgtgtgtatgtgtatgcgtgtgtgtgtgtgtatatatatatatatacacacacacacatacattgtgcatatgtaaacatacaggcat

SEQ ID NO: 5635 - DNA, 95 bp, Homo sapiens
gttctagtgtgtgtgtatatatatatatacatatgcataaatatatatatagtgtgtgtgtatgtatacacatatgtgtacatatatgctagaac

SEQ ID NO: 5636 - DNA, 58 bp, Homo sapiens
tgagactgaatctcactctgtcacccaggctggagtgcagtggcgcgatctcagctca

SEQ ID NO: 5637 - DNA, 130 bp, Homo sapiens
ggtccaagaagaagaaaacaaaatctgtgccaaagtacatgtacttggttgacgatttttttcttttttttttgagaccgagtctcactctgcctcccaggctggagtgcaatggtgcgatctcggctca

SEQ ID NO: 5638 - DNA, 77 bp, Homo sapiens
gaatatactatatatgtgtgtatatatacatgtgtttttatatgtatatacatacacacactttttatatactgttc

SEQ ID NO: 5639 - DNA, 78 bp, Homo sapiens
gtcaaaggggattgttctctggctggcagcggtgggggtcacaaggtgctcagttggggagcttttgatccaggatga

SEQ ID NO: 5640 - DNA, 104 bp, Homo sapiens
ggcaagattgtgaggcatcagtgaaacaggtccagaaatagggaattattttaataaataattttaattttattactgttttagtgtgaatgtaactattttcc

SEQ ID NO: 5641 - DNA, 119 bp, Homo sapiens
tatacttacgtgtctttttttctccagttacatttaagattgtctacactaatttaatttttaatttttattttttgtagtatatagtttttaatttttgtggctacatagtaggtgta

SEQ ID NO: 5642 - DNA, 95 bp, Homo sapiens
gagcaccaattttgttacacatgtttagatcagacattttatttttataaatgaacctatctgtttgtgcacgtgtgtggatgtgtgtggatgtc

SEQ ID NO: 5643 - DNA, 78 bp, Homo sapiens
atatatatgtatgtatgtatgtatgtgtatgtatgtgtatatatatatgtatatgtgtgtatacatacacacacacac

SEQ ID NO: 5644 - DNA, 115 bp, Homo sapiens
tatatcatatattatatatgaatagatacgtgtgtatatattatatcattatatgaatagatatatgtaatatatgtgtgtggatagctatatgtacaataaatatatagatata

SEQ ID NO: 5645 - DNA, 58 bp, Homo sapiens
tatgtatatgtatgcatatatgtacacatttatacatatatgtatcaatatatacata

SEQ ID NO: 5646 - DNA, 106 bp, Homo sapiens
tgacaaggagaggcataggtaaattagacggcatgcaggaaaagaggaatatgatttgaaactttttatttctgtaaagcattttggtagatgttctcttctagca

SEQ ID NO: 5647 - DNA, 67 bp, Homo sapiens
cctgggtgagggggtgatgggattttttttgtttgttttttgactgagtctcgcactgtcacccagg

SEQ ID NO: 5648 - DNA, 91 bp, Homo sapiens
cttggtcccagaagtgttctgtgttgattgttgtgtgagagcagaggaaaaacagttcattttttaactcaacattatacttcaattcaag

SEQ ID NO: 5649 - DNA, 93 bp, Homo sapiens
ttgaaaagacagtggcgggtcagtgggtctcagtgcctctgcccacagcctgcacagagaccccaggggccccgtgaggagctgtctccacaa

SEQ ID NO: 5650 - DNA, 136 bp, Homo sapiens
tatatatcatgtgtatatatgtgtatatatcatgtgtatatatgtgtatatatcgtgtatatatgtgtatatatacatatgtgtatacatgtatatgtgtatatacacttatatgtgtgtatacatgtatatacat

SEQ ID NO: 5651 - DNA, 58 bp, Homo sapiens
tgagatggagtctctctctgtcacccaggctggagtgcagtggtgggatcttggctca

SEQ ID NO: 5652 - DNA, 118 bp, Homo sapiens
tgcttaggattgtcttggctatacaggctcttttttggttccatatgaaatttaaagtagttttttctaattctctgaagaaagtcaatggtagctcaatggggatagcattgaatct

SEQ ID NO: 5653 - DNA, 73 bp, Homo sapiens
tagtggttgttgggtgactgtctgtctctcttgaagtgctgagaggaggccttagttagcgctaacatgacta

SEQ ID NO: 5654 - DNA, 74 bp, Homo sapiens
cttcttgacagtactttgtgtgcactgtcatatactgatgctcagaaagtaatgtattttgatttgttggggag

SEQ ID NO: 5655 - DNA, 386 bp, Homo sapiens
tacatgtgtatacatatatgtatatatgtgtatacatatatgtatatatgtgtatatatgtatacatatatgtatataagtgtatatatgtgtatatgtatataagtgtatatatgtgtatatgtatataagtgtatatatgtgtatatgtatataagtgtatatatgtgtatatatgtatacatatatgtatatatgtgtatatatgtgtatatgtatataagtgtatatatgtgtatatatgtatacatatatatgtgtatatatgtatacatatatgtatatatgtgtatatatgtatacatatatgtaaatatgtgtatatatgtgtatatgtatataagtgtatatatgtgtatatatgtacatatgtatacatatattta

SEQ ID NO: 5656 - DNA, 95 bp, Homo sapiens; identical to SEQ ID NO: 68

SEQ ID NO: 5657 - DNA, 93 bp, Homo sapiens; identical to SEQ ID NO: 69

SEQ ID NO: 5658 - DNA, 92 bp, Homo sapiens
actctaatcttattgaattagaatttcaagaagtagagctttaaattttttaaagtttttttcttagtatttcatacctcggtatctagagt

SEQ ID NO: 5659 - DNA, 71 bp, Homo sapiens
aggtgcagtgaggttggttgtctggtgggagctgctctccacttctaaaatggcaccttgttgctgcatct

SEQ ID NO: 5660 - DNA, 95 bp, Homo sapiens; identical to SEQ ID NO: 68

SEQ ID NO: 5661 - DNA, 93 bp, Homo sapiens; identical to SEQ ID NO: 69

SEQ ID NO: 5662 - DNA, 115 bp, Homo sapiens
tacatttatagttatatatcttgggaaagatagttttaatgactgcataataattcacaataaatatttcattatgtatggaactaattccttgttgtaggataatatagatgta

SEQ ID NO: 5663 - DNA, 88 bp, Homo sapiens
gtacatttacagatatatattatgaggatatatgtatatatacatatatgtatatatcctcatagatacatatatatcatatgagtac

SEQ ID NO: 5664 - DNA, 101 bp, Homo sapiens
tttagatttgtaattttgctcctaactatatttattgtttaattttatatggaacaaaacacagattatagaatggagtcagagatttttgggaatctgag

SEQ ID NO: 5665 - DNA, 87 bp, Homo sapiens
ctctgtgtgttgacatgaaaaaggttgggaaggatagactatttgaaacacccagacttgttttttttgttttgttttcagacggag

SEQ ID NO: 5666 - DNA, 148 bp, Homo sapiens
ttttgtatttatgcaatatattatatacgtattttgtatatacatatctgtatatttatattatgtttgtatatgtatatacaaatatatacatataaaagtgtatatatacaaaatatacatataaaaatgtatatatgtatacaga

SEQ ID NO: 5667 - DNA, 114 bp, Homo sapiens
ctgaaataggagctatttggttctactctgatatttttcaattattgttttataaaatacatgccattcgagaatgttttaaatgtggattgtaacttgttttggctctgttag

SEQ ID NO: 5668 - DNA, 64 bp, Homo sapiens
gtatgtgtgtgtatatacattatatatgtattaaataggtatgtgtgtgtatacatgtgcagac

SEQ ID NO: 5669 - DNA, 58 bp, Homo sapiens
gagggctgtcagtgactcactgcgtgggccacccagagcatgtggtgctgaggctgtc

SEQ ID NO: 5670 - DNA, 93 bp, Homo sapiens
tgtctggctgggttatttcaaaagacctgtattcaaattctgagattttttttcttcctgtttgagctagtctattgttgtagctttcaaata

SEQ ID NO: 5671 - DNA, 58 bp, Homo sapiens; identical to SEQ ID NO: 1847

SEQ ID NO: 5672 - DNA, 76 bp, Homo sapiens
atatgaatatgtataaatgcatgtgtgtatatatatatatacatacacacacacacgcacatatatatacacatat

SEQ ID NO: 5673 - DNA, 68 bp, Homo sapiens
atgtgtatatatatgtgcgtgtgtgtgtgtatgtatatatatatatacacacatgcatttatacatat

SEQ ID NO: 5674 - DNA, 77 bp, Homo sapiens
agagctcattaagagtttgtcacttatttttttttgtattatttacgggggcagaaaaggcagaagtagtgagctct

SEQ ID NO: 5675 - DNA, 60 bp, Homo sapiens
ttgagacagggtctcactgtgtcacccaggctggagcgcagtggcaccatcatggctcaa

SEQ ID NO: 5676 - DNA, 122 bp, Homo sapiens
tggtatcaatttttattgcagtgtggtccaagagcatgcttggtatgattttgttttttttgaatttgttgagaattgctttatggctgagcatgtattcaatcttaaagtatgtgccatgt

SEQ ID NO: 5677 - DNA, 115 bp, Homo sapiens
gtaataagtcattcctggatttctgacccacagaaacaatgtaagataatcaatatttttgttttaagccactaagttctggtgtggttgtaatgcagcattggatgattaatac

SEQ ID NO: 5678 - DNA, 119 bp, Homo sapiens
ctgagttgcagtcactttgctggggagcgcagagccacagcatgtaaggctcccatgtctctgtgtgtgcctgagcagctgctctgctgagactccatgcagccctgtgtgtcagacca

SEQ ID NO: 5679 - DNA, 57 bp, Homo sapiens
gagtgaaactgcagccacttcagcactgaagccagtgaggacagaggctgcttactc

SEQ ID NO: 5680 - DNA, 95 bp, Homo sapiens; identical to SEQ ID NO: 5211

SEQ ID NO: 5681 - DNA, 66 bp, Homo sapiens
gttgatgaatggtcttaatggtgagtagaagcaatactcttgctctctctcacattgttcactggc

SEQ ID NO: 5682 - DNA, 109 bp, Homo sapiens
tgtaatcattaacgttttcagtggtacaccaaagaaatgcaaacaaatgtgattttctggttgtttaattgggcattttctggtgcccacttagaattgtgggattggg

SEQ ID NO: 5683 - DNA, 105 bp, Homo sapiens
caggccctaaaggaagtccacagatgcacagagaagagacagaccatcctaaaatgggggccaacattccctctctctccccaccctgtgataatttagtgcttg

SEQ ID NO: 5684 - DNA, 95 bp, Homo sapiens; identical to SEQ ID NO: 68

SEQ ID NO: 5685 - DNA, 93 bp, Homo sapiens; identical to SEQ ID NO: 69

SEQ ID NO: 5686 - DNA, 101 bp, Homo sapiens
tgaggcaggagaatcgcttaaacctgagaggcagagattacagtgagctgagatcgcgccactgcactttagcctgggcgacagagagagattccgtctca

SEQ ID NO: 5687 - DNA, 114 bp, Homo sapiens
ggttgtttccaccttttggctgttgtgaaaaaagtcgtgaacatcagtagacatgtgtctgtctgagtctctgctttcaattcatttggttagagatccagaaatggaattgct

SEQ ID NO: 5688 - DNA, 79 bp, Homo sapiens
agccactcccagagcctctggaactctggcccaaggctctctgactgactccttcccagatcttcttggcttagcggct

SEQ ID NO: 5689 - DNA, 107 bp, Homo sapiens
acaaaataaggaggaaatattcatggcaattacagtccttgtttctataactgatcatttggttgtagctggtattgatagctatcttcttctattatccattttgt

SEQ ID NO: 5690 - DNA, 95 bp, Homo sapiens; identical to SEQ ID NO: 68

SEQ ID NO: 5691 - DNA, 93 bp, Homo sapiens; identical to SEQ ID NO: 69

SEQ ID NO: 5692 - DNA, 95 bp, Homo sapiens
caaaggcacatacatatatgtatatactatatatgtatatatttgcctttgtttatatgttttcatatatatgtgtgtgtatatatttgcctttg

SEQ ID NO: 5693 - DNA, 112 bp, Homo sapiens
tgtggacgagggagcccagactgtggcctcaggagagtgagagcagaggggcccgcccgagctcttagcacacacctgggtgtcatctccaacagtcctgtgtctttccacg

SEQ ID NO: 5694 - DNA, 192 bp, Homo sapiens
atatatatatatatatatatatacactctagaatgtgtatatatatatatatatacactctagaatgtgtgtatatatatatacactctagaatatatatatatatactctagaatatatatatatacactctagaatatatatatatatatacactctagaatatatatatatatatatatatatatatat

SEQ ID NO: 5695 - DNA, 95 bp, Homo sapiens; identical to SEQ ID NO: 68

SEQ ID NO: 5696 - DNA, 93 bp, Homo sapiens; identical to SEQ ID NO: 69

SEQ ID NO: 5697 - DNA, 111 bp, Homo sapiens
agttagtgtcaactgaaaattctgccttttggttcgtattccagtttttattcttttctttttttttgagacggagtctgttgcccaggctggggtgcagtggcatgatct

SEQ ID NO: 5698 - DNA, 95 bp, Homo sapiens; identical to SEQ ID NO: 580

SEQ ID NO: 5699 - DNA, 93 bp, Homo sapiens; identical to SEQ ID NO: 69

SEQ ID NO: 5700 - DNA, 109 bp, Homo sapiens
gtctgatgactcaaagtttctatgagtgtattcaagattttttctcttttgaaaaatcactctgagtacaagcggaagaaataatgatgtgctatgtgtccttcctgac

SEQ ID NO: 5701 - DNA, 78 bp, Homo sapiens
tattcagtctctctatatctcagtttctacatcggccaaatggcttatgagaattgtaaaggtaagaaagactggatg

SEQ ID NO: 5702 - DNA, 104 bp, Homo sapiens
ttaacttctactttttcaattcggatgctttttatttttttctcttgcctgattgctctggctaagacttccagtactatgttgaatagaagtagcaaagttga

SEQ ID NO: 5703 - DNA, 67 bp, Homo sapiens
agaacagagagagcaaactcaccagattacagctctgtgtcactgtgtcacttgctcctctgattct

SEQ ID NO: 5704 - DNA, 129 bp, Homo sapiens
gcttcctcttggccttccctcaaagaccctgactttatctgggggtacatttagctctcagtccctcggtcactgagccttggggaagcgtgggtcctcagctctctacggactcctccagggctccag

SEQ ID NO: 5705 - DNA, 106 bp, Homo sapiens
cagctcacccggcagccactcccagagcccctggaactctggcccaaggctctctgactgactccttcccagatcttctcggcttagcggctgaagactgacgctg

SEQ ID NO: 5706 - DNA, 81 bp, Homo sapiens; identical to SEQ ID NO: 1309

SEQ ID NO: 5707 - DNA, 77 bp, Homo sapiens; identical to SEQ ID NO: 1310

SEQ ID NO: 5708 - DNA, 92 bp, Homo sapiens
ggtctgaacgtgctaatcaatcataccactctctgtgtcaatctgtcccaactaagaaacagacacagcagtaagacaggcatgaaaagatc

SEQ ID NO: 5709 - DNA, 90 bp, Homo sapiens
gctactcaagaggctgaggtaggaggatcacttgaacccgggatgtcaaggctgcagtgagcctgcactccagcctgcgtggcagagtga

SEQ ID NO: 5710 - DNA, 116 bp, Homo sapiens
tatgatgactaagatcttgagtttgtagtcacatggctctggaatcaaaacttttttttttttattatactttaagttttagggtacatgtgcatattgtgcaggttagttacata

SEQ ID NO: 5711 - DNA, 88 bp, Homo sapiens
gttcaatctatgttgctgcaaatgacagaattttattttgtgaggtatatgcatcacattttctttatttgttcatctgttgttgaac

SEQ ID NO: 5712 - DNA, 114 bp, Homo sapiens
attggacacctctgcttcagaagatcctttagtgaaaatctagtggtgaacccttttttaatttttattttctttagtcaggatctcactctgtcatctgggctggagtacagt

SEQ ID NO: 5713 - DNA, 96 bp, Homo sapiens
ttcttcccttcctatttgaatatactttattgttttttcttgcctgattgccctggccagaacttccaatactatgttgaatagaagtggttagag

SEQ ID NO: 5714 - DNA, 139 bp, Homo sapiens
catggatacagaggactgactgcatatatatatatatatatatatatatatatatatctcatatatttatttatttctgtatatgtatgtgtatatatgtatatgtatatacatatgtgtatatgtaagtgtgtatatg

SEQ ID NO: 5715 - DNA, 105 bp, Homo sapiens
cttggtggtgcaggcgagtcctttagattagtttaatagtaaatgtagtttatatctgaatatttaaagaacacttttcacttgccctcaatgttcaaccccaag

SEQ ID NO: 5716 - DNA, 94 bp, Homo sapiens
tatttcgcttcgctttcagaatgattgtttttggaaagctatgaaatgttatttattaaccttccattgccaatggcttctgtagtgtgaaata

SEQ ID NO: 5717 - DNA, 72 bp, Homo sapiens
tctacccctgactagctatctcacagtaggccagttatggcctctctgtgactcagtttcttcatctgtgga

SEQ ID NO: 5718 - DNA, 84 bp, Homo sapiens
tcaccacaagctgactgaagagactttgtaccttaagggaacattggtggtagtctggtagtactccctgtaggcctgtggtga

SEQ ID NO: 5719 - DNA, 114 bp, Homo sapiens
tccacagaaagtagaatgaaggcaaaactatcatgagcattcttctgtactcactcactcactgtgaaagggtagaggaatatctatttgctgtttctgataccgtctgtaggg

SEQ ID NO: 5720 - DNA, 84 bp, Homo sapiens
ctcctagtccttggcacgctcctccatcctgccacttgcgcctagcagagggctgcctagagtgagcactcagtgacgacagag

SEQ ID NO: 5721 - DNA, 95 bp, Homo sapiens; identical to SEQ ID NO: 68

SEQ ID NO: 5722 - DNA, 93 bp, Homo sapiens; identical to SEQ ID NO: 69

SEQ ID NO: 5723 - DNA, 96 bp, Homo sapiens
atgtacatatatatatatacacacacacgtatatatatatatatatatatatatatatatggtgtgtttgtgtatgtatttgtgtatatatgtgtg

SEQ ID NO: 5724 - DNA, 119 bp, Homo sapiens
tgtaataagatacttaagagagagagatcacattcaaataacttttattacagtatactgttatagttgttgtgttttattattagttgtttttactttcttacggtgcctgatttata

SEQ ID NO: 5725 - DNA, 100 bp, Homo sapiens
cccagtgcctttggttcctcagagagcatgctgtttgccagaagatagttttgaaaatggcatcttgctgcagctgcttaggtctcacgaaggatgtggg

SEQ ID NO: 5726 - DNA, 113 bp, Homo sapiens
ggattgtcttggctatacagcctcttttttggttccatatgaaatttaaagtagtttttttctgattctgtgaagaaagtcaatggtagcttgatggggatagcattgaatct

SEQ ID NO: 5727 - DNA, 81 bp, Homo sapiens
ctgctgttctccagattttcttcttgttttcatggaaagagggacacccccagtctgagtagtagaaacggggaagggcag

SEQ ID NO: 5728 - DNA, 59 bp, Homo sapiens
ctttggtctgcctctctctctgctagtccggcattagactcggaggaggtgtgcccagg

SEQ ID NO: 5729 - DNA, 75 bp, Homo sapiens
tgtcactcactcctttctcttttttttttttgagacagagtctcactctctcaaccaggctggagtgcagtggca

SEQ ID NO: 5730 - DNA, 101 bp, Homo sapiens
catttagaccatagcatggattgaatagatatagtcatatactatatgtttttatatatgtatatatgaatatatttatttatttgatatacatctgcatg

SEQ ID NO: 5731 - DNA, 79 bp, Homo sapiens
gcagagtgatccctgagttcaggggattggattaattgttaatttttttttttttttttttgagatggagtctctctgt

SEQ ID NO: 5732 - DNA, 101 bp, Homo sapiens
tggtagtatcacagaggcattattcaccctgatgactcacactctggctcccacacagcagaggcaagaagtaacattagtgaccttgaagatgttggcca

SEQ ID NO: 5733 - DNA, 117 bp, Homo sapiens
gctggtgtggtggcatgagcctgtagtcccagctactcaggaggctgaggtagaagaatcacttgagcctgggcagttgaggctgcactgagctgtgatcccaccattgcactctag

SEQ ID NO: 5734 - DNA, 119 bp, Homo sapiens
cacttgatcatggtggattatctttttgatatgttgtttgacttggttaggtagtactttgttaagtattttaacatctatgttcatcagagatattggtctgtagtttttgtgtccgg

SEQ ID NO: 5735 - DNA, 103 bp, Homo sapiens
ccaaaacaagtgagtcttggaagttgcttttatttttttaattcaagtgaatggtccctttattttttaaaatgtgaggtaagtatctctcccttgtttctgg

SEQ ID NO: 5736 - DNA, 118 bp, Homo sapiens
gctggaccgcccattccccagcctcttctccttcttcccaggaaagaggaggagtactcactggctggctggctggctggctcccctcaagctccctggaagatcccttctggagaag

SEQ ID NO: 5737 - DNA, 79 bp, Homo sapiens
gcctgaagccctgagatctgtatcactctccctcaacagcagagcattcgatggagatgaaaggcattcagtcacaggc

SEQ ID NO: 5738 - DNA, 87 bp, Homo sapiens
atatatatatgtgtatatatatatatacacacacacatatatatgtgtgcatatatatgtatatatgtgtgtgtatatatatatgta

SEQ ID NO: 5739 - DNA, 112 bp, Homo sapiens
acatacttgtttgtgtgtctatttctggacgctaaacatgtgaaaggaagggtactttttttaaaattttactttaagctctagagtacatgtgcacaatgtgcaggtttgt

SEQ ID NO: 5740 - DNA, 60 bp, Homo sapiens
gtgagacggagtctcactctgtcacccaggctggagggcagtagtgtgatcttggctcac

SEQ ID NO: 5741 - DNA, 110 bp, Homo sapiens
gacttgctttgagtagcaagtttccttagccatggaagtatttgtttataaattatcaaaatattttttaatcttaggtgagggaggaaattagaggcaaaaggagagtc

SEQ ID NO: 5742 - DNA, 95 bp, Homo sapiens; identical to SEQ ID NO: 68

SEQ ID NO: 5743 - DNA, 93 bp, Homo sapiens; identical to SEQ ID NO: 69

SEQ ID NO: 5744 - DNA, 74 bp, Homo sapiens
tgtgcgtctgcaagtaaggacaatctcgatggtgatcggtgtctctgtctctcccacattgcagagtgtgtgca

SEQ ID NO: 5745 - DNA, 112 bp, Homo sapiens
tgctgagttctgtaccactcatttggaaggacattgataatctgggaatcttcagaggagagtgaccagagtgaaggcaggcatgctacatgaggaactagggaatctagta

SEQ ID NO: 5746 - DNA, 107 bp, Homo sapiens
gagggatgtgctgggctaaatttagccaatactttgtggacagaaataagaatttttcttttaaaaagtctttttaattggctattgctatatatacacaatacctt

SEQ ID NO: 5747 - DNA, 86 bp, Homo sapiens
tgtatatatacatatgtgctatatacatgtgttatacaatatatgtgttttatacatatatatgtatgtatgtatgtatataacat

SEQ ID NO: 5748 - DNA, 93 bp, Homo sapiens
gtgctcttttgtttgtttgtttgttttgtttttattgtactttaagttctagggtacatgtgcacaacgtgcaggttttttacataggtatac

SEQ ID NO: 5749 - DNA, 116 bp, Homo sapiens
ttactaatttatagcaaatgagtataatttacttaaaaagcagaaataaactttttcttattgaaatatatatttgtgccccacctgagtacatagctctgtgctaaacactgtaa

SEQ ID NO: 5750 - DNA, 78 bp, Homo sapiens
aggagagagagaacagactgcctgcccacgtgaacgcacaatcaagagaggcctcatgtaccagcagttggctatcct

SEQ ID NO: 5751 - DNA, 98 bp, Homo sapiens
tgggcaactaatcctgtcagagttggttttttgtttttttttgttttgttttgttgttttttttttttttttgagacagagtctcgctctgtggccca

SEQ ID NO: 5752 - DNA, 77 bp, Homo sapiens
gctgctagacctgatgtccatcgtcttcatgggtacctctcactgtgtgtcaccctatgtcaggctttctagacagc

SEQ ID NO: 5753 - DNA, 108 bp, Homo sapiens
ggcctgttcttgtgttgccccattttcagcctgagaggtctgtctgcctgactgacttgtaagaagacttccctattctggaaactggaaatatataggttcgaggct

SEQ ID NO: 5754 - DNA, 107 bp, Homo sapiens
gctaaggttctgttttggtttgggggttttttgtttttttgttttttgtttttgagatggagtctcacgctgtcacccaggctggagtacggtggtgtgatcttggc

SEQ ID NO: 5755 - DNA, 111 bp, Homo sapiens
gaattttcttacatgttgatctcttgtgtttattttgtttgtaatatattatttctataaaatgttaattaaaagggaatgcagtggtgtcttttgaaagaagaggatgtc

SEQ ID NO: 5756 - DNA, 109 bp, Homo sapiens
agatatttctgggcttaagatatgattatatatgtatttattaatattaacagcaagcaattgttgaaaatattaacttttgtatagtacaataagatgagaggtgtgt

SEQ ID NO: 5757 - DNA, 114 bp, Homo sapiens
ggattggatcttgggacagagaagtgacattggtgggaaaactaattaaatctgaataaattctttattttaattagttaatcaaggttaatttcttagtttggaaagttgttc

SEQ ID NO: 5758 - DNA, 60 bp, Homo sapiens
ttgagaccgagtctcgctctgtcacccaggctggagtgcggtggtacaatctcggctcaa

SEQ ID NO: 5759 - DNA, 82 bp, Homo sapiens
ctctctctctcagttactcacaaaacatggctgtcttattcagagattagcaattattgtaatgagatactgtcggagaggg

SEQ ID NO: 5760 - DNA, 107 bp, Homo sapiens
tctttagttgtgtatatgttaatagtaagtactgaaaaattaagagtaataagctctggtatatgattttaattatttattattggcatacttattttaatggaaga

SEQ ID NO: 5761 - DNA, 83 bp, Homo sapiens
tttgttattgagaatgatgcagccacacacattcttgtttatatgcttttatgtgtttgtcttattatttctcgtaggatgga

SEQ ID NO: 5762 - DNA, 95 bp, Homo sapiens
gagacagagtttcactcttgccaccacacccagttaacagctatattttatttatttatttacttatttttgtgacagagtctcactcttgtctc

SEQ ID NO: 5763 - DNA, 95 bp, Homo sapiens; identical to SEQ ID NO: 68

SEQ ID NO: 5764 - DNA, 93 bp, Homo sapiens; identical to SEQ ID NO: 69

SEQ ID NO: 5765 - DNA, 87 bp, Homo sapiens
gggtctcgctctgtcgcccaggctagagtgcaatggcccaattttagctcactgcaatctctgcctcactgactcaggtgatcttcc

SEQ ID NO: 5766 - DNA, 106 bp, Homo sapiens
atggcttcatgggtcatgttaggaataacttatagaagtaagttgtaaatctgccaactttctctatttgtttttgtacttcattataacataattatcaagccat

SEQ ID NO: 5767 - DNA, 141 bp, Homo sapiens
tatataaatatatacatattttgtaaatctatataaatatatacatattttgtaaatctatataaatatgtacatattttgtaaatctatataaatatgtacatattttgtaaatctatataaatatgtacatattttgta

SEQ ID NO: 5768 - DNA, 74 bp, Homo sapiens
aaatatgtacatatttatatagatttacaaaatatgtacatatttatatagatttacaaaatatgtacatattt

SEQ ID NO: 5769 - DNA, 74 bp, Homo sapiens; identical to SEQ ID NO: 5768

SEQ ID NO: 5770 - DNA, 58 bp, Homo sapiens; identical to SEQ ID NO: 1745

SEQ ID NO: 5771 - DNA, 95 bp, Homo sapiens; identical to SEQ ID NO: 68

SEQ ID NO: 5772 - DNA, 93 bp, Homo sapiens; identical to SEQ ID NO: 69

SEQ ID NO: 5773 - DNA, 84 bp, Homo sapiens
ctgtaggtatgtgtgtgcatatatgtatatatatatgtgtgtgtgtatatatatatgtatatgtgtgtatacacacacacacag

SEQ ID NO: 5774 - DNA, 95 bp, Homo sapiens; identical to SEQ ID NO: 68

SEQ ID NO: 5775 - DNA, 93 bp, Homo sapiens; identical to SEQ ID NO: 69

SEQ ID NO: 5776 - DNA, 68 bp, Homo sapiens
gggctctcctctgccacagtcactcaccctgcaggaacagtgagatgggtgctggtagagggaaggtc

SEQ ID NO: 5777 - DNA, 67 bp, Homo sapiens
gacagagtctcgctcactcagtgctcgatgttgcccaggctggagtgcagtggcgtgatctcggctc

SEQ ID NO: 5778 - DNA, 92 bp, Homo sapiens
gatttttgttatgtgtacataaacatatatatgtatgggtgcgatatatctgtatatatatatgtgaatacatacatatgtgaacctatatc

SEQ ID NO: 5779 - DNA, 118 bp, Homo sapiens
ggtatttttgttatagaagcacaaatggactaagacaatggctttatctcatttatatatgttaatatacagctatgtttgttctcagttctcttttgtgatttctgccattactgct

SEQ ID NO: 5780 - DNA, 120 bp, Homo sapiens
ttgttatataaatacaatatgatatactgcctgatgttatgttattatataggttatatttttatcttctatgatatgtattataggcaatatagtgttttatattataaattatataat

SEQ ID NO: 5781 - DNA, 89 bp, Homo sapiens
atgtatgtgtatgtatacatatatgtatgcatatgtatatgtatatatacatgtatatacacatatatgtatgtatacacgtatataca

SEQ ID NO: 5782 - DNA, 89 bp, Homo sapiens
ggtattttattctcttagtagcaattgtaaatgggagttcactcatgatttggctctctgtttgtctgttactggtatataggaatgct

SEQ ID NO: 5783 - DNA, 85 bp, Homo sapiens
ttatctttggaaatgactggttgtagtgagagaaagataacctctgacagtctctgtgtagcaagaccacatctctgagagatga

SEQ ID NO: 5784 - DNA, 102 bp, Homo sapiens
gctcagaaatagacgtagacacatattacatgattatgtgatttttgacaaaggtttcaaagtaattcaattgggtaagtatggtcttgtcaacaaataggc

SEQ ID NO: 5785 - DNA, 104 bp, Homo sapiens
gtaggtagatagatagacagacagacagacagacagacagacagttattcccatggaagagcagctccatctgttttttgtagtcctcggtgtaatcaacctac

SEQ ID NO: 5786 - DNA, 95 bp, Homo sapiens; identical to SEQ ID NO: 68

SEQ ID NO: 5787 - DNA, 93 bp, Homo sapiens; identical to SEQ ID NO: 69

SEQ ID NO: 5788 - DNA, 83 bp, Homo sapiens
gaaggactttgaggtttaagcttgattacctgctcagtaagtctccctctgctctagagaatgaagctctggtctcctccttc

SEQ ID NO: 5789 - DNA, 116 bp, Homo sapiens
gagaaaaactggtcagtgctttgtgccccggtgaggctgagtaaaggcttttttttttttttttttagatgaagtctctctctgtttcccaggctggagtgcagtggcacaatctt

SEQ ID NO: 5790 - DNA, 98 bp, Homo sapiens
agtgatctggaaaacattgaacagttggcttttaaagactttgagtggaaatgaaatgtttttgaaagtatttgaagtaagtgtttcctaccaccact

SEQ ID NO: 5791 - DNA, 65 bp, Homo sapiens
atcaacatataaaatataactatatatacatatatttcatattctgttatattttatatgttgat

SEQ ID NO: 5792 - DNA, 72 bp, Homo sapiens
atatatgtgtgtgtgtgcgcgcgtgtgtgtgtatttgtatatatatgtatgtgtgtgtgtgtgcatgtgtgt

SEQ ID NO: 5793 - DNA, 59 bp, Homo sapiens
acagcctggctcttctgcctatggccacgctatgccactgtcactcagacccagggtgt

SEQ ID NO: 5794 - DNA, 101 bp, Homo sapiens
tcattttatatttcaaggaatttgcaacttagtcattatttatttatccctccagggatagaaattggttaaaaaaagagttctctgctattgtttggtga

SEQ ID NO: 5795 - DNA, 69 bp, Homo sapiens
gaagcggattcagaggacaggacagaacacttgggcaagtgaatctctgtctgtctgtctgtctgtctc

SEQ ID NO: 5796 - DNA, 63 bp, Homo sapiens
gcggattcagaggacaggacagaacacttgggcaagtgaatctctgtctgtctgtctgtctgt

SEQ ID NO: 5797 - DNA, 105 bp, Homo sapiens
tctgcaattagagcaaatgacaataaatctatggctgatgtccttggtgatggtggaaactcctcactcactatctctgaaggtcctattgtctctgagcgcagg

SEQ ID NO: 5798 - DNA, 95 bp, Homo sapiens; identical to SEQ ID NO: 68

SEQ ID NO: 5799 - DNA, 93 bp, Homo sapiens; identical to SEQ ID NO: 69

SEQ ID NO: 5800 - DNA, 116 bp, Homo sapiens
gccatcgggtcctgagattttctttgttgggagatttttgtaaaattactgactcaatctctgtatctgttattggtctgttcaaattttctgtttctacaggattctatcttggt

SEQ ID NO: 5801 - DNA, 67 bp, Homo sapiens
cgctcccctctcatgtgtgtggcttatgtatgattcacagaagacacacacacactcagattgagtg

SEQ ID NO: 5802 - DNA, 77 bp, Homo sapiens
gagcacttagcacacttatgtcaatttttaaatgtatattctatagaaagaaattggtatggttgggctgtgtcctc

SEQ ID NO: 5803 - DNA, 92 bp, Homo sapiens
cctttccaagctctttctctatttatttatttattattatactggctagaattccagtacgatattaagtggcagtgatgagagtggccagg

SEQ ID NO: 5804 - DNA, 75 bp, Homo sapiens
gagacacacagagagagagagagaactaattcccagcttcggggatgaagattctatgcacttgctgtttgtctc

SEQ ID NO: 5805 - DNA, 72 bp, Homo sapiens
atatttttcaattcaaaaacatatattgaatgcttactgcatgtcaagtgttattgaaggtatgggggatat

SEQ ID NO: 5806 - DNA, 88 bp, Homo sapiens
gtgactaaggaggcaccacgtgggctctgatgagagttttattttattttatttattttatttttgagacacagtctcgctctgtcac

SEQ ID NO: 5807 - DNA, 110 bp, Homo sapiens
ccaaggtaaagaggagaacaatatctctagaagtggggaggccaaggaactgagagaacagacattggaaaggatctgctatagggatactgaactcactaataagtagg

SEQ ID NO: 5808 - DNA, 111 bp, Homo sapiens
ctccctgataatttcctgcccaccatggatcttgattctctgcatgtgaatctggattaagcacagttcactaaacagaaacttataattcagcacaatttttgtctggag

SEQ ID NO: 5809 - DNA, 116 bp, Homo sapiens
gcagaatggatgttctaataccatactaatgggcagaaacagaaattcactctagagtcttagctgtagtccatatctcttttcttttataatggtcaagaaagatttattgatgt

SEQ ID NO: 5810 - DNA, 92 bp, Homo sapiens
tttgactggctttgttcatagggtccattacaggtctatgctgtgtcactcagcatctcactatgatcctaagatttttttagcttattaag

SEQ ID NO: 5811 - DNA, 118 bp, Homo sapiens
tgaactatacacttaaaatagatgcatcttacatataaattacacatcaataaaatttattttattaagttacagagttgtttaaatttatgtagtagaaatgcaggtgtatttgtca

SEQ ID NO: 5812 - DNA, 78 bp, Homo sapiens
gtcactttctcagtcacattgtgtgttcgatctttaaccttgggtgcaataatggttttatctgaagaaggaggtgat

SEQ ID NO: 5813 - DNA, 74 bp, Homo sapiens
tgaggctttgggggcagggagaggggcagggctgctacaggacatctgtccgtccgtctgtctgtgaagctgca

SEQ ID NO: 5814 - DNA, 86 bp, Homo sapiens
agccttgacatgaatattgatatctcttggatagatcccctaaatttattcttttttaaaatcagtgttcaagtcattcataggct

SEQ ID NO: 5815 - DNA, 106 bp, Homo sapiens
gcctggaactagggtcattgtgggtggtcctggagcctgtgagtctgtgggtctgtggatgccagcctgacaccagggtctactgagatggacctggaaactgagt

SEQ ID NO: 5816 - DNA, 109 bp, Homo sapiens
ggtccatctcagtagaccctggtgtcaggctggcatccacagacccacagactcacaggctccaggaccacccacaatgaccctagttccaggcctactccagtgaacc

SEQ ID NO: 5817 - DNA, 70 bp, Homo sapiens
atgggcatatctgagtatttatatatgtgagttcatttacatatatattgtgtatttaaggcatgcctat

SEQ ID NO: 5818 - DNA, 117 bp, Homo sapiens
tttggcatgtattaagaagatcatatgtgtgtgtatatatatttatacgtgtttgtgaatatatatatgtgtggtgtgtatgtatacatatacatctttttctgtcaatatggtgaa

SEQ ID NO: 5819 - DNA, 95 bp, Homo sapiens
ccagtactttagaatgtggccttatttgaaactagagtgtttgcagaagaagtaagatacagtcatcagaatgggttccaattcaatatgactgg

SEQ ID NO: 5820 - DNA, 68 bp, Homo sapiens
gaagaggtagatggatgtaaggaagactgcagaaagaatacttcatacatgttttcatttgcttcttt

SEQ ID NO: 5821 - DNA, 114 bp, Homo sapiens
tttgttctttttgcttaggattgtcttggctatagaggctcttttttggttccatatgaaatttaaagtagatttttctaattctgtgaagaatgtcaatggtagttggatgga

SEQ ID NO: 5822 - DNA, 134 bp, Homo sapiens
tccagctttgttctttttgctcagaattgtcttggctatatgggctctttttggttccatatgaaatttaaagtagttttttctaattctgtgaagaaagtcaatggtagcttgaggggaatagcattgaatct

SEQ ID NO: 5823 - DNA, 79 bp, Homo sapiens
gccaggctggatgttgaatgagggtgcagcattatcagcaagttgtaatgacagggagcactcagcgagcattcctggc

SEQ ID NO: 5824 - DNA, 59 bp, Homo sapiens
ggtgtgtgtgtgtgtgtgtgtgtgtgtatacagcacacacatatgtacatacacaggtc

SEQ ID NO: 5825 - DNA, 109 bp, Homo sapiens
tttaaaaattctatgcatacacatgtatgcaattatatatgatataatatttttattcacatatgttgtatatatgcatatatatatgtgtatgtgtatcttgtttaag

SEQ ID NO: 5826 - DNA, 109 bp, Homo sapiens
tgatcagaatggaggagagagtgctgaatatgatattagaagtgaaaacatgtttgttttatgtgcttggataaaaggatcatgcagctcagtcctcagccaaatttca

SEQ ID NO: 5827 - DNA, 101 bp, Homo sapiens
atttttaatatttgtgggtacatagtagtatatatatttatgaggtacacgagatgttttgatacagatatgctatgtgtaataatcacatcatgaaagat

SEQ ID NO: 5828 - DNA, 97 bp, Homo sapiens
gtatgttgtttaatctccaagtatttggggttttaaaaaatattttttcattgatttttagtttaactccattgtaatctgagagaagacattatat

SEQ ID NO: 5829 - DNA, 77 bp, Homo sapiens
cctcatcttggagtctctcagtcactgtgtagatataaatatataccctcctgtggtggagttctcccagaatgagg

SEQ ID NO: 5830 - DNA, 73 bp, Homo sapiens
gcctcttcctctcaaccacacagtcagactcagaggctatccttcaggcccttgagtttccctggatcatggc

SEQ ID NO: 5831 - DNA, 79 bp, Homo sapiens
gttgttttgttttttgagatggagtctcactgtgtcgctcaggctggagtgcagtggcttgatctcggctcactgcaac

SEQ ID NO: 5832 - DNA, 62 bp, Homo sapiens
tgtatatgtgtatacatatatatgtatatgtgtatatatatatatatgtatatgtatatata

SEQ ID NO: 5833 - DNA, 59 bp, Homo sapiens
tatatacagtagtgcctctgttttatatttttaataaccagaggcaggctctgtgtgtg

SEQ ID NO: 5834 - DNA, 85 bp, Homo sapiens
tcatgctccccctagggatttgaacagcggggcaccgaagaagcaagccacactccctgtcacacaccctgcgaggggtatatgg

SEQ ID NO: 5835 - DNA, 118 bp, Homo sapiens
tacttgtcctctaccatattgccttatctttgcagaaaatgaaatacgaggaaaattatttttctttgtatgtaaaagcttcccaactaaagactggaaaatatcactgaggggggtg

SEQ ID NO: 5836 - DNA, 80 bp, Homo sapiens
ctaaaagccagagctgtatctatgtgtattttatttttttattttagagacagagtctcactctgcagcccaggctggag

SEQ ID NO: 5837 - DNA, 75 bp, Homo sapiens
gcaatgcttctgtggattcatctgtggattcatggactgccttatccatcgtcatggtattccacacagcaatgc

SEQ ID NO: 5838 - DNA, 82 bp, Homo sapiens
ttgagatggaatctcactctgtctcccaggctggagtgcagtggcctccaactcctggattcaagtgattctcctgcctcag

SEQ ID NO: 5839 - DNA, 108 bp, Homo sapiens
tctaggagtttaatagtttcagctcttactttaagtctttaatccatattcagtggatttttgtgtgtggtgtaaggtagggcccaattttattattttgcatgtaga

SEQ ID NO: 5840 - DNA, 58 bp, Homo sapiens; identical to SEQ ID NO: 1215

SEQ ID NO: 5841 - DNA, 73 bp, Homo sapiens
catctcagtgtctatctgactgtataaagcccccagtggctttatacagagaaaaaaaagcaataaggagatg

SEQ ID NO: 5842 - DNA, 100 bp, Homo sapiens
ggatctgtgtccccacacaaatcttatcttgtagcttctatagttcccacgtgttgtgggagggaaccggtgggagataattgaatcatggggtaggtct

SEQ ID NO: 5843 - DNA, 84 bp, Homo sapiens
tatatacacacacacctctctctgtctgggtttctctctcaaggagtcaccaacacagaccaagatatgggatgggaaaatata

SEQ ID NO: 5844 - DNA, 74 bp, Homo sapiens
ctggccgatctcttgttttgctggtagagttgctgaaagacttacagttgagcctgagcacaagaatttgccag

SEQ ID NO: 5845 - DNA, 77 bp, Homo sapiens
gtgcccttataagaggaggaagatacaagatgggctcactatctctctctcttgcactcttcaccatgtgaggacac

SEQ ID NO: 5846 - DNA, 119 bp, Homo sapiens
gtatcgttggtatttatgttagccattctaatacatgtgtcatgagatctcattttgttcttaatctacattttcataaaggcacttgatgttgaaaagcttttcatgtgcttatttgc

SEQ ID NO: 5847 - DNA, 58 bp, Homo sapiens; identical to SEQ ID NO: 1745

SEQ ID NO: 5848 - DNA, 136 bp, Homo sapiens
gtatgtatacatatatgtatgtatacatatgtatacatatacacgtgtgtatgtatacatatatgtatatatacatatgtgcatatacgtatgtgtacatgcgtatgtgtgcatgtacatatacatgtgtacatat

SEQ ID NO: 5849 - DNA, 88 bp, Homo sapiens
ttgactggtttaacttacatagtgatctagatgaaaaatgataaatcatttttatatttgtttctatgaagtggaaatcctaggttgg

SEQ ID NO: 5850 - DNA, 65 bp, Homo sapiens
gtatatatgtatgtatatgtatagtatacataaaatatgtaattatatatgaatgtacatattac

SEQ ID NO: 5851 - DNA, 82 bp, Homo sapiens
gcgaggacagcgaggcctcggccgtttcacctggctggcaactcgctgccctgccggcggcctgactcactgactgtcctcc

SEQ ID NO: 5852 - DNA, 116 bp, Homo sapiens
tatatatgtatatacacacatatatatgtgtatatatacatgtatatataaacatatatgtatatatacatgtatatataaacatatatgtatatatgtgtgtatatacatatatg

SEQ ID NO: 5853 - DNA, 115 bp, Homo sapiens
taagatgtattttccttaacaaaagtgtcacttttgaagtggaatcaaaatatgtttgtaatagtaaatattttcaatgatgattctgtgcactttgtgggactatatagtttta

SEQ ID NO: 5854 - DNA, 98 bp, Homo sapiens
agtaattaaataataaaaggagtttagatgcaaatttactatttgattaattatacaaaccttttgcatttacatactccttttcttgttttcattct

SEQ ID NO: 5855 - DNA, 93 bp, Homo sapiens
gtaagttggaactgagggtggggtggaggggagcgagttgtggcttaaatgccacagactctcactctttttactgatattcagtcgattttc

SEQ ID NO: 5856 - DNA, 96 bp, Homo sapiens
ttttgaatacagaaaataagcactttgaatttaatattttgcttttaaaatgactaggttatgattgattaaagtgctgtattctctttgtcaaaa

SEQ ID NO: 5857 - DNA, 83 bp, Homo sapiens
gatataatatatagatatatataatatatattgatataacctatatatcaacctgtatatatatatgtgtgtatatatgtgtc

SEQ ID NO: 5858 - DNA, 118 bp, Homo sapiens
atcctttgaatgtgtttacaaaatgtggaaataagttgtttctagataatatcaatatttatttgctagaaaataaaaactcacctgtaaacatgttttattgttattttaaagtggt

SEQ ID NO: 5859 - DNA, 82 bp, Homo sapiens
aggtttttttgtacagacacaatcagatttattttttacctattactttggtagtatggaggatgtgtagcatctgaaacct

SEQ ID NO: 5860 - DNA, 58 bp, Homo sapiens; identical to SEQ ID NO: 3380

SEQ ID NO: 5861 - DNA, 105 bp, Homo sapiens
agaagtatatatgttatcagagatatctcaggagatgtcctaagaaccttaatcagtcacactgaatgtcagtttcttggattagatatgttttggtgatcttct

SEQ ID NO: 5862 - DNA, 56 bp, Homo sapiens
ggagggactgtcactaacactgttactgagaagcagtgggtagacaggacttagcc

SEQ ID NO: 5863 - DNA, 100 bp, Homo sapiens
ttttgaaagatatttttaccagacatgagtaccaagatactttttctattttagcattttgaggtgacagtcattgtcttctgtaaaaagaatttcaaga

SEQ ID NO: 5864 - DNA, 112 bp, Homo sapiens
actagacactggatctgcatgtgcctttttttttcttttttctttctttctttttttttttttttttttttgagagagaaagagagtcttgctgtgttgcccaggatgaagt

SEQ ID NO: 5865 - DNA, 116 bp, Homo sapiens
gtatatgtatacatacatatatgtatatgcgtatatgtatatatgtatacatatatgtatacatatatatatacacacacacacacacacacgtgtatatatatatatatatatat

SEQ ID NO: 5866 - DNA, 101 bp, Homo sapiens
ccatcattttggcttggagagattagtacatattctggatatatatacatttatagatatatatttcaagaactctttacttgccaaaagaattgattagg

SEQ ID NO: 5867 - DNA, 101 bp, Homo sapiens
cagagcaagactcaatcttaaaaaaaaaaaaatggtatcaagtatgaaaacagactaattatttttattcatttgtttatttaaactggagtctcactctg

SEQ ID NO: 5868 - DNA, 110 bp, Homo sapiens
tgacaaatcaccctgatgttgatgaggcatgggggattgggttagacagacactctctgagcctccagttctgcatggttctcaacacacatatccaggtgtttttctca

SEQ ID NO: 5869 - DNA, 71 bp, Homo sapiens
gcctggggtagagcttgtaattttgtatttctgacaaactttcaggtgataccaaagcggctggccctggt

SEQ ID NO: 5870 - DNA, 85 bp, Homo sapiens
ctgtagtccgagatattcaggaggctgaggtggaaggatcacttgagcctgggaggttgaggctgcagtgagccatgattgcacc

SEQ ID NO: 5871 - DNA, 108 bp, Homo sapiens
ggtataaggaagatttccatttgtgagacataaatatttatctgtgctttgtatatttatttagtacacatgaatgctatgtaggcatggaacatttctgaaaagatc

SEQ ID NO: 5872 - DNA, 92 bp, Homo sapiens
tgtgtatttatatatgaatgtgtgtgtaggtacatgtatataattatatgatattatttttggatatatacatatgtatataaaaatgcata

SEQ ID NO: 5873 - DNA, 61 bp, Homo sapiens
gcacaggagatggaggcagaaatcctccaagtcttaccactctgcaactgcatctccatgc

SEQ ID NO: 5874 - DNA, 57 bp, Homo sapiens
gactgcatatatatatgtgtgtatgtttatatatgtgtgtgtatatatatgtatgtc

SEQ ID NO: 5875 - DNA, 79 bp, Homo sapiens
gattaaaatatggggactaatatgctaaggttctagtatggtaagctagcatatggtatgttagctacatgtacatatc

SEQ ID NO: 5876 - DNA, 75 bp, Homo sapiens
ggttgtttttgagaccaagtctcactctgtcaccgaggctggagtgcagtggtgtgatcttggctcacggcaacc

SEQ ID NO: 5877 - DNA, 70 bp, Homo sapiens
ttgccacctctgtgtctctgaggctctgagcacagatgcctagggcatcagcctgagatgaaggtggtgg

SEQ ID NO: 5878 - DNA, 90 bp, Homo sapiens
tgtgtggagaggcattcaggtacaaagaattataatagcaaacctaccttctatatatataattgttatctgctaggtctgatccccaca

SEQ ID NO: 5879 - DNA, 78 bp, Homo sapiens
cagtatttcttcaataaaagttactgacactctctatatgtcaagcactggagggtgccagtgaaaagagatggtctg

SEQ ID NO: 5880 - DNA, 112 bp, Homo sapiens
tttggaggggacaaaccttcaagttatagcaacttctatacctagcttttgttttctttttttagtttttaccatgaaaggttgttgaaatttgtcaaatgcttcttctgaa

SEQ ID NO: 5881 - DNA, 119 bp, Homo sapiens
cagttgttcaatagataaagtgacatcacagcatgtcaccagggcaatttgattatttttttgtgattctcttgatgacttcttgatgtaaccttcatgtgcttaagtgatttcaagtg

SEQ ID NO: 5882 - DNA, 95 bp, Homo sapiens; identical to SEQ ID NO: 580

SEQ ID NO: 5883 - DNA, 93 bp, Homo sapiens; identical to SEQ ID NO: 69

SEQ ID NO: 5884 - DNA, 78 bp, Homo sapiens
cacaaggtctcactcactctgttgcccaggttgcagtgcaatactgtgatcacggctcactggagcatcatcctcgtg

SEQ ID NO: 5885 - DNA, 100 bp, Homo sapiens
catttgttcttgaagtttatctgcctccatagttctctggcaggtggtaaaatacaacctatcaggtcaagggaccaggaggcgagtcctgatgaaaatg

SEQ ID NO: 5886 - DNA, 123 bp, Homo sapiens
gctgtgcagacggtcaacctaaggctgggacaggaaaggtggatgaggtgagagtctgcagagtggtgggaggtgggcctgtcaggcagggaggggcgggtggggggtgctacttcctgagac

SEQ ID NO: 5887 - DNA, 115 bp, Homo sapiens
ggcagaagcaaggaggcaggagcccttccactgtcatattctggtgtggcttatgtacagagtgatcagagtagcttcagcagaggggcggaatcttgaaagagagctctaagcc

SEQ ID NO: 5888 - DNA, 107 bp, Homo sapiens
ttaactaaatatatatttaactaaatacaaataaataaagggagactattgtatttgtatttaacagtatttgtatttagttaaatacaaatacagtagtccccctt

SEQ ID NO: 5889 - DNA, 82 bp, Homo sapiens
tggattaagggggactactgtatttgtatttaactaaatacaaatactgttaaatacaaatacaatagtctccctttattta

SEQ ID NO: 5890 - DNA, 64 bp, Homo sapiens
agagaggagagagagaagagagtgtgtgtatttgtatgtgtgcttttttttttttttttttttt

SEQ ID NO: 5891 - DNA, 98 bp, Homo sapiens
tgtgtatatatacgtatatatacgaatatatacacatatatatacacatatgtgtgtatatatatgtgtatatatgtatgtgtgtgtatatatataca

SEQ ID NO: 5892 - DNA, 70 bp, Homo sapiens
tctgtgtgtgtgtgtgtgtatatatatatatataaacatatataaaaacacatatatatataaacacaga

SEQ ID NO: 5893 - DNA, 82 bp, Homo sapiens
gtctctagagagcccagttcccatgcaagaggctgcatcaacagcattttgaaacagcaactgcagctgcattttcttagat

SEQ ID NO: 5894 - DNA, 95 bp, Homo sapiens; identical to SEQ ID NO: 68

SEQ ID NO: 5895 - DNA, 93 bp, Homo sapiens; identical to SEQ ID NO: 69

SEQ ID NO: 5896 - DNA, 96 bp, Homo sapiens
gctggatttggtttcctattacgttgtagattattgtatctatattcttagagatattgctgtgcagttttcttttttgtgatgtctttatctggt

SEQ ID NO: 5897 - DNA, 79 bp, Homo sapiens
tcagataaaaagatcaaaaggccttctacaatttttacctttaatattaatgctggcctttatctttttttatatctga

SEQ ID NO: 5898 - DNA, 107 bp, Homo sapiens
gctaggaagtgttcgctcctctcgtatgttttggaactatttgtgaagacttggtaaaaatttttctttaaatgtttgacataatttgccagtgaacccatctgggc

SEQ ID NO: 5899 - DNA, 104 bp, Homo sapiens
tactttaagttctagggtacatgtgcacaacgtgcaggtttgttacatatgtatacatgtatgttggtgtgcagcacccattaactcatcatttacattaggta

SEQ ID NO: 5900 - DNA, 115 bp, Homo sapiens
tgggattttcttggctattcgggctcttttttggttccatatgaaatttaaagtagttttttctaattctctgaaggaagtcaatggtagcttgatggggataacattgaatctc

SEQ ID NO: 5901 - DNA, 95 bp, Homo sapiens; identical to SEQ ID NO: 68

SEQ ID NO: 5902 - DNA, 93 bp, Homo sapiens; identical to SEQ ID NO: 69

SEQ ID NO: 5903 - DNA, 58 bp, Homo sapiens
tgagacggagtctcactgtgtcgctcaggctggagtgcagtggcgcgatctcggctca

SEQ ID NO: 5904 - DNA, 98 bp, Homo sapiens
cttatgaagcttcgtttggctgggtatgaattcttgattggaattttttttctttaagaatgctgaatataggcccccaaattcatctagcttgtaag

SEQ ID NO: 5905 - DNA, 107 bp, Homo sapiens
cattaatatatatgtatgactgcatgtgaatatatatatattatatattcagactttagaatatatatatatatatatacatcaaagtccatatcaaagagaaaatg

SEQ ID NO: 5906 - DNA, 74 bp, Homo sapiens
atatacatatacacatgaatatacatgaatatatattcatatatatgaatatattcactatgtatatgtgtgta

SEQ ID NO: 5907 - DNA, 98 bp, Homo sapiens
gttttcagatggacttaaaacaatactgtaattctatatttatatgtatgaatgtagagtattcagctcattgttattttaagaatgttttctgttgc

SEQ ID NO: 5908 - DNA, 115 bp, Homo sapiens
tagctgagcatggtgacatgcatgcctgcagtctcagctacttgggaggttgaggtagaaggatcacctgaatctaggaggttgaggctgcgataaaccatgatcgtgccactgc

SEQ ID NO: 5909 - DNA, 95 bp, Homo sapiens; identical to SEQ ID NO: 68

SEQ ID NO: 5910 - DNA, 93 bp, Homo sapiens; identical to SEQ ID NO: 69

SEQ ID NO: 5911 - DNA, 111 bp, Homo sapiens
tgttcacaaatgcaccatggctttgtgaatagggcatatgaactaatagttaggcctcctcaattctgtatctgtctatgccagtcatagggcttgtgagtatgtgtcaca

SEQ ID NO: 5912 - DNA, 119 bp, Homo sapiens
gcattgcattaaatgctagggaccccacagaacaatctcttctcctccctgttagttactatttgattatttaagagtgaactgatatatgtttgtgggagagcatatattttgaatgt

SEQ ID NO: 5913 - DNA, 111 bp, Homo sapiens
tcattgctttaaataatgtcttgatggggtttatgttgagaaataaagtttatatttttatcttttaattccatttaacatgaacttttcaaagtatctttatgtatttga

SEQ ID NO: 5914 - DNA, 60 bp, Homo sapiens
ctgcctgcgtgtatgcacgtgtgtgcacctgtgcacacacacacgcacacactcacacag

SEQ ID NO: 5915 - DNA, 87 bp, Homo sapiens
caactggtaaattggagaaatttgctttcaaaggcactagcctgcatattccctgcacagtgtctcaggctctctgaaaggcagttg

SEQ ID NO: 5916 - DNA, 104 bp, Homo sapiens
aatttaatcgcctatcgtatgattttgaataaggctctgactagtttgtatatttgtttaaatttatttaaagttgtgcttttggggttttgtttctcatatga

SEQ ID NO: 5917 - DNA, 98 bp, Homo sapiens
gggaaagtgacatgttgttttggaactgagcagcctgggatcttctctctgactcactctatgaccttgaacttaaactgtctgcttcttactttcct

SEQ ID NO: 5918 - DNA, 110 bp, Homo sapiens
ccagcagtgtagaagtgttccctgatcacagcatccatgccaacatctactgttttttgattttttgattatggccatttttgcagaggtaaggtagtatgacattgtgg

SEQ ID NO: 5919 - DNA, 85 bp, Homo sapiens
ctcattactatttctatctttatcatttttgcctcagcatactagcacagtgcaagaagcattgttgaggaagaaataatctgag

SEQ ID NO: 5920 - DNA, 83 bp, Homo sapiens
gctctgtcaagtaaaattgaaagcttcttatgaaaacggtcaactggaggtgccaagtttttgtttttcttttgaacaagagc

SEQ ID NO: 5921 - DNA, 82 bp, Homo sapiens
ttttagagtttcattcctgacagtgttataagagaggtacaattttctccatttgacagatgagagaatggaaactcagaaa

SEQ ID NO: 5922 - DNA, 182 bp, Homo sapiens
gtactattttatatatatatatatatatatacacgtatatatatatatacgtatatatatatatacgtatatatatatatacgtatatatatatatatacgtatatatatatatgtatatatatatatacgtatatatatatatgtatatatatatatatacatatatatatatatatttat

SEQ ID NO: 5923 - DNA, 114 bp, Homo sapiens
tctgggactacaagtgtgagccaggctgactaagctcttaatttttttttttcatttcttgggtcttgaaaataaagggcatcataatacctgacagcttcacttagagttaga

SEQ ID NO: 5924 - DNA, 81 bp, Homo sapiens
ttccagtgtgtgtgtgtgtgcgtgtgtgtgtatgtatacatatatatatatatacacacacacacacatatacactgtgaa

SEQ ID NO: 5925 - DNA, 101 bp, Homo sapiens
tgatccagtgcactgaatttgagacatccttacccgtcccttctgcaatgtgtctctctgacactggacgctgggaatgcagcactctctgtaatggatca

SEQ ID NO: 5926 - DNA, 90 bp, Homo sapiens
ttacggcttgtggtaggtgttgaataaatgttttgatttcctaatgcatgcaaattaatatttattattatttactattagtaatagtaa

SEQ ID NO: 5927 - DNA, 115 bp, Homo sapiens
tttgtctgcagtagtgtgaatgaaagcgttttccgttttaaggattttttttttaattatttaaaggttcatctttgtgatgttctttgctaagaatttgatatctcaagacaaa

SEQ ID NO: 5928 - DNA, 122 bp, Homo sapiens
gcagcactgatgccccatctaggagtggccggtggccatctgtagtggcaccaggcatcatgcgcacttgactggtgctcttcttggctggcagttcaggattagagagtacatgttggggc

SEQ ID NO: 5929 - DNA, 112 bp, Homo sapiens
tagatgggcatggtagcacatgcctgtagtcatagctgcttgggaggctgaggtaggaggatcgcttgagcatgggaggttgaggctgcagtgagccatgatcatgccacta

SEQ ID NO: 5930 - DNA, 86 bp, Homo sapiens
ctgccctgctctgttttctttattgtacacatcagcgtactctctatcagtggctctctcaaggtgtgctcctagagcagcagcag

SEQ ID NO: 5931 - DNA, 97 bp, Homo sapiens
gagggctctcatttgttgaatgatatgagatggacaccaaagcaatgggtgaggagttgacttgtgtctctttctccaaataggacaagaagctctc

SEQ ID NO: 5932 - DNA, 58 bp, Homo sapiens
tgagacagagtctcgctctgtcacccaggctggagtgcagtggcgcgatctctgttca

SEQ ID NO: 5933 - DNA, 72 bp, Homo sapiens
caggcacacaaaccacactgagctactcaccggacaatctgtcagtgggtccctcatgttgaaatgtgtctg

SEQ ID NO: 5934 - DNA, 82 bp, Homo sapiens
ttactgaaactctctgtgtctccattgcccaatctgtaaaatggggcaatgcacaatgacatatgacattgggttgttgtga

SEQ ID NO: 5935 - DNA, 119 bp, Homo sapiens
ttagtgcccacagagaacctttacaagtaaacagccactgatgccaaataactagagacagacgcactcagagacaggcaaacttggtgttacttccaaagcttctgccaaaactgagg

SEQ ID NO: 5936 - DNA, 71 bp, Homo sapiens
ttctacttggccttagctagtaatctatgattagtgatgacacagattctgctttggtctgaaaggtggaa

SEQ ID NO: 5937 - DNA, 95 bp, Homo sapiens; identical to SEQ ID NO: 68

SEQ ID NO: 5938 - DNA, 93 bp, Homo sapiens; identical to SEQ ID NO: 69

SEQ ID NO: 5939 - DNA, 113 bp, Homo sapiens
tgtgtcagtccataggaaggctatgctaggcacccactgggagataaggaaggaatcagaagactgagtccagcctgttaagaaggttgtggtacggttcaggggacagcaga

SEQ ID NO: 5940 - DNA, 105 bp, Homo sapiens
gatagaagcatgtggagatataaaaggacaatatgagggagtcttgagatgatgagaatgttctgatcttgattatatcactgtcaatatcctgggtgtgatatt

SEQ ID NO: 5941 - DNA, 109 bp, Homo sapiens
cagagttgtgcattcactgccacagtcaattttagaacattttcttttttttccttttttttaattatactttaagttttagggtacatgtgcacaatgtgcaggtttg

SEQ ID NO: 5942 - DNA, 121 bp, Homo sapiens
tgattacaaggtggcctgtcaggcttatcacaaagaaaacagtagcatagtgactgtgtctgtgtgagttctggctacttctgcgtggttgcctctgatcacagcactgccctagttttct

SEQ ID NO: 5943 - DNA, 84 bp, Homo sapiens
ggatgtattttatttgtttttcttgtctaattgccctagaatttctagtacaatgttgaatagaaatagcaaatgacagcatgc

SEQ ID NO: 5944 - DNA, 116 bp, Homo sapiens
gtgggagatggcaaccttgtcttgtgctggtttcctttctttttttttttttaattaaattaagtttaattttaagttccaggatacatgtgcaggatgtgcaggtttgttacact

SEQ ID NO: 5945 - DNA, 78 bp, Homo sapiens
ctatcatctatctctctatctatctattgatctatctatttgcaataggattaaagatagtagagcaggtggtaatag

SEQ ID NO: 5946 - DNA, 98 bp, Homo sapiens
gcttgtataactctatcatctgttttatttaggaacttttgggaaaatcataaatctaggatagttttttttttactaagaggtgatgagtttaaagt

SEQ ID NO: 5947 - DNA, 146 bp, Homo sapiens
tctatatagatatagaatatatattatagaatatagaatatatatttatagaatacagaatatatatctattatatatagaatatagaatttatatatctgtataggatataggtatattctatgtatctacctatgtgtgtgtgt

SEQ ID NO: 5948 - DNA, 95 bp, Homo sapiens; identical to SEQ ID NO: 580

SEQ ID NO: 5949 - DNA, 93 bp, Homo sapiens; identical to SEQ ID NO: 69

SEQ ID NO: 5950 - DNA, 95 bp, Homo sapiens; identical to SEQ ID NO: 68

SEQ ID NO: 5951 - DNA, 93 bp, Homo sapiens; identical to SEQ ID NO: 69

SEQ ID NO: 5952 - DNA, 58 bp, Homo sapiens; identical to SEQ ID NO: 1099

SEQ ID NO: 5953 - DNA, 56 bp, Homo sapiens
gagtcagggtctcactctctcacccaggctggagtgcagtggtgcgatcacagctc

SEQ ID NO: 5954 - DNA, 75 bp, Homo sapiens
ccttccactccttctgccccaatattaaattctcttctttttgactgagtggaagtaggtaggtttgttggaggg

SEQ ID NO: 5955 - DNA, 113 bp, Homo sapiens
tctctttgaagcaattgtgaatgggcgttcactcatgatttggctctctgtttgtctgttattgatgtataggaatgcttgtgatttttgcacattgattttgtatcctgaga

SEQ ID NO: 5956 - DNA, 107 bp, Homo sapiens
tattttgaaatgcttcttggcatgctgcatcttatgtctgtttcttttttatttcgttttaagttctgggatacatgtgcaggatgtgcaggtttgttacataggta

SEQ ID NO: 5957 - DNA, 120 bp, Homo sapiens
agttgcttaaatagttgctgcacagatgcctcatagaaaacacagtcacactttttttttttttgagtcagggtcttactgtgtcactcaggctggagtgcagtagtgtgatagctcact

SEQ ID NO: 5958 - DNA, 118 bp, Homo sapiens
ttgctctttgttcaataacttggcagtcaatgtcgactgaaatatatttcttttttctagttttactgaaatataattggtatacaaaaaactgcacataatgtatacagtttggtga

SEQ ID NO: 5959 - DNA, 107 bp, Homo sapiens
ctttatgtaatagtatttgggttggggattggtgcttttccagttgtacgatgaatagttgtattacgttaggcataattatgacttattattgtctttatttgaag

SEQ ID NO: 5960 - DNA, 105 bp, Homo sapiens
gacaatgagaaatctttcacttactattctgattttgtttttcacaaaacgttttgtgaagttaatattccacaaaatcattaagtattggagttcaaatcatgc

SEQ ID NO: 5961 - DNA, 109 bp, Homo sapiens
gtaatcaatggcaggcacacagagaaatgacagaccaaaaacgggatttttttttttttttttttgagacagtcttgctctgtcacccaggctggagtgcagtggcgca

SEQ ID NO: 5962 - DNA, 64 bp, Homo sapiens
gacagtgagactcagtctcaaaaaaaattttttttctttttttttaatagagtctcactctgtc

SEQ ID NO: 5963 - DNA, 106 bp, Homo sapiens
cctttgaatagcttccttaagaatgggtgtatgagaggtaaaattttttaattatctgaaaagtttattttttactcatttttatttattttattattttttaagg

SEQ ID NO: 5964 - DNA, 96 bp, Homo sapiens
ggtcaaacatgtgtcttgttatagctgtctgtgtctgtcaatatttccttagtcctttgtagcacccagcttaatttatggaacatggtattgacc

SEQ ID NO: 5965 - DNA, 72 bp, Homo sapiens
tgcagctgcatggccgtctgcaaagacagacagctctgactctgtctttctctgggtgccagcatgcctgca

SEQ ID NO: 5966 - DNA, 67 bp, Homo sapiens
gtgatagttaatgaagctttttttttctttttttttttttttgagagagagggtctcactctgtcac

SEQ ID NO: 5967 - DNA, 114 bp, Homo sapiens
tccagctttgttctttttgcttaggattgtcttggctatgtgggctcttttggttccatatgaaatttaaagtagttttttccaattctgtgaagaaagtcagtggtcgcttga

SEQ ID NO: 5968 - DNA, 82 bp, Homo sapiens
cactaagcacagtggataagtgcagactctttttttttttttttttttaaatagacagggtctcactctgtggcccagggtg

SEQ ID NO: 5969 - DNA, 88 bp, Homo sapiens
gacattcaaatctatgatcttgactataactgagctgtaagcattgtttatcaatctttatttatagtcagctttcatgaccaatgtc

SEQ ID NO: 5970 - DNA, 109 bp, Homo sapiens
tgtaaacacttttattcttgcatttatgttcctattactttttttaaattttattattattatgctttaagttttagggtacatgtgcacaatgtgcaggttagttaca

SEQ ID NO: 5971 - DNA, 110 bp, Homo sapiens
gctagatctgtcactcctctgctcaccacagtcagtagtctcatttcatttggaatgaaaaaaactaaagacattatgatggcctaagagggtgtctctattactctggt

SEQ ID NO: 5972 - DNA, 115 bp, Homo sapiens
gtattgatttcaatttttattccactgtggtccaagagtatggttggtattatttcaatttttttgaatttatcgagacttgtcttacagctgagaatgcagttgatcagagtat

SEQ ID NO: 5973 - DNA, 117 bp, Homo sapiens
gtgtcttggcccatgcctgccacatgccctgacctagcctgaccttgcctgtgccctgtctctgtatcactcaaatcttggcatgggaattgggtacctggcagtgttcctaataac

SEQ ID NO: 5974 - DNA, 104 bp, Homo sapiens
gttacgttgttttatatttctctatttttagttgaaattaataaaaataaacttggtttatttttttaattttattgagttaagtgatttgtgtcattagtaac

SEQ ID NO: 5975 - DNA, 113 bp, Homo sapiens
ctatttatttactcagtccgatggggggggttgttgtttttaaaattttatttatttatttagtaatttttagagatggggtcttgctctgtcaccaggctgaaatgcagtgg

SEQ ID NO: 5976 - DNA, 100 bp, Homo sapiens
gcaggggacctcataaaaattaatcaaaaagccacagggaagcgtaaatgactctgactctgtctttcatttgtttaatgttcatgccagtccctactgc

SEQ ID NO: 5977 - DNA, 68 bp, Homo sapiens
gggcatggtggtgggtgcctgtagtcccagctactcaggaggctgaggtagtagaatggcgtgaaccc

SEQ ID NO: 5978 - DNA, 133 bp, Homo sapiens
cccatacttgagaaagtggggctttctttctttctttttctttttcttttttttgagatggagtctcactctgtcacccaggctggggtgcaatggtgcgttcttggctcactgcaatctccccttcctgagt

SEQ ID NO: 5979 - DNA, 86 bp, Homo sapiens
ctcctttagtatctctcactcagtctgtttcaaggaaatactgaactggaactttaccttggggcaaggaggttagaaagtaggag

SEQ ID NO: 5980 - DNA, 77 bp, Homo sapiens
tatatatatatgtgtgtgtgtgtatatatgtgtgtatatatatatgtgtatatatatgtgtgtgtatatatatatgt

SEQ ID NO: 5981 - DNA, 95 bp, Homo sapiens
gctccatatgccttcactcctgaacatttgctagaaaatttctgaatatttattgttagagagtcagtgcagtcaggcagaagaagcagaaaagc

SEQ ID NO: 5982 - DNA, 74 bp, Homo sapiens
gactgtggtttctatcttgtgtgctttctctcactctctccaggggaagacagctgccacatggtaacgcagtc

SEQ ID NO: 5983 - DNA, 81 bp, Homo sapiens
cttacctgatgtttttcagttggagattcttttttttttttttttttttgagacagagtctcactgtgtcatccaggctgg

SEQ ID NO: 5984 - DNA, 57 bp, Homo sapiens
ccactctctgtcactgagcctcagccctgtcctgctgaggccaccagctccaggtgg

SEQ ID NO: 5985 - DNA, 87 bp, Homo sapiens
tcaggtcatgccaacaccttaccatttcattcattagtgagggctagtaggatgaagagtatggacagggggtactgatgatcctga

SEQ ID NO: 5986 - DNA, 93 bp, Homo sapiens
cttgaaaaggggggatttagatattttattctcttgctgtctttctggttagggagtagacatgtgaatttgttctgtgcctttctaagcagg

SEQ ID NO: 5987 - DNA, 77 bp, Homo sapiens
ttgtttatttttgagagggagtgtctctctgtcacccaggctggagtgcagtggctcaatctctcagctcactacaa

SEQ ID NO: 5988 - DNA, 101 bp, Homo sapiens
gacagctctgttctttaaggatcaaatgatatatgtgtgtgtatgtatgtatgtatatatattttttcttttttttttttgagacagggtctcactctgtc

SEQ ID NO: 5989 - DNA, 91 bp, Homo sapiens
tttatttttaagtgatagacactttatataccatattttagttatttttaacaaagtgaggtagattgtgttgcttctatttagaaataag

SEQ ID NO: 5990 - DNA, 80 bp, Homo sapiens
tgagacagagtctcacactgtcacccaggctggagtgcagtgacacgatctcggctcactgcaagctctgtctcctgggt

SEQ ID NO: 5991 - DNA, 123 bp, Homo sapiens
tactgtgtctctctggtattgctgtggtctcctggctcctgtttttttgttgttgttgttgttgttgttttttttttgagagaggggtctcactctgtcacccaggctggagtacggtgacgc

SEQ ID NO: 5992 - DNA, 105 bp, Homo sapiens
taattgtatacatttatggggtacagtgtcatgttttgatatatatatatatatatatatatacacacacacacacacaaacacacacataatgtggaatgatta

SEQ ID NO: 5993 - DNA, 108 bp, Homo sapiens
attgtttcttccagatagattcccagaatgaaattagtggatcaaaaaacaaatttttttttttttttgagaaagggtctcactctgttgcccaggctggagtgcagt

SEQ ID NO: 5994 - DNA, 112 bp, Homo sapiens
actttgactctgtgataaacatttttattcatagtatttccccatattttgaatttttttcttaggaaagattctcagaaataggaatatatgtatgttatacagttaaagt

SEQ ID NO: 5995 - DNA, 66 bp, Homo sapiens
ctttctgagttagtagacagtgttgttagaggcctgctctgggttgctgtttctgaacttaaagag

SEQ ID NO: 5996 - DNA, 73 bp, Homo sapiens
ggaactctgtcacactgtttctgaagaagtataactgtgcttctttgccagcagctgcacagacatattttcc

SEQ ID NO: 5997 - DNA, 89 bp, Homo sapiens
gccttttaaaaaaaatctgtttatttttgacaacatggatgatcctggaggacattatgttaagtgaaataaaccaggcacagaaaggc

SEQ ID NO: 5998 - DNA, 83 bp, Homo sapiens
ggtctcactgtgtcactcggactggagtgcagtggtttgagcacaactcactgcagcctcaacctcccctgactcaggtgatc

SEQ ID NO: 5999 - DNA, 115 bp, Homo sapiens
gagctggtcaggctcacaggagtatctgggccttctggcagttatgtttttcattgtaaattaataaattgacattctccaatgtaccagtgtcttaggagcctgttagttccgg

SEQ ID NO: 6000 - DNA, 83 bp, Homo sapiens
gtgtgtgtatatatatatcatttagtaaatgctcagtaaatagtagcagttattactactacatggtcagaatgtacacaggc

SEQ ID NO: 6001 - DNA, 112 bp, Homo sapiens
tgtgatttgcttgcagaattgaggttttatattgtcctcgtcttagatgttcacttttttttttttttttttttttgagacagggtctcactctcacccaggctggattgca

SEQ ID NO: 6002 - DNA, 62 bp, Homo sapiens
gtctgagacagtctcactctgtcacccaggctggagtgcagtgtgtgattgcagctcactgc

SEQ ID NO: 6003 - DNA, 92 bp, Homo sapiens
tgaattgtctagattattcactgagtgtgtagtgcttaaaaattaattagaagacatcacacacattcactgagaatcctaatcaatcttca

SEQ ID NO: 6004 - DNA, 109 bp, Homo sapiens
gtctgtcttgttccatgaaaggttttacacacacacacacacacacacacacacacacatattttatatatatacacatatataaaacctttcatggaacaagacagac

SEQ ID NO: 6005 - DNA, 76 bp, Homo sapiens
gtacacatatacatgtgtgtgtatatgtacatatatgtgtatatgtgtaaatatatacatatatgtgtatgtgtac

SEQ ID NO: 6006 - DNA, 98 bp, Homo sapiens
tatcatgggcatccactcaggtaagtgactgaggactttggatttgaattgattttaaaactaaatgtgtccaagtatatacatgatggatgtggata

SEQ ID NO: 6007 - DNA, 74 bp, Homo sapiens
ttgtgtatagatatatatatgtgtgtgtacatatatatatgtgtgtatatatatgtgtgtgtgtatatatataa

SEQ ID NO: 6008 - DNA, 80 bp, Homo sapiens
gtctcactctgtcactcaggctggagtgaactcggccaagattgcaccactgcactccagcctgggtgacagagtgacac

SEQ ID NO: 6009 - DNA, 86 bp, Homo sapiens
gtttctatttttcacatcctttcctgtggttggtattgactgtctttttcattttaaccattgtgatgggtgtgtaatggtatggc

SEQ ID NO: 6010 - DNA, 77 bp, Homo sapiens
tgtatatatgtatatgtatgtgtgtgtatatatatacacacacatagaatccctatatatatatacacatatacatg

SEQ ID NO: 6011 - DNA, 58 bp, Homo sapiens; identical to SEQ ID NO: 2442

SEQ ID NO: 6012 - DNA, 82 bp, Homo sapiens
ctcagttttttttttttaagttagagagtgcagttacaatatttaaataagaaactggcactgtctgtcttgacaagatgag

SEQ ID NO: 6013 - DNA, 96 bp, Homo sapiens
tcatagttctagcttcatcttaattaagtgggtttctacagtttttcttcttctaaaaggggaacgtgtgtgttagtccatttgcattgctgtgaa

SEQ ID NO: 6014 - DNA, 80 bp, Homo sapiens
gcatgttctgggccagtgagtgtagagaacagacagaagtcactgttcttctgtagtttacattttagtgaccaatgtgc

SEQ ID NO: 6015 - DNA, 71 bp, Homo sapiens
tacatatttatacatgtacaaatacatatgtatgtgtctatatatattatgtgtatatgtatatatatgtg

SEQ ID NO: 6016 - DNA, 67 bp, Homo sapiens
gataggaatgattagatgtttgtaggcttcatgagaagaggaaataaatatctattcagagcctaac

SEQ ID NO: 6017 - DNA, 85 bp, Homo sapiens
ccaacctaagatcatctctctctgtctctctcatcacattataagtttcatgtgggtagatccatgggcagtggattagagttgg

SEQ ID NO: 6018 - DNA, 81 bp, Homo sapiens
acctgattctcattttcttgttcactcataattctctttgaagtaaacaatgtatgaggacaggagatttgagttgaaggt

SEQ ID NO: 6019 - DNA, 89 bp, Homo sapiens
tagacctggatagcataagtccctgagttttatagaacttaaaaaaaattttttttttgagatgaagccttgctctgttgcccaggctg

SEQ ID NO: 6020 - DNA, 74 bp, Homo sapiens
gcacctttcacttggcaccactgtgatatcctcattagccgtggctcacagtgtctgtcagatggtgtccatgc

SEQ ID NO: 6021 - DNA, 116 bp, Homo sapiens
tctctgtgtaacgttttggtaattcttgcaatatttcacctttttcattatttttatatccataatggtgatctgcaatctgatctttgctattactgttgtaataattttggaga

SEQ ID NO: 6022 - DNA, 58 bp, Homo sapiens; identical to SEQ ID NO: 1215

SEQ ID NO: 6023 - DNA, 56 bp, Homo sapiens
ggattctttctctctgactctaaggcccatatccctgagagggagggaaagagacc

SEQ ID NO: 6024 - DNA, 89 bp, Homo sapiens
gggcgtccaccattactgaggcttgagtaggcagttttcccctcacattgtaaacaaagctgccaggaagttctaactgggtggagccc

SEQ ID NO: 6025 - DNA, 107 bp, Homo sapiens
gcactctacctgcttcttactggatgaggggcatcaaaattctttttattttctatcaagtgagtaaaatcctgtgagaggcattgcagtagaaggagtcagagtgc

SEQ ID NO: 6026 - DNA, 103 bp, Homo sapiens
tgcctggtagttggaagctcactcatttattttgcccacaaacagaaactgccttttgaaatgaaaagatgaatcctagttaaccgggtttccatcccaggca

SEQ ID NO: 6027 - DNA, 79 bp, Homo sapiens
gctcctgcttataagtgagaacatgtggtgtttagttttatttttagaaactgtctcattctgtcacctaggctggagt

SEQ ID NO: 6028 - DNA, 95 bp, Homo sapiens; identical to SEQ ID NO: 580

SEQ ID NO: 6029 - DNA, 93 bp, Homo sapiens; identical to SEQ ID NO: 69

SEQ ID NO: 6030 - DNA, 89 bp, Homo sapiens
ccaggggtcccattacacagaaaaaaaggtatggggatgggcccatgacgatgatgtcctctggttgtatcttgtattgtatcccctgg

SEQ ID NO: 6031 - DNA, 56 bp, Homo sapiens
accgaggggcatctggagggagggcagtgttctctggctccatgtgacccctcagt

SEQ ID NO: 6032 - DNA, 81 bp, Homo sapiens
tgatgagtctctgtcctttctcggtctctgttcctctgagggagacatgaaggaaaaggggagggtttctgtatctcttca

SEQ ID NO: 6033 - DNA, 116 bp, Homo sapiens
tgcctcatttttgtattcttggtgagtagcataaatacatacatagaacctggaagaaaatatatatatctatttggtagaaggcatgaaaaccgagaataagattataataggta

SEQ ID NO: 6034 - DNA, 87 bp, Homo sapiens
tttgtcctctacaatggaacaggcgtgagtgaccacactcagcccgagtgggttttttatgacatgttgaaatcagatggggatgaa

SEQ ID NO: 6035 - DNA, 115 bp, Homo sapiens
tcaatgtaagggaatagagattggcagaaaatgagaagggagaggcttttttttttttttttttttttttttttttttttttttgaggcagagtctcgctgtctcccaggctgga

SEQ ID NO: 6036 - DNA, 108 bp, Homo sapiens
tgtgaatggttccatgtatggtctgtaagtgtgtctaagttttgataaattttaactttttataatagagttgtatatattttacagtagtaagtgataaaattgaca

SEQ ID NO: 6037 - DNA, 64 bp, Homo sapiens
aagatatccatctcaaatggcttaaatctaaaggattttatttatttatttgagatggagtctt

SEQ ID NO: 6038 - DNA, 74 bp, Homo sapiens
ttttgtctggttttctagctctttgtagcaggagggcagttcttgtagcagaggggaagcaaaactccccaaaa

SEQ ID NO: 6039 - DNA, 96 bp, Homo sapiens
atgtgtgtatacatacgtgtatatgtgtgtatatatgtatatatgtatttatgtgtgtatatatatatttttttactgaaatcacactgcatttat

SEQ ID NO: 6040 - DNA, 93 bp, Homo sapiens
cctttaacatctctgagtttctttatttttaaaaagagtaagtccaggcaaagtggcttactcctgtaatctgaacactttgggatgccgagg

SEQ ID NO: 6041 - DNA, 109 bp, Homo sapiens
taagcattttttccttccatttttaggctactagcctgataaactatgtttaatgtattttactttaaaacttagttcatagggcctttggctggaaaaattaaactta

SEQ ID NO: 6042 - DNA, 106 bp, Homo sapiens
actagtgataccgagcttggctttcagtgtatttgattttgatttttttttttttttttttttgagacggagtctcactctatcacccagcctggagtgcagtggt

SEQ ID NO: 6043 - DNA, 119 bp, Homo sapiens
gggataaatgcacaggagtacagttgctaagttgtatggtagttgcatgtttagttttttttttttaactgacaaactattttctagagtggctagctgtacattcttacctttatttc

SEQ ID NO: 6044 - DNA, 79 bp, Homo sapiens
cagtttggcaagatgttaccattgggggaaactgggtaaagggtacacagtatctctcagtattatttttttataactg

SEQ ID NO: 6045 - DNA, 68 bp, Homo sapiens
ctgtggtcctagctactcgggaggctgaggtgggaggatgacttgatcctgggacgttgaggctgcag

SEQ ID NO: 6046 - DNA, 78 bp, Homo sapiens
ccaaacaagtgaagtatctctctctctctcagctgactgcttagagctgggggagggttgacacaagcactcctgtgg

SEQ ID NO: 6047 - DNA, 58 bp, Homo sapiens
tgagactgagtctcgctctgtcacccaggctggagtgcagttgcgcaatcttggctca

SEQ ID NO: 6048 - DNA, 91 bp, Homo sapiens
cgcctgccattaatctagagactagagacagaggagtaaacagaatagaaaagattctgcattcctgtagtttacattcttgtggggggag

SEQ ID NO: 6049 - DNA, 132 bp, Homo sapiens
cgtggaggaggtgccaggtgcagtggctcacacctataatcccactgctttgggaggctgaggtaggaggatcatttgagggcaggagttcaaggtttccgcaagctatgatcatgtctctgcactccagcc

SEQ ID NO: 6050 - DNA, 84 bp, Homo sapiens
gtagggtttctgctgagacacagacactgttagtctgatgggctcccgtttgtgaccaggcctttctgtctggcttcccttaac

SEQ ID NO: 6051 - DNA, 96 bp, Homo sapiens
ctgtgaatatcttcttgtccctgtgtctgtgactcagtatatatgtcaactctagattgtgtaaagaggtcaaagatttgccaaagatggtagcag

SEQ ID NO: 6052 - DNA, 101 bp, Homo sapiens
gtaaagagcatgttatttgtgtttattttttctctatttttctatgttaatcaaagataaggttttagcagggaatgaaaacaagtattatagttgtttgc

SEQ ID NO: 6053 - DNA, 206 bp, Homo sapiens
tgtattccatggtgtgtatatatatatgtctatctatttatctctatatatctatatctatatagatatatatatatatcaattatatatatatatatagatatagatatatagagatatatagacatagatatatagagatatatagatctatattagatctatagatctatagatctatatatatagatatatagatgtatata

SEQ ID NO: 6054 - DNA, 175 bp, Homo sapiens
tatatctatatatatagatctatagatctatagatctaatatagatctatatatctctatatatctatgtctatatatctctatatatctatatctatatatatatatataattgatatatatatatatctatatagatatagatatatagagataaatagatagacatatatat

SEQ ID NO: 6055 - DNA, 100 bp, Homo sapiens
ttcatagttaagaggtcttagatttcagtctttaattcatttttatttgatttttttatatgatgagagaggggtgtagtttcatacttctgcatatgga

SEQ ID NO: 6056 - DNA, 94 bp, Homo sapiens
tactgtgtgccagccacagaatggtgatattagagtataaagtaaaaaaaaatttttttttctaatctcaagccatttacagtctggggatgta

SEQ ID NO: 6057 - DNA, 115 bp, Homo sapiens
cccttgaagtagtctgggtaaggtattcttgcctttgtagggatgacttgccaggtcctgtgtggctctgtctccctggttgtgcaggggagcctttgccttctgctgcagaggg

SEQ ID NO: 6058 - DNA, 111 bp, Homo sapiens
tgcttaggattgtcttggctatactggctctttttttggttccatatgaaatttaaagtagttttttctaattctgtgaagaaagtcaatggtagcttgatggggttagca

SEQ ID NO: 6059 - DNA, 99 bp, Homo sapiens
tcaggtaaaaactttatagttatatatatttattattattattttaaattttaatttttttggatacatagtaagtatatatatttgtagggtacatga

SEQ ID NO: 6060 - DNA, 93 bp, Homo sapiens
tgtctgtttgtgtgtgtgcgtgtgtgtgtgtgtgtttttttttttttttagaaggagtctcactctgtcaccaggctggagtgcagtggggca

SEQ ID NO: 6061 - DNA, 108 bp, Homo sapiens
gatagccagttgatagattatagcggcatacatatctctgcacattggaatgagatttgcacttttaggtttgtttgctaacatgcatatctgtctttcctgtatgtt

SEQ ID NO: 6062 - DNA, 95 bp, Homo sapiens; identical to SEQ ID NO: 68

SEQ ID NO: 6063 - DNA, 93 bp, Homo sapiens; identical to SEQ ID NO: 69

SEQ ID NO: 6064 - DNA, 81 bp, Homo sapiens
gtccttggtagagtcctcagagctgacagaagagagaggcgactctcactcctaccaccctgcatctctgtctctctagac

SEQ ID NO: 6065 - DNA, 92 bp, Homo sapiens
tgttcaatgcacgagatataaatgcctctgtgagtgtatgtgtgtgcatctctgtgtgtgtacatatgcatgcgtgtgtgtgtgcgtgtgca

SEQ ID NO: 6066 - DNA, 116 bp, Homo sapiens
tgaatgtttcttgaagaaggcattgtaactttaaccaagcagcccgtattctatatctatggttttctaggttattgtccaaggtgcaggccagataacttttaagaaagtcattt

SEQ ID NO: 6067 - DNA, 58 bp, Homo sapiens; identical to SEQ ID NO: 1673

SEQ ID NO: 6068 - DNA, 75 bp, Homo sapiens
tgtgcatacatatatatacatgcatatatatacacatgtatatatgtgtgtatatatatatgtgtgtgtatatat

SEQ ID NO: 6069 - DNA, 95 bp, Homo sapiens; identical to SEQ ID NO: 68

SEQ ID NO: 6070 - DNA, 93 bp, Homo sapiens; identical to SEQ ID NO: 69

SEQ ID NO: 6071 - DNA, 120 bp, Homo sapiens
cctccaattctgttgcatctcttgctcacttattttatatatatatatataatatatatatatattatacatatatatattatactttaagttctagggtacatgtgcacaatgtgcagg

SEQ ID NO: 6072 - DNA, 62 bp, Homo sapiens
gctctgagttttatagaagcaacatttttttttaattgagtgctttgaagagacttaagagc

SEQ ID NO: 6073 - DNA, 115 bp, Homo sapiens
tttaaaaagacatggcacataattgggtgatttcattttactggatttgttttgaaaagtggtatcagtagctacacttagatcatggcttgttgtgtaaacatgtacagttgaa

SEQ ID NO: 6074 - DNA, 107 bp, Homo sapiens
ggatttagtgagttttattttgaagagagtatatttcaatttttgtagtatttacactgacaattatatatgctttttaaaaagtatctactcatttaagaaaattt

SEQ ID NO: 6075 - DNA, 77 bp, Homo sapiens
tcttgtgcgcaagtcactgccagtctgtctgcatgaaacaccatgatggggggtggggatgtctagtcagtgtaaga

SEQ ID NO: 6076 - DNA, 106 bp, Homo sapiens
gaggttgtaacgttgtctatatataccctgtagaaccgaatttgtgtggtatccgtatagtcacagattcgattctaggggaatatatggtcgatgcaaaaacttc

SEQ ID NO: 6077 - DNA, 101 bp, Homo sapiens
atagaatatatgtgtatatatatgtatatatgtgtatatatgtacatgtgtacatatatacgtgtatatattatatatgtgtgtatgtgtgtgtgtatata

SEQ ID NO: 6078 - DNA, 89 bp, Homo sapiens
tctcatactagcatttggtggctgtttggagaatataaaataattttaatattaaaataaatatttagaaacggtgctaatgtgtgaga

SEQ ID NO: 6079 - DNA, 93 bp, Homo sapiens
gggctgactctgcctgtcattctcactggctctaattaaaagacgcctaagtcagaggtctgaggcagggatgacaataggacagcagtcccc

SEQ ID NO: 6080 - DNA, 71 bp, Homo sapiens
tgccttcccagttctcagtcatattggctgctgacatctctcagtgtcggttgattgtcagtggcaaagca

SEQ ID NO: 6081 - DNA, 117 bp, Homo sapiens
tctctctgttagtctctctctctaactctctgtatccttaaaccacacacacacacacacacacacacacacacacacacacacacacagagagagagagagagagagagagagaga

SEQ ID NO: 6082 - DNA, 79 bp, Homo sapiens
tctctctctgtctctctctctgtgtccagggctccaagatgtcctggggtgcttacagactctaagaggctttcaggga

SEQ ID NO: 6083 - DNA, 119 bp, Homo sapiens
tgcttaggattgtcttggctatatgggctcgtttttggttccatatgaaatttaaagtagtttttttctaattctgtgaagtaagtcaatggtagcttaatggggatagcattgaatct

SEQ ID NO: 6084 - DNA, 88 bp, Homo sapiens
taaaatttagaaaccacacattttatttttgtaaaaaataattcaaagcctgatttttttttcagttaaaatgtgtgtccaagtttta

SEQ ID NO: 6085 - DNA, 61 bp, Homo sapiens
ccaagagcaagtcctacagggttgaggggaatctcctctgggttctggggctggttagggg

SEQ ID NO: 6086 - DNA, 114 bp, Homo sapiens
gaatagctaagtcagacccagtgactttctttgtgaccttttggaaatatcaaattttatttttgtatttaggggggtttatagtgccattcctggatctgtgcttttgtgttt

SEQ ID NO: 6087 - DNA, 77 bp, Homo sapiens
tataaaattatatatgatatatatattattactgtcattagacagtataaatatatgtgtgtgtgtgtatatatata

SEQ ID NO: 6088 - DNA, 58 bp, Homo sapiens; identical to SEQ ID NO: 605

SEQ ID NO: 6089 - DNA, 58 bp, Homo sapiens
tgagctggagtctcactctgtcacccgggctggagtgcagtggcgggatctcagctca

SEQ ID NO: 6090 - DNA, 150 bp, Homo sapiens
atatatacacatatatacatatatacatatatatacacatatatacatatatatgtatatatacgtatatatacatatatacgtatatatatacacgtatatatatatgtgtgtgtgtgtgtgtatatatatatatatatatgtatgtat

SEQ ID NO: 6091 - DNA, 111 bp, Homo sapiens
gtatatatttgcttatatatatatacacatatgagtatatttatacagaatatatattatagtatatataatatgatagtatttaggatgtatatatttgcttatatatac

SEQ ID NO: 6092 - DNA, 106 bp, Homo sapiens
gggaatattatgtcaacagagtgatataaaactacttaaattatttattacttaattatatgtatgttatgccagtactttatattcactttgtataattgtttcc

SEQ ID NO: 6093 - DNA, 96 bp, Homo sapiens
gtcttaagtaagtcaaaattatctccaaataaaaagttttcttttttaaaaaagcctttaaggtttggggattttgtttgtttttaaagtgtaggc

SEQ ID NO: 6094 - DNA, 99 bp, Homo sapiens
atttcctagattaggaaattgttaagtaagatgggagtataatttttttaaatctttgtttttactttttggcttttaattcttaatctttaaggaaat

SEQ ID NO: 6095 - DNA, 110 bp, Homo sapiens
ctcaatggttatgttgatttatttattttgagacacggtctcactctgtcatccaagctatagtgcagtggtgtgatcatggatcactgcagccttgacctcctgggatc

SEQ ID NO: 6096 - DNA, 128 bp, Homo sapiens
tgttgctgtagatggactggcatccatttgtctgggctatttatttatttattgttggggaggataacagatgtgggctcatctctgcctcacacagactgattttcaattcccgttcgtgatataaa

SEQ ID NO: 6097 - DNA, 171 bp, Homo sapiens
ataccatatatatatgtgtatatatatacacacacatatatatgtatatatatacacacacatatatgtatatatatacacacatatatatgtgtgtgtatatatatatacatgtatatatatatatatacatgtgtatatatatatatatatatatatatatatatatat

SEQ ID NO: 6098 - DNA, 118 bp, Homo sapiens
tatatatacatgtatatatatatacacacacatatatatgtgtgtatatatatacatatatgtgtgtgtatatatatacatatatatgtgtgtgtatatatatacacatatatatatg

SEQ ID NO: 6099 - DNA, 83 bp, Homo sapiens
gactgagtctcactctgtcacctaggctggaatgcaacgacatgattgtagctcaatacagcctcgacatcttgggcttaagc

SEQ ID NO: 6100 - DNA, 110 bp, Homo sapiens
ttcatttttattgccaaataatatttcattgtatagatgtcttatttatttgttcatcagttgattgacatttgagttgcttccaggatattatgaataatagctgtgaa

SEQ ID NO: 6101 - DNA, 115 bp, Homo sapiens
atagtagtacaagaaaccctcatgtttatgggtcatctgttcttaggttttgtagctttatcagtcatctgctccatgggaacagggtatccatgtgtgtttctgaagacattgt

SEQ ID NO: 6102 - DNA, 290 bp, Homo sapiens
acaagtcctgcatatatatatatatatatatatatatatatatatatatatatatatgtgtgtgtgtgtgtgtgtgtgtgtgtgtgtgtttgtgtgtgtgtgtgtgtatatctatatgtgtgtatatatatctatatatgtatatatatctatatatgtgtatagatatatatgtatatatgtgcatatatgtatatatatgtgtgtatatatatctatatatgtgtatatatatctatatatgtatatagatatctatatatgtgtatagatatatatgtatatatgtg

SEQ ID NO: 6103 - DNA, 95 bp, Homo sapiens; identical to SEQ ID NO: 68

SEQ ID NO: 6104 - DNA, 93 bp, Homo sapiens; identical to SEQ ID NO: 69

SEQ ID NO: 6105 - DNA, 115 bp, Homo sapiens
ccagctttgttcttttttcttaggattgtcttggctatacaggttcttttttggttccatatgaaatttaaagtagtttttttctaattctgtgaagaaagttaatggtagcttg

SEQ ID NO: 6106 - DNA, 62 bp, Homo sapiens
tgagatggagtctcactcactctgtcacccaggctggagtacagtgttgtgatctcggctca

SEQ ID NO: 6107 - DNA, 133 bp, Homo sapiens
tgtgtatatatatatatatacacacacacatagatatgtgtatatatatatatacacacacacatatatgtgtatatatatgtatacacacacatatatgtgtgtacatatatgtatacacacatatgtgtgt

SEQ ID NO: 6108 - DNA, 71 bp, Homo sapiens
tttgtttgagacggagtctcgctctgtcgctcaggctggagtgcagtggcgtgatctcggctcactgcaag

SEQ ID NO: 6109 - DNA, 101 bp, Homo sapiens
aacactaaggactcagacaagagtgagataaaagctgcagggctcacgggtagaaaagaaagcttttatttatttattttttcaagtatgtatcaagtgtt

SEQ ID NO: 6110 - DNA, 63 bp, Homo sapiens
gtgtgtgtgtgtgtgtgtgtgttttttttttttgaaacattgtctcacacttgtcacacaggc

SEQ ID NO: 6111 - DNA, 117 bp, Homo sapiens
atagcaaggattctgtcatactaaggaggagaaagttgccgtacattttcagtttaaactattatttttatttatttacttatttttttttttttttgagacagagtctcactctgt

SEQ ID NO: 6112 - DNA, 88 bp, Homo sapiens
ccaggagtagtggtgcatgcctgtagtcctagttattcgggaggctgaggtaaaaggatcatttgagcctgggaggtcgagactgcag

SEQ ID NO: 6113 - DNA, 77 bp, Homo sapiens
gggtagttgagagaagagactgaaagagcactgccttcagcccagtgaccattctttgagctgttttctctttcccc

SEQ ID NO: 6114 - DNA, 100 bp, Homo sapiens
gtatatatatgtaggtatacatgtttatatatatatatacacagattatatatatatagtatgtgtgtatgacatatatcatatgtgtgtatgtgcgtgt

SEQ ID NO: 6115 - DNA, 106 bp, Homo sapiens
tcactcctttcgccctcctgctaggaacctgagacagtctctctcttgccagtaaaacagtgaagctgaagcagtgtccttcttagagcagcctggaaggtcttga

SEQ ID NO: 6116 - DNA, 102 bp, Homo sapiens
acatgtttgtggtcttatcctcacgtgtctctttcatatatatatatatatatatatatatgaccatgtatatgtggtttttaatgccttcaaatgaaatgt

SEQ ID NO: 6117 - DNA, 76 bp, Homo sapiens
gattctgagcctcacaaatgaaatctccactgtcctcagtactgagattgttcatctgtatgacggccactgagtc

SEQ ID NO: 6118 - DNA, 80 bp, Homo sapiens
tatttttcaatgctcagttcacacatctttctctggctctctcccagacagagaatgatgagtacgtgggcctgttaata

SEQ ID NO: 6119 - DNA, 56 bp, Homo sapiens
tgagggtttggaagaaggtactgagcatgctcagatctgtctctatgaggccctca

SEQ ID NO: 6120 - DNA, 73 bp, Homo sapiens
ttgtatgaagagagcaaatgtctattttttatgttattaaatataaaggttgatgctatggctctcttttcaa

SEQ ID NO: 6121 - DNA, 58 bp, Homo sapiens; identical to SEQ ID NO: 637

SEQ ID NO: 6122 - DNA, 64 bp, Homo sapiens
ctggcagtcactcccagagcccctggaactctggcccaaggctctctgactgactccttcccag

SEQ ID NO: 6123 - DNA, 95 bp, Homo sapiens; identical to SEQ ID NO: 68

SEQ ID NO: 6124 - DNA, 93 bp, Homo sapiens; identical to SEQ ID NO: 69

SEQ ID NO: 6125 - DNA, 99 bp, Homo sapiens
catgtggtttttgtttttggttctgtttatatgctggattacgtttattgatttgcgaatgttgaaccagccttgaatcccagggatgaagcccacttg

SEQ ID NO: 6126 - DNA, 104 bp, Homo sapiens
aagtacctttaacgttgtggtatagtgtgatgagtctgtgcactctggagccagaggtctcagctctaccacttactcactgtaacaccttgggcaagccactt

SEQ ID NO: 6127 - DNA, 85 bp, Homo sapiens
agggtaacgtgctgatgttgttacaaggcttagagggagacacatctcagatgagtgtgagcacccatcatcatgcttataaact

SEQ ID NO: 6128 - DNA, 74 bp, Homo sapiens
gtcttctctctgtatgtgtctgtgtccagatttcctctccttataaggataccagtcatatatttagattgggc

SEQ ID NO: 6129 - DNA, 119 bp, Homo sapiens
gtagtattccatcatacgtgtatatatatatatgtgtgtatatacgtatatatgtatatatatgtgtatatatgtatatgtgtgtgtatatatacacatatatatatcacatatataca

SEQ ID NO: 6130 - DNA, 92 bp, Homo sapiens
tgtgatgtatatatgtgatatatatatgtgtatatatacacacacatatacatatatacacatatatatacatatatacgtatatacacaca

SEQ ID NO: 6131 - DNA, 109 bp, Homo sapiens
gtgggtcattttccttccttttttgtgtgtgccttgttattttttattgaatgttagacatcttgtttaggacagtaaagactgaggtgtaggtagtatttgtgcctgc

SEQ ID NO: 6132 - DNA, 60 bp, Homo sapiens
tcagaagagagtcaggagtcaggtcatggaagaccatgtaggcaatggcttccattctga

SEQ ID NO: 6133 - DNA, 112 bp, Homo sapiens
atatactatattgtatatgctatattatatattgtatataacatactatattgtacatgctatattatatattatatataatatactatattgtatatgctatattatatat

SEQ ID NO: 6134 - DNA, 105 bp, Homo sapiens
gcattgaatagaacgtgtattctgtggttgttggatgaaatgttctgtatatatctgttaagtccatttgttccaaggtatagtttaaatccgttgtttctttgt

SEQ ID NO: 6135 - DNA, 83 bp, Homo sapiens
cttcctggcttcagatgagactcagcacattcccagctgtgttggctacagattgagactccatctgtttgagaaaagtgaag

SEQ ID NO: 6136 - DNA, 92 bp, Homo sapiens
ggtatagtcatgcatcacttactcatagggatacattctgagaaatttgtagttagcctttttgtagttgtgtaaatgtcatagactgtact

SEQ ID NO: 6137 - DNA, 58 bp, Homo sapiens
tgagccagagtctcgctctgtcacccaggctggagcgcagtggtacaatttcggctca

SEQ ID NO: 6138 - DNA, 111 bp, Homo sapiens
aacaacagtgtgtaagcattcctttttctccacagcctcatcagtatctgttttttttgttttttaataatagacattctgactggcgtgaaatggtatctcattgtggtt

SEQ ID NO: 6139 - DNA, 95 bp, Homo sapiens; identical to SEQ ID NO: 68

SEQ ID NO: 6140 - DNA, 93 bp, Homo sapiens; identical to SEQ ID NO: 69

SEQ ID NO: 6141 - DNA, 66 bp, Homo sapiens
atgtgtatgtacatgtgtatatgtgtatatatacatatatacatatatacgtatgtacatacacat

SEQ ID NO: 6142 - DNA, 110 bp, Homo sapiens
gtatgtgtgtgtgtacgtatgtgtgtatatacgtatgtgtgtgtatacgtatgtgtgtgtatacgtatgtgtgtatatacgtatatgtgtgtgtatgcgtatgtgtgtac

SEQ ID NO: 6143 - DNA, 126 bp, Homo sapiens
gaatgcatgggtgtgggtgtgtgtatatacacatacatagatatgtatacatatatataaatacacccatatgtatacatacatatacatggatatattaatatatatatacatatctatgtatgt

SEQ ID NO: 6144 - DNA, 141 bp, Homo sapiens
atatgtatgtatatatctatgtatatgcataagggtatatatctacatacatagatatgtatatatatattaatatatccatgtatatgtatgtatacatatgggtgtatttatatatatgtatacatatctatgtatgtg

SEQ ID NO: 6145 - DNA, 112 bp, Homo sapiens
acacatatgtatacatatatgtatatacgtatatgcatatgtgtatacatatatgtatatatgtgtatatgtatatgcatatgcatatacatatatgtatacgcatatgtgt

SEQ ID NO: 6146 - DNA, 81 bp, Homo sapiens
atatatgtatacatatgtgtatatacatatatgtatacatatatgtatatacacatatgtatacatatatgtatatataca

SEQ ID NO: 6147 - DNA, 61 bp, Homo sapiens
gttgcagaatccttaacaataagatgtttcattatatatttgtggtttgggattcttcagc

SEQ ID NO: 6148 - DNA, 58 bp, Homo sapiens
tgagacagagtctcgctctgtcgctcaggctggagtgtagtggtgtgatctgggctca

SEQ ID NO: 6149 - DNA, 101 bp, Homo sapiens
tatataaacctatacatgtaccctatgaatctaaaatatgtatatatacttaaaaacatgtatatgacatatatacatatatagcatgtatatgttatata

SEQ ID NO: 6150 - DNA, 93 bp, Homo sapiens
tgctgagggaagaggagtaagcgttttgggctgggtgaagcaagaatgagattttgaagttcactaagcaaattctgaaaatatctcaaagca

SEQ ID NO: 6151 - DNA, 102 bp, Homo sapiens
attttatttgatgcattcctgtttactctcccataaatatagaattattgtagttcatttggagagcgagtatatggaggaattactggcctaagataaagt

SEQ ID NO: 6152 - DNA, 92 bp, Homo sapiens
tctgagttctagtgttacaatggtaaatcagaaaggcaaataaacattttttatttgaaaagatctactaattgcctagcatgtgacttaga

SEQ ID NO: 6153 - DNA, 84 bp, Homo sapiens
acctactacatgtctggtttaaggaagaagtgagcaccaggatgcctggggatttaggactagcaccaggcttgctggctgggt

SEQ ID NO: 6154 - DNA, 64 bp, Homo sapiens
tgtatatgtatatacacacatgcaaggaaatttattattttatgtgtctttgtatacatatgca

SEQ ID NO: 6155 - DNA, 96 bp, Homo sapiens
gcggaactgtgagtcaattaaacctcttttctttataaattgcccagtctcaggtagttctttatagtggtgtgacagtggactaatacagttggc

SEQ ID NO: 6156 - DNA, 81 bp, Homo sapiens
caaagctcttgcatgctttgttgttgttttatttgtggctttatagagttgtatcaagaaacagagcactatcagtctttg

SEQ ID NO: 6157 - DNA, 67 bp, Homo sapiens
agctggcagatgaggctttttttttttttttttttttgagacagagtctcgctctgtcccccaggct

SEQ ID NO: 6158 - DNA, 130 bp, Homo sapiens
aatatcctagcaggttgttactcctaatgtcacagggggtgtacactctgtaatattatttataatattttagaggattgttactcctaatgtcacagggtgtgtacaccccgcgatattattcgtaata

SEQ ID NO: 6159 - DNA, 115 bp, Homo sapiens
tctggtcagaaacattgccttttacttttaaagcaagcattccttaagaaacatctttctaaatttatatttttaattgtgtttgagttagtcttaggcaataaaagtgaataga

SEQ ID NO: 6160 - DNA, 84 bp, Homo sapiens
gagaaacctgtgcatttgaaaatgtgcatgttgaagctgtgaaatttagttattaattgattattttttatgagacaggctctc

SEQ ID NO: 6161 - DNA, 92 bp, Homo sapiens
aatggggttgatttttgcttattaatttgtttaagctccatatagattctggatattgttggatgaatagtttgcaaatattttctcccatt

SEQ ID NO: 6162 - DNA, 124 bp, Homo sapiens
gtttttaggatgattctgaaatatatgattccatttgctattgacaaagtacatttccagtttagtcaatttgttgaacttcaaatcgtagatgtcagggaatgcatcaaaacgtattacagaa

SEQ ID NO: 6163 - DNA, 111 bp, Homo sapiens
ccattattttagtctatgcatgtgtaggcctataacagagatcaagaaactaatgtacatatataaaagttttattaactgtctaggcctatatttttgcctgatatgtgg

SEQ ID NO: 6164 - DNA, 85 bp, Homo sapiens
tctttctttttctatatatatatatgtctatcttatatatgtaaatacacatacataaatataaatatatatagagagagagaga

SEQ ID NO: 6165 - DNA, 83 bp, Homo sapiens
ggaggaggttatgattcatgagccaaaagagaagaaattcacacttctctttcacactcacagtcagtaccgtaatcttctcc

SEQ ID NO: 6166 - DNA, 101 bp, Homo sapiens
gtagttttatagtttgaggtcttagacttaagtctttattccattttgatttgttttttttatatggtgagagatagtggtctaatttcattcttctctat

SEQ ID NO: 6167 - DNA, 89 bp, Homo sapiens
ttttgtctgagcaaagggtaaatgggccacacctttctctgtcagcctcagaggaacccagtccaaataccacagctcatataacagga

SEQ ID NO: 6168 - DNA, 125 bp, Homo sapiens
atatacatgtatatgttataatatatacatataatatacatgtgtatatatactatacatgtatatataacatgtatatatatacatgtatatatattatgtatacatgtatagtatatatacat

SEQ ID NO: 6169 - DNA, 58 bp, Homo sapiens; identical to SEQ ID NO: 1409

SEQ ID NO: 6170 - DNA, 119 bp, Homo sapiens
gcttccaggtacatggtgaaagtgccttatacaggttgaataaaaatcactgccattttcagaatattgatggcactgaaaagaaaacacagggtatttgaactctggaaagtttggga

SEQ ID NO: 6171 - DNA, 67 bp, Homo sapiens
gcatagcaattgaggagggcattggaagaggagctgggctgtccatgacttctcatattgctcttgt

SEQ ID NO: 6172 - DNA, 79 bp, Homo sapiens
aaatggagccaaatcagcatagatggtatctgcactgtctctgtatgactgccatcatgcgtgtttctttgctctgttt

SEQ ID NO: 6173 - DNA, 131 bp, Homo sapiens
gcaccccacaccgttgatttcagtgagctttctttctttttttttttttttttgagacagagtctcactctgtcacccaggctgaagtgcagtggtgtgatctcggctcactgcaagctccgcctcccggg

SEQ ID NO: 6174 - DNA, 95 bp, Homo sapiens; identical to SEQ ID NO: 68

SEQ ID NO: 6175 - DNA, 93 bp, Homo sapiens; identical to SEQ ID NO: 69

SEQ ID NO: 6176 - DNA, 74 bp, Homo sapiens
ttgccccttcctggagtgagggtggcacgcctcggcaaatggccactgtgcctcactctcactcaagtaagcag

SEQ ID NO: 6177 - DNA, 79 bp, Homo sapiens
tgagatggagtctcgctctgtctcccaggctggagtgcagtggcaggatctcggttcactgcaacctccacttcccggg

SEQ ID NO: 6178 - DNA, 120 bp, Homo sapiens
gtatttgattgtgtatatatatatatatattcaatatatatattgtgtatgtatatacacaatagtatatgattgtatacatcaaatacaaatagtatttgattgtatatatgtatatat

SEQ ID NO: 6179 - DNA, 115 bp, Homo sapiens
agacagtaacaggctatctgtacttctgatattactgttttcttgaaaaatatacatagaagaaagtaagattttgtataacaagtggtagagatgcccccaaataatactttct

SEQ ID NO: 6180 - DNA, 98 bp, Homo sapiens
gtttacagaaagagagctgaaacagaagacagagtgctgccttgttcaacctcagctgggactcaaatttttctccactctgcgcattgtctgtaaat

SEQ ID NO: 6181 - DNA, 116 bp, Homo sapiens
agcagttgtttgaatctttagcaccttaatttttgtttcattcaagtgattttcctgaagtcattgaagaatctaccttgacaccaattttaactagagaaattcaattatttgct

SEQ ID NO: 6182 - DNA, 81 bp, Homo sapiens
cagaggctctgtcagtgagtgctttagcctaattacatttgatgcagcaaatcaacaaaaccactgctggtatgacctctg

SEQ ID NO: 6183 - DNA, 93 bp, Homo sapiens
gcaaataacacctaaatatagaggaaactcaaatctgattttgaacttatcaacagttgggaaggaagattctctgtgtttgagcatttttgt

SEQ ID NO: 6184 - DNA, 111 bp, Homo sapiens
tgactggctgatatgacaccagtgtcaattcttttctaacagtagtcaattttttcataaatacaagttatacgtttttaaagatgaatactggtgagcatctgcctttca

SEQ ID NO: 6185 - DNA, 91 bp, Homo sapiens
accataagcaaggtcactgattaggtcagaagctgtctatcattttttattatctgtagagatagagtctcactatgttgcctaggctggt

SEQ ID NO: 6186 - DNA, 109 bp, Homo sapiens
gtgtcagagtcacagagtcactgcctggtagagatgcttgcaggttttttttttaatgtaatttaagtatttccacccccacgaggagattttaatgtagttatgatac

SEQ ID NO: 6187 - DNA, 95 bp, Homo sapiens; identical to SEQ ID NO: 580

SEQ ID NO: 6188 - DNA, 93 bp, Homo sapiens; identical to SEQ ID NO: 69

SEQ ID NO: 6189 - DNA, 65 bp, Homo sapiens
gtgtgtgtgtgtgtgtgtgtgtatatatatatatttatatatatgcacatacagccacatgccac

SEQ ID NO: 6190 - DNA, 114 bp, Homo sapiens
gcatgtgtgtatatatgtatgtgtatatatatgtatgtatatatgtgtgtatatatgtgtgtgtatatatatgtgtatgtgtatgtgtgtgtgtatatacatatatgtgtgtac

SEQ ID NO: 6191 - DNA, 112 bp, Homo sapiens
gcatatccctccagtagcgaggtgaagattaatttgtatatctatctatatctatatagatatagatacgtacacacagacacactctcagtatggtgactggcacaaatgc

SEQ ID NO: 6192 - DNA, 59 bp, Homo sapiens
ggtgaaaaatgggggagaggcatggagcacaactctctcagcacctccatgtgttcacc

SEQ ID NO: 6193 - DNA, 71 bp, Homo sapiens
ggtgggtatgtggaggctgggaattgtgaagcctctagggaggctctctctctctctcgacatcatttact

SEQ ID NO: 6194 - DNA, 95 bp, Homo sapiens; identical to SEQ ID NO: 68

SEQ ID NO: 6195 - DNA, 93 bp, Homo sapiens; identical to SEQ ID NO: 69

SEQ ID NO: 6196 - DNA, 96 bp, Homo sapiens
aggctctttttttggttccatatcaagtttaaagtagtttttttctaattctatgaagaaagtcaatgggatcttgatgggaatagcattgaatct

SEQ ID NO: 6197 - DNA, 90 bp, Homo sapiens
agatatgtacatcatggttactttttgtcctttcaaatggactttttatttctatttatggagagactgtaactactgcttttaatgtct

SEQ ID NO: 6198 - DNA, 109 bp, Homo sapiens
gggttcatcttagttaataagtgggtatttattttggtctctcagaacatgaacggtttactgtactgtttttgttggatttgaaattgacttgttttctacataattc

SEQ ID NO: 6199 - DNA, 95 bp, Homo sapiens; identical to SEQ ID NO: 68

SEQ ID NO: 6200 - DNA, 93 bp, Homo sapiens; identical to SEQ ID NO: 69

SEQ ID NO: 6201 - DNA, 85 bp, Homo sapiens
ctctgacttatttctctcagtatctgactatttcctctttattgacagggcaggaaggctggacaggatgctgtaattgttgggg

SEQ ID NO: 6202 - DNA, 78 bp, Homo sapiens
ctactttagtgttttagttgatgccctgctatttcagggtggccctatcagtgtgacatttatgaagcactctagtag

SEQ ID NO: 6203 - DNA, 104 bp, Homo sapiens
ttgctaggaatttttctttgcttggtatttcacagattttgatgttttgttatagcattatctgtggaaaacagatagaaaaataaggtaatttcataagttcc

SEQ ID NO: 6204 - DNA, 95 bp, Homo sapiens; identical to SEQ ID NO: 68

SEQ ID NO: 6205 - DNA, 93 bp, Homo sapiens; identical to SEQ ID NO: 69

SEQ ID NO: 6206 - DNA, 81 bp, Homo sapiens
gatctgtgtccctgtgtgccttttttcctgttacgttcagttcagctgtttccatgcaggctcagaggttcagggcagatt

SEQ ID NO: 6207 - DNA, 110 bp, Homo sapiens
gcacatgtggctgctaagcacttcaactgtggattagtgatattgtagaactgatttttttattttatctcaatttaaaattaaatagtgatacatagctaatggatagc

SEQ ID NO: 6208 - DNA, 193 bp, Homo sapiens
gtatatatatatgtatatatatatgtgtatatatatatgtatatatatatgtatatatatatgtatatatatgtatatatatatgtatatatatatgtatatatatatgtatatatatgtatatatatgtatatatatgtatatatatgtatatatatatatgtatatatatgtatatatatatatatatata

SEQ ID NO: 6209 - DNA, 57 bp, Homo sapiens
gctgggacactctctctctgatgtgggcatgcaggggtccactgaggcgattccagc

SEQ ID NO: 6210 - DNA, 88 bp, Homo sapiens
ggagggaaagagatgaatgtgagcagacaggacaattcagtatttgtgggtataatattttctgagcatcacgggtttttttttttct

SEQ ID NO: 6211 - DNA, 87 bp, Homo sapiens
agcacgccacagcttagaaatttggttctactaatagcacacatgtaaatggcagagaatgaaactttcaagtaattggcacaggct

SEQ ID NO: 6212 - DNA, 115 bp, Homo sapiens
tggatttaatactttatgtggttgccaagtttgcaggttagttttatcattatttatatatcaatgaaagagactgatttgccttccagattaaacgtaagatgtatgactcaca

SEQ ID NO: 6213 - DNA, 75 bp, Homo sapiens
gccctcagtctctttttctgtcttatgcccctcagtcgaattctttcctgaggaggcaggaattgaggttgctgc

SEQ ID NO: 6214 - DNA, 130 bp, Homo sapiens
atgcatactatatactatatataaatatgtagtatactatacattttatattatatattatatattatacattattatatactatatatattatatatgtgtatattatatgtgtatatgtatacacata

SEQ ID NO: 6215 - DNA, 170 bp, Homo sapiens
atatatatgtatatatatgtgtatatatgtatatatgtgtatatatatgtgtgtatatatgtatatgtgtatacatatgtatatatatgtgtatatatgtatatatgtgtatatatgtatgtatatatatgtgtatatatatacgtatatatatatacgtatatatatat

SEQ ID NO: 6216 - DNA, 78 bp, Homo sapiens
ccatcaggaattgctatgacagagagagataaataaccagatagaactttctctctctctcatatactgtttctgagg

SEQ ID NO: 6217 - DNA, 109 bp, Homo sapiens
atgatagaaggccaattccataagacacagcattagaagatatctcaactatttgttattagctttatatctttatttgcttgagtggtttatttaggccccaaattat

SEQ ID NO: 6218 - DNA, 115 bp, Homo sapiens
gctttatttttgggttttctattctgtttcattgatctgtgtgtctgtttctctgccaatatcatgctgtttcgattactatagctatatagttagccctagttttgagtaaagt

SEQ ID NO: 6219 - DNA, 66 bp, Homo sapiens
atttataatgtatatatttataaatatgtagacttatgtgtatatatagatatgtgtattataaat

SEQ ID NO: 6220 - DNA, 74 bp, Homo sapiens
gtatatattctacatgtatacacatgtatatgtatacatatatacatactatatgtgtatatatgtatatatac

SEQ ID NO: 6221 - DNA, 95 bp, Homo sapiens
tactattcagactcagtcatccgataattgcatagtctatgttaatatatctttatttgactgtgcatttcaacatggccagtgcctgacaagtg

SEQ ID NO: 6222 - DNA, 116 bp, Homo sapiens
gaattttattatatatcttaaccatcccaaattcatgatagaataaagtaaaatataaatatttaattatgtctattttgaggttataaggatggatactaaatgataaatatttc

SEQ ID NO: 6223 - DNA, 146 bp, Homo sapiens
gtgtatgtatgtgtatatatatactatgtgatatatatgtgtgtgtatatatatacatacacatatgtatatgtgtatgtatgtgtatatatatactatgtaatatatgtgtgtgtgtgtgtgtgtgtgtgtgtatttatgtatac

SEQ ID NO: 6224 - DNA, 76 bp, Homo sapiens
atatatgtgtatgtgtatatatatatactatgtgatatatacacatatgtatatgtgtgtatatatatgtatatat

SEQ ID NO: 6225 - DNA, 57 bp, Homo sapiens
gacggagtctcactctgtcacccaggctggagtgcgtgcggtagagcgatctcggtt

SEQ ID NO: 6226 - DNA, 108 bp, Homo sapiens
tttctatttgtattctgctgtggtgtgagaagatacttgatagaatttcaatttttgaaaatttattgagacttgttttgttgtctatcatatggtctgtcttggaaa

SEQ ID NO: 6227 - DNA, 114 bp, Homo sapiens
tgtgtctgcatatatgtatacactggatcatatgtgtgtatatatatacatgtatatatacatgtatgtgtatgtgtgtatatatatgtatatgtatatatatatgtacacaca

SEQ ID NO: 6228 - DNA, 113 bp, Homo sapiens
gagaaagagagtgactggttgtgcaaggtcccagatgagacatgagattgtggcttccattatgtctgtctctgtctctctatcactttatagaggcagttaagaagcaattc

SEQ ID NO: 6229 - DNA, 106 bp, Homo sapiens
tcacatgccagacttgtaaaatgacatctttttatttctttctaaattataaattttctatatccctggaaatattttgatagtatatcataagtctgagtctgga

SEQ ID NO: 6230 - DNA, 70 bp, Homo sapiens
gtgagtcagtagagtgagtggtgagtgaatgcgaaggcctaggacattactgtacattctgtggactttc

SEQ ID NO: 6231 - DNA, 66 bp, Homo sapiens
cacatgtgtgtatatatgtatgtacatatatatgtatgcgtgtatatatgtatgtacacatatgtg

SEQ ID NO: 6232 - DNA, 76 bp, Homo sapiens
caatgtatttcaagcgtggcactactgacaattgagctggataattctttgttatgagtgcctgctttgtgcaatg

SEQ ID NO: 6233 - DNA, 95 bp, Homo sapiens; identical to SEQ ID NO: 68

SEQ ID NO: 6234 - DNA, 93 bp, Homo sapiens; identical to SEQ ID NO: 69

SEQ ID NO: 6235 - DNA, 75 bp, Homo sapiens
gactgggtgacagagagtgagatgctgtttccaaagagagagagagagagacaacactgcatttgttattcagtc

SEQ ID NO: 6236 - DNA, 88 bp, Homo sapiens
catggctgtacatgcacataaatacatggatgtatgtatttatgtaagtatgtactgtgcatgtatgagtgttttgtgtttagttatg

SEQ ID NO: 6237 - DNA, 72 bp, Homo sapiens
tagtaggggcagaatacagatgctgcaaacaaggtactatgttggagatctgattttgtttttcacttacta

SEQ ID NO: 6238 - DNA, 71 bp, Homo sapiens
tatcagaaatattgtatttggagtattgttcaatatttgaatatttttaggtgagatcaatatttctgatg

SEQ ID NO: 6239 - DNA, 80 bp, Homo sapiens
ttgtttctctctcactctctcaagtgtgcagatttttctcttcatgcagaatggccacttctgggggttgggagaaggga

SEQ ID NO: 6240 - DNA, 95 bp, Homo sapiens; identical to SEQ ID NO: 68

SEQ ID NO: 6241 - DNA, 93 bp, Homo sapiens; identical to SEQ ID NO: 69

SEQ ID NO: 6242 - DNA, 75 bp, Homo sapiens
tcactttgttcatgtttcatttgttactataattatataatttaattcagtgttaagtgaaatgatgaaatgtga

SEQ ID NO: 6243 - DNA, 130 bp, Homo sapiens
agactgcttccttttgtaggtgattttttattcatattagtatagctattcaaaatttatttgtttacatttgcttttgtgtctataaatgccatctgtgaatagagatagctattgaataaatggtgct

SEQ ID NO: 6244 - DNA, 116 bp, Homo sapiens
ctagatagaatgttctgttttttaggtccatttggtctaatgttcagtttaagataaatgtttctttattgaatttctgtctagatgatctgtttaatgatgagcatgggatgtgg

SEQ ID NO: 6245 - DNA, 108 bp, Homo sapiens
tgtgttagagtgctacccagccatcaataaatttgtgtttatattttattctgagccttagaagtaaatgtgtctggaattggtgggttcttggtgtcactgacttca

SEQ ID NO: 6246 - DNA, 112 bp, Homo sapiens
gcaagaggacatgggtctgcagccttaggctgtctctcggtctgtctcagggaaacctggggaaggagggctcagtgctgaggctctctgcgtggctctggcaaccccttgt

SEQ ID NO: 6247 - DNA, 134 bp, Homo sapiens
acagacaaataaatatgtgtacatattaacatatatgtgttaatatgtacatatacatgttaatttgtacatataatataagtacatattacaaataaatgtatgtacatattaacacatacatgttatgtata

SEQ ID NO: 6248 - DNA, 79 bp, Homo sapiens
tgggtgacacactgagaccctgtctctaaaaaaaataagtaaatatagctgggcatggtggctcatgtgtgtactccta

SEQ ID NO: 6249 - DNA, 102 bp, Homo sapiens
gaggactttaaacactaccctgtactgaaatcattacttctgttctaaagacatattgtacttcagaatttaaatttaagtatgaggaatgtgttttctccc

SEQ ID NO: 6250 - DNA, 113 bp, Homo sapiens
gcattattatgaggatattttttaagataggtgtatacctattaagcttggtaatcaagtttatatttttcataatctcctgtcttcaaaactgttgttctttctctttctgt

SEQ ID NO: 6251 - DNA, 115 bp, Homo sapiens
gacattgaaattggaggataaagaaaaatgcaatggagatatacatatgtaatttattaatttcaatgaaatgcgtatccactgttttctaaatttaggcagtgtttcatatgtc

SEQ ID NO: 6252 - DNA, 69 bp, Homo sapiens
ttgtttgagacggagtctcactgtgtcacccagcctggagtgcagtggtgtgatcttggctcatggcaa

SEQ ID NO: 6253 - DNA, 124 bp, Homo sapiens
gcaaaagggttgagggggtgggtaatagagatatttatagtgaagggtttcactatatatattttagtgtgtaaagtgacctatggagtgctctgtcatgtttttatgtttctcaaatcccctt

SEQ ID NO: 6254 - DNA, 95 bp, Homo sapiens; identical to SEQ ID NO: 68

SEQ ID NO: 6255 - DNA, 93 bp, Homo sapiens; identical to SEQ ID NO: 69

SEQ ID NO: 6256 - DNA, 76 bp, Homo sapiens
acacatatgtacatacatgtatatatgtatacatatacatatatgtgtatttatatatatacctgtatatatgtgt

SEQ ID NO: 6257 - DNA, 86 bp, Homo sapiens
ggtatatatataaatacacatatatgtatatgtatacatatatacatgtatgtacatatgtgtgtgtatctatcaatatatatacc

SEQ ID NO: 6258 - DNA, 112 bp, Homo sapiens
tgatatcattataggcacaatcagtggtggctacacagaatttatcttttttaaaaaattttgtttttatttttaagttctggatacaagtgcagaatgtgcaggtttgtta

SEQ ID NO: 6259 - DNA, 69 bp, Homo sapiens
ggacaatgaaaatagttgccatatatgtgtgtgtatatatatatatgtgctgtggaatactattcagcc

SEQ ID NO: 6260 - DNA, 86 bp, Homo sapiens
ccagggagcttagaggagcaaatgtttaatagcttatattttaatattagtgagcttttttttgcttctcataaacagtattttgg

SEQ ID NO: 6261 - DNA, 95 bp, Homo sapiens; identical to SEQ ID NO: 580

SEQ ID NO: 6262 - DNA, 93 bp, Homo sapiens; identical to SEQ ID NO: 69

SEQ ID NO: 6263 - DNA, 109 bp, Homo sapiens
tataaagttggacttctttgactgggcttgtacagtaatgatttagtactttttgaccagtgatcagttacctgctgttcgagagataccagcaaagattcagggtata

SEQ ID NO: 6264 - DNA, 95 bp, Homo sapiens; identical to SEQ ID NO: 5211

SEQ ID NO: 6265 - DNA, 110 bp, Homo sapiens
cagtgaattatcactctggcagttacatgagatccggttatttaaaagagtgtggtatcttcctactctctctctctctcttgctcctgctcttgccacatgatatgctg

SEQ ID NO: 6266 - DNA, 95 bp, Homo sapiens; identical to SEQ ID NO: 68

SEQ ID NO: 6267 - DNA, 93 bp, Homo sapiens; identical to SEQ ID NO: 69

SEQ ID NO: 6268 - DNA, 103 bp, Homo sapiens
tcagttaacaagattcagtgagtctagagtaagtcctaaatatctgtatattaataaatctaaacaggtaagtgacgtaaactggagaattgtggaacactga

SEQ ID NO: 6269 - DNA, 123 bp, Homo sapiens
ataggttctatatatatacacacatatatatgtgtatataaatgtgtatctatatatatatacacacacatatatgtgtatataaatgtgtatctatatatatatacacacacatatatgtgt

SEQ ID NO: 6270 - DNA, 173 bp, Homo sapiens
tccctgtatatatatacacatatatgtatatggatatatatatatgtatatgtgtatatggatatatatgtgtatatgtatatatggatatatatgtgtatatgtatatatggatatatatatatgtatatgtatatatggacatatatggatatatatacatagggatacca

SEQ ID NO: 6271 - DNA, 73 bp, Homo sapiens
tttgagacaggctgtcactctgtcacccaggctgaagttcagtggtgtgatcatagctgactgcaacctcaaa

SEQ ID NO: 6272 - DNA, 113 bp, Homo sapiens
catatacatatatgtgtgtatatatgtagatacatatatctgtgtatatgtgtatatatatacatgtgtgtatatgcatgcacacatatacatatatgtatagacatgtgtac

SEQ ID NO: 6273 - DNA, 107 bp, Homo sapiens
ttcatgcagaatttctttttgttcatatgtgaagattataggtttaatattgttctagatttgaatattttcatataatgaaaaatgtaaaagattatttatatgga

SEQ ID NO: 6274 - DNA, 70 bp, Homo sapiens
atatacacactatattgtgtatatatatatatagtgatatctatatcacacacatatatagtgtgtatat

SEQ ID NO: 6275 - DNA, 105 bp, Homo sapiens
gcagttcagatttatacatttttaaagtattctccgaaaatatccaaaagttagtacttttaatttttaatttatatggggaacaaatgtaagaatagagactgt

SEQ ID NO: 6276 - DNA, 86 bp, Homo sapiens
caaagttgaacataatttgaaagtatttcatttaggatacttgtggctccatttatgaaacagtttaacattttatgtcagctttg

SEQ ID NO: 6277 - DNA, 69 bp, Homo sapiens
ctcccatcaatttctctgagtttattattttatttcaatggagcacattcttcaggagattgatgagag

SEQ ID NO: 6278 - DNA, 95 bp, Homo sapiens; identical to SEQ ID NO: 68

SEQ ID NO: 6279 - DNA, 93 bp, Homo sapiens; identical to SEQ ID NO: 69

SEQ ID NO: 6280 - DNA, 78 bp, Homo sapiens
gactcctcacagagtgcagacagaggtcaggatatgccagcccatgaatatggccctgtgtgttttgtgggccttgtt

SEQ ID NO: 6281 - DNA, 95 bp, Homo sapiens; identical to SEQ ID NO: 68

SEQ ID NO: 6282 - DNA, 93 bp, Homo sapiens; identical to SEQ ID NO: 69

SEQ ID NO: 6283 - DNA, 118 bp, Homo sapiens
ctctataaatctgacttcaatatgttttcctcagttgggtttgacctagaagaaaaataatattttatttattgggtttccaaattttcaaaacctattgtgtgtaaggttctgagag

SEQ ID NO: 6284 - DNA, 69 bp, Homo sapiens
tgctttctaagcaattgagaaaagcaatagatttttttttctttgcttaagctcagtggcaagaaagca

SEQ ID NO: 6285 - DNA, 118 bp, Homo sapiens
ggtattaggttggtgcaaaagtaattgcgatttttgccattactttcaatgctttgtaaacaagaaagcattataccggtgaagaaaggattgtttatgttgtgcccatactagaact

SEQ ID NO: 6286 - DNA, 93 bp, Homo sapiens
catttgtgtgtatatatatatacatttgtatatatatacatttgtgtgtatatatatatacatttgtatatatatacatttgtgtgtatatat

SEQ ID NO: 6287 - DNA, 130 bp, Homo sapiens
gcttaggattgttttggttgtttgggctcttttattggtttcatatgaaattttagaatagtgtttttctaattctgtgaagaatgtcattggtagtttgatagaaatagcattgggtctgtacgttgct

SEQ ID NO: 6288 - DNA, 82 bp, Homo sapiens
gtgtgtatgtgtatatatgtgtgtatttctacataggtgtatatatgaatatgtgtgtatatatgtgtgtatatgtatatat

SEQ ID NO: 6289 - DNA, 108 bp, Homo sapiens
ggataggtggctttagcctacataggtttccaagcttagagccttgctggatctctcaccctctgtaactttctttgaactacctttgaagtcattgccaaaaattcc

SEQ ID NO: 6290 - DNA, 92 bp, Homo sapiens
cttccatcgtcaatctcactctttgtgtgtctgcatccttgttctcatggctatgagacaacaaacctcgagtgttaccccagacaatgagg

SEQ ID NO: 6291 - DNA, 76 bp, Homo sapiens
ctgggtgggcatgaggctctgaatttcatttttttttttttttttttttgagacagagtctcactctgtcacccag

SEQ ID NO: 6292 - DNA, 101 bp, Homo sapiens
gctctctagcctctggagagtctgtgagctatccaatagcttaaaaacaatattttttttttttgagatagggactcactctgtcacccaggctggaatgc

SEQ ID NO: 6293 - DNA, 94 bp, Homo sapiens
gcccctgctgctgacaccttggttttagacttctaggctccagaattgctacagaagtacagaagtgagtgtggtttcagccaacaagtttggt

SEQ ID NO: 6294 - DNA, 95 bp, Homo sapiens; identical to SEQ ID NO: 68

SEQ ID NO: 6295 - DNA, 93 bp, Homo sapiens; identical to SEQ ID NO: 69

SEQ ID NO: 6296 - DNA, 115 bp, Homo sapiens
gaatggcccctccagaatcttgaaactgtatgcccatcagggatcttaaggtaaagctaaccaaagaagtttctcctgagaagtaggcagaatccttgatataaacagctttttc

SEQ ID NO: 6297 - DNA, 117 bp, Homo sapiens
agccccataccactggacacctagaaattttactgaggtagaaggtccctgaattttaattcaatttattttctattctctgacaaatatctcacaagtaggttcagtgtgtttgct

SEQ ID NO: 6298 - DNA, 119 bp, Homo sapiens
gtatacaatatacattatatatatatacatatatatacttatatatgtatatatgtgcatatatatgtatatatatgtgtgtgtatatatatgtgcatatatatatgtgtgtatatata

SEQ ID NO: 6299 - DNA, 76 bp, Homo sapiens
tgtgggtaccagggagagactataggattcacatttttttttttatttgagacagggtctgactctgtcacccagg

SEQ ID NO: 6300 - DNA, 116 bp, Homo sapiens
ttatgatttctctttttattgctatgtctacaaattacaggtctatccatgtattttttaaatatttaaatatgatttgacttgaagattatagatatgtgataattatgttataa

SEQ ID NO: 6301 - DNA, 100 bp, Homo sapiens
cagcactcctttcttattgtgagacaagagcaagaagcagcctgaacagagagagatcataggctgtgtgaatacattgttaccagtaaaaagctggctg

SEQ ID NO: 6302 - DNA, 107 bp, Homo sapiens
tctagaaggcaggaggtggtaaaaaatgtttatatcaatttgagattttttttcatttttttctcactttgttttatttcttttcttttacagtctgttcatctggg

SEQ ID NO: 6303 - DNA, 94 bp, Homo sapiens
tagcattttgtatgtaagatatatctgcccacagtaagttgcagataatatgtgtgaatgtggttgtaagttgtatccttctttgcaaatgtta

SEQ ID NO: 6304 - DNA, 85 bp, Homo sapiens
gaaaatgggaaattaattttttgatttgcaactgtagtttaaactgcaggccaaaaaaagaattattttacatgtgtccattttc

SEQ ID NO: 6305 - DNA, 82 bp, Homo sapiens
ggacaggtgtggtggttcatgcactctgtgagtctgacacgggtggatcacttgatgtcaggagttcaagaccagcctggcc

SEQ ID NO: 6306 - DNA, 106 bp, Homo sapiens
atgtccctgtatgcacattatttagtgcccactgatgaaagagaacatacaatatttgtttttctctgtctgagtttttacttaagataatggcttccagttccat

SEQ ID NO: 6307 - DNA, 66 bp, Homo sapiens
tggtgtgtgtgtatatatatatatatatatatgtatgtatgtatgtatgtatgtatatatcacatc

SEQ ID NO: 6308 - DNA, 125 bp, Homo sapiens
gcaaactctgctgaagggactgcccagcagtaagaagacagggtgtggactcagataacagcaacaccatgtggatgtgggattcagtgcccagcagactgcaggggaaagagagaggttgttct

SEQ ID NO: 6309 - DNA, 82 bp, Homo sapiens
gggaggtaatgagatcatgggggtgatggttttataaagggcttttccctctgctcagctctcattctctctcttgctgccc

SEQ ID NO: 6310 - DNA, 112 bp, Homo sapiens
accagcagtgcataaacattcctttttctccacagtctcactagcatcttttattttttgactttttaataatagctattctgactagtgtgaggtagtatctcactgtggt

SEQ ID NO: 6311 - DNA, 95 bp, Homo sapiens
gcccactttttgatggggttgtttgtttttttcttgtaaatttgtttgagttcattgtagattctggatattagccctttgtcagataagtaggt

SEQ ID NO: 6312 - DNA, 81 bp, Homo sapiens
tttggtggaagatgaggtaaaaatgcatgtgtaaactgtacatttatagtttacatatatattgtttgtaagttcatcaag

SEQ ID NO: 6313 - DNA, 116 bp, Homo sapiens
atatatatatgtgtgtgtgtgtgtgtgtacatatatatatatatgtacacacacatatatatgtatatatgtatatacatgtatatatgtacatatatatatacacatatatatat

SEQ ID NO: 6314 - DNA, 89 bp, Homo sapiens
gttatatgaatgctccctctctcggtctctcaaaatatcttaatattttcagactgtgactgattgagggtaattgagccacagaaagc

SEQ ID NO: 6315 - DNA, 91 bp, Homo sapiens
atgagcatatatatatacttatgagcatacatatatatacttatgagcatatatatatgtgtgtatatatatatatatatatatattcatg

SEQ ID NO: 6316 - DNA, 80 bp, Homo sapiens
gcaaaattaaacaaacagtagagagtgaccagccaggatggcttcaagtgctgaggtcatgtgtttgcctctctacttgc

SEQ ID NO: 6317 - DNA, 111 bp, Homo sapiens
tagctagtatctacatactttctggtggagttgtaagacgtgttttacaaaaaaagtgtagagtgcacattgcatcaaataaaatgctaagaagtggggtttggatagtta

SEQ ID NO: 6318 - DNA, 94 bp, Homo sapiens
ttaggtctgctgttgacccatttgaaaactgagaaagccaagggttagacagaacagcacttctcagaattcagtgtgtataggagccacctga

SEQ ID NO: 6319 - DNA, 96 bp, Homo sapiens
cttattatgacaacaagcaggagtgaccagctgtaaactagaaaactaattttttagttaatttgtctgaggttcttttgtatgtgattttttaag

SEQ ID NO: 6320 - DNA, 116 bp, Homo sapiens
tgtctgtttttcaaattcaataatctgaatcattaataaatcttcaaaaataattgcaggtaactatttttgttttattttaatatcaggaatttgggagctcatttgaatagata

SEQ ID NO: 6321 - DNA, 87 bp, Homo sapiens
ctatgttcatcctggatattggcccatagttttattttatgtgtctgtgcgtgtgtctgtcaggtttcgatatcaggatgatgctag

SEQ ID NO: 6322 - DNA, 58 bp, Homo sapiens
ttctttatgtgtgtgtatatatgtatgtatgtatatacatataaacacatatggagaa

SEQ ID NO: 6323 - DNA, 137 bp, Homo sapiens
gtatatatacgtatatatgtgtatatatatacgtatatatgtatatatacgtatatatgtgtatatatatacgtatatatgtatatatacgtatatatatgtgtgtgtatatatatatatttggttacacataatac

SEQ ID NO: 6324 - DNA, 57 bp, Homo sapiens
tgagacagtgtctcgctctgtctccaggctggagtgcagtggcgtgatctcagctca

SEQ ID NO: 6325 - DNA, 95 bp, Homo sapiens; identical to SEQ ID NO: 68

SEQ ID NO: 6326 - DNA, 93 bp, Homo sapiens; identical to SEQ ID NO: 69

SEQ ID NO: 6327 - DNA, 58 bp, Homo sapiens
tgagacggagtctcactctgtcacccaggctggagtgcagtggtgccatctcggctca

SEQ ID NO: 6328 - DNA, 100 bp, Homo sapiens
ttatcatcttttcacagaagtgatagacctggtttgcactgaaagaaggcaatgtcttctagatttattgtatttaatggtcttgtgtgggagatgttag

SEQ ID NO: 6329 - DNA, 159 bp, Homo sapiens
atgtgtatatatatacatatttgtatatatacatatatatacatatttgtatatatacatatatatacatatttgtatatatacatatatatacatatttgtgagatggagtctcgctctgccaccaggctggagtgcaatggtgtgatttcagctcac

SEQ ID NO: 6330 - DNA, 115 bp, Homo sapiens
ggaaaattgtttgagctgtaaattataccactgtctgcatggaggcacttacttaaatggttggaaagtaatttggaggcagtatgtacaaagtggataatacccttgaaaaccc

SEQ ID NO: 6331 - DNA, 89 bp, Homo sapiens
ttatgtttatttctactgtctaagatatatgtatatgtatatttacatatgtaaatatataactatatttatcagtagattagatatga

SEQ ID NO: 6332 - DNA, 80 bp, Homo sapiens
gtctcaaaaatatgtatgtgtgtgtgtgtatatatatatatgagacatatatatatgagacatatatatatgagacatat

SEQ ID NO: 6333 - DNA, 89 bp, Homo sapiens
atacatatatatatatatatatatatatatatatatatatttgtgtgtgtgtgtatacatatatgtatgtgtatatatatgtatatgta

SEQ ID NO: 6334 - DNA, 115 bp, Homo sapiens
cattccctccagcagtgtagaagtgttcctgatcatgtccacgccaacatctattattttttgattttttgattatggccatttcttgcatgagttagatggtattgcattgtgg

SEQ ID NO: 6335 - DNA, 80 bp, Homo sapiens
gcatatatgtacctaggagtagaatgactggtcatagattatctatatatttcatttgactacctagtgacagaaagtgc

SEQ ID NO: 6336 - DNA, 117 bp, Homo sapiens
tgttctttttgcttgggattgtcttgacgatacgggctgttttttggttccatatgaaatttaaagtagtttttttgtaattctgtgaagaaagtccatggtagcttgatggggata

SEQ ID NO: 6337 - DNA, 115 bp, Homo sapiens
gcatttctggtctgacttctgcacagtgcacgcaggctctttttttttcttttattattattatactttaagttttagggtacatgtgcacaatgtgcaggttagttacatatgt

SEQ ID NO: 6338 - DNA, 60 bp, Homo sapiens
tgtgtgtgtgcatatatatatacacatatatgtatgtgtatatatatatacacacacaca

SEQ ID NO: 6339 - DNA, 58 bp, Homo sapiens; identical to SEQ ID NO: 1847

SEQ ID NO: 6340 - DNA, 76 bp, Homo sapiens
caaatggcactgatgagaagtctctgaaatatgtgaacacaagaagtcagaagagttgtcatatacttgtgctttg

SEQ ID NO: 6341 - DNA, 91 bp, Homo sapiens
ctggtgtcagaagtgttgtgtgagagtgaagagaaacagtttgttttcccagactcactctctttgatcactccatccagaaatgattcag

SEQ ID NO: 6342 - DNA, 119 bp, Homo sapiens
atctgcttctttataatgtctccttttacctaaactagctgagataagtttttgtatattaaacaaagattctcttaggcacagagtttctggtcctttcttataattgggagtaagat

SEQ ID NO: 6343 - DNA, 69 bp, Homo sapiens
tgttgttgagatggagtctcactctgtcacccaggctgtagtgcagtggtgtgacctcagctcattgca

SEQ ID NO: 6344 - DNA, 60 bp, Homo sapiens
tgtgtgtgtgtgtgtctgtgtgtagatagatagctagacagacagatagacagacagata

SEQ ID NO: 6345 - DNA, 141 bp, Homo sapiens
actgcacccaggctgtttcttttttaatctgtatttatttatttaattttttttaaatattgagatggggtctctcactgtcagccaggctagagtgcagtagtgcaatcttggctcactgcagcctctgcctcccaggct

SEQ ID NO: 6346 - DNA, 112 bp, Homo sapiens
tcagacctctgtcaacacagattagttctttatgttcttgaacttgatataaatgaaatcatatggtatgtattattttggcacagagtttttgatgatgatttaggtttga

SEQ ID NO: 6347 - DNA, 65 bp, Homo sapiens
gaggttctaatggatgtgtgtgtgtgtctgtgtatatacacacacacatttagatgtggaatgtt

SEQ ID NO: 6348 - DNA, 107 bp, Homo sapiens
gaaagtaaaaaggcaaattggtactgcttttatggtatatttgcctatacagtaaatatttgtatatgatacatgtgctatatgttttgaaagccttaagtatattc

SEQ ID NO: 6349 - DNA, 87 bp, Homo sapiens
gcacatatcacactttgcttacttacaccccataatgtaaatttcaggagaccaggtgggtgtgtgtgtgtgtgtgtgtgtgtgtgt

SEQ ID NO: 6350 - DNA, 92 bp, Homo sapiens
gtcatgagaatgggactgatggctttgtaagaaggagaagagagacctgagttagcacactcagcccctaaccacgtgatgccatttgttgc

SEQ ID NO: 6351 - DNA, 88 bp, Homo sapiens
gtgtatatatatatatgtgtgtgtgtatatctatacacacatatatatgtgtgtgtatatatatatatatacatatatattttttcat

SEQ ID NO: 6352 - DNA, 117 bp, Homo sapiens
tgtcttcttttgagaagagtctgttcatatccttcacccactttttgatttttttttcttgtaaatttgtttcagttccttgtagattctggatattagacctttgtcagatggata

SEQ ID NO: 6353 - DNA, 71 bp, Homo sapiens
cctttaagaggtgattatgttgttaagatggattagtatctttcttgcaagactgggttagttcttatggg

SEQ ID NO: 6354 - DNA, 75 bp, Homo sapiens
gctagctggtttgcaggacgaaatacaaattcaattttttgaatttgaatttgtactgacataagcagaaatagt

SEQ ID NO: 6355 - DNA, 58 bp, Homo sapiens; identical to SEQ ID NO: 3040

SEQ ID NO: 6356 - DNA, 56 bp, Homo sapiens; identical to SEQ ID NO: 3041

SEQ ID NO: 6357 - DNA, 57 bp, Homo sapiens
atgtatatgtatatgtatatgtatatgtataatgtatatgtatatgtatatgtgtgt

SEQ ID NO: 6358 - DNA, 70 bp, Homo sapiens
ttgttttgagacagagtctcactctgtcgcccaggctggagtgcagtggtgtgatctcagctcactgcaa

SEQ ID NO: 6359 - DNA, 58 bp, Homo sapiens
tgagacagagtctcactctgtcgcccaggctggagtgcagtggtgtgatctcagctca

SEQ ID NO: 6360 - DNA, 113 bp, Homo sapiens
atttttttctaggtgatgattatcagtgagttttagtttttttttttaaattttatttttatttatttatttatttttgaggtggagtctcactctgtcacccaggttggagt

SEQ ID NO: 6361 - DNA, 59 bp, Homo sapiens
tgagacaagagtctcgctctgtcacccaggctggagtgcagcggcatgatctcggctca

SEQ ID NO: 6362 - DNA, 89 bp, Homo sapiens
caaaggcgcggcaatattcactcctgtgtttgtttctttatataagactccatctcagcacagtggagagagatttcctgccacctttg

SEQ ID NO: 6363 - DNA, 112 bp, Homo sapiens
gtgtgtatatatacacatatatatgtatatgtatatatatcatatatggtatatataaaaatatatatatcatatatgtatatgtgatatacatatgtgtatgtatatatgt

SEQ ID NO: 6364 - DNA, 107 bp, Homo sapiens
tttttaaaatgccactcttctcattacgtttttcatgttggaagatatatttgtttttcttaaaacatgtttaacatggagtgggtttattattgtcattttgaagg

SEQ ID NO: 6365 - DNA, 62 bp, Homo sapiens
tgagtcggagtctcgctcgctctgtcgcccaggctggagtgcaatggcgcgatctcggctca

SEQ ID NO: 6366 - DNA, 58 bp, Homo sapiens
tgagacagagtctcactctgtcgcccaagctggaatgcagcagcatgatctctgctca

SEQ ID NO: 6367 - DNA, 57 bp, Homo sapiens
gtgacggagtctcactgtgtctccaggctggagtgcagtggtgcgatctcggctcac

SEQ ID NO: 6368 - DNA, 105 bp, Homo sapiens
tttatttagatgggaaaacggtgggtggagaaagtgtgcagaggtgggaatcaggatgatctaggacctaggatgtttgagctgtctatcagctatccaagtaga

SEQ ID NO: 6369 - DNA, 107 bp, Homo sapiens
agccatgcagctaataaagttcagagtgctttgtactatactgtgtttaaatttttgtataaatctagagctagatggtagaatgaagcttattattgctgtttgct

SEQ ID NO: 6370 - DNA, 112 bp, Homo sapiens
ttggttatcagagccttgctcagtcatgggctggggcagcctcagaagagtgtgacctcaatctaaaggctggtggcccatgaagctaatagctggaggctgtctctaccaa

SEQ ID NO: 6371 - DNA, 118 bp, Homo sapiens
gagagaaggagaagaaacaatcactgatctaggtagattataggctgttacataatgaaatttattttatacactaatattcctcctaaggtttcaggatatttaatctctgccactt

SEQ ID NO: 6372 - DNA, 104 bp, Homo sapiens
gtgtgtatgtatacatatatgtgtgtatatgtatacatgtgtgtatatatgtgcatatgtatacatatgtgtgtatatgtatgcgtgtgtgtatatgtatacat

SEQ ID NO: 6373 - DNA, 83 bp, Homo sapiens
tatatgtgtgtatatatatgtatacacatgtgtgtatatgtatacacatatgtgtgtatatgtatacacatgtgtgtatatgt

SEQ ID NO: 6374 - DNA, 111 bp, Homo sapiens
gggatagggtctaaagtcagcatataaaatgaaaccatgcattgcctaaattttttttaaatttctttaaattaacttaggatgcacagttttatgtatgcagccctatac

SEQ ID NO: 6375 - DNA, 91 bp, Homo sapiens
gaagtatgactggtttgacacaagtgagtgaccagagttggtgtcttcttggaactgaccttgtgttaccatatgacaaaccaaagccttc

SEQ ID NO: 6376 - DNA, 95 bp, Homo sapiens; identical to SEQ ID NO: 68

SEQ ID NO: 6377 - DNA, 93 bp, Homo sapiens; identical to SEQ ID NO: 69

SEQ ID NO: 6378 - DNA, 70 bp, Homo sapiens
gtcagtaagttgctcctggcaacattcacgcaggcgactctgcaagttgttgttgttgttgtttattggc

SEQ ID NO: 6379 - DNA, 60 bp, Homo sapiens
atacacacacacatatatatgtgtatatgtgtgtgtgtgtgtgtgtgtgtgtgtgtgtgt

SEQ ID NO: 6380 - DNA, 97 bp, Homo sapiens
gctcctgctagaacctgcatcccttttcagtcactgtctctcatttgtatcacatagggcataagctgctatgaggagatgcagaaaacagaagggc

SEQ ID NO: 6381 - DNA, 128 bp, Homo sapiens
atatatacatatatatatatacgtatatatatatgtgtatatatatacgtatatatatatatgtgtgtgtatatatatatgtatacatatatatatatatgaagcacccaatttttctatatattaca

SEQ ID NO: 6382 - DNA, 101 bp, Homo sapiens
ggatctgaggcattagagagattaagttcttgatttttttttgtttgtttgtttgctcctttgaaatcaaggtctttctgttctcccgagttatcatctcc

SEQ ID NO: 6383 - DNA, 84 bp, Homo sapiens
ccttgaagacacagggagctttgaagaatgggagcagaagaatgacagagagagttgcctattttagaagtaccctctgtcagg

SEQ ID NO: 6384 - DNA, 90 bp, Homo sapiens
atactaattgcatgattagtcaatgctcctgtgagatgatggtgaaagtcctctcttaagagcttcgtgatcagatttgtacatttgtat

SEQ ID NO: 6385 - DNA, 118 bp, Homo sapiens
gatggaggtaggagttgcctttttacatatttgaagatttactggtggatattattatgtatatttacttatgtatgttccatttcagatatttaagacaaatttcatattttgcatt

SEQ ID NO: 6386 - DNA, 95 bp, Homo sapiens; identical to SEQ ID NO: 68

SEQ ID NO: 6387 - DNA, 93 bp, Homo sapiens; identical to SEQ ID NO: 69

SEQ ID NO: 6388 - DNA, 115 bp, Homo sapiens
gtataagtgttcccttttctccacatttttaccaacagatgttggttttaaactttttaataatagctattctgactggtgtaagatggtatctccttgtggttttaatttgtat

SEQ ID NO: 6389 - DNA, 97 bp, Homo sapiens
gtgtgtatgtgtgtgtctagagaagagagagagatcagtattgaaatgatacatatttctcttgtaagtgtttatctgatgaattatggtgatatac

SEQ ID NO: 6390 - DNA, 116 bp, Homo sapiens
gggggtagtttctaggtaccataaattgatgcttgttttgaaaaaagtaatttctatgaatttatgaagcaaatttcaaaatgcattaattccagaaacattaaataattatttct

SEQ ID NO: 6391 - DNA, 78 bp, Homo sapiens
tatatacatatacacacgtgtatacacgtatatatatgtatatacatatatatacatgtatatatgtatatgtattta

SEQ ID NO: 6392 - DNA, 82 bp, Homo sapiens
atatacatatatacatgtatatatatgtatatacatatatatacgtgtatacacgtgtgtatatgtatatacatacacgtgt

SEQ ID NO: 6393 - DNA, 105 bp, Homo sapiens
attccatggccctgaatatgtgtgttatataagttcagagataacagacagcaaaagttgggtaggtcttctctgaggaggcgacatgacagtgttttctggagt

SEQ ID NO: 6394 - DNA, 117 bp, Homo sapiens
tctcaactaaggtgatataatacctcattgtggttttcgtttgcatttttctgatgattagtgatattgatcatttttccacatgcctgttgatcatttgtatgtcttcctttgaga

SEQ ID NO: 6395 - DNA, 118 bp, Homo sapiens
tgaaagaatgtggtttattgtagcattgatctttccttcctgcttagaatgtatttttttctgatttaaagaggaaaattttcagccactggggatcatgaggctgatcattatatca

SEQ ID NO: 6396 - DNA, 104 bp, Homo sapiens
gtgtgtatatgtatgtgtatgtgtatgtgtgtggggtctatatatatatatattatatatatatatattatatatatatatatatgtatgtatatgcatatgca

SEQ ID NO: 6397 - DNA, 115 bp, Homo sapiens
atatgttaaggtacattgttagactgaaaatggagtctataagtacatgtatctgtatttttgaatttatgtcttgtagaagttaccaaattctaatattgtatttagatcatgt

SEQ ID NO: 6398 - DNA, 94 bp, Homo sapiens
attatatattataaatgtatatgacattatacattatatattatatatacatatattatgtaatgttacatataacacattttatatatgtaat

SEQ ID NO: 6399 - DNA, 119 bp, Homo sapiens
tcaaaaatcttataacaataaaaacctatttctacagtagaaatagattgatcttataatttttttattttttaatgttgtgggtacatagtaggtatttatatttatggggtacttga

SEQ ID NO: 6400 - DNA, 108 bp, Homo sapiens
gtgagtgtggtacattctaaattatttggtaatttttgatgttatatttaattttgtaaaaaattttgttacccctcaaatcaccaattttatcgtgtattacatagc

SEQ ID NO: 6401 - DNA, 95 bp, Homo sapiens; identical to SEQ ID NO: 68

SEQ ID NO: 6402 - DNA, 93 bp, Homo sapiens; identical to SEQ ID NO: 69

SEQ ID NO: 6403 - DNA, 58 bp, Homo sapiens
tgagactgagtctcgctctgtcacccaggctggagtgcagcggtgcgatctctgctca

SEQ ID NO: 6404 - DNA, 115 bp, Homo sapiens
tggcaggctcagagtactctcttttgcatcagaccatatgaatagtaaactagatatttttttatagtggtcttgaggcaggagggcctatcacagtcctttctaacttctgcca

SEQ ID NO: 6405 - DNA, 108 bp, Homo sapiens
gtattcttagaagttgaattgtttaatcaaaatctttgaaattttttaaaaaaggtgctgaaaaattgccttccaaagagattataacaatttcagctcctatagtat

SEQ ID NO: 6406 - DNA, 95 bp, Homo sapiens; identical to SEQ ID NO: 68

SEQ ID NO: 6407 - DNA, 93 bp, Homo sapiens; identical to SEQ ID NO: 69

SEQ ID NO: 6408 - DNA, 146 bp, Homo sapiens
cacacataatatatataatacatgtatatatttttgcatatgtatatttatatgtgcatatgtatatgcgcatatgtatatttgcatatgtgtgcatgtatatatgtgtgtatatatatatatatacacatgcacacatatatgag

SEQ ID NO: 6409 - DNA, 84 bp, Homo sapiens
ggttataggattacagaagactgagaagacagcttgaggttagcttccaagccctgcactgctcagttctctcaattactgatt

SEQ ID NO: 6410 - DNA, 113 bp, Homo sapiens
cagcctgggtgacggagtgagacactgtctcaagataaaaaacaaaacaaaaaaaaagaaagagtctatttatttatttattgagacggagtcttgctctgtcacccaggctg

SEQ ID NO: 6411 - DNA, 97 bp, Homo sapiens
ggtgtacatatctgaacagtatggaagagtgtgggtggcatgcaaggattcatttggtcactgtctttctctctatgcattacgtaggatgtatgct

SEQ ID NO: 6412 - DNA, 69 bp, Homo sapiens
accattatatatgtatgtatgtatatgtgtgtatatatacatatgtatttacattatcgttagtatggt

SEQ ID NO: 6413 - DNA, 94 bp, Homo sapiens
cctggattaagagagtgttatctcctcctttcaatataaataattttttatttttttctctttggggggacggagtcgcactctgtcacccagg

SEQ ID NO: 6414 - DNA, 62 bp, Homo sapiens
acacacacatatgtgtgtgtatatgcgtgtatatatgtgtgtatatatatgtatgtgtgtgt

SEQ ID NO: 6415 - DNA, 84 bp, Homo sapiens
tatatatacacacatatatacacgcatatacacacacatatgtgtgtgtatatatatgtgtgtgtatatatgtgtgtgtatata

SEQ ID NO: 6416 - DNA, 126 bp, Homo sapiens
atatacatatatatatacacacaaacacacacacacacacacacacatatatgtgtgtgtatatatatgtgtgtatatatatacacatacatatatatacacacacatatatacacacacatatat

SEQ ID NO: 6417 - DNA, 166 bp, Homo sapiens
ataagcaatgtgtatatatatgtgtgtatatatatgtgtatatatatacacacacacatacacatatatgcatatatacttatacatatatatgtatatatgtgtatatatacttatgtgtatatatacacacatatatgtatatacacatatgtatatacacaca

SEQ ID NO: 6418 - DNA, 95 bp, Homo sapiens; identical to SEQ ID NO: 4236

SEQ ID NO: 6419 - DNA, 95 bp, Homo sapiens; identical to SEQ ID NO: 68

SEQ ID NO: 6420 - DNA, 93 bp, Homo sapiens; identical to SEQ ID NO: 69

SEQ ID NO: 6421 - DNA, 135 bp, Homo sapiens
atatataagtgtatatatatatctcatatatatcatatgtatgtatgcaaaagtatatatgtatatatgtgtatgtatatatctatatctacatataggtatatatatacctacatatatatcttaatttatttt

SEQ ID NO: 6422 - DNA, 64 bp, Homo sapiens
ttgaggcggagtctcactctgtcacctagcctggagggcagtgacacgatcttggctcactcaa

SEQ ID NO: 6423 - DNA, 83 bp, Homo sapiens
gtgtgcgtgtatatatatatgtgtgtgtgtatatatatgtgtgtgtgtatatatatatgtgtgtatatatacatatatgtcac

SEQ ID NO: 6424 - DNA, 67 bp, Homo sapiens
acatacacattgtatgttatataaatataagtatatatattttatatatctatgtgcatgtgtgtgt

SEQ ID NO: 6425 - DNA, 102 bp, Homo sapiens
tatatatatttatatatagatatataagattatagagtatatatatgaatatagaaataacatatctatatatctatatgtatctatttagagatatatatg

SEQ ID NO: 6426 - DNA, 106 bp, Homo sapiens
tataacttatctatgtatctatatatgtgtctatatatagatatatctgtatatctttatgtctgtctatattagatatctgtatattatatctagatatgttata

SEQ ID NO: 6427 - DNA, 96 bp, Homo sapiens
tgtattgtgtgtgtatttatatgtatgtatgcatatatgtgtgtgtatatatatacacacacacacatatatatacatatatatttgtatatatac

SEQ ID NO: 6428 - DNA, 103 bp, Homo sapiens
ttaattggagcatttagcccatatacatttaaggttaatattgttatgtgtgaatttgatcttcttattatgatgttagctggttattttgctcattagttga

SEQ ID NO: 6429 - DNA, 91 bp, Homo sapiens
tgcctcagggatacagttctgaaacttggagtttataccataacttggctaatctgctcagattcagcatctgtaactcctttaagtggca

SEQ ID NO: 6430 - DNA, 72 bp, Homo sapiens
tgttttttgagacagagtctcactctatctcccaggctggagtacagtggagtgatctctcggctcactgca

SEQ ID NO: 6431 - DNA, 102 bp, Homo sapiens
ccacagtatgtgactcagtcaaagcagatatatatatatatatatatatatatatatatatatatatatatatatacatatgttttcagaaacattatttgg

SEQ ID NO: 6432 - DNA, 125 bp, Homo sapiens
atgtatatgtatacacgtatatatgtatatgtatacacgtatacgtgtatatatgtatatgtatacgtgtatacatatacatatatagtatacgtgtatatatgtatatatatacacatatacac

SEQ ID NO: 6433 - DNA, 72 bp, Homo sapiens
acatgtatctatgcatgtatacatgtatatacatgtatatacatatatgtgtatacatgcatagatacatgt

SEQ ID NO: 6434 - DNA, 114 bp, Homo sapiens
tgtatatacatgtatatacatgcatacatgcatagatacatgtatacatgtatatatgcatatatacatatatacgtgtatctatgcatatatacatgtatatatacatgtata

SEQ ID NO: 6435 - DNA, 64 bp, Homo sapiens
acgtgtatatatacacgtgtatatgtatacacttgtatatgtatatatgtgtatatatacatgt

SEQ ID NO: 6436 - DNA, 80 bp, Homo sapiens
tgtatatacacatgcatatacgtatatacacgtgtatataagtatatacacatgtatacatgtatgtatgtgcatgtaca

SEQ ID NO: 6437 - DNA, 62 bp, Homo sapiens
atgtatatatgtatatgtacatatatatacacatgtatatatgtatatgtacacgtatatat

SEQ ID NO: 6438 - DNA, 76 bp, Homo sapiens
atgtacatgtatatatgtatatgtgcacgtatatatgtgcatgtatatatgtacatgtacatgtatatatgtacat

SEQ ID NO: 6439 - DNA, 182 bp, Homo sapiens
tgtttaaatatatatatgtatatatacacatatatatgtgtatatatacatatatgtgtatatatacatatatatgtgtatatatacacatatatatgtgtatatatacatatatatgtgttgtgtatatacacatatatatgtgtatatatatgtatgtgtgtgtgtgtatatatatatat

SEQ ID NO: 6440 - DNA, 64 bp, Homo sapiens
gtgtgttatatatatatatgtgtgtgcatatatatatatgcacacatgttcctttataatgcac

SEQ ID NO: 6441 - DNA, 60 bp, Homo sapiens
ctgagtatatatatatatactcagtatatatacatatatactgagtatatatattctcag

SEQ ID NO: 6442 - DNA, 62 bp, Homo sapiens
tatatatgtatgtgtgtgtatatctatctatatatatagatatatatatatatatatatata

SEQ ID NO: 6443 - DNA, 96 bp, Homo sapiens
aggaatagtcatagatttctcgatttcaaaaacatatatatatatatatatatatagagagagagagagagagagagagagtgtcttaaaaatcct

SEQ ID NO: 6444 - DNA, 98 bp, Homo sapiens
gtgtgtagatgtgtttatatatatatacaggtatgtacgtatgtgtgttgctttatatgtatatgtgtgtatatatatgtatgtacacatttttatat

SEQ ID NO: 6445 - DNA, 118 bp, Homo sapiens
ctctatatgtatatatatatacacatatatatgtgtgtgtatatatatgtatatatatatctgtgtgtatatatatacgtatatatgtgtgtgtgtgtgtatatatatatatatagag

SEQ ID NO: 6446 - DNA, 88 bp, Homo sapiens
gtaactgatctgaagggaaaagtgatgtattgatgtatttatgtatacaatattgatgcacctactttttctctgagaccttggccac

SEQ ID NO: 6447 - DNA, 69 bp, Homo sapiens
tttatctgatgatcagtggtgttgagcatatttttatatatgttttccacttgtgcgtcatcttttgaa

SEQ ID NO: 6448 - DNA, 101 bp, Homo sapiens
ccttgttatgtgtttgtgtatgatttacttgtatgtatgtatatatctatgcacacacatatatgtgcatttgtacacatgagcacacatgaagagagagg

SEQ ID NO: 6449 - DNA, 106 bp, Homo sapiens
gatgaagatagaatgagaagaagtagcagtgatctcagaagcctagaggggcaatgctctatctatctatctatctatctatctatctatctatctatctatcatc

SEQ ID NO: 6450 - DNA, 118 bp, Homo sapiens
gctgcaaaggcaggagttcttgggctttattatattatctaccaagtttttttctttaaatgagataaaacctgggaaataggacaaaatatctgcttcaggtttccttaccgtcagt

SEQ ID NO: 6451 - DNA, 71 bp, Homo sapiens
tatttatacgtgtatatatttatctgtaaatatgtactatatatatatatacatgtatgcacgtgtgtata

SEQ ID NO: 6452 - DNA, 80 bp, Homo sapiens
gatccctcccaggcattttttcaaggatagattttccttagaattgtgaggaatgaagtctgggtgcttgtggacagatc

SEQ ID NO: 6453 - DNA, 68 bp, Homo sapiens
agaatattcttatatatgtaagcatatataagcttacatatatatgcttatatatatgtaagcattct

SEQ ID NO: 6454 - DNA, 95 bp, Homo sapiens
gtatcagttaagtatatggtttctagccaagtttacattgtggctcagccactcactgtctatgagactttatgctttatttaaacctcttgtgc

SEQ ID NO: 6455 - DNA, 118 bp, Homo sapiens
aacctattcttctctactcgggattgtgcattttcctaatgtttctgagagaagaatctcaggttaccttggtggacacagcagtttatctcagagccagtggaagagatacttaagg

SEQ ID NO: 6456 - DNA, 70 bp, Homo sapiens
gttcctgcaaagaggatgatcgggggagtcttctatttagccatctcactctgcctctctctcatggagc

SEQ ID NO: 6457 - DNA, 86 bp, Homo sapiens
catatatatatatatatgtgtgcgtgtgtgtgtatatatacatatgtgtgtgtgtgtgtgtatatatatatatgttaactacacat

SEQ ID NO: 6458 - DNA, 86 bp, Homo sapiens
catacatatatacatatgtgtgtgtgtgtgtgtgtgtgtatcacaaaacatcaacgtgtatatacatgtgtgtgtatatatgtatg

SEQ ID NO: 6459 - DNA, 161 bp, Homo sapiens
tatatgtatatatatatttatatgtatatatatgtatatatatatttatatgtatatatatgtatatatatatttatatgtatatatatttatatgtatatatatatgtgtatatatatttatatgtatatatatattttatatatataaaataaattgca

SEQ ID NO: 6460 - DNA, 103 bp, Homo sapiens
atcatctggcaacacagtccactgtagactatcagttgttaacactagtgattttgtggttgactgggagctatggctggctgctgctgtccagcattgtgat

SEQ ID NO: 6461 - DNA, 119 bp, Homo sapiens
gtatacatgtgtatatgtatacatgtgtgcatatgtataagtgtgtgtacatatgtgtatatgtatatgtgtgtatacatatatgtgtgtatgcatatatgtatacatatatactatat

SEQ ID NO: 6462 - DNA, 106 bp, Homo sapiens
gagatgactaaaattaaattgctttacaatattctttttttggtggggggcggatagagtctctctctgtcacccaggctggagtacagtggtgcgatctcatctc

SEQ ID NO: 6463 - DNA, 99 bp, Homo sapiens
gtgacaagtttatttgatatattcttgtgatgtgtatatatatttgtgtgtgtatgtaggtatataatgcacacacacacattttcatggaatttgcac

SEQ ID NO: 6464 - DNA, 80 bp, Homo sapiens
tgctgtgctggacaggtttgggtgagtataacacatgttggatgctgtcatactctctctgaaacctctctatggctgta

SEQ ID NO: 6465 - DNA, 56 bp, Homo sapiens
gagtcagggtctcactctgtcactcaggctggagtgcagtggtgcgatcatgtctc

SEQ ID NO: 6466 - DNA, 78 bp, Homo sapiens
gtctgggttaggataaggagttgcggagtcaaagtttctttttttttttgagacggagtctcactctgtcacccaggc

SEQ ID NO: 6467 - DNA, 95 bp, Homo sapiens; identical to SEQ ID NO: 68

SEQ ID NO: 6468 - DNA, 93 bp, Homo sapiens; identical to SEQ ID NO: 69

SEQ ID NO: 6469 - DNA, 75 bp, Homo sapiens
gctcccactgagaacaagcaacaaccttcagctgtgggcggacgctgactcacagactgtgttgctactcagagc

SEQ ID NO: 6470 - DNA, 93 bp, Homo sapiens
tgcttagataaagcaaatttccatatatatttttttctaccttcatgcctaggtagagatcctagatatgttgagctttattttatttctgca

SEQ ID NO: 6471 - DNA, 156 bp, Homo sapiens
tatatatacatgtggaattattttatacatattttatatattatatataaaatagaccccatattgtgtgtatatatgtgtatacatatgtgtgtgtgtatatgtatatatatatatatatatatatatatatacacacacacacacacacacaca

SEQ ID NO: 6472 - DNA, 100 bp, Homo sapiens
gctgaggggtttttttggtgggggacaggttggtttgtatgttttttgtttgtttttaaatcattggaggttaaatttatggttttatacttctttcagc

SEQ ID NO: 6473 - DNA, 68 bp, Homo sapiens
ggcagacagactgacattttttttttttggaaaggcccagagaataaatattttagtctttgtgagcc

SEQ ID NO: 6474 - DNA, 70 bp, Homo sapiens
tgggtggggtggtgtgcatctgtagtcccagctactcaggaggctgaggtagaagaatcacttgaaccca

SEQ ID NO: 6475 - DNA, 105 bp, Homo sapiens
gacagaatgagactccatgtcaaaaaaaataaataaataaataaaaagtcaccaaacggaaatggaatttttttttttttttttgagacggagtctcactctgtc

SEQ ID NO: 6476 - DNA, 115 bp, Homo sapiens
tcagctttgttttttttgcttaggattgtcttggctatatgggttcttttttggttccatatgaaatttaaagtagttttttctaattctgtgaagaaagtcaatggtagcttga

SEQ ID NO: 6477 - DNA, 88 bp, Homo sapiens
tctttgctgttaggagttagtattatagccttgttataagctataacaaggcttataacaagccttgtgatttagttctagcaaacga

SEQ ID NO: 6478 - DNA, 78 bp, Homo sapiens
tatttacagaagaatgcatataacataatacatttttgtttaaaagtacacttgtgcatatgtgtttctctgtgtgta

SEQ ID NO: 6479 - DNA, 87 bp, Homo sapiens
aagttgttttaggtcatatttttaaaattttaaaatgctcttagaaagtaagagctttgaacatgtaattgttttttggaacaactt

SEQ ID NO: 6480 - DNA, 97 bp, Homo sapiens
attctgtggaataacagtgttgattttttttctaataagcaggtttatttctttgagcttgtataggtttgattttttacactttgttagactggat

SEQ ID NO: 6481 - DNA, 106 bp, Homo sapiens
aggattttctttttctttctttttttttttttttttttttttttgttactcacgtttcctagtgaggatgaaatacaagaaagactgcaggatagaggaaaaccct

SEQ ID NO: 6482 - DNA, 100 bp, Homo sapiens
gggctttatgaacaagaaattaaggaatcattatcattgtatttttaaaatgtggaaataatcagaagtgaaacctggtagttttcaagtctgtgagcct

SEQ ID NO: 6483 - DNA, 107 bp, Homo sapiens
aggctttcctctgtgcatgtatgtccctggtgtctatctgtgtgtcagaatttcctcttcttataaggacacctgtcagattagattaaggtctatactaatggcct

SEQ ID NO: 6484 - DNA, 109 bp, Homo sapiens
gctgcaataattatgggagtgcagatatctttaacatattgaatttattttctttggatatatattcaatagtgggattgctgaaatatctggtagttttatttttagt

SEQ ID NO: 6485 - DNA, 106 bp, Homo sapiens
attaacttcaagtatatgtacaattaaaacgttttaggtaggttttttattttattattattatactttaagttttagggtacatgtgcacaatgtgcaggttagt

SEQ ID NO: 6486 - DNA, 111 bp, Homo sapiens
gagtagctataggcatttatatatgtacatgtgtatgtgtatatatatatgtacatatatacataagtgtgtgtatatatatgtatgtgtatatataacttatgactattt

SEQ ID NO: 6487 - DNA, 90 bp, Homo sapiens
gtgctttttaaaattttggcagttgtgaggaacaagtatctttgttttttgaattaaaggcaaactcagaactcagtgccaagagggtac

SEQ ID NO: 6488 - DNA, 68 bp, Homo sapiens
ctacaatgtgtctcagtttctctttcacaccttggagtggaagacaatctctactcacactgttgtgg

SEQ ID NO: 6489 - DNA, 100 bp, Homo sapiens
gtgaaaaaagattgtgtgaaaaaaaatgtgcgtgtgtgtatgtatatatacatatatatgttaacatatgtatgttaattgctgcataacaaaagactac

SEQ ID NO: 6490 - DNA, 111 bp, Homo sapiens
gtcatcagactgtcggtacgaggtaagttgtatgtttgattaatttttaagatttagttgtagaataagctagaaatgttctttttatataagcttcagatatatggtggc

SEQ ID NO: 6491 - DNA, 95 bp, Homo sapiens; identical to SEQ ID NO: 68

SEQ ID NO: 6492 - DNA, 93 bp, Homo sapiens; identical to SEQ ID NO: 69

SEQ ID NO: 6493 - DNA, 76 bp, Homo sapiens
ggtttgtccctgcagtagccagtaacacaggctcccgcttcctgggcatctgtctctctctctctctgggcatacc

SEQ ID NO: 6494 - DNA, 95 bp, Homo sapiens; identical to SEQ ID NO: 68

SEQ ID NO: 6495 - DNA, 93 bp, Homo sapiens; identical to SEQ ID NO: 69

SEQ ID NO: 6496 - DNA, 65 bp, Homo sapiens
tgagaaagagtctcactctgttgctctgtcacccaggctggagtgcagtggcatgattcagctca

SEQ ID NO: 6497 - DNA, 77 bp, Homo sapiens
ccaagtttctgactctgtcactttaatcatgtattctttacccacatggcctaaagagaaggctcagaaaagactgg

SEQ ID NO: 6498 - DNA, 124 bp, Homo sapiens
catgagcatttggccatgagcacagcagatggagaattatggagcagataaacaagattcaatatttttttttgtcgaaaccctgaatttgtgtctggctctgtgtcttgtgtgaaatgtggtc

SEQ ID NO: 6499 - DNA, 125 bp, Homo sapiens
tgacagactgggactttgtctcttttctcttttttttttggagacagactctcgctctgtcacccaggctggagtgcagtggtagtggtgtaatcacagctcattgcagcctcaacctcgcgggc

SEQ ID NO: 6500 - DNA, 87 bp, Homo sapiens
gcaggttatttactggggaatgttttcaggcacaaccctggtggggatgaggagagcaggactgggtagaaggagaagttgatctgt

SEQ ID NO: 6501 - DNA, 64 bp, Homo sapiens
tctctctctctctctcttttgagacagagtctcgctctgtcgcctaggctggagtgtgcagtgg

SEQ ID NO: 6502 - DNA, 110 bp, Homo sapiens
gtccataacaaggtttcagaggaaagcacagatgtttaaggtagtttagttgagcgataagctgaatgccattcgtgtttgctcgccgttggttgacctgcctagtggtc

SEQ ID NO: 6503 - DNA, 58 bp, Homo sapiens
tgagacggggtctcactctgtcgctcagcctggagtgcagtggtgctatctcggctca

SEQ ID NO: 6504 - DNA, 119 bp, Homo sapiens
gcctggacaacagagttgagactctgtctcaaaaaaacaaaaaacaaaacgaaacaacaaaaaaaagttttttgttttttgttttttttttgaggtggaatcttcctctgtcgccaggc

SEQ ID NO: 6505 - DNA, 82 bp, Homo sapiens
agactctgtctctaaataaataactcagatgtaagtgtatttcaccatcgaatatttttatttattttgagagacagactct

SEQ ID NO: 6506 - DNA, 86 bp, Homo sapiens
cctgctcactctgtccctgtcactgtggcctgcttactgctcctcatagcttccaagcatggtctactgcggggcctgtgctctgg

SEQ ID NO: 6507 - DNA, 95 bp, Homo sapiens; identical to SEQ ID NO: 68

SEQ ID NO: 6508 - DNA, 93 bp, Homo sapiens; identical to SEQ ID NO: 69

SEQ ID NO: 6509 - DNA, 117 bp, Homo sapiens
agggaatggattggatgatacataattaactcttagaagctttgtgtctttggtaaactcggtgatccaaagttgcctagtagctatcagaatattatgctacattttcttttctct

SEQ ID NO: 6510 - DNA, 95 bp, Homo sapiens; identical to SEQ ID NO: 68

SEQ ID NO: 6511 - DNA, 93 bp, Homo sapiens; identical to SEQ ID NO: 69

SEQ ID NO: 6512 - DNA, 95 bp, Homo sapiens; identical to SEQ ID NO: 68

SEQ ID NO: 6513 - DNA, 93 bp, Homo sapiens; identical to SEQ ID NO: 69

SEQ ID NO: 6514 - DNA, 82 bp, Homo sapiens
tctggcaatgttgggagacatttttgattatcataactatggggagcctagggatacttctaaacatcctacagtgcacagg

SEQ ID NO: 6515 - DNA, 101 bp, Homo sapiens
gattggctcctgggcagccttttgggatacctggtttcagagttgggggcattcttctctccctgactcgggccaggtgtcttttcccaggatgtcccttc

SEQ ID NO: 6516 - DNA, 94 bp, Homo sapiens
gggagttcgaatatgaagccctggctggaaagtcaggagccctgggttctacccggttctgtcactcactggctgtgtgctctgaagaagtcct

SEQ ID NO: 6517 - DNA, 116 bp, Homo sapiens
aggacattgatggggtatgttatatggggaggaagctttcaaaggagagagaggtcagagtgcacatagcatggtcttctctctctcctccccaacccaacaatcagggctgacct

SEQ ID NO: 6518 - DNA, 88 bp, Homo sapiens
accctgtgttaagcaagtctactggtggcatttcgtgtctcattttggcatcgtgtgctcactttgtgtctctgtgtcacattttggt

SEQ ID NO: 6519 - DNA, 96 bp, Homo sapiens
ggagttaagcaagttgcctgaagtcacacagcatacgacagctgagctttaaacccaggtctgtgtgacttttgctaataaactggttgcctctcc

SEQ ID NO: 6520 - DNA, 64 bp, Homo sapiens
tagtaacaggagtgcagaatcagcactctcctgagctggatgctgagatctgtctctgaaacta

SEQ ID NO: 6521 - DNA, 83 bp, Homo sapiens
ggtctcactctgtcactcagactagagcgcagtggcacaatctggctcactgcaacctccacctcctgggcgcaagtgattcc

SEQ ID NO: 6522 - DNA, 114 bp, Homo sapiens
tagttgccaatttctagatttccaatgagttttattttttatcatgtgtagtgagctcaatgctgatccccaaagatactcatttcctggaaaagcagatcattgtgcatatta

SEQ ID NO: 6523 - DNA, 94 bp, Homo sapiens
tgtggttctgcacatgaatgataatggaaatggattttggtattaggcaatcctggatttattttctttaatttttaacttttgcaggtacata

SEQ ID NO: 6524 - DNA, 71 bp, Homo sapiens
gttgtttgagacagggtctcactctgtcacacaggccgatgtgcagaggtgcaatcatgtctcactgcagc

SEQ ID NO: 6525 - DNA, 111 bp, Homo sapiens
tgggataaatgcctaagaatacaaatgttggattgtatggtagttgcatgtttagttttacgagaaactatcaaactattttccagagtaatgtatcattttgtattccca

SEQ ID NO: 6526 - DNA, 67 bp, Homo sapiens
cctgatatgtatacatatacatacatacatatacatatgtgtatatgtatatatgtatgtatcagtg

SEQ ID NO: 6527 - DNA, 104 bp, Homo sapiens
actttactcttaaataaaaaattaaaattcctcaaaaatatggttctttgtttatatatagacagtcatatgctgtataatgaggttttggtcaacagtagagt

SEQ ID NO: 6528 - DNA, 82 bp, Homo sapiens
atatatatatatatatatctgtgtgtgtgtatatatgtatatatgtgtatataggtacatatatgtatatatgtgtgtgtat

SEQ ID NO: 6529 - DNA, 103 bp, Homo sapiens
ggatggatggatggatggatggatggatgattagctgtgattaattatatatttgcctcttaatatttattcatttaaattaccaaactttccactattatct

SEQ ID NO: 6530 - DNA, 86 bp, Homo sapiens
ccaggtttgtgacagtacaaagtgaggaatcagagacagaccagggagaggagtttccagcctggctcatactgtagcaagaatgg

SEQ ID NO: 6531 - DNA, 60 bp, Homo sapiens
tgtatgtgtctcagtatatgtgtgtatatgtatgtatatatgcatacacacacacataca

SEQ ID NO: 6532 - DNA, 93 bp, Homo sapiens
ctagtaatcttggacatagggagaccatttcttgtcattgtatcatcttttttttttttttgagaccgagtctcactgtgtcacccaggctgg

SEQ ID NO: 6533 - DNA, 112 bp, Homo sapiens
gctatgataaggtaaaaatgcaacagctataagtcacgataagattttttttttcttttttgagaaggagtcttgctctgtcgcccaggctggagtgcaatgttgtgatctc

SEQ ID NO: 6534 - DNA, 85 bp, Homo sapiens
gtgtgtgtttgtaggagttggagccatgggtgatttattattttatactttattaccttttctgatacttgtataataagcacac

SEQ ID NO: 6535 - DNA, 91 bp, Homo sapiens
ttgtatgttgattttatatcctgcaactttactgaatttgtttataaattctaagagtttttaggtagagtctagatttttcaatatacaa

SEQ ID NO: 6536 - DNA, 95 bp, Homo sapiens; identical to SEQ ID NO: 68

SEQ ID NO: 6537 - DNA, 93 bp, Homo sapiens; identical to SEQ ID NO: 69

SEQ ID NO: 6538 - DNA, 95 bp, Homo sapiens; identical to SEQ ID NO: 68

SEQ ID NO: 6539 - DNA, 93 bp, Homo sapiens; identical to SEQ ID NO: 69

SEQ ID NO: 6540 - DNA, 85 bp, Homo sapiens
tcccatgaacctaaagaccaggaattctctgatggctgggaactcaatctctcagagtcacagttttctcatctgttaaatggga

SEQ ID NO: 6541 - DNA, 84 bp, Homo sapiens
cccaatagattaggaatctgaatgtttttctttcaaatgctaacagcattaggtaggattatctcgatgtctaatgctatttgg

SEQ ID NO: 6542 - DNA, 63 bp, Homo sapiens
tttttcatttacatatgaatggaatgtatagacatatatatacatttatatataaatggaaaa

SEQ ID NO: 6543 - DNA, 77 bp, Homo sapiens
gctgtgtgtttcatgctcatgttcccctctgagtctgtctgaagacagaacagaatcaggacatgaggagactcggc

SEQ ID NO: 6544 - DNA, 79 bp, Homo sapiens
gacttttaagttcagcaagtacttaggccagaagccatgtgaaggatgggtggggagtacactctgagcactgagggtt

SEQ ID NO: 6545 - DNA, 87 bp, Homo sapiens
tgagtacagagtttttgttggggataatgaaaacattttgtatatataagatagtagtggttgttacacaacattataatgtattta

SEQ ID NO: 6546 - DNA, 81 bp, Homo sapiens
cacaaaggttagcaaagatcctgaaaactcttcaaactttatatttgttactttcagagaagtttctttgtaggccatgtg

SEQ ID NO: 6547 - DNA, 94 bp, Homo sapiens
gcatcattgttcatcaaggatattggcctgaagttttccttttttttcttttttttggtcatatctctgccaggtttcagtatgaggatgatgc

SEQ ID NO: 6548 - DNA, 103 bp, Homo sapiens
tgcagtcttttctcttgctttgtggctagcgttttcttttttcttttctttctttttttgagatagaatctctctctgtcgcccaggctggagtgtagtagca

SEQ ID NO: 6549 - DNA, 101 bp, Homo sapiens
ggaaagtgactactgaagatgtgaaatggactaggcaaggaaaataaagttgctttaacttttttgaatttcatatttcatcttcagcctgaaacttggct

SEQ ID NO: 6550 - DNA, 105 bp, Homo sapiens
gaatcctgcctctgcacccatctcatggctgaagtcctgctgctacagccagatctccctggctctgtgtatcccttcagtgatacactggctctggggccgttc

SEQ ID NO: 6551 - DNA, 97 bp, Homo sapiens; identical to SEQ ID NO: 1307

SEQ ID NO: 6552 - DNA, 88 bp, Homo sapiens; identical to SEQ ID NO: 1308

SEQ ID NO: 6553 - DNA, 81 bp, Homo sapiens; identical to SEQ ID NO: 1309

SEQ ID NO: 6554 - DNA, 77 bp, Homo sapiens; identical to SEQ ID NO: 1310

SEQ ID NO: 6555 - DNA, 78 bp, Homo sapiens
gtgtatatatatgtctatacatatgcatacacatacatacaccttatggatatatatatcttagtcatatatatacac

SEQ ID NO: 6556 - DNA, 114 bp, Homo sapiens
tgtgtgtacatgtgtgtgtatgtgtgtatatatatacacatatatgtatatatgtatatgtgtgtatatacatgtatgtgtatatacacatatatacatgtatgtgtatacata

SEQ ID NO: 6557 - DNA, 67 bp, Homo sapiens
gtgtgcgtctgtgtctgtgtgtgtgcatgcatgcatgcccaagaaggggacaaggtaggatgtgtat

SEQ ID NO: 6558 - DNA, 127 bp, Homo sapiens
ctccccagtgagagttttcacttaacttttttttttttttttttttttttgagatggagtttcactctcactcaggctggagtgcagtggcatgatctcggctcactgcagcctccgcctcctgggt

SEQ ID NO: 6559 - DNA, 201 bp, Homo sapiens
tatatatgtatatatatatagtgtgtatatatgtgtatatatacaaggatgtgtgtatatatgtgtatatatacaaggatgtgtgtatatatgtgtatatatacaaggatgtatgtatatacatatgtatgtgtgtgtgtgtgtgtgtgtatctatatatatatatatatatatatatatagtctttcactcctatattct

SEQ ID NO: 6560 - DNA, 93 bp, Homo sapiens
ggagagaacaaaattattccacaaattaaataaaactttctgaagttagcatttcagaaatctttatttaattttcagaattccagttcttct

SEQ ID NO: 6561 - DNA, 118 bp, Homo sapiens
tcctatgggatcccagttccataactattcatttatttctgtagtattaagtgttcaatttatttattacttagttcaaatagcttagcatataagtgggacccagagctgtcgggga

SEQ ID NO: 6562 - DNA, 74 bp, Homo sapiens
ccctctcagtgtgtctctctctgcggcttgtcagtgagtccggctctggctgctggcagaggcggccgagaggg

SEQ ID NO: 6563 - DNA, 110 bp, Homo sapiens
ggtgtggtggcactcgcctatagtcctagctacttgggaggctgaggtaggaggatcccttgagcccaggagttccaggttacagtgagctatcattgtgtcactgcact

SEQ ID NO: 6564 - DNA, 110 bp, Homo sapiens
aatgactacaggtaaagggctagaaatttttagacaaaaggccagtgggtatcacagggagctttccagttggctgttttggcagaatggcaagactttccttcctcatt

SEQ ID NO: 6565 - DNA, 76 bp, Homo sapiens
tttgctttttttgagatggagtctcactctgtcacccaggctggagtgcagtggtgccatctcagctcactgcaag

SEQ ID NO: 6566 - DNA, 116 bp, Homo sapiens
gtaaatgtgttcttgtatatgtgtatgtatttcctcaattctaaggttgtttttttttatatttcagtgattccaaaatgaggataaatcatacacttaatataaatattttttac

SEQ ID NO: 6567 - DNA, 117 bp, Homo sapiens
taggagttcctgagggggtagacagcagatgcttaatggtttttgaatgaatagatgtgtgggaataaatacatggctaaaggaaatcatggcagtgaggtctctatgaactgacta

SEQ ID NO: 6568 - DNA, 81 bp, Homo sapiens
gccataaatagagcagtggattcctgatctcgatgtttctcagctggacacatctcagtgagtacatgcctcccacctggc

SEQ ID NO: 6569 - DNA, 99 bp, Homo sapiens
gctggcagccaggtgctccttgtaggacagagtatgtaattatgaatattttaaatgtgggtagttgatcccttttctattcagcatgtagctgtgagt

SEQ ID NO: 6570 - DNA, 104 bp, Homo sapiens
atatatatgtgttgatatttactcgttgatatatatgtgtgtgtgtatatatatatatatgtacatatatatatatcaacgagtacataaagacactctggtat

SEQ ID NO: 6571 - DNA, 74 bp, Homo sapiens
tatgtactcgttgatatatatatatgtacatatatatatatatacacacacacatatatatcaacgagtaaata

SEQ ID NO: 6572 - DNA, 72 bp, Homo sapiens
ggtaaggaaaggaggtaggttgggcctgttaaaatgatctgaggtctcacactctttctcaatttcattacc

SEQ ID NO: 6573 - DNA, 107 bp, Homo sapiens
atgtgggaccagcacagagaaagcagaagagattagaaaattcagatggatggcaacagatggaatatttatttatttcaaatgcttttttgctgggagagacacat

SEQ ID NO: 6574 - DNA, 94 bp, Homo sapiens
tgtatactgctagtatgtatatattaagtacatagtatatatgtatttaagtagcatgcatgtatattatgtatataatatatatgttatgtag

SEQ ID NO: 6575 - DNA, 80 bp, Homo sapiens
tcagttgcatcttgggcaacacaattgtacatggagaccctgatcctgacagttgtctctgacctcccctgtgcagctgg

SEQ ID NO: 6576 - DNA, 109 bp, Homo sapiens
caaatgtttatgaggactagaggctaaaataaaaaaagtctgtgagtgatactcttctagaatttattatttttgttttgccacctactcttcctctttataatttttg

SEQ ID NO: 6577 - DNA, 84 bp, Homo sapiens
gatacaagccgtctctttcactctcactttgccaaaaatgtaggtcccatgtgagggatgaggcgagaaaattaggttaggatc

SEQ ID NO: 6578 - DNA, 108 bp, Homo sapiens
ccaagatcaagatgtcaacaggtttggtttcttctttttttatttattatttttatagatttagagggtacaagtgcaggtttgttatatggatatattgaatattgg

SEQ ID NO: 6579 - DNA, 69 bp, Homo sapiens
gggggcttccaggtcttaggcagataaaagacagatggttgtattcttttgagtttctgattagcctct

SEQ ID NO: 6580 - DNA, 95 bp, Homo sapiens; identical to SEQ ID NO: 68

SEQ ID NO: 6581 - DNA, 93 bp, Homo sapiens; identical to SEQ ID NO: 69

SEQ ID NO: 6582 - DNA, 92 bp, Homo sapiens
ctcttctctcttctattcactttctccaggctgctctgtatctctgtttctcagaactgtatctctgtgaaagtttatggcaagatcttgag

SEQ ID NO: 6583 - DNA, 105 bp, Homo sapiens
atacataggtactgtggataatcagggagtcatgttcattgtttttttatgtctaaagatcttgaatgactttcatgagcatgtttcagaaacatattcatgtgt

SEQ ID NO: 6584 - DNA, 115 bp, Homo sapiens
catagcattaaatagtaaatattaataatgattaactgttaatattgttagtattttaaatattaataataaatattaacaggtattgttattgtcatcactgttcttatctatg

SEQ ID NO: 6585 - DNA, 84 bp, Homo sapiens
catatatacacatatatacatacacgtatatgtatatatgtgtatgtatatgtacatatatgtatatatgtatgtgtgtatatg

SEQ ID NO: 6586 - DNA, 94 bp, Homo sapiens
atacatatatacatatatgtacatatacatacacatatatacatatacgtgtatgtatatatgtgtatatatgtatatgtgtgtatatgtatat

SEQ ID NO: 6587 - DNA, 97 bp, Homo sapiens
gcactgagccattcaaggatccactcagtctcactgtttcttttaagatcaagtttaaacttcccactctgggactgtaggcccctctcagtcaggc

SEQ ID NO: 6588 - DNA, 161 bp, Homo sapiens
taatatatatatgtatgtatgtgtgtgtgtatatatatttttatatgttttatatatatttatatattatatatctatatataaatatatattatataaatatatatataatataatatataaatatatatataatataatatatatttttttttggtaga

SEQ ID NO: 6589 - DNA, 115 bp, Homo sapiens
agtggtgtgtgtgtgcctgtagttccagctacttgggagactgaggtagaaggatctcttgagcccaggagttcagggctgtagtgtgcaataatcacacatgtcaatagccgct

SEQ ID NO: 6590 - DNA, 74 bp, Homo sapiens
gagtctcactctgtcacccagggtggggtgcagtggcgcctgcaacctctgccgcctgggttcaagtgattctc

SEQ ID NO: 6591 - DNA, 115 bp, Homo sapiens
tcatttaaatgtactgttgaatttgatttgctagtattttgttatgagtttttatatgtatattcatcagagatattgacctgcagttttcatttcttgtggtgtctttgtttgg

SEQ ID NO: 6592 - DNA, 68 bp, Homo sapiens
ttgttgagacggagtgtccctctgtcactcacgctggagtgcaatggtgtcatctcggctcactgcaa

SEQ ID NO: 6593 - DNA, 57 bp, Homo sapiens
tgagacagggtctcactctgtcacccaggctggagtgcagggcgcaatcttggctca

SEQ ID NO: 6594 - DNA, 97 bp, Homo sapiens
tcagtaccaagctgttttggttactgtagccttatatttttttaaatttttttatttctatgggttattaggaaacaggaggtgtttggttacatga

SEQ ID NO: 6595 - DNA, 58 bp, Homo sapiens
tctgggtggctggagtgcacttttttttttgagacagagtctctctctgccacccagg

SEQ ID NO: 6596 - DNA, 85 bp, Homo sapiens
tttttttgagacggagtctcgctctgtcacccagactggagtgcagtggtgcgatctcagctcactgaaagctctgcctcccggg

SEQ ID NO: 6597 - DNA, 77 bp, Homo sapiens
tgtcactagagaatttgatgttggtcagcacattgccagtggtggcagtgggctagcttggaagatttttaatggca

SEQ ID NO: 6598 - DNA, 137 bp, Homo sapiens
cagttacaaaggcccagagttaagagagtgatgaagaattaaaagaagtaacaaaaggtctgtgtctctgtgactgagtatgagcaaggaggagagtggtacaagatgagggaggagaagcaggcaggggccagact

SEQ ID NO: 6599 - DNA, 95 bp, Homo sapiens
gattttttacttatagatcctgggcaaggagggcacagtgagtcaggagggcagtccgtcagtccctgggtcatgagaagcaggaatgaaaagtc

SEQ ID NO: 6600 - DNA, 103 bp, Homo sapiens
tgctcaagagtgcaattggtgggtcatagggtagttgcatgtatagtttttttaaagaaactgaataaaaggcaagatggtttactaggagaacacatggaca

SEQ ID NO: 6601 - DNA, 139 bp, Homo sapiens
gatggtgacctgttagggactctgtttagttctttttttttttttttttttttgaaacagagtctcgcactgtctcccaggccggagtgaggtggcgccatctcggcctcactgcaacctctgcttcctgcgttcaagc

SEQ ID NO: 6602 - DNA, 97 bp, Homo sapiens
ctgggaactgcagacgggagctgctcctatttggctatcttggcttttttttttttttttttccaagatggagtctcattctgtcgccctcccccag

SEQ ID NO: 6603 - DNA, 92 bp, Homo sapiens
gtcatgcagcactttccccctgtgtatctctgtatctgtgtctattctaataaggacagcagtcatactggattagggttcatcctaatgac

SEQ ID NO: 6604 - DNA, 57 bp, Homo sapiens
tacgttttgtgtgtgtgtatcttgtgtatatatatatatatgcacacacgatatgta

SEQ ID NO: 6605 - DNA, 58 bp, Homo sapiens; identical to SEQ ID NO: 3040

SEQ ID NO: 6606 - DNA, 56 bp, Homo sapiens; identical to SEQ ID NO: 3041

SEQ ID NO: 6607 - DNA, 80 bp, Homo sapiens
cctttgaacacttggaatctgtttctataatagcctggatgatggccgttaggagtggattgatgtgaggagtttgtagg

SEQ ID NO: 6608 - DNA, 80 bp, Homo sapiens
cagtgtggaagttcagctgctcagtgacttgccatggttcagacccagtgacaggtgtgtgagaactgatgctatctctg

SEQ ID NO: 6609 - DNA, 82 bp, Homo sapiens
gttttggggaaaactttgtttgttacccttaccaggacaaaattttgccctgtcagttgacagtgagaattccctagttaac

SEQ ID NO: 6610 - DNA, 76 bp, Homo sapiens
gtcagctaggttgagacacagctggattcaggattgacaatctcttttcctgtctcactctctgtctgcctctgtc

SEQ ID NO: 6611 - DNA, 114 bp, Homo sapiens
cttgtatagcctgttggagagacatgtgctgcatatatatatatatatatatatatatatatatatatatatatatatatatcagacattacattactgcaatgataatacagg

SEQ ID NO: 6612 - DNA, 58 bp, Homo sapiens
tgagttggagtctcactctgtcacccaggctggagtgcaatggcgtgattttggctca

SEQ ID NO: 6613 - DNA, 56 bp, Homo sapiens
gagacagggtctcagtctgtcactcaggctggagtgcagtggtgtgatcatgtctc

SEQ ID NO: 6614 - DNA, 77 bp, Homo sapiens
gacgtgaaagaaagaattatagagaggatggtggaagctaaatgacactttcactcactgcattttttcactcagtc

SEQ ID NO: 6615 - DNA, 58 bp, Homo sapiens; identical to SEQ ID NO: 47

SEQ ID NO: 6616 - DNA, 123 bp, Homo sapiens
tctgtggctgaaaagattttacagcaattcatgtcaaatattagctcaaactaggtttttttaaaaaatatttttaaactttagtttctactcagtgacattagttctgtgctatgaggtcac

SEQ ID NO: 6617 - DNA, 58 bp, Homo sapiens
tgagacagggtctcactctgtcacccaggctggagtgcagtggtgtgatcttggctca

SEQ ID NO: 6618 - DNA, 56 bp, Homo sapiens
gagacagggtctcactctgtcacccaggctggagtgcagtggtgtgatcttggctc

SEQ ID NO: 6619 - DNA, 112 bp, Homo sapiens
atatgtatacatgtgccatgttggtgtgctgcacccattaattttttttattttttttattatactttaagttctagggtacatgtgcacaatgtgcaggtttgttacatat

SEQ ID NO: 6620 - DNA, 96 bp, Homo sapiens
ctgggtgaaagagtgagacctcatctctattttttttcttctttctttcttttttttttttttttttttgagacggagtctcactctgtcgcccag

SEQ ID NO: 6621 - DNA, 123 bp, Homo sapiens
gtgagtggaggaggacaccactgtacatgtgaggaggaagaaacagctgaacatttaatgaattccttttttttttttttttttttaaggcagagtctcactctcttgcacacactggagtcc

SEQ ID NO: 6622 - DNA, 105 bp, Homo sapiens
gttcggattatagatgtgagtcactgcacccaactcagaaattattaatggacaagaatttcttttttttttttttgagagggagtctcgctctgtcacccaggc

SEQ ID NO: 6623 - DNA, 58 bp, Homo sapiens; identical to SEQ ID NO: 1763

SEQ ID NO: 6624 - DNA, 84 bp, Homo sapiens
gtgtgtgtatgtatatgtatgtgtgtgtatatgtatgtgtatatacgtatgtgtatatatatgtatatgtatatatatatgcat

SEQ ID NO: 6625 - DNA, 75 bp, Homo sapiens
ggaggcagaggtggaaggatggcttgagcctgggagggtgaggttgcagtgagccatactgcgccactgcattcc

SEQ ID NO: 6626 - DNA, 95 bp, Homo sapiens; identical to SEQ ID NO: 68

SEQ ID NO: 6627 - DNA, 93 bp, Homo sapiens; identical to SEQ ID NO: 69

SEQ ID NO: 6628 - DNA, 91 bp, Homo sapiens
ctactgggtccctttgcgcggtggtggaaggccttttttttttttttttgagaagaagtctctctctgtcacctaggctggagtgcagtgg

SEQ ID NO: 6629 - DNA, 58 bp, Homo sapiens; identical to SEQ ID NO: 3701

SEQ ID NO: 6630 - DNA, 79 bp, Homo sapiens
ggcgggggggggggagctgggaggagttgttgttgttttgattttttttgagacaaggtctcactctgtcacccatgct

SEQ ID NO: 6631 - DNA, 90 bp, Homo sapiens
tgcactccagcctgggcaacagagcaagactccatctcaaaaaaaaaaaaaaagagatatgtctcactctgtcacctaggcttaactgca

SEQ ID NO: 6632 - DNA, 58 bp, Homo sapiens
tgagtcggggtctcactctgtcacccaggctggagtacagtggtgtgatctcagctca

SEQ ID NO: 6633 - DNA, 118 bp, Homo sapiens
tcccaaagtgctgggattacaggcgtgagccactgcgcccagcccagtattttttttaatgtctaaagatttcagggcaggtgtggtggctcatgcctgtaatcccaacactttggga

SEQ ID NO: 6634 - DNA, 105 bp, Homo sapiens
cttctttaggatttgggctgaaaatgaagttcatttaaatgccagagattttcttcttgtatttcaacaggcttcttatttttttccctttctgttgtagggtag

SEQ ID NO: 6635 - DNA, 111 bp, Homo sapiens
gtgaatatatttgtgttcccatctcagtatttttaatactgagataaatatactgagatttttaatatttttaatttttaatactgagataaaatatactagtattttctc

SEQ ID NO: 6636 - DNA, 118 bp, Homo sapiens
ttagaagcagggcatggtgaaacatgcctgtagttccagctacttggaaggctgaggtaggaggatcccttgcatccagtatgaggctacagtgagctatgatcacacctgtcactag

SEQ ID NO: 6637 - DNA, 113 bp, Homo sapiens
actagttggaagctgggtgtggtggctcacacctgtaatcccagcactttgggaggctgaggtagctggatcatttgaggtcaggagttcaagaccagcctggccaacatagt

SEQ ID NO: 6638 - DNA, 59 bp, Homo sapiens
gttttcagaccctccctctctcgctgacggaggcaagtggagagaggaggaccggaggc

SEQ ID NO: 6639 - DNA, 58 bp, Homo sapiens
tgagacagagtctcactctgtcacccaggctggagtacagtggtgtgatctcggctca

SEQ ID NO: 6640 - DNA, 96 bp, Homo sapiens
catcacatggatcctcatccagtttgcatttaggtaaaaaaaaaaccaaaaccctttttatttgtatgtatacatgtatgtgtgtttgtgtgtgtg

SEQ ID NO: 6641 - DNA, 83 bp, Homo sapiens
ttgagacaagagtctcactctgtcaccaaggctggagggaagtgttgcgatctcagctcactcaagtgattctcttgcctcag

SEQ ID NO: 6642 - DNA, 87 bp, Homo sapiens
ccctgcttctgtagtggtgagctgtgggaactttttttttttttttttgatggagtctcgctctgtcaccaggctggagtgcagtgg

SEQ ID NO: 6643 - DNA, 75 bp, Homo sapiens
gacagtctcactctgtcacccaggccaggcgcttcggcatcccaaagagctaggattacaggtgtgagccactgc

SEQ ID NO: 6644 - DNA, 74 bp, Homo sapiens
actctagacccatggaaatggctctgatagcactctgctgtcctgtatctgagcatgttcatgtggttttaagt

SEQ ID NO: 6645 - DNA, 118 bp, Homo sapiens
gccagtagcatagtatcttccaatttctgtctgactctgactcccctgtctccctcttttttttttttttttgagatggagtcactctgttgcccaggctggagtgcaatggtgcggt

SEQ ID NO: 6646 - DNA, 88 bp, Homo sapiens
cctctgtgtctctgggtccctgtgtccaagtgttccttatttttttttgagacagtcttgctctgttgcccaggctggagtgcagtgg

SEQ ID NO: 6647 - DNA, 58 bp, Homo sapiens
tgagaaggagtctcactctgtctcccaggctggagtacagtgacacgatttcagctca

SEQ ID NO: 6648 - DNA, 115 bp, Homo sapiens
tcagcctcccgagtagctgggactacaggcgtgtgccaccacactcagctaattttcatatttttagtagagacggggtttcaccatgttgaccaggctggtcttgagctcctga

SEQ ID NO: 6649 - DNA, 58 bp, Homo sapiens; identical to SEQ ID NO: 2595

SEQ ID NO: 6650 - DNA, 116 bp, Homo sapiens
gttgaatctcttacagcagctccaacagattgaaatcagctgtctgactcactgtgttgaacaggacttctgaaacttcatatcagttcaatgggagcataggaaggggaggaggc

SEQ ID NO: 6651 - DNA, 83 bp, Homo sapiens
cctttattaacctctcataggtacaggcgataaaactgaagactgtgtgctttctcctagaaatattggaggaaaaataaagg

SEQ ID NO: 6652 - DNA, 84 bp, Homo sapiens
ttgagatggaatttcactcactctgtcacccaggctggagtgcagtggtgcgatctcagctcactgcaacctccaactgtgggt

SEQ ID NO: 6653 - DNA, 97 bp, Homo sapiens
gtgctctggtgaagatgtcattctcactggcctgtccagatgctgtattctgttgctatcacagtagaatgtctgctccaggtgcaggctggggaca

SEQ ID NO: 6654 - DNA, 84 bp, Homo sapiens
ctgaggtcagaacacagtcaggttagagcccatgcatgggcttactcatgtggctcaagccctaaggtcatggtggactcttag

SEQ ID NO: 6655 - DNA, 96 bp, Homo sapiens
aataaactgcagttctctttctgttatccttaagtgttaatttgttctatttttattgtagagccattttgaaattctgagagtctgttctttatt

SEQ ID NO: 6656 - DNA, 81 bp, Homo sapiens
ccaggtaataaacgcctgactgtgtgcaagtgcatcagcaaaagacccaggcatgagtaagcagtgtgtgatgttgcttgg

SEQ ID NO: 6657 - DNA, 86 bp, Homo sapiens
tgttgcattattttatcaaacaagtgatttttttttttttttgagacaagctttcactctgttgaccaaggtggagtaaagtggca

SEQ ID NO: 6658 - DNA, 116 bp, Homo sapiens
gctggaggtgatttttttcccttcttggtctgagagatgagcagttatttttctttttgaaaagagaaagccaattttcagtttataccagtaggtgtcatccattcacacaaagc

SEQ ID NO: 6659 - DNA, 66 bp, Homo sapiens
gtccccctctgactgacactcatattgaaaattaatccccagtgtaatagaattgggaggtggggc

SEQ ID NO: 6660 - DNA, 118 bp, Homo sapiens
gttttgcctataggtgttttcttggaccacctttcaatggaagtgtaatttattactttttttccaaaggagagtcttaggtgccctcgtcttaatatctaaattatgtgcatcctac

SEQ ID NO: 6661 - DNA, 117 bp, Homo sapiens
attgatttttaaaattgataacattatgacccaagagtatataaatatacatatttgatgtcagattcaagggtgtgggtctctaggtcaactgtgttctggtcgataagaattgat

SEQ ID NO: 6662 - DNA, 69 bp, Homo sapiens
gctggtgcagctatgtccaaacagagcagagagtgcccaggcaagctgttctattttggacatgccagt

SEQ ID NO: 6663 - DNA, 95 bp, Homo sapiens
gctgtccatccgcaggtccctagcagcagtgggcaggagcagtagaggtgactgatgactggcactgcagaggccagggtgcttcagggagcagc

SEQ ID NO: 6664 - DNA, 74 bp, Homo sapiens
gtgaatctgggaactcagcctcagtggtttgtggcacacatgagctcacagtcactctgacttccttccagcac

SEQ ID NO: 6665 - DNA, 100 bp, Homo sapiens
gaatttctgaagactggcaggtttcgctgtcctttgcaatgtagtgtagtaagtaaaaagatagccttgaagtcagagatctagtcagtatttaacattc

SEQ ID NO: 6666 - DNA, 119 bp, Homo sapiens
atacagtaaccagcagtttgcagaaagagatttcctgagaagaaaaatattcagatgaatctatctatctatctatctatctatctatctatatatgccacattttgttggttttgtat

SEQ ID NO: 6667 - DNA, 109 bp, Homo sapiens
gtttccgtggtaacagagtctaatgttatacataaatatgtatgtggtatgtatacatgtgtgtattataaatatatgctataggtgattatgactgtattccaagagc

SEQ ID NO: 6668 - DNA, 131 bp, Homo sapiens
atagacattcataaaaagtatatatgtgtatatatatgtatgtgtatatatgtatatatatgtgtgtgtgtatatatatacacatatataattatatgtgtgtgtgtatatatatatatatatatatatat

SEQ ID NO: 6669 - DNA, 61 bp, Homo sapiens
tgaggcagggtctcactctgactctcaggctgggggggggcagtggtgtgatcacatctca

SEQ ID NO: 6670 - DNA, 112 bp, Homo sapiens
cagtgtgtgactagcttccttcccttccctgagcttaattattccatctataaaacaaagatgatattgtttatccagtggggatgttgtagggctggacatgtcatgcttg

SEQ ID NO: 6671 - DNA, 83 bp, Homo sapiens
ggaagggccacttgggaaatgcagctgtgggtcgtaaggagtccctcactctatcgctctgtgtttcctggggctgccatgac

SEQ ID NO: 6672 - DNA, 95 bp, Homo sapiens; identical to SEQ ID NO: 68

SEQ ID NO: 6673 - DNA, 93 bp, Homo sapiens; identical to SEQ ID NO: 69

SEQ ID NO: 6674 - DNA, 58 bp, Homo sapiens
tgagacagagtctcgctctgtctctcaggctggagtgcagtggcatgatctctgctca

SEQ ID NO: 6675 - DNA, 79 bp, Homo sapiens
ctgcctcactctgtcactctgccttatgcccctgtgatgaattctttcctctggggaggcaagaatcaagctgctgcag

SEQ ID NO: 6676 - DNA, 72 bp, Homo sapiens
tgcacactccagcctggatgatagagtgagactctgtctatctatctatctatctatctgtctgtctgtgta

SEQ ID NO: 6677 - DNA, 114 bp, Homo sapiens
cattgtggttttaatttgtatttctttgatgattagagatgttgagcattattttcatatatattttggtcatttgtatttcttcttctgagaaatgcctgttcagatcctttg

SEQ ID NO: 6678 - DNA, 111 bp, Homo sapiens
gctggatacttcttggagataacagggcttctgcatactctgctgtatttttttttttttttttttttttttgagatggagtctcgctctgtcaccaggctggagtgcagt

SEQ ID NO: 6679 - DNA, 83 bp, Homo sapiens
ccagtgtatgcatatatgaaaacaatgttgtatactttaaatatatacaacttttgtttgtcaaatatacttcataaagctgg

SEQ ID NO: 6680 - DNA, 139 bp, Homo sapiens
tttcagcaaaggagggacccaccacatgaccgggaggtggttgcctcctgtctccgtctctgtctcggtctctgtcagttgttggagggccaggattctgtcttatctccgcatcttgaagacccagcacaatgcctgg

SEQ ID NO: 6681 - DNA, 195 bp, Homo sapiens
gctacatatgtatatttgttttatgtatacagtccgctatatatgtatatattttttatatatacagtccgctatatatgttttttatatatacagtccgctatatatgttctttatatatacagtccactatatgttttttatatatacagtccgctatatatgttctttatatatacagtccgctacatatgt

SEQ ID NO: 6682 - DNA, 124 bp, Homo sapiens
atatgtatagtacactatatacatattttatatatatagtccactatatattttatatatatagtccactatattttatgcatatagtccaccatatatattttatgcatatagtccactatat

SEQ ID NO: 6683 - DNA, 88 bp, Homo sapiens
cagtcttcatgaggatttactgagtgtagacactgtgctcttggagcctcttgggagtggaagtggagagagacgggcagtgatgcac

SEQ ID NO: 6684 - DNA, 58 bp, Homo sapiens; identical to SEQ ID NO: 1391

SEQ ID NO: 6685 - DNA, 56 bp, Homo sapiens; identical to SEQ ID NO: 1392

SEQ ID NO: 6686 - DNA, 131 bp, Homo sapiens
cattaactggacaaacagacagtggctagacccagagtccagagtgacctcacaggcagcatttttttttttttttaaacagagtctccctttgtcccccaggctgtagtgcagtggtgcaatctcagctc

SEQ ID NO: 6687 - DNA, 58 bp, Homo sapiens; identical to SEQ ID NO: 2442

SEQ ID NO: 6688 - DNA, 113 bp, Homo sapiens
actattggtgacataaagaagtaaagttcctgtttctcacctagtaagtagtatagaaatgggcggctgctagcagggaagaggagggagatttcagtggatatcagattggt

SEQ ID NO: 6689 - DNA, 103 bp, Homo sapiens
gttattttctgttttggtgcataagtaaatataatcataacttactttctttttgtaaatgaggttaataagtgcttgtgtcaaaaaatagccagtttatgac

SEQ ID NO: 6690 - DNA, 94 bp, Homo sapiens
gccactcttttgcatcttgtggtgggaatgtgcataccctacggatagcatttcttactcttcacagcattgttgggtggcacctttctttgcc

SEQ ID NO: 6691 - DNA, 71 bp, Homo sapiens
ataggaaatgaggaatgatgtctggctctttaattaaagacacagagccagagtttgctcttcaagcttgt

SEQ ID NO: 6692 - DNA, 72 bp, Homo sapiens
tgtgtgtgtgtgtgtgtgtatatatatatgtgtatatatatatatatatatatacacacacacacacacaca

SEQ ID NO: 6693 - DNA, 82 bp, Homo sapiens
gctcttctctagcgcagaagtgagagttctccttgcatgggaccactgagacggtctgtcactgcctgcgctgattcagggt

SEQ ID NO: 6694 - DNA, 103 bp, Homo sapiens
tagtgttactcttactatccatatagggcatgcctgggcccatcccgccggtgctcactggcagtctgtgtgtctaggtatgtctatgcttacagatacacta

SEQ ID NO: 6695 - DNA, 69 bp, Homo sapiens
tgtgtgtgtgtgtgtgtgcacgtgtatactttacatagatatatgtatatatatatatatataaacaca

SEQ ID NO: 6696 - DNA, 69 bp, Homo sapiens
ggcagagtccagtgccctcagtcactcagtgtgcctccagctgacacccctgagcatgtactgtgtgcc

SEQ ID NO: 6697 - DNA, 78 bp, Homo sapiens
tgtgacacagatactgcatgagcaagtgctgttggaaaaaatggcatcaatagacttgattgacgcagggttgtcaca

SEQ ID NO: 6698 - DNA, 78 bp, Homo sapiens
caccagcttggtatataactaggggctaaggattcagcctttttggacctcagtctcaatgtgtgtgattcactggtg

SEQ ID NO: 6699 - DNA, 93 bp, Homo sapiens
atgatataatgctttcaagtgtatacttttagtagaattgtccagcatgaaccaatttgtatgtaaatgtatatgctgagtccaatatattat

SEQ ID NO: 6700 - DNA, 109 bp, Homo sapiens
gcctctgcttacctttcagctgcttttttttttctccttcccccctgttccctcggctgggctgacagatcagagtgagaggcgctggcaatggactaggaagctcggc

SEQ ID NO: 6701 - DNA, 116 bp, Homo sapiens
atagtaacttcatttatttgtctggttatgttattgtatatataaatatttatgttttcatatattgcatataaaaatttgtgttacatgttactctcagaacagattgctgtaag

SEQ ID NO: 6702 - DNA, 58 bp, Homo sapiens; identical to SEQ ID NO: 2051

SEQ ID NO: 6703 - DNA, 70 bp, Homo sapiens
ttgttttttgagagagtctcactctgtcatccaggctggagtgcagtggtgtgatctcggctcactgcaa

SEQ ID NO: 6704 - DNA, 74 bp, Homo sapiens
agcaccttgtcctctacccactagatgtcagtaacttccccttgtttgtgacaacagtgtgttcagacattgct

SEQ ID NO: 6705 - DNA, 76 bp, Homo sapiens
ggaggctgaggtaggaggatcacttgagcccaggagttcaagaccagcctgggcaacatagtgagacctcatctct

SEQ ID NO: 6706 - DNA, 75 bp, Homo sapiens
gggtcactgccagactctctccaaccttgacccacagttccttttttttttggatggagtctcactttgtcaccc

SEQ ID NO: 6707 - DNA, 116 bp, Homo sapiens
ccttttgggctatttttttctcacaaaaccgtgtgggtctgtggaatgggcttttttttttttttgatggagtctcacactgtcacccaggctggagtgcagtggcgcaatcttgg

SEQ ID NO: 6708 - DNA, 62 bp, Homo sapiens
gagactgggtctcactctgtctcccaggttggaatgcagtggtgggggtgggatcacagctc

SEQ ID NO: 6709 - DNA, 91 bp, Homo sapiens
aagtgctagggttacaggtgtgagccactgtgcctggccaacattttttttaatgtaatcaaatgtatcagtgacttttctgtaggtactt

SEQ ID NO: 6710 - DNA, 92 bp, Homo sapiens
ggtggcaggggggtggtgtggacagagtctcactgtgtcatccaggctggagtgcagtggcaggatcttggctcactgcaagctctgcctcc

SEQ ID NO: 6711 - DNA, 114 bp, Homo sapiens
atgtacatgtatacgtatacatgtatatgtacatatatgtatatatgtatatgtgcatatatgtgtatatacgtatatgcgcacatatatatgtatacgtacatatatgtatat

SEQ ID NO: 6712 - DNA, 89 bp, Homo sapiens
atcacttgatagttttatattattttgtatttcattaggagcggattcttctcctgattgatgattttgttactgtcttttttagtggt

SEQ ID NO: 6713 - DNA, 114 bp, Homo sapiens
tgaaacaaccgatgagagcctgaggagccattttgagcaatgggggaacactcacagactgtgtggtaatgagagatccaaacaccaagtgctccacgggctttggttttgtca

SEQ ID NO: 6714 - DNA, 58 bp, Homo sapiens; identical to SEQ ID NO: 1763

SEQ ID NO: 6715 - DNA, 117 bp, Homo sapiens
gtgtacgagcgtgtttttttattttagcaagcttactattattttatttttatttatttatttattattattttagcaagcttactattgtaagacaaggaaatgctgctggtgtat

SEQ ID NO: 6716 - DNA, 110 bp, Homo sapiens
gatagtctacatgggctgaaaatttaagaccatttaatgaaagttgtctggctgcaggaaaaatgctcatttttacaaattgtcttaaagttctgatttatagatctgtt

SEQ ID NO: 6717 - DNA, 85 bp, Homo sapiens
gagttgaaagtgtgtgggagacatttgagagagtgcacaaagctagttattatttcttaattgttaccacaaatcttctcagttc

SEQ ID NO: 6718 - DNA, 84 bp, Homo sapiens
tgtcctagagaatctgattatctctctgtgtctcatgacctcaaaaagtttgagaggcattggattagattattgtaaaggata

SEQ ID NO: 6719 - DNA, 117 bp, Homo sapiens
caaagtgctgggattacaggcatgaggccaccgtgcctggtcataactttttttttttttttttggcttaagtttcaggcattggttctcagagctgcaatacatgacagtcctatg

SEQ ID NO: 6720 - DNA, 101 bp, Homo sapiens
tgttcgtttgtgactatttctaattgtgacaggtaagtctgtgtaagtgtatgtatattttttctaaagatagatttgttattattcctggtttatgagca

SEQ ID NO: 6721 - DNA, 86 bp, Homo sapiens
gcagagagattacctatgttacaaagtatttgtaatagtccactaatataagtgatatgtgacttgtggatatatcagttgtttgc

SEQ ID NO: 6722 - DNA, 106 bp, Homo sapiens
tgcaagatagaaaaagatattgctggtgatttgagtaagacagctaaatatgatttttttttttttttaagatagagtcttgctctgtcacccagtctggagtgca

SEQ ID NO: 6723 - DNA, 71 bp, Homo sapiens
tgtgtgtgtaagctggggtctcactctgtcacccaggctggagtgcagtggagggatctcagctcactgca

SEQ ID NO: 6724 - DNA, 96 bp, Homo sapiens
ttaccatttccactttgcagatgaaaaactgagttacagagaggctaagcagcctctctgtaactcagtttttcatctgcaaagtggaaatggtaa

SEQ ID NO: 6725 - DNA, 82 bp, Homo sapiens
ttccactttgcagatgaaaaactgagttacagagaggctgcttagcctctctgtaactcagtttttcatctgcaaagtggaa

SEQ ID NO: 6726 - DNA, 117 bp, Homo sapiens
tttgagaacctgagcatagtatggctcttctcccctgccccccaaaatatgtatgtatgtatatacaatttaaagagggtcagaaaactccgaagtgcatcctgtggtcactacaaa

SEQ ID NO: 6727 - DNA, 81 bp, Homo sapiens
atcattccctgtctgactgtctgtgccatccaggacagaggaatctctgctggtgagccctgcagcccctggggatctggt

SEQ ID NO: 6728 - DNA, 95 bp, Homo sapiens; identical to SEQ ID NO: 68

SEQ ID NO: 6729 - DNA, 93 bp, Homo sapiens; identical to SEQ ID NO: 69

SEQ ID NO: 6730 - DNA, 100 bp, Homo sapiens
catcagatgcttgactttctgagaagtaaagagccagagacatccaggttatttctttttttttttttttttttttttgagacagagtctggctctgttg

SEQ ID NO: 6731 - DNA, 95 bp, Homo sapiens; identical to SEQ ID NO: 68

SEQ ID NO: 6732 - DNA, 93 bp, Homo sapiens; identical to SEQ ID NO: 69

SEQ ID NO: 6733 - DNA, 104 bp, Homo sapiens
tacaagctgtgtatactcctttaaattgaggtaaaatgtacacacagatataaatcttttctttttattatactttaagttttagggtacatgtgcacattgtg

SEQ ID NO: 6734 - DNA, 89 bp, Homo sapiens
caccaaatttcatgcgcgtccgtgtgaagagaccaccaaacaggctttgtgtgagcaacatggttgtttatttcacctgggtgcaggtg

SEQ ID NO: 6735 - DNA, 113 bp, Homo sapiens
tttttaaggtgttattcatttaatctttatatagacagaatttactgagctgaaaaagatatgcatttttttccttctgtggctgttttttgaggatgctgaatccttcaaaa

SEQ ID NO: 6736 - DNA, 100 bp, Homo sapiens
ttatttgtttcctttggcaagatccactggggggaggaatgagattggtgagtttaaaatttttgttttgttgttgcattttggaagaagaggcgagtaa

SEQ ID NO: 6737 - DNA, 69 bp, Homo sapiens
acattggagccgagcccaggaggaggcagagaggatgcatgggtcatgcctgtctccctcgctccctgt

SEQ ID NO: 6738 - DNA, 71 bp, Homo sapiens
ttgtttttgagacagagtctcactgtgtcacccaggctggagtgcagtggtgagatcttggatcactgcaa

SEQ ID NO: 6739 - DNA, 89 bp, Homo sapiens
tatatagtatatatgtatatgtgagtatatgtgatatatatgtatatatactcatatatgtgcatatttgtatatatataatcttcata

SEQ ID NO: 6740 - DNA, 121 bp, Homo sapiens
ccccaaatctctctctccaagccacagaaagcagggaagatgagcctgaatgtctgtctgtgtgtgagtgagtgcggggtgcatcagagcggattctcccatgctgctctccagttactta

SEQ ID NO: 6741 - DNA, 118 bp, Homo sapiens
agtcctggcaggggaattcgtccatttcatctctccattcctccacctacttacctatgtatcaatgtatcaatttttggagggcttgaactggatgacatatcaattcaatgggatt

SEQ ID NO: 6742 - DNA, 113 bp, Homo sapiens
gctgtaaaaagggagcatggccagatacagtggctcacacctgtaatcccggcactttgggaggctgaggtaggaggatgacttgagcccaggagtttgagaccagcctaggc

SEQ ID NO: 6743 - DNA, 85 bp, Homo sapiens
atttcaactctaagaaaaggcaacttagcatctgtaagttcatcaaggagtactactgtttattttcttttttaggagttgagat

SEQ ID NO: 6744 - DNA, 58 bp, Homo sapiens; identical to SEQ ID NO: 1265

SEQ ID NO: 6745 - DNA, 106 bp, Homo sapiens
tgggtgacacagcaagaccctgtctcaaaaaaaaaaaaaaagaaattctgacagtctttttttttttttttttttttgacacagagtcttctcactctgtcaccca

SEQ ID NO: 6746 - DNA, 58 bp, Homo sapiens
tgagcctggctctcactctctcgcccaggctggagtgcagtggcaccatctcggctca

SEQ ID NO: 6747 - DNA, 96 bp, Homo sapiens
agccatcctagcaggtatgaagtggcatcatattatgtttttgatttgcaatctctgtgaattaataatattgagcattgactgggcatggtggct

SEQ ID NO: 6748 - DNA, 111 bp, Homo sapiens
tatcaaaattattgctatcttgttcattgtaaatttgtatataattttatgttttaaaatattgcattagcatattatttatgatgagtaccaatggttatggttttggtg

SEQ ID NO: 6749 - DNA, 58 bp, Homo sapiens; identical to SEQ ID NO: 1725

SEQ ID NO: 6750 - DNA, 76 bp, Homo sapiens
tgacattcctagggtttcagacaattttttttttctttgagacggagtcttgctctgtcgcccaggctggagtgca

SEQ ID NO: 6751 - DNA, 58 bp, Homo sapiens
tgagaccaagtctcgctctgtcacccaggctggagtgcagtggtgcaatcttggctca

SEQ ID NO: 6752 - DNA, 69 bp, Homo sapiens
tcatgaagatttctggaaaaaggtggagatttcgtggaactgtggggccacctttttttttttttatga

SEQ ID NO: 6753 - DNA, 96 bp, Homo sapiens
gatttacatcaaggggaaggaaaaaagctatgaaggccacatgtcattttttttttaaaggaagacatcaagttgttcatctgtttggatgggatc

SEQ ID NO: 6754 - DNA, 116 bp, Homo sapiens
gtcccctacagtcattttgcagcagtgtattctggttttcaatactttctttctttattattattattatatattttttgagacagagtctcactctgccacccaggctagggtgc

SEQ ID NO: 6755 - DNA, 62 bp, Homo sapiens
ctctgcgttaagttggacggcctgagctcagagctcatttctgtctctgttagctttcagag

SEQ ID NO: 6756 - DNA, 106 bp, Homo sapiens
tataaacaagtaagtgtatatatgtgtatatatatgtatatatacacacacacacatacacatgcataagtatatatatacacacacatatacttatatgtatata

SEQ ID NO: 6757 - DNA, 84 bp, Homo sapiens
acagaaagttcagtttggaatgggtcatagccccctcgttaccatcactgggtctctgtggctctctctgctggggccatctgt

SEQ ID NO: 6758 - DNA, 81 bp, Homo sapiens
acttgtcaatatttgtttttgttgcaattgcttttggggacttagccaaaattctttgccaaagccaatgttgaaaaaggt

SEQ ID NO: 6759 - DNA, 115 bp, Homo sapiens
gagtaagcttaaaatctgttctgtcattccaaggtgctcttggcctctttttttttttaattatactttaaattctagggtacatgtgcacaacatgcaggtttgttacatattt

SEQ ID NO: 6760 - DNA, 95 bp, Homo sapiens; identical to SEQ ID NO: 68

SEQ ID NO: 6761 - DNA, 93 bp, Homo sapiens; identical to SEQ ID NO: 69

SEQ ID NO: 6762 - DNA, 111 bp, Homo sapiens
actgtggacttttgaattaatgctgaagtgagttaagactttggaggactgttgggaaggtatgctttgttttgaagtatgaggacatgagatttaggaggggccaggagt

SEQ ID NO: 6763 - DNA, 120 bp, Homo sapiens
gtatatatgtatatatatatacatgtatattgtgtgtgtatatagatagatagatatagtatgtgtggatatgtatgtatatgtatatatacatatatatacacacatattcatacatac

SEQ ID NO: 6764 - DNA, 113 bp, Homo sapiens
ctagctattcctttaaaatgtaatcatcaggaaggataaagcctctgtctcccagtctctgtgggaggacagaaccctaacttccataattgccacttaatagacatagctgg

SEQ ID NO: 6765 - DNA, 133 bp, Homo sapiens
taccttaagtttatgtgagtccttatgcattaggttgaagggggatataaggaaccagagagactagacagagtgcaggagggtgtttattttaaggtgtacactggcccagcagacatgtgtcctaaaggtt

SEQ ID NO: 6766 - DNA, 92 bp, Homo sapiens
gtatccacaatgtaccaaaagggctctgagattttatttagtgtgagtacgtgcattagagagaggacagagagagatggaaatgtggttat

SEQ ID NO: 6767 - DNA, 93 bp, Homo sapiens
tatatcctagttcccattgcctacaataacaattgatgtttattttttcaacaaatgtttattgaacaggtgctgggttaaaacctggaaata

SEQ ID NO: 6768 - DNA, 110 bp, Homo sapiens
tctcctaggaagctcatgtgtttagggcgaagctctaggacgacccttgattggcttaatctgtcatcatattccccttccctggccttagtcactagttcctggcttga

SEQ ID NO: 6769 - DNA, 113 bp, Homo sapiens
gttatgcagataggttaatttgtttcattttgctttgcaaattcagggagtggttttattttttgtattttgatgtaattttgcttaataaatatgcaaaatgttggcatagc

SEQ ID NO: 6770 - DNA, 98 bp, Homo sapiens
ctttacaattatgtaaatatttctttgatattctaagtttttgttctttaaagctattctgcaaaaatgggaatatctctgtgtgagtggttgtgaag

SEQ ID NO: 6771 - DNA, 101 bp, Homo sapiens
ccataataagtctaggagaatcattatctgtacctatataagtatatatacatatatatgtatgtatgtgtgtatatctgctgttggttctgtttctttgg

SEQ ID NO: 6772 - DNA, 99 bp, Homo sapiens
atgtgtgtgtatgtacttgtttgtcttctgaatttatatgtatatttacatacacggattgtatatatatatatacacaaatataagatacacaaatat

SEQ ID NO: 6773 - DNA, 80 bp, Homo sapiens
ttatctttagatgttgttatcttaacatctatctacagattatctgtaatagatgttaagataacaacatctaaagataa

SEQ ID NO: 6774 - DNA, 86 bp, Homo sapiens
atatatacatacatatgtacatatacatatatacatacatatgtacatatatacatgtatatttatgtacatatacatgtatatat

SEQ ID NO: 6775 - DNA, 72 bp, Homo sapiens
tgtgtgtatatatgtgtgtatatatatgtatatacacacatatatacatatacacacacatatacacacaca

SEQ ID NO: 6776 - DNA, 58 bp, Homo sapiens; identical to SEQ ID NO: 605

SEQ ID NO: 6777 - DNA, 73 bp, Homo sapiens
gttgagcagcaatggggcacatgtatcagtatttttgcttatttatatactacactgctgttttctgctcagc

SEQ ID NO: 6778 - DNA, 80 bp, Homo sapiens
gactgtattaatttgaggattaggttttgttttaattaattaatttttttgaacatagaatctagccccttgtttcagtc

SEQ ID NO: 6779 - DNA, 118 bp, Homo sapiens
agcctgatcaacatagtgagacccccatctctacaaaaaaatttttttttaattagctgggtgcagctatttaggaggctgaggtgggaggatcacttcaactgaggacattgaggct

SEQ ID NO: 6780 - DNA, 95 bp, Homo sapiens; identical to SEQ ID NO: 68

SEQ ID NO: 6781 - DNA, 93 bp, Homo sapiens; identical to SEQ ID NO: 69

SEQ ID NO: 6782 - DNA, 113 bp, Homo sapiens
ctccaacctcatagtcactggcttggttcatatccttatcatttcttacttggatttctttttttaatttaattttttagagacagggtctcactctgccactgagactggag

SEQ ID NO: 6783 - DNA, 92 bp, Homo sapiens
ggggtccggcaggtcgcttaccagggtgtgatgggagtgggaatgcctggcgctcagactctccatctcagtggctgcatctgaactgcctc

SEQ ID NO: 6784 - DNA, 101 bp, Homo sapiens
ctgagcctttggcaagttataatttttattttgctggtggagggtcttgatattgagggctgctgactgatgagagagagaagtggttgctgaaggttggg

SEQ ID NO: 6785 - DNA, 84 bp, Homo sapiens
tgtcagcatggggtttaacacaaatctgaatttgaatgtgttttatgagacacacactctctggtttgccatagttccttgaca

SEQ ID NO: 6786 - DNA, 81 bp, Homo sapiens
gctgtgaaaagtgagactttgaggaggaatatgggtaagaaggaatcttgcaatctctctctctgtgttacatggcatggt

SEQ ID NO: 6787 - DNA, 66 bp, Homo sapiens
ggtaacttggactgagaggtgacagcgtgctggcagccctcgctcactctcggtgccttcttggcc

SEQ ID NO: 6788 - DNA, 105 bp, Homo sapiens
ggaacttactgaaagagagaggagaattccccttcttgatgttttatatttcttaatgaaagggcatcagtgaatgtaagtcttgtcctcctctggtccccttcc

SEQ ID NO: 6789 - DNA, 58 bp, Homo sapiens; identical to SEQ ID NO: 1847

SEQ ID NO: 6790 - DNA, 110 bp, Homo sapiens
gcattcatcctgtatgcatgcatctgtgtctaaattcccccttttcatttttatttttttaattatttatttagagacagagtctcactctgtcacccaggctggagtgc

SEQ ID NO: 6791 - DNA, 73 bp, Homo sapiens
cacctgtagtcctagctactcaggaggctgaggtggaaggatcacttgagcccaggtggcagagattgcagtg

SEQ ID NO: 6792 - DNA, 115 bp, Homo sapiens
ctgatagtattacggaggatcccttgcatgtgcttctctcttgccgctttcaagattctttctttttgtcattcagtagtttgattataatatgtttctttgtagtactctttgg

SEQ ID NO: 6793 - DNA, 81 bp, Homo sapiens
aaggttttataaaaatgtagccagtttatgttaaaatttttgatatattattataaattgaagctatttttgtaatgcctt

SEQ ID NO: 6794 - DNA, 87 bp, Homo sapiens
tagccgtgggaggtaggctgtttccaatactctagattaattttttttttttttttgagacggagtctcacactgtctcccaggctg

SEQ ID NO: 6795 - DNA, 89 bp, Homo sapiens
gtcttgattactgtagtttaatagcaagtcttaaagtcaggtagtatcagacttctgactttgttcttctccttcaatacggtgttggc

SEQ ID NO: 6796 - DNA, 83 bp, Homo sapiens
agaaaagccaagagcatgagataaagtgagcaagcaatagggcaaaccctatttttattttttctttctttcttttttttttt

SEQ ID NO: 6797 - DNA, 118 bp, Homo sapiens
agatgctttttaacattatatgtatatatgtgtgtatatatatataaaaaatatatctctatatttatatctcttttatatataaatatatatatctatatgtatctcatagatatct

SEQ ID NO: 6798 - DNA, 107 bp, Homo sapiens
cttatcagctgcatgacattgagcaacttacttaaccctacttttactcaatttcttcatctgtaaaatggggataataataggacctagctcatgacactgatgtg

SEQ ID NO: 6799 - DNA, 95 bp, Homo sapiens; identical to SEQ ID NO: 68

SEQ ID NO: 6800 - DNA, 93 bp, Homo sapiens; identical to SEQ ID NO: 69

SEQ ID NO: 6801 - DNA, 128 bp, Homo sapiens
atatatatctccatatatatatatctccatatatatataaatatatagatatatagatatatatatatctccatatatatatctctccatatatatatatctccatatatatatctccatatatatat

SEQ ID NO: 6802 - DNA, 66 bp, Homo sapiens
tatgcagatatgtgtatctgcacgtgcatgtgtttgtgtgtgtgtgcacaagcctgtgtctgtatg

SEQ ID NO: 6803 - DNA, 144 bp, Homo sapiens
tgtatatatacacacacatatacatatgtatgtatatatacacacacacatatatatatgtatgtatatatatacacacacatatatatatgtatgtatatatatacacacacatatatatatgtatgtatatatatacacaca

SEQ ID NO: 6804 - DNA, 75 bp, Homo sapiens
gagcagggcattctgttctaggaatttcttgttaaaatatttcatttaattaagtttttacaaccagctctgctt

SEQ ID NO: 6805 - DNA, 112 bp, Homo sapiens
gcttttaagtacatttgattttgaatttcaggggttatattagacaaaacatggtaaactctgtctgaaactctgtctgaaatacatttttttttccttgatgtattcttgc

SEQ ID NO: 6806 - DNA, 63 bp, Homo sapiens
gagtggcagagagagccctcaacaattttttttttttttgagatggagtctcactctgtcacc

SEQ ID NO: 6807 - DNA, 114 bp, Homo sapiens
actttttaattgtacctttttggtgtgtgtacctagcagtgtcttcattttttaaatatagaaactgaggcacagaaaaaactaagtaagttgcctaaagttacataagagagt

SEQ ID NO: 6808 - DNA, 116 bp, Homo sapiens
atatatatttatatatatatatataccaacttatgcatatgtgtacatatatacatcaatttatgtatatgtgcatacatgcatatatgtgcatatatatgtatgcgagtatgtgt

SEQ ID NO: 6809 - DNA, 95 bp, Homo sapiens; identical to SEQ ID NO: 68

SEQ ID NO: 6810 - DNA, 93 bp, Homo sapiens; identical to SEQ ID NO: 69

SEQ ID NO: 6811 - DNA, 95 bp, Homo sapiens; identical to SEQ ID NO: 580

SEQ ID NO: 6812 - DNA, 93 bp, Homo sapiens; identical to SEQ ID NO: 69

SEQ ID NO: 6813 - DNA, 118 bp, Homo sapiens
tatatcttattttatatacgttatatatatgtcttattgtatatgtaacaaaagatatacatatcttattttatatataacatataagatatatatcctattttatatataagatata

SEQ ID NO: 6814 - DNA, 95 bp, Homo sapiens; identical to SEQ ID NO: 68

SEQ ID NO: 6815 - DNA, 93 bp, Homo sapiens; identical to SEQ ID NO: 69

SEQ ID NO: 6816 - DNA, 83 bp, Homo sapiens
ggcctcatgttgtcaaatcacagtgaacaagctctctatatccaggggtttatcaataaggatgctaagacttgcatgagtac

SEQ ID NO: 6817 - DNA, 98 bp, Homo sapiens
gaatatatatatatgtacacgtatatatatgtgtatacatatatatgtgtatatatatattcatatacatatatatacgtgtatatatattcatatac

SEQ ID NO: 6818 - DNA, 114 bp, Homo sapiens
tcaatgatctttagttacctgacaaattgggagatatgttactgtcctccatactttttctttcttttttttgagatggagtctccctctgtcaccccgactagagtgcagtgg

SEQ ID NO: 6819 - DNA, 119 bp, Homo sapiens
tatatccagcaatctccaaatgtattgttttttaatctggagattccaagtgaggaataaactatatttttttgaatcaccaataaatagcttctgcagtcaccatttgctaaaatatg

SEQ ID NO: 6820 - DNA, 107 bp, Homo sapiens
tcatgagagatattggtctgtaattttccattttgaatatctttatattagagccctattgatgggctggtaaagtcagggagggaaaacagtctacaattttatgg

SEQ ID NO: 6821 - DNA, 105 bp, Homo sapiens
taaaaaagacacattatataaatagatacataagagtgacagcacatttctttttttgtttgtttttcttttgtttgtttgtttttggtttttgtgttttttttg

SEQ ID NO: 6822 - DNA, 106 bp, Homo sapiens
gactgtgaattggggaatattactagagttagctgatcttttaatttttttaagagtggccagaattctggattttttgtgatttcccaaatttaaatcttaagtc

SEQ ID NO: 6823 - DNA, 77 bp, Homo sapiens
ggttcatcttttttggcacactgaaaagactgtgcttagagcagcaacgttgtaccactgtgccgcaggattgaact

SEQ ID NO: 6824 - DNA, 117 bp, Homo sapiens
tggagggatgtttgggcaagcattgagtaaactgagataatatgggtatgaaaattcatcatgtaatttttttcatattgctgtagtttggggctatataaatgcatgaacacttca

SEQ ID NO: 6825 - DNA, 81 bp, Homo sapiens
aataagtaaattattatttgtgaattatttgtaacagtgtttagcacttagcaaatactttgtaaatattagtgacttatt

SEQ ID NO: 6826 - DNA, 145 bp, Homo sapiens
tatatatatatatatatatatatatgtgtgtgtgtgtgtgtatatatatatgtgtgtgtgtgtgtatatatatatatgtgtatatatatatatatatatatatatatatatgtgtatatatatatatatatatatatatatccca

SEQ ID NO: 6827 - DNA, 104 bp, Homo sapiens
gaattggtattaaatcttctttaaataaagatctggtagaatttagtgatgaggccattggtcttagacttttctttgttgggagatattttattaactgattc

SEQ ID NO: 6828 - DNA, 99 bp, Homo sapiens
gtatatataaaaaggcttcaaaatcttcactctgattcttccaaagtcattaagatttttaatatatcaagtgaatgtgttaaaagctttgttaaatac

SEQ ID NO: 6829 - DNA, 95 bp, Homo sapiens; identical to SEQ ID NO: 68

SEQ ID NO: 6830 - DNA, 93 bp, Homo sapiens; identical to SEQ ID NO: 69

SEQ ID NO: 6831 - DNA, 109 bp, Homo sapiens
ccttctttgctcttataacctctaactgagtactcttttcaagttgctttttttttttttttgagacggagtttcgctctgttgcccgggctggagtgcaatggcatgg

SEQ ID NO: 6832 - DNA, 95 bp, Homo sapiens
gcctattctgtttaaattgagacatactagatttgggttaattttaattttaatttttatttttattcttatttttttttgagacggagtctggc

SEQ ID NO: 6833 - DNA, 112 bp, Homo sapiens
agcaatcaggaaaggagggacaagatttcatgcatttggtagaaagttgtttagaaaactttaaagtctttttattctttgtgactcttctgtcttcttaaaatgtgacgct

SEQ ID NO: 6834 - DNA, 115 bp, Homo sapiens
aggtatatacacatgttatacatgttatacctgttatatataacacatgtgttatacatgttatacctgttatatataacacgtgttatacatgttatacctgttatatataaca

SEQ ID NO: 6835 - DNA, 100 bp, Homo sapiens
gtatcctttgtccactttttgatgggtttgtttttttcctgtaaatttgtttttctttgtagattctggatattagccctttgtcagatggatagattgc

SEQ ID NO: 6836 - DNA, 115 bp, Homo sapiens
gaagtgttccctattcaccgcatccacaccaacatctactgttttttgattttttgattatggccattcttgcaggagaaagttggtatcacattgtggttttgatttgcatttc

SEQ ID NO: 6837 - DNA, 201 bp, Homo sapiens
catgtgtatgaatatatgtgtatagtataaatatatagtaaatatataatgtgtatatatatgtatgtgtgtatatttgtataatatatatttatatgtgtttatatgtatgtgtgcatgtgtataatatatattgtatgtgtataatatacatttatgtgtgtatatgtatgtgtgtgtatgtgtataataatatatatt

SEQ ID NO: 6838 - DNA, 111 bp, Homo sapiens
atattatatgtcaatataatatattgacatatatataatatatgtcaatattatatataatatatatgtcatatatataatatatatgtcaatatatataatatataatat

SEQ ID NO: 6839 - DNA, 92 bp, Homo sapiens
aatgacaaagtagtacaaaggtctagctggaaggcaaaactcaaagattaaagagtgtctgtgtctgtcaggcagttttactggttctcatt

SEQ ID NO: 6840 - DNA, 89 bp, Homo sapiens
gaagtgagaatggatgatgttaccaatggcctgagtgtagagagagaagatcagagctggagtgacagaacactgggaaaactcatttc

SEQ ID NO: 6841 - DNA, 126 bp, Homo sapiens
tatatatatatatatatatatgtatatatatatgtatatatatatgtgtatatatatatgtatatatatgtatatatatgtatatatatatatgtgtatatatatatatgtatatatatatatatg

SEQ ID NO: 6842 - DNA, 102 bp, Homo sapiens
tttgcaacattgaagttgaagcatgactcctttagctttgatttatttatttgattgatgctgaattatatgcttgtgagtcatcaacatggtgcttgtaaa

SEQ ID NO: 6843 - DNA, 59 bp, Homo sapiens
ttttggaatatttgcatatatatatatatataatatgtatatatgtagatatcttgggg

SEQ ID NO: 6844 - DNA, 114 bp, Homo sapiens
aacttttcataatgatttccaaaggaaggtaattttgtttttgtttttttttttttcaaaagaaaaattcactttgctttcctaatttaaaatttgtcatttattatacgggtt

SEQ ID NO: 6845 - DNA, 115 bp, Homo sapiens
aagattttgtgcttcatcaaatgctgtgaatcatcaatgtcgtttgctgattggtatttctggctcacaattcctctggttcacagcaattgctcttgaaaaaataagaagtctt

SEQ ID NO: 6846 - DNA, 83 bp, Homo sapiens
catctagaagagttgatcatacactgaaaatgttctattttttttaagaacattctcaggaaaggtttgatctcatttagatg

SEQ ID NO: 6847 - DNA, 107 bp, Homo sapiens
ctgttgaagaatttcttaatgacatggaaatgcttaggttattatagagaggtaaatactttatagtatattatatatacatccatacattatctgtttatcgatag

SEQ ID NO: 6848 - DNA, 100 bp, Homo sapiens
aaatgattatgttctcaggtctttcacagccacatttcatcacactagtgacactactaaagtggttgagtgaatgtagtgcctgttcataaaatcattt

SEQ ID NO: 6849 - DNA, 101 bp, Homo sapiens
ggtgtggtgatgtgcgtctgtggtcccagctatagggaggctgaggtaggaggatcgcttgagtccagaaggtggaggttgcagtgagccaggatcacgcc

SEQ ID NO: 6850 - DNA, 87 bp, Homo sapiens
gtttggttgaaagaacagttgctttctgacttctgctaaaaagttgaattccaacatagttgtcagatgaaactgtacaatccaaat

SEQ ID NO: 6851 - DNA, 84 bp, Homo sapiens
gtctgctcccactcaggaggaggactttcaaactggcacatcctctgcctcgctctgtgcctgtgagagagtagattaacctcc

SEQ ID NO: 6852 - DNA, 75 bp, Homo sapiens
gtaaatgctcagagtattcagtgaggttacttcccttatggctggtcagaactcctgcatctcccagcactgtgc

SEQ ID NO: 6853 - DNA, 85 bp, Homo sapiens
gctggtcatgtggttgtagctggtattgattactaccttgttctatctattctgtagtccctttgccttcagcaagtacctcagc

SEQ ID NO: 6854 - DNA, 82 bp, Homo sapiens
gtctgtagagggggtggtatctgttttcttttggttgtttttttttgttttttgagacagagtctcgctctgtcgcctaggc

SEQ ID NO: 6855 - DNA, 95 bp, Homo sapiens; identical to SEQ ID NO: 68

SEQ ID NO: 6856 - DNA, 93 bp, Homo sapiens; identical to SEQ ID NO: 69

SEQ ID NO: 6857 - DNA, 95 bp, Homo sapiens; identical to SEQ ID NO: 68

SEQ ID NO: 6858 - DNA, 93 bp, Homo sapiens; identical to SEQ ID NO: 69

SEQ ID NO: 6859 - DNA, 58 bp, Homo sapiens; identical to SEQ ID NO: 4018

SEQ ID NO: 6860 - DNA, 116 bp, Homo sapiens
gcctcgctgtctaatgtaaagtctctagaagctgctgtgtctccttcctgggtctggctctcactctcagtgcacaggcacagcctcctttttccagggacctctgaccctctggc

SEQ ID NO: 6861 - DNA, 83 bp, Homo sapiens
gggattagactttggagcaataagatgtgattttttttcttaaagtcattgtaatctaaaattgtccaggtctcacaaatctt

SEQ ID NO: 6862 - DNA, 106 bp, Homo sapiens
cattgatgattcttttgtaataaagattccagttatatgttcaaaaagaaatctatctgaatatttttaaaattcagaacctgttgttttaaaagggttttcagtg

SEQ ID NO: 6863 - DNA, 58 bp, Homo sapiens; identical to SEQ ID NO: 1409

SEQ ID NO: 6864 - DNA, 69 bp, Homo sapiens
ggcaggggtttcagtgagccaagactgcaccaccgcactccagcctgggccacagactgacactctgtc

SEQ ID NO: 6865 - DNA, 57 bp, Homo sapiens
tgcttttctcttggtcacctgacttttaagagagtcagcatgaccaagtgataggcg

SEQ ID NO: 6866 - DNA, 77 bp, Homo sapiens
ggtttggaatttgaggcacatattgaaattaacaaaagttatatatatatgtcaatctgagtctcaatttctacact

SEQ ID NO: 6867 - DNA, 120 bp, Homo sapiens
ctgctacagcattgtaaagtgttttgtaccctctgaatataatactgtaaaatgttctacattattatttgaagaaaattgttgaggaataattttacagtgtgtaaggtggtagatgca

SEQ ID NO: 6868 - DNA, 74 bp, Homo sapiens
atagagtggggaaggttaaaaataaaggtctctgaagtatgagaggccaaagcacataagaccttcctgtctgt

SEQ ID NO: 6869 - DNA, 68 bp, Homo sapiens
tgtgtgtatctctctgtgtgtgtatatatatgtacatgtacatatatgtatatgtacatgtacatata

SEQ ID NO: 6870 - DNA, 146 bp, Homo sapiens
gtacagaactaataggatatatatatatgtgtgtgtatatatatgtatatatatctttttatgtatatatatgcatgtatctatatatgtatctttcatatatatgtgtatatatacaagtttatacaagtatatatatatacaca

SEQ ID NO: 6871 - DNA, 88 bp, Homo sapiens
gtatatatacacatacgcacatacatgtatatatatgtatatacatacgtgtgtgtgtgtgtgtgtgtatatatatatatatatatat

SEQ ID NO: 6872 - DNA, 105 bp, Homo sapiens
tctctgtctatatatatatatatatatatatatatatgtatgtgtatatatatatatatatatgtatgtatatatatgtatgtatatatatatatataatcaaga

SEQ ID NO: 6873 - DNA, 108 bp, Homo sapiens
aacctgcaggctgcaggctacatgcaccacaggacagcttattttattttattttattatcattatactttaagttttagggtacatgtgcacaacatgcaggtttgt

SEQ ID NO: 6874 - DNA, 69 bp, Homo sapiens
ggcctttcatctgtgtctatctgtgtcctaatctctttatgaggacactagtcatattgcatttgggcc

SEQ ID NO: 6875 - DNA, 96 bp, Homo sapiens
ggattgaatgcattttcatttaatgaatacaaatgtttaaatatcttatggaaagaagtattaatgtttgtatttcaccatgaaaaagtaaaatcc

SEQ ID NO: 6876 - DNA, 81 bp, Homo sapiens
gtacttgctaactgaatgaagtggttatttattgagggcctctggccctagtagtggaaaatatttattttagattcgtgc

SEQ ID NO: 6877 - DNA, 60 bp, Homo sapiens
tgagacggagtctccctctgtcacccaggctctggagtgcagtggcgcaaacttggctca

SEQ ID NO: 6878 - DNA, 80 bp, Homo sapiens
gcagggacttagattctggttcatgtcatcttcagcactggatacaggttgaggaagtagctactattctggtatactgt

SEQ ID NO: 6879 - DNA, 113 bp, Homo sapiens
tagggattaattagattatagtagggttataacgagaaggggtacagaaattattaactttttctttaaatacctctatattgtttgacatggtaacatagttattatctttg

SEQ ID NO: 6880 - DNA, 125 bp, Homo sapiens
gtaaaatatatatatacacatacacacatatatacgtgtatgtatgtatgtatgtatatatatgtgtgtatgtatatgtgtgtatctatatatatacacacacacacacacatatatatatatat

SEQ ID NO: 6881 - DNA, 77 bp, Homo sapiens
gtctgtgagtgaatgaacagttcatgaagagccatttagcggttgtcaatgaatagtgctcagtctgtctctcagtc

SEQ ID NO: 6882 - DNA, 103 bp, Homo sapiens
ttgtgttttttggcaatcctgcattgagcaagtctgtcagtgctgtttttccaacagcctatgctcagtgtgtctctgtgtcacattttggtaattctcacaa

SEQ ID NO: 6883 - DNA, 66 bp, Homo sapiens
catgtgtgtatatatatgtatgtgtgtgtatatatgtatatataagtgtgtgtgtatatatgtatg

SEQ ID NO: 6884 - DNA, 142 bp, Homo sapiens
atatatacgtgtgtgtgtgtgtgtatatatatatacctacagaattttatatatatttaaatatatatatatatatatatatatatatatatatatatatatatatatatatatacaccattaactacatacagaattttgt

SEQ ID NO: 6885 - DNA, 107 bp, Homo sapiens
cactgactgggatcaaaggaagtttctgcaagggtgtagagtgggcttgccaagtagagcttgttgactgtagactcacagcgtttgctgcttttataagtcaagtg

SEQ ID NO: 6886 - DNA, 78 bp, Homo sapiens
ggaaaactagacagaagctgccacacagctttctgctcttgcacttgtgagaagaaagacagcattctgactatttcc

SEQ ID NO: 6887 - DNA, 99 bp, Homo sapiens
agccttttccgtatgccagtcatctggtcaaggaccctctgtggctctcactgcccttagaacaggccctcctggaccattgctgatggatggattgct

SEQ ID NO: 6888 - DNA, 109 bp, Homo sapiens
tttgggattgctgcattttgctctgctgttcactattgtctggacattggttaagtctgaggtgggagggctgttgtgtgtggctatgtacaagataagcaaagtccaa

SEQ ID NO: 6889 - DNA, 86 bp, Homo sapiens
cctaggcatcaagaaatactgagaggtgacagtgtgctggcagccctggcagccctcactcgctctcggtgcctcctcggcctcgg

SEQ ID NO: 6890 - DNA, 85 bp, Homo sapiens
cggttgggggcagtggggcgcaggccaggagtttggattttttttttttttcttgtgacggagtctcgctctgtctcccaggctg

SEQ ID NO: 6891 - DNA, 113 bp, Homo sapiens
agcctcctgagtatctgggactacagctgcacaccagcatgcccaactaatttttgtatttttcatagagatggtttcaccatgttgtctgtctggtcttgaactctagggct

SEQ ID NO: 6892 - DNA, 102 bp, Homo sapiens
ggtgtggtgatgcattcctgtagtcccagctacttgggaggctgaggtaggaggatcacttgagccctggaggtcagggctatagtgagttgtgattacgcc

SEQ ID NO: 6893 - DNA, 63 bp, Homo sapiens
cctgagtcattttcttgatctctttaacacctgatagttggagagtgtcaaaggaatatcagg

SEQ ID NO: 6894 - DNA, 67 bp, Homo sapiens
tcagtgtgtgctcatggagaggagagagagctcactggcatctcttcttataaggatactagtctga

SEQ ID NO: 6895 - DNA, 117 bp, Homo sapiens
ggtttgtttaatttttatattgattttttacaaaactgggatcatatatatatatatatagatcatatatatatatgatggcttcctggatgtgtcaacttggctaggctacaggct

SEQ ID NO: 6896 - DNA, 93 bp, Homo sapiens
aatgggctgctagtgcttctacatctggaaatatcttcaaatgggcaacaccttgtctgtttgaggggatttttctctgttagctggcccatt

SEQ ID NO: 6897 - DNA, 141 bp, Homo sapiens
tatatgtatatatatatacacacacatatatgtgtatatatgtatatatgtgtatatatgtatatatgtgtatatatgtatatgtatgtgtatatgtgtgtgtatatatatatacacacacacacacacacacacatatat

SEQ ID NO: 6898 - DNA, 115 bp, Homo sapiens
gggtttatatatatatatgtgtgtgtgtgtgtgtatgtgtatatgtgtatatatatgtgtatatatacacatacccatatgtatatatatgtgtatatatacacatacccatatg

SEQ ID NO: 6899 - DNA, 85 bp, Homo sapiens
ggaggtaattgtatttgcggttgagaagggatgccacatcacattatgttgatctgtatatccatcactgcctgtgctttcctct

SEQ ID NO: 6900 - DNA, 63 bp, Homo sapiens
tgttttctgaacgtttcctgtgtacgtttacatggtactaggaagaaaagtttgtagaagaca

SEQ ID NO: 6901 - DNA, 118 bp, Homo sapiens
attgttttgtctgggaccatgtttattggtagaggtgagagcaggcattgtttttgttttatttctgagttctgtgaaatgtccctgaagtttcacctttatatatgttagctataat

SEQ ID NO: 6902 - DNA, 80 bp, Homo sapiens
gggcttctcaagaagcgtgactcagtgctaagtctaatttttttttttttttttttagccagagttttgctgtgttgccc

SEQ ID NO: 6903 - DNA, 103 bp, Homo sapiens
tagatagaaaattgagactgatacttagctgtttttattttcatttaaaccgtagttattatagatttttaaacaagttgagtgttatgccaatgttctttta

SEQ ID NO: 6904 - DNA, 107 bp, Homo sapiens
caggttcttatctgccttgtctccctggctactaaaaggcactcaaagtatttttttaaagttagtggtggagtagcagtagggtctcaaaggatgagcagaatttg

SEQ ID NO: 6905 - DNA, 121 bp, Homo sapiens
acctgtatgaaagagagaagctggttggctctagttcaggcctcaggttgagagaagggtgtgaggagatagttgcatgtggtccagggtctggtgttctatgttaggtagtttggctgtt

SEQ ID NO: 6906 - DNA, 119 bp, Homo sapiens
gtttttcaagatccatccatgatgtagcatgtatcaggacttcatttttttaaaaatgtaatttaatatagttaattttaagttgtgggatacatgtgcaggatgtgcaggtttgttac

SEQ ID NO: 6907 - DNA, 97 bp, Homo sapiens
ggtggttcaaggcctgttcctctgagggctgtgggttgggcaggggtctccatcactgtctgtctttgaatctgccctttcttcaggctctagcccc

SEQ ID NO: 6908 - DNA, 103 bp, Homo sapiens
ttaattggagcatttagcccatttacatttaaggttaatattgttatgtgtgaatttgatcatgtcattatgatattagctggttattgtgctcgttagttga

SEQ ID NO: 6909 - DNA, 112 bp, Homo sapiens
ggattgtcttggctatacgggctcttatttggttccatatgaaatttaaagtagttttttctaattctgtgaagaaagtcagtggtagcttgatggggatagcattgaatct

SEQ ID NO: 6910 - DNA, 86 bp, Homo sapiens
cccattatgatttggattttatttatatttttgttcttgcagtaattctgcaatgaacattatgaatataatcatgtactcttggg

SEQ ID NO: 6911 - DNA, 56 bp, Homo sapiens
gagacagagtctcgctctgtcacacaggctggagtgcagtggcgtgatctctgctc

SEQ ID NO: 6912 - DNA, 91 bp, Homo sapiens
gagctgtgaatgttcataaaggtggtcctgatgaatgcatattaaacaagtatgttacatatgacccatgttcatctcacagagaagactc

SEQ ID NO: 6913 - DNA, 89 bp, Homo sapiens
agaatgaccaatgccagagagcaaggtctatgtgagtcagtctcagtctcattgccttactctcctttttttgtttgcttgtttgtttt

SEQ ID NO: 6914 - DNA, 58 bp, Homo sapiens
tgagacagggtcacactctgtcacttaggctggagtgcagtggcgtcatcttggctca

SEQ ID NO: 6915 - DNA, 70 bp, Homo sapiens
agactgtatttatttctttctacttagtggcagggatgcctgacacctgtgtgggcagaaaaggaagtct

SEQ ID NO: 6916 - DNA, 96 bp, Homo sapiens
agaaagggaagtcactgcagagagaagagacagtggggctggagaacagcaataagaagagccattgattctatttccctcttgcatcctaggtct

SEQ ID NO: 6917 - DNA, 95 bp, Homo sapiens; identical to SEQ ID NO: 68

SEQ ID NO: 6918 - DNA, 93 bp, Homo sapiens; identical to SEQ ID NO: 69

SEQ ID NO: 6919 - DNA, 72 bp, Homo sapiens
ttgttttttgagactgagtctcgctctgtcacccaggctggagtccagtggcgccatctcggctcactgcaa

SEQ ID NO: 6920 - DNA, 185 bp, Homo sapiens
atatatatatatatgtgtgtgtgtgtatgtgtatatatacatatacatatatatgtacatatatgtatatgtatatatgtatatgtatatatacatgtacaaatatatgtatgcatatgtatatatgtatgtatgtgtgtgtatctaagacaatgacaaataatgtatacatatatgtatacata

SEQ ID NO: 6921 - DNA, 64 bp, Homo sapiens
cttgggaacctggcaggcagctgagcaggggcactcactcagcctgcctctctgggtccctggg

SEQ ID NO: 6922 - DNA, 81 bp, Homo sapiens
agggacagaagtgagtgtgaaaataagagagtgtggccctctccactttggggccgcttcactccttttcctactgcccct

SEQ ID NO: 6923 - DNA, 112 bp, Homo sapiens
tactgatgtaatgtcactggatcaacaaagtggttacacacaggcagtcacacaggcacagactcagagtgtgcagggcaatggaactttaattcaggatatggagcaagta

SEQ ID NO: 6924 - DNA, 77 bp, Homo sapiens
tatatgtgtatatatatgtgtgtgtatatatatatataaaatacacatacagatatatatatatatacatctcacat

SEQ ID NO: 6925 - DNA, 93 bp, Homo sapiens
ggcagagtggtgtcctcataggtaaattgtggtagggaattttgattatttatttattattattattactttgaaatggggtctctctctgtc

SEQ ID NO: 6926 - DNA, 77 bp, Homo sapiens
gagagctaaattcctggccttttgagaagagacactatcagccttttcttttcttggggctcagtgagttcttgcct

SEQ ID NO: 6927 - DNA, 96 bp, Homo sapiens
cttgagctatttcctgaagctctgagccagtaaggaggtgatctccaactaggtgtttagtctcctcattggtaagataacaggattgccattaag

SEQ ID NO: 6928 - DNA, 116 bp, Homo sapiens
gctccactttcctcattttagggtggactaagtgatatctctttttctttttttctttttatttttattttgagatggagtctcactctgtcgcccaggttggagttcagtggtac

SEQ ID NO: 6929 - DNA, 115 bp, Homo sapiens
gtattttctaggggagagaggttgtgggctacgcatatttttgtactcactggcaaagttctgtaaaataaccaggtgtttctagcacaatttctttatagtccctactaaatat

SEQ ID NO: 6930 - DNA, 115 bp, Homo sapiens
tcttttttttttttttttttgcacccagataagaaaaagacttgaatgtatttttttctataaaatgcagtcaatattgttctgtgagggggaaagaagtagtggaggatgaaga

SEQ ID NO: 6931 - DNA, 117 bp, Homo sapiens
aggtaggcaggtttcaaagggcacaaagatggtgttgaatagtctctgtggtgcctggcaccctctctccatgacacaggatggtctttctgcaatatccaagtaaactatgctcct

SEQ ID NO: 6932 - DNA, 110 bp, Homo sapiens
tacttccctcctgccagtcctcccatcctatacagcatgtttactgaagtcaatctgtgtatatttttgtttatgactgtttaaaggtgatcatgggcagaggtgtggtg

SEQ ID NO: 6933 - DNA, 95 bp, Homo sapiens; identical to SEQ ID NO: 68

SEQ ID NO: 6934 - DNA, 93 bp, Homo sapiens; identical to SEQ ID NO: 69

SEQ ID NO: 6935 - DNA, 138 bp, Homo sapiens
ctgcacccagtgcatcttgaattcttttcttgtcctgtgcccaggaagaatcaggtcacatgaaaggattgaagggtggtgtatgcagaggattttactgagtgatgggagtggcttcagcaggatggggagctggaa

SEQ ID NO: 6936 - DNA, 86 bp, Homo sapiens
ctagctcttggttagaaagtgaggtaactggaagaaggacattgctctttttttgagatggagtctcactctgtcacccaggctgg

SEQ ID NO: 6937 - DNA, 82 bp, Homo sapiens
gtttcaagactgggagagaacaacatcccaagtggggcagaattttaatttttctctcttgaaatgtttccaaccttggaac

SEQ ID NO: 6938 - DNA, 66 bp, Homo sapiens
ctctcactttcccactcacagtttggagcaggcaatgatgccagtaggttgagttggaggggagtg

SEQ ID NO: 6939 - DNA, 56 bp, Homo sapiens
gagacggagtctctctctgtcacccaggctggagtgcagtggcgtgatctctgctc

SEQ ID NO: 6940 - DNA, 77 bp, Homo sapiens
ctgagaaccaacaggtgagaagtgactgagctgggattggatcccacaattctctgatccttctgccctgttctcag

SEQ ID NO: 6941 - DNA, 81 bp, Homo sapiens
tctctgactctatgtgtgtgtgtgtacatgtgtgtgtacccatgtgtgcatgtatgtgcgcccatgtacgtgtacccgagg

SEQ ID NO: 6942 - DNA, 119 bp, Homo sapiens
tctgcttggctgtactggcacattcctaggggctggcagtgtgtgtgcagtgtgtgtgcacacacgctgacccatgtgacctgaggcctttgttaagtcctagtggtggtgaaagcagg

SEQ ID NO: 6943 - DNA, 71 bp, Homo sapiens
gggcctctgggtagcccccctcactggtgttggtgaccccgtccagagaagagagtgtgcccatgctgccc

SEQ ID NO: 6944 - DNA, 74 bp, Homo sapiens
ccaagcatcacttgtgtgtctgtatgtgtcgggcatgtgctagaccctatagatatgaacagaaagaagtcagg

SEQ ID NO: 6945 - DNA, 118 bp, Homo sapiens
tctgggatggatgtgtctgtgcctgtgtgtcggggtgggtaagtgtgctgtcttgtctggctatgggaggagagacaaaatgagctttggaaaggtaagcaagtgagcagctaccaga

SEQ ID NO: 6946 - DNA, 119 bp, Homo sapiens
atctagactatctgtatctcaggaaggtgttggcaggatccctgatgaaattcctggagacaagagagaaagctgagtagattcctagccagcaagcaaaggggtgttgatgaatagat

SEQ ID NO: 6947 - DNA, 96 bp, Homo sapiens
agatctctagcagtggtttgaagtcttgtctgcacattagaatcaccttggtgctttaagaaaaccgatgtctgtattctactccctggaggttct

SEQ ID NO: 6948 - DNA, 84 bp, Homo sapiens
cctctgggtcagatgctgtgccaggtcctggtgctgagagccagccccttacctgggaagacagacacagtcagacaatcatgg

SEQ ID NO: 6949 - DNA, 121 bp, Homo sapiens
ctccctaggggggatgttttggcctctaatacatggttccctgtgtctgagtgtctgtgtctggtccactgtggggagctttgcatctctgctcagggacctggagggaagacggactgag

SEQ ID NO: 6950 - DNA, 107 bp, Homo sapiens
gtgtgtcttgtgtgagtgtgtgtgtgcctgtgtgtatgagtgtatgtgtgtgtctgtgtgtgtgtgcaccttctccctagcaagagcacccataggttacatcagat

SEQ ID NO: 6951 - DNA, 60 bp, Homo sapiens
cagccccactcactcactcacctttcctgtagaggagccactgaatgaggtgggtgtctg

SEQ ID NO: 6952 - DNA, 68 bp, Homo sapiens
ttcccagtctgtctgcatcttgttattggaccctaagtgcaagcagccggacctcattcatctgggaa

SEQ ID NO: 6953 - DNA, 58 bp, Homo sapiens; identical to SEQ ID NO: 3380

SEQ ID NO: 6954 - DNA, 91 bp, Homo sapiens
ccctactttggccagtggtacacttgtgtatctcaagctttgggaaacattgagataagcaaatcgtaaaccctgaacaaatgcccatggg

SEQ ID NO: 6955 - DNA, 108 bp, Homo sapiens
gggaacaatttaggaggctggctgggcaatccccaccggctgcctctctcccactctgttccctttggccatggttcaggtttggtatagtagagtgaagaagggggc

SEQ ID NO: 6956 - DNA, 119 bp, Homo sapiens
aggccttgacggtctgttcctcccagcgcacagtagacactttttcttttcttttttttttttttttgagacagagtctcgctctgtcgccaggctggagtggtgcagtggcaagatct

SEQ ID NO: 6957 - DNA, 109 bp, Homo sapiens
aggcgcccacatagggagtgcgtggcctggagaaggaggtcctggggtgctctctccctgcctctcacagcctccatgactgctgctgatcagccccattgcggtgcct

SEQ ID NO: 6958 - DNA, 108 bp, Homo sapiens
gccccaccctgcccgggacccagttcaagtaattcaggataggttgtgtgctgtccagcctgttctccattacttggctcggggaccggtgccctgcagccttggggt

SEQ ID NO: 6959 - DNA, 84 bp, Homo sapiens
agtctcactctgtcactcagactgcagtgcaatgatgcgatctcagctcactgcaacctctgcctcctgggttcaagtgattct

SEQ ID NO: 6960 - DNA, 58 bp, Homo sapiens; identical to SEQ ID NO: 1725

SEQ ID NO: 6961 - DNA, 118 bp, Homo sapiens
tgatctgcagttcattataaggctgtctgaaaggtgtatggaggtagaatttttttttttttttttctgagacagagtctggctccaggctggagtgcagtggtatgatctcggctca

SEQ ID NO: 6962 - DNA, 133 bp, Homo sapiens
ccagtctcttagtgagagatacttgtttgttttctgcatttttgtttttgagacggagtctcacactgtcacccaggctggagtgcagtggcgcgatctcggctcactgcaacctccgcctcctgggttcaca

SEQ ID NO: 6963 - DNA, 117 bp, Homo sapiens
gtgtctgctgcctgcaagagaggtttaggggagagtgaatgaaacttttaatgggaaatgttatctttttaattaaaaaaatttttttttaaatttttctgggtacatagtaggtgt

SEQ ID NO: 6964 - DNA, 111 bp, Homo sapiens
ttgtttgttggttggttggtttgtttttgagatggagtctcgctctgtcacccagattggagtgctgtggttcgatttccactcactgcaacctccgcctcccgggttcaa

SEQ ID NO: 6965 - DNA, 58 bp, Homo sapiens
tgagacagagtctcactccgtctcccaggctggagtgcagtggcaggatctctgctca

SEQ ID NO: 6966 - DNA, 56 bp, Homo sapiens; identical to SEQ ID NO: 324

SEQ ID NO: 6967 - DNA, 58 bp, Homo sapiens
tgagacggagtctcacactgtcacccaggctggagtgcagtggcgtgatctcggctca

SEQ ID NO: 6968 - DNA, 58 bp, Homo sapiens
tgagacagtgtctcactctgtcacccaggctggagtgcagtggtgcgatcatggctca

SEQ ID NO: 6969 - DNA, 107 bp, Homo sapiens
ccgcatgactgaggcaagagcctacagcatcagcctcgtgggcctccctgtccctctgacccactgagccaagcagagcatgaaggcttagagcctgagcactccgg

SEQ ID NO: 6970 - DNA, 94 bp, Homo sapiens
cctcaggatgctcaatgtcaggctgtctcactctgggatgctaagtttgatccttgggttctggtagtggcaccctgatgcaaatagccctagg

SEQ ID NO: 6971 - DNA, 77 bp, Homo sapiens
ggggaatgtggagtgagaggggtggggtctgcatcatcagatgggcactagcagcccctcactctctgactgtcccc

SEQ ID NO: 6972 - DNA, 149 bp, Homo sapiens
tatatatattagcatatatatatataagcatatatattagcatatataaaagcttatatatattagcatatatataagcttatatatattagcatatatataagcttatatatattagcatatatatataagcgtatatatataaaagc

SEQ ID NO: 6973 - DNA, 107 bp, Homo sapiens
atatatatatgcatatatatatgcatatatatatatgcatatatatatgcatatatatatgcatatatatatgcatatatatatatgcatatatatacatatacgtg

SEQ ID NO: 6974 - DNA, 119 bp, Homo sapiens
tttctggtgttatactactcaggagaatggtaaagagatggttataatttaacttcacatagttatttcattatttcttgtttaaataatctcatctcttgtttggtaactttgaggag

SEQ ID NO: 6975 - DNA, 88 bp, Homo sapiens
tcacagctgccagtgtcatttttgtgatctgcagctagtattctcactccagttgcatagtcacaaaagtgatcattggcaggtgtgg

SEQ ID NO: 6976 - DNA, 84 bp, Homo sapiens
gcatacccatatattcacatatatacatgtgtgtgtcctgtttacagaacatacatgtgtgtgtgtgtgtgtgtgtgtgtgtgt

SEQ ID NO: 6977 - DNA, 105 bp, Homo sapiens
ccctcccatcccccaccccctgtccgtgagtcagcgctgactgtctctgtccgcacagatgtgagtcagcaccaggcctggctgtggggagggggacaagagagg

SEQ ID NO: 6978 - DNA, 116 bp, Homo sapiens
tccccacccgcctttcctgtaggctaaagttcggactcctctgtcagtggggcctgactccctgacagcctccccctccatgcctagaccgtttctggagggcaagggttttggga

SEQ ID NO: 6979 - DNA, 90 bp, Homo sapiens
tgtgaccttgggcaagtaacctctctgtgtctcagtcttcctcttgtcgtgaggattaaatgagctcattcacatagagtgcttagcaca

SEQ ID NO: 6980 - DNA, 135 bp, Homo sapiens
gcatgtgtgcgtgtgcgtgcgcatgcgtgcgtgtatgtgcatgcatgtgtgtgcatgtgtgtgcgtgtgtgcgtgcgtgtgcatgtgtgcgtatgggtgtgtgcatgcgtgtgtgtgtgcgcgcgtgtgcgtgca

SEQ ID NO: 6981 - DNA, 94 bp, Homo sapiens
ctggtgggcaggctggagagacccggtcttcaggacactgggtgccagtgtctcttctggatctctgtgtgtctctcacatgcctgcctcacag

SEQ ID NO: 6982 - DNA, 86 bp, Homo sapiens
gcctggggactctgactcagtgcctgtcatgggacccagatggagaaggaggggcagtggccatggcaggggctggagggtctggc

SEQ ID NO: 6983 - DNA, 120 bp, Homo sapiens
ggagagggaattgtaaaatatcctcagttgaggaccatttattaagactttgacagtatttttatatcttaccttctctttatatgaatcttcatctgagactttgctttctctgactcc

SEQ ID NO: 6984 - DNA, 149 bp, Homo sapiens
atatatatattatatatacatgtatatgtatgtgtgcatatgtatgtatacacatatgtatgtatatgtatatgtatgtatggatgaatacagaatatatatatatatatatatagcaatttctgtattcatccattcattgacgaaca

SEQ ID NO: 6985 - DNA, 64 bp, Homo sapiens
tctctcggtgtctcagtttctcatctgtaagatgggaatactaagagtatctttctcagagagg

SEQ ID NO: 6986 - DNA, 73 bp, Homo sapiens
tccagaaactccacaggctggctggtcactccagagtctctcagctaaacctttggatggagcaggccttgcc

SEQ ID NO: 6987 - DNA, 95 bp, Homo sapiens; identical to SEQ ID NO: 580

SEQ ID NO: 6988 - DNA, 93 bp, Homo sapiens; identical to SEQ ID NO: 69

SEQ ID NO: 6989 - DNA, 56 bp, Homo sapiens; identical to SEQ ID NO: 324

SEQ ID NO: 6990 - DNA, 62 bp, Homo sapiens
tccagtgtgtctctgtgtctgtattcggacacagccatatgaagacagaggcagagactgga

SEQ ID NO: 6991 - DNA, 91 bp, Homo sapiens
ggtcgcccatgggttcagagtgactgtctatgtgtcaggtaaagtagaaactttaggatgccatggaagagacagccaacttttgggcacc

SEQ ID NO: 6992 - DNA, 102 bp, Homo sapiens
gtgtatgtgcatacgtgtgtgattatatatatatatatatatatatatatatatatatatatatatatatattatgtatatatatgtgtgtgcatacatgtg

SEQ ID NO: 6993 - DNA, 103 bp, Homo sapiens
acactgggcagatgggaaactggtgcctgagacaagaaagtgacctgggaagtgataacagttcttctcctccttttcttcttccttcttcctctcccgatgt

SEQ ID NO: 6994 - DNA, 147 bp, Homo sapiens
tatatatgtacatgcaaataacatatatgtgtatatacacacatatgtgtgtgtatatatatagatatatatatagatatatatagatatatatatagatagatagatatagatatatatagatatatatagatagatatatagata

SEQ ID NO: 6995 - DNA, 90 bp, Homo sapiens
aatcgtgatagtgagcatagttttttgtttattgattttaatagaatactattaataatttaccattaacaatgatgtttgctgtagatt

SEQ ID NO: 6996 - DNA, 88 bp, Homo sapiens
aagcataagaattgaaatctagcaatagttctgggattccacacacttggcccagttttattattagtatttttgaatcattcagctt

SEQ ID NO: 6997 - DNA, 120 bp, Homo sapiens
agtctcaagtatgcctttattagcagcataagaacagactgatacagttgcttttagttatttatttcatagtttcagctgtttttatagttgtttgaaccatatctgcatgactttagg

SEQ ID NO: 6998 - DNA, 105 bp, Homo sapiens
ttgccaagagtctgctgagctggcacagagtgtggttaggaaggtgtgatggttgattttatgtgtgtacttgactggtccacagagcgcccagatacttggtaa

SEQ ID NO: 6999 - DNA, 108 bp, Homo sapiens
ttgtcctcatatacttttaatgcttattgtagatccatatgaattcagtaaacacttattttgacttattttatgtgtgattctgtcaggcactggaatgggaggcag

SEQ ID NO: 7000 - DNA, 75 bp, Homo sapiens
gggaagacagaagacactgtggaaagaaaaactcctctgcttataaaattctttacccagtgaagctatctttcc

SEQ ID NO: 7001 - DNA, 84 bp, Homo sapiens
tatgtacacaaatatgtagtatctttccccactttacatatgtatatatatatatgtgtgtgtgtatatatatttgtgtgtgtg

SEQ ID NO: 7002 - DNA, 98 bp, Homo sapiens
tgagacaatttgggaatttgtttaagtggtactcataggcttacacaacctgagtacagtagcttttttattaatatttaatcctcaaaacagtctca

SEQ ID NO: 7003 - DNA, 165 bp, Homo sapiens
tatatatatatatatatatgtgtgtgtgtgtgtgtgtgtgtgtatatatatatgtatatgtgtatatatgtatatgttatatatgtgtgtgtgtatatatatagttacatatagctatatatatagctatatatagttatatatatatttcagtataacatatat

SEQ ID NO: 7004 - DNA, 131 bp, Homo sapiens
atgtgaagttatgtatttcacatataatgaatatactaatatatatggtattatgtatttcatatatattattatttgcattatatccataatatgtatttcatatatattagtatatccatatttggagg

SEQ ID NO: 7005 - DNA, 56 bp, Homo sapiens
gagactgagtctcactctgtcgcccaggctggggtgcagtggtgagatcttggctc

SEQ ID NO: 7006 - DNA, 85 bp, Homo sapiens
tcttgagtctctcacacacactgccaagtttttggcagctgcctctatttaagctgcatcagatcagtgcctgagagattttgga

SEQ ID NO: 7007 - DNA, 108 bp, Homo sapiens
catccttctatgtctgctgcatcccctgccttgtactctgtcactgtctttctcattagtgagacctgcatctcgccagcctcccttgcaaaggaggcataaagggtg

SEQ ID NO: 7008 - DNA, 114 bp, Homo sapiens
ctcccttatctgagaaagaagcaccagagaagttggtaggaatgaaaacaaccatgttctatgccactcccttctccaagcttttaataactatttttttggacttctagggag

SEQ ID NO: 7009 - DNA, 109 bp, Homo sapiens
caacagtgcttgtgatatcactgaatcaaaggcttggaagcaaagctaagaccagactttgtatatttttttatccctagttaagtgatttttctacaatctttagttg

SEQ ID NO: 7010 - DNA, 85 bp, Homo sapiens
atgtacaaagtgtctcagaggctctctcattttccaatacacttatgtgttgcttaatgatggggatatattctgagaaatgcat

SEQ ID NO: 7011 - DNA, 85 bp, Homo sapiens
ggtgtgccaccatcaagatcctcatatgctcagtctcctaggttcttcaaggcagtacagactgtgcactcaggattttcacacc

SEQ ID NO: 7012 - DNA, 116 bp, Homo sapiens
aaggggcttcacatttcatagtagggatcttgaaggcagcttttaaagcatctatatatgaattttatgcaggccactaatttctctattcttggtgtgttgtctgtttctgtccc

SEQ ID NO: 7013 - DNA, 115 bp, Homo sapiens
gcttggttttgtttatattcagttgtcttattgtagatttctacatatatgtatatatttctatattgtagaaatcagcaataaaagaagacaactcaatataagcaaaaggcta

SEQ ID NO: 7014 - DNA, 77 bp, Homo sapiens
gattctttattagggtgtgtgtgcttgtgcatgtgcatgcatgcaggtgcacatatgtgtttgtatatcttgaggaa

SEQ ID NO: 7015 - DNA, 242 bp, Homo sapiens
atacacgtatatatgtacgtatatacgtatatacacgtatatatgtgtgtatatatgtgtatatatatacatatatatgtgtatacatatatacgtgtatatatatgtgtatatatatgtgtatatatatatgtgtatatatatgtgtatatatatgtgtgtgtatatatatatatgtatgtgtatatatatatatatatatatatatatatttttttttttttttttagaccaatagcatg

SEQ ID NO: 7016 - DNA, 110 bp, Homo sapiens
atgtgtacatcacagcttgtacatttttgcatacaatatcatattctcattttgtagatgagaaaaatagaaatgcagagagattaccagacttgaccaagattatacat

SEQ ID NO: 7017 - DNA, 111 bp, Homo sapiens
tatatagatatatctagatatatatagatatgcatatatatacatatatacacatatatattatatatacatatatgtatatatctatatatatatacacacacatatata

SEQ ID NO: 7018 - DNA, 74 bp, Homo sapiens
acacacacacagacacatttttatatacgtatgtgtgtgtatatatgtatatgtacatatgcatgtgtgtgtgt

SEQ ID NO: 7019 - DNA, 71 bp, Homo sapiens
gaggtcagactcactgagtcacaatgtatcaccatgagaccttgaacaactcacttgagcttcctgatctc

SEQ ID NO: 7020 - DNA, 97 bp, Homo sapiens
gggctcccagaaatgaacctagatctagaataaaaataaaccttctgggacacacttagattatttctttttgagatagggtcttactctgttgccc

SEQ ID NO: 7021 - DNA, 111 bp, Homo sapiens
gaagccattgggtctcaggattttctttactggaagacttttgatttacttagatcttgttacttgttattggtctgttcaggttttggatttcttcatggttcaatcttt

SEQ ID NO: 7022 - DNA, 103 bp, Homo sapiens
ggtgcggctccaaggggctggtaatatatttaagaaacccttatattatgtaaagatgtattgtttggggagaaatatcaatgagagccctttctatctcact

SEQ ID NO: 7023 - DNA, 58 bp, Homo sapiens; identical to SEQ ID NO: 1409

SEQ ID NO: 7024 - DNA, 97 bp, Homo sapiens
gcaccattaatacacaggcttagggttttttggacacaagttcacatgactgtctctcagtgtgcaaaagaacagcagctgatttaagagtgagagc

SEQ ID NO: 7025 - DNA, 119 bp, Homo sapiens
acaaccagagtacatatatatatatatatgtgtatatatatatacacgtgtatatatgtgtatatatatatacgtgtatatatatgtgtgtatatatacgtgtatatatatgtgtgtat

SEQ ID NO: 7026 - DNA, 98 bp, Homo sapiens
gcgcagaaacattttagtttcatgttggaccttttttttttttttttgcttttaaaggagaaagtaccagagagtactatcaaagtttcaaaatgtgt

SEQ ID NO: 7027 - DNA, 104 bp, Homo sapiens
gggtcacctaatgcagacatcgcctccaaagtggcatcgtttagcaggcgtgtgtctctcagtctgtgtgcctcatggggagcggagttggcggagggaggaac

SEQ ID NO: 7028 - DNA, 62 bp, Homo sapiens
gcacctcttttttttttcttttttggagacagagtcttgctctgtctcccagactagagtgc

SEQ ID NO: 7029 - DNA, 96 bp, Homo sapiens
catgtggatccctgtcaagctctgatggactggtcattttcttctatcattggttatgtaccagtgactgagagctttcagtctcatgtgcaaagc

SEQ ID NO: 7030 - DNA, 78 bp, Homo sapiens
actgatggagaatggctgttcttttttcatcagtgatcacaaaccccttgacactggagaattcattcaccagtcagt

SEQ ID NO: 7031 - DNA, 83 bp, Homo sapiens
gagctagaacagagtgagcaaaggggaggaataggaggccagatcatattaggccttttgggttattctaagaacattagctt

SEQ ID NO: 7032 - DNA, 107 bp, Homo sapiens
tctacctatctatcatctgtctatctatctatctgtctgtctgtctgtctctaatattatagatatagccagattgaaactgggaggctggagtgaagtaagggaga

SEQ ID NO: 7033 - DNA, 61 bp, Homo sapiens
tgagacggagtctgtcactgtctcctgggctggagtgcagcaatggcacgatctcggctca

SEQ ID NO: 7034 - DNA, 101 bp, Homo sapiens
ctctccagaaaatgaaggactatctgacgggttcgtttgggaggaagaacatgcacggcatggctcgctcgctctctccgttttcctactgatctgcagag

SEQ ID NO: 7035 - DNA, 82 bp, Homo sapiens
agttttagggtacatgtgcacaatgtgcaggtttgttacatatgtatacatgtatcatgttggtgtgctgcacccattaact

SEQ ID NO: 7036 - DNA, 95 bp, Homo sapiens; identical to SEQ ID NO: 68

SEQ ID NO: 7037 - DNA, 93 bp, Homo sapiens; identical to SEQ ID NO: 69

SEQ ID NO: 7038 - DNA, 95 bp, Homo sapiens; identical to SEQ ID NO: 580

SEQ ID NO: 7039 - DNA, 93 bp, Homo sapiens; identical to SEQ ID NO: 69

SEQ ID NO: 7040 - DNA, 59 bp, Homo sapiens
tgtgagagtggggctcttgtttatcttttttttttttgagacagagtctcgctctctca

SEQ ID NO: 7041 - DNA, 102 bp, Homo sapiens
tattttaatacagtattgatatagtaatattatataatactatataaatattatattaacataacattaatattactatatcaatgttatgatattaacatg

SEQ ID NO: 7042 - DNA, 111 bp, Homo sapiens
gttagttacctgggatttgtcttcctgtgcttccactggttttcttctcttgtcactctctctgtgcagaggcttaaactcagccattcacactctcatcctgctctagct

SEQ ID NO: 7043 - DNA, 70 bp, Homo sapiens
gtgtttcttgaactaaacattcatcagatcccaggtcaatgttgtctggtaggatggtttcatgcaacac

SEQ ID NO: 7044 - DNA, 74 bp, Homo sapiens
ggcctgacagtctgttaaggcaggtgtctatggcctgtgtcacacaaactcacactctttagcaatgtcacgcc

SEQ ID NO: 7045 - DNA, 107 bp, Homo sapiens
atctagagatgatttaaaatatgtgggagaatgtgtataggtaatatgcaaacaatgtgcaatatttttcttatttatttttgtacatgaataagttatttaatgat

SEQ ID NO: 7046 - DNA, 99 bp, Homo sapiens
ggctcccagggacattgaaatgtttggtgtttttattcctatgtgatacatctctacttaggggaaagtacgctattccttttcaaaagatttgatgct

SEQ ID NO: 7047 - DNA, 80 bp, Homo sapiens
attcattcattcattcattcatttctttaaatgttcggaatacaacatttgttttgaatgaatgaatgaatgaatgaatg

SEQ ID NO: 7048 - DNA, 77 bp, Homo sapiens
gtgaccgagggcctcactctccctctcatacttttgctggggtgagtgctccaggactcttacacctcagaggtcac

SEQ ID NO: 7049 - DNA, 86 bp, Homo sapiens
agttggtggtgagagcagtgagtcagcatatttgtaaacttcagaagagtacagaacactgataatttactgtggcactggtaatt

SEQ ID NO: 7050 - DNA, 60 bp, Homo sapiens
gtgagacagagtctcactctgtcgcccaggctggagtgcagtggtgtgatctcggctcac

SEQ ID NO: 7051 - DNA, 58 bp, Homo sapiens; identical to SEQ ID NO: 2626

SEQ ID NO: 7052 - DNA, 109 bp, Homo sapiens
gaggcacaggttttcaaatggttttcgcaggaagtctgatactagaaagtgtgctctaagctgctgtataaaagatccctcgaaaatgaaaaggctggaggaatgtctt

SEQ ID NO: 7053 - DNA, 109 bp, Homo sapiens
tggctggccatggtggcacacgcctgtagtcccagctacttgggaggctgaggtaggaggatcacttgagctggggaagttgaggctgcagtgagccatgattgtgcca

SEQ ID NO: 7054 - DNA, 58 bp, Homo sapiens
tgagaccgagtctcactctgtcacccaggctggagtgcagtggcgcgatctcggctca

SEQ ID NO: 7055 - DNA, 86 bp, Homo sapiens
gccagctaggctataatttgttcttttttggggggacagtgtcttactctgtcacccagactaaagtgcagtggcacaaagatggc

SEQ ID NO: 7056 - DNA, 115 bp, Homo sapiens
ccaataagaaggtgcatcagtgaaagaggacaagaaaagccaccccttggtttatggttgacccatgagagtgagctgtgttctgcttactatgatggagacacagcgtttttgg

SEQ ID NO: 7057 - DNA, 81 bp, Homo sapiens
ggaggtagtttcaaggggcctacaagcaaaaagctgcctaattctcaacagctctttgcttgttcttttttttttttttct

SEQ ID NO: 7058 - DNA, 67 bp, Homo sapiens
tttttcctggatagtgaaagatctgagtgaacagttaaaaattgagaatttcattaccaaggaagaa

SEQ ID NO: 7059 - DNA, 99 bp, Homo sapiens
cagggccatcaagacactggtgagtcaaacttgagtgatccaggctcttacactcagtgactcaaattcaccaaacccattttgctcctgaaggccatg

SEQ ID NO: 7060 - DNA, 113 bp, Homo sapiens
ctgctctataacttactggtcagaacatcttgagcaactaaaattcagtcttttttaatttttttttttttttgagatggagttttgctcttgtcacccagcctggagtgcag

SEQ ID NO: 7061 - DNA, 127 bp, Homo sapiens
tcttctcttggtctctgattttctagaggtactagcagaagatgaaagcaagggaagaaagtgaggtgacagtgtccattctcggttgtcctgagacctggtcactgtgggttgcctgtgtctctcc

SEQ ID NO: 7062 - DNA, 115 bp, Homo sapiens
tgggagcaaataaagaatatttcagctcatatcaaatgcacttcaatatcacattttgtacttctgctattgtgatgggaggtggatgagtagaaaacattccatgtggctgtca

SEQ ID NO: 7063 - DNA, 84 bp, Homo sapiens
atatatgtatatatgtgtgtatatatgtgtatgtatatatacatatacatacacatacacgtatatatacatatatatttatat

SEQ ID NO: 7064 - DNA, 98 bp, Homo sapiens
gccactgcgcccagcccagtttccatattcttaagcaaaatactgtcctatgccactttaggaagtaggttggaaagaatgaaactccttgcattgac

SEQ ID NO: 7065 - DNA, 124 bp, Homo sapiens
agtcctttttactgctagtagcaaatatatgctttttaggaagcaggaccatttttatatttttgaaactcagtgagtctgctatacctgtaaatatttgaatactataaatgactagtgctga

SEQ ID NO: 7066 - DNA, 105 bp, Homo sapiens
ctgtaaaaaaactgaggacttatttgacagccacctttcttgccctaaatatacttttatttatatggcaggtatgctggtctttatctctatttgtttttatgg

SEQ ID NO: 7067 - DNA, 70 bp, Homo sapiens
cacatgactcatggctttgagctgtgtcttccattacagagaagtcagccagactgtctgagtgtttgtg

SEQ ID NO: 7068 - DNA, 58 bp, Homo sapiens
tgagacggggtctctctctgtcacccaggctggagtgcaagggtgtgatctcagctca

SEQ ID NO: 7069 - DNA, 101 bp, Homo sapiens
ggattccagtagcgggtggggtgggatatttagactcatctaagttgcttttttttttttttttgagatggagtctttctctgtcacccagtctggagtgc

SEQ ID NO: 7070 - DNA, 58 bp, Homo sapiens
gtgagacagtctcgctctgtctcccaggctggagtgcagtggtgagatctcagctcac

SEQ ID NO: 7071 - DNA, 58 bp, Homo sapiens; identical to SEQ ID NO: 285

SEQ ID NO: 7072 - DNA, 99 bp, Homo sapiens
tccaggagggtggcaggcatctgcaaatatctcttcttcttcttcttctttttttttttttttttttagacagagtcttgctctgtcacccaggctgga

SEQ ID NO: 7073 - DNA, 102 bp, Homo sapiens
tgtgctttgtttagcttgaacaaggttttattttattttattttatttatttttttgagacggagttttgctctttggcccaggctggagtgaagaggtacg

SEQ ID NO: 7074 - DNA, 58 bp, Homo sapiens
tgagactgagtctcactctgtcacccaggctggagtgcagtggcgcgatctcggctca

SEQ ID NO: 7075 - DNA, 72 bp, Homo sapiens
ggccatggatagggttcgagacttttttttttttttttttttgaggcagggtctcactctgtctcccaggct

SEQ ID NO: 7076 - DNA, 78 bp, Homo sapiens
aggatgggagtacagatttgggaccttttttttatttttaattttttggagacagggtctcactctgtctcttaggct

SEQ ID NO: 7077 - DNA, 116 bp, Homo sapiens
atgaagcaaacaatggttcttaattttgtttttcctagactaacaggtgatggtacagtaatgattttcaagtagcataatttgaggagtctggaaatagatgctgaattcttcat

SEQ ID NO: 7078 - DNA, 68 bp, Homo sapiens
tatatactacaccatagtgtgtgtgtgtatatatatatatatatacacacacacactatctgtatata

SEQ ID NO: 7079 - DNA, 111 bp, Homo sapiens
gcccctgggacctcttgccctggttcctctggctcctgggttctgaggtcctctttgcagagacagaagtcagcctggagcccaggggaagcatgccagctcccaagatgc

SEQ ID NO: 7080 - DNA, 68 bp, Homo sapiens
aatccaaggggcaggaggccagggaagagggggaccagcctcatttctgactggctgtctctgtgatt

SEQ ID NO: 7081 - DNA, 93 bp, Homo sapiens
gatccggggggtgtaggggtggaggataggacgtagggagggaaagttactgacttctcagagactctgcttcttcatctgctaaataggatt

SEQ ID NO: 7082 - DNA, 128 bp, Homo sapiens
ttttaattagccaagagtggtggcatgcttctgtattcccagctactcaggaggctgaggtaggaggatcacttgagcccatgagatggaggcagcagggagccatgatcatgatgccactgcactcc

SEQ ID NO: 7083 - DNA, 73 bp, Homo sapiens
aggcttaagtgatccatccacctcagtgcccccaaagtgctggggttacaggtgtgagtcaccacactggcct

SEQ ID NO: 7084 - DNA, 58 bp, Homo sapiens
tgagtcagagtctcactctgtcacccaggctggagtgcagtggcgtgatctcggctca

SEQ ID NO: 7085 - DNA, 118 bp, Homo sapiens
tgtgtgtgtgtgtgtgtgtgtgcatgcacgtgtgtgtgtgtatatatatatatatggaggacgaacaagagatgtataaacatacacacatgtttatatacatatacatatatatata

SEQ ID NO: 7086 - DNA, 112 bp, Homo sapiens
ttatatataaggagttctatatatatatatatatatatatatatatatatgagttccatatatataattatgtatatatgtgtgtatatatatgtatatataactatatata

SEQ ID NO: 7087 - DNA, 116 bp, Homo sapiens
aattttatagggtgttaaccaatggattagatgacaaccaaaaactgtatatgttttttaagtaaatggctttttgttttgcttttgatttatgattagcattgtctaataaaatt

SEQ ID NO: 7088 - DNA, 102 bp, Homo sapiens
gctctattttatcatatgccactaattatttattttaaaattcttagaaagagcaatccaaaatatgaaagaaaaagtaaataagcatttgattaatagagc

SEQ ID NO: 7089 - DNA, 123 bp, Homo sapiens
gtgtatatacataaactattattattgaacataatgggtatttgtcatttcttatgtaagtatgtatttatgtatatacatatatatgcatgcatatatgtacatacaaaacgcacagtctca

SEQ ID NO: 7090 - DNA, 109 bp, Homo sapiens
ggttgaagtgtagggggtagttctaagtgtgtgtctgtctgtggctctgtttgagttacagtcagttaaagagacgttcacaccttgtgttgcctttaaacattcagcc

SEQ ID NO: 7091 - DNA, 123 bp, Homo sapiens
atatatgtgtatatacatatgtatatcgttatatatgtgtatatagttatatatgtgtatatatgtatatatgtgtatatataatatgtgtatgtatacatatatagattttttttacatgac

SEQ ID NO: 7092 - DNA, 71 bp, Homo sapiens
ggacaaaagagctatttaggccacacagtttcctggccccaggcatttgttgtgcatatgttgttttgttt

SEQ ID NO: 7093 - DNA, 128 bp, Homo sapiens
atatatatgtgtgtatatatatatgtgtgtgtgtgtatatatatatgtgtgtgtgtatatatatgtgtgtatatgtatatgtgtgtgtgtacatatacatatacacacacacatacatacacatatgt

SEQ ID NO: 7094 - DNA, 68 bp, Homo sapiens
tatatgtatatatgtatacgtatacatatatacatatgtatatgtatatatgtatacgtatacatata

SEQ ID NO: 7095 - DNA, 89 bp, Homo sapiens
aatgaaacattacatttgctttgaaatagcttatctttttgttttaaattattcagaaaggtaagatatatctctggcatattttcatt

SEQ ID NO: 7096 - DNA, 62 bp, Homo sapiens
gcaattagctccattgtctgggtccaggattcattccaggatcacacactgcatctagttgc

SEQ ID NO: 7097 - DNA, 86 bp, Homo sapiens
cctgtttgctctctgactgtgagtcaggggctactctcagctgcatttcttgccatgtggcccctccattttcaagctagcaatgg

SEQ ID NO: 7098 - DNA, 139 bp, Homo sapiens
atacatgtatgtgtatatgcgtatatatacgcatacacatgtatatatgtgtatatatacatacatacatgtatatatgtgtatatatacacatatatgtatgtgtatatatacacatatatgtatgtgtatatgtatg

SEQ ID NO: 7099 - DNA, 95 bp, Homo sapiens; identical to SEQ ID NO: 68

SEQ ID NO: 7100 - DNA, 93 bp, Homo sapiens; identical to SEQ ID NO: 69

SEQ ID NO: 7101 - DNA, 121 bp, Homo sapiens
ccaagggtaggtcccttgtttcattatttaggtttatatcagacaagtgacagtacagattgtgttccttcctagatcgttccttgaatgataagcaacttcagctctattggtttctccc

SEQ ID NO: 7102 - DNA, 93 bp, Homo sapiens
atttatatacatatatatgctcatatatgtatgtatgtatgtgtgtgtgtatatatatgtatatgtatgtgtgtgtatataaatgtatataaa

SEQ ID NO: 7103 - DNA, 95 bp, Homo sapiens; identical to SEQ ID NO: 68

SEQ ID NO: 7104 - DNA, 93 bp, Homo sapiens; identical to SEQ ID NO: 69

SEQ ID NO: 7105 - DNA, 107 bp, Homo sapiens
ggagcccacatgaccgggtctgaaaagaacctaaaagtcactgtctcacagagtatttgataatttttagcatttctattcacagcctagctttctctggagcatct

SEQ ID NO: 7106 - DNA, 99 bp, Homo sapiens
tgattgatacccatgagaagacctgagacacagcagagtgtgagctaaggggcctgaagcttctacagtgtgggaggccttctttaataaatttaaaca

SEQ ID NO: 7107 - DNA, 88 bp, Homo sapiens
ggtgagaggcaagtctgtgattctcactgtgaatttagtgtagcctaaataattgcccaacagtgaatggaatctgctttttagaacc

SEQ ID NO: 7108 - DNA, 121 bp, Homo sapiens
ttggttgcatgatatagttgtatgtgcatatatatatgtaatatatataagtacctatatatttatatttgataacataaatacatatatgcaaacacatacattgcgctggccctgaacc

SEQ ID NO: 7109 - DNA, 96 bp, Homo sapiens
cactgtgatccttatcctccctctaacagcagctcaccagacagtgtctgtcattcagatcctggcagcggggagacagaggaaaagccttatttg

SEQ ID NO: 7110 - DNA, 69 bp, Homo sapiens
gtatatatatatatatgtgtgtgtgtgtgtgtatgttacatacgtgtgtgtatatatgtgtgtgtgtat

SEQ ID NO: 7111 - DNA, 76 bp, Homo sapiens
gagaggggttggtcttgctgtcttaggaatggcagaggtagaagaaagtccatagataaggggacctgcatatttc

SEQ ID NO: 7112 - DNA, 60 bp, Homo sapiens
tggtgaactgaaaaggggagagaagactgaaaagatctctctctctctctctctcacaca

SEQ ID NO: 7113 - DNA, 97 bp, Homo sapiens
tatttataatatatatgtgtatgtatgttcgatattatatatttgtattatgtatttatgtaatattatcacagattcacacagggtgttaaaaata

SEQ ID NO: 7114 - DNA, 131 bp, Homo sapiens
tgataagtcatgttcatagggtgtgtccttggtaggatgtgatgagatggaactttacctctgtgtttttcactctctaagcatattatcacagcctaattttgagaaaaaacatcagacaaatcccaatg

SEQ ID NO: 7115 - DNA, 71 bp, Homo sapiens
gccatgagctcaggttacaaatttgtttatatttagatgaacaggtgtgtggctcagttctaaatcaaggc

SEQ ID NO: 7116 - DNA, 68 bp, Homo sapiens
acatatatacatatatatacatgtatacacatacatatatgcatatatgtatatatacctatatgtgt

SEQ ID NO: 7117 - DNA, 113 bp, Homo sapiens
acaaactctcagtgtatttcttctacagcagggttggcaatgccttttaaaatatttatttgtgtacttgatccagccaagttgctcaggggtgtacttttttccatgtgagt

SEQ ID NO: 7118 - DNA, 108 bp, Homo sapiens
ttggtgatatacaaaggctggcctcttttgccttagattttcagacagggatttctgtgtcattcagtgattaagggtgccaaatgtagccaggaactgtttcagcaa

SEQ ID NO: 7119 - DNA, 125 bp, Homo sapiens
tatatgtatacatgtgcatatgtgtatatgtacgtgtgtatatgtatgcatatacatatgtgtatatgtacatgtgtatatgtacatgtatacatatacatagatgtgtatacatacacatatgt

SEQ ID NO: 7120 - DNA, 123 bp, Homo sapiens
attcatttaagtgaatgaatatatatattcatttaagtgaatgaatatatatgtattcatttaagtgaatgaatatatatatgtattcatttaagtgaatgaatatatatatgtattcattta

SEQ ID NO: 7121 - DNA, 92 bp, Homo sapiens
acatatatatgtatgtacacacatatatacacacacacatatatatgtatgtgtgtatatatgtgtgtatatatatgtgtgtgtttatatat

SEQ ID NO: 7122 - DNA, 66 bp, Homo sapiens
tctctgtctcccagtctgtgtgggaggatggaatcctaatttgcacagtgagtgccagatagcaga

SEQ ID NO: 7123 - DNA, 81 bp, Homo sapiens
cttttgctaaagtaagagttggaagtccactttgatgctactttgccagatgtgaatacttctttctttatttttctgaag

SEQ ID NO: 7124 - DNA, 82 bp, Homo sapiens
gaaggggtactgattattgatgtatgtttcgttagcagtagatttattgccctgcaataatattaatttttagaaacccttt

SEQ ID NO: 7125 - DNA, 82 bp, Homo sapiens
gttttgagaaggtagggatgagatggaggccactggttggttacatggtctttctatatttgtcacacactctctctgttgc

SEQ ID NO: 7126 - DNA, 117 bp, Homo sapiens
tggtgtccttattgttattaaagggaaggctgctaagagagtctattatttattatttgatgacttgtgctagattttgagactgtgtaaggctctcaacttacagtttggacttca

SEQ ID NO: 7127 - DNA, 88 bp, Homo sapiens
gcccaggctagagctgctggagtttgtctccttttttttttttttttttttttttttttgagatggagtctcgctctgtcacccaggc

SEQ ID NO: 7128 - DNA, 71 bp, Homo sapiens
ctgtggcctctctctgcctgtccctgtaatgtgctgttgaccgtggagttggaagggatgctggctcacag

SEQ ID NO: 7129 - DNA, 106 bp, Homo sapiens
ctctattcaggaagaagtttgtttagctcagccaaacttactttatttttcaacagatgaagtaaaccagactcagaactctacatcttttttttcacatatgggg

SEQ ID NO: 7130 - DNA, 70 bp, Homo sapiens
catatatagatacacatatgtgtgtgtgtgtatatatatatatatatatatatagatgtataggcttgtg

SEQ ID NO: 7131 - DNA, 104 bp, Homo sapiens
tgtgtatctatatatgtgtgtatatatatctatatatgtgtatatatatctatatatgtgtgtatatatctatatatttgtatatattcatctatatatacaca

SEQ ID NO: 7132 - DNA, 116 bp, Homo sapiens
gtggagggccaattgtatttctcaaatgactcaagattagtgtatttttaaatgtgtctacattatatgataaatgaaactgattaagaaggtctgaatacctatggcatattcat

SEQ ID NO: 7133 - DNA, 73 bp, Homo sapiens
tatctggaatgtaatgaacattgagtttattattttgttttttgatccatgcttaaggcttgcattccaggta

SEQ ID NO: 7134 - DNA, 71 bp, Homo sapiens
gtctgactgcatctccatgagtagatcctgaagaaaccaggagcctgcagcccctaggagggtgcagtgac

SEQ ID NO: 7135 - DNA, 95 bp, Homo sapiens; identical to SEQ ID NO: 68

SEQ ID NO: 7136 - DNA, 93 bp, Homo sapiens; identical to SEQ ID NO: 69

SEQ ID NO: 7137 - DNA, 58 bp, Homo sapiens
tgagacagagtctcgctctgtctaccaggctggagtgcagtggcgcgatctctgctca

SEQ ID NO: 7138 - DNA, 87 bp, Homo sapiens
caaactttgctgtctgtgtctgtgtgtgtgctctgaataatacgtgtgcaggggccaatcacagacagactttgacagaaatcattg

SEQ ID NO: 7139 - DNA, 119 bp, Homo sapiens
gtctctggatagggaaggctcccagtcctgagcggcactctgctgtgtgtgtctttgtgtctgcgtggtcaaggagagctgtgtgtgccacaacagggagcctgtggtcttcctgagat

SEQ ID NO: 7140 - DNA, 60 bp, Homo sapiens
gtgagacagggtctcactgtgtcacccaagctggagtgcagtggtacgatctcagctcac

SEQ ID NO: 7141 - DNA, 105 bp, Homo sapiens
aagtgtgtttgtacacatctgtgcctgtgtgcccatgtgctcatctgcctctgtgtgtgcgtgtgtgtgtgtgtgtgtgaatgaggtcattgtatgaatatgctt

SEQ ID NO: 7142 - DNA, 309 bp, Homo sapiens
tatatatacacatgtgtatatatataatatgtgtatatatacatatatgtgtatctatgtgtatatatacatatgtgtatatatacatatatgtgtatatatacatatgtgtatatatgtgtatatatgtgtatatatacatatatgtgtatatatgtgtatatatgtgtatatatacatatatgtgtatatatgtgtatatatacatatgtgtatatatgtgtatatatacatatatgtgtatatatgtgtatatatacatatatgtgtatatatgtgtatatatacatatatgtgtatatatgtgta

SEQ ID NO: 7143 - DNA, 209 bp, Homo sapiens
tatatatacatatatgtgtatatacacacatatatgtgtatatatgtgtatatatacatatatgtatatatacatatatgtgtatatatgtgtatatatacatatatgtgtatatatgtgtatatatacatatatgtgtatacatacatatatgtgtatatatgtgtatatatacatatatgtgtatacatacatatatgtgtatatat

SEQ ID NO: 7144 - DNA, 160 bp, Homo sapiens
atacatatatgtgtgtatatgtgtatacatacatatatgtgtgtatatatgtgtatacatatgtgtgtatatgtgtatatatacatatatgtgtgtatatatgtgtatatatacatatatgtgtgtatatatgtgtatatatacatatatgtgtgtatat

SEQ ID NO: 7145 - DNA, 92 bp, Homo sapiens
tgtatatatacatatatgtgtgtatatatgtgtatatatacatatatgtgtgtatatatgtgtatatatacatatatgtgtgtatatatata

SEQ ID NO: 7146 - DNA, 71 bp, Homo sapiens
ctgggcccaggtgcttgcggctctctcccgaaggtgtcatgctccctctgtgcctgctacactctgtccag

SEQ ID NO: 7147 - DNA, 56 bp, Homo sapiens
gagactgagtctcactctgtcgcccaggctggagtgcagtggtatgatctcggctc

SEQ ID NO: 7148 - DNA, 76 bp, Homo sapiens
ttcttcttggaaatgatatgaaatctaatatgcatgaacaaaagttctttatattatctattactgctaagaagaa

SEQ ID NO: 7149 - DNA, 138 bp, Homo sapiens
ccaacctgggcaatatagtgagaccctatctacaaaaaaaaaaaaaaaattttgagacagagtctcactctgtcacctaggctggagtgcagtggcacaatctcggctctctgcaactcctgcctctgggtacaagtg

SEQ ID NO: 7150 - DNA, 118 bp, Homo sapiens
ccaattctgtagatgactcacaggcacttccaattcaacctgactgaaccttttaaaaatatatatttatttctttatttattttgagatggagttttgctcttgtcacccaggctgg

SEQ ID NO: 7151 - DNA, 68 bp, Homo sapiens
atatatgtgtgtgtgtatatatatgtgtgtgtgtatatatatatatatatacacatatatatatatac

SEQ ID NO: 7152 - DNA, 91 bp, Homo sapiens
ggagcgaggcttcctgactctgtctctgccacttttcacataggagttgccaaggaacagatgaagggatactaaaaatacaagctttgcc

SEQ ID NO: 7153 - DNA, 76 bp, Homo sapiens
tgcctcggcctcccaaagtgttaggattacaggcatgagccaccgcacctggcctgaagctggattgttgagggca

SEQ ID NO: 7154 - DNA, 95 bp, Homo sapiens
gggcagactgagcagatgttcctagtccaacgtcaaacaggtttttttttgtttgtttttttgtttttttgagacggagtctcgctctgtcaccc

SEQ ID NO: 7155 - DNA, 96 bp, Homo sapiens
tgtattctgagcttaacaaaataaaatcgtgagaactaatatttcatttttttgaaaaaaattcttatgatggatttattgttgtttcatattgca

SEQ ID NO: 7156 - DNA, 114 bp, Homo sapiens
ttagctgggtgtggtggcggaggcaggaggatcacttgaggtcagaagtcagagaccagtctggacaacatgatgaaaccctgtctctactaaaaagagaaaaattagctgggt

SEQ ID NO: 7157 - DNA, 60 bp, Homo sapiens
tctgacgatgtctcactctgtcacccaggctggagtgcagtggcgagatctcggctcagg

SEQ ID NO: 7158 - DNA, 95 bp, Homo sapiens
tcatgttcgggaaaaagtgaacacagtgagatcacacttctccctaggtatttggggttatttctcactggtgttatatggatctgggaaagtga

SEQ ID NO: 7159 - DNA, 90 bp, Homo sapiens
gcctacttctgtcaattcgtcagtctcattctctgtccagttttgttcccttgctggtgaggagttgtgatcctttggagaagaagaggc

SEQ ID NO: 7160 - DNA, 79 bp, Homo sapiens
gggcatgctggcaccctgatctcagacttccagcctccagaactgtgaggaagaagtttctattgtttgtgagccaccc

SEQ ID NO: 7161 - DNA, 95 bp, Homo sapiens
caatcatttgcatatatgtatttatatatgtatatataaatgtgcatatatatatacacgtgtatatatataaattattatatatgtgagtgttg

SEQ ID NO: 7162 - DNA, 115 bp, Homo sapiens
cagaggagaaagctaggtcagacactctgttaggaagctttgggtgggtgagtgtttgccagtacaagctgcccttggagcattgacaaagaggatggcactttgctttagtctg

SEQ ID NO: 7163 - DNA, 116 bp, Homo sapiens
tatactatatataattttatgtattttttatattatatatttgtacatttttatatattatatatttatatgtattacactatatatactatgtatataattctgtttatagtata

SEQ ID NO: 7164 - DNA, 211 bp, Homo sapiens
tatatatataatatatataatcatgtataattttatatatacacatgtgtatatatacacatgtatatatgtatatatgcttatacatacacgtgtatatatgtatatatacacgtgtatatgtgtatatacacgtgtatatatgtatatatgtatatatacacatatgtatgtatatatacacatatatatgtatgtgtatacatatata

SEQ ID NO: 7165 - DNA, 79 bp, Homo sapiens
caagcctagatttgtgggtgacagtgaagagagactgcagctgtagactttacacagcacctctagctactggggtttg

SEQ ID NO: 7166 - DNA, 115 bp, Homo sapiens
gctgaagtagatatcatattgctgtgcacttttagttatgttctccctttcttttttattttatactttaagtgctggggtacatgtgcagaacgtgcaggtttgttacataggt

SEQ ID NO: 7167 - DNA, 105 bp, Homo sapiens
ggactgatggatattgaactagttttccaagggcaaagtttcaattattatatgaatattatcaaacttccctagatcatgaactgcttctgagctccatcttct

SEQ ID NO: 7168 - DNA, 87 bp, Homo sapiens
gtgtatgcatgtacacacatgtgtgtgtacacacatatatgtatatgtatatatgtgtacacacatatacgtatatgtatatatgtg

SEQ ID NO: 7169 - DNA, 123 bp, Homo sapiens
tatatatgtatatacatatatatgtgccatatatatgtgtatattatatgtgtatatatgtatatacatatatatacatatacatgtgccatgtatatacgtgtatatatatatgtatatata

SEQ ID NO: 7170 - DNA, 93 bp, Homo sapiens
ggtgatagctgacctggattgtcttggatcaaagcaccagatttcctttatcacagtcagagtgcttgttctttctctagaagagttatcgct

SEQ ID NO: 7171 - DNA, 85 bp, Homo sapiens
ggaactaatttttatgtaagggcatctttgcagtctccttccagaccaatctgtggtttgttgactgctactaggaatctgttct

SEQ ID NO: 7172 - DNA, 88 bp, Homo sapiens
tgtccctctgactctctctctctcgcctggttcttatactgataaaaatctatgtgattccattagatctcggagacagtccaggata

SEQ ID NO: 7173 - DNA, 99 bp, Homo sapiens
atatatatttatatatttatatatgtgtgtatatatacatatttatacacttatacatgtgtatgtatacatatacttatgtgtttgtgtgtgtgtata

SEQ ID NO: 7174 - DNA, 63 bp, Homo sapiens
tgggagagtttggagtgcaccatctgccttctgcggtggcggtgtctctctctgactgttcca

SEQ ID NO: 7175 - DNA, 70 bp, Homo sapiens
ggtagagatattctagttcacaaaggggccagcatccttatagccccaggacaaactttttgtctctccc

SEQ ID NO: 7176 - DNA, 69 bp, Homo sapiens
ggaaaattcagagtgtatgacacctctctcccatccaatgattgtgtcacacgcactctgaatgtttcc

SEQ ID NO: 7177 - DNA, 78 bp, Homo sapiens
ctcgttccatatatatatatatatatatatatatacatatgtatatatgtatatacgtatgtatatgtgtatgagtat

SEQ ID NO: 7178 - DNA, 73 bp, Homo sapiens
tctcaatcctaatcctgagtgttgcaaaatcttgattttttaaatttcagtaggaatttaggaaggattgaga

SEQ ID NO: 7179 - DNA, 95 bp, Homo sapiens; identical to SEQ ID NO: 68

SEQ ID NO: 7180 - DNA, 93 bp, Homo sapiens; identical to SEQ ID NO: 69

SEQ ID NO: 7181 - DNA, 114 bp, Homo sapiens
gtggcattcttgtcaaagatatatatggacggctagatggatagataggtaagtagatagaaatatttcattatttgcatgtaattgcaccttgcttttaggacaaactgctac

SEQ ID NO: 7182 - DNA, 101 bp, Homo sapiens
ggtgaggtaatgtgcacctgtggttccagctgctcaggaggctgaggtgggaggatgtcttgagcccaggagtttgaggctgtagtgactatgatcgcacc

SEQ ID NO: 7183 - DNA, 108 bp, Homo sapiens
ccttgtcactttttctattagggttttcttgattttttaaaaatttttatttatttaaattttttgagatggagtttggctcttgttgcccagactggagtgcaatgg

SEQ ID NO: 7184 - DNA, 96 bp, Homo sapiens
gggcaaggacattttcatgcagtctgagaaatctgatgatggatgttattttcattatcttttatttcttttgttttttgaaaagctaagtaaacc

SEQ ID NO: 7185 - DNA, 101 bp, Homo sapiens
ggtaattctaagttttaaatttggggacatggataatgtgggctaggagagctcacataattaaatatttatgttttcttcgttagattgtaagagttacc

SEQ ID NO: 7186 - DNA, 167 bp, Homo sapiens
cttatgtcagtgactatatatatatgtgtgtgtatataggtgtgtatatatacatatatgtatatacatatacttgagaatatatacacatatacatgagaatatatatacatatacatgagaatatatatatatgtgtgtgtgtgtgtgtgtgtgtgtatatatat

SEQ ID NO: 7187 - DNA, 112 bp, Homo sapiens
gatagatatatgatagatacatagatggatagaaatatatctagctttatattcttatatatattttgcatatatttatatagtcatctctcagtatcagtgagtatttgtt

SEQ ID NO: 7188 - DNA, 95 bp, Homo sapiens; identical to SEQ ID NO: 580

SEQ ID NO: 7189 - DNA, 93 bp, Homo sapiens; identical to SEQ ID NO: 69

SEQ ID NO: 7190 - DNA, 113 bp, Homo sapiens
ggtagctcctctctgcagctggttgtcctgatgtctcctctgctctgtctgagtctggaatttttatggtcttcagatggaaggagtgcttgctgattggtccatgagccacc

SEQ ID NO: 7191 - DNA, 111 bp, Homo sapiens
tagcaattccactgaagtttagttggtaaaactctttctatgtatttatttaggtgttcctattaatattcaggtatctattttctcacctattcttctgtagatttacta

SEQ ID NO: 7192 - DNA, 113 bp, Homo sapiens
attttgttatttggtataaaagatgtttcttggtgtcttaggacttgagtctatgtactgattttgttctcctggacatctggtcaatgccatctttaccaccatggtaaaat

SEQ ID NO: 7193 - DNA, 120 bp, Homo sapiens
atctcattgtggttttaatttgcatttttctgatgattagaaatgttgagaatattttcatatatatgttggccatttttatgcctttcgttaggaaaatgtccattcaggtcctttgtg

SEQ ID NO: 7194 - DNA, 110 bp, Homo sapiens
cagctggctctggaaaacaaagggagaggaagagccatgtttacaaatgcccagtccctctcttcacctcatcagtaagagctttcctcccctggggaaggagcaaggtg

SEQ ID NO: 7195 - DNA, 85 bp, Homo sapiens
gatagtgaataagtctcatgagaagggatggttttaaaaacaggagcttccctgcacaacctctctctctttgactgctgccatc

SEQ ID NO: 7196 - DNA, 84 bp, Homo sapiens
ttcatctgtttatctattcaaagtatttgttgagtgcctactaggggcttgacattgttctaggtgctaagatatagcagtgaa

SEQ ID NO: 7197 - DNA, 76 bp, Homo sapiens
tgtgtgtgtttgtgtgtgtatatatatgtatgtgtgtgtatatatatataaatatatatatataaatatatataaa

SEQ ID NO: 7198 - DNA, 184 bp, Homo sapiens
tatatttatatatatatacacacacatacatatatatacacacacaaacacacacacacatagatatgtgtgtatatatatatacatgtatgtgtgtgtgtatacatatatatatatatatataaatacataaccatcagtgtcacttaaggcctagttgtttgtgtatgtgtgtatgtgtgta

SEQ ID NO: 7199 - DNA, 115 bp, Homo sapiens
gtttataaggcatatgatttttcattgtagagtgccttttttttttttttaagaaaaccaaatttgagaatctgcgtggtatatctggggtaaaatcatatgatatttttagtac

SEQ ID NO: 7200 - DNA, 87 bp, Homo sapiens
aatatgaatatatgtatgtatatgtatgtgtaatatgtgtatatgtgtttatacatgtatgtatgcatgttatgtatgtatatgtat

SEQ ID NO: 7201 - DNA, 108 bp, Homo sapiens
gtatatatgtgtatatatatgtatatgtgcatatatatgtatatgtgtatataaatacacacatatttatatatataaatatatatatatatatttatatttaactac

SEQ ID NO: 7202 - DNA, 83 bp, Homo sapiens
tctgctaggctctcttaccctcactctgtttgagttcaggcaaatggaagaaatgggcagggtctcaggggacaagagcatgg

SEQ ID NO: 7203 - DNA, 93 bp, Homo sapiens
tcttgccttttcatgatttagagtgattcaagaactctaattttttttttttttttgagatggagtctcactcattctgtcacccaggctgga

SEQ ID NO: 7204 - DNA, 71 bp, Homo sapiens
ggccagggtgggggccggagtgagatggctgtggcccacccagccatccctctctctctctgtgtgctggt

SEQ ID NO: 7205 - DNA, 83 bp, Homo sapiens
aagtgtttttcacagtggctgaagcattttgcattcccaccagcaatgtgcgagtgttctaatgtctccacatacaaacactt

SEQ ID NO: 7206 - DNA, 57 bp, Homo sapiens
tgagatggagtctcactctgtcacccagctggagtgcagtggtgcaatctccgttca

SEQ ID NO: 7207 - DNA, 114 bp, Homo sapiens
agtccagggcagttccaggtgatcatggctgatttttgttttatttttattttttggagagtgtcagttccactcagtcatttcagggatcaaattaaagaaagctctgcaact

SEQ ID NO: 7208 - DNA, 101 bp, Homo sapiens
ctaagagggtagatcttggcatgttctcaccacacacacacacacacacacacacacgtggtaactgtgatgtgatggtcttgttaattaccttgacttgg

SEQ ID NO: 7209 - DNA, 67 bp, Homo sapiens
ctcagcatctctgtaactctctgtgtggtctccagcctggcagcctcagagcagccggacttttgag

SEQ ID NO: 7210 - DNA, 88 bp, Homo sapiens
agccttagcaccactgggctccaggacagttcacagtctctcatctacattctttctcgtgcatggtcactgaagtctctgcttggtt

SEQ ID NO: 7211 - DNA, 72 bp, Homo sapiens
ctgggcgtggtggtatgcacctgtagtctcagctacttggaaggctgaggttggaggatcacttgagcccag

SEQ ID NO: 7212 - DNA, 88 bp, Homo sapiens
tgactcagttgttatattaatgttttattttagaagattttaattcttttattgtactaactaagacatatgatttcacagtgggtca

SEQ ID NO: 7213 - DNA, 82 bp, Homo sapiens
ttactttttttctatccaatctaggtgcaactctgctatcttgagaatcagactggttgatttctgggttggtatcaagtaa

SEQ ID NO: 7214 - DNA, 58 bp, Homo sapiens
tgagacggagtcttactctgtcactcaggccggagtgcagtgctgtgatctctgctca

SEQ ID NO: 7215 - DNA, 59 bp, Homo sapiens
gagacggagtctcgctctgtctgtcgcccaggctggagtgcagtggcgtgatctcgctc

SEQ ID NO: 7216 - DNA, 123 bp, Homo sapiens
gagataccagaggtctgctgggactctgagaaagattttatcacttgttttttgtttgttctttttttttttttttcttttgagatggagtcttgctctgtcactcaggctggagttcagtgg

SEQ ID NO: 7217 - DNA, 58 bp, Homo sapiens
tgagacagggtctcactctgtcacccaggctggagtacagtggtgcgatctcagctca

SEQ ID NO: 7218 - DNA, 87 bp, Homo sapiens
gtaacaggctggttgcaaatgctcgaaacagaaataggtttcttcataggctgtgtttcagcatgtccaactgtgagcctgtgaagc

SEQ ID NO: 7219 - DNA, 58 bp, Homo sapiens
tgagtcagagtctcgctctgtcacccaggctggagttcagtggcgagatcttggctca

SEQ ID NO: 7220 - DNA, 58 bp, Homo sapiens
tgagaaggagtctcactctgtcacccaggctggagggcagtggtatgatctcagctca

SEQ ID NO: 7221 - DNA, 77 bp, Homo sapiens
gcagaaagagacattggaaagaatagaagaaacagggttttttgtttgtttgttttggaaaccaagtctcactctgt

SEQ ID NO: 7222 - DNA, 61 bp, Homo sapiens
cttccgtggtgcctgctgccagtgtctcactgtgattcactgtgtagagagctgcaggaag

SEQ ID NO: 7223 - DNA, 58 bp, Homo sapiens
gctcatgacactgtgcctgtctgccactcaggggaggagcagaccgcagttggttagc

SEQ ID NO: 7224 - DNA, 117 bp, Homo sapiens
attttggggcagatgccatgagagttcttggtggcttggattcagatctgacagtggagatgcagagaagagtgccaattcaagatcagttttgcaggtattgttgacaggatttga

SEQ ID NO: 7225 - DNA, 77 bp, Homo sapiens
aggagatcatgtagcaaaagcagccactctctctgcctcagcccaaggctagggaggatgggctttatctggtccct

SEQ ID NO: 7226 - DNA, 80 bp, Homo sapiens
ggagtaatagtgtttcatcctgagatagggaacactgggagaggagtcagatctgtgtcaggaaagatggtatgtactct

SEQ ID NO: 7227 - DNA, 104 bp, Homo sapiens
atgggggatccttgctcacaagttattaaggatttcagaacagtgaaagcagaacactaaactaagcacagagtcatttgtgactgcacaggatgcatgctcat

SEQ ID NO: 7228 - DNA, 113 bp, Homo sapiens
tacattttactttgaaagatacagtgagcaattagaatgaatgtattattacattgttattttataacatcaagatgaggttcttctttgctcttaggtctttccctagtgta

SEQ ID NO: 7229 - DNA, 98 bp, Homo sapiens
gtggtgcatgcctgtagtcccagtgatgtgggaggctgaggtggaaggatcatttgagcctggaaggtcaagactgcagtgagccaagattgcaccac

SEQ ID NO: 7230 - DNA, 125 bp, Homo sapiens
ttgggcctggttagtatgtgatgttctcctttagtgctctttggccccagtgttcttttttttttttttttttttttgagacagagtcttgcactgtcacactgtcacccaggctggagtagaat

SEQ ID NO: 7231 - DNA, 95 bp, Homo sapiens; identical to SEQ ID NO: 68

SEQ ID NO: 7232 - DNA, 93 bp, Homo sapiens; identical to SEQ ID NO: 69

SEQ ID NO: 7233 - DNA, 87 bp, Homo sapiens
gcaaaacttaatagtttggggggtttgggggtttttgttttttgttttttgagaccgagtctcactctgtgtcccaggctggagtgc

SEQ ID NO: 7234 - DNA, 156 bp, Homo sapiens
tatatatgtatatatgtgtatatatgtgcatatatatgtgaatatatgtatatatgtgtatatatatgtatatatgtatatatgtgtgtgtatatatgtatatatatgtacatatatatatgtgtgtatgtgtgtgtgtatatatatatatatata

SEQ ID NO: 7235 - DNA, 74 bp, Homo sapiens
atatatatatatatatatgtgtgtgtatatatacgtatatatatgtatatatgtgtatatatgtgtatatgtgt

SEQ ID NO: 7236 - DNA, 117 bp, Homo sapiens
tgagcaaggtgggagctgttagaggattttttttttaatgccttaatagactttttattttaaaatttaatttattaatttatttaagacagagtctcactctgacacccaggctgg

SEQ ID NO: 7237 - DNA, 84 bp, Homo sapiens
gacgcggggtcttgagacctgagtcttgctcctaggctcccacgctcagcttagtgttcttctctgtctcacactgtgcctgtc

SEQ ID NO: 7238 - DNA, 63 bp, Homo sapiens
ccagtctctctttctcactgcaagacacccttgcaggagaattttttaaaaagtagtggttgg

SEQ ID NO: 7239 - DNA, 115 bp, Homo sapiens
cagtagttggctttcattgggctcagcttggggacttgtccacactatgagctgtgtgtgcacactgagacccaagctctggacatatgctcattaagtgaaatggccagcattg

SEQ ID NO: 7240 - DNA, 76 bp, Homo sapiens
gctgctgagaggtgtgcagcagtctggagagggcaggatgtggccgttgagagtgtggacagagtgacagagcagc

SEQ ID NO: 7241 - DNA, 69 bp, Homo sapiens
gcggacgggtaggcaagagggggccttacggagtgcgtgtatgaccagcctctctgactgtctgtctgt

SEQ ID NO: 7242 - DNA, 115 bp, Homo sapiens
gtgtaaagttctccgaaatctataattagggtaaagcaggtggcaagagcaagaatatatatttatctctatcccgtttgtgaattttttaagtgatagcgctatggctgtgcat

SEQ ID NO: 7243 - DNA, 74 bp, Homo sapiens
catcactgtcagtgtctctggcctggttctttggaggcagagtccccagacaggagacctaaagagacaggatg

SEQ ID NO: 7244 - DNA, 113 bp, Homo sapiens
aggagttgctttctccaaaagaaaactttggcaaacgcatcactgtatcagcaagtgcatcaaaatcagagatgacccagggtacatctgttttgagagaatctcctagttac

SEQ ID NO: 7245 - DNA, 73 bp, Homo sapiens
caggatctctctgggtgatctccctttttgttttttgagacagggtctcactatgtcactcatgctggtcttg

SEQ ID NO: 7246 - DNA, 111 bp, Homo sapiens
cccagcatttgctaagtctgatcacagggaggttattttgtctctctgtctcggtttctctgagccactgagacagatggctgtccgctttgaggctctgcagagctgtgg

SEQ ID NO: 7247 - DNA, 84 bp, Homo sapiens
acagattacttggggtgtcattctacagaggtacttctttttttttttttttgagatggagtgtccctctgccacccaggctgt

SEQ ID NO: 7248 - DNA, 57 bp, Homo sapiens
gggtttagagtgtgacttctttttttttttttgagagggagtctcactctgtcaccc

SEQ ID NO: 7249 - DNA, 96 bp, Homo sapiens
gaataactgtaaatccaaaagaagagagtgagctctcttcagcattttgtagaatttcagaactgagcttattgtcatctgcattttcattttttc

SEQ ID NO: 7250 - DNA, 109 bp, Homo sapiens
ggaagtggtaggtataaattggtggtcatatggattgaagtatctctgtctctgtcatggtcgagattcttccttagttgaatattattctaccttgctcttggcttcc

SEQ ID NO: 7251 - DNA, 115 bp, Homo sapiens
ggggaagttgctcagtccctgtgtttgctgatctgaaagtggaaatggcagtgcatgaaatgagttaatatgtgtaaagttcctacagtggcatgcctggtgactagtgagccct

SEQ ID NO: 7252 - DNA, 106 bp, Homo sapiens
gatggcggcgcggcggcggtctggcggagaggcggtttttttgtttttgttttttttgagactgagtcttgctctgtcacccaggctggagagcagtggcgcaatc

SEQ ID NO: 7253 - DNA, 79 bp, Homo sapiens
cctggctgtcttagttaggggggtctcctgtttttttttttttttttttttgagatggagtctcgctctctcacccagg

SEQ ID NO: 7254 - DNA, 116 bp, Homo sapiens
cctcagtttccctgcctgtaaaatgtctaaggaacagctgtgagaattcagtgaggacatatcctgggcccagttgttagcaccccttagatggaagtatagttctgggaagtagg

SEQ ID NO: 7255 - DNA, 75 bp, Homo sapiens
gagcaagatgccagtgctgtgtggtctccgcacagaatcccctctgtcccactcagtccctctttcagccggctc

SEQ ID NO: 7256 - DNA, 58 bp, Homo sapiens; identical to SEQ ID NO: 5218

SEQ ID NO: 7257 - DNA, 116 bp, Homo sapiens
tgggaatgtaaactagtccagccactgtggaaagcagtttggagatttcttttttttttttttgagacggagtttcactcttgttgcccaggctggagtgcagtggctcgatctcg

SEQ ID NO: 7258 - DNA, 95 bp, Homo sapiens
caaatgttaactaaacttgaattgagactataccctacttgatcatgatgatcatcatttttatatatgtcttgattcagtttaatttttttttg

SEQ ID NO: 7259 - DNA, 93 bp, Homo sapiens
tggcatagtggaacatgcctgtagtcccagctacttgggaggctgaggttggaggatcccttgagtttgggaggcagagattgcagtgagcca

SEQ ID NO: 7260 - DNA, 119 bp, Homo sapiens
gaccgggttaggtaggcatcatatagctccattttttagacaagaaagtgtgctcgcttcggcagcacatatactaaaattagacaagaaagcagatttagccattaaccagcttgctc

SEQ ID NO: 7261 - DNA, 85 bp, Homo sapiens
gtgtgtgtgtgcaggcaggcgtgtatgtagaggctacaaataaagcagtgtgtctgcgtctgtgtgtctgtgtgagtgtagagac

SEQ ID NO: 7262 - DNA, 109 bp, Homo sapiens
ccaagcttccgcgggcaccccaggcctgatcttggttccgtgtgaggctgcgtggaggctctgtcactcactgaatcggagccgcggtgttctcagcggtgaaatgggc

SEQ ID NO: 7263 - DNA, 85 bp, Homo sapiens
cttgaacccaggaggcagagatggcagtgagctgagatcgtcccattgcactccagcctgggtgacaagagcaaaactctatctc

SEQ ID NO: 7264 - DNA, 129 bp, Homo sapiens
acccgggagttggaggttgcagtgagttgagatctcaccactgcactccagcctgggtgacacagcgactctgtctcaaaataaattttttttttttttcgtagagatggggtctccttatgttgccta

SEQ ID NO: 7265 - DNA, 108 bp, Homo sapiens
agctttgcctatatatctacctacctacctgtctgtctgtctgtctaaaacggcatcttagatagacagacagataggtagatagatagtgcagtggtgcacatggct

SEQ ID NO: 7266 - DNA, 90 bp, Homo sapiens
ttggaatgctttctctgtctctttgagatgcatgtaaatctttttattttattttattttattttgagatggagtattgctgttgcccag

SEQ ID NO: 7267 - DNA, 65 bp, Homo sapiens
agggagggaggtaaaggggctgtaagtgaaggaactaaaatggagtctgtctggctctctcagct

SEQ ID NO: 7268 - DNA, 64 bp, Homo sapiens
gtagagtcaaggtctcactctgtcaccccagctggagtgcagtggtgtgatctcggctccctgc

SEQ ID NO: 7269 - DNA, 109 bp, Homo sapiens
cacctacttttgatttctttcttgccctaataacaggctgcctctgggatgtactaatgatgacagatgagacactggtcacactggtaggaagggacttcatgtggtg

SEQ ID NO: 7270 - DNA, 72 bp, Homo sapiens
ccgggcacaatggctcatgcctatggtcccagcttcttgggaggctgaggtaggaggatcacttgagcccgg

SEQ ID NO: 7271 - DNA, 97 bp, Homo sapiens
ctcatatgacattctgaagagtatctattttatattttagtgatggaaaaccattgcaaattctgagaataatatgatcagaattatatttaatgag

SEQ ID NO: 7272 - DNA, 109 bp, Homo sapiens
ggcaggactaaaaatgggtacaatcactttgggaatggtttggctagaaagttgtaaagttaaacatgtacctatgtatgattcagtaatttcctttttaagtagagtc

SEQ ID NO: 7273 - DNA, 91 bp, Homo sapiens
acagagctagagatgaggaatagaaaacattttctaagattctttggaatagaaaactttttttttttttttagatggagtctcactctgt

SEQ ID NO: 7274 - DNA, 75 bp, Homo sapiens
ctctgtccgtgactctgggtctgtctccgtgctagcaagcaattctggggaggaggatctgggtcaatgatgaag

SEQ ID NO: 7275 - DNA, 125 bp, Homo sapiens
gtgtatatatgtgtatatatgtatgtgtatatatgtatacgtgtatatatgtgtatgtgtatatgtatatgtgtatatatgtatatgtgtatatatatatgctacacacacacacacacacacac

SEQ ID NO: 7276 - DNA, 62 bp, Homo sapiens
tatatatgtatatatgtgtatatatgcatatatgtgtatatatgtatatgtgtatgtgtgta

SEQ ID NO: 7277 - DNA, 92 bp, Homo sapiens
gacctgggcccgcagggcgctggtcaaggggcccagggaggtggggtccagccctctgtgcccctgactgactgtctgatctgggcaaggtc

SEQ ID NO: 7278 - DNA, 117 bp, Homo sapiens
gctggaacgccagccctgccactctcactgcgtgatttcaaactttttttttttttaattttgagacaaggtcttgctctgttgcccaggttggagtgcagtggcatgacctcgggt

SEQ ID NO: 7279 - DNA, 100 bp, Homo sapiens
gggaggcaaggggtgctttgaaaggcgaaaggagcagtgcatggtcggtttttggtttttgtctttttttttttttttttcttgagttgctctgttgccc

SEQ ID NO: 7280 - DNA, 111 bp, Homo sapiens
tagggaatatgtctacctatattaacccccatatacccacatatctatatgtctgtatctatctgtgtgtgtgtgtctattaaacatgattgtaggctacgttctactcta

SEQ ID NO: 7281 - DNA, 98 bp, Homo sapiens
cactgcagtccggcctgggcgacaaaacgagactccatctcaaaaaaaaaaaaaaaagagacagagtctcactctgtctcccaggctggagggtagtg

SEQ ID NO: 7282 - DNA, 58 bp, Homo sapiens; identical to SEQ ID NO: 1868

SEQ ID NO: 7283 - DNA, 58 bp, Homo sapiens
tgagactgagtttcactctgtcactcaggctggagtgcagtggtgcgatctcggctca

SEQ ID NO: 7284 - DNA, 58 bp, Homo sapiens
tgagatggagtctcgctctgtcgctcaggctggagtgcagtggtgtgatcttggctca

SEQ ID NO: 7285 - DNA, 94 bp, Homo sapiens
tgagctaggttctcactctgtcatccaggctggagtatagtgagggtctcactctgtcacccaggctgtagtacagcggcatgatcatagctca

SEQ ID NO: 7286 - DNA, 75 bp, Homo sapiens
ggcttgtaaaagcatcacccagatggctgccttcatcctcacatggagttctctgtctgtctgtggctttgtgtc

SEQ ID NO: 7287 - DNA, 69 bp, Homo sapiens
tagcctgaaggtactttttttttggggggggggggtttgaggtggagtctcactctgtcacccaggctg

SEQ ID NO: 7288 - DNA, 64 bp, Homo sapiens
gcgtgtgtatgtatatgtatatgtgtgtatgtgtgtgtgcatgtgtatatatatatatacacgc

SEQ ID NO: 7289 - DNA, 99 bp, Homo sapiens
agcagtggtttgcagggggtttttttgttttgttttttttttgagacagagtctcgctctgtcacccaggctggagtgcagtggcgcgatctcggctca

SEQ ID NO: 7290 - DNA, 58 bp, Homo sapiens; identical to SEQ ID NO: 315

SEQ ID NO: 7291 - DNA, 95 bp, Homo sapiens; identical to SEQ ID NO: 68

SEQ ID NO: 7292 - DNA, 93 bp, Homo sapiens; identical to SEQ ID NO: 69

SEQ ID NO: 7293 - DNA, 86 bp, Homo sapiens
tacctcacaggcagcctggaaaggggaggtcatgggtgtggagtcagaggccctgggttcactgtctggctgtctcactaggtagc

SEQ ID NO: 7294 - DNA, 66 bp, Homo sapiens
ggctgtgatggctggagctttggcagtcaccttgacagatgacagagtagaaagctagaaggagcc

SEQ ID NO: 7295 - DNA, 88 bp, Homo sapiens
gagtgccagggcttagttccccagagagagccaggcttgccttgtcctggcctctggctctgtctctggctgcgctgtccctggtctt

SEQ ID NO: 7296 - DNA, 105 bp, Homo sapiens
tcaggatgctcccaagtcataaatccactcatgagagtgaggacaaagatcaagacagttttgctctcatctgagtgagaaaaacattccttggtggattcttga

SEQ ID NO: 7297 - DNA, 105 bp, Homo sapiens
tatgtgtgactgtgtgtggatgtgtgtgcatgtgtgtccatgtgtgtctgcatgtgcatgtatttttgtgtgtgtgtctgtgtgtgcttgtgtgtccatgtgtgt

SEQ ID NO: 7298 - DNA, 80 bp, Homo sapiens
catgtgtgtccatgtgtgtctgcatgtgcatatgtttgtgtgtgtccatgtgcgtctgtgtgtgcctgtgtgttcgtgtg

SEQ ID NO: 7299 - DNA, 98 bp, Homo sapiens
atatatactgtatatatatatgtgtgtgtgtgtgtgtatatatatatatatatatacacacatacacacacacattacatcatatatatagtgtgtat

SEQ ID NO: 7300 - DNA, 75 bp, Homo sapiens
tgtctgtctctgacaggggctcttcaccatgtgtgggatgtgagcagcggaggggagccctgtctggggcaggca

SEQ ID NO: 7301 - DNA, 121 bp, Homo sapiens
tgggagttgctggtccattagcacagttagcagagcaggtgctgcatgatgaccgtggctctcactgactgggagccacgccccgggctctgttagttcgttaaaccacttgggcaagtag

SEQ ID NO: 7302 - DNA, 89 bp, Homo sapiens
taatctggggcctggttctcacaccctctgtcgctggcctccctggagctgggtggtggcattgcaaggactatttaccaacaggatta

SEQ ID NO: 7303 - DNA, 63 bp, Homo sapiens
catatatgtatgtgtgtatatatatgagtgatatatatgtatatatatacacacacatatatg

SEQ ID NO: 7304 - DNA, 74 bp, Homo sapiens
ggctgctgccaattctggtgagaagtgactgagctcccccgctccccacaggactctcatagagggcagaagac

SEQ ID NO: 7305 - DNA, 112 bp, Homo sapiens
tcctgtgtaactggttttgttggatactcgtcagctgtgagccgatcactctcagaaacacacactgacagaatcccaaattatcagctgctccatgatcccatacacatga

SEQ ID NO: 7306 - DNA, 61 bp, Homo sapiens
gcctgaggctgactcactgtctcggtgcttccaatggtatagagctgggcctcctacaggc

SEQ ID NO: 7307 - DNA, 66 bp, Homo sapiens
ccctctgtgtgtgtctgtgtcctcatctcctctttttatgaggacgccagtcataccggattaggg

SEQ ID NO: 7308 - DNA, 87 bp, Homo sapiens
ctattaatatctttttgtaaaaaggaggacattgtttgtgtgtgaagaagataaacttagttttttttttccaaaaagaaacaatgg

SEQ ID NO: 7309 - DNA, 58 bp, Homo sapiens
tgagacagggtctcactctgtcacccaggctggagtgcagtggtgcaatcttggctca

SEQ ID NO: 7310 - DNA, 78 bp, Homo sapiens
tgctaagaacgtgagctccagactgtgggtccgcacgtgggagacactcagacagcagacactggggtgagggaggca

SEQ ID NO: 7311 - DNA, 119 bp, Homo sapiens
gcctcattccaagcatatgcagattattgtgatgtttttaccaccatttcatcatcttgaaaccttttttttttttgacaacgtcttgctctgtgtcatccatgctggagtgcagtggc

SEQ ID NO: 7312 - DNA, 58 bp, Homo sapiens
tgagtcagagtctcgctctctcacccaggctggagtgcagtggtgagatctcggctca

SEQ ID NO: 7313 - DNA, 73 bp, Homo sapiens
gacttggtaacacagtcatattctctcacatattggcagatgtttggtgaaagagtgactgttcagccaactc

SEQ ID NO: 7314 - DNA, 57 bp, Homo sapiens
gaggatggacaaggactgctgtgactcacggacagtgtttgtaaaggcaccatcttc

SEQ ID NO: 7315 - DNA, 84 bp, Homo sapiens
agggcgtgtgttttttctcgtcagctctctctgtcagagccccctttgtggcctaatggaagggcagagaaattactactacct

SEQ ID NO: 7316 - DNA, 101 bp, Homo sapiens
tggctcaaggtgaagaggggctgaaatttctatttctatttcagaatattaggcgcccctggattgaaggaggtggaaattcacgacgacgctgacagcta

SEQ ID NO: 7317 - DNA, 73 bp, Homo sapiens
atatatgtgtatatgtattgtagatatgtatatatatctatgaatatctatatttgtacatatttatatatgt

SEQ ID NO: 7318 - DNA, 110 bp, Homo sapiens
gcatcagcaagaaagctctagggtggtttggtttgtgactgagactgtgtgtgcctgtgtgtggcggtgttcagcgcctgctttgtgccattcttctgtgactgtggggc

SEQ ID NO: 7319 - DNA, 119 bp, Homo sapiens
ccaagtgggtggggcaggcagaaggaagctgggaggagggtgaacagtgcctcactgagtgggagttgtttttggctaaatgggaatcttggtggttgttgttcctgtctttggagacc

SEQ ID NO: 7320 - DNA, 93 bp, Homo sapiens
gtggcagggaagctaataaggcatctcactgcattcttcccttttcttcctggatggatgacatgtgttaatgttcatgtaaatccttgcccc

SEQ ID NO: 7321 - DNA, 70 bp, Homo sapiens
gtggtttattaaccacaaaaggttttgtgtgggttttttccagagaacctgtgtgtgtgtctgtgtcctc

SEQ ID NO: 7322 - DNA, 82 bp, Homo sapiens
ccccagcaggacggagtccgagctcctgcaggatttgttttttttttttagatggagtctcactctgtcacccaggctgggg

SEQ ID NO: 7323 - DNA, 131 bp, Homo sapiens
tagactgtcagtcatggaggggccttcagggatgacttggtccagccccctcattttgaaactgaagagtctgaggactagagagatggggtgatttgcccaaggtcagcagaatcttgaagctggagtga

SEQ ID NO: 7324 - DNA, 104 bp, Homo sapiens
cctgggtttctctgtctgtcccaacagctgcagccccatgtctctctgtgtgtctggatggccactgccccgtgtctgtctgtcccgatggccactgtcctggg

SEQ ID NO: 7325 - DNA, 101 bp, Homo sapiens
ctctgtcacagtttcttttaagtactttttttgttttgtttgttcctagtacttcaaagctgaagggtttttcttgggagcagaagcagaggtgaccagag

SEQ ID NO: 7326 - DNA, 72 bp, Homo sapiens
tatatatatgaatgtatatataggtatgtgcatatatgcatgtacacaaatgtatatattcatgtcagtatg

SEQ ID NO: 7327 - DNA, 119 bp, Homo sapiens
gctgggcgtagtggcacgcacttgcagtcccagctactcaggaggcagaggtggaaggatcacttgattctgggaggttgaggctgcagtgagctataatcatgccactgcatgccagc

SEQ ID NO: 7328 - DNA, 68 bp, Homo sapiens
gagcaggcttggaagggccacgtgagcgaggatggtgtctgctgtgtcactcagtgtcctagcttctc

SEQ ID NO: 7329 - DNA, 84 bp, Homo sapiens
aattagctgggcgtgttggcacatgcttgtagtcccagttactcaggaggctgaggtaggaggatgtcttgagcccaggaagtt

SEQ ID NO: 7330 - DNA, 56 bp, Homo sapiens
tctgtctgtctatctgtctgtctgtctatccaaaggaggcagttggtggaggcagg

SEQ ID NO: 7331 - DNA, 183 bp, Homo sapiens
tatatatatacacacacatagatgtctatatctcgatatctctatatatgtgtatgtgtgtgtgtatatatatatgtgtatatatatatatgtgtatatatatatgtgtatatatatatgtgtatatatatatatgtgtatatatatatatgtgtatatatatatatatatatatatatatat

SEQ ID NO: 7332 - DNA, 116 bp, Homo sapiens
caggatgctatttctctcagatttagttcgctgtggatgtgtgtgtgtgtgtgtgtgtgtgtaaaacacttaataaccatctcatagaacatttttgtttaaagaaatgcattttg

SEQ ID NO: 7333 - DNA, 119 bp, Homo sapiens
tgcatatgtatatatatatacatacatatacgtatatatgtatatgtgtatatatatacacatatacatatatatacgtatatatatgtatatatatgtatatgtgtatgtgtgtgtgt

SEQ ID NO: 7334 - DNA, 66 bp, Homo sapiens
atatatgtatgtgtatatatatatttgtaaacagataatcacacatatatatacacatacatatat

SEQ ID NO: 7335 - DNA, 66 bp, Homo sapiens
atatatgtatgtgtatatatatgtgtgattatctgtttacaaatatatatatacacatacatatat

SEQ ID NO: 7336 - DNA, 58 bp, Homo sapiens; identical to SEQ ID NO: 1265

SEQ ID NO: 7337 - DNA, 80 bp, Homo sapiens
tgagctggagtctccctctgtcaccctggctggagtgcagtggtgcgatcttgactcactgcaacctctgcctcccgggt

SEQ ID NO: 7338 - DNA, 113 bp, Homo sapiens
ctcaggtcagcttcagaccctctgacacttttatggttcttatatcacattgggtgttctttatcctatgctatagaatccaaggtctggaggggggtgtaggggtatatggg

SEQ ID NO: 7339 - DNA, 117 bp, Homo sapiens
tcatatacttgacattatagtgtacactatatatatagtatagtacgtctacagtgaaaactatatgtatatatacatataagatatatatacatacacatataagattatatatga

SEQ ID NO: 7340 - DNA, 58 bp, Homo sapiens
tgagacggagtctcactctgtcacccagggtggagtgcagtggtgagatcttgactca

SEQ ID NO: 7341 - DNA, 86 bp, Homo sapiens
cctactattatacttaaagtgacatgtttatttctattttaataaaagatagaagctaaaattctcttaagtgtgaaacagctggg

SEQ ID NO: 7342 - DNA, 138 bp, Homo sapiens
aacaaaaaacttaaccaggtgtagtggtgtgcccctgtaattccagctacccgggaggctgaggtaggaggatccctagtgcctgggagacagatgttgcagtgagctgagattgcaccactgcactccagcctaggt

SEQ ID NO: 7343 - DNA, 98 bp, Homo sapiens
gaagaggggtatataagcatcagatgtaccattgcaagtgggacagtcactctgtgattcttccccatgtacgctaataaagctgtatgtacttcttc

SEQ ID NO: 7344 - DNA, 57 bp, Homo sapiens
gtggcacctgtggtcccagctactcaggaggctgaggtaggaggatcatttgagccc

SEQ ID NO: 7345 - DNA, 94 bp, Homo sapiens
cagcctgggtgacagagtgagactgtttcaaaaaaaaaaaaattcgttttattttattttttagagatagagtctcactctgtcacccaggctg

SEQ ID NO: 7346 - DNA, 58 bp, Homo sapiens
tgagatggagtctcactctgtcacccaggctggagtgcaatggtgcgatctcggctca

SEQ ID NO: 7347 - DNA, 90 bp, Homo sapiens
gggtcattaacaagctgtgccaagcagcatatgaaatcggtgagataagctttgatgcatattagctgtgggaccttaagcaaatgactc

SEQ ID NO: 7348 - DNA, 79 bp, Homo sapiens
gtcccagagagagaaaaaaatcagagttccagagacagaaaatggaggggctcattttttttttttttttttttgagac

SEQ ID NO: 7349 - DNA, 82 bp, Homo sapiens
aggactgactgtgtgtgtctcgctcaggaccaggagcaacaaatgttggcttcttccccggcaaagacccgcgctttctcct

SEQ ID NO: 7350 - DNA, 78 bp, Homo sapiens
ggggagagagcggttttgatcactcgcaccaggaatgactcgagtcagaagcaggtgactttgacctgttctgttacc

SEQ ID NO: 7351 - DNA, 69 bp, Homo sapiens
tccatttttcaggcaggaggaaggggagggggctctgccagctcagtctctctctttgtgaaagggaaa

SEQ ID NO: 7352 - DNA, 111 bp, Homo sapiens
gtgaatatacatatatccattatatatacatatatatatatatatatatatatatatatatatatatatatatatagtgtgtgtatatgtgtctgtgtgtgtgtatctcat

SEQ ID NO: 7353 - DNA, 58 bp, Homo sapiens
tgagatggagtctcactctgtctcccaggctggagtgcagtggtgtgatctcagctca

SEQ ID NO: 7354 - DNA, 80 bp, Homo sapiens
tgagagagatgtgactgtgatctgagtcacagatggttataacgtctgtttttcggattatagattcccttgctttttta

SEQ ID NO: 7355 - DNA, 66 bp, Homo sapiens
catcagtgtccaggctgtcatttccaggctaattagctgccagatgactgagaggacacgtggatg

SEQ ID NO: 7356 - DNA, 108 bp, Homo sapiens
gccattccagaatcactgcaaaatgtgtgggctggaccaggtgccatctaaaatctttttcattctttttttgagatggagtctcgctctgtcaccaggctggagtgc

SEQ ID NO: 7357 - DNA, 96 bp, Homo sapiens
ctacataatatctattagctatctaaggttggtgcccttaaattgtatatatttaagcagaagctaggtttggagagaaacttgaagatgatgtag

SEQ ID NO: 7358 - DNA, 87 bp, Homo sapiens
ccgtgagggctgttgtggcaactgtctcactgagtcaatatcgatgaaggatgactttgtgcagggtccgctctgcatctgtcccgg

SEQ ID NO: 7359 - DNA, 117 bp, Homo sapiens
gcatgtattagggagtgtgtgagcgtgccttgcaagagctggtgtgtgtgtgagtgtgcctgtgtgtgtgcctgtgtgagagtgtgcaagtgtgtgtgagtgtgcctgtgtgagtgt

SEQ ID NO: 7360 - DNA, 145 bp, Homo sapiens
gctcagttcaagaggacatgcacataaacaaaataaggaaagctgtgggcatgctatgaccatcacacactcactctgactttcttagcttgttatgaccttgatctcatgctcagctcctgtactcttaatatttctttgtttt

SEQ ID NO: 7361 - DNA, 62 bp, Homo sapiens
tactgtctgtctctgtgattctggctactccaggtgcctcatataaatggaatcggacagtg

SEQ ID NO: 7362 - DNA, 68 bp, Homo sapiens
ggagtgtcgctgtgcccttgagagttcagagagaggagtgcctctttctaacttgcacaaaagcatcc

SEQ ID NO: 7363 - DNA, 58 bp, Homo sapiens; identical to SEQ ID NO: 902

SEQ ID NO: 7364 - DNA, 90 bp, Homo sapiens
catgtcgtgctgaagacacactaccactatccccgtgtccctgaatgaggaaacggtggcaccgtgtatccctgaggctttaatgaaatg

SEQ ID NO: 7365 - DNA, 57 bp, Homo sapiens
tgagatggagtctcactctgtcaccaggctggagtagagtggcgcactcttggctca

SEQ ID NO: 7366 - DNA, 71 bp, Homo sapiens
gagtttgcattggtgcattgctagaggaaagcacccagttcactgtgtatctctgtgtacctgtgtatttc

SEQ ID NO: 7367 - DNA, 110 bp, Homo sapiens
cgtgtgtatgtttatatttatgtaggtatctatgtatgtatgtatatatgtctaatttctgtatgtgtgtgtatgtattttctaatttgaccgtgaaagcaaagcagatg

SEQ ID NO: 7368 - DNA, 108 bp, Homo sapiens
cccaggtgacagagtgagaccttgtctcgtttttttttttttttttttttaaaaggtaaacaaaagagcattgcaaaactggagaaagtgcctaactcctcatctggg

SEQ ID NO: 7369 - DNA, 112 bp, Homo sapiens
gccaaatcagatttcacttcctctcccaacttttttttttaatttacattgtaaaatacaaagtaactactacacaaaggtaccagcagtgagtgaggaccctgcatgtggc

SEQ ID NO: 7370 - DNA, 77 bp, Homo sapiens
tggtggcataggtgttgagtgtgagcacacgagcatggcaggagctcgcgggaacgggccaacgccccactgcccca

SEQ ID NO: 7371 - DNA, 67 bp, Homo sapiens
catgaagacacacacactcagccacactgtatttaatgggccgggatttgtgtaagtgatctccatg

SEQ ID NO: 7372 - DNA, 73 bp, Homo sapiens
ggtaggaagtttgatgacattgtcttctaggtcacttcagactctgaagaatgtgagctctaaaactttcacc

SEQ ID NO: 7373 - DNA, 71 bp, Homo sapiens
gtgtgtgtgtgtgtacatgtgcatgtgtatgtttaagtgtgtgtgtatgtgtgtgtgtatgatgtatgtat

SEQ ID NO: 7374 - DNA, 85 bp, Homo sapiens
ttgatctgttagacgagattttggtggatttagtttacattatttgtatatctgtacttttgccaagtatattttaacagtacaa

SEQ ID NO: 7375 - DNA, 115 bp, Homo sapiens
tctttggtttttcactatgggagggtggtgggcatgacagctttaagtaaattaaatattttatttataagctatattccaaataacatatttactactgtggtacagaataaga

SEQ ID NO: 7376 - DNA, 79 bp, Homo sapiens
tttccttccaacagacaactctgtctgcaccctacgctgagatgtacccacaggcaccacctgtctggatggaaagaaa

SEQ ID NO: 7377 - DNA, 88 bp, Homo sapiens
ttgcaactgctcaaggggctgaggtaggaggatcacttgagcccaaagcaatccagcctgctcaaacccagcctgggcagtatagcaa

SEQ ID NO: 7378 - DNA, 89 bp, Homo sapiens
ggtttttggtttttgagacggagtctcactcactctatcgcccaggctggagtgctgtggcgcgatctcggttcactgcaacctctgcc

SEQ ID NO: 7379 - DNA, 58 bp, Homo sapiens
tgagatggagtctcattctgtcactcaggctagagtgcagtggtgtgatcttggctca

SEQ ID NO: 7380 - DNA, 73 bp, Homo sapiens
ggaaactcactgtctgtctcgagaccaacgtctccatttattaacgagggtatgagattagattagtgcttcc

SEQ ID NO: 7381 - DNA, 119 bp, Homo sapiens
tgtattattctttgagcactttcctggatttgatttgttgctattctacatacaattttttatctctttttatgtcaacagtttttggggtacaggtgtaatcaaagtttttgattaca

SEQ ID NO: 7382 - DNA, 97 bp, Homo sapiens
cccgagatgtcttatatgggtcttactgtctgctctttctggctgcttgcagttggaagagaagtgatatccttgaaatgcatgaggctagaaaggg

SEQ ID NO: 7383 - DNA, 99 bp, Homo sapiens
ggggacactcaggaggaggatgacttcgtggggagtgcggaactgtccagggcacatcggcctgtgactgtctctgtctgtcccaatttgtatcagtct

SEQ ID NO: 7384 - DNA, 111 bp, Homo sapiens
tgagtgagtgctcagtgaacactgttgtattgaactgaattatatgtttttttaacaaatctataataattctccagtagtgctaatcctatgtgaactggatacttttta

SEQ ID NO: 7385 - DNA, 84 bp, Homo sapiens
ggctttagctcggggtttcaggacttcagcatgactgaccctgctgtcagcctccctgtgtccctgtgctcccctccaagagcc

SEQ ID NO: 7386 - DNA, 58 bp, Homo sapiens; identical to SEQ ID NO: 3380

SEQ ID NO: 7387 - DNA, 72 bp, Homo sapiens
atatgtatgtatgtgtatatgtatatttacaaacacatgatgtatattatatatatatacatacatatatat

SEQ ID NO: 7388 - DNA, 262 bp, Homo sapiens
atatattgtgtgtgtgtgtgtatatatatgtgtatatatatgagtgtgtatatatatgtgtgtatatatgtgtatatatatacagtatataccccaagaatatattgtgtgtatatatgtgtatatatatgtgtgtatatatatatacagtatatatatatatacacacagtatataccccaagaagaatatatactctgtgtgtgtgtgtatatatatacagtgtgtatatatatatatatacagtatatatatacacaca

SEQ ID NO: 7389 - DNA, 117 bp, Homo sapiens
tagagattgaaagagagcatatatgcgaatcaatgcagttgagtgaatggacagaagaatgagtgaagtactttgaaacctgcgtagggccacgcaaatgttcctaacccttttcta

SEQ ID NO: 7390 - DNA, 69 bp, Homo sapiens
tccctggtgtctctctgtgtgtccaaatcccctctttgtataaagacaccagtcagattggattaggga

SEQ ID NO: 7391 - DNA, 113 bp, Homo sapiens
gcaacaaggtgggtgagatgggattctgaacagtggagagttggtgctcttgggacttgagaggagtcttttgactgtggaaaggtttccagacagaaagtgagccgtggggt

SEQ ID NO: 7392 - DNA, 119 bp, Homo sapiens
ccagctggagccaccatcgactgagaaggacactctgcacttggaggacaggtctgccacttcctccaggcttgtgtccgctggcctgagtttcctgtggatgctcccctgccccttgg

SEQ ID NO: 7393 - DNA, 77 bp, Homo sapiens
ggctgaatccccaggcacagtggtcaggcagacctggtttgaatcaagtcaccctgactgtctgggtgaccttagct

SEQ ID NO: 7394 - DNA, 75 bp, Homo sapiens
gcttcagactatctctaatacccagtccagagtgcagactctgtcagtgactgtggaaaagactctagactgagc

SEQ ID NO: 7395 - DNA, 135 bp, Homo sapiens
agccaaaagaaagtcaggcagcaaacacacaaaagcccacctcggtggcccacgtgtggctgtctgactcagtctgtggttccaggccatgtgtcctggtctcatctccagtgccagacctgctcccacttggat

SEQ ID NO: 7396 - DNA, 86 bp, Homo sapiens
ggcagttgtgtctgtgtctgtgtctccccatacctaaaatgttaaatcccggggacatttgcaagcccagcccaacacagtctgcc

SEQ ID NO: 7397 - DNA, 61 bp, Homo sapiens
ctcgctgcctgtttccctgtgtgcccatggttcttctaggtgctgggaatagacgagtgag

SEQ ID NO: 7398 - DNA, 71 bp, Homo sapiens
tcggagtccccgtgcatcataatgaatttgtgtgaaggtcacataactgagtgtgcacgtgggcattttgg

SEQ ID NO: 7399 - DNA, 108 bp, Homo sapiens
gctgtgcaaaggcccggagaggaagttggaggtgtctggagagagacagcccaggaaagaggctgagaatcacccagaaaacccttgaaggccactgtttgcagacgc

SEQ ID NO: 7400 - DNA, 90 bp, Homo sapiens
tgacatcaaagattcttctgtgatttcctttcttggctgtgctgctgacagtggagaatgtggactcagcagcagggaaatctgaagtca

SEQ ID NO: 7401 - DNA, 115 bp, Homo sapiens
ctgggcacctggagccaggccctacacaggggatgaaatgacgtgagcggccaaccctcactgtcactgtcaaagagcttctagtcaagtggggatgataccagaggggtccagg

SEQ ID NO: 7402 - DNA, 116 bp, Homo sapiens
tttatatatataagtatatatatatatgtgtatatatatatatatatatatataatacgtatatgcatatatatagtatataaatatatacatatatacatgtacatatatatata

SEQ ID NO: 7403 - DNA, 116 bp, Homo sapiens
tgcatggtggatcttattataatgctgggcaaggtttcaaacagagaacaggagaaaaggaaagttcttttttttttctaaagtggagttctgacttgtgttgacgccatcacgca

SEQ ID NO: 7404 - DNA, 115 bp, Homo sapiens
gtgtgtttgagtgtgcatgtgatatgtgaacaagtgagtgaatgtgagtctttgcatgtgcatgtgatatgcaagtgtgtgagtgcatgagtctgtgcatatgatgtgcgaatgt

SEQ ID NO: 7405 - DNA, 84 bp, Homo sapiens
gcatgtgtgtgcatatgcgtgcatgtgtgtgcgtgtgcatgtgcatgcatatgtgcatgtgtgtgcgtatgtgtgcatgtgtgt

SEQ ID NO: 7406 - DNA, 107 bp, Homo sapiens
cctttaccctgggctggcccctgtgaagtgctttctgaggactgtctcagtcagtctttccagcaacctcaggaggcatcattaccctccccattttaccatgaagg

SEQ ID NO: 7407 - DNA, 72 bp, Homo sapiens
taggggtggtttcacagggagctttctagtgacagtttctgggggaaatgtgatagctaggtgatacctctg

SEQ ID NO: 7408 - DNA, 71 bp, Homo sapiens
ggagctgggtgatttagtttttttttttaaatttattttttgagacagagtctcactctgtcacccaggcc

SEQ ID NO: 7409 - DNA, 87 bp, Homo sapiens
tagagaatggaagtgtttatgttgttggcatttgaattaagagctgagcagccttctgcggacattatgggtattccattatctctg

SEQ ID NO: 7410 - DNA, 74 bp, Homo sapiens
gggtgtttcaggatgagattatcttcttttttattttttgggtggtgggggaatggagtctcactctgtcaccc

SEQ ID NO: 7411 - DNA, 56 bp, Homo sapiens
tgggagtgtgtgtcctgcaagctgaggtgtcctgagagagcagacaggggctctga

SEQ ID NO: 7412 - DNA, 103 bp, Homo sapiens
ttaggaataaatgttgaattttgtcaaaagtattttttttagattagaagttcagaaatgttcttctttatttctttgacaatttattctaacctgttcctaa

SEQ ID NO: 7413 - DNA, 74 bp, Homo sapiens
gcttagtgtgtgagtctgtgatactgtctctcatgtgcttgaaccccagagtgtgtgcatagtctatgctaagt

SEQ ID NO: 7414 - DNA, 73 bp, Homo sapiens
ctgaggacagggaccagccaggcacacatgcccctctccctctttggtcagtctgtctgtccctcctcttcag

SEQ ID NO: 7415 - DNA, 87 bp, Homo sapiens
gattacaggtgtgagccaccatggctggctgtaagcctcacttaaaatcccatcctcggccaggtgcggtggctcactcctgtaatc

SEQ ID NO: 7416 - DNA, 100 bp, Homo sapiens
gctcctgtcccattggccagcatgttgggcagcagtgggcacacacactctctgtgttagtttgctagggctgctgtaacaacgtgctacaaacagggtc

SEQ ID NO: 7417 - DNA, 58 bp, Homo sapiens; identical to SEQ ID NO: 315

SEQ ID NO: 7418 - DNA, 74 bp, Homo sapiens
tctgcactcctggtcactgactgagtgtctgtaacccagaagacagaaccagggtatgccaggctgtgtgtgga

SEQ ID NO: 7419 - DNA, 80 bp, Homo sapiens
ggtcatcactgcctgctttgagggggatcactgcctgctttgagggggatccttgccacacagtcacgcaggctctgacc

SEQ ID NO: 7420 - DNA, 85 bp, Homo sapiens
agtggctactgtaactgcatttccatgtcattcctggggagagaacgcccctagtaacagcaagtgcaattaactagtagttcct

SEQ ID NO: 7421 - DNA, 113 bp, Homo sapiens
cggttttctgcagtagctctagatggacttgtctcttgtttgtctctatggtattggggtattttaaatttttcacgtctagagtgttaagagttcgtctttctggagattgt

SEQ ID NO: 7422 - DNA, 81 bp, Homo sapiens
cagacactgggtgcctccacgctgccctcttaacttttttttttttttttgagacggagtctcgctctgtcacccaggctg

SEQ ID NO: 7423 - DNA, 61 bp, Homo sapiens
ggtggcagaaccttgctctttttttttttttttttttaagacagagtctcattctgtcacc

SEQ ID NO: 7424 - DNA, 72 bp, Homo sapiens
ctcccggactctgcagcaccaggtacgtggcagggcagccaggtgtgtggctgtcactgagactgaggtaga

SEQ ID NO: 7425 - DNA, 116 bp, Homo sapiens
accgctcctggccgtcattttcattttataagtgcattatttatttgtttaaaactattatttgacaaattggttagtcccttctctgtgattatgaattgattctacagtgtggt

SEQ ID NO: 7426 - DNA, 91 bp, Homo sapiens
cctgtggatacaaagggctgactgtactacctcattttatttatttatttataaataaataaagagacgctgtcttcctctgtcacccagg

SEQ ID NO: 7427 - DNA, 109 bp, Homo sapiens
tgggagggggcagcggcttacttggggagctcaggagccaagagccaaaggcctgttgggctctgactccctgactctccccttctggccttgcccatcccttctccca

SEQ ID NO: 7428 - DNA, 69 bp, Homo sapiens
cactgcttttttggggggatgggggtgggggacaaggtctcactctgtcacccaagctagagtgcagtg

SEQ ID NO: 7429 - DNA, 101 bp, Homo sapiens
gaactaccatccccagccctggagagactgctctgtaacagccacaggagatgccaaatcagagtggctgttcagcagcagccactggaggaggtatgttt

SEQ ID NO: 7430 - DNA, 237 bp, Homo sapiens
gtgttgtatgtaatgtgtgtgtagtgtgcagtttggtgtgtggtgtgtagtgtgcagtttggtgtgtggtgtgtgctgtgtgtggtgtgtgcagtgtgcatgtgtagtgtgcagtgtgtgtggtgtgcagtgctgtatgtagtgtgtgtagtgtgtgtgtagtgtgcagtttggtgtgtggtgtgtgctgtggtgtgtggtgtgcagtgtgcgtgtgtagtgtccagtgtgtgtggt

SEQ ID NO: 7431 - DNA, 74 bp, Homo sapiens
cagcctttgtgcaaggtggtgggtttctttcttttttttttttgagacagagtctcactctgtcacccaggctg

SEQ ID NO: 7432 - DNA, 58 bp, Homo sapiens
tgagacagagtctcactctgtcacccaggctggagtgcagtggtgtgatcttggctta

SEQ ID NO: 7433 - DNA, 112 bp, Homo sapiens
ggttggctccatgctttgaccaataaactgtgacagaagtgacactgcatacattccaaggttgggccctaagatctgtagttttcacctttgttcttggaatgcagccacc

SEQ ID NO: 7434 - DNA, 58 bp, Homo sapiens; identical to SEQ ID NO: 2442

SEQ ID NO: 7435 - DNA, 83 bp, Homo sapiens
cttcatggaactcatgtattctagtgaccaaagtatttatatttaaatgctggcctgtggctcagaaacacaattctaggaag

SEQ ID NO: 7436 - DNA, 112 bp, Homo sapiens
ggcagagtccacaggagctgccctgagaagaacacacaggcagctttgaactgtgcagaacgagaggtgccgcgggatgttcagcctcaggtgagcacaggacgtgatgacc

SEQ ID NO: 7437 - DNA, 112 bp, Homo sapiens
gtgtatatgtgtatatgcatatgtatgtatgcatatgtgtgtatgtatgtgtgcatgtgaatgtgtaggtacacacgtgtgtgtacatgtgtatgtgtgtgcatgtgtgtat

SEQ ID NO: 7438 - DNA, 81 bp, Homo sapiens
ctggtccagtcagagatgcacgtgttggagaaacatgcatgacatgtgtccgtccctctctgtgtgtcctccctgccccag

SEQ ID NO: 7439 - DNA, 157 bp, Homo sapiens
gtcagagaagtcactcagcatggaaagaggaaggacgtttgtcagagaagtcactgagcatggaaaggggagggacgtttgtcagagaagtcactgagcatggaaagaggaaggacgtttgtcagagaagtcactgagcatggaaagaggaaggaca

SEQ ID NO: 7440 - DNA, 82 bp, Homo sapiens
tgaagctacgcatcacactctgtggctcagtggcgctgtcggaagagcaggcctggggatgcggggagtgtgattttcttca

SEQ ID NO: 7441 - DNA, 115 bp, Homo sapiens
ccagttggtagaactagttgccatgaaccagtggagaagagcaaccaaattttatttgattatcaataattggtttttagctatttagtcatatttattctggcttgttttgacc

SEQ ID NO: 7442 - DNA, 137 bp, Homo sapiens
gtggacccccgagacgcagagtgtgcgctcagagatcctcccaccactcagagtgcacactcggagatcctgccaccactcagagtgcacactcggagatcctcccaccactcagagtgtgcactcagagatcctcc

SEQ ID NO: 7443 - DNA, 87 bp, Homo sapiens
gtgtcgctgggaccctgggcccctctctgtgtctctgtgacccgacccctctgtgtcgctgagaccctgggcccctctctgtgtcgc

SEQ ID NO: 7444 - DNA, 102 bp, Homo sapiens
gacagggccagggtgggtgggcacggggccaaggaggggtgttagtgggacagggagctggcttcactcccccaggttaatgcagcttgtcccatgggggtt

SEQ ID NO: 7445 - DNA, 90 bp, Homo sapiens
gtgtgcacatctgtatatgagtacacacgtgtgcttgtgtgtctttgcatgcacgtctttgtgtgtatatctctgtgtgtgtgtgcacat

SEQ ID NO: 7446 - DNA, 74 bp, Homo sapiens
atatagtcagaagagacagaactgtgtggatcactgtcatggacataggacgctggatctttcctgcactgtgt

SEQ ID NO: 7447 - DNA, 70 bp, Homo sapiens
gggccaccgtgatgcatgaggcttcaggctcagggctctctgtcggtctgagaaaatcatgtcattgccc

SEQ ID NO: 7448 - DNA, 83 bp, Homo sapiens
gtcctgcctggctccctctatgcagggctgggtgctgggcatgactggcgttcatgccccatgcagtggggggcagacatgac

SEQ ID NO: 7449 - DNA, 95 bp, Homo sapiens; identical to SEQ ID NO: 68

SEQ ID NO: 7450 - DNA, 93 bp, Homo sapiens; identical to SEQ ID NO: 69

SEQ ID NO: 7451 - DNA, 135 bp, Homo sapiens
gtgtacattgtgtgtagagtggtgtgttcattgtagagtggggtgtacactgcgtgtagagtagtgtgtacattgcagagtggtgtgtacattgtttgcagagtggtgtgtacattgtagagtggtgtgtacatt

SEQ ID NO: 7452 - DNA, 86 bp, Homo sapiens
tgaggctgagtctcgctctgtcacccaggctggagtgcagtggcacaatctcggctcacagcaacttctgtctcccgggttcaagc

SEQ ID NO: 7453 - DNA, 60 bp, Homo sapiens
ttgagacagagtctcactctgtcgcccaggctggagtgcggtggtgtgatctcggctcaa

SEQ ID NO: 7454 - DNA, 100 bp, Homo sapiens
tctgagttttggcgcttctctggcaagtcactgtgtatctctgagcctcaggctcccctctgtgcacagggagagtgccaggagggtccttgcccccagg

SEQ ID NO: 7455 - DNA, 81 bp, Homo sapiens
aggagacggagccaccgttcatccattggctcagacatggaatctgggtgccaatgctgacctctctctttctgtctacct

SEQ ID NO: 7456 - DNA, 116 bp, Homo sapiens
ttaaagcttttcttgaagtaatgaaatggcttttaactagctagtatattttattaattgacatattaccaatcttacagtaaaaaaagttatctttacttttaaaaaagttttaa

SEQ ID NO: 7457 - DNA, 78 bp, Homo sapiens
gagtctcgctctgtcacccagtctggagtgcagtggttgctcactgcaacctccacctcctgggtttgagtgattctt

SEQ ID NO: 7458 - DNA, 90 bp, Homo sapiens
gtgactgcagatgctgctcagctggcgactgagctcgctcacacacactcacacaccctcatgcaagctcatgcagttatgcacactcac

SEQ ID NO: 7459 - DNA, 104 bp, Homo sapiens
gtgtgggtgtgagtgtatacaaatatgtgtaagtgtgggtgtgagtgtatatgtctgtgtgcgtgtgtggctgagtgtatataagtatatacgtgtgcctgtgt

SEQ ID NO: 7460 - DNA, 117 bp, Homo sapiens
atatatatgtatcttgtacactcattcatatatataatacacacatttttatatatctatagttacatataaattatatatgtgggtatatatgcttgtttatatttgcttatatat

SEQ ID NO: 7461 - DNA, 75 bp, Homo sapiens
cagctctgcagaggggctgcagggagcatccagggcccatactcgtctgctcatctctcagtctctgtgtttatg

SEQ ID NO: 7462 - DNA, 69 bp, Homo sapiens
gggcaacatagtgagatcctctccctgccaaaaagaaagagagagagacagggtctcactctgtcaccc

SEQ ID NO: 7463 - DNA, 73 bp, Homo sapiens
aggttaggccccttgcccaggggcacagtgacaggtgagtggctgagtccctctcaagggatccttctgacct

SEQ ID NO: 7464 - DNA, 121 bp, Homo sapiens
gctcagcgaggacagcagggtggtcggcctgcaggcacggtgggctctgacactgactggctgggtggacctggaccaggcactaacacaggttcggagaggaggcaggcaggacacagcc

SEQ ID NO: 7465 - DNA, 77 bp, Homo sapiens
accagtgcacatccattatttattacagccttcacaataaatggaaaactgtggtgtgtgtgtgtgtgtgtgtgtgt

SEQ ID NO: 7466 - DNA, 61 bp, Homo sapiens
gcacctgctgtgtgccaagctatgtctacagggcagacagagagatgagagactgcagggc

SEQ ID NO: 7467 - DNA, 113 bp, Homo sapiens
gatgtgtgtctatgtgcatgtatgtgatatgtctatgtgtgtgtgtctgtgcgtctgtatgtgtatctatgatatgaatctgtgtatgtctgtgtgtgtttatgatgtgtgtc

SEQ ID NO: 7468 - DNA, 103 bp, Homo sapiens
gtctatgatgggtgtctgtgtgtgtctatgtgtgtctgtgtgtctttgatctttcttataaggacacactcattggattcagaccctcctaatccaatatgac

SEQ ID NO: 7469 - DNA, 84 bp, Homo sapiens
gggcctgtggggtctgtgcagtgtgatgtgtgtgtgcacatctcatgtgtataccacacatactccttgagctcgtgagtgccc

SEQ ID NO: 7470 - DNA, 63 bp, Homo sapiens
ggtgtgcaagcagggcatgtacggggcctgtgtgtgcagggtctgtgtgtgtgtgtgcagggc

SEQ ID NO: 7471 - DNA, 96 bp, Homo sapiens
cctctctctctgagtccattgtcttcacagcctgtctctctctcttccccgcgggaggactccttgatgacattgggcccactcagataatccagg

SEQ ID NO: 7472 - DNA, 217 bp, Homo sapiens
gcattcgcgtgtgcgttcacatgtgtgtattcgtgtgtgcatgtgcgtgtgccttcgtgtgtgtgcatttgcatgtgcatgtgcgtgtgtgcattcgtgtgtgtgcatttgcatgtgcatgtgtgtattcgtgtgtgcattcacattgtgtgcatgtgcatgtgtatattcgtgtgtgcgttcacgtgtgtgtattcacgtgtgcatgtgcgtgtgt

SEQ ID NO: 7473 - DNA, 116 bp, Homo sapiens
gtgtgcttgtgtgtgcatttatgtgtgcatgtgcatgtgcattcgtgtgtgtgtgcatttgcatgtgcttgtgtgccttcatgtgtgtgcatttgcgtgtgtgcatttgcatgtgt

SEQ ID NO: 7474 - DNA, 81 bp, Homo sapiens
acctggtctcttctgtgagtctcagtttccccaggtgtattcaggagcctggggctgctgtgagtctcagtttccccaggt

SEQ ID NO: 7475 - DNA, 113 bp, Homo sapiens
tatttgtgagaacagttttagatgtatcctatagattcgaataacgtgtgatcctattattttttattattctatatataatatactttattctttttgctgttttctagata

SEQ ID NO: 7476 - DNA, 85 bp, Homo sapiens
tcctattttcctgaggaggcgaaactgccgcatccgagtgtctgtttctctgtgcaatagtaatgccccgctaggtggcagggga

SEQ ID NO: 7477 - DNA, 130 bp, Homo sapiens
ggccttcgcccgccttgcgtccagcctgccgggggctcccaggccggcgcccgagctctggctccgtgtcttcactcccgtgcttgtccgaggagggagggagggacgggggctgtgctggggcagctgg

SEQ ID NO: 7478 - DNA, 87 bp, Homo sapiens
tatgaatctaagtattatacatgcttggtctagaaaatttttttaagtattaagaactcgaaaatcagccaggcatggtggctcata

SEQ ID NO: 7479 - DNA, 58 bp, Homo sapiens
tgagtcagagtctcactctgttacccaggctggagtgcagaggtgtgatctcagctca

SEQ ID NO: 7480 - DNA, 67 bp, Homo sapiens
tatcattgtaattgtcagaaatgagagtggtcttgaggactgttttctctgcctttacagtttgata

SEQ ID NO: 7481 - DNA, 103 bp, Homo sapiens
cctctgcttccaggtaaatctgccctgcagccatctgcagtctctgtctctgtatcagcagatagttgcatctcatggctccgagggtgtgttgagggggagg

SEQ ID NO: 7482 - DNA, 78 bp, Homo sapiens
ggggctggctctcgaggtgggcatggggaggtggtggggaaggtgtcgaagactgagtgtacacagggtgctggtctt

SEQ ID NO: 7483 - DNA, 116 bp, Homo sapiens
gctcccgtccactgtgtcctgtgctgcggggagggcagagaggaggggctggccgctcctcacatgtgtctctctcttccagttacatcccggccgtggtggaccaccgtgggggc

SEQ ID NO: 7484 - DNA, 112 bp, Homo sapiens
ggagtagtggcaacatctgtagtaccagctccttgggaggctgaggtaggaggatcacttgagctcaggagttcgaggctgcggtgagctaatgatcacaccactgcactcc

SEQ ID NO: 7485 - DNA, 107 bp, Homo sapiens
tatgtgagtgtgcatgagcatgcatgtgtgtgtatgagtgtctgtgtgtgtgaatgtatgcatgggtgggtgtgcgtgcatgtgtgtgtcagtgtgtgtgcaatgtg

SEQ ID NO: 7486 - DNA, 107 bp, Homo sapiens
gtgttgtttgttttcttgttgttgggttgtaggaattctttttttttttttttttttttttttttagacagagtctccctctcactcaggctggagtgcagtggcgc

SEQ ID NO: 7487 - DNA, 68 bp, Homo sapiens
agaggcctgaggagagaggtcacagaggggactgactccagctaggaccttttctcagggtgtccttt

SEQ ID NO: 7488 - DNA, 57 bp, Homo sapiens
gtggctgactgacagcctcactgattccggggaatggcgagctgtcatctcatccgc

SEQ ID NO: 7489 - DNA, 96 bp, Homo sapiens
cgtggctctgctcaattattgtgggatatagagttgacattttttttttttgagacaaagtctcgctctgtctccaggctggagtgcaatggcgcg

SEQ ID NO: 7490 - DNA, 71 bp, Homo sapiens
gcggtgcccaacacgggaacaggccggtccctgggctctagatgctatggctctgtctctctgggtagcgt

SEQ ID NO: 7491 - DNA, 111 bp, Homo sapiens
gatacttacttacctggaccctgcagcagtaacatttgacgtgggcacttgtcttattagacattttcttcttgttacctgaaaatcttatctgaaggtatttacggtatt

SEQ ID NO: 7492 - DNA, 105 bp, Homo sapiens
ctgttcttatcagccttatgacttggggacttgggatacttttttttttttttttaatttattgagacagagtctctccctgtcacccaggctggagtatgacag

SEQ ID NO: 7493 - DNA, 77 bp, Homo sapiens
ttctaagctttaggtgatagctgtatcaaattttttttttttttgagacagagtcttgctctgtcgccaggctagag

SEQ ID NO: 7494 - DNA, 115 bp, Homo sapiens
tgtctttccccttagagttgtatttgctcttctttcaaaaatagttcaattaaaaattaatatatatatatatttttgagatggagtcttgctctgtcacccaggctggagagca

SEQ ID NO: 7495 - DNA, 84 bp, Homo sapiens
aggaccattgctcctggcctcaggatgtgcagctgctgccagaggcagcttggcagacacacagacacacaggtgccctggcct

SEQ ID NO: 7496 - DNA, 81 bp, Homo sapiens
ggccagggcacctgtgtgtctgtgtgtctgccaagctgcctctggcagcagctgcacatcctgaggccaggagcaatggtc

SEQ ID NO: 7497 - DNA, 90 bp, Homo sapiens
agttatatgttaatacaactgactacacgaaaaatatgtaatagcatatgctatgtaatttttcaaatcactaggtattgatatgtgcct

SEQ ID NO: 7498 - DNA, 93 bp, Homo sapiens
ttccagagctagagattggcagagctagaattcaaaccaggcaatggatctccaaaatgcattatgttccttaaatctctgctgatcttggaa

SEQ ID NO: 7499 - DNA, 75 bp, Homo sapiens
aggtctcactctgtcactggggctggagtgcagtggtacgatcacggctcactacagccttgacctcctgggctt

SEQ ID NO: 7500 - DNA, 103 bp, Homo sapiens
gctaggtccagagccacccacataaggcaggaagcggggaggctctgccaggctgggggcctctctgagcctcactgtaaaatggggcctggcctggacctgc

SEQ ID NO: 7501 - DNA, 96 bp, Homo sapiens
gggtgtggagaggtccaggaggtggcaggcagaccacagtgtggctgtgttctccaccagtccctagcactgtccctaaaagcatgctccccattc

SEQ ID NO: 7502 - DNA, 114 bp, Homo sapiens
ggaaatgctgtgtctgtcactgttatactacatcgtcttttgtttattttttattgttgtattgttatttttatggttgaatctgcagatgtggagcccgcaaatacaggggcc

SEQ ID NO: 7503 - DNA, 107 bp, Homo sapiens
aggtgacggaacagctcagattttctttgtctggaaatgtactgatttagttgataaaaatgtcttttcctcagtggatttccgtggttctgggttgacagttgctt

SEQ ID NO: 7504 - DNA, 65 bp, Homo sapiens
tgagtctcagtttctctctccagaggtctatgacctcagagagggctcaaaacgctgggtgatca

SEQ ID NO: 7505 - DNA, 107 bp, Homo sapiens
agcagaatataaatctcaaaaatgtttctgaggcataaacagttgttttatcacaactgtttttgaaggtagctagacttataagagattcttatatttaaagtgct

SEQ ID NO: 7506 - DNA, 73 bp, Homo sapiens
catgaatgggtctcagacagtgtgtgagtggatgaagcaggaaaaacacatgctgctagttaattcatttatg

SEQ ID NO: 7507 - DNA, 84 bp, Homo sapiens
gggggcttccaggtcacaggaacgtaagagacaaatggttgtattcttttgagtttctgatgagcctttgcaaaggaagcaatc

SEQ ID NO: 7508 - DNA, 118 bp, Homo sapiens
gggccctgcttggagcctgagtccacctgcagctgggtgtcctttcccccatgcccaacacactcagtctctggggatcagggtttgtgcatctctgggtggctgctccaccagcccc

SEQ ID NO: 7509 - DNA, 110 bp, Homo sapiens
gggagctaagaggtaagccaccatcatgagtcctgtgctgacgcaggccccagacatgactgacagcacagtcagactacgtgatgtctctggcttgcctattaattttc

SEQ ID NO: 7510 - DNA, 86 bp, Homo sapiens; identical to SEQ ID NO: 2671

SEQ ID NO: 7511 - DNA, 95 bp, Homo sapiens; identical to SEQ ID NO: 580

SEQ ID NO: 7512 - DNA, 93 bp, Homo sapiens; identical to SEQ ID NO: 69

SEQ ID NO: 7513 - DNA, 93 bp, Homo sapiens
acggtggcactggcactgttcactggagcactatgacacagtcacactggcactgttcactggagcactatgacacggtggcactggcactgt

SEQ ID NO: 7514 - DNA, 93 bp, Homo sapiens
atggtggcactggcactgttcactggagcactatgacacagtcacactggcactgttcactggagcactatgacacggtggcactggcactgt

SEQ ID NO: 7515 - DNA, 114 bp, Homo sapiens
ctcacacaagttgtaactgtcagcattgcagtgccagaatgggatgcagttatgtgtttttttatttccaaatccagcgttgtttctgctatgccatacagcaactgttaaaag

SEQ ID NO: 7516 - DNA, 91 bp, Homo sapiens
gtgattgttaagacttcctttatggtgtgttacatagtcaatatttgtaaatgttttctatgtggtcttgtaaatgatcttgaaaagttac

SEQ ID NO: 7517 - DNA, 127 bp, Homo sapiens
agcatctgtgggctacagtgtgtggtttggagcagtacgaggggagttcccagtttcttttttttttttttcttctctgctgactctgcctcaaagccagtctgttatgaagctgcactactgaggc

SEQ ID NO: 7518 - DNA, 120 bp, Homo sapiens
agtgttctacgtatgttgggaacttgatacatgcctgctgaatgaatgaatgaatgaatgagtgaccaccacacaacatcctattcttcagaacgtgtatcccaaatttcaggatccact

SEQ ID NO: 7519 - DNA, 94 bp, Homo sapiens
gtagaagttttaagccttaagagcagaaggatccatttctatgtttatttaaaagaacagtctatgggacttttggaaaggttttaaccgatgc

SEQ ID NO: 7520 - DNA, 62 bp, Homo sapiens
tcactgggataggcggcaagcactagaaatggctgtttctctggctgtcactgtcattgtga

SEQ ID NO: 7521 - DNA, 88 bp, Homo sapiens
ccacctcctcactgtccctgctcatgggcctcgacctacgcacaatgtgtctctgagtctccgtgttggtgatagcacatacccgtgg

SEQ ID NO: 7522 - DNA, 56 bp, Homo sapiens
gagactgagtctcactctgtcacccaggctggagtgcagtgttgtgatctcagctc

SEQ ID NO: 7523 - DNA, 95 bp, Homo sapiens
ttccatttgtgttttttattttcaaaaatctttatgtttgtgtgtgagagagagagacagagagagagcatttgtgttgagaaagacagagagaa

SEQ ID NO: 7524 - DNA, 70 bp, Homo sapiens
agatctgtctgactccagagcctgtgctcttttccattgtatcacactgaggctctgagtttggagttct

SEQ ID NO: 7525 - DNA, 81 bp, Homo sapiens
ctggggggggaggcagagcagatgggagcaaacaggcaggggggtctcctgtgtgtctgtctgtctgtctgtccttcccgg

SEQ ID NO: 7526 - DNA, 58 bp, Homo sapiens
tgagacagggtctctctctgtcacccaggctagggtgcagtggtggaatcatagctca

SEQ ID NO: 7527 - DNA, 139 bp, Homo sapiens
actctgtctccaaaaaaaaaaaaaaaagaggcaccagctttgctgctttgctggcctttttagactttttttttttctttcccgagacaaggtctccctctgtcacccagtctggagtgcagtggtgtgatctcggctc

SEQ ID NO: 7528 - DNA, 58 bp, Homo sapiens
actgggcagggaaggagaccgatgaaaaagttgagtcagtctctctctctctctcagt

SEQ ID NO: 7529 - DNA, 108 bp, Homo sapiens
agaatttcagtgtatttgttctagtttttgtgtccatgtttatgtatattttaaaatatatatgtataaaattgggatcctacaggatagtgttaaaactgaatttct

SEQ ID NO: 7530 - DNA, 71 bp, Homo sapiens
acgtgagtgtgtgtctgtgtgtgagtgtgtgtaatagcacagtaggcgggcgcagcacctgacctttatgt

SEQ ID NO: 7531 - DNA, 87 bp, Homo sapiens
atacaaacgtataaaatgtatatatgtgtgtgcatgtgtatggatatatatacatgaatgtatacatgtatgtgtgtatgggtgtgt

SEQ ID NO: 7532 - DNA, 77 bp, Homo sapiens
ctgggtagaggtgggatctctgtatcatttctttttttttttttttttcttgagacggagtctcactctgtcaccag

SEQ ID NO: 7533 - DNA, 58 bp, Homo sapiens
tgagacggagtctcactctgtcacccaggctggagtgcagaggtgtgatctcggctca

SEQ ID NO: 7534 - DNA, 78 bp, Homo sapiens
ccagcccgggtttcccaccttcggtgtggctgtctctcactgggaatgcgggggatgtcactgggtctatggggctgg

SEQ ID NO: 7535 - DNA, 101 bp, Homo sapiens
gtgttgagccctctggtgaacggtgcctctgtcagcctgtgggtgggggcttcgatggctccacctgtgggggagagaagaggatcagtggggcggagcac

SEQ ID NO: 7536 - DNA, 67 bp, Homo sapiens
tgggtcaggaatctgtgagtggcttgctggggtcctcaggctcaggctctctcacagactgcaatca

SEQ ID NO: 7537 - DNA, 77 bp, Homo sapiens
gggctgggattctgtcctcacactctcggacagtctgctctgggctgcctggggtagtcttaggtcgggtccagccc

SEQ ID NO: 7538 - DNA, 82 bp, Homo sapiens
acctgagcttcctctgtgtccggctcctctgctaacctgtggcagcatgggcagaaacaacacactgaggtcacggccaggt

SEQ ID NO: 7539 - DNA, 82 bp, Homo sapiens
taacatgaggctgtggagggtggagatgatgtactatgggggaaggtgtgttagtctgtgcttcttctatgtgtcttggtta

SEQ ID NO: 7540 - DNA, 134 bp, Homo sapiens
atgtatgtaaatatttaaatatacataaatatatatttatatttatatttatgtatatattgtgatttatatatttatgtacataaatatacatgtatattatgtaattggtatatttatgtgtatttatgtat

SEQ ID NO: 7541 - DNA, 105 bp, Homo sapiens
agagttcagtgacattttcttatggcacctaaatttttatatatgtaacgtaggtgaaaatacagaatttggggaatattacaaagagttgttataatggatttt

SEQ ID NO: 7542 - DNA, 74 bp, Homo sapiens
actggcctaatttcaatatttttatgtcttagggaatagggaggcctgagaagagagagagagagatggtcagt

SEQ ID NO: 7543 - DNA, 110 bp, Homo sapiens
aagtgattctccctcctgagtctctcgaagggattaaaggtgtgagccactctgactgaccactgtgggtttttcatagatgtcctttttcaggttgagaaagttctctt

SEQ ID NO: 7544 - DNA, 111 bp, Homo sapiens
ggattacaggcttgagccactgtgcccggccaaggatgtggtcaatttttatatgtatctttgcgtacttgaaaataaaacatattctctcatcagtggaggctgtacttt

SEQ ID NO: 7545 - DNA, 85 bp, Homo sapiens
gtggggaaaagattgagaggttggatggttgccgtgtctgtgtagaaagaggtagacatgggagacttctcattttgttctgtac

SEQ ID NO: 7546 - DNA, 69 bp, Homo sapiens
tgcagtagctcacacctgtaatctcagtactttggggggctgaggtaggaggatcagttgagcccagca

SEQ ID NO: 7547 - DNA, 68 bp, Homo sapiens
tatgtgtgtgtgatgtcattatgtggtggactcttctgtgtgtgtgtgatgtcattatacagtgcatg

SEQ ID NO: 7548 - DNA, 77 bp, Homo sapiens
tgggggagggaggggaggctcagctggtttattttttatttatttatttttaagacagagtctcactctgtcactca

SEQ ID NO: 7549 - DNA, 118 bp, Homo sapiens
gtatctggggacctgaaatggcctttctacatgaagctgctttctttctttcttttttttttttttaaagagactgggcctctctctgtcacccaggccagagtgcagggatatgatc

SEQ ID NO: 7550 - DNA, 74 bp, Homo sapiens
ggtgtcagctaccgtgcccaccctgtgctttttttttttttttttttaaagaatcagggtctcactctgtcacc

SEQ ID NO: 7551 - DNA, 115 bp, Homo sapiens
tttcactgaaaagaaaaaatatattttggaagttaatgtaaggatacattggctttttttttttttctttacattggctttttaaaagacagtttttatttttcagatactggaa

SEQ ID NO: 7552 - DNA, 99 bp, Homo sapiens
cacaggctccgtgttctgggtggtctcaggagtcttctgccgggcttggagagacttaacagagacagcactgagccccagctcgaacgactgcctgtg

SEQ ID NO: 7553 - DNA, 94 bp, Homo sapiens
caagtgtgtgtatatatatatatagatagatagatagatagatgtatatatctatatatatgtatgtatgtgtgtgcgtgtgtgcacgtgtgtg

SEQ ID NO: 7554 - DNA, 70 bp, Homo sapiens
tgccaaacaatgattgactggagttggtgtatattattaatatatgcatttcagttgcctattgctggta

SEQ ID NO: 7555 - DNA, 75 bp, Homo sapiens
tgagtctcactctgtcacccaggctggagtatataactcactgcagcttcgggctcctgggctcaagtgatcctc

SEQ ID NO: 7556 - DNA, 119 bp, Homo sapiens
gggatgggagaggctttgagaaggtgtgcattaacttttgttgttgttgttgtttgagacagggtctcactctgtcaccctggctggagtgcagtggtgtaatcacagctcactgcaac

SEQ ID NO: 7557 - DNA, 96 bp, Homo sapiens
ggaaatgcttccccaggtgcagtggctcatgcctgaaatcccagtatattgggagggtgaggtaggaggatcacttgaggccaggagtttgagacc

SEQ ID NO: 7558 - DNA, 109 bp, Homo sapiens
aaatgtttaataaaaattatgcaggaaggaacagaagacagagcaccgctcagccccagctcacagtcaggctctctcattataaattacctagcttttatgtgcattt

SEQ ID NO: 7559 - DNA, 58 bp, Homo sapiens; identical to SEQ ID NO: 1065

SEQ ID NO: 7560 - DNA, 81 bp, Homo sapiens
tgagtgtattccttgtctctgcgtgtgtgtcctgtgtgacgccctcacacactcccacacagggaggacgtgggacaccca

SEQ ID NO: 7561 - DNA, 156 bp, Homo sapiens
tgtcctctctgcgtgtgtgtgtcccgtgtcctctctgcatgtgtgagtgtcccatgtcctctctgtttgtgtctgagagtgtcatgtctacgagtgtgagagggtgctgtgtcctctctgtgtgtgtgagagtgttttgtgtcctctcggtgtgtg

SEQ ID NO: 7562 - DNA, 58 bp, Homo sapiens
tgagccggagtctcgctctgtcacccaggctggagtgcagtggtgtgacctcggctca

SEQ ID NO: 7563 - DNA, 77 bp, Homo sapiens
atacagtatatttgtatatgtgtgtatatatatacacacacatatatatttatatacattcatatatacatgtatac

SEQ ID NO: 7564 - DNA, 65 bp, Homo sapiens
gcctgggtgagtcagtccctgtctcagggggcggggagaagcttattatctaccatataccaggt

SEQ ID NO: 7565 - DNA, 58 bp, Homo sapiens; identical to SEQ ID NO: 605

SEQ ID NO: 7566 - DNA, 99 bp, Homo sapiens
tcatttcttactactgtctcagatcttttgtccaatttatttcattttagttaggatgggttggagaaatggaagaacctcagacatggagtctgttga

SEQ ID NO: 7567 - DNA, 111 bp, Homo sapiens
gggtagtattattacaggggttagtgcaagataccgttagattattgactttatgttcttctgtaattggtttaatttctgcaagagcttcaggtttagggggtattatct

SEQ ID NO: 7568 - DNA, 58 bp, Homo sapiens
tgagacagggtctcactctgtcacccgggttggaatgcagtggtgtgaccttggctca

SEQ ID NO: 7569 - DNA, 62 bp, Homo sapiens
tgagacagagtctcactccctctgtcacccaggctggagtgcagtggtgcgatctcggctca

SEQ ID NO: 7570 - DNA, 64 bp, Homo sapiens
atatatatgtgtgtatatatatatgtgtgtgtgtgtgtatgtgtgtgtgtatatatatatatat

SEQ ID NO: 7571 - DNA, 79 bp, Homo sapiens
cacatgtgtgcatgtgtgagtgggtgtgcatgcgtgtgtgagtggatgcatgtgtgcgtgtgtgagtgggtgcatgtgt

SEQ ID NO: 7572 - DNA, 64 bp, Homo sapiens
gactgaagaatcagagcagagcctggggccaggctgtcctggtagggttgcttccttctttgtt

SEQ ID NO: 7573 - DNA, 81 bp, Homo sapiens
caaaggctgggtctttctctgtctctccctagcttttccagagttgtaggttaaatgtaggggctcaggttccagcctctg

SEQ ID NO: 7574 - DNA, 115 bp, Homo sapiens
tctgtgctcccaacatgccctagtgggtggcgtatggatgggggagcctgggacaatgtgtgtccatctcacacactctctacttcccatgccagtggggaaagtgggggcagga

SEQ ID NO: 7575 - DNA, 72 bp, Homo sapiens
ccaggtatggtcttgcacgcctgtagttccaggtacttgggaggctgaggtacaaggatcaatgagcctagg

SEQ ID NO: 7576 - DNA, 117 bp, Homo sapiens
ctgagagtaagagggcgggagggagctctgcctcaggctaagagaggatgagccctcattgcctgtctctctcaccctatcctgaacctgggtccctgtccaccagcaagctcttag

SEQ ID NO: 7577 - DNA, 86 bp, Homo sapiens
ttgttttgaaacagggtctcactctgtcacccaggctggagtacagaggcacgatcttggctcactgcaacctccacctcctgggt

SEQ ID NO: 7578 - DNA, 70 bp, Homo sapiens
gcaaataaaatgtggaagtgacaggccagtccccaccctcaggctctgtctgactccacagtcagaatgc

SEQ ID NO: 7579 - DNA, 93 bp, Homo sapiens
gtttgttttgttttttgagacaaggtctcactctgtcacccaggctggggtgcagtggtgtgatctcagctcactgcaacctttgcctctcag

SEQ ID NO: 7580 - DNA, 106 bp, Homo sapiens
gaagcagattgccagggtttttctgcctgcagactcagccatctgtgcccctctccctctgacactgatggtctctaactcaggtatagagatccttaaagccttc

SEQ ID NO: 7581 - DNA, 81 bp, Homo sapiens
ttgtatgataataagtttctgttgctggaagtcactcactctgtttgtggtaattatagcagcaacaggaagctaatacaa

SEQ ID NO: 7582 - DNA, 99 bp, Homo sapiens
cagagagctcgctttctctctcaggcacaggaacagaagaaaggccgtgtgaggacacagtgagaaggcagctattgaccagccgggaggagagagctc

SEQ ID NO: 7583 - DNA, 61 bp, Homo sapiens
gagagaattacgccatggagagattccgacgcctgtctgagactctctctcatggactctc

SEQ ID NO: 7584 - DNA, 77 bp, Homo sapiens
gccagggtctcactctgtctcccaggctggagtgcagcctcccaaagtgctggggttacaggcgtgagccaccctgc

SEQ ID NO: 7585 - DNA, 58 bp, Homo sapiens
tgagacagagtctcactctgtcgcccatgctggagtgcagtggtgcgatcttggctca

SEQ ID NO: 7586 - DNA, 71 bp, Homo sapiens
gagcctccctgtcaccatccctcagggctgattcctccctggccagctcacaggctggtttcaggagcctc

SEQ ID NO: 7587 - DNA, 87 bp, Homo sapiens
ggtcatgggcctcccccagagaaccgacttgctctttcttttttcttttttctttttgagacagagtctcgctctgtcgcccaggct

SEQ ID NO: 7588 - DNA, 63 bp, Homo sapiens
tgggctctgctctctgagtctgtgtccatcttccctgggctctgctctctgagtctgtgtcca

SEQ ID NO: 7589 - DNA, 149 bp, Homo sapiens
gtgtccatcttccctgggctctgctctctctgagcctgtgtccatcttccctgggctctggtctctgagtctgtgtccatcttccctgggctctcctctctgagtctgtgtccatcttccctgggctctgctctctgagtctgtgtcca

SEQ ID NO: 7590 - DNA, 63 bp, Homo sapiens; identical to SEQ ID NO: 7588

SEQ ID NO: 7591 - DNA, 63 bp, Homo sapiens; identical to SEQ ID NO: 7588

SEQ ID NO: 7592 - DNA, 63 bp, Homo sapiens; identical to SEQ ID NO: 7588

SEQ ID NO: 7593 - DNA, 72 bp, Homo sapiens
ctatctctgtctctgtcttactggaagcttaactctgcccaagtgaggctttattgaacaggatagtggtag

SEQ ID NO: 7594 - DNA, 75 bp, Homo sapiens
ttcggaaaggctccactacacatttgatttttaatttatgcaagcacagattatgtggtgggttccgtctctgaa

SEQ ID NO: 7595 - DNA, 72 bp, Homo sapiens
ctttctgtttaatgtatgtatgtatacatgtatgtacgtatgtgtgtatatatgcatttatttatttatgag

SEQ ID NO: 7596 - DNA, 91 bp, Homo sapiens
ctcagggctcagtgcacaatagcttctcagtacctatatatttattgaatgaatgaatgaatgaatgggagaggttaaactagggtttggg

SEQ ID NO: 7597 - DNA, 67 bp, Homo sapiens
cctgctgtctgtctgtgagtcctccctgagcaggagtcctgtctttggggctgcaggtagaagcagg

SEQ ID NO: 7598 - DNA, 82 bp, Homo sapiens
cagagaaagtggcaaccaaagcatgagcacagttaaacatacttctgatgcacactggcctcactgtctcttggtctctctg

SEQ ID NO: 7599 - DNA, 68 bp, Homo sapiens
gagagggctgaactcgttgatctcattttttttttttttttttttttgagacagagtctcaccctgtc

SEQ ID NO: 7600 - DNA, 115 bp, Homo sapiens
ctgggcgacaagagtgagactccgtctcaaaaaaaaaaaaaggtgtactatattttgataattttctttgttttgtgtttttttttttttgagatggagtctcactgtcacccag

SEQ ID NO: 7601 - DNA, 101 bp, Homo sapiens
ggcatgagccaccgctcggccacctctggagttctgattgttcccacagaagagacagatctgacaagtggggctccaaggtcatggctggtggctatgct

SEQ ID NO: 7602 - DNA, 103 bp, Homo sapiens
ggctaaggtgggaggctgcagacagtgaagtctctgagggcatgctgccagccctggaggagacttccttctctggtccagcagaatcataggcaccagggct

SEQ ID NO: 7603 - DNA, 83 bp, Homo sapiens
ggaggacatgtaagtagagaaaggcgaggcactgggaagaagtggatcctgtccctacacagtctctgagtcacaggaacccc

SEQ ID NO: 7604 - DNA, 111 bp, Homo sapiens
gatcacaccactgcactccagcctgggcaacagagcaagaccccatctcttttttttttttttgagacagtctctcactctgttgccaggctggagtgcagtggcacgatc

SEQ ID NO: 7605 - DNA, 104 bp, Homo sapiens
ggactacaggaccccatgctctgacttatttttagattttagaagaaaggagacacttttttttttttttttttttttttgagacagagtctcttctgttaccc

SEQ ID NO: 7606 - DNA, 68 bp, Homo sapiens
tcttacctggataactgaaactgtcttttttttttttgagacagtttcacactgtcacccaggctgga

SEQ ID NO: 7607 - DNA, 89 bp, Homo sapiens
ggcagggtaagagaacaaggagaaaagtggtagtcaccttgaactgacagtacacctcccactactgtttttcttcatgtagcctttcc

SEQ ID NO: 7608 - DNA, 58 bp, Homo sapiens
tgagatggagtctcactctgtcacccaggttggagtgcagtggtatgatctcagctca

SEQ ID NO: 7609 - DNA, 58 bp, Homo sapiens
tgagacagtgtctccctctgtcacccaggctggagtgcagtggcctgatcctggctca

SEQ ID NO: 7610 - DNA, 106 bp, Homo sapiens
gatacagcaaagccttgccttaccgataaaagtcactctctgggtcactgtgccggatctggaatggtgcattgggattcttacaatctaaaggcaggaggtcatc

SEQ ID NO: 7611 - DNA, 82 bp, Homo sapiens
gctgcaatacatatgtgtgtatatatgtgtacatatatattaaaatgtacatatatattttaatatgtatatgtaatgtgac

SEQ ID NO: 7612 - DNA, 80 bp, Homo sapiens
actgctgggtgcagtgacttatacctgtaatcccagcactttgggaggctgaggtaggaggatcacttcagcccaggagt

SEQ ID NO: 7613 - DNA, 120 bp, Homo sapiens
ctcctgagtagctgggaccacaggtgtgcaccaccacacccagctaatctttttatattttgtagagatgaggttggccaggcacggcggctcacgtctgtaatcccagcacactgggag

SEQ ID NO: 7614 - DNA, 58 bp, Homo sapiens
tgagactgagtctcactctgtcgcccaggctggagtgcagtggcgcgatctcagctca

SEQ ID NO: 7615 - DNA, 123 bp, Homo sapiens
tttttagaactctctttgtttttggactctgggaaaatcttatttctattttttagatatattaatagtaataaggcttctgttttatcccagagttctgagtatcttgtagaaggagagttt

SEQ ID NO: 7616 - DNA, 93 bp, Homo sapiens
tctctgtgtttcattcactgatttttttcatttagataagatttatcaagcattgctctaggtgttaggattataggactgacgagacagaga

SEQ ID NO: 7617 - DNA, 98 bp, Homo sapiens
gtgagccaagatcacatatgtgtgtgtatatatatgtgtatgttatatatatacatatatacatacatatatatgtgttttttaaaaaaaaaactcat

SEQ ID NO: 7618 - DNA, 91 bp, Homo sapiens
ctaaaatctggaacaaggcaagaatatctaatcttaaaacttttttttttattttttgaggtggagtctcactctgtcatccaggctggag

SEQ ID NO: 7619 - DNA, 127 bp, Homo sapiens
atatacatatatacatatatatgtgtgtgtatatataaacatatataagtttatgcatatatgtatatgtatatatgttatatatatacatttataaacatttatatgtatatatataaaatatata

SEQ ID NO: 7620 - DNA, 114 bp, Homo sapiens
atacatataaatgtttataaatgtatatatataacatatatacatatacatatatgcataaacttatatatgtttatatatacacacacatatatatgtatatatgtatattta

SEQ ID NO: 7621 - DNA, 94 bp, Homo sapiens
caattaaagaaccacaagtacaaatacagcacagagggaggccagccaaatctttttgtttgtttgttttttatctgttgttttttgttttttg

SEQ ID NO: 7622 - DNA, 79 bp, Homo sapiens
tggaaaaattctgactaatgtattatatctgtgctctgctaacttgtctgaggacacagaagactgtcagaataatcta

SEQ ID NO: 7623 - DNA, 91 bp, Homo sapiens
acaaaggagaagagatgcgtatttacagatataagaacatgcagggcatcctcccagctctttctgtctgtgcttcatctttctcctttgt

SEQ ID NO: 7624 - DNA, 118 bp, Homo sapiens
tttgagttgtgctagttaaacatatacttgcagctgagcaaacggagggtaaagattgtgataataaagaactatctacttctacagctgttgaggtagtttttaaaaagaactcaaa

SEQ ID NO: 7625 - DNA, 75 bp, Homo sapiens
tgagctcagtgtcccattgatgtaggcaggagattgttttttggttttttgtgttttttttgagacagagtctca

SEQ ID NO: 7626 - DNA, 78 bp, Homo sapiens
ctgagtgacagagtaagaccctcctcaaaaaaaaaaaaaaaaaaaaaaaaaaagacagggtctcactctgtcacccag

SEQ ID NO: 7627 - DNA, 62 bp, Homo sapiens
gccaggtgtgatgcttgtagtcccagctacttaggacgctgaggtaggaggatcacttgagc

SEQ ID NO: 7628 - DNA, 72 bp, Homo sapiens
tctggggtgtgtgtactacattttggaggccactgtgctagcttcttcatgtttaattatatatactaaaga

SEQ ID NO: 7629 - DNA, 58 bp, Homo sapiens; identical to SEQ ID NO: 1265

SEQ ID NO: 7630 - DNA, 77 bp, Homo sapiens
atctcactaattctctctctgagtgaagaacgaccattagctccattttagggacagaaatttaggcttagtgagat

SEQ ID NO: 7631 - DNA, 120 bp, Homo sapiens
ataaagaaaatgtggcatatatacatatatatgtatatatataaatactttatatatgtgtatatataaatactttatatatgtgtatatgtaaatactttatatatgtgtatatgtaaa

SEQ ID NO: 7632 - DNA, 64 bp, Homo sapiens
ggaacgtgggaagctactggatggggcagcctgtctggctcagtcacagcttctaccaacctcc

SEQ ID NO: 7633 - DNA, 63 bp, Homo sapiens
cagtatggtagcttatgcctataatcccagcactatgggaggctgaggtaggaggatcatttg

SEQ ID NO: 7634 - DNA, 81 bp, Homo sapiens
attcaaccaatatgtctctccctctcattcactggcttgctcactccctacagtgcaggaggggacggctccctggagaat

SEQ ID NO: 7635 - DNA, 78 bp, Homo sapiens
cgccctgggtgactctctgactgtgagtagtgagccatgaaccaggatgggcagctcagagtccagccaggccctgcg

SEQ ID NO: 7636 - DNA, 106 bp, Homo sapiens
cctaggattaataatagaagtatgatggctcacgcctgtaatcctcaactttggaaggctgaggtaggaggatcacttgagcccaggagtctgagaccatcctggg

SEQ ID NO: 7637 - DNA, 74 bp, Homo sapiens
gttgtttttcgagacagaatctcactctgtcacccaggctggagtgcagtggtgcgatctctgctcactgcaac

SEQ ID NO: 7638 - DNA, 75 bp, Homo sapiens
ctgggaggcagagatctgtgtttctaaaatttttttttttttttttttgagatggagtctcgctctgtcgcccag

SEQ ID NO: 7639 - DNA, 58 bp, Homo sapiens
tgagacagggtctcactctgtcacccaggctggagtgcagcagcatgatcttggctca

SEQ ID NO: 7640 - DNA, 96 bp, Homo sapiens
ggactgttttggtgagaaatgaagcaaagttcaaagaggagagaaaatcttttttttttttttttttttttttttttttttttggcaacagagtct

SEQ ID NO: 7641 - DNA, 58 bp, Homo sapiens; identical to SEQ ID NO: 1673

SEQ ID NO: 7642 - DNA, 124 bp, Homo sapiens
aacaccaggtgagcctcggatgatcactttttggaattcagtggataatcagggcagtctgtttctctcactgggatacatgttggggtcaggaaaatagagaagccattcagtgttgatgaat

SEQ ID NO: 7643 - DNA, 58 bp, Homo sapiens; identical to SEQ ID NO: 1391

SEQ ID NO: 7644 - DNA, 56 bp, Homo sapiens; identical to SEQ ID NO: 1392

SEQ ID NO: 7645 - DNA, 89 bp, Homo sapiens
ggagcgagtgtgcaggaacagagatgatattttgacttggctggtttatttttttttaattttttttttctggaacagagtctcgctct

SEQ ID NO: 7646 - DNA, 75 bp, Homo sapiens
tgagcagtcccacctgaagccacttacttgtgagctagacctcaaaggccgctcacactgtgtgtctcctgctca

SEQ ID NO: 7647 - DNA, 138 bp, Homo sapiens
atatacatacgtatatatgtatatatatacgtatatatatacgtatatatgtatatatatacgtatatatatgtatatacatgtatacatatatatgtgtgtatatacatatatacgtatatatatgtgtgtgtatat

SEQ ID NO: 7648 - DNA, 77 bp, Homo sapiens
gcgacaggatgacaggaagagcacagtcactttgactcaccggtggatgaagtggttttcctccaaatactgacagc

SEQ ID NO: 7649 - DNA, 93 bp, Homo sapiens
tgagtatatttctgttcagcctgtgagccaaggtgagctgacctgcaggtcacagagaactcagtgtggtcccaaccagctcttactgctggc

SEQ ID NO: 7650 - DNA, 93 bp, Homo sapiens
ggtgaaattgggctgatgtatcagtaagagaagagttctaccctttcctggacagacagactctatatctctctggatctcagtctgctcatc

SEQ ID NO: 7651 - DNA, 114 bp, Homo sapiens
ctttattagcagcatgagaatggactaatacatatatgaatacatattctctctctctctctatatatatatatgaatacatatatgtgtgtgtgtgtattcttctcaatagag

SEQ ID NO: 7652 - DNA, 60 bp, Homo sapiens
gagtggatgagcaaatgcatgtctacctggggtggtagtcattgctctctgcttctattc

SEQ ID NO: 7653 - DNA, 60 bp, Homo sapiens
gtgagacagtgtctcactctgttgcccaggcttgggtgcagtagtgcaaactcagcttac

SEQ ID NO: 7654 - DNA, 170 bp, Homo sapiens
atggaggactggataagaaaatatatatatatatatatatatatatatatatatatatatatatatacacacacacacatatatgtacttttttatggctaagtagtatttcatcatgtatatatatatatatatatatatatatatatatatgcattttttcttatcca

SEQ ID NO: 7655 - DNA, 118 bp, Homo sapiens
ccagccagccccacttctgctttcctccctgcgtctgactggcctctgctcttgactgctgtgtgaagtgagtgggcagattgactgacaacagcaagaagtgtcaactcatccctgg

SEQ ID NO: 7656 - DNA, 95 bp, Homo sapiens; identical to SEQ ID NO: 68

SEQ ID NO: 7657 - DNA, 93 bp, Homo sapiens; identical to SEQ ID NO: 69

SEQ ID NO: 7658 - DNA, 79 bp, Homo sapiens
caaaagggttctgtgcacaaaggagtttgggaaatgtttcattttatattccactcttgaagagccacaactcttattg

SEQ ID NO: 7659 - DNA, 72 bp, Homo sapiens
tatgtatacctatatgtgaatatatatgtatgcctatatatgcatatatatgtacacatatgaatatatatg

SEQ ID NO: 7660 - DNA, 91 bp, Homo sapiens
ttttggatttcagatttttagatttgggatgttcaaccagtaaatataggttaatattctaaaatttttttttaaaaatcaaaatccaaaa

SEQ ID NO: 7661 - DNA, 90 bp, Homo sapiens
gccaccatgcctggccactttgtctctatttctgtctctgaaacatgtgtgacaacttcttggaaaggaatcttgatgccaggctttggc

SEQ ID NO: 7662 - DNA, 85 bp, Homo sapiens
tggagcaggcctgtattgaacactgtctgatttggtaacataccctgtgactctcagacaggcacacagagtatgcaggcatcca

SEQ ID NO: 7663 - DNA, 64 bp, Homo sapiens
caggagatctggttgtttgaaggtgtgtggcacttcccccttcgctctatctctctgtctcctg

SEQ ID NO: 7664 - DNA, 101 bp, Homo sapiens
caggttttttgttgttgttgcttattttgatttgcctgtttttctttttttaaagaagagctgaataggtgagagttgagtctgagacaggagagaaactg

SEQ ID NO: 7665 - DNA, 95 bp, Homo sapiens; identical to SEQ ID NO: 68

SEQ ID NO: 7666 - DNA, 93 bp, Homo sapiens; identical to SEQ ID NO: 69

SEQ ID NO: 7667 - DNA, 65 bp, Homo sapiens
tgccaggccagatggcgccaggcacattatacagatgagtggcagcagtccaggtgtgccaggca

SEQ ID NO: 7668 - DNA, 105 bp, Homo sapiens
gtatgatgatttcatatgatgaaactttattgaatttgtttattatttctaacagttcgttggtggaatctttagggttttcatatgtcagatgatgtcatctgc

SEQ ID NO: 7669 - DNA, 58 bp, Homo sapiens; identical to SEQ ID NO: 1435

SEQ ID NO: 7670 - DNA, 81 bp, Homo sapiens
ttttgaggcagggtctcactctgtcactcaggctggagtacagcaacgtgatctcagctcagtgcagccttgacctcttga

SEQ ID NO: 7671 - DNA, 57 bp, Homo sapiens
tgagatggagtctcactcactctgtcgcccagctggagtgcagtggcgcttggctca

SEQ ID NO: 7672 - DNA, 112 bp, Homo sapiens
ctgttttggtttctctggttctgtcatttaaagaaacattcagggtccctctgtgccagtggggactagagtacaggagaggagggaagaggtttgccagagaggtctgcag

SEQ ID NO: 7673 - DNA, 66 bp, Homo sapiens
gagcttcgtgacctgtagtgggcttccctccatcggggtccctctcacccactctcagagctcatg

SEQ ID NO: 7674 - DNA, 72 bp, Homo sapiens
tatctatatatatagatgtgttatatatagatgtgtatatatatctatatatagatgtgttatatatagatg

SEQ ID NO: 7675 - DNA, 140 bp, Homo sapiens
ctttataaatatgtatgtataaataatatatgtatatgtatgtatatatgtatatacacacatagaatacatacgtgtatatatatacatatatgtatattcagctttatggatatgtgtgtatgtatacatatatgtat

SEQ ID NO: 7676 - DNA, 116 bp, Homo sapiens
cacatctgtatgtcataggaagatagtaggcatggtggtagtaagacagtaagaacacaggctggaaacacaatgctaattgtgtgatatggacaaattacttaaacttcaatgtg

SEQ ID NO: 7677 - DNA, 78 bp, Homo sapiens
ggacacagaaaacacaagtacatggagaagagtatatatttatattctgtatatgtgtatgtgtgtgtgtctgtgttt

SEQ ID NO: 7678 - DNA, 86 bp, Homo sapiens
agctctgcgtgactaagattcctttaattgtgtgtatgtgcatgtgtatgtgtgtatacacacatcttcacaaccaaagtttccag

SEQ ID NO: 7679 - DNA, 100 bp, Homo sapiens
gagtgtgaagtgatatctcactgtggttttgatttgcattttcatgatgactaatgattttgagcatcttttcagtgcttgtgggttattttatatcttc

SEQ ID NO: 7680 - DNA, 100 bp, Homo sapiens
gctggtgggaatgtaaaatggtgtagctgctttggaaaacagtttggtggttcctcaaaaatttacaaatagaatttccgtatgatccagcagttccact

SEQ ID NO: 7681 - DNA, 81 bp, Homo sapiens
ctgcctcataggttgtgattaggattagatgagatcacaaaaggtgagattatgaaaacaagattgtagttatgagagtag

SEQ ID NO: 7682 - DNA, 151 bp, Homo sapiens
atacatatatatgagtatgtatatgctcatatatgtgtgtatatatgtgagtatatatatatgtgtgtgtatatatataaattccatttcctttaatacatatatgattatatatatgctcatatatgtgtatgtatatatgtgtgtatat

SEQ ID NO: 7683 - DNA, 92 bp, Homo sapiens
ccagcctgagcaatatagtgaaaccttgtctctacaaagaattttttttcttttttttcagagacagggtctcgctctgttatctagactgg

SEQ ID NO: 7684 - DNA, 75 bp, Homo sapiens
tagggagtattgaagtacaagttcctagagtggagagacttcacatctgtttatcttgctctgaattacatccta

SEQ ID NO: 7685 - DNA, 116 bp, Homo sapiens
tccagctttgtactttttgcttaggattgatttggctatatgggctcctttttggttccatatgaaatgtaaagtagttttttctaattctgtgaagaaaatcaatagtagcttga

SEQ ID NO: 7686 - DNA, 61 bp, Homo sapiens
ctcctcagttttgtgtctgtgactggactttcctgggagccagtgacagctgcgtgggcag

SEQ ID NO: 7687 - DNA, 75 bp, Homo sapiens
gtgctgtccttgtgatgagagtgagctctcgctctgagttcacacaagatctggttgtttaaaagagtgtggcac

SEQ ID NO: 7688 - DNA, 99 bp, Homo sapiens
tggcctctcctctagatggctaatagaaccttagattcccaaggctggaagagactgaggacactggccaggttgtcaagatctgagtcttgttccacc

SEQ ID NO: 7689 - DNA, 110 bp, Homo sapiens
tgcctcggacacttggcaatgtatggatggttttgtggttcgtttgggattatttttttttttgtaatttttttgaaacagggtcttgctctgtcacccagtctggagta

SEQ ID NO: 7690 - DNA, 61 bp, Homo sapiens
ctttagtctctctgtgcctctgtttgcatctgtaaaatgaaggggttgttggaggataaag

SEQ ID NO: 7691 - DNA, 115 bp, Homo sapiens
tcttacggttttccccaaagcactcatcagagggaggcatttttcatctgcctttttacagaagaaacagaggtctcagcattttctgagtgtagcattcacataggccacaaga

SEQ ID NO: 7692 - DNA, 72 bp, Homo sapiens
tcatcacgggctcactatcatgccacacgctgccccttaattgcaatggaaagatgaatgaatctgtgatga

SEQ ID NO: 7693 - DNA, 70 bp, Homo sapiens
caaagatagagacagaagagacagagctaggatgagaacccaggcttcttggctcttctacctctggttg

SEQ ID NO: 7694 - DNA, 61 bp, Homo sapiens
gggtatgtacttttccagaccatggttggacacggtccacacttctctctgggacagtccc

SEQ ID NO: 7695 - DNA, 58 bp, Homo sapiens
tgagacagggtctcactctgtcacccaggctggagtgcagtggtgagatctcggctca

SEQ ID NO: 7696 - DNA, 74 bp, Homo sapiens
gagtaagtgagtgagtgagtgagtgagtgagtgaaagtcaccgtgacgatctctgtagctgacactcacttctt

SEQ ID NO: 7697 - DNA, 109 bp, Homo sapiens
gcctctcaatcaaagaggtgtgagggtttggaagaattgactaattacaaaacatgccctaggctcagtctctctctctccccagctccttccttctttctttcagggc

SEQ ID NO: 7698 - DNA, 109 bp, Homo sapiens
gctgattttcgtgtgttgattttgtatcctgcaactttactgaatttgtttattagtgctaaccagtttttagtggagtctttagggttttatttatataagattatgc

SEQ ID NO: 7699 - DNA, 103 bp, Homo sapiens
ggaagagtacctcaaagtctaagcaatgaagggattttcttgttgatatctgactcagaggtcacctaagtccatttgtatgtgctttattatcatggtatcc

SEQ ID NO: 7700 - DNA, 76 bp, Homo sapiens
gtgtgtctctgtctcagtctctttgtctcttctcctcttctttttaggacacagttatattggattaagggcacac

SEQ ID NO: 7701 - DNA, 96 bp, Homo sapiens
tgaacctatttaaagggtgcaatttggtgtgtgtgtgtgtgtgtgtgtgtatatatatatatatatctaccagtgcagtttggtagatatatttca

SEQ ID NO: 7702 - DNA, 95 bp, Homo sapiens; identical to SEQ ID NO: 68

SEQ ID NO: 7703 - DNA, 93 bp, Homo sapiens; identical to SEQ ID NO: 69

SEQ ID NO: 7704 - DNA, 64 bp, Homo sapiens
tgcagctcctgcttggaatggacagaacagtgtgtggagactcacactgtgagcttttgctgca

SEQ ID NO: 7705 - DNA, 76 bp, Homo sapiens
tccctcccccaagcacacagattctctctctgtgccatgtggccagtgatgggggtcgtgtggtgtaggtgattga

SEQ ID NO: 7706 - DNA, 107 bp, Homo sapiens
cagatgcagaacaagtgtaaaagggaatgctcaggtgtaaaagagcagtgcccacctctgtctctggctctcttcctcctggggtttgcccttacaaattgctcctg

SEQ ID NO: 7707 - DNA, 97 bp, Homo sapiens
agcttgaaaggctagtctcactcacgctgtgcctcacaaaagcactgagtttatttctaggcagctggtgagcagggctgagaacttgccccaggct

SEQ ID NO: 7708 - DNA, 60 bp, Homo sapiens
gcatgtacacacacacacacacacacacacacacgtgtatgtgtgtgtgcatgtgcatgt

SEQ ID NO: 7709 - DNA, 71 bp, Homo sapiens
atacatatgtatgtatatatgtatatgtatatatgtatatatgtgtatgtatatatgtatatgtatatgta

SEQ ID NO: 7710 - DNA, 111 bp, Homo sapiens
ggttgatttgagcatatgtatgctgtgtttgtgaagtagcaggacattacattaaattttttttgttgaagtaaacatatattgaaaaagtatacaaatcaagtatatacc

SEQ ID NO: 7711 - DNA, 115 bp, Homo sapiens
cattgtactcagagggcccatttacactcagtaaattctatgtatttatttgcaaatacatttttgtatgtgagtgttggggggtggggtggggtaggtgggtgtgggtgggtgc

SEQ ID NO: 7712 - DNA, 91 bp, Homo sapiens
agcaggggtggggtggcgggtgtacatgagttggaaaaaaacgaaaaaatacttttttttttagactgggtctcgctctgtcacccatgct

SEQ ID NO: 7713 - DNA, 87 bp, Homo sapiens
cgaaatataaaaaggagagaagccagcagagatgagcccagcatttggagcacttttctttcctttttttttttttttttttttttg

SEQ ID NO: 7714 - DNA, 61 bp, Homo sapiens
cagttcctcagttggaaatgcagaaatcagctgtcttctgtgtcgctcacactgggagctg

SEQ ID NO: 7715 - DNA, 75 bp, Homo sapiens
atatgtaactatatatgtatgtgcatatacatatataactatatacagatagcttatacatatatagttatatat

SEQ ID NO: 7716 - DNA, 115 bp, Homo sapiens
gccccagcaagagcacaagaagattagagaggttctcagctgctagggagtccctgccacactcactctcccaccatactgagaatctccccctgacacagtttccatgccaggc

SEQ ID NO: 7717 - DNA, 72 bp, Homo sapiens
ggccaggcacagtggctcactcctataatccccgtgctttggggggcagaggtaggaggatcacttgaggcc

SEQ ID NO: 7718 - DNA, 96 bp, Homo sapiens
cagctaaggaggacaggttttctttgggggctaacaaaaaatgttctaaaaaaaattttttttttgagacagggtctcactctgtcatccaggctg

SEQ ID NO: 7719 - DNA, 77 bp, Homo sapiens
catttttttcaatatacactcagaaatggaattattagatcatatagtaattctatttttaagttttggaagaactg

SEQ ID NO: 7720 - DNA, 72 bp, Homo sapiens
ctgggcatggtggtacatgcctttagtcccagctacttagaaggctgaggtagaaggatgacttgagcccag

SEQ ID NO: 7721 - DNA, 107 bp, Homo sapiens
tcttgatagttgggattatagacatgcaccaccatcagtgaatttttttatgtttagcataaatgaggttttgccatgttggctcagctggtcttgaatccctgatc

SEQ ID NO: 7722 - DNA, 88 bp, Homo sapiens
tatatatatatatatatatatatatatcatatacgagatatatcatatgagatatatatatatcatatatgatatatatcacatatga

SEQ ID NO: 7723 - DNA, 79 bp, Homo sapiens
atttgttcaatcatagagatggagtctcactctgtcacccaggctgcagtgcaggggcacgatctcaggttcaagggat

SEQ ID NO: 7724 - DNA, 109 bp, Homo sapiens
ccattgttaacattttaatatattctctaagtaaactggagtaactctttctttctttttgttttttgagatggagtcttgctctgtcacttaggttggaatgcagtgg

SEQ ID NO: 7725 - DNA, 117 bp, Homo sapiens
tttgtctgactttggagatttttgtcttaatgctaggaaagtatttaagcagttttactttttgtttttttactgttcattaagataaaaactttatatagttaaaagtttcacaaa

SEQ ID NO: 7726 - DNA, 75 bp, Homo sapiens
acaaaggaatgaatggatgaatgaatatcttgacttccagtctgatgtagttcccattgcatcattctttactgt

SEQ ID NO: 7727 - DNA, 60 bp, Homo sapiens
gacagtgtgagacactgtctcttttttttttttttttttgagacagagtttcactctgtc

SEQ ID NO: 7728 - DNA, 60 bp, Homo sapiens
gaccctgaaagaggaatgaattagctcttcaagggcctgctcagtcctctttctttggtc

SEQ ID NO: 7729 - DNA, 118 bp, Homo sapiens
gtgggaggggtttgggtcatgggggtggacctctgatagcttgatgtgtcctcacagcagtgagtgagttctcacgagatcaggttaagtgtgtggtacctcccctgctccccccgac

SEQ ID NO: 7730 - DNA, 107 bp, Homo sapiens
ctagatcagaaatgctcagggttctaggcattttagattaagtcataatttttcattttgtaacttcttaaattatacttgtcagaaatgtgttagcatttgtttag

SEQ ID NO: 7731 - DNA, 106 bp, Homo sapiens
gtgaggctggctggctgctttaggataaatacttccaggtgagtgtgagcacagatgctgctaggcattgtctgggagtaccctggaaggtcaggcccagcgtctc

SEQ ID NO: 7732 - DNA, 75 bp, Homo sapiens
aggcctcactctgtcgctcaggctagagtgccgtggcatgaccatggctcactgcagccttgacctgctgggctt

SEQ ID NO: 7733 - DNA, 90 bp, Homo sapiens
atttgtgttttaaattgatagctgctatcaatggcatgttaaaaaatactttagtgaatttcatattttgatacagctttcagcacagat

SEQ ID NO: 7734 - DNA, 84 bp, Homo sapiens
cattatttgctttcacactcattgtctcaggagtacagtggagttttccagagaatacataatgtgtgatcttgcagcagattg

SEQ ID NO: 7735 - DNA, 75 bp, Homo sapiens
tctgggactacagttagtgcctggctactttaaaaaaatgttctgtagaggtgtgctctcactctgtctcccagg

SEQ ID NO: 7736 - DNA, 58 bp, Homo sapiens
agttttgagatgatgatgatgatgatgataatcatcatcatcattactgtatatgact

SEQ ID NO: 7737 - DNA, 92 bp, Homo sapiens
acatcctatgttgggtgttctctggtcattggtaaaggatatctcttttttttcccagcttcttttcaaagttcatccgtgttgtagcatgt

SEQ ID NO: 7738 - DNA, 95 bp, Homo sapiens; identical to SEQ ID NO: 68

SEQ ID NO: 7739 - DNA, 93 bp, Homo sapiens; identical to SEQ ID NO: 69

SEQ ID NO: 7740 - DNA, 89 bp, Homo sapiens
gagagcccttcggccctcacagactctgagacttaacatagggagctgcctagagacctcgtgatggaattgctgccgagagggagctc

SEQ ID NO: 7741 - DNA, 117 bp, Homo sapiens
gtatggaatagacgtattttctctaataaagctcctgttggcttttcacagttgattctgaggtcagaattcagggggccatttttgggtgctgttgaggagatagagtgcccaggc

SEQ ID NO: 7742 - DNA, 86 bp, Homo sapiens
ttccatcctttgccaggcaggattccattcttttttttttttttttttttttgagacggagtcttgctctgtcacccaggctggag

SEQ ID NO: 7743 - DNA, 75 bp, Homo sapiens
ggtaagagaatgtgatggctagaaccacagacagattcagaggattcttctgtgaccaggccctgttcctctgcc

SEQ ID NO: 7744 - DNA, 58 bp, Homo sapiens
tgagacagtgtctcactctgtcacccaggctggagtgcagtggtgcgatcttggctca

SEQ ID NO: 7745 - DNA, 85 bp, Homo sapiens
ccacagagagttttttttaaagcacaaaataaggcctagacatgaaggaatttataattaggttgttgagagaagaaactcttgg

SEQ ID NO: 7746 - DNA, 58 bp, Homo sapiens
tgagacagagtctcgctctgtcacccaggccggagtgcagtggtgctatcttgtctca

SEQ ID NO: 7747 - DNA, 106 bp, Homo sapiens
ggatttcctattaaaattgtcaaggtttcatattttaaatgtatcatatcttaggatgtatttatatttagtatttgctttgatctgttttgtagcctcagactcc

SEQ ID NO: 7748 - DNA, 120 bp, Homo sapiens
tttggctttcgagaagacaccactgtgtggggctttagtttcaccccacatgtgattttcttgctgttaaaatgtccatatgtgacgtggaagccccatggttgaagaaaagtggacttc

SEQ ID NO: 7749 - DNA, 84 bp, Homo sapiens
gtgtatatatgtgtgtatatatatgtgtatatgtgtgtatatatatgtgtacatgtgtgtgtatatatatatatatatatatat

SEQ ID NO: 7750 - DNA, 101 bp, Homo sapiens
ctgaggcccacatagaacaaaaaggcagaggaaagagaatgtgctcacttctctcacttttggagctgagacactcttcttctcctgcccttggacatcag

SEQ ID NO: 7751 - DNA, 131 bp, Homo sapiens
atagatctatatctatttagatctatatagatatagatctatgtctatttagatctatatagatatttatactattgacaatagtacatatataatatacagtatatacactattgacaatagtgtatata

SEQ ID NO: 7752 - DNA, 76 bp, Homo sapiens
ggaccaagagtggcagcctctgtgtgcctgtgatttgttaatggaagagatggagctctggagctgagcgtggttc

SEQ ID NO: 7753 - DNA, 101 bp, Homo sapiens
gggcagaggcagccaaatcaagttcagccaagcacatctgcaatatttattgagagaatattgaatgcaaagcaatgctaaatcctgtaagatctttgtcc

SEQ ID NO: 7754 - DNA, 107 bp, Homo sapiens
gctctatgtttattccactgtggtctgagggtatgttggcattatatcaatttttttgcatttattgagacctgcttttcggctgagcatgtggttaatcttagagt

SEQ ID NO: 7755 - DNA, 113 bp, Homo sapiens
tgtcgactatcatatatatgatgtatatatctgtttatacacatgagtatataatatctgtatatatataagtgtgtgtgtatgcatgtgtgtatacatgaaggtgaagtaca

SEQ ID NO: 7756 - DNA, 71 bp, Homo sapiens
gtgtgtgtgtgtgtgtgtgtgtgtgattatcaggctagaggtgactgcacatgctctgtcacttcacccat

SEQ ID NO: 7757 - DNA, 109 bp, Homo sapiens
gtcataagatggcaatataaattcacccttttgtagaagttagctggatttaaattatttctgacaagattgacagctgtctacatggttaaaatttgtttgctctgat

SEQ ID NO: 7758 - DNA, 102 bp, Homo sapiens
tccatgggaaaatgtttttcaaactttttcaagtgtttatttaacataatatatctatttatataaaagtttggaacactgaaattaaacaatgcccttgga

SEQ ID NO: 7759 - DNA, 78 bp, Homo sapiens
gagttttgtaaaattttatttatctttagccttcttagaacttctccttgggagaagatactgaaagttttatatctc

SEQ ID NO: 7760 - DNA, 97 bp, Homo sapiens
cttacatgggtacggccagttgcactgggcagcaggtactggactcatttcacctacagtctgcaacagcaagtggtcttttgagcattcgtgtggg

SEQ ID NO: 7761 - DNA, 95 bp, Homo sapiens; identical to SEQ ID NO: 68

SEQ ID NO: 7762 - DNA, 93 bp, Homo sapiens; identical to SEQ ID NO: 69

SEQ ID NO: 7763 - DNA, 76 bp, Homo sapiens
tatatatttatttctacatatagatttttatatatttaatatgtttatagttttctatatgttatgtagatatata

SEQ ID NO: 7764 - DNA, 100 bp, Homo sapiens
ctcagccagcaagcatttgataggtgtagacagttcagcttctcagtacccaaataagagagagaggagacagtcattcctacagataatggttggtgag

SEQ ID NO: 7765 - DNA, 90 bp, Homo sapiens
gaatcatcttaccaatttgtacaaagaagtcatttagaattctgatagggattatgctgattttgtagatcaattggtgagtattgtctc

SEQ ID NO: 7766 - DNA, 109 bp, Homo sapiens
ctgcctgcgtgtgtacgtgcatgcacatgtgtgtatgtctgtatatctgtatacatagtaggtatatatatatatatatgcgtgtctatatatgtgtatacgtagtaag

SEQ ID NO: 7767 - DNA, 183 bp, Homo sapiens
atgtgtatatgtatacatatcgtgtctgtgtatgtatgtctatatatacacacatcgtgtgtgtatatatatgtatatacacattgtgtgtgtgtatatatatacacattgtgtgtgtgtatatatgtgtatatatatatacacattgtgtgtgtgtatatatgtgtatatatatacacattg

SEQ ID NO: 7768 - DNA, 126 bp, Homo sapiens
acacacacacacaatgtgtatgtagacccacacacacacagtgtgtatgtagacccacacacacacagtgtgtatgtagacccacacacacacacacacagtgtgtatgtagacccacacacacac

SEQ ID NO: 7769 - DNA, 160 bp, Homo sapiens
acacacagtgtgtatgtagacacacacacacacagtgtgtatgtagacacacacacacacagtgtgtatgtagacacacacacacacacagtatgtagacacacacatacacactgtgtgtatgtagacacacatacacactgtgtgtatgtagacacac

SEQ ID NO: 7770 - DNA, 90 bp, Homo sapiens
gtgtgtatgtagacacacacatacacacacagtgtgtatgtagacacacacatacacacacagtgtgtatgtagacacatatatacacac

SEQ ID NO: 7771 - DNA, 116 bp, Homo sapiens
tcatgtattttatattgcaggtctggaggcggttgtgtgtaaaactttattaatattaattatactagctattttgtttatgactgtcctgtcaaagcagttaatttgatgtatgg

SEQ ID NO: 7772 - DNA, 117 bp, Homo sapiens
tgtataggaaaaaacattatatatatgtgtgtatatatatatgtgtgtgtatatatatatttacatatatatacacatatatatattcacatatatatgtacacatatctatataat

SEQ ID NO: 7773 - DNA, 68 bp, Homo sapiens
tccttatggcagacaggactggctggtgtaggtggcattcacacacactgacagtcccttatgatgga

SEQ ID NO: 7774 - DNA, 89 bp, Homo sapiens
gtttcttaaagtgctgggattacaagtatgagcctctgtgcctggcctcttcttgtatatatatatttttttcttttattttctgagac

SEQ ID NO: 7775 - DNA, 116 bp, Homo sapiens
cactgttaataagtttctacgtattttagatctgtagctgcactgaagaatgtgaactgtttttatgtctctacatttgcagtacaaattttactagctggcaactcaaaacaatg

SEQ ID NO: 7776 - DNA, 83 bp, Homo sapiens
tatagatatatgctatgtatacatatatgttatatatagatatataactatatatacatatatactatatatacatgtctata

SEQ ID NO: 7777 - DNA, 96 bp, Homo sapiens
tacagaatatgcagtatttgctgaatatattgcaatgagaaactttcctttatagaatattttttaaatgtaatgttctgcagagcataatttgtg

SEQ ID NO: 7778 - DNA, 118 bp, Homo sapiens
ttaaaggagaaagtattataactttataaatggttgcatatgtaatatgcaatatataatatataattatattatatatgcaaccacatatataaagttataatattttctcctttaa

SEQ ID NO: 7779 - DNA, 115 bp, Homo sapiens
gtaggcaattaaaatagtgtttttacatatgtcatatatatgtataaacatatgtgacacacacactcatatatgatacatatatatatatatagtttcaaccaactagctttac

SEQ ID NO: 7780 - DNA, 95 bp, Homo sapiens; identical to SEQ ID NO: 68

SEQ ID NO: 7781 - DNA, 93 bp, Homo sapiens; identical to SEQ ID NO: 69

SEQ ID NO: 7782 - DNA, 115 bp, Homo sapiens
atgggctcttttctggttccatatgaaatttaaagtagtttttttctaattctgtgaagaaagtcaatggcagctttatggaatgtggggcttaaaacctagatgacaggttcat

SEQ ID NO: 7783 - DNA, 58 bp, Homo sapiens
atatatgtgtgtctgtgtgtgtatatatatatatatacatatacatatacacatatat

SEQ ID NO: 7784 - DNA, 80 bp, Homo sapiens
tatgtgtatatatatgtatgtatgtgtatatatgtatgtgtatatatgtgtgtgtgtatatataggtatgtgtatatatg

SEQ ID NO: 7785 - DNA, 85 bp, Homo sapiens
gagtgcatctctgtgtgtgggtgcatctgtgttcatgtgtctctctttctctgtgtatctgtgcatgtgcatctgtgtgtgcctc

SEQ ID NO: 7786 - DNA, 116 bp, Homo sapiens
cagtataatgtaagtacattggccatgatgtatatctatacatttaatctactacagaaaatactgagagtttaagttaggagttgaaatgcagctggcacttgcttgccaaactg

SEQ ID NO: 7787 - DNA, 104 bp, Homo sapiens
tggctatttgggctcttttttggttccatatgaaatttaaagtagttttttctaattatatgaagaaagtcaatggtagcttaatgggtacagcattgaagcca

SEQ ID NO: 7788 - DNA, 99 bp, Homo sapiens
gtaaaactagtttaaaaagcatagtatataagtatatatacataaatatgtatatgtgtgtgtatatatatatatattctgtatatattctgttttcac

SEQ ID NO: 7789 - DNA, 99 bp, Homo sapiens
taaaagaaatttctaccatcttttagtattggtgattacgttttcaatatgcctggtttactaattattttttattaaatgtggtttgattttcttttg

SEQ ID NO: 7790 - DNA, 116 bp, Homo sapiens
cagtgagatccaatcccccggctgactgattctgaagcaggggctctgttgtgtgtcacttacactcactgaaccttagctgctttatctacaaaagagggagatattggaggctg

SEQ ID NO: 7791 - DNA, 72 bp, Homo sapiens
gaattgccataactggaagtcttttttgaactatatttgtagttcaattgggattactcaatcagcaagctc

SEQ ID NO: 7792 - DNA, 76 bp, Homo sapiens
ggtgacctgaggtttgtcagtgtgactctgggactcaagtggtttgagaccagcctggccaatatggtgaaacacc

SEQ ID NO: 7793 - DNA, 109 bp, Homo sapiens
caagagtatatgtatgtatcactcttgcatatgtagctacagacaagagtatatgtatgtatatatgtatgtatatacactcttgtatatgtaaggatatatactcttg

SEQ ID NO: 7794 - DNA, 118 bp, Homo sapiens
tctatttgtagatatgtatacccacctatatatgtctatatatagatatgtatacccacctatatatatatctatatatagatatgtatacccacctatatatatatctatatataga

SEQ ID NO: 7795 - DNA, 122 bp, Homo sapiens
tctatatatagacatatataggtggttatacatatctatatatagacatatattggtgggtatatatatctatatatagacatatataggtgggtatatatatctatatatagacatatata

SEQ ID NO: 7796 - DNA, 200 bp, Homo sapiens
tataggtgggtatatatatctatatatagatagatataggtgggtatatatatctatatatagatatatatacctatatatagatatatagatatatacctatatataaataggtaggtatatatatatctatatatagatacataggtatagatatcttagatatatctatctatcgatacataggtatatatctatat

SEQ ID NO: 7797 - DNA, 230 bp, Homo sapiens
atatctatctatagatacatgggtatatatctatatctatctatagatatatgggtatatatctatatctatagatagatatatgggtatatatctatatctatctatagatagatataggtaggtatatatatctatatatagatacataggtatatatatatctatatatagatacataggtatatatatatctatatatagatacataggtatatatatatctatat

SEQ ID NO: 7798 - DNA, 80 bp, Homo sapiens
ctatgtatctatatatagatatatatatctacctatatatatctatatataggtagatatctatatatagatatagatag

SEQ ID NO: 7799 - DNA, 96 bp, Homo sapiens
tcacagttgagtagagaggatatgaaatgagagtcattaagggggtacctggggaatctagcttccttgataatcagtctcctgttgagatggtga

SEQ ID NO: 7800 - DNA, 121 bp, Homo sapiens
gtatatatatgtgtatatatatgtgtatatatgtgtatatatgtatatatgtgtatatgtgtatatatatgtatatatgtatatatatatgtgtgtgtgtgtatatatatatatatatata

SEQ ID NO: 7801 - DNA, 88 bp, Homo sapiens
caggttaaggaagttcctttctattcctaagtgatgcagtatttttattgatgaaatggtgatggattttggcaaatgcttttttctg

SEQ ID NO: 7802 - DNA, 112 bp, Homo sapiens
aatagcactttctccttcccctgttatagcacttttcatactgtgttagagttcacatttctgtctctctgcctcattgtgatctatttgagtgccaggattgtgtgttatt

SEQ ID NO: 7803 - DNA, 105 bp, Homo sapiens
gctgactgcatttttagtacatatccattgatacgcacgtgtgtaggtatctaattttatacgcaatttgtatttgtgtgggattctgtttgtctgcttgttggt

SEQ ID NO: 7804 - DNA, 83 bp, Homo sapiens
cagcacatatgttagggtgcttgacattttcccacagtttactaagactgtgcttattttttgtcattgttaatatagctctg

SEQ ID NO: 7805 - DNA, 81 bp, Homo sapiens
tggcagacactggcagactggaaggtgggatggtgaaggctgggcatgtattttgctgtcttcctccctgtcagactgtca

SEQ ID NO: 7806 - DNA, 61 bp, Homo sapiens
tgagatggagtctcgctctgtcactggctggagtggagtgcattggtgagatcttggctca

SEQ ID NO: 7807 - DNA, 111 bp, Homo sapiens
gcggtaggcggtgtctgggggaaattgaggcatgtgaggatggcacgctctgtgtctgcttgtccaaagcgcacccttgggcttccctttcctgctccttcagcttgctgc

SEQ ID NO: 7808 - DNA, 96 bp, Homo sapiens
ggatggattgtgaggtcctaaagaacagaacctctaccacatttatttatttaaatagatcgaaaggttggatcagaggacctctgaaaccctttc

SEQ ID NO: 7809 - DNA, 114 bp, Homo sapiens
ctctgtattcttcccctcgggttctagggcttatgggttcattttttaaaaattttatctatttatttttttcgagatggagtcttgctctgttgcccaggctggagtgcagtg

SEQ ID NO: 7810 - DNA, 97 bp, Homo sapiens
cacacacacactgtacagtcccagcatgcttggtttgcaagaaggggtagcattcttcagggcaatcaagtctgctgtcctgactatttttttgttg

SEQ ID NO: 7811 - DNA, 84 bp, Homo sapiens
tcagccactagtggtgacgtgttcctgtagtctcagctgcttagggggctgaggtgggaggatgaattgagcccgggaggtgga

SEQ ID NO: 7812 - DNA, 107 bp, Homo sapiens
gtctcttcaaattattatttattgatcaacacagcctgagaaaaagccacagcataatcatatgtttttttcttgtttttttttaataaattacattttagagagac

SEQ ID NO: 7813 - DNA, 87 bp, Homo sapiens
aacagctgtttctccattatgaaaagactaactgcaaatgccaataactttggtaatcctgagtttctttttctttaaatagctgtt

SEQ ID NO: 7814 - DNA, 108 bp, Homo sapiens
agtgtggtggtgtgtgcctgtggtcctagctactagggaggctgaggtaggaggatcgcttgagccctaggggtggaggttgcagtgagccaacattgccactgcact

SEQ ID NO: 7815 - DNA, 98 bp, Homo sapiens
atccatggaggaggcaatatttgtgctagcttatgaaatgtaaataagaccattgcaatttgtatgtgtgtgtgtgcaagtgtgtgtgtgtacagggt

SEQ ID NO: 7816 - DNA, 116 bp, Homo sapiens
ttgaatctaagtctgtctgcaaaccatatgcactttctactttacatcattggactgacccactctgtgtgtgtgtttgtgtgtgtgtgtgtgtgtagtataaagatgaactttag

SEQ ID NO: 7817 - DNA, 70 bp, Homo sapiens
tgaggaatttagaagtaattagacttccctgttatctaaagcgggcatctggttccaggcttctttctca

SEQ ID NO: 7818 - DNA, 78 bp, Homo sapiens
aacaaagttatttatttatcagtccaaatatatgaagccacagtgattcatatatttggactgataaataaatttgtt

SEQ ID NO: 7819 - DNA, 95 bp, Homo sapiens; identical to SEQ ID NO: 68

SEQ ID NO: 7820 - DNA, 93 bp, Homo sapiens; identical to SEQ ID NO: 69

SEQ ID NO: 7821 - DNA, 99 bp, Homo sapiens
tggaacctcaataaaaactctggacatggaagtgtgagtaagattccttgattagcatgattctttttcttcttcttttttttctgagatgaggtctca

SEQ ID NO: 7822 - DNA, 95 bp, Homo sapiens; identical to SEQ ID NO: 68

SEQ ID NO: 7823 - DNA, 93 bp, Homo sapiens; identical to SEQ ID NO: 69

SEQ ID NO: 7824 - DNA, 84 bp, Homo sapiens
atatatacgtatatatgaatatatacatgtatgtatatatgaatatatgtatatatatgaatatatatgtatatatgaatatat

SEQ ID NO: 7825 - DNA, 70 bp, Homo sapiens
tatatgaatatatatgtatatatgtatatatatgaatatatatgtatatatgtatatatgtatatatatg

SEQ ID NO: 7826 - DNA, 115 bp, Homo sapiens
aaatcaacatcattatatgtgtctgactctgtgctgtttatatatgcatatatatatatatgcatgtatatatatatatacacacacgcacacacatatatatgcatatggattt

SEQ ID NO: 7827 - DNA, 68 bp, Homo sapiens
atatgcatatatatgtgtgtgcgtgtgtgtatatatatatatacatgcatatatatatatatgcatat

SEQ ID NO: 7828 - DNA, 104 bp, Homo sapiens
tgaataatattccattttatatatgtgtgtatatatatgtatatatatatgtatgtgtgtatatgtacacacacacaccatataaagtatgggatatatattta

SEQ ID NO: 7829 - DNA, 76 bp, Homo sapiens
gtcatgatatgggaagcactgcctgatggggccccacctccagcacattggctgtctctctgtcacttggcttcct

SEQ ID NO: 7830 - DNA, 108 bp, Homo sapiens
ggaagagtctgtgcttaggcaggtggtgttgagtctagagagagaggataggcacccacccagccatgggtcttttcttcccacaggcacctcagactgagcactgga

SEQ ID NO: 7831 - DNA, 79 bp, Homo sapiens
aagcaacggctctgtcagcatgacctgggttcctgcctgtgtgcctgtgtctatgcctcatgaagcctttaccctgctt

SEQ ID NO: 7832 - DNA, 110 bp, Homo sapiens
tggaaaaaaattgtattttggataacagctttagttattcaggataggatgttgtcgcaaaacactaaacttgaaaactaggcattattcagagagaaaaagttcttcca

SEQ ID NO: 7833 - DNA, 67 bp, Homo sapiens
ttgaaacagagtctcacactgcctctcctgggctggagtgccatggtgtgttcttggctccctgcaa

SEQ ID NO: 7834 - DNA, 85 bp, Homo sapiens
gcgctttgtgatgagataagatgccccacagggtccaggccgacttcactgtccgcctctgtgcctcgctctgcttccagactgc

SEQ ID NO: 7835 - DNA, 121 bp, Homo sapiens
tgtgttgatgaacaaatttttctgtgcatctatgttttcctttccaagcactttttgttttattatactttaagttctagggtacatgtgcacaatgtgcaggtttgttacatatgtatac

SEQ ID NO: 7836 - DNA, 109 bp, Homo sapiens
ttcgtggtgttttgtgttattttcgaataatcagtactgtttttgttgatactatatgagagtatcatatgaacctaacagtaaatgaaaatatctagggcaagaagaa

SEQ ID NO: 7837 - DNA, 68 bp, Homo sapiens
gccctaattggactgccactctcagacagactggccccaccatgtagagtgtggaattcatctggagc

SEQ ID NO: 7838 - DNA, 89 bp, Homo sapiens
aaaaagaaaaaaagtgagtgctctctctctctcactggtttacctgtccctaaaacccattcatagaaagagtgcctcattttcttttt

SEQ ID NO: 7839 - DNA, 95 bp, Homo sapiens; identical to SEQ ID NO: 68

SEQ ID NO: 7840 - DNA, 93 bp, Homo sapiens; identical to SEQ ID NO: 69

SEQ ID NO: 7841 - DNA, 107 bp, Homo sapiens
gcagcatagtattccatggtatatatgtatcacattttctttatctgatctgccactgatgggcatttaggttgattccatgtctttgctattatgaatagtgctgc

SEQ ID NO: 7842 - DNA, 65 bp, Homo sapiens
gggctgtcttagttttcactatacttgcagtgcctcatgcagacagtgacactctgtaactgccc

SEQ ID NO: 7843 - DNA, 122 bp, Homo sapiens
tcagcctcccgagaagctaggactacaggcgtgtgccaccatgcccaactcttaaaaaaacttttttttttttttttgtagctatgggggtctcactttgttgtccaggctgacagaactgc

SEQ ID NO: 7844 - DNA, 89 bp, Homo sapiens
tattgttatgtgtgaatttgatcttgtcattatgatgctagctggttattttgcccattagttgatgcaatttcttcacagtgtcaatg

SEQ ID NO: 7845 - DNA, 58 bp, Homo sapiens
tgagacgcagtctcgctctgtcacccaggctggagtgcagtggcgtgatctcgactca

SEQ ID NO: 7846 - DNA, 97 bp, Homo sapiens
ttaggcaaatgtctgatctggggtctctctctgcctctcattctctagtttttgctcccaggctaaagagatggccatagaaaaccacagaacctaa

SEQ ID NO: 7847 - DNA, 72 bp, Homo sapiens
ttgtttttgagatggagtctcactctgtcaccccggctggaggtacagtggtgtgatcttggctcactgcaa

SEQ ID NO: 7848 - DNA, 98 bp, Homo sapiens
agactcagtcctttgcatcctgaagcttcaagtctcatcaactccctgtctacccatgcagactgggtctgtctgtgactctagcttaggcttgatct

SEQ ID NO: 7849 - DNA, 93 bp, Homo sapiens
ttaccccggcgggaactgatataagcagattgaggtataaattttaatttttttgtttatcttactgctgatatgtttcctaggaaagggtga

SEQ ID NO: 7850 - DNA, 56 bp, Homo sapiens
gagacggagtctcgctctgtcactcaggctggagtgcagtggcgtgatctcggctc

SEQ ID NO: 7851 - DNA, 61 bp, Homo sapiens
ccagcaactgttctggtgggacttgactggagacagagaccagtttagatgctgttgttgg

SEQ ID NO: 7852 - DNA, 94 bp, Homo sapiens
atcagcttaaaatatgtttatttgattttaagttctggggtacatgttcaggatgtgcagatttattatataggtaaacatatgtcatggtggt

SEQ ID NO: 7853 - DNA, 58 bp, Homo sapiens; identical to SEQ ID NO: 1215

SEQ ID NO: 7854 - DNA, 143 bp, Homo sapiens
ctgggtgacaaaagcgaaactccgtctcaaaaaaaaaaaagtaacaaactttttttttttttttgagacagagtcccactctgtcacccaggctggagtgcaatggggcgatctcggctcactgcaacctctgcctcctgggt

SEQ ID NO: 7855 - DNA, 110 bp, Homo sapiens
tcatgtgtatatatatatgcatgtgtgtgtatatatctcatgtgtgtatatatatatttgtgtatatatacacacagatgcatatatatttgtgtatatatatacacaga

SEQ ID NO: 7856 - DNA, 56 bp, Homo sapiens
ggatagtccctgggagtagagtgtgtgctcttaaccactctctccaatgtctctcc

SEQ ID NO: 7857 - DNA, 58 bp, Homo sapiens
tgagacagagactccctctgtcacccaggctggagtgcagtggtgtgatctcagctca

SEQ ID NO: 7858 - DNA, 95 bp, Homo sapiens
atggatatggaaggccaactgtattatatatattttaatgctggggaatgcagaagaagggtatatattatttggctctgttgattccaattcat

SEQ ID NO: 7859 - DNA, 89 bp, Homo sapiens
gctaccacaccgggacaaagtggcacttttttttttttttttttttttttttgagacagagtctcgcactgtcacccgggctggaatgc

SEQ ID NO: 7860 - DNA, 197 bp, Homo sapiens
tatatacacatatgtatatatacatatatatacacatatgtatatatacatatatatacacatatgtatatatacatatatatacacatatgtatatatatacacatatgtatatatacatatatatatacatatgtatatatacatgtatatatacatatgtgtatatatacatatatatatacatatgtatatat

SEQ ID NO: 7861 - DNA, 62 bp, Homo sapiens
ttgttttgagatagagtctcgctctgtcacccaggcagtggtgtgatcttggctcactgcaa

SEQ ID NO: 7862 - DNA, 68 bp, Homo sapiens
ctggctctctctctgtctgtgtatagatatagatagatagatagatacatagatagatagatagatag

SEQ ID NO: 7863 - DNA, 117 bp, Homo sapiens
gccagtagtcacatgtggttattaaatatttgaaatgtggctaatggaactgaggaaatgaattttaaatttaattttgataaattgtatttcaaatagccacctgtgactagttgc

SEQ ID NO: 7864 - DNA, 80 bp, Homo sapiens
acttagactcaaactctctatcactggattcccacaaataaggccctgttctgagtaggggaaacagtgatattctaggt

SEQ ID NO: 7865 - DNA, 82 bp, Homo sapiens
ggtgtgttttgtaattcaggatctaaaactttttattttagaagagtaacacggtgcatatatcctgtgttatttaacaccc

SEQ ID NO: 7866 - DNA, 64 bp, Homo sapiens
ttgagactggtctcactctgtcacccaggctggagtgcagtgcagtggtgtgataatagctcaa

SEQ ID NO: 7867 - DNA, 76 bp, Homo sapiens
ctataaatattctttggatatggtatggaaagaatctcctgatgactttccttattgtaattggataaatttgtag

SEQ ID NO: 7868 - DNA, 90 bp, Homo sapiens
cgggctattttttggttccatatgaaatttaaagtagttttttctaattctgtgatgaaggtcaatggtagcttgatgggaatagcattg

SEQ ID NO: 7869 - DNA, 95 bp, Homo sapiens
tgtgttgttggatccagtctgctactattttgttgagaatttttacatctatgttcatcagtgatattgtagttttctggtttgatgtccttaca

SEQ ID NO: 7870 - DNA, 72 bp, Homo sapiens
ggtgtggatccccagggggctctcactcactcacccttcttcatattagcaagtctctcctggctccgcacc

SEQ ID NO: 7871 - DNA, 64 bp, Homo sapiens
ccagcccctctgctgccctttggtggctgcagtagccctcagaagagagaaagcagtgggtggg

SEQ ID NO: 7872 - DNA, 104 bp, Homo sapiens
atctaactatatatgtatgtgtatgtatatgtgtgtatatatataaaactatatgctctatatatacacacacacatacatgcacatcatatacaacagataga

SEQ ID NO: 7873 - DNA, 95 bp, Homo sapiens; identical to SEQ ID NO: 580

SEQ ID NO: 7874 - DNA, 93 bp, Homo sapiens; identical to SEQ ID NO: 69

SEQ ID NO: 7875 - DNA, 103 bp, Homo sapiens
tgaaggaaaaagtctttagatatcagattggcatgactgtcttactctctggatgtgtgaccctggaaatgttatctgaactttataaacctcagtttcttca

SEQ ID NO: 7876 - DNA, 86 bp, Homo sapiens
gtgtgtgtgtgtatgcacgtgtatatatatgtatatacatatatacacttgtatacatacatatatacgtgtatacatacacatac

SEQ ID NO: 7877 - DNA, 123 bp, Homo sapiens
tgaggggatctcctgaccagaggattgcaaagatccacgggagaagcatggcttcctggagtcacacattcactcactgctttccttggtagaggaggttccgttagctctgtgtttctcctg

SEQ ID NO: 7878 - DNA, 82 bp, Homo sapiens
tgagaagaagtagcttgtcttgtttcagcattctgggcctaaaggataagggtaattataggaccagtgtttgcccttctta

SEQ ID NO: 7879 - DNA, 95 bp, Homo sapiens; identical to SEQ ID NO: 68

SEQ ID NO: 7880 - DNA, 93 bp, Homo sapiens; identical to SEQ ID NO: 69

SEQ ID NO: 7881 - DNA, 233 bp, Homo sapiens
atatatgtatctgtatatatgtatatacatatatatgtatctgtatatatgtatatacatatgtatcagtatatgtatatatgtacatgtatatactatatatgtgtataaatgtatatagtatatatacatatatacgtgtatacatatatacacgtatatatgtatatgtatatacatacatatatatgtatatacacacaaatatacatatatacacgtatatgtataca

SEQ ID NO: 7882 - DNA, 131 bp, Homo sapiens
atgtatagatgtgtatacatatacgtgtatatatgtatatttgtgtgtatatacatatatatgtatgtatatacatatacatatatacgtgtatatatgtatacacgtatatatgtatatatactatatac

SEQ ID NO: 7883 - DNA, 93 bp, Homo sapiens
gtcaatatctataacatttctctaaatatatagcgagatcagagatgtctctatatatttatatatagagagaaatatgttatagatattggc

SEQ ID NO: 7884 - DNA, 146 bp, Homo sapiens
agatatatatctatagatatacatttatatatagatatatagatatatagatctctctatataaatatatgtgtatgtatatatcatatatcatacataaatatatgtatatatctatatatatttatatagagagatctatatat

SEQ ID NO: 7885 - DNA, 99 bp, Homo sapiens
tatatatatatcatacatatgtatatatatgatatatatgttatacagatatatatacatatatatgatatgtgtgtaaatatatatgttatatatgta

SEQ ID NO: 7886 - DNA, 82 bp, Homo sapiens
tctctccatgtatttatttattttcagacagtttgaggttacagtgagctatgatcgcactgtctggagtgcagtggtgtga

SEQ ID NO: 7887 - DNA, 115 bp, Homo sapiens
gggattacaggtgtgagccaccactcccagcctaagcatataacttgatatagttgtcaagtgattaacttgtttcagtttctttgggagtgggtcttaactcatctgaaatcct

SEQ ID NO: 7888 - DNA, 73 bp, Homo sapiens
tgtgagtgtgcatatgtacacacacacatacacacagacatatgtgtgtgtgtaatatatatacacacacgca

SEQ ID NO: 7889 - DNA, 111 bp, Homo sapiens
acatctctgtgcttgctgtctcagaaaagtggagaggttgctttttttttttttttttttttaaaacagagcctcgctcaatctgtcacccaggcttaagtgcagtggcgt

SEQ ID NO: 7890 - DNA, 67 bp, Homo sapiens
gctagggagacagatgactttttaattttacttttctttaaacagggtctcactctgtcacccaggc

SEQ ID NO: 7891 - DNA, 99 bp, Homo sapiens
gtcagattgctgtctctgtgtggttcctcgtcctgcagtgtcacagacaatctgtctgtcatcgcagagcaggtggccaggcagaacaccggtgtagat

SEQ ID NO: 7892 - DNA, 58 bp, Homo sapiens
atgtacatgtatgcatgtgtacatgtatgtgtacatgtatgtatatgtacatgtacat

SEQ ID NO: 7893 - DNA, 107 bp, Homo sapiens
gaagacagatgattgagaggaatatttcacatctcttgttctcttttttaaaaattctacaattaagacagagtctaattggatttcctttatgaaaccactgtctc

SEQ ID NO: 7894 - DNA, 76 bp, Homo sapiens
agtttttgtgtggacatatatttttatttctttgggtatatacctaggagtggaaatgttgagttatatggaaact

SEQ ID NO: 7895 - DNA, 87 bp, Homo sapiens
gctagtaaactctgaagtcattttcttctactctatgattaagcaccgaagtgtctggatgaagtggaacccttcaactttgctggc

SEQ ID NO: 7896 - DNA, 76 bp, Homo sapiens
cacctgtcatacaggattacatttgctggggcatgactctgtgtctctcaccaaatatgaacactctgtgaaggtg

SEQ ID NO: 7897 - DNA, 74 bp, Homo sapiens
gatggtaacaacttatgcctcctagggttgtgaggattaaataaacaactaagtgaatgctagttgttattatc

SEQ ID NO: 7898 - DNA, 58 bp, Homo sapiens
cacacatatatgtgtacacacatgcacaaaggtgcatgtatatatatatatgtgtgtg

SEQ ID NO: 7899 - DNA, 66 bp, Homo sapiens
tttcacttctttggaaggcaggggctctggctgtctgcttcagagctctgttctcagtgtctgaaa

SEQ ID NO: 7900 - DNA, 108 bp, Homo sapiens
tatttctttcttaaaattggccaatgagtttcatctcacttttaaatattactaaatattctgtgagttgaaagtcagcacaagtcatttattgagcactcaggaata

SEQ ID NO: 7901 - DNA, 73 bp, Homo sapiens
tgcagtaacagataattgatagactgttcatgagttctgtgtctctgaagagtttatgttgtttgcctttgta

SEQ ID NO: 7902 - DNA, 82 bp, Homo sapiens
tacacacctatcatatatgtaatgtgtataatatataatgtgtgtttatatatctgtatgtgtatatatgtgtgtatgtgta

SEQ ID NO: 7903 - DNA, 100 bp, Homo sapiens
tgttagttatctgaattatatgtgtgtgtgtgtatatatatatatatatatatatatatatatatatatatatacacacagagattgaaatgttgtgata

SEQ ID NO: 7904 - DNA, 88 bp, Homo sapiens
atacaggtatatatatgtatggaaatatatatagggatgtatatatatacatatatagggatacaaatatatatatataggaatgtgt

SEQ ID NO: 7905 - DNA, 70 bp, Homo sapiens
agcatgactagtgtctgtgatttcttcagtggcttaaggtggagttgttagtagacactgtggtgatgct

SEQ ID NO: 7906 - DNA, 106 bp, Homo sapiens
gaatagaaatgatcatgataggcacatggattttataaggaatgtattgatgtttcatcgtagaatataacatttcttgtatgttttgcctccagatagtcttatc

SEQ ID NO: 7907 - DNA, 96 bp, Homo sapiens
tatgtaatattggcttatgtttattttactatatatacaaatagaaagttaagcaagtaaatatagtatgaatgtatgcatgagttagtgtacata

SEQ ID NO: 7908 - DNA, 91 bp, Homo sapiens
catcttttttattgtgtctgtcccctttctcactctctcaaaaaaaaaaagttagtgtttataagaagtggtgacaggtttggagaagatg

SEQ ID NO: 7909 - DNA, 144 bp, Homo sapiens
tacatatatgtatgtatatatacatatgtgtatatatgtatatgcatgcctatatgtgtatatatgtatgtatatatgtatatatgtttttatacatgtatacatatatacacacagagacatatatatgtgtaattttgtatg

SEQ ID NO: 7910 - DNA, 99 bp, Homo sapiens
atacactatgtatattaagtgtgtatatatacatatatgcagtatatatatatttacagtatacatgtacagtatacatatacagtatatacagtgtat

SEQ ID NO: 7911 - DNA, 89 bp, Homo sapiens
cctggttgctttatgaaatgatggctttggcagctctgtggaggatagaccatagagagtccagagtgaccacaggaagaacatccagg

SEQ ID NO: 7912 - DNA, 57 bp, Homo sapiens
tgagccagagtctcactctgtcaccgggctggagtgcagtggtgtgatctcggctca

SEQ ID NO: 7913 - DNA, 70 bp, Homo sapiens
tgctaatttatatacatatatatacacatatatatgcatatatgtgtgtatatatatgtatatgtatgta

SEQ ID NO: 7914 - DNA, 95 bp, Homo sapiens
ggaaatagttctgaaggcaccaccggtaatgcttgaaacagtgtaatgagtcagcacacatcagctagatctaggtgcatttcattatggaatct

SEQ ID NO: 7915 - DNA, 91 bp, Homo sapiens
ccatctgaagactatctgaagaactgatcccaagtgttctttctatttcactgaacacagactgcagtcaggttggaatagcagcagcagg

SEQ ID NO: 7916 - DNA, 104 bp, Homo sapiens
tctgttgtgagactgagttcagctgttcttccagttgggggacagatgtgtgtttctctccctcagtccctggacaggcacaactgctctcagaccagaactga

SEQ ID NO: 7917 - DNA, 128 bp, Homo sapiens
tgtatatatactatatataatgtatatacaattatatataattgtatatatacatgtatatgtatatgtatatatacatgtatatgtatgtgtatatatacatatatgtatatgtatgtgtatatatg

SEQ ID NO: 7918 - DNA, 107 bp, Homo sapiens
tgaaaattaggacataagaaaattaaggttgtgtatataattatcatgtttacaatatttttgatgacatgaagcacacaactatgtttagatgtgcgtctgtttca

SEQ ID NO: 7919 - DNA, 127 bp, Homo sapiens
gtatgtatatatatacacacacacatatatatatacagtgtatatatatatgcgtatatatgtatatatgtatatatgtgtatatatgtgtatatatgtatatatgtatatatgtgtgtatatatgt

SEQ ID NO: 7920 - DNA, 71 bp, Homo sapiens
ttatttttgagacagagtctcactctgtggcccaggctggagtgctgtggagtgatctcggctcactgtaa

SEQ ID NO: 7921 - DNA, 95 bp, Homo sapiens; identical to SEQ ID NO: 68

SEQ ID NO: 7922 - DNA, 93 bp, Homo sapiens; identical to SEQ ID NO: 69

SEQ ID NO: 7923 - DNA, 118 bp, Homo sapiens
catttttatttatgaagaatatcatttgatctaatgaaaaacattaaggataaattattcattatgatttattcagtaatgttttgtatagaggatgctctttataattttgacagtg

SEQ ID NO: 7924 - DNA, 71 bp, Homo sapiens
aagcattagtgatgatgatgatgatgatgatgttagtgataacatcatcacttcgacaatggctgctgttt

SEQ ID NO: 7925 - DNA, 95 bp, Homo sapiens; identical to SEQ ID NO: 68

SEQ ID NO: 7926 - DNA, 93 bp, Homo sapiens; identical to SEQ ID NO: 69

SEQ ID NO: 7927 - DNA, 104 bp, Homo sapiens
tcaacgactgcattttcctggtgattcttactgatcagagtgagcatatgaccaaaattgacccagtaagattaaatggaagaaattacatttgtatttgagga

SEQ ID NO: 7928 - DNA, 60 bp, Homo sapiens
catctcacttcactctctctcagagaaggcaactatagctcagagagatgaagtgacttg

SEQ ID NO: 7929 - DNA, 57 bp, Homo sapiens
tgagacggagtctcactctgtcaccaggctggaggacagtggtgtgatctcggctca

SEQ ID NO: 7930 - DNA, 92 bp, Homo sapiens
ggtattctggggacatgcgtaacttttaacaagaatattgttgataccaatcacccttcctctgagagtctctgtctgccacccagaattct

SEQ ID NO: 7931 - DNA, 62 bp, Homo sapiens
ttagtcagggttctccagagagatagaaccaataggatctatctatctgtctgtctgtctaa

SEQ ID NO: 7932 - DNA, 117 bp, Homo sapiens
tgctccctctgctgcaaaggggtatgcatggaaagtacttgttttttttttaaattttattttaaatttttttttgagacgcagtcttgctctgtcacccaggctggagtacagtgg

SEQ ID NO: 7933 - DNA, 78 bp, Homo sapiens
tgggcggcggggggggggctctctttttttttttttttttttttttttttttgagatggagtctcactctgtcaccca

SEQ ID NO: 7934 - DNA, 112 bp, Homo sapiens
gatctggttatgtaaaagtgtgtggcaccaccctcccactctctctctttctctcttcctcctgcttttgccatgtgaagtgcctgctctcgctttgtcttctgccatgatt

SEQ ID NO: 7935 - DNA, 100 bp, Homo sapiens
tgtagcttgctcctaccagaacttcttaagggagatagagggagtctgacttaaaattgaattttttttttcttttttggttggtagagatgtgaatata

SEQ ID NO: 7936 - DNA, 71 bp, Homo sapiens
gagagcagcgaggttcacgggttgtgtgaacagaggaaggtggacacgacagagagcacacttggggttcc

SEQ ID NO: 7937 - DNA, 111 bp, Homo sapiens
agctgtgacgttctgtgagtcaggggtattaagtgcatattcttttttttttgaaacaaggttttgctcaacatgttgcccaggctggagtgcagtggcttgatcacagct

SEQ ID NO: 7938 - DNA, 94 bp, Homo sapiens
tgttagagttgtgagaattaagtggctagctacatatgagagtgaacagactctaaaagggccatacaaatgccagattttctcatgcataaca

SEQ ID NO: 7939 - DNA, 106 bp, Homo sapiens
tcagctggaattcgttttgtgtatggtatgggatagagattttatctttttatagaaagtcaattttcctattaccatttattgaacatccaccctttcccactga

SEQ ID NO: 7940 - DNA, 85 bp, Homo sapiens
gtgtgtgtgtgttttgagatgaagtctcactctgtcacccaggctggggtgcagtggtgtgatctagactcactgcaacctgcgc

SEQ ID NO: 7941 - DNA, 88 bp, Homo sapiens
agctggggtgacagagcaagattctgtctcaaaaatttttttttttttaaatttttattgagaaggatctcactctgttgtccaggct

SEQ ID NO: 7942 - DNA, 95 bp, Homo sapiens
actagttagctttggaaccttaggtgagtcagtcatctcatctcctttttttttgtttttgagatgaagtctcactctgtcacctaggctggagt

SEQ ID NO: 7943 - DNA, 72 bp, Homo sapiens
ctgggcgtggtggcaggcgcctgtagtcccagctactaaggaggctgaggtaggagaatgtcgtgaacccgg

SEQ ID NO: 7944 - DNA, 96 bp, Homo sapiens
gccactttgcccggcccaagttacagattcttaatatttctttgtataaagaacagtgtcaaaatattaggttctgggattggtaaatcagtgagt

SEQ ID NO: 7945 - DNA, 109 bp, Homo sapiens
tgttggtgagcatgtatatagctatgtttgtatatctgtctatatgtatatatatgtatgcctcagtacttaactgcagaattatagttaatacatgtttaattaaata

SEQ ID NO: 7946 - DNA, 83 bp, Homo sapiens
ccactgtgtagggcacttactgtgaatggagcttgcagcactggaagttgctttgggtgagtcagtgagtgagtggtacgtgg

SEQ ID NO: 7947 - DNA, 95 bp, Homo sapiens; identical to SEQ ID NO: 68

SEQ ID NO: 7948 - DNA, 93 bp, Homo sapiens; identical to SEQ ID NO: 69

SEQ ID NO: 7949 - DNA, 78 bp, Homo sapiens
gagacggagtctcactctgtcacccaggctggagcgcactggcgcgatcttggctcactgcaagctctgtctcctggg

SEQ ID NO: 7950 - DNA, 87 bp, Homo sapiens
agcctgggcaacatagtgagaccccccgtctctatttaaaaaaaaacaattttttttttgagagagtctcactctgtcacccaggct

SEQ ID NO: 7951 - DNA, 71 bp, Homo sapiens
ttgtttttgagactgggtctcacactgtcacccaggctggagtgcagtggtgggatctcggctcactgcaa

SEQ ID NO: 7952 - DNA, 62 bp, Homo sapiens
gctgtgtgtgtgtgcatgtgcatgtgtgcgccggtgtacatgtgtgcacataggcatgtagc

SEQ ID NO: 7953 - DNA, 60 bp, Homo sapiens
gtgagacggagtctcactctgtcacccaggctggagtgcagtggtgtgacctcggctcac

SEQ ID NO: 7954 - DNA, 95 bp, Homo sapiens; identical to SEQ ID NO: 68

SEQ ID NO: 7955 - DNA, 93 bp, Homo sapiens; identical to SEQ ID NO: 69

SEQ ID NO: 7956 - DNA, 58 bp, Homo sapiens; identical to SEQ ID NO: 1409

SEQ ID NO: 7957 - DNA, 58 bp, Homo sapiens; identical to SEQ ID NO: 1409

SEQ ID NO: 7958 - DNA, 128 bp, Homo sapiens
cctacaaaaaagaaaacgaaaattagccgggcttggtggtcccagctactcaggaggttgaggtaggaggttcacttgagcccaagagtttgaggctgcagtgagctgtgatcctgccactgcactct

SEQ ID NO: 7959 - DNA, 114 bp, Homo sapiens
gccccagtgtgtgtgtttctgagtttgtgtgcattactttggctgtgtgtgaggtgtgtgtgcatactgctggctgtgagcacctatagatggggggcttaagggactgggtgt

SEQ ID NO: 7960 - DNA, 71 bp, Homo sapiens
gggcctggtgtctgggcattagtgactgtgcccatttgtgtgtgtcagtgagtgtctgtgggctgtggttc

SEQ ID NO: 7961 - DNA, 113 bp, Homo sapiens
taagaacacttttttatgatttgaatatttttaaatgtattgagacttgttttagtaatctgaatatatttaattttagttaatgttccatgtgcaattgaaaagtgtgttta

SEQ ID NO: 7962 - DNA, 103 bp, Homo sapiens
tggtctgtgtacacttctctgcctatgtggaagaagctagttttggaataatctctcagtgataccgcaccagggcaggtttcgcctagatcagcttttcctc

SEQ ID NO: 7963 - DNA, 98 bp, Homo sapiens
gaccttccacggtggcacgaccagtatcactgccatttgcacttataagtgacattttgtagtagtgaaaccatttttttgttgttgttgggttggtc

SEQ ID NO: 7964 - DNA, 78 bp, Homo sapiens
tccatggaccagacactgcctctccttatatttgattatatcttgtagataggagttaggaggtacttctttgatgga

SEQ ID NO: 7965 - DNA, 73 bp, Homo sapiens
gacagaatgaaaccatgtctctcaaaaaaaccatttttttttgtttgtttttgagacagagtctcactctgtc

SEQ ID NO: 7966 - DNA, 100 bp, Homo sapiens
gcagtctccaaacacgaggattcgttctagtatttaaataagccagccactcgggaggctgaggtggaaggatcacttgtacccaggagttcaaagctgc

SEQ ID NO: 7967 - DNA, 95 bp, Homo sapiens
gtggctcgacttccattgtgacaagtgtagagcattagtctaataagtatttatttattttttgagacagattctcactctgtcacttaggctac

SEQ ID NO: 7968 - DNA, 80 bp, Homo sapiens
gactaggttctcttaaggaaaaaaattaatagcttgtaataaatctcagttgttaacttttttttttttgagacagggtc

SEQ ID NO: 7969 - DNA, 58 bp, Homo sapiens; identical to SEQ ID NO: 1763

SEQ ID NO: 7970 - DNA, 72 bp, Homo sapiens
gtgagtgaggtgattaaaggagatgaaaatggcggtatacacaatgctactctcactctcctactcacacat

SEQ ID NO: 7971 - DNA, 97 bp, Homo sapiens
ggctgagagcactggctatattatataagattccattagtgacagaagagtgtagacagtctctacagtgtagatcgtttagtcagttgtggtagtc

SEQ ID NO: 7972 - DNA, 107 bp, Homo sapiens
aaatctgctatttcatttgcggattatccatttcttgtaattcagtaaattttttgttttgaagctgtactattggatatgtgtagatttagaattagccatggttt

SEQ ID NO: 7973 - DNA, 113 bp, Homo sapiens
gatatctcattgtggttttgatttgcatttccctgatttgtgatgttgaacattttttcatatatttgttcgtcatttctgtttttgagaaatgtctgttcagatcatttgtc

SEQ ID NO: 7974 - DNA, 98 bp, Homo sapiens
gaaatctccatagtatattccacagacaatgatataatagaagaaactgtaacagtcacttctgattatgttgttttggacctgcttcccaatacttc

SEQ ID NO: 7975 - DNA, 95 bp, Homo sapiens; identical to SEQ ID NO: 68

SEQ ID NO: 7976 - DNA, 93 bp, Homo sapiens; identical to SEQ ID NO: 69

SEQ ID NO: 7977 - DNA, 160 bp, Homo sapiens
ctggatagacctctcactagctatctggatagaattctcactctctggataaaactctcactgtctgtctggatagaattctcaccatctggataaaactctcactatctgtctggtagaattctcactatctggatagaactctcagtatctgtataga

SEQ ID NO: 7978 - DNA, 104 bp, Homo sapiens
gagtaactgctggaaaagaggctgcttatctgcgactgtgtgtgtctcttagaatgatggggtgtcaggaagtgggattggaggagcttcgtctgcattaaatc

SEQ ID NO: 7979 - DNA, 92 bp, Homo sapiens
gcagttttccttcaacatggatttgtttttgtttttaaaagacaaacctattatttaaaaacaaaacaatctccttggcgggtgggggtggt

SEQ ID NO: 7980 - DNA, 95 bp, Homo sapiens
gatcttgatattcaaacttaatgaacgtagtttttttaagttcttaaaaaaactctttagttcttgattttatatatagtgtttgaaatcagatt

SEQ ID NO: 7981 - DNA, 116 bp, Homo sapiens
gtatgtaaaatcattccctgtacatcgtatgtgccaacacagtgtaaaactaattttattttagtacaaaaattatgtgtgaatatagatagatagaaagagatataaaaacatac

SEQ ID NO: 7982 - DNA, 81 bp, Homo sapiens
cagccactcccagagcccctggaactctggcccaaggctctctgactgactccttcccagatcttcttggcttagcggctg

SEQ ID NO: 7983 - DNA, 89 bp, Homo sapiens
tgtgagggtcaggttatgtgtgtgtgattttgcatgtgcctctgtgggtgtgtcagtgcgacacgtgccttcgtttctctgttctcgca

SEQ ID NO: 7984 - DNA, 84 bp, Homo sapiens
ggtcaccatgacatcctggcttgtaccatgtttggacagtgtttcagtctcacacactattacaagtcagtaaaattggcttcc

SEQ ID NO: 7985 - DNA, 87 bp, Homo sapiens
gggactctggggacaaggctcagaaaggtgaattttaaaatagctccccagatgatttttttttttttttttttgagacggagtctc

SEQ ID NO: 7986 - DNA, 56 bp, Homo sapiens
gagacggagtctcactctgtcacccaggctggagtgcagtggtatgatctcggctc

SEQ ID NO: 7987 - DNA, 108 bp, Homo sapiens
tggtctgagaaatttttccccaagggaaacattaagactaaattttttttgtaacaaatacagagatgtttgaagtaaagtgattccccttgatgtttctgctttcca

SEQ ID NO: 7988 - DNA, 111 bp, Homo sapiens
gacatgtgcagggatcacatagaagcaagagagaggggggatatgcctagtttttttcatttgtttttgtttttgagacaaaggacaaggtcttgctctgtcactcaggct

SEQ ID NO: 7989 - DNA, 95 bp, Homo sapiens; identical to SEQ ID NO: 68

SEQ ID NO: 7990 - DNA, 93 bp, Homo sapiens; identical to SEQ ID NO: 69

SEQ ID NO: 7991 - DNA, 56 bp, Homo sapiens
gagatggagtctcactctgtcacccaggctggcgtacagtggtgtgatctcagctc

SEQ ID NO: 7992 - DNA, 84 bp, Homo sapiens
tttgggggacgtattggagagcaaagttgaaaggggcagttctttgggtcagaatttgtatccattatgaatccacaggcccaa

SEQ ID NO: 7993 - DNA, 69 bp, Homo sapiens
tgtactgtgtatatgtatatatctgtatataaatatagatatacaatgcatacatgtatatataatgca

SEQ ID NO: 7994 - DNA, 117 bp, Homo sapiens
actctagaagctatgacacattactgtaaaactttgaaggggaaattgttttaaattctatctttttttttttttttttttttagacagagtcttgctgtgtcacccaagctggggt

SEQ ID NO: 7995 - DNA, 84 bp, Homo sapiens
gcagaggctgaggtaggaggatcacttgagcccaagaattcaaagctattgtgcacaatgatcacacctgtgaatagccactgc

SEQ ID NO: 7996 - DNA, 57 bp, Homo sapiens
tgtgcgtgtgtgtgtattaatctaatatatacattagattcagcaagtacatgtgca

SEQ ID NO: 7997 - DNA, 116 bp, Homo sapiens
actgggcaacatagtctgggcaacatagcgagaccccatctcaactaaaataaatttatttatgtatttattttttgagacagagtctcgctctgtcgcccaggctggagtgcagt

SEQ ID NO: 7998 - DNA, 110 bp, Homo sapiens
tgcttaggattgtcttggctatacgggctcttttttggttccatatgaaatttaaagtagttttttccaattctgtgaagaaagtcaatggtagcttgatggggatagca

SEQ ID NO: 7999 - DNA, 100 bp, Homo sapiens
tgattctacatcatggtgagttgtatagttatttcattatctattacaatgtcataataatagaaataaagtgcaaaataaatataatgtgctggaatca

SEQ ID NO: 8000 - DNA, 58 bp, Homo sapiens; identical to SEQ ID NO: 2051

SEQ ID NO: 8001 - DNA, 80 bp, Homo sapiens
tgagactgagtctcactctgtcacccaggatggagggcagtggcgcgatcttggctcactgcaacctctgcttcctgggt

SEQ ID NO: 8002 - DNA, 80 bp, Homo sapiens
aatacttaacaaactccatgtatatatctatagagtttgttaagtacttatatatatatatatggagtttattaagtatt

SEQ ID NO: 8003 - DNA, 102 bp, Homo sapiens
ctggtgtgtgatgttcccctccctgtgtgcctgtgttctcattgttcaactcccacttatgagtgagaacacacggtgtttggttttctggtcatgtgttag

SEQ ID NO: 8004 - DNA, 86 bp, Homo sapiens
agctatgagaagtctgtaggaaacaattcaattcagatgtgagatagcacagagagcccttgtttcaactgctggctgacttggct

SEQ ID NO: 8005 - DNA, 69 bp, Homo sapiens
cccttatcagaatgtctctgaacttaacaaagcagataatgagttccagagacagatactgcttggggg

SEQ ID NO: 8006 - DNA, 96 bp, Homo sapiens
cacacacacatatatatatatatacacatatatatgtgtgtatatatatatatacacacatatatatgtgtatatatatatatatattttgtgatg

SEQ ID NO: 8007 - DNA, 135 bp, Homo sapiens
atatatatatatatatacacatatatatgtgtgtatatatatatatacacacatatatatgtgtatatatatatatatgtgtgtgtgtgtatatatatatatatatatatatatatatatatatatatatatatg

SEQ ID NO: 8008 - DNA, 76 bp, Homo sapiens
ctgcaacagctgacgtccaatgggcactcgctctgtatcagtcactgatccagaagcttcacatggactagctcag

SEQ ID NO: 8009 - DNA, 108 bp, Homo sapiens
gataatatgtacaaagtgcttagaacagtgcctggcccagagtactgaaaacaatgttaattattgttattactgggggcacagttctcaaaatttctgtcagttatt

SEQ ID NO: 8010 - DNA, 88 bp, Homo sapiens
tgtacacacacactatatacacactatacatactacatatatactatatagtgtatatgtatatatgtgtatatacacataatgtata

SEQ ID NO: 8011 - DNA, 79 bp, Homo sapiens
tacactctctgtctttctcacatatacacatatttataaatatgggttttatatacagtagagagcagatagagaggta

SEQ ID NO: 8012 - DNA, 104 bp, Homo sapiens
tttgggtgtcatcttgactggattaagggatgctcagacagctgataaaacattacttctgtgtgtgtctgtgagagtatttccagaagagactgacatttgaa

SEQ ID NO: 8013 - DNA, 62 bp, Homo sapiens
ttgagatagagtctcactctgtcatccaggctggagtgcagagtgcagtggcgcaatcttgg

SEQ ID NO: 8014 - DNA, 78 bp, Homo sapiens
gagggaagtgggagtctgtgataaggggaagacaagcatttttttttttttttttttgagatggagtcttgctctgtc

SEQ ID NO: 8015 - DNA, 74 bp, Homo sapiens
gctttttttgtcactttcactctcttactctcaggagagtccagaggctacatgacatgtgataagacaatagc

SEQ ID NO: 8016 - DNA, 65 bp, Homo sapiens
gggtactctgcctgatcctaggctctttggggacccttgagactgaggagagataggctcttccc

SEQ ID NO: 8017 - DNA, 83 bp, Homo sapiens
actgagaaacaggagttgagggagcaagttcttttatttttttaagacggagtcttgctctgttgcctaggctggagtgcagt

SEQ ID NO: 8018 - DNA, 75 bp, Homo sapiens
cctggatgtaggcagagggatgggctgattgtatgactcctcagtctctgtcagtccattttctatgactttagg

SEQ ID NO: 8019 - DNA, 82 bp, Homo sapiens
ttcagtagggaataggtgcctatcatcttttttttttttttttttttttaggatgaagtctcactctgtcacccaggctgga

SEQ ID NO: 8020 - DNA, 115 bp, Homo sapiens
gtggacatccaagatcagggagccagtatgggtgggatctgctgagggccctcttccttgctcacatgacagagagctcactcactcaggtctcttcctcctcttataaggacac

SEQ ID NO: 8021 - DNA, 81 bp, Homo sapiens
ggtggtggcggggagagccaggactgggagtcaactccaccaagctaagaaacccagagcctccctctctcagtccctggc

SEQ ID NO: 8022 - DNA, 78 bp, Homo sapiens
tagatatatatgtatatgtatatatgtatatatatacacacacatatatatacgcatatatatatatatgttcctcta

SEQ ID NO: 8023 - DNA, 63 bp, Homo sapiens
gtcacccagctagtaagggaccaagctgggattatgcactctggctcttactgactctgtgat

SEQ ID NO: 8024 - DNA, 102 bp, Homo sapiens
ggggtggagagagcaggggaggtaaggagcagagatgggagagaggacaagctggcagagactctttctctatgaaaagccttgcctgagtcactccttccc

SEQ ID NO: 8025 - DNA, 112 bp, Homo sapiens
ttcaggagcctggagaaggcgaagtggggagagggcaaaaactgacgaagaattgggaaatactttttttttttttttgagactgagtcccactctgtcgcccaggctggag

SEQ ID NO: 8026 - DNA, 65 bp, Homo sapiens
agctagagctggtgctcagagaagagctgccccatggtagcaagtgtctgtcactggctctttct

SEQ ID NO: 8027 - DNA, 78 bp, Homo sapiens
acacacacatacctgtatatacatatatatactaatatattagagagatatatgtctatatacaggttttgtgtgtgt

SEQ ID NO: 8028 - DNA, 118 bp, Homo sapiens
tcatttaatccttgcatgaactcagtgaggtaggtctgtttcccctgttacacagaagagacagtggaggctgggagatgtcagataattcgcccaagatcctgcaggtaataaatgg

SEQ ID NO: 8029 - DNA, 58 bp, Homo sapiens
tgagacaggatctctctctgtcactcagggtggagtgcagtggagtgattacagctca

SEQ ID NO: 8030 - DNA, 107 bp, Homo sapiens
ggacataaacatctttgggggccattattctgtctatcacattgatcaatatgtattttcctttttatatattgtttgatttgaattgctaataaaatgttttgttt

SEQ ID NO: 8031 - DNA, 79 bp, Homo sapiens
tcagcaggaccttgcagtattgggaagagcataatgccacaggcatgggcagctctctctctctcaggtgcctttctga

SEQ ID NO: 8032 - DNA, 102 bp, Homo sapiens
ggacagggctctgagagcatgggtggcctgcagacaggctgtgtgtgtcactgggaccagggcactcaccagcctgcagccagatctgttccagcgtggtcc

SEQ ID NO: 8033 - DNA, 77 bp, Homo sapiens
tcacattaccaatgtaaagttgtatacttattggctatttacgttattttcgaaataactgagtcattggtgatgga

SEQ ID NO: 8034 - DNA, 81 bp, Homo sapiens
gggtttaaggtctgtgtctagattcttttcctcttttttatttttattttggaggaagagtctcactctgtcacccaggct

SEQ ID NO: 8035 - DNA, 105 bp, Homo sapiens
gtgagccacagcacccagctgcagtatcagtctttttcatgagtctctacctctctctggtatagactcatgaaaatctgtgaccatctgtactgtgaatttcac

SEQ ID NO: 8036 - DNA, 84 bp, Homo sapiens
gaggagcccacaccgaggacggtggggtggtccctgcagaagcccagaaaccctcactgtcactgtgaggagtgggcatttctc

SEQ ID NO: 8037 - DNA, 118 bp, Homo sapiens
cctaagaatctctgatttaggaccatctttaagggctctaacattctatgattctttttttaacctacccacaagccagcctgtcaagatgtcacctgaaaatgcagtgattttttgg

SEQ ID NO: 8038 - DNA, 103 bp, Homo sapiens
aattcatgagtctttaaaatgtttgccagaagattcagagctcagattctgcttctggcgttgagctcagggttttctctatcacaaattgtgctggctcatg

SEQ ID NO: 8039 - DNA, 112 bp, Homo sapiens
ctttgtatacctaatatctgctcacatcattcatcccatactgagagatcactctgtgctgaaattgtctagaaaagtcttgaggaatgaagtagaacttaagtcttcaaag

SEQ ID NO: 8040 - DNA, 60 bp, Homo sapiens
ctccaagcatcagtcagccacagcgacgctgtcattctgtctgtctgtccatgctagggg

SEQ ID NO: 8041 - DNA, 68 bp, Homo sapiens
gatggagtctcgctctgtctcccaggctggaggcaacctctccctcccaggttcaagtgattctcctc

SEQ ID NO: 8042 - DNA, 72 bp, Homo sapiens
atgtcatatatatcatataatatatatgatacattatatgtcatatataatatatgatacattatatgtcat

SEQ ID NO: 8043 - DNA, 103 bp, Homo sapiens
tttattgagcaagctcctcagccgtgccgagtgccatgacagcagatgtggtttttgttctcacactcggtgtctggctgccgaggtaaatgtgtgcaatgaa

SEQ ID NO: 8044 - DNA, 64 bp, Homo sapiens
tctctgtggtctcactggcgtcggaaaagaaagctggacctgaatgagagtgaggacacatgga

SEQ ID NO: 8045 - DNA, 132 bp, Homo sapiens
gctaggattacaggtgtgagataccacgtccggccaacttttttttttcttttgacatggagtctcactctgtcacccaggctggagtgcagtggcaggatcttggctcgctgcaacctccgcctcccaggt

SEQ ID NO: 8046 - DNA, 118 bp, Homo sapiens
gagatcatgacactgcactccagccagggcaacacagagagactccttttcttttttttttttttttcagatggagtctcgctctgtcacccaggctggagtgcagtggtgcaatctc

SEQ ID NO: 8047 - DNA, 60 bp, Homo sapiens
gtattccattgtgtgtgtgtgtatatatacatatatatacacacatatacatatatatac

SEQ ID NO: 8048 - DNA, 95 bp, Homo sapiens
tcagatttgacccgtggtactggtgtctgcctctctctgtggagcccattgcttcacagagggcggcttctccactaatctgcagtgggatgtga

SEQ ID NO: 8049 - DNA, 58 bp, Homo sapiens
tgagactaagtctcactctgtcgcccaggctggggtgcagtggtgcgatctcagctca

SEQ ID NO: 8050 - DNA, 112 bp, Homo sapiens
gaattcactggacatggtggcatacacctgcagtcctatcacttgggaggctgaggtggaaggatcacttgagcccaggagtttaaagctgcagtgagctatgattgtacca

SEQ ID NO: 8051 - DNA, 77 bp, Homo sapiens
tatgctgatggggaatgggggcacagggtagtacaagatgctcgtgctcgtgtgtctgtgtgtctgacgtcagggtg

SEQ ID NO: 8052 - DNA, 122 bp, Homo sapiens
ccaaaacagcccctttgcagctgctgggggaggcctgtctggccagtgactgtcagtcattctgtctgtgccttctgcctggatggcctcccacagagcagtgctgagaggtcactggctgg

SEQ ID NO: 8053 - DNA, 71 bp, Homo sapiens
ttgtccctgtcgatccactctcagactctcccagtggccgggtggggtctgctgtgcaggcggccgggcag

SEQ ID NO: 8054 - DNA, 130 bp, Homo sapiens
agcttcttggaggccaggcatgacggctcatccctgtaatcccaactctctgggaggctgaggtaggaggatcacttgaggccgggatttgaagaccagcctggacaacatagtgagactccatctctac

SEQ ID NO: 8055 - DNA, 94 bp, Homo sapiens
gcgttcccagaccactgtagatcacagggattcaatcatttttgtttatcaatttaacaaatgttgctttcctttcaagtgtcagggactatgc

SEQ ID NO: 8056 - DNA, 81 bp, Homo sapiens
gcctcagtctcctgagtagctgggattacaggcacaagccaccacgcctgtctaattttatatttttagcagagacggggt

SEQ ID NO: 8057 - DNA, 58 bp, Homo sapiens
tgagttggagtctctcactgtcacccaggctggagtgcaatggcacgaccttggctca

SEQ ID NO: 8058 - DNA, 85 bp, Homo sapiens
ttgtttgtttgagacaagtctcgctctgtcacccaggctggagtgcagtggcgtgatcttatgttttttgtttttatagagacag

SEQ ID NO: 8059 - DNA, 70 bp, Homo sapiens
ttgtttttgagacagggtctcactctgtcacccggctggagtgcagtggtgggatctcgactcactgcaa

SEQ ID NO: 8060 - DNA, 104 bp, Homo sapiens
gagtgcctggcaccctagaaatccttaagtgaattaaagaatacatacatatatatatatctttcattttttagggattttttttttcagacaaggtttcactc

SEQ ID NO: 8061 - DNA, 82 bp, Homo sapiens
gtatacacacacacgtgtatatatatacacgtatatatacacacatatatatgtatatatatacacgtatttatggaattgc

SEQ ID NO: 8062 - DNA, 113 bp, Homo sapiens
tctctttgaagcaattatgaatgggagttcactcatgatttggctctctgtttgtctgttattgatgtataggaatgcttgtgatatttgcacattgattttgtatcctgaga

SEQ ID NO: 8063 - DNA, 74 bp, Homo sapiens
ctgttcaattttttggagtaatttgagaagaatcagtgttagttcttctttataacttttgtagaattcagcag

SEQ ID NO: 8064 - DNA, 86 bp, Homo sapiens
tatatttatacatatctatgcagcatatgtatcaagagtttttttaactttgaatatacataaatgcatacataaatatagatcta

SEQ ID NO: 8065 - DNA, 81 bp, Homo sapiens
tttgttttttgttttttgagatggagtctcactctgtcacccaggctggagtgcactggcccaatctctgctcactgcaag

SEQ ID NO: 8066 - DNA, 118 bp, Homo sapiens
tagcacatgactgtaattgactaaaaggagaagttttcagaggaaaataagaaaaccattttattgtattattattacttttttttgagatggagtattgctcttgtcgcccaggcta

SEQ ID NO: 8067 - DNA, 109 bp, Homo sapiens
tgtacctgtcttttgtttctcaatcaaaagatttgtcttctttttgtttttattttccttaagaataatgcaaaacacagagagctttagaagagacttttgctgtaca

SEQ ID NO: 8068 - DNA, 112 bp, Homo sapiens
aggattcagccttgggcatgcatacagtcaccctgagatgacgatggtggcagggctctccttcactgtctctttcactgatcacacccaggtttaagctctgctgattgct

SEQ ID NO: 8069 - DNA, 101 bp, Homo sapiens
tcctgagtagctggtattacaggcgcccaccaccacgccctgctaattttcatatttttagtagagatggggtttcaccatgttgaccaggctggtcttga

SEQ ID NO: 8070 - DNA, 75 bp, Homo sapiens
tgtgggcagcatcagtttcggccggcctccacattcgttctgagcagactgaagtcactgtagagtgcgcccaca

SEQ ID NO: 8071 - DNA, 125 bp, Homo sapiens
ttgggtattggtaagaaattaaatgtgaaatcattttaattcctctaaaagttatcctggaaagcatggagatagtatatttaactttcttatagagtggctaaaatgttatcctatttaatatc

SEQ ID NO: 8072 - DNA, 58 bp, Homo sapiens
tgagatggagtctcgctctgtcgctcaggcttgagtgcagtggtgtgatcacagctca

SEQ ID NO: 8073 - DNA, 169 bp, Homo sapiens
tatatatatatgtatgtatgtatagtatatatatgtgtgtatatatgtatatatgtgtgtatatatgtatatgtgtgtacatatgtatatatgtgtatatatgtatatatgtgtatatatgtatatatatgtgtgtatatatgtgtgtatatatgtgtgtgtatatata

SEQ ID NO: 8074 - DNA, 128 bp, Homo sapiens
ctgtgcttttcccatggtcttcacaaccagcagaccaggagattccctcccgtgcctggctcgctgggtcccatgctcacagagcccagcaagctaagatccattggcttgaagttcttgctgctagt

SEQ ID NO: 8075 - DNA, 75 bp, Homo sapiens
gggttcagtgcctgcagacttaaccacaagggtacacctgtgacactgtgagtctaacagaaaagcataaaatcc

SEQ ID NO: 8076 - DNA, 59 bp, Homo sapiens
gagcaaggaggaagctgggaagaaagtccccaattctgtctctcccacactcccagctc

SEQ ID NO: 8077 - DNA, 85 bp, Homo sapiens
ttattgctctaagccactgtttctctcatcctgtgactcagtctacactgggaatggatcatgtagagtcatacttaggcaatag

SEQ ID NO: 8078 - DNA, 137 bp, Homo sapiens
tattgggtgtgtgtgtgcatttgcatgtgcatttgcatgtgcatgtgtgtgtgtgtgtgtggtgtcttctctaactctgtccatacgggttctcattctccaggacctgtctgcatggtttaggcttttaccaatat

SEQ ID NO: 8079 - DNA, 94 bp, Homo sapiens
gctttttatatctgtgtgctctggtgttggatatatatatatatatatatatatatatatatatatatatattccaattgtaatgatttcttgc

SEQ ID NO: 8080 - DNA, 95 bp, Homo sapiens; identical to SEQ ID NO: 68

SEQ ID NO: 8081 - DNA, 93 bp, Homo sapiens; identical to SEQ ID NO: 69

SEQ ID NO: 8082 - DNA, 80 bp, Homo sapiens
tcctaaacaaatgtagtctctctctctctctgtgctgaactgcctggatctgggtgagggttgacacaaatacacctgga

SEQ ID NO: 8083 - DNA, 106 bp, Homo sapiens
acagatttttgtgtgttaattttaaatactgcaactttactgaatttgttcattagttctaacagtttttggggagtctgtagtgtttctatatataagattatgt

SEQ ID NO: 8084 - DNA, 87 bp, Homo sapiens
acacacacacgtatatatgcatatatgtatatatacatatatacgtatatatgtatatatatgtatatacatacatagtgtgtgtgt

SEQ ID NO: 8085 - DNA, 95 bp, Homo sapiens; identical to SEQ ID NO: 68

SEQ ID NO: 8086 - DNA, 93 bp, Homo sapiens; identical to SEQ ID NO: 69

SEQ ID NO: 8087 - DNA, 95 bp, Homo sapiens
tgggtgcctaaggaaaatgatggtaaatagatgttgacgtgggtgtcagttgccagtgatgacagctgtaaccataggagtagctgaggtgtcta

SEQ ID NO: 8088 - DNA, 61 bp, Homo sapiens
ttggtgtggcctttgatcccctctgctctccactggtgagtaaagagagaggtcagaccag

SEQ ID NO: 8089 - DNA, 83 bp, Homo sapiens
acggaaaaacagatgacagcctcagttcagctccttgatttctaagctgtttccctgcgggctgagagctctggggtgacgtc

SEQ ID NO: 8090 - DNA, 81 bp, Homo sapiens
agtcagtatttattttgttattgcaggagtagccttctgtttaaaatgacaccttctcttgcaattgaaatcttactggct

SEQ ID NO: 8091 - DNA, 58 bp, Homo sapiens
tgagacggagtctcgctctgtcgctcaggctggattgcagtgatgggatctccgctca

SEQ ID NO: 8092 - DNA, 80 bp, Homo sapiens
acatatataagattttaataagattatatatatatgtgtgtatacatacatgtatatataacaaaatatatatataatgt

SEQ ID NO: 8093 - DNA, 58 bp, Homo sapiens; identical to SEQ ID NO: 2224

SEQ ID NO: 8094 - DNA, 56 bp, Homo sapiens; identical to SEQ ID NO: 335

SEQ ID NO: 8095 - DNA, 71 bp, Homo sapiens
tgtaaatgtatatgtatagatagacatgcatgtgcatatatatgcatgctatatatatatatatatttgca

SEQ ID NO: 8096 - DNA, 84 bp, Homo sapiens
gtcataaggcacaagtttcagagcagtgttgttacatggcgtaggtaactggtgcctaagtgtgactccctaaccacagtgctc

SEQ ID NO: 8097 - DNA, 70 bp, Homo sapiens
ttagcatgtctctttatttattgatgaaaatctcagaggagaattgtgtctggaataaagaaatagctaa

SEQ ID NO: 8098 - DNA, 114 bp, Homo sapiens
attgttaaagtggctaaatcctgtgatgatggtgattctttggtttttgggtttattgttattttttaattactaatgatcaccttgttcaaaagaatgtttttcatttccaat

SEQ ID NO: 8099 - DNA, 94 bp, Homo sapiens
ttacccattttttatatcagttatattcaggggctatatgaatattatttttcatataatgtggagaaagtgtactgctatgacaagagggtaa

SEQ ID NO: 8100 - DNA, 58 bp, Homo sapiens; identical to SEQ ID NO: 884

SEQ ID NO: 8101 - DNA, 56 bp, Homo sapiens; identical to SEQ ID NO: 885

SEQ ID NO: 8102 - DNA, 81 bp, Homo sapiens
gcacatgatacagtggaagagatacttgtaataattttatgttaatattttgtgtatcatcatcttactttttgcatgtgc

SEQ ID NO: 8103 - DNA, 101 bp, Homo sapiens
tgataggaaatggttggagtgtaatttgtagtataagaaagcatgctggccttgaggaaaagcttttttgtatttaaatgtaatgacacattttaagtaca

SEQ ID NO: 8104 - DNA, 67 bp, Homo sapiens
gtgtgtgtgtgtgtgtatatagcatatgtgtatacatacacacacacacacacacacacacacacac

SEQ ID NO: 8105 - DNA, 77 bp, Homo sapiens
agaggagtcatttaccagttggagaattagagattctaattctaattctaattctccaattgctatcaagtttccct

SEQ ID NO: 8106 - DNA, 101 bp, Homo sapiens
caggaggatctaatctactctggagcatcagaaacggcttctcagaggaagtagcttgtgaagtttgacaagggtggccatataacctatcatccaaactg

SEQ ID NO: 8107 - DNA, 82 bp, Homo sapiens
aaatttgtgggttcctaaaatactgagagaaatatgtgagctcaggagatttctcatgttcatcaggaggttttgcaaattt

SEQ ID NO: 8108 - DNA, 105 bp, Homo sapiens
ggttcccctcattgcaggagtcttcatacaggatctgaggctctgtctgggtctgagaagaaataagatttgtctagggattttgctggtaaggctaagggaacc

SEQ ID NO: 8109 - DNA, 119 bp, Homo sapiens
tcattctttttatggctgcatagtattcctgtgtgtgtgtatgcatatatatatatatatatatatatatatatatatatatatatatataatattttgtttatccattcatccagtga

SEQ ID NO: 8110 - DNA, 81 bp, Homo sapiens
gctgctctaagtcactgtgtctctatgtggaggtgactcatattccacttcccacaaagtggcatatagattggtggcagc

SEQ ID NO: 8111 - DNA, 93 bp, Homo sapiens
ctgaagttatgagaatggagttaacaataaaaagcttgtattgcatcgttgccttttaatagcttgtattgtaaaagctgttttttatctcag

SEQ ID NO: 8112 - DNA, 111 bp, Homo sapiens
gattttcttggctgtacgggctctgttttggttccatatgaaatttaaagtagtttttttcaaatggtaacttgtaagtttaaaaacgtgctccatttttcagttaatatc

SEQ ID NO: 8113 - DNA, 113 bp, Homo sapiens
gtgagtatcattttcttttccttgatcttagagaaacagctttcagcttttatccattcagtcggatgttagcagtgtgtttgtcagatatggcttttattgtgctgagttac

SEQ ID NO: 8114 - DNA, 58 bp, Homo sapiens; identical to SEQ ID NO: 1555

SEQ ID NO: 8115 - DNA, 88 bp, Homo sapiens
tgatttctatttttttttctattaaaataaagctgctgtggacattcgtttacagatctttgtatcttagagtagaatgtgtggatca

SEQ ID NO: 8116 - DNA, 97 bp, Homo sapiens
atatatctacatataaatgtatacatgtatgcacttatacatatatacatatatataagtgtgtacacatgtatatatttatatgtagatatatatg

SEQ ID NO: 8117 - DNA, 120 bp, Homo sapiens
catatatatgtatgtatatgtatatatactgtatagatgtatatatgtatatacacagcataagtatatatgtatatatagtatattacacagtatatgtatatgctacatacatacata

SEQ ID NO: 8118 - DNA, 65 bp, Homo sapiens
atatctatagatatgtatatgtctatatatacatgtatatatgtaaatgtgctatctatagctat

SEQ ID NO: 8119 - DNA, 117 bp, Homo sapiens
cttatattttagaatcagggagtacatgtgcacgtttgattagtatatatttaaatatatgtggctatattgatgttttggatcatgtgaattcattattgaaaactgagatatctg

SEQ ID NO: 8120 - DNA, 83 bp, Homo sapiens
catatgtattgcatgtaatagaatatatatttttatatgtatcacatgtaatagaatacttatatttttatatgtatcatatg

SEQ ID NO: 8121 - DNA, 77 bp, Homo sapiens
ccattttcattcaatttttgtatatgctatgagaaatgaattaaagttctttcttcttgcatgtaaatggtaaatgg

SEQ ID NO: 8122 - DNA, 87 bp, Homo sapiens
gtaagaatgcatttaattatgtatgtttatgtatatatcctgtgcatatatatgtatgtgtgtgcttatgtaattatatgtagttac

SEQ ID NO: 8123 - DNA, 217 bp, Homo sapiens
tatgtataacattaagatgttatatataacattaatatataattatgttatatataacattatataatgttatatataacattatataatgttatatataacattatataatgttatatataacattaagatgttatacatatatatgtatatatatacacacacatatataggtatatatataggtatatataggtgtatatatataggtatatat

SEQ ID NO: 8124 - DNA, 76 bp, Homo sapiens
tatatacctatatatatacacctatatatacctatatatatacctatatatgtgtgtgtatatatatacatatata

SEQ ID NO: 8125 - DNA, 95 bp, Homo sapiens
gtaaaaaagagatatatgtatatgtatatgtatatatacatgtatatgtatatacatgtatatgtgtctatatatacatgtatatgtatatgtat

SEQ ID NO: 8126 - DNA, 89 bp, Homo sapiens
atttaaaaacatacacatacatatgtatatatgtgtatgtatatatctgtatatgcacgcatgtatatatgtatgtgttatatgtaaat

SEQ ID NO: 8127 - DNA, 108 bp, Homo sapiens
gtgtatagatgtgtgtgtgtgtatacatatgtgtgtatgtttatatatatatatatatatatatatatacacatatatatatatatatatatgttgctatatacccac

SEQ ID NO: 8128 - DNA, 117 bp, Homo sapiens
ttccaagtgtagcatttatgatgataagtgtttgaaaggtgtttcattttggtggtaggttgtttccatgaaacttttctcctgcatttttcagtcacaagtaattgcttttgagag

SEQ ID NO: 8129 - DNA, 84 bp, Homo sapiens
tcaagtcagtttcctgtagatgggatttagttctgttctgtaacaatgcacactgaatttctcatttgcccttaagctccttgg

SEQ ID NO: 8130 - DNA, 146 bp, Homo sapiens
atatatgtatatgtgtgtatatatatgtgtatatatacacatatatatgtatatatgtgtatatatacacatatatacacatatatatgtatatatgtgtatatatacacatatatacgtatatatatatatatatatatatagtg

SEQ ID NO: 8131 - DNA, 95 bp, Homo sapiens; identical to SEQ ID NO: 68

SEQ ID NO: 8132 - DNA, 93 bp, Homo sapiens; identical to SEQ ID NO: 69

SEQ ID NO: 8133 - DNA, 115 bp, Homo sapiens
agattttcttaacacatagggtaggttcctttatttacttgttagcttgatgtatggttattatttatttcattacactgtggattgaggacttaggtatgttatttgattatct

SEQ ID NO: 8134 - DNA, 95 bp, Homo sapiens; identical to SEQ ID NO: 68

SEQ ID NO: 8135 - DNA, 93 bp, Homo sapiens; identical to SEQ ID NO: 69

SEQ ID NO: 8136 - DNA, 56 bp, Homo sapiens
ggtaggagcagaatctgatgatttgagttattaggttcaaaagttctgcttttatc

SEQ ID NO: 8137 - DNA, 105 bp, Homo sapiens
ctgaggagtagggtaggtttatcagggagacacagaactcacagagctgaagttttcctccaaattccagttctcttactgtgtggtggtcattcttaaattcag

SEQ ID NO: 8138 - DNA, 117 bp, Homo sapiens
gtagacaaggtactctggattaactggctaaatttgttttattttattttattttattttattttattttttgagatggagtctagctctgtcacctgggctggagtacagtggtgc

SEQ ID NO: 8139 - DNA, 117 bp, Homo sapiens
ggacttcagtactgtgttgaagaggaatggtgagaatgggcattcttgtcttgttccagctctcagagggaatgctttcaacttgtccccgttcagcattatgttggctgtgggttt

SEQ ID NO: 8140 - DNA, 111 bp, Homo sapiens
agcttttagaattaaacaaaatgcaagtgttaggccttcaccacaacagtactgaattagaacttctgttaatggggccgtaaatgtacaggtttaaattccacaattgct

SEQ ID NO: 8141 - DNA, 73 bp, Homo sapiens
gggatacaccccaaccacattctctactgaatttatgcgtcatgtcaaaagtgagtgtggtcttgtgtggact

SEQ ID NO: 8142 - DNA, 98 bp, Homo sapiens; identical to SEQ ID NO: 1311

SEQ ID NO: 8143 - DNA, 94 bp, Homo sapiens
tgtaagacctgtgatgaagcctacacacattccatgccatgacttacttgccatgaaagaagtcatgctggagaggctggtacagtggcttaca

SEQ ID NO: 8144 - DNA, 76 bp, Homo sapiens
gaggaaaatggaaagagtaagtgctttaccacatttcttacatgcgtagggctttttttttctttttttttttttc

SEQ ID NO: 8145 - DNA, 81 bp, Homo sapiens
gtgtgtatgtgtgtgtatatatatacatatgtgtatatatatacatatatatgtgtgtatatatatataaatggcctacac

SEQ ID NO: 8146 - DNA, 96 bp, Homo sapiens
ttttcactggcgcttcccctagttctctctggttaactaggtggcatatggtttacctgattacttttacaaaacaaggggtattgtttttgagaa

SEQ ID NO: 8147 - DNA, 186 bp, Homo sapiens
tatatatatatacatatgtatatatagtgtatatatagtgtgtatatagtgtgtatatatatattgtgtgtatatatatatatagtgtgcatatatatatagtgtgtgcatatatatatatatatatagtgtgtgtatatatatgtggtatagactctagtgtatgtgtgtatatatatatatgtg

SEQ ID NO: 8148 - DNA, 89 bp, Homo sapiens
tctctgacaccaaatattatttttataattctatcagctgaagatggattgggttgataaatagtatgacaatgaatttgcattggaga

SEQ ID NO: 8149 - DNA, 75 bp, Homo sapiens
cagggaaaagaacccagaagtctgctatgccggcaaaagggtaagaatctcagacttctggtctctctctctctg

SEQ ID NO: 8150 - DNA, 95 bp, Homo sapiens; identical to SEQ ID NO: 68

SEQ ID NO: 8151 - DNA, 93 bp, Homo sapiens; identical to SEQ ID NO: 69

SEQ ID NO: 8152 - DNA, 58 bp, Homo sapiens
tgaggcggagtctcgctctgtcacccaggctggagtgcagtggcgcaatctcggctca

SEQ ID NO: 8153 - DNA, 81 bp, Homo sapiens
agggtctctcactctgtggcccaggctggagtgcagatcatggcttactgcggcctccacctctcaggttcaagtgatcct

SEQ ID NO: 8154 - DNA, 58 bp, Homo sapiens
tgatactgagtctcgctctgtcactcagtcgggagtgcagtggcgtgatctcagctca

SEQ ID NO: 8155 - DNA, 95 bp, Homo sapiens
attaagggtcacttgagaatatttataaaactatatttgtaaataatgtccattatttccaaatgtaatgtgatttttattctaagccacttggt

SEQ ID NO: 8156 - DNA, 105 bp, Homo sapiens
gctcaattgatattattcctttgtactctccactgttttactcactgtaccccaaaggcaagaagtgatttagttgttgggtaagtttgggaagaatagacaggc

SEQ ID NO: 8157 - DNA, 95 bp, Homo sapiens; identical to SEQ ID NO: 580

SEQ ID NO: 8158 - DNA, 93 bp, Homo sapiens; identical to SEQ ID NO: 69

SEQ ID NO: 8159 - DNA, 68 bp, Homo sapiens
tgtatgtgtgtgtatatatgtgtgtgtgtatatatatatatacctacacacagttatatatatataca

SEQ ID NO: 8160 - DNA, 56 bp, Homo sapiens
gtgtgtatatacgtatatatgtatacatgtgtatatatgtatatatgtatacatat

SEQ ID NO: 8161 - DNA, 139 bp, Homo sapiens
atatatatgcatgtatatatgtgtgtatataagtatgtgtatgtttatatgtgtgtatatgtatatatacatatatgtatgtatatatacatatatgtatgtatatatgtatatatgtgtgtgtatgcacacatacata

SEQ ID NO: 8162 - DNA, 149 bp, Homo sapiens
attttatatatatataatatatatatgtacatgtgtatatatgtgtgtatatatgttgagatgcttcacaatatatatgtatgtatatgtgtatatatacacatatgtatattatatatgtgtgtatatatgtgtatgtgtatatatgc

SEQ ID NO: 8163 - DNA, 103 bp, Homo sapiens
gggttcagaaatgtgactttttctgttttatattgttattttaaaccactaattttgggataatttgttacaaagcaatagaaaactgcatcagactgaatct

SEQ ID NO: 8164 - DNA, 93 bp, Homo sapiens
gtcacatttctgaaccctacaggcaggaaaagttaggacaggagccatcaagggaccattctcacagtctctgtgggtcaggaatctgtgcac

SEQ ID NO: 8165 - DNA, 60 bp, Homo sapiens
ttgagatggagtctcactctgtcacccaggctggagtgcagtgcagtgtgacaatcttgg

SEQ ID NO: 8166 - DNA, 69 bp, Homo sapiens
ggctctgagaggtgcattttgctttgacccagtcctctgtggcccagtgtctgtgtgtctctgagagct

SEQ ID NO: 8167 - DNA, 96 bp, Homo sapiens
tttacatatggttgttatggtgatgggatgaagaggagaattgtatattattttacaatgtagaaaaatatctggatcacaaagccttgatgtggg

SEQ ID NO: 8168 - DNA, 110 bp, Homo sapiens
cctacatgccgagctgtgatgaccgttttggggcttccgggctatttttttctttactatctcttgactttaagcctgagttctgatcatggagttataggggacagagg

SEQ ID NO: 8169 - DNA, 104 bp, Homo sapiens
cacggtaaaacatgtatgggtgtgtatatgtatgtgtgtgtgtatatatgtatatttacttatatacacatagatatatacatattatatatgtatttaaaatg

SEQ ID NO: 8170 - DNA, 95 bp, Homo sapiens; identical to SEQ ID NO: 68

SEQ ID NO: 8171 - DNA, 93 bp, Homo sapiens; identical to SEQ ID NO: 69

SEQ ID NO: 8172 - DNA, 114 bp, Homo sapiens
gctgtcttatctatgttttactgtctcctctttctggatgctcatagttagaagagaagtgatttccttgaaatgcatgaggctagaaacagagctggaacttaaagtggcggt

SEQ ID NO: 8173 - DNA, 79 bp, Homo sapiens
gtatatatatatatgacatatgtgtgtgtatgatatatatgtatcatatcataaaatatatataaatatatatatatat

SEQ ID NO: 8174 - DNA, 114 bp, Homo sapiens
gtcactgcgcccggccggtacactgatagctattttatttgttatcattttatataaaactagatggaaaacagatattatgtcagctttttagtctgccaaggtaagtctgat

SEQ ID NO: 8175 - DNA, 89 bp, Homo sapiens
tccaactaagctgctcccaattttccaatgcatagaaataaatgtgtatttatttctattataagaaatattaagtgtttattgttgga

SEQ ID NO: 8176 - DNA, 119 bp, Homo sapiens
tccaactttgttctttttgcttagggttgtcttggctatgcgagtcttttttggttccatatgaaatttaaagtagttttttccaattctgtgaagaaagtcaatagtagcttgatggg

SEQ ID NO: 8177 - DNA, 102 bp, Homo sapiens
acaaagatttgaaaagtccagaaacataggatagaacttatatttaagtatatataccattgttcttgtgtttacagaattttgggcattttatacttttgt

SEQ ID NO: 8178 - DNA, 112 bp, Homo sapiens
tcccagtgtgctgggattacaggtgtgaaccaccatgcctgcctgtatcttgtatatttttaaaagtgggccaggagcggtggctcacgcctgtaataccagcactttggga

SEQ ID NO: 8179 - DNA, 68 bp, Homo sapiens
ttgtttgagacagagtctcactctgtcacccaggctggagtgcagtggtgtgatcctggctcaagtga

SEQ ID NO: 8180 - DNA, 104 bp, Homo sapiens
cagtgtaaggatagttttctaaaatgactgataatcctattataatatttgattttcaaaaaataggtcttttgtcaattatttttgctgatactccttcattg

SEQ ID NO: 8181 - DNA, 109 bp, Homo sapiens
ggaacgaggaggaggtgggctgcgggcagggtaagcagcctagggaggcccgcaaagacctccctgggtccctgcgtgccatcagtacccctatctttcccttccttcc

SEQ ID NO: 8182 - DNA, 77 bp, Homo sapiens
tgctctgtcacccaggctggagtgcagtagcacgatcatagctcactgcagtctcagtctcccgggctcaaggggta

SEQ ID NO: 8183 - DNA, 86 bp, Homo sapiens
gaaagtgttgggaaagtgttgggattacatgcgtgagccactgcatatggtatgtgtccttttttttttttttttgacactgagtc

SEQ ID NO: 8184 - DNA, 63 bp, Homo sapiens
tagatggagtctcactctgtggctcaggctagagtgcagtggcgtgatcttggctccctgcta

SEQ ID NO: 8185 - DNA, 80 bp, Homo sapiens
cagttggtctctgagtcacactgtgaaatagtattcagagctgaggcttcatctgcagtgcttgattcaacagatccctg

SEQ ID NO: 8186 - DNA, 79 bp, Homo sapiens
cgtatgtatttttgtgactgtacacactgaggtgtactgatgacagtcacataggtgtaacagttacgagaagatgaac

SEQ ID NO: 8187 - DNA, 85 bp, Homo sapiens
tgaaaggctgtgagtctgtgtctctgggctcctgtgactggcaggtttatctctacccaggagctgcattgaccatgaactttgg

SEQ ID NO: 8188 - DNA, 110 bp, Homo sapiens
tggaatgttgtgcagctgtgcagagcgtgagtctcaaatgtgctaattaaatatgttttttagcaagaatggaatgtagcagcatttgaatggcttcaaaaaacattcca

SEQ ID NO: 8189 - DNA, 90 bp, Homo sapiens
tgagcattattccatgttttatgtagacataaaatatcattgtttttatttgatgcatgagagtctacatattatatgtatggtgattta

SEQ ID NO: 8190 - DNA, 101 bp, Homo sapiens
ttttctaggattgatattctcttcctttcaagtatcataggccaatctttactcattttgtttatttgaaaggttatggatttctaagtaagtctgggaaa

SEQ ID NO: 8191 - DNA, 107 bp, Homo sapiens
ggcatggtgggtggtgcatgcctgtagtcccagctacttgggaggctgaggtggaaggatggcttgagcccaagaggtagagggttgcagtgagccaagattgtgcc

SEQ ID NO: 8192 - DNA, 114 bp, Homo sapiens
cagtgcagaagccctcatcagaaagaatcctccatatttctttttttttttttttttgagacggagtcttgctctgtcacccaggctggagtgcagtggcatgatctcggctca

SEQ ID NO: 8193 - DNA, 73 bp, Homo sapiens
tttctcaaaaggacctgacagcttgaatgggaaatcccattcccactctcactgactctcaagccttgaggaa

SEQ ID NO: 8194 - DNA, 71 bp, Homo sapiens
tgaagtgtgaaaaagttgtagagaccagttcagtagccagagctctgtttctgtgacttagatatattcca

SEQ ID NO: 8195 - DNA, 81 bp, Homo sapiens
tctcactctgtcactgaggctgcagtgcagtgatgcaatcacagttcactgcagtagtccagcctgggcgacagagtgaga

SEQ ID NO: 8196 - DNA, 117 bp, Homo sapiens
atccagatgggatagtgccttctatgaaaggtagccagatggataaaggtgagactcatgtcacagacactgactgagtgcctgccaggagatactgatggaggttaacatatgggt

SEQ ID NO: 8197 - DNA, 134 bp, Homo sapiens
gtaacgtagcaagattctgtctctaaaaaaaaaaaaaatttttttttttgagacggagtctcgctctgtctcccagactggaatgcagtggtgtgatctcgactcactgcaacctccgcctcctgggttcaagc

SEQ ID NO: 8198 - DNA, 116 bp, Homo sapiens
agaagttacttggattagttctgtattttaaaaattcagcatggttatgttattcattttaaataaagttgggttcactggaatacagttaggtttacattcagttttaggcttct

SEQ ID NO: 8199 - DNA, 79 bp, Homo sapiens
gaggtacagtgtgcactatagttaattttatgcagttatgatttaatactgcatctttatatgtgtttacatttatctc

SEQ ID NO: 8200 - DNA, 66 bp, Homo sapiens
gacatatacatgtatgtatatacatatatatgtgtgtatgtatatatacatgtatgtatatatgtc

SEQ ID NO: 8201 - DNA, 71 bp, Homo sapiens
gggcaaatctgtcaacatttcgtactgccaaacttaatgaaaggtaggaggactgatgatagagaggaccc

SEQ ID NO: 8202 - DNA, 85 bp, Homo sapiens
gcatctagaaagcaaattcttagactgatatttaaaaacaaacacaaggtattcaatagaagtttggagattggcttttaagtgc

SEQ ID NO: 8203 - DNA, 89 bp, Homo sapiens
ttgtcttcagtgaagagaaacatttggcagggctggcatttaagttcagtctcagctttttttcttttttttttttttttttgagacag

SEQ ID NO: 8204 - DNA, 103 bp, Homo sapiens
gtacttttccagtggtaggtataaagttaggcatattgagtgtagacattttgttgaaaagtataaaatgagttatgctattatgaattcttttgaaaagtac

SEQ ID NO: 8205 - DNA, 75 bp, Homo sapiens
tatacatgtatatacatatatgtagatgatatagatttatgtatctatatatacatatatgtgtttgtgtgtgtg

SEQ ID NO: 8206 - DNA, 115 bp, Homo sapiens
tataatgaaattggaaattggaaaatctagggttaatgtccagctctgtcactggctctctgacgtaaaataagctgcttgatgattgctctgaatctcaattttcttcagtata

SEQ ID NO: 8207 - DNA, 113 bp, Homo sapiens
ctcccactcatttagcatccctggctactctgtcctcttttggaaagcttctgtctgtctctctgaagtgggtaaaagagacaagggtggtggtggtagttgctctgggggag

SEQ ID NO: 8208 - DNA, 92 bp, Homo sapiens
tcagagaggagattgaggccttggctcactgattggctcacagtttcatagctgccaaaggacggagctagaacacaatcacagatgtctga

SEQ ID NO: 8209 - DNA, 91 bp, Homo sapiens
ttatgaaataaagtctcactgtcactcaggctggagtgcagtggcgcaatcatagctcactgccatgtgagagtgagcctcaaactcatga

SEQ ID NO: 8210 - DNA, 57 bp, Homo sapiens
tgagatgagtctcactctgtcacccaggctggagtgcagtggtgcaatctcagctca

SEQ ID NO: 8211 - DNA, 110 bp, Homo sapiens
tgtgacttgtcaacacatccctaaatgtctaatatgaatgaatgaatgaatgaatggtaatcttggttggtttatgtaactcaatggcattttgtagatgttaaggaaca

SEQ ID NO: 8212 - DNA, 94 bp, Homo sapiens
ctaggggaagagcagcctcttttaaaaaaaaaatgttattttggaaattttttattttactttttttgagacaggctctgactctgtcacctag

SEQ ID NO: 8213 - DNA, 58 bp, Homo sapiens; identical to SEQ ID NO: 4572

SEQ ID NO: 8214 - DNA, 82 bp, Homo sapiens
agcctgggcaacagtgtaagaccctgtctcaaaaaaaattttttttttttttgagatggagtctcgctctgtcacccaggct

SEQ ID NO: 8215 - DNA, 86 bp, Homo sapiens
atgagaattttgcatggcccttactggggagtttcctcctcatttgactgatgtgagtagagactcttagagccagccaccatcat

SEQ ID NO: 8216 - DNA, 111 bp, Homo sapiens
cacccagtaatgcaaggtttacttttaatggggtgctagtttttaatttgtttttaatgtagttttgaggagccagcatactccaaaaagatgagatccttcagaagggtg

SEQ ID NO: 8217 - DNA, 94 bp, Homo sapiens
gtttttctttatctgttatagtagatccagtttggcttgtttctttatttttacaaacaaaccacagaacaaggttaacagagagaggaagggc

SEQ ID NO: 8218 - DNA, 95 bp, Homo sapiens
tagagtgtctggattatgttatgtctctacaaagaagactgattttcttaatttatttttcttttcttctttttctgagacagagtctcgctctg

SEQ ID NO: 8219 - DNA, 96 bp, Homo sapiens
aagtatgcactgtctctgcaagttgccttgaaaatggaaacttgatcaaagaaagtttgttttttttcaagtgaacagtaaagaattataatattt

SEQ ID NO: 8220 - DNA, 78 bp, Homo sapiens
ggggagctgtaagtcctgcactttctcacatctgatgggtccgtgggacagtcacaagagagagaggaacgtgcctcc

SEQ ID NO: 8221 - DNA, 62 bp, Homo sapiens
agacagggtctcactctgccactctgtcacccagactggagtgcagtggcagaatctctgct

SEQ ID NO: 8222 - DNA, 82 bp, Homo sapiens
tatgtttaaagtctatatatatatgtgtgtgtatatatatacatatacatatatatatatataaaactttttttcagatata

SEQ ID NO: 8223 - DNA, 58 bp, Homo sapiens; identical to SEQ ID NO: 1847

SEQ ID NO: 8224 - DNA, 109 bp, Homo sapiens
gcatgcatctgtgtgtaggtgtggctgtgtgtatatacccattaattttttttgttttttcactagtaattatatataagtagtttggaaatttactattgatgtttgt

SEQ ID NO: 8225 - DNA, 90 bp, Homo sapiens
gtttttgatgtcgcagatactgcatcaggaactgattggataagaatcagtcaccatcagttcctaatgcattgccttcagcatctaaac

SEQ ID NO: 8226 - DNA, 117 bp, Homo sapiens
aggtctaacacggatggctgtgagttggcttaatctcagctggcaactgtgagatgttcatacaatccctcacagtggtctctgggattatgctaaacagagcaatttcctagccct

SEQ ID NO: 8227 - DNA, 89 bp, Homo sapiens
atctatccatatctatatctatatctacatattatgattatataaaattgtagtctatctatatatactatagatatagatatatagat

SEQ ID NO: 8228 - DNA, 94 bp, Homo sapiens
cactgactcctgagaaagagactgctcatagacttctgctctagtaagttgtgattctatttgtctgtctgtctctccaatttgggggacagtg

SEQ ID NO: 8229 - DNA, 69 bp, Homo sapiens
gctttgctcacagtagatactgaacacgttttttttaattcagtgttacttacaaatgtgagttttagc

SEQ ID NO: 8230 - DNA, 112 bp, Homo sapiens
tatgtatacttgcatatatacatatatatgtatgtatatgtgtatatatacatatatgtatgtgtatatatacatatatgtatgtatatgtgtatatgtgtatgtgtatata

SEQ ID NO: 8231 - DNA, 100 bp, Homo sapiens
ggaattacctcagtcaatctcatgggaggtggaatgggatgggcagaattccaaaagtttatttgtaaatgagttgttttgaaagaggaaaacacattcc

SEQ ID NO: 8232 - DNA, 75 bp, Homo sapiens
gcatgtgtagtgtgtgtgcactgtgtgtctacgtgagatgtgagatgtgcagtgtgtgcgggatattttgcatgc

SEQ ID NO: 8233 - DNA, 63 bp, Homo sapiens
ttgagatggaatctcactctgtctgtcacccaggctggagtgcagtggtgtgatctcggctca

SEQ ID NO: 8234 - DNA, 104 bp, Homo sapiens
gcttaaataggtttatgtggatctggaaataatttttaaacattttttatttaatatgggtatggcctagattttttccagagcttataaaaatgtggaaaagc

SEQ ID NO: 8235 - DNA, 99 bp, Homo sapiens
gaggtataatatgcaaagaatttagtgcaataattggcatgtcataaacttctaataaatgctagttgtttgtattaataaaactgtttttcttatctt

SEQ ID NO: 8236 - DNA, 171 bp, Homo sapiens
atatatatatattttatacatatgtatgtgtgtatatatatacacacatatatatgtatatatatgtgtgtgtgtatatatatatatacgtatatatatacatatatatacatatatatgtatatatatatatacatatatatacatatatatatatatgtatatatatat

SEQ ID NO: 8237 - DNA, 114 bp, Homo sapiens
ggcctatattggctttagacatgccttccttagtaagcttaagtatttctagtttatatatatatattttattatactttaagttctagggtacatgtgcacaatgtgcaggtt

SEQ ID NO: 8238 - DNA, 123 bp, Homo sapiens
gtaagataacttatgtggttttgatttgcatttctctgatggttattgatattgagcatttttttatatatctgttggccatttgtatgtattcaagaaatgtctattcagatttttgcccat

SEQ ID NO: 8239 - DNA, 58 bp, Homo sapiens
tgagactaagtctcgctctgtcacccacgctggagtgcagtagcgcgatcttggctca

SEQ ID NO: 8240 - DNA, 76 bp, Homo sapiens
atgttatacatataatgttgaatatatatgtattatatatataatacatatatattcaacttgttatttataatgt

SEQ ID NO: 8241 - DNA, 83 bp, Homo sapiens
gataactttctatttctattttggaatattgtcttacaatatttttttattggacaatttctactagaagtagattgtccctc

SEQ ID NO: 8242 - DNA, 115 bp, Homo sapiens
actctgttgatagtttctttagctgcacagaagctctttaattagacccaatttgtcaatatttgtttttgtttcaatggcttttggcacctttgtggtgaagtatttgccaagt

SEQ ID NO: 8243 - DNA, 114 bp, Homo sapiens
tttcacttttccacttagttattaactttgtaacacttctcattttctttattatataaatcatatggtaaagggaaagaaatgaatttaatagagaactatgttagggtgaaa

SEQ ID NO: 8244 - DNA, 104 bp, Homo sapiens
attgctttgggcagtgtggccattttaacaatattgaatctttctatttgtgatcatggaatatttttccattgtttgtgtcctttctgatttatttgagcagt

SEQ ID NO: 8245 - DNA, 84 bp, Homo sapiens
ttcacagcctggaagaaaaactttacatgctgagctctttaataagtaatacagcatagtgaagactgtcagctttgcagtgaa

SEQ ID NO: 8246 - DNA, 76 bp, Homo sapiens
agtgcttctaattggcagcaaacctttgtttttaattttatgctctaatcatcatagtttgaccagtagaagcact

SEQ ID NO: 8247 - DNA, 87 bp, Homo sapiens
tagagaatgtacaaacatggtatacatatgtgtgtgtgtgtgtatatatatacatatatatgtatgtattccagagcattgactaca

SEQ ID NO: 8248 - DNA, 66 bp, Homo sapiens
ttgagcctatgtgtgtctctgtatgtgagatgggtttcctgaatacagcacactgatgggtcttga

SEQ ID NO: 8249 - DNA, 112 bp, Homo sapiens
tgaagtgtttttttttgtgtgtgtgttcccataaaactttatttatttatttattttttcttttattattatactttaagttttagggtacatgtgcacattgtgcaggtta

SEQ ID NO: 8250 - DNA, 103 bp, Homo sapiens
ctgttgctttcctggagggaaaagtattagaaaatggattgaatacatctttaaatgtacatagtggaattcatttcttatgccagttagaacaagcaaacag

SEQ ID NO: 8251 - DNA, 100 bp, Homo sapiens
agaagcccaatatataaaaagctgactatttatatatttgattccttaaaagcaatgaggaatacaaagcagatggtccagcattgtagatttccctttt

SEQ ID NO: 8252 - DNA, 106 bp, Homo sapiens
gataggaaaatagctacagagagaatatatacatatatatgtacatgtttggtacactgtatttgtatatgtatatgtttggtacattgaagatatttaggatatt

SEQ ID NO: 8253 - DNA, 85 bp, Homo sapiens
ggtagcctctcatggatgaagttagtctaataaaggtcatgtctaaatcagaaatacagtttattaatttttaatgagagatacc

SEQ ID NO: 8254 - DNA, 104 bp, Homo sapiens
aagccaatggctcatgtgcaatgcgatttaaatgaagtttttagcattttaaaacagtttttgctacttttttttttttttaaagcagagcagggacatggctt

SEQ ID NO: 8255 - DNA, 105 bp, Homo sapiens
caggactgctctcctctctcctcatctttgtacttttcctgggagtcaaaaatattttttgtacttttagtagagacaggatttggtggccggcgcctgtagtcc

SEQ ID NO: 8256 - DNA, 83 bp, Homo sapiens
gctcacctgtgtgtcacacaaagaacagcaatgaacgtcctgcaaaactcccgctcacctgtgtgtcacacacagagaacagc

SEQ ID NO: 8257 - DNA, 103 bp, Homo sapiens
atgtgggtgtatatatctatatatgtgtgtatatatgtgtacatatgtgcatatatatgtaatgtgtatatctatatttatatctgtatctacatatatatat

SEQ ID NO: 8258 - DNA, 113 bp, Homo sapiens
tcttgcaacccattcccacaatgaggatctctcctgtgtggctccctcaatccgatgaaaagtactagagaaaggggaaaacaaaagactcatgtggggataggcttattgga

SEQ ID NO: 8259 - DNA, 79 bp, Homo sapiens
atatatattgtgtctgtttgtgtatatatgtatatacatatatatgtatatatgcacacatatatacacatacatatat

SEQ ID NO: 8260 - DNA, 124 bp, Homo sapiens
atattccattgtgtgtgtgtgtgtatatatgtatatatatatgtgtatatgtatatatgtatgtgtatatatgtgtgcatatatacatatatatgtatatacatatatacacaaacagacacaa

SEQ ID NO: 8261 - DNA, 107 bp, Homo sapiens
agacactatatagtatagtgagagtaggagcacagtagagtgtagttagagagcagagagtaggagctacatcttatgttatcttttttcttgtatcatagaggtct

SEQ ID NO: 8262 - DNA, 78 bp, Homo sapiens
gtatgtatcatgatgaatatatatacatacatacacataagtatatgtgtatatatattcattatgatatgataatac

SEQ ID NO: 8263 - DNA, 83 bp, Homo sapiens
gctcatctgtgtgtcacacaaagaacagcaatgaacgtcctgcaaaactcccgctcacctgtgtgtcacacacagagaacagc

SEQ ID NO: 8264 - DNA, 58 bp, Homo sapiens; identical to SEQ ID NO: 1673

SEQ ID NO: 8265 - DNA, 70 bp, Homo sapiens
gtgttatatgtatgtgtttgtgtgtgcatgtgtatatatatatatacacacctatacatatatatactac

SEQ ID NO: 8266 - DNA, 82 bp, Homo sapiens
gagatgggagtctctctgtgtcacacaggctggaatgcagtggtgtgatctcagttcaccacatcctagaactcctgggctc

SEQ ID NO: 8267 - DNA, 71 bp, Homo sapiens
aggatgtatgtgtatgtatatatgtatagattcacatgtataaataacatatattcatatgtatatatcct

SEQ ID NO: 8268 - DNA, 86 bp, Homo sapiens
gtgcatggaattaaaagagaacagggtggggaaaggaatttatttatttatcaagccctacactttttctgggcaaatgtatgcat

SEQ ID NO: 8269 - DNA, 99 bp, Homo sapiens
ggtgatggcctcagtgactgcatgcaggtttccaagtccaggcccaactctactgtgtttcctgtccttggatgcatggatgtccgtgacatcatcatt

SEQ ID NO: 8270 - DNA, 74 bp, Homo sapiens
tgtgcaaccaccctgtcttagtctgtttggtaatgttagaatgccacagactcacagactgagtaacgtgtata

SEQ ID NO: 8271 - DNA, 117 bp, Homo sapiens
ttagacagacatagaaaaatgtgtatggtatgatatgatttgtgtaggagaagaagaaaaactttataaatatacattaaaaatatatatgatatacacatatactctactgtgtag

SEQ ID NO: 8272 - DNA, 119 bp, Homo sapiens
gagcatgtagattagcatcttattttaataaaatgattttatatatgtgtgtgtacatgtatatgtatatatacatataaatatgtatcttttgttgtaaacagactaatgcatcccca

SEQ ID NO: 8273 - DNA, 120 bp, Homo sapiens
ttgttctttttgcttaaaattgtcttggctatacaggctcttttttggttccatatgaaatttaaagtagttttttccaattctgtgaagaaagtcaatgatagcttgatggggatagca

SEQ ID NO: 8274 - DNA, 81 bp, Homo sapiens
actcacacagtgatctgaggcggccccaggcctgtgtcagagccggcttccaggtcaaacagtctgcctctctgtctgggt

SEQ ID NO: 8275 - DNA, 78 bp, Homo sapiens
tcattttaggtgcaggagggattcttttcttttcttttttttttttagacagagtttcgctcttgtcgcccaggatgg

SEQ ID NO: 8276 - DNA, 79 bp, Homo sapiens
ctccctcctcatgtggctgagagaacacagtctcttgtttttattcatggctgattctttatgtggctaaaggaggcag

SEQ ID NO: 8277 - DNA, 82 bp, Homo sapiens
gtgaaactttttttttttaaatttatgatctctatgttattgagatatgagaaacaatggattgaatggaagaaagtcttgc

SEQ ID NO: 8278 - DNA, 106 bp, Homo sapiens
tgctgacatcttgatattgaacttctagcctctagaactgtaagaagaatatatttttattgtttaagctacctagcatgtggtactttgttatggtgttctagca

SEQ ID NO: 8279 - DNA, 98 bp, Homo sapiens
tctctatcatatagatatatatatatgtgtgtgtgagtatatgtgtgtatatatatacatatatagtcaatttatatctttatatatttatttagtga

SEQ ID NO: 8280 - DNA, 95 bp, Homo sapiens
gagtacatttcttggtggtctcacctacatctctgccacaagcacctaaaacataaggatggtgacagatgaatcagtgcaccatgttgttactt

SEQ ID NO: 8281 - DNA, 91 bp, Homo sapiens
gtatgatgttggctgtgggtatgtcataaatagctcttattattttataatatgtaatataatttattatacataatagctcttattatac

SEQ ID NO: 8282 - DNA, 109 bp, Homo sapiens
agaattattttctaatctgtcaggtttactatttgtttttttttaactttaaaatggggcatttttaataaaaataatgaagggagaccaggatctagtgactagttct

SEQ ID NO: 8283 - DNA, 113 bp, Homo sapiens
aatgaaattcatgttgagattatgcattggtaaaaaatatagtctttgtttaaacactgtatttttgatatttttgacctagttcatttgaatcttagcaacattattttatt

SEQ ID NO: 8284 - DNA, 88 bp, Homo sapiens
tgaggtgaggtctcactgtcactcaggctggagtgcagtggcgctatcttagctcactgcaacgtctgcctcccaggctcaagagatc

SEQ ID NO: 8285 - DNA, 95 bp, Homo sapiens; identical to SEQ ID NO: 68

SEQ ID NO: 8286 - DNA, 93 bp, Homo sapiens; identical to SEQ ID NO: 69

SEQ ID NO: 8287 - DNA, 71 bp, Homo sapiens
gctgcactacccaaataaagtcttcatccttggcagtactcactgtctcagtgattggttttctgtgcagt

SEQ ID NO: 8288 - DNA, 119 bp, Homo sapiens
acatcaggatttaaagagaatatcaccagtgactttacagaattaaaaagtattgtatctatatttatatgaaatattggtctgcagttttcacatgatgtttttgtctggtttggtgt

SEQ ID NO: 8289 - DNA, 123 bp, Homo sapiens
tagcataattaatatatataacatatgtgtgtatgtatgtatatatgtatatatgtgtatatatgtgtatatgctatatatatatgtatacaaacatattttatatatacacatatatattat

SEQ ID NO: 8290 - DNA, 66 bp, Homo sapiens
tgaataatgctgagagtgggggaggagagtgatggtctctctctctcactttggctctatctttca

SEQ ID NO: 8291 - DNA, 74 bp, Homo sapiens
agtctgtcacagtgactgtgattcccaagagtttttttttttttaattattgagtcacagtaagcttgagggct

SEQ ID NO: 8292 - DNA, 74 bp, Homo sapiens
gtgtgtgtgtgtgtgtgtgtgtgtgtgtgtgtgcatgtatccatgtacctatgcatgtacttgtgtatgtgtac

SEQ ID NO: 8293 - DNA, 95 bp, Homo sapiens; identical to SEQ ID NO: 68

SEQ ID NO: 8294 - DNA, 93 bp, Homo sapiens; identical to SEQ ID NO: 69

SEQ ID NO: 8295 - DNA, 83 bp, Homo sapiens
gagatgagaagactgagagcagagagagattaaatgtgctggctcattctagactcaccttctctaatcagaattcccatttc

SEQ ID NO: 8296 - DNA, 88 bp, Homo sapiens
gaggaattgccacactgtctcactgtcttccacaatggttgaactagttttcagtcccaccaacagtgtaaaagtgttcctatttctc

SEQ ID NO: 8297 - DNA, 108 bp, Homo sapiens
ttgctaactctgtggtcttgggcctgctgcttaacctcacttgcccggtgtgtcactgtctgtctactgagaataataaaagtgtccaagtacaaaaacactctgcga

SEQ ID NO: 8298 - DNA, 90 bp, Homo sapiens
ctcagatgcttgctgctgcttcctgtgtcactccctgtctgtcttaagcaggccggtggtgcaggcagactcagccccagaacaacagag

SEQ ID NO: 8299 - DNA, 80 bp, Homo sapiens
tgaggagagaagggtgaggaagtgcggatgtctgcttcagggtgctatttggggtttcatctattcatgcttctcactta

SEQ ID NO: 8300 - DNA, 111 bp, Homo sapiens
aaagattttgtctattaactatctgaaaccctttttgttctcattaaaatatattattattaatcaaatttctagtgagagcaatgggattggataggcatgattattttt

SEQ ID NO: 8301 - DNA, 88 bp, Homo sapiens
cattcatggtgctccagaactgtgtctgtgtttctcacattctctttcgtgtctgccagagcaacattctcagcaaaccatctgaatg

SEQ ID NO: 8302 - DNA, 95 bp, Homo sapiens
agcagaatgagtctgctgaaacagccaactctgtctctgtctcccccaagccctcctagtcagaacgttctctcagcatttcagcaggtactgct

SEQ ID NO: 8303 - DNA, 87 bp, Homo sapiens
tacacacatacatatgtacatactacatatatacatacgtatatgcatgtatgaatatatatatagttgtgtgcctgtgtgtgtgta

SEQ ID NO: 8304 - DNA, 83 bp, Homo sapiens
tgggccctctcactcactcacttactctgagcgggggacaccatttctcggtaagagtatgagagccgaaggtaaagagcccg

SEQ ID NO: 8305 - DNA, 56 bp, Homo sapiens
gagacagagtctcactctgtcacccaggctggagtgcagcggtgcgaccttggctc

SEQ ID NO: 8306 - DNA, 117 bp, Homo sapiens
atctttttcccatatctaccatgttaaaggcctttgaaatctttctagtgcattcttcatgtattcaaccttcagtctttgaataaacattggtggggcactctctgtggtctaggt

SEQ ID NO: 8307 - DNA, 58 bp, Homo sapiens
tgagactgagtctcactctgtcacccaggctggagtgcagtggcgtgatctcagctca

SEQ ID NO: 8308 - DNA, 63 bp, Homo sapiens
tgttttacattgctttgtaaagttgaaagtataaaacatcaactttgaggcaatggtgggaca

SEQ ID NO: 8309 - DNA, 77 bp, Homo sapiens
ctgctctaaaacttgtctcggtctctccttctgtctcctgaggaggcaagaattggggctgctgcagacccgaacag

SEQ ID NO: 8310 - DNA, 79 bp, Homo sapiens
tgagacagagtctcactctgtcacccaggctggagtgcggtggtgtgatctcagctcactgcaacctctgcttcctggg

SEQ ID NO: 8311 - DNA, 223 bp, Homo sapiens
caccaaatatatatatatgtgtatatatatatgtgtgtgtgtgtgtgtgtgtgtatatatatgtatatatgtgtgtgtgtgtgtgtgtatatatatacatatatatgtgtgtgtatgtatatatatgtgtgtatatatacatatatatgtatatatacatatatgtgtgtgtatgtgtgtgtgtgtgtgtgtgtgtatatatatatatatatatatatagaga

SEQ ID NO: 8312 - DNA, 88 bp, Homo sapiens
agtttaagaggaaaaatgggcaagatgaatgtttgatacttttaccaaaaatttatatttcatttacttgctgatttccctgaaaact

SEQ ID NO: 8313 - DNA, 58 bp, Homo sapiens
tgagactgagtctcgctctgtcacccaggctggagtgcaacagcaagatttcggctca

SEQ ID NO: 8314 - DNA, 101 bp, Homo sapiens
atagctgtgtaactttgggcaggttgcttaacctctctgtatctcagtttcttcatctgaaaatagagacaatcatagtatgtacttacctaatcagttat

SEQ ID NO: 8315 - DNA, 105 bp, Homo sapiens
gctgagataacaggcatgagccacggcgcccgacctaatatttttcattttagaaaaggtggttattttaggcagggcatggtggctcacactggtagtcccagc

SEQ ID NO: 8316 - DNA, 113 bp, Homo sapiens
gtaaaaattaatttcaaaaactgggcaacaaagtgagaccctgtctctacaaaaagttttttttttttttgagacggagtctcgctctgtcacccaggctggagtgcagtggc

SEQ ID NO: 8317 - DNA, 58 bp, Homo sapiens; identical to SEQ ID NO: 6359

SEQ ID NO: 8318 - DNA, 118 bp, Homo sapiens
tgctttgatggaagaaaatggaatgtcctttacaatgagcttgaaactggcctgggcagttttgtatatcattattaagatttaaatattctataagcaattttattttcatatagta

SEQ ID NO: 8319 - DNA, 112 bp, Homo sapiens
gtccgcatctgattttgtatttattgggattcatagtgcttcttgaatgtgagttttttaaaaatttattttagaagtacttagccattattttttcaaatgtagtcactgc

SEQ ID NO: 8320 - DNA, 115 bp, Homo sapiens
tgtatggtaactagtttaataggttctaagcaaatgatttgtgtccaaacatacgtattagttattttattttattttgagacaagtcttgctctattgcctggggtggagtgca

SEQ ID NO: 8321 - DNA, 61 bp, Homo sapiens
gtgatctctgcctgtcagtcagtcaggagcatttcctggaggcctgctgtgtggggaacac

SEQ ID NO: 8322 - DNA, 83 bp, Homo sapiens
aacaccaggtgtggtgacgtgctcctgtaatcccaggtattcttggaggctgaggtaggaggatcacttgagctggggaggtt

SEQ ID NO: 8323 - DNA, 58 bp, Homo sapiens
tgagacagagtcaccctctgtcacccaggctggagtgcagtggcatgatctctgctta

SEQ ID NO: 8324 - DNA, 127 bp, Homo sapiens
tcaaccatgtgtgttgtatggacctagttttttaatttatacatttcaaaaatttgtatttcttagggatggggggtctctctcactgtcacccaggctggagtacagaggcactatcatagatcaa

SEQ ID NO: 8325 - DNA, 110 bp, Homo sapiens
gcccagaagttgcagactagcttgggtaacatatccagacccctctctagaaattttttttttttcagagggagtcttgctctgtctcccaggctgaagtgcagtggcgc

SEQ ID NO: 8326 - DNA, 80 bp, Homo sapiens
tgataggtgggcaccactatgcctggctagtaaatgttattatttattattattttttgagatggagtctcactctgtca

SEQ ID NO: 8327 - DNA, 97 bp, Homo sapiens
gggctgccactctcagagtgaggttagagatgccggaatttctcgtgatttttcagctgacagtctctatcactctgaagagtgagtgatcagctcc

SEQ ID NO: 8328 - DNA, 124 bp, Homo sapiens
gacttgaatgagattttgttgtattggcttttttgttttgagacagagtctcactctgtcacccaggctggagtgtagcagcgggatcatggctcactgtaacctctgcctcctgggctcagtg

SEQ ID NO: 8329 - DNA, 67 bp, Homo sapiens
ggggcattccagatgagactagagtatcaaacttttttttttgagacagggtcttactctgtcaccc

SEQ ID NO: 8330 - DNA, 56 bp, Homo sapiens
gagacatagtctcactctgtcacccaggctggagtgcagtggcatgatcatgtctc

SEQ ID NO: 8331 - DNA, 104 bp, Homo sapiens
ggaccatcaacagtactgcagagagagttctaaaaataaagagggaaagaaagaacatacttttttttttttttaaactttgtaattgcttctggagactctcc

SEQ ID NO: 8332 - DNA, 118 bp, Homo sapiens
gtatatatgtttatatatatatataaatgtgtgtgtgtgtatatatatgtatgtgtatatgtatacatatacgtgtgtttgtgtatatatatatgtgtgtatatatatatatatattt

SEQ ID NO: 8333 - DNA, 82 bp, Homo sapiens
gacccctctacttgaaagtggttgtgtaatggaagggcatgccaggttttccaatactgcagctggttacacattataggtc

SEQ ID NO: 8334 - DNA, 97 bp, Homo sapiens
tgagttcttgagagatctggtcgtttattattttattttgagacagagtttcactcttgtcacccaagctggaatgcagtggcacaatcttgactca

SEQ ID NO: 8335 - DNA, 97 bp, Homo sapiens
gccatttagctgcaaactgtctctgtctctgtttatccgagcagaacctggaaggggctggcaaggactaggcaacagatgggacagccagagaggt

SEQ ID NO: 8336 - DNA, 129 bp, Homo sapiens
tgtgtgtatatgcatgtgtgtgtatatatatatgtgtgtatatatatacatatatatatacatatatacatatatatacatatatatatacgtatatatatatgtatatatatacgtgtatatatatat

SEQ ID NO: 8337 - DNA, 59 bp, Homo sapiens
gtgtgtgcatgtgtgtctgtgagctgtgtgtgcactcatgtggctgtgtatgtgcatgt

SEQ ID NO: 8338 - DNA, 93 bp, Homo sapiens
tcctgtttggtgaggggtctattcagatttttccatttatttatttatttatttatttataagatggagtctcactctctcgcccaggctgga

SEQ ID NO: 8339 - DNA, 101 bp, Homo sapiens
cagggggctggacacagagaggagggtcaccagcctggcacagagaacacagagagcagaaaactgagccaagaaggctgccccctccaagtgtttacctg

SEQ ID NO: 8340 - DNA, 58 bp, Homo sapiens
tgagacagagtctcgctctgtcacccaggctggagtgcaatggcgggacctcggctca

SEQ ID NO: 8341 - DNA, 106 bp, Homo sapiens
tgttctctggaagagtttgtggtaaggttgatgtttttctttgtaatgtgtctggaagaattcaccagagaagccatcggtgcctggagctttctttgtgggaagg

SEQ ID NO: 8342 - DNA, 56 bp, Homo sapiens
tgatgaggtctcactctgtcacccagcttggagtgcagtggtgtgatctcagctca

SEQ ID NO: 8343 - DNA, 72 bp, Homo sapiens
aggctgcctggtctctcggtctctctgagggctgagcccttctccaagtgggccaaagtgagaaggccacct

SEQ ID NO: 8344 - DNA, 77 bp, Homo sapiens
gcacccagtcttcactgacattttattttgtacttgaattgctttaggactgtgaatttcatgattctgctgggcgt

SEQ ID NO: 8345 - DNA, 85 bp, Homo sapiens
tcatgctggtggtggtgttggcacaggggtggggcactggcaggcacaagtctgtgtgcactgtgtgcactgccatcaggggtgg

SEQ ID NO: 8346 - DNA, 116 bp, Homo sapiens
tggtttttaaatgtcgaaccaaccttgcatacatagaatccaatttgatcatgttgtataattctttttaaccattgttggatttgatttgctatgttgatctgactttctgacta

SEQ ID NO: 8347 - DNA, 56 bp, Homo sapiens
gagtcagggtctcactctgtcatttaggctggagtgcagtggtgcaactgtggctc

SEQ ID NO: 8348 - DNA, 108 bp, Homo sapiens
ttttgatgttgttgctgttgttgcttttttgagccacggtctcactctgtcacccaggatagagtgcagtggtgcaaaaacagctcactgcagcctcaacctacaggg

SEQ ID NO: 8349 - DNA, 60 bp, Homo sapiens
gagctggagtttcactcactctgtcgcccaggctggggtgcagtggcacgatcttggctc

SEQ ID NO: 8350 - DNA, 61 bp, Homo sapiens
gtggttcatgcctgtaatctcagctactcaggaggctgtggttggaggatctcttgagccc

SEQ ID NO: 8351 - DNA, 80 bp, Homo sapiens
ggcattcaagaaatgtttgctgatttgtattacctatggtgtgggtgagagaaaacacagagctggaacgcttgggtgtc

SEQ ID NO: 8352 - DNA, 85 bp, Homo sapiens
gtatgtttaatttttttttaatcatgaaagggtatagaattctatcaaatgctttttctggattgactgagatgattacatgtac

SEQ ID NO: 8353 - DNA, 109 bp, Homo sapiens
aacaaaaacagtttattgagaagactgacattgtttttcattttttccagggtctaatatctggcttaattgaaaacagctttctgcattcaatatgttgtaatgtgtt

SEQ ID NO: 8354 - DNA, 77 bp, Homo sapiens
gtcatgtgttgcttaacaatggggatatatgctgagaaatgcattgtcaggagattttgttgttgtgcaaacatcac

SEQ ID NO: 8355 - DNA, 100 bp, Homo sapiens
tgtatatataaatatattgcatagcaatgtttatatatgtgtgtatatatgtatatatatatatataagtattgtatatgtacatatacatacaacatac

SEQ ID NO: 8356 - DNA, 58 bp, Homo sapiens
tgaggcagactctcactctgtcacccaggctggagtgcagtggtatgatcttggctca

SEQ ID NO: 8357 - DNA, 73 bp, Homo sapiens
atacatataaaatatacatttatatacatacacatatacatagatgtgtggatatgactgtgtgtatatgtgt

SEQ ID NO: 8358 - DNA, 73 bp, Homo sapiens
gacagaatgagactctgtctcaaaaggaaaaatgaaaaactttttttttcttgatacagtgtctcattctgtc

SEQ ID NO: 8359 - DNA, 75 bp, Homo sapiens
ggcagatatctaggaattgaattgctgggtcttattctaagtttatatttaattcgctagttttaagaaactgcc

SEQ ID NO: 8360 - DNA, 92 bp, Homo sapiens
tagggtagcttccattgcacaaaacagaatgaaaggtcacctaaatgtcccaattttttcttttttttcttttgagatggagtctggctctg

SEQ ID NO: 8361 - DNA, 89 bp, Homo sapiens
catatatctgtgatactgtttttgtccttctgattggaaaaatattttcaaacagaagggatttggcctactaggatcttccatatgtg

SEQ ID NO: 8362 - DNA, 119 bp, Homo sapiens
cataattttgacttctatttttattgtgctgtggtccaggagtgtgtttggtatgctttcagtttttttacattttttgaggattatgttcaattatgtggttgattttagaatatgtg

SEQ ID NO: 8363 - DNA, 79 bp, Homo sapiens
gtatcaccagtcgaggctcagttggaaatgcagaaatcacccgtcttctgtgtcagtcacactgggagatgcagactgg

SEQ ID NO: 8364 - DNA, 106 bp, Homo sapiens
ccagcgtgttcttttggcttaggattgtcttggctatatgggctcctttttggttccatatgaaatttaaagtaattttttctaagtctgtgaagaatgtcaatgg

SEQ ID NO: 8365 - DNA, 106 bp, Homo sapiens
gtgctgttgaatagaatgtgtattctgtggttgttggatgaaatgttctgtatgttaagtccatttgttccaaggtatagtttaaatccattttttctttgttcac

SEQ ID NO: 8366 - DNA, 142 bp, Homo sapiens
gtgtgtatatatatatatacatatatatgtacatatgcacatatatatgtgtatatatatacacatacatatgcacatatatatgtatatatatacacacatatatgtatatgtatgtgtatgtatatatatataatgcttg

SEQ ID NO: 8367 - DNA, 103 bp, Homo sapiens
gcattatatatatatacatacacatacatatacatatatgtgtgtatatatatacatatatatgtgcatatgtatgtgtatatatatacacatatatatgtgc

SEQ ID NO: 8368 - DNA, 106 bp, Homo sapiens
tgtagttcatctttcacctgatggtcttgtgtccaagaatgtttgaatatttaaaacttttctggcatcttaaaatacgagccacttctagtaatggtggagtagg

SEQ ID NO: 8369 - DNA, 110 bp, Homo sapiens
tgcttaggattgtcttggctatatgggctcttttttggttccatatgaaatttaaagtagttttttctaattctgtgaagaaagtcaatggtagcttgatggggatagca

SEQ ID NO: 8370 - DNA, 167 bp, Homo sapiens
ctttaaaaactatatatatatatatatatatatatatatatatatatatatatatatgcacacacataaagagtatatatatatatgaagagtgcatatatatatatattcttcgtatatatacactcttcgtatatatacacactatatatgtgtgtgtgtgtata

SEQ ID NO: 8371 - DNA, 86 bp, Homo sapiens
ggctgaataatattccattcacatgtatgtgatatatacatacaagatgtatatgtatatatcacattttgtttatctgttcatcc

SEQ ID NO: 8372 - DNA, 58 bp, Homo sapiens
tgagacaaggtcacactctgtcacccaggctgcagtgcagtggcatgatcttggctca

SEQ ID NO: 8373 - DNA, 101 bp, Homo sapiens
cactttggcccttcgttgcaatggatcatcttgtgctaccacttctttttttgtttaagacagggtcttgctctgttgccgaggctggactgcagtggtgc

SEQ ID NO: 8374 - DNA, 58 bp, Homo sapiens
tgagtcggtgtctcactctgtcgcccaggctggaatgcagtggtgcgatctcggctca

SEQ ID NO: 8375 - DNA, 88 bp, Homo sapiens
ttgttttttgagttggagtctcactctgtcacccaggctggagtgcagtggtgtgatcttggctcactgcaacctctgcctcccgggt

SEQ ID NO: 8376 - DNA, 118 bp, Homo sapiens
tgccaaatgtgcacctccagctcagacttctctcctgaactccagacctcttttttttttttttttttttttttgagatggagtcccacactgtcacccaggctggagtgcagtggca

SEQ ID NO: 8377 - DNA, 102 bp, Homo sapiens
ccaatactatgttgaataggagtggtgatagagggcattcttgtcttgtgccagttttcaaggggaatgcttctgccttttgcccattgaatgtgatgttgg

SEQ ID NO: 8378 - DNA, 97 bp, Homo sapiens; identical to SEQ ID NO: 1307

SEQ ID NO: 8379 - DNA, 88 bp, Homo sapiens; identical to SEQ ID NO: 1308

SEQ ID NO: 8380 - DNA, 81 bp, Homo sapiens; identical to SEQ ID NO: 1309

SEQ ID NO: 8381 - DNA, 77 bp, Homo sapiens; identical to SEQ ID NO: 1310

SEQ ID NO: 8382 - DNA, 73 bp, Homo sapiens
gggcccctcagaggctcctttttttttttttttttttttttttaaattgagacggagtctccctctgtggccc

SEQ ID NO: 8383 - DNA, 66 bp, Homo sapiens
agcagctctctcatcagcagctctcttacacggtctgctctgtctcagctgcttgatctggctgct

SEQ ID NO: 8384 - DNA, 109 bp, Homo sapiens
gtattctgtaaggacatttgtgtttatatatatctgtcatatgtatatatatatcatatatatatcagtcatatatatatctcacacatatatgtaagtgattttatgc

SEQ ID NO: 8385 - DNA, 80 bp, Homo sapiens
ccaaattcatcatcatcatcatcctctgctccattgtctaatggtggtggggatgaagagtacattcgaatgatgtctgg

SEQ ID NO: 8386 - DNA, 79 bp, Homo sapiens
caggggccaagactccagtttctgcatttatttattttattttttattttttatttttttgagatggagtcttactctg

SEQ ID NO: 8387 - DNA, 105 bp, Homo sapiens
cttgtttcatctacatggccaggttttgggtttttttttgtttgtttgttttggagtattttaaagcaaattccaggcatcagagcatattatgtttttgttaag

SEQ ID NO: 8388 - DNA, 106 bp, Homo sapiens
gatttttatcagtttgatagctgtgaaatatctctttataatttgcatttttctttttttgtagaaatgagggtctagctatgttgcccaggctggtcttgaactc

SEQ ID NO: 8389 - DNA, 82 bp, Homo sapiens
ctagcctggaaacctgcccattctgtcttcttttttttttttttttttttgagacggagtctcgctctgtcacccaggctgg

SEQ ID NO: 8390 - DNA, 91 bp, Homo sapiens
tgtttgttgacttattctgttaggttttctacatgtctgaaaagttttatgatagaaagcttgggtatgggggaatacggtatgagagaca

SEQ ID NO: 8391 - DNA, 70 bp, Homo sapiens
tgattgtagctgatcagtctcgctctgtcgctcaggctggagtgcagtgacgagatctcggctcactgca

SEQ ID NO: 8392 - DNA, 70 bp, Homo sapiens
cagtcatacccactcactctctggcttccgaggagactgctgtgaaggatgaagtgtggtggcaggggtg

SEQ ID NO: 8393 - DNA, 81 bp, Homo sapiens
tcatcctcgctaacaattggcagaaccaggattgaacccaatccacctgagtccctctgacagtgtcctcggtgaggagga

SEQ ID NO: 8394 - DNA, 88 bp, Homo sapiens
taaatcagttttaggtttacagaaaattgagtggagttccaatactccatccagtcccaatttctcctgttacttacttattggctta

SEQ ID NO: 8395 - DNA, 102 bp, Homo sapiens
ggtgcagtggtgcacacctgtagtcccagctactttggaggctgaggttggaggatcacttgagccaaggaggttgaggctgcagtgagttatgattgtgtc

SEQ ID NO: 8396 - DNA, 110 bp, Homo sapiens
gtatacctgtggtccaagctacttgggaggctgaggtaggaggatggcttgagccctggaggcagaggctgtgagccaagattgtgccactgcaccccatcataggtgac

SEQ ID NO: 8397 - DNA, 76 bp, Homo sapiens
tgggaggctgaggtaggaggatggcttgagccctggaggcagaggctgtgagccaagattgtgccactgcacccca

SEQ ID NO: 8398 - DNA, 76 bp, Homo sapiens; identical to SEQ ID NO: 8397

SEQ ID NO: 8399 - DNA, 86 bp, Homo sapiens
tgtaaagcagcaaaaaaggaaaagtgcccaggtcacagtgactctctcactgtcagactaataactgtcatttcttgctgctgtca

SEQ ID NO: 8400 - DNA, 58 bp, Homo sapiens
ggtgtctcagtcactctgtgctgttataaatgactatatactgggtggcttagacaac

SEQ ID NO: 8401 - DNA, 84 bp, Homo sapiens
ggaggctgtgcttgtcagagtcactcagagtgatgtcaagatatcactcagagtcactcaagctgatggagcttccctgcctcc

SEQ ID NO: 8402 - DNA, 56 bp, Homo sapiens
gagacggagtctcgctctgtctcccaggctggagggcagtggcgtgatctcggctc

SEQ ID NO: 8403 - DNA, 86 bp, Homo sapiens
gacgactgtttttatttatttatttttttggagacagggttataccctgtcatccaggctgaagtgcagtggcgtgaacacggctc

SEQ ID NO: 8404 - DNA, 117 bp, Homo sapiens
gcctctctgggtgaaaagattaattgcagatgggtttggggaaaaaaactctgaactttattttttgatacttagccacagggtggccccctagctccaataattactccatagccc

SEQ ID NO: 8405 - DNA, 58 bp, Homo sapiens
tgagacagagtctcactctgtcttccaggctggtgtgcagtggtgtgatctcggctca

SEQ ID NO: 8406 - DNA, 93 bp, Homo sapiens
gctctgcctggcagaggaggcaggaccctctcttttcttttctttttttcttttttctgagacagggtcttactctgtcacccaggctggagt

SEQ ID NO: 8407 - DNA, 82 bp, Homo sapiens
gtgaaaggccatttctgtgtctgtttatgattcgcttcctgcctcaccgaatctctgactcacaggtgccagagcctcccac

SEQ ID NO: 8408 - DNA, 73 bp, Homo sapiens
gggtggctgggctgggttctaccctccagtttctttttttttttttttgagatggagtctcactctgtcaccc

SEQ ID NO: 8409 - DNA, 117 bp, Homo sapiens
cactatttgtagtttgaatagttcagttttattttggatagtaaagaagagcttgctttttttttttttttttttttgtctgagacggagtcttgttctgttgcccaggctggagtg

SEQ ID NO: 8410 - DNA, 58 bp, Homo sapiens
tgagacggagtctcgctctctcacccaggctggagtgcaagggtgcgatctcggctca

SEQ ID NO: 8411 - DNA, 99 bp, Homo sapiens
tgtctatatagctatatttttgttagtcattttagtattgtggatcaaaagatcataatgatttatttttattagcaaagttggaagtttttatagata

SEQ ID NO: 8412 - DNA, 113 bp, Homo sapiens
gccatgaaaagcaaaggggagggtagaagttctcatatttttaatttatatcaacacctgaacaggggcacaaaaattgaagttaatttcatctgattttgtttatgtatggc

SEQ ID NO: 8413 - DNA, 68 bp, Homo sapiens
gggtttagtggctcacgcctgtaatcttagcactttgggaggctgaggtaggaggatcacttgagccc

SEQ ID NO: 8414 - DNA, 82 bp, Homo sapiens
gccccaagtttttgatatcacagggatgttgtataagatcaagctaaaacagctccttcccttgaaatccctaaaactgggc

SEQ ID NO: 8415 - DNA, 82 bp, Homo sapiens
acaggatttttcaacaacttatttcaagggaataagaggtgaacacctgtttttgttgttgttgttgttgttgtttgtttgt

SEQ ID NO: 8416 - DNA, 62 bp, Homo sapiens
ctgtcaatccgtgagtctgtctgtctgtctgtcgacaagacgacagctcttggcttgagcag

SEQ ID NO: 8417 - DNA, 100 bp, Homo sapiens
ggtgacagagtgaaactccgtatcaaaaaaaaaaaaaaaaaagatttaccatcttaaattttttttttttttttttgagatggagtctcactctgtcgcc

SEQ ID NO: 8418 - DNA, 84 bp, Homo sapiens
cattgagtgagtgtgtcacagagaaaacagactggggagaccactgtgggcctgagtttggtgctgtaggaactggtctcagtg

SEQ ID NO: 8419 - DNA, 84 bp, Homo sapiens
attgcatatgtgtgtgtatatatatgtgtgtgtgtgtatatatgcatatgatgtatatgcatataaatatatatataaggcaat

SEQ ID NO: 8420 - DNA, 106 bp, Homo sapiens
agttgggaggaaagccgagctgcaggcctctcggtcactgggtcccaccacggggatacccggtgccgcgctgagcccagagcagatccagactctcctcccgact

SEQ ID NO: 8421 - DNA, 96 bp, Homo sapiens
tatatatatgtgtatatatatgtatgtatatatatatgtgtatatatatgtatgtgtgtgtgtgtgtatatatatatatatatatatgtatttatg

SEQ ID NO: 8422 - DNA, 109 bp, Homo sapiens
ccaccattgagaaaaatgtgcaattcaatgtgtgtgtgtagatatatatatatacgtgtgtgtgtgtgtgtgtgtgtgtacacaacattttgcctacagtttcaagggg

SEQ ID NO: 8423 - DNA, 98 bp, Homo sapiens
tgcatatgtgcatgtgtatctgtgtatgtgcacgtatatatgtatgtctgcatgtgtatgtatgtgtgtgtgtatgtgcatgtgtatgtatatgtgta

SEQ ID NO: 8424 - DNA, 72 bp, Homo sapiens
agaagaaaggggctgtcagggtaagcactctctgaaacttatgagactgtcagactgattcttttctcttct

SEQ ID NO: 8425 - DNA, 92 bp, Homo sapiens
caacttggtggccttgggcaaattatttatctatttaagccttagtttctgtaagtcgctttagggtaaattatatcgagctagcttagttg

SEQ ID NO: 8426 - DNA, 103 bp, Homo sapiens
ggttggggtgtgagagtgtaaagaccttggtaagaaggggctgggcaaagcactctctcagtccctctggcaatggtttaaaatggagcaacttcccatctcc

SEQ ID NO: 8427 - DNA, 103 bp, Homo sapiens
gctgttcatttttagaaatatgtctgccatacaagtctgagtgatcaaagattgctgtccaaggatctttcaactaaatgtggtgttccgtgaaagaattagc

SEQ ID NO: 8428 - DNA, 77 bp, Homo sapiens
tatataggtagtgcatgcatgtatatatacatattgtattatgtatatgtgtatgtgtgtgtgtgcatgtccatgta

SEQ ID NO: 8429 - DNA, 94 bp, Homo sapiens
ccagtgattggtggcaacctgtgggttttattttttttcttttcatttatttatttttgtttgagatggagtcccactctgtcacccaggctgg

SEQ ID NO: 8430 - DNA, 113 bp, Homo sapiens
tggaactgaggacaaagagaagattaatgtaaggaagattggggaaaagctgtttgatgaaattttttttgttttattttttgagttagattataatctctaatttccttcca

SEQ ID NO: 8431 - DNA, 58 bp, Homo sapiens; identical to SEQ ID NO: 2442

SEQ ID NO: 8432 - DNA, 117 bp, Homo sapiens
ctggcctgacaatgatgcacaatgagctctgtacttgaacatcatttaaaaattcttatttttttttttttattatactttaagttctagggtacatgtgcacattctgcaggttag

SEQ ID NO: 8433 - DNA, 117 bp, Homo sapiens
aacttatggatggcaggccacgcagaagggatgtgatataggaaagtcagaaggaatgcaatgtaaaaaagtcacccatccctcttgatgttggacttaagggcatttaatgcagtt

SEQ ID NO: 8434 - DNA, 113 bp, Homo sapiens
gttaaaatctagttattataatgcctagaggttatctcttatccttgagcttaactcttagaacacagagagctcagaggatgggcctaagacagctctaggcaagattttgc

SEQ ID NO: 8435 - DNA, 109 bp, Homo sapiens
ctgttaagatgtgtgccttctaatgtacatacattttatgtattattttatttaaaataataataataattacatgggagtggggaataagtagatatatagatgatag

SEQ ID NO: 8436 - DNA, 89 bp, Homo sapiens
gtgggtggaagatgaggaaactgaaaatacagagcagacaaaatacgtctcctttgtgtcaaggtcagtttaggaatgtatgtactagc

SEQ ID NO: 8437 - DNA, 83 bp, Homo sapiens
gtgtgtgtgtgtgtgtgtgtatgtgtgtgtgtgtgtatatgtatatgtatatatacacacacatatatgtatgtatataacat

SEQ ID NO: 8438 - DNA, 108 bp, Homo sapiens
catcagattgcattatgaagttttatgccaagccctctggcttatatttttattttttaaaaatactaattagctagcttgtggaatgagattataattatatctttg

SEQ ID NO: 8439 - DNA, 66 bp, Homo sapiens
tttttgagatggagtctcactctgtcactcaggctggagggcagtggcgcgatcctggctcactga

SEQ ID NO: 8440 - DNA, 94 bp, Homo sapiens
cagtagggaagccaatggccacttaggcttcagacataaatatatatttataagtcacccagctgcctaattgagagccatagtgttttcactg

SEQ ID NO: 8441 - DNA, 117 bp, Homo sapiens
ctgtgtcttttaattggggcagttagcccatttacatttaaggttgatattgttatgtgtgaatttgttcttgtcattatgatgttatctggttattttgcccattatttgatgcag

SEQ ID NO: 8442 - DNA, 86 bp, Homo sapiens
agtgggtgccagggtgcctgcctctgtgcgggtgttcaccacagtagtggaggcaacataactcaaggggaccaggggctcctgct

SEQ ID NO: 8443 - DNA, 68 bp, Homo sapiens
ggccttggcttggtgtcttaactcggcagccctgtggtgctaggttttatacattatttcaaagggct

SEQ ID NO: 8444 - DNA, 102 bp, Homo sapiens
gcgttatgcttttgtaggtgccgtttatcaaggtgaggaagttccttctattcttaggtctttaatccctccattttgaagcatatgatataaggaaggggc

SEQ ID NO: 8445 - DNA, 71 bp, Homo sapiens
tttttttttgcaggaggctagggtgtctgcagacaccagcatcctctctgtctctctgctactttggaaaa

SEQ ID NO: 8446 - DNA, 113 bp, Homo sapiens
gaggtaggacctacttttttgcctgcagagttgcagagacatacttaagaacatcagaccctcactgtctccttccacattttgcacataagtctttgtggttgtttcatttc

SEQ ID NO: 8447 - DNA, 119 bp, Homo sapiens
gtgtgtgtatatatgtgtgtgtgtgtgtatatatatgtgtgtgtgtgtatatatacatatatatacatacatatatatatatgtatatatacacacacacacacacacacatatacata

SEQ ID NO: 8448 - DNA, 72 bp, Homo sapiens
gggtaggagggagatgcagttaagtaaggaagaatgaacctttacctttgtgcacacttctctctctctctc

SEQ ID NO: 8449 - DNA, 89 bp, Homo sapiens
tacatatacattgtatgtacatacatgtacattcttatatatattttatatttatatattttgtgtgcatatatacatatgtgtgtgta

SEQ ID NO: 8450 - DNA, 112 bp, Homo sapiens
atctttcacgaaatgcttctgagcacaatggtaacctgagactttcattgaaattcttgtcttcttcatcatcatcatcaagctaacatttatgaagcacttcgtgtcagat

SEQ ID NO: 8451 - DNA, 97 bp, Homo sapiens
gtcacattctttttcatactttatggggcttcatttttttaaatttaaattaagattttgggggtttgttggcaggttaatgtatggactatgtgat

SEQ ID NO: 8452 - DNA, 73 bp, Homo sapiens
atacatacatattaaacattatgtacctatataaaatatatgtgtatgtatatatgtatctatatgtatgtgt

SEQ ID NO: 8453 - DNA, 97 bp, Homo sapiens
gctataggagtcttgaattagtgggtttttttagttactaaaacgataataatttttagtatttctaatactcaataattcttaaagaatatgtggt

SEQ ID NO: 8454 - DNA, 97 bp, Homo sapiens
gtattgttttgccaaatggaaaacacagctaagaattctttatttatttattttttttctgagatggagtttcactgtgttgcccaggctggagtgc

SEQ ID NO: 8455 - DNA, 88 bp, Homo sapiens; identical to SEQ ID NO: 1308

SEQ ID NO: 8456 - DNA, 81 bp, Homo sapiens; identical to SEQ ID NO: 1309

SEQ ID NO: 8457 - DNA, 77 bp, Homo sapiens; identical to SEQ ID NO: 1310

SEQ ID NO: 8458 - DNA, 67 bp, Homo sapiens
ctggttcggcagttgaggcttaatttttttttttttcttcgagacagagtctcgctctgtcacccag

SEQ ID NO: 8459 - DNA, 110 bp, Homo sapiens
gtgaaatttcaaatccagcataaatggaggtatgggaaaaatagctgttgatgggaatgttggcacctttcaagagtctatgcagtcagagttgcttagtgaaggtaaac

SEQ ID NO: 8460 - DNA, 85 bp, Homo sapiens
tttctttgggttgggaactcagacaggacacagtgggcttggcttgcctctctgctccatgatatctgcagcctgagctgggaag

SEQ ID NO: 8461 - DNA, 100 bp, Homo sapiens
cagaaaaacggcaagggtagccagcagagttccagggaggacagggaaagaaacgctgtctgtctttttcactgttgttaccccagtgctttttgtggct

SEQ ID NO: 8462 - DNA, 94 bp, Homo sapiens
gtatatatgtgtgtgatgtgtgtatgtgctgtgtgtgtgtgtgtgtgtgtgcgctgtggcagtatgtgtatatgccatgtgtctgagtgtgtat

SEQ ID NO: 8463 - DNA, 85 bp, Homo sapiens
acaagtgagtttgtgactatggcatatttgctttttttttttttttttttgcatatgctcttctcatttcataagacttgcttgt

SEQ ID NO: 8464 - DNA, 82 bp, Homo sapiens
atttttaggatgcagacagaaatgacactggtgtggcagaggagcgagagcccactgtgttggctgatgtgacggggaggat

SEQ ID NO: 8465 - DNA, 127 bp, Homo sapiens
acacatatatgtatgtttgtatgtatatatacacatatatgtatgtttgtatatatgtatatatgtatatatgcatatatacacgtgtatatgtgtatatatatgtatatgtgtatatatatgtata

SEQ ID NO: 8466 - DNA, 118 bp, Homo sapiens
gagccacagggatgagaaaaagaactaataacctgcactctccatgtctcccactctcacagctatctagaccttgatccactggagaagcagcttggtttctgtccttcctgagttc

SEQ ID NO: 8467 - DNA, 80 bp, Homo sapiens
gcctcagtctgtcactctgccttatgcccctcactcgaattgtttcttctgaggaggcaagaattgaggttgctgcagac

SEQ ID NO: 8468 - DNA, 58 bp, Homo sapiens
tgagacagggtctcactctgtcacccaggctggagtgcagtggtgcaatcttggctta

SEQ ID NO: 8469 - DNA, 84 bp, Homo sapiens
ggtctccccttcacagtggttctgtgacattttcctggtagaagtaacagaggtcagctgaggaaagggtaaattctcaagact

SEQ ID NO: 8470 - DNA, 168 bp, Homo sapiens
atacatatatatacacacatatatatacatatatatacatatatatgcgtatatgtgtatatatacacatatatacgtatatatgtgtatgtatatatgtatatgtgtatatatgtgtatacatatgtatatatgtgtatacatatgtatatatgtatatatgtgtat

SEQ ID NO: 8471 - DNA, 86 bp, Homo sapiens
tagattacttataatacctaatacaatgcaaatgctatgtaaatagtactgtattgtgttttaaaatttgtattatttttaatttg

SEQ ID NO: 8472 - DNA, 132 bp, Homo sapiens
atatatatgtatatatatgtgtatgtatatgcatatatacgtatatatgcgtgtgtatatatgtatatacatatatacgtatatatgcgtatgtatatatatgtatatacatatatatgtgtatacatatat

SEQ ID NO: 8473 - DNA, 109 bp, Homo sapiens
tttggattttggtatcaaggaaacagggctactcaaattctatttcacactggaagaggtgtgatagtttgtgtttaaggaactggttcattacttcaaagttgtcaaa

SEQ ID NO: 8474 - DNA, 153 bp, Homo sapiens
tgtgtgtgtatgtatgtgtgtatatatatatacgggtgtgtgtgtatatgtgtatatatatgtgtgtgtatgtgtgtatatatgtgtgtgtgtatatatacacacatacacacacacacacacacacacacacacacacacacacatatatat

SEQ ID NO: 8475 - DNA, 58 bp, Homo sapiens; identical to SEQ ID NO: 2051

SEQ ID NO: 8476 - DNA, 79 bp, Homo sapiens
agattgggcaggataagagaaaacccatctttatgaaatttttttttttgagatggagtctctctctgtcacccaggct

SEQ ID NO: 8477 - DNA, 102 bp, Homo sapiens
cttcagaacattgcacagatgggtgccctgtggctcgctcactgtttgcagcaggatagcccgggcagcagagatggtcaacccggatgagctgtgctggag

SEQ ID NO: 8478 - DNA, 92 bp, Homo sapiens
tgtgccttgtgtatcagtcactctgtgcctccctgagccagccatgtggtctttgtctctgagtgctaggaggacaaatgcaacacaggcca

SEQ ID NO: 8479 - DNA, 114 bp, Homo sapiens
tctatatatatatatatgtatgtatgtatatgtgtgtatatatatgtgtatatatgtgtgtgtatatatatacacacacatatgtgtatatatggatatatgtgtatatatgga

SEQ ID NO: 8480 - DNA, 116 bp, Homo sapiens
agacaaatttacaaatcaggacaaccactgcctatccattctcccaccaggcttccataccctggaggttcagaagacaggccgtggcttctgtcctgtcctgcgtgactttccct

SEQ ID NO: 8481 - DNA, 98 bp, Homo sapiens
ttggtttctttttcagattgtttgctgttggcatatagaaatgctattgattttttgtcttttttgtgtcctgcagctttactgaatttatttatcag

SEQ ID NO: 8482 - DNA, 140 bp, Homo sapiens
ggagaagcagcacattccaggcaggataaggggcactgctcctgatctcttggaaaggaaactgagagcacagagtgagcaggtagccagaaaatgaacactgggcagctgcctcctgtggctggcgagccagctcaccc

SEQ ID NO: 8483 - DNA, 78 bp, Homo sapiens
tacctatgtatctatgtatgtgtgtgtatctatgtgtgtatacgtgtgtatgtatgtatgtatgtatgtatgtatgta

SEQ ID NO: 8484 - DNA, 75 bp, Homo sapiens
ttgtttgtgttttgagacagagtctcactctgtcacccaggctggggtacagtgagctgtctcagcccactgcag

SEQ ID NO: 8485 - DNA, 113 bp, Homo sapiens
taccttttccaaaattatcttttaattcttaattcatttatttttctttttcacttgatgagaaacattgaaatctatgaatttgatatgatcagatcctgtggacactggta

SEQ ID NO: 8486 - DNA, 113 bp, Homo sapiens
gctgagactgcaggtgcatgtgaccatgcctggctaattatttttttttgttttttgtagagatggagtctcactttgttgtccaggcttgtcttgaactcctgggctcatgt

SEQ ID NO: 8487 - DNA, 76 bp, Homo sapiens
ctacctgttgtaggagtagaaagaggttataggttgtattgattgcctggattgttttctatgccacagactggag

SEQ ID NO: 8488 - DNA, 96 bp, Homo sapiens
ttgtatgttgattttgtatcctacaactttactgaatttgtttatcagctctaatagttttttggtggagtctttaggtcatatcatctgcaacaa

SEQ ID NO: 8489 - DNA, 56 bp, Homo sapiens
ggtgcatctgtggtcccagctactcaggaggctgaggtagaaggatcacttgtgcc

SEQ ID NO: 8490 - DNA, 107 bp, Homo sapiens
taggatatataggttcagaagtgttcatagcctgtagaaaggatgactttttaaatgatctatttttgtagttgttatctattgagcatattttgggtgtaggcttg

SEQ ID NO: 8491 - DNA, 99 bp, Homo sapiens
ctcttatttggtgtcttcatgggtgagctctgactcatcaatcttcttttttttttttttttttttgagatggagtctcactctgtcacaaggctggag

SEQ ID NO: 8492 - DNA, 86 bp, Homo sapiens
ccaacagcaggaagtgaagctagattttgtgggtgttggaagttaccaggtctttcttctgtctgcctctctgtctgtctctctgg

SEQ ID NO: 8493 - DNA, 78 bp, Homo sapiens
ggaggctgaggtaggaggatcgcttgaggccaggggttcaagaccagcctggacaacatagtgagaccttgtctctac

SEQ ID NO: 8494 - DNA, 58 bp, Homo sapiens; identical to SEQ ID NO: 2626

SEQ ID NO: 8495 - DNA, 72 bp, Homo sapiens
cagaggggaggaaagtgttctgtggcccttcgtttctcctgatttctctctgacacactctccttttcactg

SEQ ID NO: 8496 - DNA, 265 bp, Homo sapiens
atatatatacgtatatatatatatatacacacacatatatatgtatatatgtatatatatacgtatatatatgtatatacgtatatatatgtatatacgtatatatatacatatatgtatatatatgtatatatgtatatatatgtatatatatgtgtatatatatgtgtatatatgtgtatatatatgtgtatatatgtgtatatatatgtgtatatatatgtatatatatgtatatatatatgtgtgtgtatatatatatatg

SEQ ID NO: 8497 - DNA, 95 bp, Homo sapiens
aacatgttttgcgagggtcagtgatttggttcatatcagaggcatctttgaacctggtcagttactttacctaaggcagacacactatatatgtt

SEQ ID NO: 8498 - DNA, 119 bp, Homo sapiens
gcatatactatatagtatgtgtatacgtgtataattatatgaatattatatatgtgtacatatgtatatatttacataatatgcataatatatacaaagtgtatatatataaagagtat

SEQ ID NO: 8499 - DNA, 93 bp, Homo sapiens
gtttttggtgtcatggccaaggagattgaggttgcagacagacacacacacagtgagtttggagcaggagtttaataggcaaaagaaaagaac

SEQ ID NO: 8500 - DNA, 87 bp, Homo sapiens
tgcaaatacacatacatacacgttaatacacatgtgttaatatatacttacatgtatattatgtgtatatatatctgtgtatatgta

SEQ ID NO: 8501 - DNA, 70 bp, Homo sapiens
gtctgatttgggactctctctgtgtgtgctttgatgggggcacagtgacaggagatggtggaaataaggc

SEQ ID NO: 8502 - DNA, 93 bp, Homo sapiens
tggccccttcagtgacttagtaggatgcagcaccagtcacagcttctagatgctcacctgactctggctgtgtgtcaccttgagtggaagcta

SEQ ID NO: 8503 - DNA, 77 bp, Homo sapiens
ggtgtcatagaagtaatgaaagacgttgcattcctgaaggaatgaataaattattcattttgttgttctggaacatc

SEQ ID NO: 8504 - DNA, 73 bp, Homo sapiens
gcactctcttgctctctctgtgaagaaagattccacacagcctggcatgagagcaaggtcccttcccaggtgc

SEQ ID NO: 8505 - DNA, 69 bp, Homo sapiens
cttcataggccacatatagttgggtctgtttttaaatttttgatagtatccaacctaatgggtgtgagg

SEQ ID NO: 8506 - DNA, 58 bp, Homo sapiens; identical to SEQ ID NO: 454

SEQ ID NO: 8507 - DNA, 105 bp, Homo sapiens
ttcacatgactggtaatgatgagaagcagaacagcatacacattgagaattttcttttttttttttctttgagacggagttttgctcttgttgcccaggctggaa

SEQ ID NO: 8508 - DNA, 85 bp, Homo sapiens
ccagcctgggcaacagaggtctaccctgtcttttcttttctttttttttttttgagatggagtctcactctgtcacccaggctgg

SEQ ID NO: 8509 - DNA, 58 bp, Homo sapiens
tgagaccgagtctcactctgtcgctcaggctggagtgcagcagtgcgatcctggctca

SEQ ID NO: 8510 - DNA, 58 bp, Homo sapiens
tgagacgaagtctcactctgtcacccaggctggagtgcagtggtgcgatcttggctca

SEQ ID NO: 8511 - DNA, 113 bp, Homo sapiens
ctcccaaagtgctgggatgacaggcgtgagccaccgcacccagccaaaataagtattttctattttatttatttattttgagatggagtctcactctgtcacccaggctggag

SEQ ID NO: 8512 - DNA, 68 bp, Homo sapiens
gcttgtcaggaggatgtttttgggttttttggttttttccagacagactctcattctgtcacccaggc

SEQ ID NO: 8513 - DNA, 82 bp, Homo sapiens
cagggtgtgggcccagcctggctcagtgcctgcttgccaaggacctgccctgagtcactctgtctttggtgccgacaatctg

SEQ ID NO: 8514 - DNA, 74 bp, Homo sapiens
catgagccactgcacctggcctatttgacaagttttaatttttaatattgtcaagtattcctctggggttcatg

SEQ ID NO: 8515 - DNA, 118 bp, Homo sapiens
gggtcctcaatccaagctgcacattagaataccctggggagtggtttttttttttttccttcaaatcccaaggacacatctaaaaccaagcaaatcagaatctctggaggtagcaccc

SEQ ID NO: 8516 - DNA, 95 bp, Homo sapiens; identical to SEQ ID NO: 68

SEQ ID NO: 8517 - DNA, 93 bp, Homo sapiens; identical to SEQ ID NO: 69

SEQ ID NO: 8518 - DNA, 113 bp, Homo sapiens
catgcaaaaatactagctgatgctttgctggggattcccatagagagaactgagaatgcactcatttttaaaatagcctcatggagaaactttttaagtggttggtgggggtg

SEQ ID NO: 8519 - DNA, 104 bp, Homo sapiens
gtgctgcctgtctgttcctggggagagggtgcctggctctgtgccacaggcagaggctccctgggcaggtgagcgccttctcccaccagctgttagaaaaaggt

SEQ ID NO: 8520 - DNA, 58 bp, Homo sapiens; identical to SEQ ID NO: 1847

SEQ ID NO: 8521 - DNA, 84 bp, Homo sapiens
gggctgcctctctgtctcatgagctcatctgcacttggtggtctctgcagccagggtcagaaagtagagagacaggagcagcct

SEQ ID NO: 8522 - DNA, 87 bp, Homo sapiens
ctgtacagcatgttactgtactaaatactggagacaactgtaacacagtagtaagtatttgtatatataaacatagaaaatgtacag

SEQ ID NO: 8523 - DNA, 85 bp, Homo sapiens
ggtctgtggatcacttgagaacttgttagaaatgcaggctctcagggccccctcagcctctgaatcagaacctgcatttgactgg

SEQ ID NO: 8524 - DNA, 62 bp, Homo sapiens
cctgtctagtttgctgattgatacagacactaggtctctgagtcaatggtgcaaaaagcagg

SEQ ID NO: 8525 - DNA, 76 bp, Homo sapiens
acctcttgcattataacctctccagtcccagagactctattagtctctgtctgactttcaggatttgaaagagtgt

SEQ ID NO: 8526 - DNA, 99 bp, Homo sapiens
ggccttctccacactggtttttaacttcaggaactgagaacgcacataacccaggctctcattcaccatctggatctgaacgccagctgcctccatgcc

SEQ ID NO: 8527 - DNA, 71 bp, Homo sapiens
tttggtttcatgatgggatagaatgatcttcagttgtctggaaaattcagatcttcccaacagaggctgaa

SEQ ID NO: 8528 - DNA, 95 bp, Homo sapiens
taggagcaggcgccctctctctctcacacacacacaactgcggctgatggcaccagttgatggcagagggatgggagaggctagattacctctta

SEQ ID NO: 8529 - DNA, 100 bp, Homo sapiens
ggtttgatttgtgcttccctatgattagtgattttgaacatcattttagatgcttattggccatcgctatatcttctttagggacacgtctactcgagtc

SEQ ID NO: 8530 - DNA, 95 bp, Homo sapiens
gcaatcttatagagagatattactttaaatatcacagtgggtgtacacacatggggtacaccccctgggatattattggtaatatcttagagagc

SEQ ID NO: 8531 - DNA, 100 bp, Homo sapiens
ggtttgatttgcgcttccctatgattagtgattttgaacatcattttagatgcttattggccatcgctatatcttctttagggacacgtctactcgagtc

SEQ ID NO: 8532 - DNA, 78 bp, Homo sapiens
gcactgggggtagagacactcctgtgatattgttgttcataacaagggggaagaggatgctattaatgccaatagtgc

SEQ ID NO: 8533 - DNA, 81 bp, Homo sapiens
agagcgaaactccatctcaaaaacaaacaaacaaacaaaaacacagactttttttttttttttgaaatggagtctcactct

SEQ ID NO: 8534 - DNA, 110 bp, Homo sapiens
gcagtaaggttggaaggaatttaggtgagatcatccaaatttagagaaatcatccttttattattttttttttgagacaggatcttactctgttgcccaggctagagtgc

SEQ ID NO: 8535 - DNA, 126 bp, Homo sapiens
gcttaggattgtcttggctatttgggctcttttggttctgtatgaatgttaaatagtttttctaattctgtgaagaatgtcaatggtagtttaatgggagtagggcagtatggcctttttcacaat

SEQ ID NO: 8536 - DNA, 94 bp, Homo sapiens
cactcctatgattatatatctctgtgtatatgtacatatgtatgtatatgtatgtgtgtgcatgtatgatatgaatgttatgtccagggtagtg

SEQ ID NO: 8537 - DNA, 95 bp, Homo sapiens; identical to SEQ ID NO: 68

SEQ ID NO: 8538 - DNA, 93 bp, Homo sapiens; identical to SEQ ID NO: 69

SEQ ID NO: 8539 - DNA, 94 bp, Homo sapiens
tagtaggtaaagaaagctaagatgtgaatccaggtagtctgactctagcgtcatccttttacactactgtcattgttcttgtcttgtcctactg

SEQ ID NO: 8540 - DNA, 80 bp, Homo sapiens
cttcctgcctgcctgcctgtctgcctacctgcctccctttcttactaattaaggctttatagccagagcaggttctgaag

SEQ ID NO: 8541 - DNA, 69 bp, Homo sapiens
gagcctgggtttgttcactcagtcggtcacacaggcacaaggatgaagactgacttgagaccctcactc

SEQ ID NO: 8542 - DNA, 68 bp, Homo sapiens
gggtgttttaggatgatgctggaaagaggcaggagccctctctgtctctgagggtctgcagggcactt

SEQ ID NO: 8543 - DNA, 92 bp, Homo sapiens
gaaatgtatttctcacagttctgaaggctgcacagtctgagatcaaggtgtcagcatcttggtaagaccttcttgctgtgtccttacatggc

SEQ ID NO: 8544 - DNA, 78 bp, Homo sapiens
acatatatgtggatatgtgtatatatgtatatgtatatatgtatatgtatatatacacatatccacatacatatatgt

SEQ ID NO: 8545 - DNA, 66 bp, Homo sapiens
tgcatatatacgtatacatatgtgtgtatatatgcatatatacacatgtgtgtatgtatatgtgta

SEQ ID NO: 8546 - DNA, 79 bp, Homo sapiens
ggaagaagtagtatatgtgtatatatatgtatgtctatatatatagacacatactatatatactgtacattgtttcttc

SEQ ID NO: 8547 - DNA, 86 bp, Homo sapiens
gaagcctctggttgccagcaggggaagaggctccctgtgtccctctaggccaatcttctggctcggagcctgggtgagctgaatcc

SEQ ID NO: 8548 - DNA, 118 bp, Homo sapiens
cgtctatgaacatgtctgagagtcattgccagctgttggctggaccttagctggtgctataagctagaaaactaatgtgcagcctcttgtgtgctgggcttcctcacaatgtgtggcg

SEQ ID NO: 8549 - DNA, 115 bp, Homo sapiens
gcctggagcaaacaggattctttttcacaatgcagggcagacagaagagtgaggccatttctcatttctcactccccgcaccccatggtgacaggacctcagcagttccatctgc

SEQ ID NO: 8550 - DNA, 80 bp, Homo sapiens
tgcttctgtctctcagtctctgggccatgatttctctgctttctgctaaaggcaggctcccaaagactcctagatgaaca

SEQ ID NO: 8551 - DNA, 92 bp, Homo sapiens
tctaggtttgtgtgtctgtgtgtctgtgtggtagtggaggggcgtgtttcccaaccagagaggagagcccagatgtgtgtactgggcctaga

SEQ ID NO: 8552 - DNA, 92 bp, Homo sapiens
gccgcagcccctcggcgtgttgtgacagggaggggccgaggctggggaaaccagtcagccactctctgtgagtcaagcctttggcaggcggc

SEQ ID NO: 8553 - DNA, 62 bp, Homo sapiens
ttcctagagagtgtgctcagaggcctgatgaggaaggtcatggccaaagccagtcttgggag

SEQ ID NO: 8554 - DNA, 87 bp, Homo sapiens
gttctctttctcagtgtagattcagtgcagtattcataatattctgttaagatggctacattgattttacatcttgtaaagtggaat

SEQ ID NO: 8555 - DNA, 63 bp, Homo sapiens
gcacttcctgtgatgttccttgtttcatatttatataaaataggggagttccataggaaatgc

SEQ ID NO: 8556 - DNA, 121 bp, Homo sapiens
tgtgtgtatgtgtgtgtatatatatatatgtatacgtaagtgtatatatatatatacatctatgtgtgtatatatatagatgtgtatatatgtgtatatatatgtctgtgtatacatatat

SEQ ID NO: 8557 - DNA, 102 bp, Homo sapiens
ggttttaatttgcatttttctgatgactagtgatgttgtacatgttttcatatacgtcttggctattcatgtgtcttctcttgagaaatgtctattcagatc

SEQ ID NO: 8558 - DNA, 118 bp, Homo sapiens
ctcagtggatttctaggtgtatgaaagttgattgttagtctagttcatattaaaattttatgttaaattttactataatcagttttcaagaaatgtggaatatttaattctatctggg

SEQ ID NO: 8559 - DNA, 95 bp, Homo sapiens; identical to SEQ ID NO: 580

SEQ ID NO: 8560 - DNA, 93 bp, Homo sapiens; identical to SEQ ID NO: 69

SEQ ID NO: 8561 - DNA, 92 bp, Homo sapiens
ggcactagtgggtcagtgaaactaggaggcagtaagatatggcaggagactgatcagacaacctgttaagtgtcagagacggactaggagtt

SEQ ID NO: 8562 - DNA, 59 bp, Homo sapiens
tattgtatgtgtgtgtgtacttgttaacttatggcatatgtatatatatatatgcagtg

SEQ ID NO: 8563 - DNA, 95 bp, Homo sapiens; identical to SEQ ID NO: 68

SEQ ID NO: 8564 - DNA, 93 bp, Homo sapiens; identical to SEQ ID NO: 69

SEQ ID NO: 8565 - DNA, 95 bp, Homo sapiens; identical to SEQ ID NO: 68

SEQ ID NO: 8566 - DNA, 93 bp, Homo sapiens; identical to SEQ ID NO: 69

SEQ ID NO: 8567 - DNA, 81 bp, Homo sapiens
cttccatttccatacacctgtgcctgggattctgccagggctttctttggctccctgaatggcagtcaggaaggctggaag

SEQ ID NO: 8568 - DNA, 113 bp, Homo sapiens
tcctagcacccagcaggtgcttcataaatggtggctgtgattattgcaatgactcaaagtcacacagtgtgacaggaacaatatagagtgattgcctgcctggggtggaaggg

SEQ ID NO: 8569 - DNA, 75 bp, Homo sapiens
aggcagtagtttaatgtcctcttttaggggtgagtgagttttctcactcactctctcaggaatggattaattcct

SEQ ID NO: 8570 - DNA, 108 bp, Homo sapiens
tgctttttctgcatcaattgagatgatcatgtggggttttctctctttttttttttttttttttgagacagagtctcactctctcacttggtcgcccaggctgaagta

SEQ ID NO: 8571 - DNA, 110 bp, Homo sapiens
gtcattgtgttttcatgtggcctttcctctgcacgcatgcatagacagagaacactctctgctgtctcttcctcactgcaaataagagggtcattcgaagagtaagtgtc

SEQ ID NO: 8572 - DNA, 92 bp, Homo sapiens
tcacagtagtgagtgagttctctgagatctggttgtttgaaagtgtgtggcacctccccactctctctcttgctctcgctctccccatgtga

SEQ ID NO: 8573 - DNA, 88 bp, Homo sapiens
cacaggtctttccaaagccagaccagggcctagtggcatagcccactgtccctctgtcaccctcaccctaggctatctggatcctttg

SEQ ID NO: 8574 - DNA, 58 bp, Homo sapiens
tgagaccgagtctcactctgtcacccaggctggagtgcagtgctgtgatctcggctca

SEQ ID NO: 8575 - DNA, 118 bp, Homo sapiens
gcacactcatacccccagtcatctcagcagataagtgagacttccaaaggagcaaggaatttttgttttatttttgagacacagtctcactttgtcacccaggctggagtgcagtggc

SEQ ID NO: 8576 - DNA, 104 bp, Homo sapiens
gggctgagaacgtagaggtgtgaggctgttgatgctgctggctggtctttctgtcaaacttcctctcctgccccacagacaccctcacatacatcctccagtct

SEQ ID NO: 8577 - DNA, 75 bp, Homo sapiens
agtccacatgtgagtctgctgtgcacctggcagtcccttcagggaagagtctgatcacagtgcccttactgagct

SEQ ID NO: 8578 - DNA, 95 bp, Homo sapiens
tcatgtaatttgttgaatactgtactgaaaaaaacagtatggttgtacatactgtttttcattttcatacagtacagtttctactgactgcatga

SEQ ID NO: 8579 - DNA, 58 bp, Homo sapiens
gctgtgactgtgtctgtggctgtgggccctgctggtctcacgtagactctcacacagc

SEQ ID NO: 8580 - DNA, 115 bp, Homo sapiens
ggactgagaatgtggtggggtttgggcattcttgggctctctctctctctcttgaaaaagagggtacaggggtggaagagaggctgggagctatactgcccatgatgctgagtcc

SEQ ID NO: 8581 - DNA, 98 bp, Homo sapiens
atcgtggaattgtagatttgtgatttactaggggtcacagcatgaggtagttggttgctaaatctgcttttcctggtcccctttctagattcgagtct

SEQ ID NO: 8582 - DNA, 78 bp, Homo sapiens
tatgtaaaactccatcttgctagccaactcacactgacagactccctgtcactggttctgaagaaggaggctgacatg

SEQ ID NO: 8583 - DNA, 134 bp, Homo sapiens
gtcacttatctatctctattttcttggcttaaggtggtcatactttggtccctatgggcatgagtgtctcactgtcttactggatattactttgagccaatatattgatgacattcattctgataggaactgag

SEQ ID NO: 8584 - DNA, 114 bp, Homo sapiens
atatggtattttacatatatatgtgtatatatatatgtgtatatatatgtgtatatatatgtgtatatatatgtgtgtgtatatatatatatgtgtatatatatatatatatat

SEQ ID NO: 8585 - DNA, 81 bp, Homo sapiens
catttgctccttcaatgtatgaatggaaacaaataaaatgtttgtaaatgtatttataatgaatggatgaatgggcagatg

SEQ ID NO: 8586 - DNA, 95 bp, Homo sapiens; identical to SEQ ID NO: 68

SEQ ID NO: 8587 - DNA, 93 bp, Homo sapiens; identical to SEQ ID NO: 69

SEQ ID NO: 8588 - DNA, 75 bp, Homo sapiens
ccaggcccttgggataatagttgttttttgttttttttttttttgagacagtttcactcttgttgcccaggctgg

SEQ ID NO: 8589 - DNA, 93 bp, Homo sapiens
gtaatccaggctggcgatgatgagtgccttcttttttctttcttttttttttttttgagatggagtctcactctgtcgccaaagctggagcgc

SEQ ID NO: 8590 - DNA, 85 bp, Homo sapiens
gctttttaattttattgtattttttgtgagatggagtctggctctgtcgcccaggctggagtgcagtggcgtgacctcggctcac

SEQ ID NO: 8591 - DNA, 88 bp, Homo sapiens
tatttgtatgcatctaataacataacttatatatacatgccaaatgtgtgtgtgtatatatgtatatgtgtgtatatgtaaataaata

SEQ ID NO: 8592 - DNA, 111 bp, Homo sapiens
gggaaatgatgctagtacctgcctcatagggttgtggtgaggattaattgaggaaatccatgcaaaactcttaacctggcctgaatacatgttagctattattatcatccc

SEQ ID NO: 8593 - DNA, 81 bp, Homo sapiens
agaacttttttttgagacagagtctcactctgtcgcccaggctggagtgcagtggtgggatcttggctcattgaaacctct

SEQ ID NO: 8594 - DNA, 98 bp, Homo sapiens
tctgtaaaagatatgtgtgtttcagatgttgacagaaaacacagtggtgctggcgatgagcatattgaattcttgtgattttgtgatacacagacggg

SEQ ID NO: 8595 - DNA, 89 bp, Homo sapiens
gctcctgtgtacattcctggccattggttccccactggaaaaatgtggatgccttagtctgtgtgtagagagtgtggaaaggtggaagg

SEQ ID NO: 8596 - DNA, 75 bp, Homo sapiens
gttgctttgtggacccttagtcagaattggaactttttttttttttttttttgagacagggtctcactctgtggc

SEQ ID NO: 8597 - DNA, 95 bp, Homo sapiens
ttccttttacaagatagcattttaaaaaaatctatttgttttttaagaaacttggaaaatacctagttgtttttaggtacttctttagacaggag

SEQ ID NO: 8598 - DNA, 79 bp, Homo sapiens
ggagtctcactctgtcacccagtctggagtgcaatggtgcggtctgcaacttccgcctcctgggttcaagtgattctcc

SEQ ID NO: 8599 - DNA, 78 bp, Homo sapiens
ccatggcctgtgagagcaggtgcatcaggtctcctgccaggatactaagatgcagtcactgcctctgacactccttgg

SEQ ID NO: 8600 - DNA, 71 bp, Homo sapiens
acatagcaaaggacaagtaacggaatgacgaggttttcctgtagtagtgttgcgattttgttctgctgtgt

SEQ ID NO: 8601 - DNA, 116 bp, Homo sapiens
ggcctgggggtcagcacggaggggactggagctggagagtgactgtagagcctcaggtcagggcctcaggacacccttttctcagcccagaccccctccatccttcccttgctgcc

SEQ ID NO: 8602 - DNA, 112 bp, Homo sapiens
attccaatagagacagagccaggaactgtgtgtgaagaaacatgtgtgacacagtgagtgtgaactttttttttttttgagacggagtctaaccctgtctccaggctggaat

SEQ ID NO: 8603 - DNA, 100 bp, Homo sapiens
acctagggattagaatcaaggtctcccaggcagacagtaggtgggccaaggccccactgtctttcactcaggcccggtgacttccccttggtagactgat

SEQ ID NO: 8604 - DNA, 80 bp, Homo sapiens
ccgctatctctctctctcactcacacttcggagctccagtcctgagtcgatgacatgttggatggaagggagggagaagg

SEQ ID NO: 8605 - DNA, 68 bp, Homo sapiens
ggccccaaagtgagacactgagcaggccatggccacttgtgcccacctctctctgtgtctctgtggcc

SEQ ID NO: 8606 - DNA, 93 bp, Homo sapiens
gagtagctgggactacaggtgtgagtcattgctcctggctaatttcttaatttttaatagagacagggtctcactctgtttctcaggctagtc

SEQ ID NO: 8607 - DNA, 74 bp, Homo sapiens
gactgaatagctagcagaggcagaaccaaaatttaaacctgtgtttgtctctggctctgttccactatcctgtc

SEQ ID NO: 8608 - DNA, 111 bp, Homo sapiens
ctaaatagacctaaattaatatttaatgaacaccccccaatctatttttttaaatcaattgatacataagtagttgggggtgataaattagctatagattttctatgtaag

SEQ ID NO: 8609 - DNA, 62 bp, Homo sapiens
ggaggtgagagacaccacagaggtgcaggcaggcaccccactctgtgactagctctccttct

SEQ ID NO: 8610 - DNA, 95 bp, Homo sapiens; identical to SEQ ID NO: 68

SEQ ID NO: 8611 - DNA, 93 bp, Homo sapiens; identical to SEQ ID NO: 69

SEQ ID NO: 8612 - DNA, 91 bp, Homo sapiens
tttttatttctgtcctaagcgatgtctctttttgaatttttacatatggggaaactgaggttgagagaagctgattgagggtgaataggag

SEQ ID NO: 8613 - DNA, 78 bp, Homo sapiens
gcagctcccctaagactctaaggtattgatccaattaccacttgaggtcacttatcctactgctgtgttttgagctgc

SEQ ID NO: 8614 - DNA, 87 bp, Homo sapiens
ggaaggcataaaaccaggagagagaagaacctttttaaaattttttttctattttttcagatggtgtctctctctgtcgcccagtct

SEQ ID NO: 8615 - DNA, 58 bp, Homo sapiens; identical to SEQ ID NO: 315

SEQ ID NO: 8616 - DNA, 70 bp, Homo sapiens
ccctgaggcactgactggctcacaccagccccttaattgctaattgtgatgtcctcaggaggtcctgggg

SEQ ID NO: 8617 - DNA, 95 bp, Homo sapiens; identical to SEQ ID NO: 68

SEQ ID NO: 8618 - DNA, 93 bp, Homo sapiens; identical to SEQ ID NO: 69

SEQ ID NO: 8619 - DNA, 103 bp, Homo sapiens
ctcagggtttatgatgtgaagttttgaagaaaagcaaatagtttgttttgttttttttgttttttttttttgtttgtttgtttttgcttttaaaaattctggg

SEQ ID NO: 8620 - DNA, 86 bp, Homo sapiens
gtgcaaacatgtgcattgctgtgcatgtatgtgtatacatgagtgtacatgtgtgtgcatgtgtgtacatgtgtacgtgcgtgcac

SEQ ID NO: 8621 - DNA, 83 bp, Homo sapiens
ccctcagggccagtgttgtcaggttccaggaattagaagacgacttcggcttcgtgaagaaaaacagcagtgagtttggaggg

SEQ ID NO: 8622 - DNA, 100 bp, Homo sapiens
atatatatgtgtgtgtgtgtatgtatatatatgtatatatatgtgtatatatgtatatatgtatatatacatatgtatatatgcgtatatatacacatac

SEQ ID NO: 8623 - DNA, 112 bp, Homo sapiens
tatatacacatataattacatgcatatatacatatataaaatataattaaatatattacatattatatactatatatgttaaatttgtggaatgtaatcatatatgtatata

SEQ ID NO: 8624 - DNA, 56 bp, Homo sapiens; identical to SEQ ID NO: 1102

SEQ ID NO: 8625 - DNA, 77 bp, Homo sapiens
ggagtctcactctgtcacccaggctggagtgcagtggctcactgcaacctctgcctcctgggttcaagtgattctcc

SEQ ID NO: 8626 - DNA, 110 bp, Homo sapiens
cttaacagtatttatttataattactaaattatatgtttatttataaattagaaatgttcttacttgaatgagcatctgattttgtttgtgggtttcttactttgtttag

SEQ ID NO: 8627 - DNA, 91 bp, Homo sapiens
ggtgccatttatcatcttaaaaaatggtttttataattttatttctcccattggttgggagctgtgtgaagacattaaggtaaagtcaacc

SEQ ID NO: 8628 - DNA, 97 bp, Homo sapiens
aagaaatttcatgtttctctgcctcaaagttggagtgctatatgaatttatttttcactaaacataattgctgtgtggtacaatgtgaaaatttctt

SEQ ID NO: 8629 - DNA, 105 bp, Homo sapiens
gtagtttttctaaagtatttccatggctgctttcagtaaagtcctcattagccttgatgtggatttcttctgatgatgccctttaccctgacttggagagactgc

SEQ ID NO: 8630 - DNA, 75 bp, Homo sapiens
ctctggttcttgcatgtaaactagattgtaatttgtaattgggacaaagggaagatcagtttgaggcaactggag

SEQ ID NO: 8631 - DNA, 83 bp, Homo sapiens
gtaggctctatcaatttggacacaaactactctgatactctgcagcaagagagatcaaagatagcattcagagatatgtctgc

SEQ ID NO: 8632 - DNA, 101 bp, Homo sapiens
tgactgtgtacatatatatgtaggtatatatgtatatgtatatgtatgtgtatatgtatgtgtgtgtatatatatgcatatatatgtgtgtgtatatagca

SEQ ID NO: 8633 - DNA, 83 bp, Homo sapiens
gggaggagagctaggagggaatgagttaggagactgtgctggaagggtggggttgaggctcactttctgactcactcactccc

SEQ ID NO: 8634 - DNA, 87 bp, Homo sapiens
ttcaacatgagatttgggtggagacacagagccaaatcatatcatgtagtgactctctttgtctcttcttacagtttttgtcttgaa

SEQ ID NO: 8635 - DNA, 92 bp, Homo sapiens
ttctttcatttgaggcaacagctgtatagcatagttcctcactgctcaaagtgtgaggaggtactgtcatcagtatcacctaggagttagaa

SEQ ID NO: 8636 - DNA, 182 bp, Homo sapiens
gcaaagataatgatataatatatgtatatgtatacatatgtgtatattatatatgtatatatattatagctccatattttatacatatacatgcatatattatgcatatgcatatgtatatgttatatatgcatatatatttgtatattatacatatatattgtatcattattacatatatg

SEQ ID NO: 8637 - DNA, 93 bp, Homo sapiens
ttttatatatatagtacataaaatatatgtgtgtgtgtgtgtgtgtatatatatatatatacacacacacatatatatgttatattcttaaaa

SEQ ID NO: 8638 - DNA, 112 bp, Homo sapiens
caatgggcattttacttttggagatgctaagctatttgaatttatatattctagaaggtctgcattctatcaacgagctttacagtgctttagaagagaaaaaaaactgttg

SEQ ID NO: 8639 - DNA, 137 bp, Homo sapiens
aggtatatatatatatatatgtctgtatatatgtgtatatatgtgtatatatatatctgtatacatgtatatatatctgtatatacatgtatatatatctgtgtatatatatgtatgtatacacacacacacacaca

SEQ ID NO: 8640 - DNA, 128 bp, Homo sapiens
aattaatctgtctatttgggtaccagaaacatgctatttttgtacttgtgataataagctctcatactttttatttttaagttccagaatacatgtgcagaatgtgcaggtttgttacataggtgtac

SEQ ID NO: 8641 - DNA, 95 bp, Homo sapiens; identical to SEQ ID NO: 68

SEQ ID NO: 8642 - DNA, 93 bp, Homo sapiens; identical to SEQ ID NO: 69

SEQ ID NO: 8643 - DNA, 82 bp, Homo sapiens
ggcagcagataagagaagagagtttgtacagggaaactccccttattaaaaccgtcagatctcgtgagactcattcgctgtc

SEQ ID NO: 8644 - DNA, 92 bp, Homo sapiens
tatgtatatgtataaatatatgtgactatgtatgtatgcattaatgtacatggagaaacatatatatatatgtgtatgcatgcatctacaca

SEQ ID NO: 8645 - DNA, 97 bp, Homo sapiens
ggatgaggaaggctgggcatgtagaaagcttcaacaggtctctctgggtcactcggtggctgggaaggtcagttaaggtgtccagtttatttcatgt

SEQ ID NO: 8646 - DNA, 64 bp, Homo sapiens
ctggcagccactcccagagcccctggaactctggcccagggctctctgactgactccttgccag

SEQ ID NO: 8647 - DNA, 57 bp, Homo sapiens
tgagacagagtctcactgtgtcaccaggctgggatccagtggcacgatcttggctca

SEQ ID NO: 8648 - DNA, 95 bp, Homo sapiens; identical to SEQ ID NO: 580

SEQ ID NO: 8649 - DNA, 93 bp, Homo sapiens; identical to SEQ ID NO: 69

SEQ ID NO: 8650 - DNA, 108 bp, Homo sapiens
gaatcaaagtggtttccatgtttctttatgtcaactgaagattatttgtttttagatcttcttcctatttatgtgcttaatcttcagttactggtttcacctgaattc

SEQ ID NO: 8651 - DNA, 95 bp, Homo sapiens
cctgtaaattattattctactgtctcttctagtagtttttttttcttgttttattgcattggattagattactgaatgacaattatgataccagg

SEQ ID NO: 8652 - DNA, 95 bp, Homo sapiens; identical to SEQ ID NO: 68

SEQ ID NO: 8653 - DNA, 93 bp, Homo sapiens; identical to SEQ ID NO: 69

SEQ ID NO: 8654 - DNA, 103 bp, Homo sapiens
gcactgcactcatacatctacaactaggtcacagaacagagtgtcctgagataaacagtgtttcaatacttgtggccatagcttgcaattcttgattgcttgc

SEQ ID NO: 8655 - DNA, 146 bp, Homo sapiens
catatatatatgtatgtgtgtgtatatatatatatgtatatatatatatgtatgtatatatatgtgtatatatatatatgtatatatatgtatgtatatatatgtatgtatatatatatatgtatgtatatatatgtatatatatg

SEQ ID NO: 8656 - DNA, 83 bp, Homo sapiens
ccatgctcttctgagaatttttatgttttaaacaaaggacattcgtttcttaaggggtaaaaatatggcttagaataaaatgg

SEQ ID NO: 8657 - DNA, 80 bp, Homo sapiens
acaaatgagacatatacataaatgtatggtgtatatatatattttgtaatatgtgtgtatatgtgtatgtgtgtgtttgt

SEQ ID NO: 8658 - DNA, 78 bp, Homo sapiens
ttgcttgtagacagtagaaagagtagatcaactgtgtcagaaaggaagtaaagtctgcagttcactgcctgtaagtag

SEQ ID NO: 8659 - DNA, 181 bp, Homo sapiens
gccacacatatgcagattgcagaaatggtgtgtgcatgtccaaaatatatcatttcaaagattatatatatgtgtatgtgtgtgtgtatatctattgtgtatatatattatatatatgtgtgtgtatatatagtatatatagtatttatgtgtgtatatatatgattatatatgtgtataa

SEQ ID NO: 8660 - DNA, 59 bp, Homo sapiens
gtgtgtgtgtgtgtatatctcatagatatatatatctatatgtgtatatatatatacac

SEQ ID NO: 8661 - DNA, 111 bp, Homo sapiens
tatgtgtgtgtgtactaaagcatacacatatatgtatatattagctatgcatataatatatatacatatataaagctaatatatatgtgtactttagtatacgtacatata

SEQ ID NO: 8662 - DNA, 150 bp, Homo sapiens
cagttatatatgtgtatacatacatagatattgtttatgtatatagttataagtagttatgtatataactatatgtatagtcagatgtgtgtatatataaatgtgtgtgtgtgtgtatatgtatatatacatataaagtatatataaagt

SEQ ID NO: 8663 - DNA, 93 bp, Homo sapiens
atatatacacatatgtgtatatatatatacgtatttatacacatatatgaagtacacatatatgtatatgtgtgtgtatatatatacgtatat

SEQ ID NO: 8664 - DNA, 63 bp, Homo sapiens
tgtcataatcaatgtatatatggatatatatatggatgtgtgtacatatgtatagttatgata

SEQ ID NO: 8665 - DNA, 98 bp, Homo sapiens
tgtgtgtatatatgtatatacgtatatatatgtatatatgtgtgtatatatatacgtatatatgtgtgtatatatacgtatatatacaaacacacaca

SEQ ID NO: 8666 - DNA, 115 bp, Homo sapiens
tcatgacaagatggaatggtgctgagtattgaaacttaaattgtaaaacaaaggtattagtatctttcaatttttgtgttgtgttagtctttaccatttgggtattttaacatga

SEQ ID NO: 8667 - DNA, 97 bp, Homo sapiens
gacagctacctggtaaccttggtctggcacctggggtgtttctgaactgagttttctcatctgtaaaatataaggaatagccaggatttcatgcgtc

SEQ ID NO: 8668 - DNA, 64 bp, Homo sapiens
catgtggaaaactttttttttttttcccaatctgggatctgataaaaaaaagtctacacacatg

SEQ ID NO: 8669 - DNA, 111 bp, Homo sapiens
gttaagtaattgaaatataaagtttaatgatcctatagtgctaacagtgctgctattaggaaaatggcagtaaaggtgacaatataggtgtatattttccaaatatttaat

SEQ ID NO: 8670 - DNA, 112 bp, Homo sapiens
tcttgtgctggcacattttgaaatgacagttttataaatatttgattatacaaaattacactaattatttgtaaatttcatttggttgttcaaaacatgtgatcagttaaga

SEQ ID NO: 8671 - DNA, 81 bp, Homo sapiens
accacaaactcggtgacttaaagaaataaatttatttcttcacagtataaatttatttctttaagtcaccgagtttgtggt

SEQ ID NO: 8672 - DNA, 103 bp, Homo sapiens
gcttttagaatgctaaggaaatctctaagaccccctcatacttcttgactctctctctgttacaagcatttgggagacttagaatattcctttgctatctggc

SEQ ID NO: 8673 - DNA, 83 bp, Homo sapiens
agggtttctgttgagaggtcggctgttagtctgatgggcttccctttgtaggtgcctcggtctttctctctggctgcccttaa

SEQ ID NO: 8674 - DNA, 82 bp, Homo sapiens
acacatatatatagtaaatacatatacatatgtgttagtaaaaatactatatgtgtatatatataagtatatgtatatgtgt

SEQ ID NO: 8675 - DNA, 116 bp, Homo sapiens
gtaaatagtgctgcaataaacacggtggtgcagttattcctttgatgtactgattttcttgttttatacaaatatccagtagtgggaatactggatcatatggtagttctcttttc

SEQ ID NO: 8676 - DNA, 83 bp, Homo sapiens
gtagaatgtgtgtgtatgtgtgtgcatgtatatatgtgtatgtatatgtgtatatgtataaatattacatatatgtataatac

SEQ ID NO: 8677 - DNA, 95 bp, Homo sapiens; identical to SEQ ID NO: 68

SEQ ID NO: 8678 - DNA, 93 bp, Homo sapiens; identical to SEQ ID NO: 69

SEQ ID NO: 8679 - DNA, 105 bp, Homo sapiens
ctcttgtgaatacttaattatatgactgtcttaatgtttttttaaaataatttcaaattttattctaggttaagggggggtacatgtgcaagtttgtcaaatgag

SEQ ID NO: 8680 - DNA, 116 bp, Homo sapiens
agtctgttctttggaaattattttaagagagactcattgatgggaaattctgttttttaatttatctaaaaatgtctttattcaactgatttttaaattatttctagatacagatt

SEQ ID NO: 8681 - DNA, 76 bp, Homo sapiens
attgtatgtgtgtgtgtgtatatatatatgtatataaaatgatatatatatatataaaacgtctaagatatgcaat

SEQ ID NO: 8682 - DNA, 110 bp, Homo sapiens
gtcattcactgagcagaaattttatatttgaattatgtccaatttattaattttttttaacagattgagcctttagtggtatatctaaaaagctgtccgggcacagtggc

SEQ ID NO: 8683 - DNA, 76 bp, Homo sapiens
tacccatgtcaacatcctggttgtgatattgtattacagttttgcaagatgttactatcaggaagaaaaatgggta

SEQ ID NO: 8684 - DNA, 58 bp, Homo sapiens
tgagtcaggttctctctctgtcatcctggctggagtgcagtggagtgatcatggctca

SEQ ID NO: 8685 - DNA, 89 bp, Homo sapiens
gtgccaatggctctttcttggacttcagagttttatctgcacagatgattctgatactgcttctgggactgctgacccagtgtgggcac

SEQ ID NO: 8686 - DNA, 129 bp, Homo sapiens
tgtgtatatatacatatatatgtgtgtgcatatatacatatatgtatgtgtgtatatacatatatgtatgtgtatatatacatatatatgtacgtgcatatatacatatgtgtatatatatgccatgtg

SEQ ID NO: 8687 - DNA, 98 bp, Homo sapiens
tgtatatatacacatacatatatgtatatatacatatatgtatatacgcacatacatatatgtatatatacacgtacatatatgtctctatatataca

SEQ ID NO: 8688 - DNA, 165 bp, Homo sapiens
gtgtatgtatatacatatatgtatatacatatatgtttgtgtatatgtgtatatatgtatatacatatatgtatatacatatatgtttgtgtatatgtgtatatatgtatatacatatatgattgtgtatatatacacatatatgtatatacatatgtgtatgtg

SEQ ID NO: 8689 - DNA, 80 bp, Homo sapiens
tatgtatatacatacacaaacatatgtgtatatacataaatacacaaatatatatatgtatgtgtatatatatatacata

SEQ ID NO: 8690 - DNA, 108 bp, Homo sapiens
ttggtttgggtgtgaatgtgtgcatgtgtgtgtatatatatatatagctgtgtgtatatatatgtgtgtgtgtgtgtatatatatatgtatgatcaaatggaaattgg

SEQ ID NO: 8691 - DNA, 112 bp, Homo sapiens
caaataggtttgaattttagagcatttcagattttggatttttgaattagtgatgcttaatatgtaatattttttcttagaaatgattgttttaatcatttaaccatatttg

SEQ ID NO: 8692 - DNA, 118 bp, Homo sapiens
gttgtcttttatttttcagtttttttgaaatcaatctctgtttcatatctatttgttattctgtgacaaatagggtactttaggatatgaatttaactctggatataaatttggcagc

SEQ ID NO: 8693 - DNA, 100 bp, Homo sapiens
ctcaagcataactttggtttgatgatgatgctatggtataaggttgtatagaatgttaacttctgaggtattcatgttcattgctaaggatttgcttgtg

SEQ ID NO: 8694 - DNA, 101 bp, Homo sapiens
gtatatatatgtatgtgtgtatatgtatatacacgtatatatatgtatatgtgtatatatatatgtgtgtatatatatatatacacacacacatataccac

SEQ ID NO: 8695 - DNA, 104 bp, Homo sapiens
tatagataggtagatagaaatatctataaataggactatttatagatctatatatgtatatcctaatagttgtatttatagataggactatttatagatctatg

SEQ ID NO: 8696 - DNA, 97 bp, Homo sapiens
gagaaatggaggaaagatatggactgaaggaaaagtgattttgtctttttgcaaatgtttctttcattttatagaaaaacatgagtctttcattatc

SEQ ID NO: 8697 - DNA, 114 bp, Homo sapiens
agaagttgtatattgtccctgtatattttcttgtatgttttatttttttctttcattattgctttggtagtaatttcagtaaaatataactagaaatagtgatacaggatttct

SEQ ID NO: 8698 - DNA, 101 bp, Homo sapiens
tgctctctactctagaaaataatcagaaatgctgcttataaaagaataattattcttttataagcagcatttctgattattttctagactagtagagagca

SEQ ID NO: 8699 - DNA, 101 bp, Homo sapiens
tgctctctactagtctagaaaataatcagaaatgctgcttataaaagaataattattcttttataagcagcatttctgattattttctagagtagagagca

SEQ ID NO: 8700 - DNA, 112 bp, Homo sapiens
tacactttatgctataggagcatagacacagaaaaagtgtttaattaatataaatatattgtagactacaaatatttttcttgttcattgaaaacctgtcaaattgtgtgta

SEQ ID NO: 8701 - DNA, 90 bp, Homo sapiens
atatatgtgtatatatgtatgtgtgtgtatattttacacacatatatgtgtgtgtatattttatatatatatatatatatatatatatat

SEQ ID NO: 8702 - DNA, 83 bp, Homo sapiens
gggaaatcttagtcactgtgtctgacataatcaggtgagttcttaaatgtagtttaagagattatgatcaagacacattttcc

SEQ ID NO: 8703 - DNA, 245 bp, Homo sapiens
atacgtatatacatgtatatatatttatacatgtatatacgtatatacatatatatatatttatacatgtatatacgtatatacatatatatatttatacatgtatatacgtatatacatatatatatttatatttatacatgtatatacgtatatacatgtatatatttatatttatacgtgtatatacgtatatacatgtatatatttatatttatacgtgtatatacgtaactacatttata

SEQ ID NO: 8704 - DNA, 96 bp, Homo sapiens
agtttttctgttatgtaatacatattatatatataatttatgtatagtataaatatatactatattgtatatatagtaagttatatatagtaaatt

SEQ ID NO: 8705 - DNA, 125 bp, Homo sapiens
tattgtcatctaaggtagagatgatggctgagccagatgaataagtaattagattgtgtacagattttgaagttggagccaacagtctttgctgaaaaattgggagtgagttgtgagagagacct

SEQ ID NO: 8706 - DNA, 97 bp, Homo sapiens
gtgtgagaaatggtgtcactggtatgaattatttttatttttaaaaatgaaaattttaaaaattgttatatattagttgtacaaattttgggcatac

SEQ ID NO: 8707 - DNA, 120 bp, Homo sapiens
aaactatacagatatatgtttgtgcatatatatacatatatatatgtacgtttgtatatatatgtatgcatttatgtgtgtgtttacacacacacgtgcacacacacatatgtatatata

SEQ ID NO: 8708 - DNA, 101 bp, Homo sapiens
ctatgctttcttcaatgcagttgatgtatggcagaggatgaagtgtgacagcacagccagtgcagtcagcacattccactgcatcacagcacgcggcgtgg

SEQ ID NO: 8709 - DNA, 102 bp, Homo sapiens
gatatgcttttttgttcaacattatttcaaatgtatgggtgaatatctttttttattatactttaagctctggggtacatgtgcagaacatgcaggtttgtt

SEQ ID NO: 8710 - DNA, 80 bp, Homo sapiens
caggatgaagaataaagtccttagtgtagtcatcaaggcactgtgttgtcttgtcactgactgactctagtttcatcctg

SEQ ID NO: 8711 - DNA, 109 bp, Homo sapiens
gtctggaagagccttcgtgattggtgaaaatacaactgattttctagtagaaatatagcttccctccagaagatctattccacctgagcaagaagctggttctttaggc

SEQ ID NO: 8712 - DNA, 95 bp, Homo sapiens
atacatctgataaggaatctatatataagatatatgtatatataatatttgtacatatatcttgcatatcttatatacaagtctcatatctgtat

SEQ ID NO: 8713 - DNA, 95 bp, Homo sapiens; identical to SEQ ID NO: 68

SEQ ID NO: 8714 - DNA, 93 bp, Homo sapiens; identical to SEQ ID NO: 69

SEQ ID NO: 8715 - DNA, 83 bp, Homo sapiens
tagtcggcaatctagtctctcttgtgactctgacagtaacaaaataggtaagaagttggtgcataaagatgctttgttgactg

SEQ ID NO: 8716 - DNA, 116 bp, Homo sapiens
atcactgcctgtgaacttggatggacaagagcgatcttagtttattttttgttgctataaaaaaatacctgaggctgtgtaatttagttcataaagaggtttatttagctcatggt

SEQ ID NO: 8717 - DNA, 106 bp, Homo sapiens
atgtggtctctccagcatggtgtcttcagggtagcttatttttttatatggaagctccaatctgccactgtatgtgtcctgagaaagagccacaaagaagccatat

SEQ ID NO: 8718 - DNA, 74 bp, Homo sapiens
tcccccaagaggtttgagcagtggggcactgaagacaccagccactccctctgtcacacactctgtgaggggga

SEQ ID NO: 8719 - DNA, 113 bp, Homo sapiens
ttgagcttgttgattctatatttaagactccagccttgaatggaatttttgtcttttctttttcttctttttttttttttagatggagttttgctctagtcacccaggctgga

SEQ ID NO: 8720 - DNA, 111 bp, Homo sapiens
gtttgtttctttttgtttgtttgtttgttttcgtttctctctgacaatcactgagtttcttctgtgctcattcactgtgacctgaaggggagcctcaggcataggaactgc

SEQ ID NO: 8721 - DNA, 58 bp, Homo sapiens; identical to SEQ ID NO: 605

SEQ ID NO: 8722 - DNA, 109 bp, Homo sapiens
ggcaagggatatgattatacttgctggagccttgtgttcatatttgtgtcacagatgactgtgaccagaggaatagcacactctggttcatatgttcactcctgtgacc

SEQ ID NO: 8723 - DNA, 97 bp, Homo sapiens; identical to SEQ ID NO: 1307

SEQ ID NO: 8724 - DNA, 88 bp, Homo sapiens; identical to SEQ ID NO: 1308

SEQ ID NO: 8725 - DNA, 81 bp, Homo sapiens; identical to SEQ ID NO: 1309

SEQ ID NO: 8726 - DNA, 77 bp, Homo sapiens; identical to SEQ ID NO: 1310

SEQ ID NO: 8727 - DNA, 74 bp, Homo sapiens
tgtatttatacatatgtgtaaacattgtgtgtgtgtatatatatatatatataggatatctgtgtgtacatata

SEQ ID NO: 8728 - DNA, 78 bp, Homo sapiens
gtatatgagtgtatatatatatatatatatatatatatatatgtgtgtgtgcgtgtgtgtatgtgtatatatgtatac

SEQ ID NO: 8729 - DNA, 138 bp, Homo sapiens
gtatgtatgtatgcaaatagcatgtttacaaatacaaatactatgtatatatagtatatatttgtatatatgtatgtatactatatatgtgtatatacatatgtatgtatatacacatatgtatgtgtatccatatgt

SEQ ID NO: 8730 - DNA, 57 bp, Homo sapiens
gtgtatatatatatgtatgctcaatacaaatttatttgtatatatgtatatatacac

SEQ ID NO: 8731 - DNA, 91 bp, Homo sapiens
ctgtggccacccctccccctaggggctcaggcccagagagatccattttctgtccctgagtctctggctggagttattagagttgctgcag

SEQ ID NO: 8732 - DNA, 133 bp, Homo sapiens
gtgtatgtgtgtatatatatatgtatatgtgtgtatatatatgaatatacatgtatatgtatatgtgtgtatatatatgaatatacacgtatacgtatatgtgtatatgaatatacacatatatgtatgtgta

SEQ ID NO: 8733 - DNA, 95 bp, Homo sapiens; identical to SEQ ID NO: 580

SEQ ID NO: 8734 - DNA, 93 bp, Homo sapiens; identical to SEQ ID NO: 69

SEQ ID NO: 8735 - DNA, 111 bp, Homo sapiens
tatatatagtctaatcgtaacaataaccttatgaggtgactactgtttttcttcatccttattttagagacagggtgacatacgggaaggttgttacatagtctgtacatg

SEQ ID NO: 8736 - DNA, 82 bp, Homo sapiens
ttccctgactctctccctgacatatttcattagctagattgggtcaccagactatgacatgacaggaagaaatgcagaggga

SEQ ID NO: 8737 - DNA, 104 bp, Homo sapiens
aagtctgtcacatttgcttgatatggttttggcctgaaaacattagaattgataaaccaatttgtttttttatgaatcactaataatttgagcatgatagattt

SEQ ID NO: 8738 - DNA, 97 bp, Homo sapiens
caagtttccacccgccacacaagttttctgtttttgtaagctgtaaagatccaacaagcttgaaaagtacagatattgttggtctttctctactctg

SEQ ID NO: 8739 - DNA, 88 bp, Homo sapiens
atggacagattcagcttatattttgaaggtaaagctgacaacacttattgttggattggatttggaatgtaagaaaaatcgattccat

SEQ ID NO: 8740 - DNA, 62 bp, Homo sapiens
tgtatatataacagcacacacacaaatatgcacacatgtgtgtgtgtgtatatatatatata

SEQ ID NO: 8741 - DNA, 85 bp, Homo sapiens
tcttgatgattgcctctctgtcactcttgctgcctacctaactctggatcaggcatttgcatgtttcatcctggcacctccaagg

SEQ ID NO: 8742 - DNA, 66 bp, Homo sapiens
gccatgatccagctttgcatgtatttcttcactccctttagtcaacatgtaggttgttttcatggt

SEQ ID NO: 8743 - DNA, 117 bp, Homo sapiens
gtctctgtccagcaatctctaccttgccgataaaatggggtttttatttgtatatgtaaatgttataaagaataacaacctcattgtcatctccaagaagacaccctggaaaaggat

SEQ ID NO: 8744 - DNA, 111 bp, Homo sapiens
gggtaattttacttgttagaaaattgagttaagatcagtgattttgtagttatcaaccattgatgttgattttttgctgcaaaactgatttctcttcctatgtctaagccc

SEQ ID NO: 8745 - DNA, 116 bp, Homo sapiens
agaatgattatatgatttttgagtctagtgctcagtattttacagtcagttgtactctgaaagtttttttttcttagtctcaaaactgttgaagattagaacttaagtttgattct

SEQ ID NO: 8746 - DNA, 115 bp, Homo sapiens
ggcaaaatcattgaaaatgtgtgtgtatggggtctcacattcttgactctttcagaactttgaaagcagtcatttgtggctattttgcacagtaagcatattcattttttttctc

SEQ ID NO: 8747 - DNA, 110 bp, Homo sapiens
gtgtttgggacttgggactggcttcttgactccttagcttgcagaaggcctattatgggacttcacattttgatcatgtgagtcaattcacctagcaaagtccccttcat

SEQ ID NO: 8748 - DNA, 80 bp, Homo sapiens
tcgttggactgctgctgggaatgtgcactttggtgactcaaattttttgtgactctctgcatgtgcatgtctgtcaacga

SEQ ID NO: 8749 - DNA, 118 bp, Homo sapiens
ctgtggttaaaatggggaagaaaatggcagcttttggagaatatagatgaaagacaaaatatttatttatttattttttgagacagtgtctcgctctgtcgcccaggctggagtgcag

SEQ ID NO: 8750 - DNA, 88 bp, Homo sapiens; identical to SEQ ID NO: 1308

SEQ ID NO: 8751 - DNA, 81 bp, Homo sapiens; identical to SEQ ID NO: 1309

SEQ ID NO: 8752 - DNA, 77 bp, Homo sapiens; identical to SEQ ID NO: 1310

SEQ ID NO: 8753 - DNA, 92 bp, Homo sapiens
gtgtgtgtgtatgtgtgtgtatatatatatatatagagagagagagagagatctagatatattagtgtgtgtatatatatatatatacacac

SEQ ID NO: 8754 - DNA, 76 bp, Homo sapiens
tatatacgtatatgtacatatgtacatatatacgtatatgtacatatgtacatatatgtatatacatatatatgta

SEQ ID NO: 8755 - DNA, 85 bp, Homo sapiens
gggtcaaatgtatagatatatatgtgtgtatatatataacatatatagaatatataacatatatagaatatatatcatatctata

SEQ ID NO: 8756 - DNA, 65 bp, Homo sapiens
ctaggtcacactaactctctgtgccatgcagctgctgccaggaggtggggtaggggtggcactgg

SEQ ID NO: 8757 - DNA, 92 bp, Homo sapiens
acatttattttgttttctgttgtcctttccttttctgtcttagcttgtagaatcttagagagagagagagagagagaaatcagtgcctgtgt

SEQ ID NO: 8758 - DNA, 95 bp, Homo sapiens; identical to SEQ ID NO: 68

SEQ ID NO: 8759 - DNA, 93 bp, Homo sapiens; identical to SEQ ID NO: 69

SEQ ID NO: 8760 - DNA, 68 bp, Homo sapiens
ccccctgttccgcggcacccagtcccattgaccacccaatggctgaggagtgtgggtgcacagtgggg

SEQ ID NO: 8761 - DNA, 78 bp, Homo sapiens
ggagggttgcttgagcctggaagttctttttgtatatgaatatatagtttttccagctccatttattggcaataattt

SEQ ID NO: 8762 - DNA, 104 bp, Homo sapiens
gtgtgaggacagcttggagatggactgagggaaacatgagatgtctttctctttatttgtatctttaaatttctttcaggaatgttttgtagttttcagtgtac

SEQ ID NO: 8763 - DNA, 91 bp, Homo sapiens
ggttgcttcatagtgtcactgtctgtgtatttcagtgtgtttttgtagtggctggtaattggagcccacagactgacactgcttggcttct

SEQ ID NO: 8764 - DNA, 95 bp, Homo sapiens; identical to SEQ ID NO: 68

SEQ ID NO: 8765 - DNA, 93 bp, Homo sapiens; identical to SEQ ID NO: 69

SEQ ID NO: 8766 - DNA, 74 bp, Homo sapiens
ttgttgttgttgagatggagtctcgctctctcacccaggcttgagtgcagtggcaagatctcgacccacggcaa

SEQ ID NO: 8767 - DNA, 144 bp, Homo sapiens
tatacatatatatgtttgtacatatatgtatgtatgtatatatacatatatgtatgtatatatgtatgtatatgtgcatatatacatacatatatgtatatgtgtatgtatatgtgtatatatacatacatgtgtgtatatatg

SEQ ID NO: 8768 - DNA, 95 bp, Homo sapiens; identical to SEQ ID NO: 68

SEQ ID NO: 8769 - DNA, 93 bp, Homo sapiens; identical to SEQ ID NO: 69

SEQ ID NO: 8770 - DNA, 106 bp, Homo sapiens
ccttgaagaggtctttcacatgtcttgtgagttgtattcctaggtattttattctttttgtagcaattgtgaatgggagttcactcatgatttggctctctattgg

SEQ ID NO: 8771 - DNA, 98 bp, Homo sapiens
ggatcccatcatatgatagatagatagatagatagatagatagatagatagatagatcttattttattatatttatgttactgggaagtgtggggccc

SEQ ID NO: 8772 - DNA, 115 bp, Homo sapiens
tcttttttaagattgatttggctatttggggtcttttgggatccacataaatttttttgtatttgttaaaaaaataccactgggatttcaacaggtatcatatttaatctgtaga

SEQ ID NO: 8773 - DNA, 84 bp, Homo sapiens
ttgagacggagtctcactgtctcccaggctggagtgcagtggcgtgatctcgatcttggctcactgcaagctccatctcctggg

SEQ ID NO: 8774 - DNA, 58 bp, Homo sapiens
tgagacagagtctcgctctgtcacccaggctggagtgcagtggcgagatctcagctca

SEQ ID NO: 8775 - DNA, 95 bp, Homo sapiens
gggtgtttatattcagtgtgtgtttcttatgggcaacatatagttaggtcttgtttatttattttattttgacgtggaatctcactctgtcaccc

SEQ ID NO: 8776 - DNA, 96 bp, Homo sapiens
agggtagaatgactcacactcaagtattaagtgaagatactttttgtacttttcttttcttctttcttttttctttttgagatggagtctcactct

SEQ ID NO: 8777 - DNA, 67 bp, Homo sapiens
agagtgagtgctgtttcactttatataaattattcttatttttttttttgagacagagtctcactct

SEQ ID NO: 8778 - DNA, 175 bp, Homo sapiens
tgctacatcctcactagcatatgttattttttctctttaataaaagtaattttgacagggatgggatcatatcttagtgtggttttgatttgcattttcctgatgattagtgattttgaactttttaaaatgtacttcttggccatttgtatgtcttctttgagaaatgtctatt

SEQ ID NO: 8779 - DNA, 118 bp, Homo sapiens
cttttttgttcttactgaaatgttggtagagctgatgcttttgatgagagaaaaatgagtgaatatgatgaattatttgatagctattggctcaaaacttgtggtatgagagaatgag

SEQ ID NO: 8780 - DNA, 84 bp, Homo sapiens
gatattatttcatactcttctgtgtgggtctgaattatttattttattttcaaaacctcccaaaaggggagaatgacatacatc

SEQ ID NO: 8781 - DNA, 128 bp, Homo sapiens
ggagtcttgaagaaatcatgtgcagctttccttatgctgactccttcccatgacagaacacacagaggacactgctccccagcaacagaaatgcagcaacatgtttttgatgttcctgcccagggaag

SEQ ID NO: 8782 - DNA, 210 bp, Homo sapiens
tatgttatatattatatatactttatatatgtatatgttatatattatatatactttatatatgtatatgttatatattatatatactttatatatgtatatatgtatatgttatactttatatatgtatatatgtatatgttatatatactttatatatgtatatatgtatatatgttatatatacttcatgtatatatgtatatatgt

SEQ ID NO: 8783 - DNA, 202 bp, Homo sapiens
tatgtatatatgtatacatattatatatatactttatatatgtatatatgtatacatattatatatatactttatatatgtatatatgtatacatattatatatactttatatatgtatatatgtatacatattatatatactttatatatgtatatatgtatatatattatatatactttatatatgtatatatgtatata

SEQ ID NO: 8784 - DNA, 108 bp, Homo sapiens
acttgtggtttcagcaagtgtatgttggcatcttaggtatgtaaagaaaactagattgttgactagcaagtgacctaagaaactttccattttgctgtttgacctagt

SEQ ID NO: 8785 - DNA, 87 bp, Homo sapiens
cacagtctgagtaaggtctcacctcacatggaggaagcagagtgaagtttggctccagggagaaggcctttgtgtactgggagtgtg

SEQ ID NO: 8786 - DNA, 117 bp, Homo sapiens
gtacaacttctaaattatatatatatatatatcaacatatatatataatttttaaattaaaaaatataaacatttaaaaatatgtaaatgtgtatacatgtgtgtatatgtatgtac

SEQ ID NO: 8787 - DNA, 70 bp, Homo sapiens
gagtagaattctgcttttgaagttgtgtagttataagactttataattatttttcagatgttttctattc

SEQ ID NO: 8788 - DNA, 118 bp, Homo sapiens
ttcctgatatcggattaattactatctttattgtaattattaatatcgatgaatactattaatttttattatgtctattaatattaataataatataattgttcctgatatccggggg

SEQ ID NO: 8789 - DNA, 84 bp, Homo sapiens
tctccttctctgccactctgccactctgacacctctctgccagtggagcctggagtttttatgggtacaagacggggggcgggg

SEQ ID NO: 8790 - DNA, 107 bp, Homo sapiens
tacattttggcttcatgcacattgatacattttttaaaaattttattattattatactttaagttttagggtacatgtgcacaatgtgcaggtttgttacatatgta

SEQ ID NO: 8791 - DNA, 91 bp, Homo sapiens
cttagtttgggcagatatgaaattctgggttgaaaaatttttttctttgaaaatgttgaatattggccctcaatttcttctgacttgtagg

SEQ ID NO: 8792 - DNA, 81 bp, Homo sapiens
ggatatatatatatatatatatatataataggtatgcgtgtgtgtatataggtatatatatgtgtatatgtgtatgtatgc

SEQ ID NO: 8793 - DNA, 94 bp, Homo sapiens
acagacaaaacctctgcagactggaaggcagagcccattacgtttaccccaagcacctctgactctctctgtgtgccgaggacgaggtaaatgt

SEQ ID NO: 8794 - DNA, 115 bp, Homo sapiens
tgtatgtttgtttccttttccagaattgaaaagtattcggtcattatttatttaaataagcattctgtcccctttctctttctctgctccttctgggaaatctataatgcataca

SEQ ID NO: 8795 - DNA, 58 bp, Homo sapiens
tgagacagagtctcgctctgtcactcaggctggagtgcagtggcgtgatctaggctca

SEQ ID NO: 8796 - DNA, 95 bp, Homo sapiens; identical to SEQ ID NO: 68

SEQ ID NO: 8797 - DNA, 93 bp, Homo sapiens; identical to SEQ ID NO: 69

SEQ ID NO: 8798 - DNA, 79 bp, Homo sapiens
agacagagtgtaatgaggaagtcccaatggctaggacctagttttggagaaaacatacacacactcacacactctctct

SEQ ID NO: 8799 - DNA, 119 bp, Homo sapiens
tgaagaacaagaaatcagagggtaatagatgtagagaagaaaaatactgtgatattagtcaccgttatttattttttttttagattacaaaacatttctgaattcataaaatgttttca

SEQ ID NO: 8800 - DNA, 71 bp, Homo sapiens
tctcagctcactgcaacttctgcttcaggggttcaagcgattctcctgtctcagtctctgagcagctggga

SEQ ID NO: 8801 - DNA, 107 bp, Homo sapiens
gctcaaattgagttaatgacagttacacatttgtatttttatatatataatacatatacatatatatataatctgctgtatgtttggtaatgtaggacatattgagt

SEQ ID NO: 8802 - DNA, 57 bp, Homo sapiens
tccttgtttctttaccttgagggtgcagccctgaagagtgaagacagtgacgagtga

SEQ ID NO: 8803 - DNA, 115 bp, Homo sapiens
atgagttcagaaatatcagagatggcatgtcaggcagatggagttagaatatagatatatatatatagagagagtaaatgtgcaaaaccgtgaagcttctgatgtgagagatcat

SEQ ID NO: 8804 - DNA, 134 bp, Homo sapiens
ggttttgtgagctcatgttggcctctgtgaatctcagcggttttgtgagcccacatttgcctctgtgaatctctgagaggttttgtggcccatgttggcctctgtgaagctctgagcagttttgtgagcccaca

SEQ ID NO: 8805 - DNA, 194 bp, Homo sapiens
tacaatatattatataatatctataatatattataatataatataatattaaaatatattataatataatatataatatttataatatatgtaatttataatatctttatttataatatctttatttataataaagatactgtaatcaagtatctttagctaatcaagcattttgtgggaagatgttttcaatt

SEQ ID NO: 8806 - DNA, 81 bp, Homo sapiens
ttggaaaaggatgtggtcaaaataaaaatacacttgcaaatatgtatttatatttgctcctctgtgccactaaatttccaa

SEQ ID NO: 8807 - DNA, 95 bp, Homo sapiens
agtctctttttctctctctctttccatatatatgtatgtatgtgtgtgtattcatatatatatatatagtctatatatagagagagaccttgact

SEQ ID NO: 8808 - DNA, 86 bp, Homo sapiens
gagcattgtctttggttttctgcctgtacagggcccagattattgtgtctgcttttggaggtggctaaccatcaggttaacagctt

SEQ ID NO: 8809 - DNA, 90 bp, Homo sapiens
gtatatatatgtatgtatgtgtgtgtatatatatacctatatatgtatatatggttatatatcttacatatctatatatagtatatatat

SEQ ID NO: 8810 - DNA, 120 bp, Homo sapiens
ctgcttcttcatagtaaatctccctcctctttctgtctttgtctctgtatctgtctcttgatagatgatagatagatagatagatagatagatagatagataggatctatagatagatag

SEQ ID NO: 8811 - DNA, 112 bp, Homo sapiens
cattgtggttttgatttgcatttctctaatgacttgtgatgttgaatattttttcatgtatttgttggccacttgtatgtcttcttggagaagtgtctgtttgtatgctttg

SEQ ID NO: 8812 - DNA, 118 bp, Homo sapiens
aaggtaaacaatacctaagcccagatatggacagagctgtgagcactcttttttttttttaaccaataaatgaatttcttgcttattgctgtgcattagggaggtaaggttgcttctt

SEQ ID NO: 8813 - DNA, 70 bp, Homo sapiens
ggctccatgactgatgaggaggtgagtgtgccatctttgactgcttacacacactctctgcatctctgcc

SEQ ID NO: 8814 - DNA, 95 bp, Homo sapiens; identical to SEQ ID NO: 68

SEQ ID NO: 8815 - DNA, 93 bp, Homo sapiens; identical to SEQ ID NO: 69

SEQ ID NO: 8816 - DNA, 115 bp, Homo sapiens
agtcaagggtttggggaacctaatcacagcctcatgaggggagaagttgagacccctcactccttcactcagtcttttctggtggggttggcatttgggccacagttttttttct

SEQ ID NO: 8817 - DNA, 116 bp, Homo sapiens
cagcagcagagtaaaagtgttccctttttaccacatccatgccaacatctatttttttttatttttaaattatggccattcttgcaggtgtaaggtggcattgcactgtggttttg

SEQ ID NO: 8818 - DNA, 101 bp, Homo sapiens
acagatataagatatcagtatgttcaaaataataatagcaacaatgtatttaattatacatgttgaggtatatatgtttgtgtgcatgtgtgtgtgtgtgt

SEQ ID NO: 8819 - DNA, 112 bp, Homo sapiens
atatgtttcaatgtcagtgtatatatatcagcctcatttttttaatatataattttttattatattttaagttctagggtacatgagcacaatgtgcaggtttgttacatat

SEQ ID NO: 8820 - DNA, 97 bp, Homo sapiens
gtgagcaataaattaggcacttttttttttcctttttttgagatggagtctcgctctgtcacccaggctggagtggagtggcatgatcttggctcac

SEQ ID NO: 8821 - DNA, 80 bp, Homo sapiens
tgtgctgctttcaagttggctgtattttttttcatatatgactcacaaggtaaataaaaatggtctatttgagcagcata

SEQ ID NO: 8822 - DNA, 114 bp, Homo sapiens
atgtgttaattaggtacatttttgtttgaatttcaaaatgtgtgggaagtttttatttttgtaattaacttttaacggatttgaagtatgatcagaaaatagtctgcaatatat

SEQ ID NO: 8823 - DNA, 58 bp, Homo sapiens
tgagatagagtctcactctgtcacccaggctggagtgcagtggtgcgatctcggctca

SEQ ID NO: 8824 - DNA, 95 bp, Homo sapiens; identical to SEQ ID NO: 68

SEQ ID NO: 8825 - DNA, 93 bp, Homo sapiens; identical to SEQ ID NO: 69

SEQ ID NO: 8826 - DNA, 65 bp, Homo sapiens
ctgaaaggggggtgttgaaatctccagctattactatattggagtctctctctctctctcttcag

SEQ ID NO: 8827 - DNA, 79 bp, Homo sapiens
catccaaggtttgaacactgtcttggagtcaagaggcaaaggcatttgctcactgaacagagactgttcattcagaatg

SEQ ID NO: 8828 - DNA, 93 bp, Homo sapiens
ccaagtatctggaactacaggtgtgtgccaccacactcggctaatttttatatctttagtagagacggggtttcaccatgttggccatgctgg

SEQ ID NO: 8829 - DNA, 88 bp, Homo sapiens
gttgtttggttttctgcagtacctgattggtggccctatggaagtttaggtacagaaacctatcttgtctggaaggaccttgctgtac

SEQ ID NO: 8830 - DNA, 75 bp, Homo sapiens
ctttgacagtcacacactgagtgctggtttgggtccaaccattggattagaactgctagacgtgcacagttgagg

SEQ ID NO: 8831 - DNA, 127 bp, Homo sapiens
ggagtgctcacatgtgagttgtagcttttttttttttttttttttgaaatggagcctcgctcacactgtcacccaggctggagtgcggtggcacgatctcggctcactgcaacctccacctcctggg

SEQ ID NO: 8832 - DNA, 74 bp, Homo sapiens
gtattctcagaggtatgatttacctgttgatgcggcttttgttgaattaactcaatctctctgagcctcagtgc

SEQ ID NO: 8833 - DNA, 110 bp, Homo sapiens
ctgttgtcatcattcttaccttgacactccatgacagattgacacaggctctctctctttatcctgtgacagttcttcactgtgagtcctaacatggttgtcctcgacag

SEQ ID NO: 8834 - DNA, 111 bp, Homo sapiens
cctgaacagggtccctgaggcccagggactcaatggagcctcagagctgagagtcagatcagagctgggattggggcagcctgggtctaaatggagcacctgctgctcagg

SEQ ID NO: 8835 - DNA, 133 bp, Homo sapiens
ccagctgctcagaggcagagtgtgaaaaggagatgctgagaagctcccaggttcccagtccctgtcactgtcactggaaagaaaatgacgccattgagaaagatgtgtggagggcaacctgaggagccactta

SEQ ID NO: 8836 - DNA, 72 bp, Homo sapiens
gcatgtacatgtgtgtgcatgtgtgtgcatgtacgtgtgtgcatgtatgtgtgtgtatgtgcatgtgcatgt

SEQ ID NO: 8837 - DNA, 129 bp, Homo sapiens
caagatgtgtgtgtgtatgtacgtgtgtgcatgtatgtgtgtgcatgtgcatgtatgtgtgtgcatgtgcatgtatgtgtgtgcatgtacacgtacatgtgtatgcatgtatgtgtatgcatgtacatg

SEQ ID NO: 8838 - DNA, 89 bp, Homo sapiens
gatccaattgattaagtgtctgatttatgtccagaatttttttgttagttttctgccacaatgatgtgtctaatactgtcagtgggatc

SEQ ID NO: 8839 - DNA, 112 bp, Homo sapiens
tcccattttctgtgtgtgaatattctcatgatgtccttatatatttttgttacaatcttgtcttcacacaaggaacataaaatatcatcatcaccaccattaaacactgggg

SEQ ID NO: 8840 - DNA, 94 bp, Homo sapiens
gcgataaacactaagtctctctcctgtctcagtctcctgcccccaacctttcctatgcagtgcaggtgagcagggaagtgggagatttaaacgc

SEQ ID NO: 8841 - DNA, 89 bp, Homo sapiens
ggctatggtccccactttataaatgaggaaatgacttctcaagggcactgagaagtcattttttcttttataaagtggggaccatagcc

SEQ ID NO: 8842 - DNA, 67 bp, Homo sapiens
ggccaccacagaggcagagccagaccatgcagattcctccctgggtctctgcctctctcatctgccc

SEQ ID NO: 8843 - DNA, 89 bp, Homo sapiens
agagattatcaaagatgtgcttgttattttatgtatgtatgtatgtacatatgtatgtatgtatttttgagatggcagagtcttgctct

SEQ ID NO: 8844 - DNA, 71 bp, Homo sapiens
gactctcacccactctctgtgttcagggaagtagcctcccctgtaggagcactgatgtggtagatatagtt

SEQ ID NO: 8845 - DNA, 58 bp, Homo sapiens
tgagacagagtctcgcactgtcacccaggctggagtgcagtggcgtgatctcggctca

SEQ ID NO: 8846 - DNA, 91 bp, Homo sapiens
ctttgtctctgggatccagtagtgttgaatgagtgagtgaatgaacaaattatttatttatttatttatttatttattttttgagacagag

SEQ ID NO: 8847 - DNA, 85 bp, Homo sapiens
gtctcagagacctcagctttggccactaagctaaaaaataagtcccttatttgtttaagccactgtggttaggttgttctgtcac

SEQ ID NO: 8848 - DNA, 86 bp, Homo sapiens
agcgggggggattaatgtgtgtctataacagactttttttttttttttttttttttgagatggagtctcactctgtcgcccaggct

SEQ ID NO: 8849 - DNA, 117 bp, Homo sapiens
gagcctaagaatccccgtaaatgaagtggtggtgctgggactcaaatgaggcctgagaaactccaagtccatgatcttccccagtaccaagccacccccaacagctggagtagtctt

SEQ ID NO: 8850 - DNA, 83 bp, Homo sapiens
tgagacagagactcactctgtcacccaggctggagtgtcactctgtcacccaggctggagtgcagtggtgcgatctcagctca

SEQ ID NO: 8851 - DNA, 58 bp, Homo sapiens
tgagatggagtctcactctgtcacccaggctggagggcagtggtgtgatctcagctca

SEQ ID NO: 8852 - DNA, 110 bp, Homo sapiens
ggattttcttgcctatgccggctcttttggttccatatgaaatttaaagtagttttttccaattctgtgaagaaagtcagtggtagcttgatggggatggcattgaatct

SEQ ID NO: 8853 - DNA, 58 bp, Homo sapiens; identical to SEQ ID NO: 315

SEQ ID NO: 8854 - DNA, 58 bp, Homo sapiens
tgagacagagtctccctctgtcgctcaggatggagtgcagtggtgcgatctcggctca

SEQ ID NO: 8855 - DNA, 79 bp, Homo sapiens
gggatatttaagctgagtctgcagagtgagcagagttggtcaaaggaaggcagatagtaggcagcgggaggtggtttcc

SEQ ID NO: 8856 - DNA, 95 bp, Homo sapiens
gtggcaagaaatgattgtgcaccagggagggatggggcagaggcctctcctagggagccatctgtccctcgctctgtcagcccttcatcacccat

SEQ ID NO: 8857 - DNA, 56 bp, Homo sapiens
tgactgagtctcactctgtctcccaggctggagtccagcggtgcaatctcagctca

SEQ ID NO: 8858 - DNA, 95 bp, Homo sapiens; identical to SEQ ID NO: 68

SEQ ID NO: 8859 - DNA, 93 bp, Homo sapiens; identical to SEQ ID NO: 69

SEQ ID NO: 8860 - DNA, 93 bp, Homo sapiens
tcatcagctcacagtccagccccactcattcatgcatataacagatatcactgagcacatgctatgtgtcaggcactgttgcagtgctggtga

SEQ ID NO: 8861 - DNA, 93 bp, Homo sapiens
gagcagtccagagctgagaccaggcctccaaagaaactggctgtgtcgctatggcacgtgcctctctctctgagtctggtcctcttttgtctg

SEQ ID NO: 8862 - DNA, 72 bp, Homo sapiens
ggagttggtcattgggcctcagctaaggaagcagtagaatacagtggaacacagttgacagtgtgcagctcc

SEQ ID NO: 8863 - DNA, 90 bp, Homo sapiens
aggctctggcccacagctagtgactctcagactgacatggtggacctgaccttcccccaatgcttgggattcagctgcttgcctgactct

SEQ ID NO: 8864 - DNA, 58 bp, Homo sapiens; identical to SEQ ID NO: 315

SEQ ID NO: 8865 - DNA, 72 bp, Homo sapiens
tgcgctggggcagtcagtctttctttgtctctctgaggtaagagatcttgaagaatgaggcagttacaggta

SEQ ID NO: 8866 - DNA, 78 bp, Homo sapiens
gtctggcccgtgggtggtcacagggtgccaaggaccctagtgctgtttcttggccctgccactcactggctgtgtgac

SEQ ID NO: 8867 - DNA, 79 bp, Homo sapiens
tgggtgacatgggaactgtttggcggagtgcgctgggtcgtgtctattgtctctcactcaccgtctctgccatcctctc

SEQ ID NO: 8868 - DNA, 112 bp, Homo sapiens
gcctctctgtgcacagctgtccactgcaaacttgtctccctctctctgtggctgggcaccaggacatgtgaagaaggaagttctcaggttatagggactcagcctccagggc

SEQ ID NO: 8869 - DNA, 113 bp, Homo sapiens
gtctctggagtagctaagactacagttgtgagacaccacacaaggctaatgtttttatttttaatagagatgatgtcttggtatgttgcccaggctggtctcaaactcctggc

SEQ ID NO: 8870 - DNA, 95 bp, Homo sapiens
gagggaaggtcccaccctggtgaggcaaaagctccgggaaatctgtgttcatgagttctctgcctgcctgtttacctgtgggggtgcagtgtttc

SEQ ID NO: 8871 - DNA, 95 bp, Homo sapiens; identical to SEQ ID NO: 68

SEQ ID NO: 8872 - DNA, 93 bp, Homo sapiens; identical to SEQ ID NO: 69

SEQ ID NO: 8873 - DNA, 112 bp, Homo sapiens
gtaaaacaaatctttaatgaagaacgggaagaatctatgacaggaaggggcttgagagaacactctgaggtgatggcaattctttgtgtcttcatgggggtttgcattgtgc

SEQ ID NO: 8874 - DNA, 86 bp, Homo sapiens
gtctgtgtttctgtgcaagtgtgtggccaagtgtgcgcatacccacactgtgctgtctgttactcactgtgcctctttcacttgac

SEQ ID NO: 8875 - DNA, 84 bp, Homo sapiens
agtggacactcagggacagttgtgtaatttgtgaggttgcaggtctcacaagagacagagctcagatgcaaactcaggtctact

SEQ ID NO: 8876 - DNA, 112 bp, Homo sapiens
tgcatgtcacaagccagtcgcctggggcaggaataggacaggctgccaggctctccctccctgtctctatttcctttctcacggccactgctccctcctgaaggtggcagca

SEQ ID NO: 8877 - DNA, 77 bp, Homo sapiens
ccctgtcagcctctcagtcagtccaggaaaagcctttcttcatcctggaagtcgggaaatgtggctccctaacaggg

SEQ ID NO: 8878 - DNA, 109 bp, Homo sapiens
ccaaaatttactgccagttgagaaatactatgatgggactacaaattctcccactttttttttttttgagatgtagtcttgctctgtcgcctaggctggagtatagtgg

SEQ ID NO: 8879 - DNA, 97 bp, Homo sapiens
ttaggatcatttctggaagagactcagcacactgggccgggtagttgcttgaaaagtacctttcaggaagccaaggaattctgcagacaaagcctgg

SEQ ID NO: 8880 - DNA, 71 bp, Homo sapiens
tagcgtgggatgtacaaacttcctgtacaggaggctggagccttttgtgtagggagacagcagccaggcta

SEQ ID NO: 8881 - DNA, 118 bp, Homo sapiens
tgggattcactgagcttcctggttctttgggtttgttggtttgtttatttgtttatttttttgtttgagacagaatcttgctctgttgcccaggctggagtgcagtggcatgatctca

SEQ ID NO: 8882 - DNA, 67 bp, Homo sapiens
attgtgagacagtctgacactctgacctcctgacaggaggcggtcgagggtgcacctcctcatcaat

SEQ ID NO: 8883 - DNA, 94 bp, Homo sapiens
ggagatcattttatggtgaagggcattctatagacgtgagctcattacttgtatctatagaattcactgtttttgccatgtgctacacatcacc

SEQ ID NO: 8884 - DNA, 154 bp, Homo sapiens
tataggcaaaattttcatatatatatatgtgtgtgtgtgtatgtatatgtgaatatatgtgtgtatatatatgtgtatatatgtgtgtatatatgtatatatgtgtgtatgtgtatatatgtgtatatgtgtatgtgtgtatatatgtatatat

SEQ ID NO: 8885 - DNA, 79 bp, Homo sapiens
tcaggatcagaggtaaactcttctgggtatggtggcatatttcagtatcactcacagtgagtttctctctccagtctga

SEQ ID NO: 8886 - DNA, 119 bp, Homo sapiens
tgtatcaggtgtgggaatgtaatgttactttatttttatatgctttaattttttttaaattaaggcttatgtttttagaaaatagtagactcacatacatgtagtacacctgtatttgc

SEQ ID NO: 8887 - DNA, 78 bp, Homo sapiens
tgcatgagcttctctttttgagtctcactttatcactcaggctagagtgcagtggcatcatgatctcagctcactgca

SEQ ID NO: 8888 - DNA, 118 bp, Homo sapiens
ccactaagcctagctgggcagactaattagaatttattttcaaaaacagaagaatgtatgaattattcattttcataatctgtttttctaataggctattaatctgggttattggttt

SEQ ID NO: 8889 - DNA, 116 bp, Homo sapiens
tcctcatgttggatgatagtttggccaaatatagaattctaagctggacatcattttccctcagaagtttgaaagcactgatctattagcctttggcttctattgttgctgttgga

SEQ ID NO: 8890 - DNA, 95 bp, Homo sapiens; identical to SEQ ID NO: 68

SEQ ID NO: 8891 - DNA, 93 bp, Homo sapiens; identical to SEQ ID NO: 69

SEQ ID NO: 8892 - DNA, 75 bp, Homo sapiens
cctgcctcgctcagatgtcagcagagaggaacgcgcagtgtgtgcactggtgtgtgtctgtgagcctgtagggag

SEQ ID NO: 8893 - DNA, 73 bp, Homo sapiens
gagatggagtctcgctctgtcacccagactgaagtgcagtggtacagtctcggctcacagcaacctccatctc

SEQ ID NO: 8894 - DNA, 80 bp, Homo sapiens
ctctaacgtctttatatgtgtctgtgtttatatatacgtgtatgtatataaatatgtatacacatatataatatctggag

SEQ ID NO: 8895 - DNA, 105 bp, Homo sapiens
ttgttattttgaattccctttctcccattttagacattttgttttcttttttttttttgagacagagtctcgctctatggcctaggctggagtgcagtgtcgcga

SEQ ID NO: 8896 - DNA, 58 bp, Homo sapiens
tgagacagggtctcactctgtcacccagacgggagtgcagtggtacgatcttggctca

SEQ ID NO: 8897 - DNA, 85 bp, Homo sapiens
ctcaaaaactgatgaacatttggttccagtttgtggtcactatgaccaaagctgctttattttttatttgtttattttttttgag

SEQ ID NO: 8898 - DNA, 91 bp, Homo sapiens
cccctcgccatctctgtgcccctctctctgtgggtgccagatcctgacctctgactccaaagcccactagaaagcaccctatcctgagggg

SEQ ID NO: 8899 - DNA, 66 bp, Homo sapiens
tatatgtgtataacgtgtatatatatgtatattatacatgcatgtgtatatatgtgtatgtgtata

SEQ ID NO: 8900 - DNA, 111 bp, Homo sapiens
tgtgtatatgtatgtgtataatgtgtatattgtgtgtatataatatatatgtctaatatgtgtgtatatatattatatatgtgcatgcacacacacacacacacacacaca

SEQ ID NO: 8901 - DNA, 106 bp, Homo sapiens
tcttccagctgccaacctgggacatagagagtgaagagacatcctttgagaaggaaatcttaatttttatttaactgtgtatttacccaaaagaaagtgagttaga

SEQ ID NO: 8902 - DNA, 122 bp, Homo sapiens
gctgtctgggctggcttgttggcttgcatggcttggctggctgggtggctggatgtcctggctggctgcgtggctggctggcttggctggcttgtctggcttggctggctgggtggcaggct

SEQ ID NO: 8903 - DNA, 110 bp, Homo sapiens
gctggcctggctggctggatggctggctggcttggctggctggatggctggctgggtggctggctgtcctggctggctgggtggctggctggcttggctgtctggctggc

SEQ ID NO: 8904 - DNA, 88 bp, Homo sapiens
tgctcacttactctgattgccatcttcagcatcatcgtgatgatgataatgatgatgatgatgatgatgatataacaagatagtagca

SEQ ID NO: 8905 - DNA, 88 bp, Homo sapiens; identical to SEQ ID NO: 4661

SEQ ID NO: 8906 - DNA, 84 bp, Homo sapiens; identical to SEQ ID NO: 4660

SEQ ID NO: 8907 - DNA, 59 bp, Homo sapiens
ttgagacacagtctctctctgtcgcctgcccgggctggagagcagtggcgtgatctcgg

SEQ ID NO: 8908 - DNA, 117 bp, Homo sapiens
tccaccactctggagatgtgcctattctctgccatttacttattcatatgtatgtgattaactaaatatataaatgtaaatcagtatggaatcatgcatatttattttatacttggg

SEQ ID NO: 8909 - DNA, 98 bp, Homo sapiens
gattccaaacctcatatgacagaatatttttttttccttagtgtgaagatgtctatcaatggctagggccacctatctgtcacaaagctttggaactc

SEQ ID NO: 8910 - DNA, 74 bp, Homo sapiens
gccatttaggaggaagacagtgtgcacactgcttacacagagaatgcacagttgtcttccttacagttttcagc

SEQ ID NO: 8911 - DNA, 94 bp, Homo sapiens; identical to SEQ ID NO: 4656

SEQ ID NO: 8912 - DNA, 92 bp, Homo sapiens; identical to SEQ ID NO: 4655

SEQ ID NO: 8913 - DNA, 78 bp, Homo sapiens
agggtctcgctctgtcactcaggctgcagtgcagtggcacaatcatgcagccttgacctcctgggctcaagagatcct

SEQ ID NO: 8914 - DNA, 58 bp, Homo sapiens; identical to SEQ ID NO: 2595

SEQ ID NO: 8915 - DNA, 58 bp, Homo sapiens
tgagacagggtctcactctgtcacccagatgggagtgcagtggtacgatcttggctca

SEQ ID NO: 8916 - DNA, 85 bp, Homo sapiens; identical to SEQ ID NO: 8897

SEQ ID NO: 8917 - DNA, 85 bp, Homo sapiens
ggtgtgtgcttggagtcccagctactcaagaggctgaggtaggaggatgacctgagcccagggaagttgaggctgcagtgagccc

SEQ ID NO: 8918 - DNA, 105 bp, Homo sapiens; identical to SEQ ID NO: 8895

SEQ ID NO: 8919 - DNA, 89 bp, Homo sapiens
cattgattatgtcaatttatatctacacatggaaatacatatatatgtgtatatatatgtgtgtgtgtgtgtctatattgcagttaatg

SEQ ID NO: 8920 - DNA, 80 bp, Homo sapiens
acctttttttctgtataaattacccagtctcgggtatttctttatagtagcctgagaatggactaatacagtaaattggt

SEQ ID NO: 8921 - DNA, 80 bp, Homo sapiens; identical to SEQ ID NO: 8894

SEQ ID NO: 8922 - DNA, 71 bp, Homo sapiens
cctcagaaggaagcccagattcccacggtgcctacaaggcctgacactgtgggtcactccctgtcctgagg

SEQ ID NO: 8923 - DNA, 108 bp, Homo sapiens
agccggatatggtggtgtacgcctgtagtcccagctacttgggaggctgaggtagaaggatcacttgagcctagggaggttgaagctgcagtgagccattatagctcc

SEQ ID NO: 8924 - DNA, 120 bp, Homo sapiens
gtcatttataccaattatcccacttttattaccattgtaaaaataatatatgattttatgtagcatttatctgcaatgtatatgaaggtgtttttatagttgttacttcaaatgaatgac

SEQ ID NO: 8925 - DNA, 105 bp, Homo sapiens
gagctgagcagcagctgcccttccagccctcttcactctgacagatcacagagtccagcagggctgcagagcagagtgagaggggaccagctgctggagcagggc

SEQ ID NO: 8926 - DNA, 60 bp, Homo sapiens
tggacatgtgggaggatgagggctcttctgtgtgtcacacactgtcatcttcccaaccca

SEQ ID NO: 8927 - DNA, 117 bp, Homo sapiens
gaaaatgcaaatcataatgagatgccacatcacactccctattttggctgtagtcagacagacagacagacagacagacatggaatgtggaaagtaaaactctgtgacataattttt

SEQ ID NO: 8928 - DNA, 58 bp, Homo sapiens; identical to SEQ ID NO: 1099

SEQ ID NO: 8929 - DNA, 88 bp, Homo sapiens
tagccatctgtgacagtctgtgcctgtgatcctagctactccagagactgaggcaggaggatcacatcggcctgggagttcaaggctg

SEQ ID NO: 8930 - DNA, 111 bp, Homo sapiens
gccgggcacggtggcgggcgcctgtaatcccagctatttaggaggctgaggtagaagaatcatttaaacccggggggtggaggttgcagtgaaccgagattgtgacattgc

SEQ ID NO: 8931 - DNA, 109 bp, Homo sapiens
tgctgaggaagtgagggcctggtgatataggaagaattggattggggcttatatatctatatgtatatctatatctatctatatatctatatgtatatatctgttagta

SEQ ID NO: 8932 - DNA, 84 bp, Homo sapiens
tggaaggccgagggggcagatcacttgaggccaatagtttgagaccagcgtggccaacacagtgagaccctctctctctctcta

SEQ ID NO: 8933 - DNA, 78 bp, Homo sapiens
gcatgttggtcaagctactgtgttttggttctctgttatagcagactcactgactcacacgtatgtatgtttacatgc

SEQ ID NO: 8934 - DNA, 117 bp, Homo sapiens
gcctcctgactagctgggactacaggcgtgcgtgcgccaccatccccagctaatttttttatttttagcagagatggggtttcaccatgttggccaggctggtctcgaactcctggc

SEQ ID NO: 8935 - DNA, 57 bp, Homo sapiens
tgagacagggtctcactctgtcacccaggctggagtgcagtggtgtgacctgactca

SEQ ID NO: 8936 - DNA, 107 bp, Homo sapiens
gcactgaccctggaactgccaagtaactcgccgtgtgctctgaaagaatctgcttctcctctctaagtctcacagtgttttaggtggcatcttggaccaggcactgc

SEQ ID NO: 8937 - DNA, 108 bp, Homo sapiens
gtgtctgttcatgtcctttgcccactttgtaatggggttgtttgtatttttcttataaatttgcttaagttccttatagatgctggatatttgacctttgtcagatgc

SEQ ID NO: 8938 - DNA, 67 bp, Homo sapiens
gggcccagctctgtctgtttctgtgggtgtagccacccaggatgggtcgacatgcagaactaggctc

SEQ ID NO: 8939 - DNA, 154 bp, Homo sapiens
catgagaggccagagtcaggagggcagaataattgaaagaaacttttgcctctgaatatgtttctttcttttttctttgttttgttttgttttttttgagacagagtctcactctgtcacccaggctggagtgcagtggtgtgatctcggctca

SEQ ID NO: 8940 - DNA, 58 bp, Homo sapiens; identical to SEQ ID NO: 1435

SEQ ID NO: 8941 - DNA, 69 bp, Homo sapiens
atcatcacctccgctttgtgccattggtcactcacacagactaactctgggacaatgggaagggatgat

SEQ ID NO: 8942 - DNA, 95 bp, Homo sapiens; identical to SEQ ID NO: 580

SEQ ID NO: 8943 - DNA, 93 bp, Homo sapiens; identical to SEQ ID NO: 69

SEQ ID NO: 8944 - DNA, 90 bp, Homo sapiens
ggagtcacagtccatgaatgagtctcactcacagtttgccagtcccagggctgggggaactgatggaggcttggctaacatggtgacacc

SEQ ID NO: 8945 - DNA, 83 bp, Homo sapiens
cactttctgtgtgtcacttgagcatttttttttcttttttttttttgagactgagttttgctcttgtcacctgggctggagtg

SEQ ID NO: 8946 - DNA, 77 bp, Homo sapiens
ccaggtgcatctcctgaaagcctccagagtaaacctcctgtatgcacagggctctctgtctcagagtctgtccccgg

SEQ ID NO: 8947 - DNA, 59 bp, Homo sapiens
tcttgagagagtctctctctgtcactcaggctggagtgcagagagaggttcaatcatgg

SEQ ID NO: 8948 - DNA, 89 bp, Homo sapiens
gggggctctttcttatttgttcttggacccatggtgaaataaaagcttgtatatttttttagaaggattcatagagatgaaaggccctt

SEQ ID NO: 8949 - DNA, 116 bp, Homo sapiens
tggttctaaagatgtatttatttgtgacagttcattgacaatgtgttttattgtaatctttttttttttttttacagtgaacttagttaacagtgagcaaagcaagtgtaaggcca

SEQ ID NO: 8950 - DNA, 108 bp, Homo sapiens
gcaagacagcgatcagtgagagaggatgagacggtgatcagcgctacagcgatcaaagctacagtgtctgtgtgtctgtgtgactttatgctgagttgttaacattgc

SEQ ID NO: 8951 - DNA, 97 bp, Homo sapiens
gtttgtgttcagtatctgagaggctggctcactcagtgacaattttctgttgccacatactacagtcagcatacatagagactgtggacacctgaac

SEQ ID NO: 8952 - DNA, 86 bp, Homo sapiens
atgtccatatattcattatttttgtagcatgtgttccttttatttctaagcagaacagaggctcgctgagtaaagtctgtggacat

SEQ ID NO: 8953 - DNA, 59 bp, Homo sapiens
atatgtgtgcatatgtgcatttatctttttatatatgatatatgcatttgcatatatat

SEQ ID NO: 8954 - DNA, 82 bp, Homo sapiens
agcccttatcactgggtcagtctctgtctttgagttgggatcaccataggcaggggcagcactagacactggacatggggct

SEQ ID NO: 8955 - DNA, 115 bp, Homo sapiens
tattttagagaggaagtagagaaaatgtggaagctagaagaatttcaagattgtttttatttactgacatttcctctggtaaaagtttctcttaacttcaacagacttcagaatg

SEQ ID NO: 8956 - DNA, 116 bp, Homo sapiens
tgaacttacagttatagatacagtttaggttacatttggtttatataatttgagaaatgatgttttcaatatttttaataatgtggcctttctttgcttcatgaaagtaaccatca

SEQ ID NO: 8957 - DNA, 82 bp, Homo sapiens; identical to SEQ ID NO: 8954

SEQ ID NO: 8958 - DNA, 159 bp, Homo sapiens
gttatatatatacattatatatataaacattatatgtatacattatatatataaacattatatatatatgtgtatggttgactcatatacatatatatatatgtatatggttgactcatatatatatatgtatatgtatatgacttagccataaaaata

SEQ ID NO: 8959 - DNA, 86 bp, Homo sapiens; identical to SEQ ID NO: 8952

SEQ ID NO: 8960 - DNA, 98 bp, Homo sapiens
tacatccagcttgccaggatcaaattctagagagacgcagatttaaatgtaagttcgcatctttttttttttttttttttttttcctgcatggatgtg

SEQ ID NO: 8961 - DNA, 115 bp, Homo sapiens
atacatatatatacacatatgtatatatgtataaatatatatatatttttgatatatatatctatatataaaaatatatattattttgtgtataaatatatatgtatatattttg

SEQ ID NO: 8962 - DNA, 91 bp, Homo sapiens
gacacactgtgtcttttacctgtttatttgtttataatctgtctctctccagtacagtataaatttcatagcagcaaggacttggcctgtc

SEQ ID NO: 8963 - DNA, 57 bp, Homo sapiens
tgagacagagtctcgctctgtcacccaggctggagtgcagtggcgcgatctcgctca

SEQ ID NO: 8964 - DNA, 117 bp, Homo sapiens
aattgagcaattatgctggaccaggaatgtgtgtaggctgcatccctgagaaagtcagtgtctgactctcatttacctatatcttttctggtgaaaaaaaaaaggccatgtttaatt

SEQ ID NO: 8965 - DNA, 58 bp, Homo sapiens
tgagacggagtctcactctgtcttccaggctagagggcagtggtgcgatctccactca

SEQ ID NO: 8966 - DNA, 92 bp, Homo sapiens
tctatctttgcatatcagtgtgcattttttattgccaaataatatttcattatatggatatgccacattttatttatgcatctgttgatgga

SEQ ID NO: 8967 - DNA, 94 bp, Homo sapiens
acagaagtaactaaggtttggggaagttgagtggtatgtacccagcatcgcttaggtaagcccactactcatatttggatctaagtctgtctgt

SEQ ID NO: 8968 - DNA, 118 bp, Homo sapiens
ctgcagagtgaccagaagctgattaggggagctcagtctgtggagaagcttgttggccagtgaagtgagtgtccacagatttcctagcccctaacctgccttctacctagcccaggag

SEQ ID NO: 8969 - DNA, 92 bp, Homo sapiens
ggggtgtatagttaggtgattgctctagccccaggctaaaggtagttaactttggaaattttgcttacagttatttcaagtgtacttaacct

SEQ ID NO: 8970 - DNA, 88 bp, Homo sapiens
tgagacagagtctcgctctgtcgctctgttgcccaggctggagtgcagtggtgcgatctcgactcactgcaacctccacctcccgggt

SEQ ID NO: 8971 - DNA, 123 bp, Homo sapiens
gctggctggcttggctgtctgggctggctggctggcttggctggcttggctggctggctggctggctggctggcttggctagcttggctggctggctggctctgctggccggcttggatggct

SEQ ID NO: 8972 - DNA, 114 bp, Homo sapiens
tatatttaatgtactgtatacattatatgtaccaaatgtattcttatatttaatgtataaaagtttatatttaacatataagatatgcttacatttaatgtataaaatgtttat

SEQ ID NO: 8973 - DNA, 58 bp, Homo sapiens
tgagatggagtctcgctctgtcgctcaggctggagtgcagtggcgggatctcggctca

SEQ ID NO: 8974 - DNA, 77 bp, Homo sapiens
ggctgaggtaggaggatcatttgagcctgggaggtccaggtttcagtgagctgagattgtgccactgcactccagcc

SEQ ID NO: 8975 - DNA, 129 bp, Homo sapiens
tatatatgtatatatatttatacatgcataaatatatatgtatatgtgtatatatacttatctatgtatatgtgtatatatatacttgtatatatatatatttatacatatatatgtgtttatataaat

SEQ ID NO: 8976 - DNA, 87 bp, Homo sapiens
tgcctcgctagccctgcaggtaggaccgttggtggttattaattttatgagagctcctaggttgtttactattatagttagtgggca

SEQ ID NO: 8977 - DNA, 113 bp, Homo sapiens
cacactctctggtaggctatatatgtgtgtatatgtatgtgtatatatatatatatatatatatatatatatatatatatatatatatatatatattgttgtttgtttgtttg

SEQ ID NO: 8978 - DNA, 64 bp, Homo sapiens
gcagagacaaagtctcactctgtcacccaggctggagtgcagtggtgcgatcttggctcactgc

SEQ ID NO: 8979 - DNA, 115 bp, Homo sapiens
tttaagttggttaatctgtattagtgtatattttgtttttttattttattttattttattattataccttaagttataggatacatgtgcacaatgtgcaggtttgtaacataag

SEQ ID NO: 8980 - DNA, 80 bp, Homo sapiens
ggtgcatagtgcaaagttctgccaactgaaattttttttaaatttttttattttttgagacagagtcttgctctgtcacc

SEQ ID NO: 8981 - DNA, 58 bp, Homo sapiens
tgggaccaggtctcactctgtcacccaaactggagtgcagtggcatgatcatggctca

SEQ ID NO: 8982 - DNA, 95 bp, Homo sapiens; identical to SEQ ID NO: 580

SEQ ID NO: 8983 - DNA, 93 bp, Homo sapiens; identical to SEQ ID NO: 69

SEQ ID NO: 8984 - DNA, 129 bp, Homo sapiens
gggtcagggcttcgggacttgtttctcctaaatctttttcttttttttttttgagacagtctcgctctgtcacccaggctggagtgctgtggcccgatcttggctcactgcaagctccgcctcccgggt

SEQ ID NO: 8985 - DNA, 83 bp, Homo sapiens
ctgagattacaggcgtgagtcactgttcccggccaagattctgttttgatagaacacttgtgtctctctcaccttgtatttag

SEQ ID NO: 8986 - DNA, 109 bp, Homo sapiens
atatacctgacacacttatctgtgagtatggtggtagcctttttattttactttttttatttttgagagagggtctcactttgtcacccaagatgtagtgcagtcatat

SEQ ID NO: 8987 - DNA, 109 bp, Homo sapiens
gcgtgtatgtgtgtgtgcatgcatatgtgtgcatgcgtgtgtgtgggtgcatgcatgtagtgtgtgtgcatgtgcatgtgtgcatgtgtgtacgtgggtgtgtgtgtat

SEQ ID NO: 8988 - DNA, 58 bp, Homo sapiens
tgagatagagtctcgctctgtcacccaggctggagtacagtggcgtgatctcggctca

SEQ ID NO: 8989 - DNA, 97 bp, Homo sapiens
gcctagagacaggctggtgtgagaattcagtgagaaaacccggggagaacatttagccagagcctgtcgcatggctggggctctggctagtggaggg

SEQ ID NO: 8990 - DNA, 93 bp, Homo sapiens
catatatatatgtatcaattgcatgcatatatatatatatatatatatgcatatatatgtatgcatcaattgctgaccaaactgatgtatgtg

SEQ ID NO: 8991 - DNA, 98 bp, Homo sapiens
gccctgagggtacagcattggaagcagggagcagtgactccccgccctgagccctgggtccctgcttccctggatccctgagggtggaggggcactgc

SEQ ID NO: 8992 - DNA, 78 bp, Homo sapiens
gcctgtgtcagtgtctgtgagtggatgggaagtccagtcacctgttttgacttcctgctagacctcacctgctcaggc

SEQ ID NO: 8993 - DNA, 85 bp, Homo sapiens
ggaattgctgcgaggatgaatgagatgactgtcagcacagaataggcacccagtgagtgttcagggattaccctcagcagctgcc

SEQ ID NO: 8994 - DNA, 99 bp, Homo sapiens
attgttgttctggagatcctgggatgcatagacagtgaatatcttttttgttttttgagatggagtctcactctgtctcccaggctgcagtgcagtggt

SEQ ID NO: 8995 - DNA, 78 bp, Homo sapiens
ttactcttttctctttttggccacatctccaactgataaaggaattagccatgtgggtgagaggtgagactgaagtga

SEQ ID NO: 8996 - DNA, 114 bp, Homo sapiens
ctgaaatgactatagggtttttgttcttgattgctgaatgtgatgtcgcatatttatttgtgtttattgaatcatcctcatattcctgggatgaaatccacttggtcatggcag

SEQ ID NO: 8997 - DNA, 103 bp, Homo sapiens
gacaatgccaagaactcactgtacctgtgaatgaacagtcagagctgagaacatggcctcgtattattgtacataaggtaccaagtgagggaacaccagtgtc

SEQ ID NO: 8998 - DNA, 81 bp, Homo sapiens
gaagtgctggttgtgatggggaatccagcatttaaacagaaatgttattgttgttgattcactaaacaaaatgtggtactc

SEQ ID NO: 8999 - DNA, 98 bp, Homo sapiens
gtgcatgtgtatgtatgtgtatggtgccgcatatgcatgtgtatatgtatgtgtgcatgtgcctgtgtatgcctgtgtatatgtgtgtgcacgtgcat

SEQ ID NO: 9000 - DNA, 108 bp, Homo sapiens
cagtttcctcatctggcaaacaggtcagcattgctcagagggttactgtgagaatcactgagttattatttgtaaagtgcttaggatagtgcctggaatgtaggtctg

SEQ ID NO: 9001 - DNA, 76 bp, Homo sapiens
gccaggcagaggcatcacgtagacttctgcatcctcagtgttccctgtctccctgtgagtctgtcttcccttgagc

SEQ ID NO: 9002 - DNA, 66 bp, Homo sapiens
cactacagtggatttatgtatatgtatgtgtgtgtatatatatataacatgaggccgggtgcagtg

SEQ ID NO: 9003 - DNA, 58 bp, Homo sapiens; identical to SEQ ID NO: 2172

SEQ ID NO: 9004 - DNA, 71 bp, Homo sapiens
gggatggcgagagttatgttttattttattttattttttaatttttgagatggagtctcactctgtcgccc

SEQ ID NO: 9005 - DNA, 114 bp, Homo sapiens
tcactgtctggatgtggtgatctggtgagtttccgttctttgatacttttttattttattttatttttttcagaacgaagttttactcttgttgcccaggctagagtgcagtgg

SEQ ID NO: 9006 - DNA, 96 bp, Homo sapiens
attcatatatatatgtatatatgtatatatatgtgtgtatatgtgtgtatatatgtgtgtatatatgtgtatacatgtatatatgtatatatgtgt

SEQ ID NO: 9007 - DNA, 96 bp, Homo sapiens
ctgtgtcagggctgagggtctggggggaagggtatgctcactctctgtctttgacactgcagctccaccagctctgaggagactcagctcttccac

SEQ ID NO: 9008 - DNA, 95 bp, Homo sapiens
aacccaaaaggtcacattctgtgtgattctatttatataacattgtaaaatgacaaagttttagaaatggagaacagattagagggccaggggtt

SEQ ID NO: 9009 - DNA, 86 bp, Homo sapiens
ggagacagagcgagactttttctcaaaaaaaaaaaaaaaaaaagtttcatttatttatttttctgagacagtcttgctctgtcacc

SEQ ID NO: 9010 - DNA, 108 bp, Homo sapiens
cccgccagggactcggagcctgcagcgactgcctgtctgtctgtcttattgggtgcagggagctgggggacagggaggtgaagtagctggtccgaggtccccagctgg

SEQ ID NO: 9011 - DNA, 58 bp, Homo sapiens
tgagacagcgtctcgctctgtcactcaggttggagtgcagtggcgtgatcctggctca

SEQ ID NO: 9012 - DNA, 82 bp, Homo sapiens
cagggtcttttctgcaagtgaagatgggaaagggtgagtgctggcgcagtctcttcctctctctttgtggaaaggtatgatg

SEQ ID NO: 9013 - DNA, 72 bp, Homo sapiens
ggtgtgtgtatatgtatgtgtgtgtatatatatgtatgtgtatatgtataggtatacacactatatatatat

SEQ ID NO: 9014 - DNA, 69 bp, Homo sapiens
ttgtttgagacagagtctcactctgtcacccaggctggagtgcagtggtgcgatctcggctccttgcaa

SEQ ID NO: 9015 - DNA, 134 bp, Homo sapiens
acaccatagatgtgtgtgtgtatatatatgtatatgtgtgtatgcatatatatatatatatatatatatatgtatatgtgtgtatgcatatatatatatatatatatatatatatatatatatatatatatata

SEQ ID NO: 9016 - DNA, 125 bp, Homo sapiens
gggtgtacaccctgtgatattacttgttatatactaggtagatattactcctaatatcacagtgggtgtacatcctgtgatattatttgtaataacctagggagatatgactcctaatattacag

SEQ ID NO: 9017 - DNA, 89 bp, Homo sapiens
tattgctcctaatatcacagtgggtgtacactctgtgatatacaaataatatcacagggtgtacacccactgtgatattaggagtaata

SEQ ID NO: 9018 - DNA, 67 bp, Homo sapiens
ctgcactcagtggctgaatccagctatggacatctctacagatctctggttctgtctctctgtgcag

SEQ ID NO: 9019 - DNA, 122 bp, Homo sapiens
cccagctcatccttttaaccattaacctttcagcaagaattgttttttttttttagatatgtttttacagcactagaaaactttaattttaattgaaagggaactaagggatttgggagagt

SEQ ID NO: 9020 - DNA, 69 bp, Homo sapiens; identical to SEQ ID NO: 9014

SEQ ID NO: 9021 - DNA, 72 bp, Homo sapiens; identical to SEQ ID NO: 9013

SEQ ID NO: 9022 - DNA, 82 bp, Homo sapiens; identical to SEQ ID NO: 9012

SEQ ID NO: 9023 - DNA, 91 bp, Homo sapiens
atatttgtgtgtgaatatataaatgtatgtatatatgtacatatatgtgtgtatatgtatagtatatatgtgtgtacatatacatatatat

SEQ ID NO: 9024 - DNA, 151 bp, Homo sapiens
tatatatatacatgtgtgtatatatatacatatatatgtgtgtatatatacatatatatgtgtgtatatatatacatatatatgtgtgtatatatatacatatatatatgtgtgtgtatatatatatatgtgtatatatatatatatatat

SEQ ID NO: 9025 - DNA, 75 bp, Homo sapiens
cagaatttcctgccactagggacctgcagccagaaaggatagggcaagaggtacagagagagcagagagagcctg

SEQ ID NO: 9026 - DNA, 86 bp, Homo sapiens
ccctgctgacttcaatccttggtttttcagtctaaagtgtgcccctcagggcccacactggctccctgaaagcgagagcagctggg

SEQ ID NO: 9027 - DNA, 81 bp, Homo sapiens
ctgtttcagcacttactgacttggagtctctctcacaatgactaaatgtaatatgagattctaggatgtatactagaacag

SEQ ID NO: 9028 - DNA, 114 bp, Homo sapiens
tccatttgaattgttttacttatgaaaatctcttgtgtaaaatggggtaatctaaatacctaattgtatgtataaatagattgtttttgcaattaaaataactcaagctcagga

SEQ ID NO: 9029 - DNA, 117 bp, Homo sapiens
tacaatgtttaatttgcattaaaatgtaagaatttgcttttcttattttattttattattattatactttaagttttagggaacatgtgcacaatgtgcaggttagttacatatgta

SEQ ID NO: 9030 - DNA, 95 bp, Homo sapiens
gcttgtagcaactttattttgtataagtatgtcaaatttgatcatttattatactttttgatatggtttatatattatactttgttgccatgagt

SEQ ID NO: 9031 - DNA, 106 bp, Homo sapiens
tctaatgcttgtagcaactttattttgtataagtatgtcaaatttgatcatttattatactttttgataaggtttatatattatatttgttgccatgagtggacga

SEQ ID NO: 9032 - DNA, 107 bp, Homo sapiens
gcaggtaaacaaggacaatggcactttagttgaatgtacacttcccaagtgctctgtggaagtgttctgaattgatcagcttaaatatatgtttggtgaatcctagc

SEQ ID NO: 9033 - DNA, 111 bp, Homo sapiens
tgcttaggattgtcttggctatatgggctctttttttggttccatatgaaatttaaagtagttttttctaattctgtgaagaaagtcaatggtagcttgatgggtatagca

SEQ ID NO: 9034 - DNA, 98 bp, Homo sapiens
atgaagtatcagcttcaagccagtgcctaggtgaaaattgttgatattctaattccttcacaaacagcttctgcatgtgcccaaagctgttgcttcat

SEQ ID NO: 9035 - DNA, 62 bp, Homo sapiens
agctaggatatcagagtctcctgtctccaggaagtggagaagagtgatgagtgtcaggagct

SEQ ID NO: 9036 - DNA, 77 bp, Homo sapiens
agtctcactctgtcacccaggctggagtgcagtggcacgatcactgcaacctctgcctcctgggttcaagtgattct

SEQ ID NO: 9037 - DNA, 57 bp, Homo sapiens
tgacagagtgattttttttttcttttttttttttaaagatggagtctcactctgtca

SEQ ID NO: 9038 - DNA, 72 bp, Homo sapiens
cctctctgggtgtctgggtggctccatgagcagtgatggcctcagcttttccaggcgcagtcattcttgagg

SEQ ID NO: 9039 - DNA, 94 bp, Homo sapiens
ctgggataacaggcgtgagccaccgcactgcacctggccaagagaccttttttttttttttttttgtgagacgcagtctcgctctgttacccag

SEQ ID NO: 9040 - DNA, 58 bp, Homo sapiens
tgagacagggtctcactctgtcacccaggctggagtgcagtggcttgatctctgctca

SEQ ID NO: 9041 - DNA, 94 bp, Homo sapiens
cagaaagcctgcctgtgtgtgaaccctgccagcaactgggaccagccttcattgaacccagccctgcagagccatagtgcatggggcctcactg

SEQ ID NO: 9042 - DNA, 112 bp, Homo sapiens
gccttccaagttgttgggactacaggcacacactaccaggcctggctactttttaattttttgtagaaacagggcctcactatgttacccaagctggtctcaaactcctggc

SEQ ID NO: 9043 - DNA, 65 bp, Homo sapiens
agcctcatcactcagcctctccctctctgcccagggagcgcaagagaggcacagtgccgccagct

SEQ ID NO: 9044 - DNA, 113 bp, Homo sapiens
tccagaaaatgctaaagtattatgacatctacagtgtatgaggtagctatggaatggaatgaaaaagcagctaaatttgtggattcatgagatgatttttttttttaagtgga

SEQ ID NO: 9045 - DNA, 76 bp, Homo sapiens
ggtaatagctggagtgagagtactgagacagtagagataagacttggcttcagctcagccccactacagcattccc

SEQ ID NO: 9046 - DNA, 58 bp, Homo sapiens
tgagactgagtctcgctctgtcacccaggctggagtgcagtggcacgatctcggctca

SEQ ID NO: 9047 - DNA, 82 bp, Homo sapiens
ctaactgtcttttgattttaaaggctcctgggcagaagggacttgccttgtcacagatgagactttggatgtagacttttgg

SEQ ID NO: 9048 - DNA, 113 bp, Homo sapiens
tgagtgtggtggtgcatgtctgtggccccagctactcgggaggctgaggtggaaggatggcttgagcccagctggctgaggctgcagtgagctgtgatcacaccactgcactc

SEQ ID NO: 9049 - DNA, 120 bp, Homo sapiens
gctgcggggccaggggcggggatgggggggcacctgggcttgccgtcctggacctgagtttctctctctgcctcagatcccacagccagccggctcccaacacccatgccatgggacctc

SEQ ID NO: 9050 - DNA, 69 bp, Homo sapiens
ggctccatctggtcaggcaccaggacacgtttgcggtgacagtgactctgtccctgacttccacaggcc

SEQ ID NO: 9051 - DNA, 61 bp, Homo sapiens
ctgaacctctctgagcctcagacattatatctgttatatctggatggctgggaagattcag

SEQ ID NO: 9052 - DNA, 89 bp, Homo sapiens
gtggtccttggtgttcctgggctcacagctgcatcctgcctctgctctcgcacagtgtctccctgtgtctgtcctcactcaactgccat

SEQ ID NO: 9053 - DNA, 115 bp, Homo sapiens
gctggaccaaatggtggccatgaggatgatagaggaggtggatttgttttctgttttttttttttttttttttttttgagacggagtctcgctctgtcacccaggctggaacagt

SEQ ID NO: 9054 - DNA, 70 bp, Homo sapiens
gggaaagggtattccagtcaaattattattattattattaattttgaatggagttttgctcttgttgccc

SEQ ID NO: 9055 - DNA, 106 bp, Homo sapiens
gatcacagtactgcaccccagcctgatggattgagaccccatttcttcttttttttgtttttttgagacggatctgctgctcaggctggagtatggtggtgggatc

SEQ ID NO: 9056 - DNA, 123 bp, Homo sapiens
ctgagcttagtggcatgccctatagtcccagctacttgggaggctgaggtaggaggttcacttgagcccaggaagtcaaagttgcagtgagctgtgattgtgccactgtactgcagcctgggt

SEQ ID NO: 9057 - DNA, 105 bp, Homo sapiens
tagcgtgctgttcggcgctctgtaaattttttttttcttcttcttgagacagagtcttgctctgtcacccaggctggagtgcagtggtgcgatctcggctcgctg

SEQ ID NO: 9058 - DNA, 70 bp, Homo sapiens
gttgttgagacaaggtctcactctgtcacccaggctggagtgcagtggtggcatcagggctcactgcaac

SEQ ID NO: 9059 - DNA, 56 bp, Homo sapiens
gagacagaatctcactctgtcacccaggctggagtgcagtggtgcgatctcggctc

SEQ ID NO: 9060 - DNA, 109 bp, Homo sapiens
ggatttctgataaattaaggaccctaaatttgagtgagagagaaaggtgtgagtagtgactgcgcattgctgcagctgtctacaacgtggtctttttcagggctagtcc

SEQ ID NO: 9061 - DNA, 90 bp, Homo sapiens
tgttttgccttttagtatgacttgtaattttcttcttgacatcagacatgaggtactgggtaagaggaactgcagttagtaggccctaca

SEQ ID NO: 9062 - DNA, 118 bp, Homo sapiens
ctcacttataactaggttctccatcatgaaaaatgccaagagagtcatactatttttgtttacataaagtgacaaagatttgttgttgttgttgttgtttttcccactaggtagtgag

SEQ ID NO: 9063 - DNA, 58 bp, Homo sapiens; identical to SEQ ID NO: 2248

SEQ ID NO: 9064 - DNA, 95 bp, Homo sapiens; identical to SEQ ID NO: 68

SEQ ID NO: 9065 - DNA, 93 bp, Homo sapiens; identical to SEQ ID NO: 69

SEQ ID NO: 9066 - DNA, 95 bp, Homo sapiens; identical to SEQ ID NO: 68

SEQ ID NO: 9067 - DNA, 93 bp, Homo sapiens; identical to SEQ ID NO: 69

SEQ ID NO: 9068 - DNA, 113 bp, Homo sapiens
ttgtaagggtatatttcatggagcctgtattcgcttttctcagtgtatttctgtcacgttctagtccccagacacaaagtagaagccatgaaggcctatgctaatacaggcag

SEQ ID NO: 9069 - DNA, 100 bp, Homo sapiens
tgattctccattatgatgagttgtgtaattatttcattatgtattacaatgtagtcataataggaataaagtgcacaatagatgtaatacgcttgaatca

SEQ ID NO: 9070 - DNA, 109 bp, Homo sapiens
gtagtttatcctgagtggttacactatctgttaaataatataataattatataatatgtatagttatataatatgtatagttgtagtttatcctgaatggttacactac

SEQ ID NO: 9071 - DNA, 109 bp, Homo sapiens; identical to SEQ ID NO: 9070

SEQ ID NO: 9072 - DNA, 100 bp, Homo sapiens; identical to SEQ ID NO: 9069

SEQ ID NO: 9073 - DNA, 94 bp, Homo sapiens
gcttgtagcaactttattttgtataagtatgtcaaatttgatcatttattatactttttgataaggtttatgtattatatttgttgccacgagt

SEQ ID NO: 9074 - DNA, 111 bp, Homo sapiens; identical to SEQ ID NO: 9033

SEQ ID NO: 9075 - DNA, 118 bp, Homo sapiens
ctcacttataactaggttctccatcatgaaaaatgccaagagagtcatactatttttgtttacatatagtgacaaagatttgttgttgttgttgttgtttttcccactaggtagtgag

SEQ ID NO: 9076 - DNA, 58 bp, Homo sapiens
tgagatggagtctcactctgtcacccaggctggagtgcagtggtgcggtctcggctca

SEQ ID NO: 9077 - DNA, 106 bp, Homo sapiens
acattgttttaggagtacagtttgactttcttttttaaaataatctatttttatagattatttgtattttgaaatacaaaaatatttgtatttttaaaaaatctgt

SEQ ID NO: 9078 - DNA, 130 bp, Homo sapiens
agtctgctgggcatggtggtacatgcctgtaatcccagctagtcaggaggctgaggtaggaggatcacttgaacccaggaggctgaggttgcagtgagccaagaatgccccactgtactccagcctgggt

SEQ ID NO: 9079 - DNA, 70 bp, Homo sapiens
tgctgctttctttcctgtttttacaaaagacagggtctcactctgtcactcaaactggagtgcagtggca

SEQ ID NO: 9080 - DNA, 92 bp, Homo sapiens
ggtgtcttttgaagagcctaagttttaaattctgatgaggtcgaaatgatgatcattttttcttttttgagatagggtctcactctgtcgcc

SEQ ID NO: 9081 - DNA, 114 bp, Homo sapiens
tattacagcagtatttttgaccttgtaggtggtggtctcctttattattattattttgtctggggacataggagatttcttgagaaagacctttaactgcagctgtatgtggta

SEQ ID NO: 9082 - DNA, 58 bp, Homo sapiens
tgagatggactctcgctctgtcacccaagatggagggcagtggcgtgatcttggctta

SEQ ID NO: 9083 - DNA, 71 bp, Homo sapiens
gttgtttgagatgcagtctcgctctgtcacccggactggagtacagtgacgcgacctctgttcactgcaac

SEQ ID NO: 9084 - DNA, 91 bp, Homo sapiens
gttaaactcctccgaagtgcctaatggtttctgactccctggacactgacagacacactcaccatgaccagaaggtgctctgaggtttggc

SEQ ID NO: 9085 - DNA, 90 bp, Homo sapiens
taattttgtagtctgcaactttactgaatttgttaattaattctaacaggtttttagtggagtctttaggattttctctgtataagattg

SEQ ID NO: 9086 - DNA, 102 bp, Homo sapiens
agccctgggactacaggcacgtgccactatgcccagataattttttatttttgcagagattagggttgggttttggggggatctcgctatgttttccaggct

SEQ ID NO: 9087 - DNA, 72 bp, Homo sapiens
agaggattgagtgacttgactgaggtcacagagccaggagggaccagacctgtgaagtgagctgtatcttct

SEQ ID NO: 9088 - DNA, 95 bp, Homo sapiens; identical to SEQ ID NO: 68

SEQ ID NO: 9089 - DNA, 93 bp, Homo sapiens; identical to SEQ ID NO: 69

SEQ ID NO: 9090 - DNA, 109 bp, Homo sapiens
ctgctggattcctgaggtctcgtttgtattgtgccctaagtgtctctctctcagcaaggctgccttagaacataaagaacaagaggacccatggagtaggcaccagcag

SEQ ID NO: 9091 - DNA, 59 bp, Homo sapiens
tttgaagtattagagataaaggaatatcatctctgtcacttagtctctaatggttcaga

SEQ ID NO: 9092 - DNA, 61 bp, Homo sapiens
tgagacagagtctcactgtgtcccccaggctggagggcaggagtgcagtggcgcgatctcg

SEQ ID NO: 9093 - DNA, 109 bp, Homo sapiens
gcttgcacagccactgcaaatgaggagaaaatcatgggacagtcacactcagacaccgacaccacttctgctcacctcatcagcctaacttcaacggtggctggtaggt

SEQ ID NO: 9094 - DNA, 87 bp, Homo sapiens
ccctcccgtgttctctttccctttggagtccttacaaactctccctctagttcgatggttcagagaagactgagagctgggcctggg

SEQ ID NO: 9095 - DNA, 121 bp, Homo sapiens
agggtcggggaatcagatgaccgcaagagcagagtgcttagcccagggctgactcagtttctctcacaggctatgctcctatccctcccactaggggtgcccagggaccttcagtctgggc

SEQ ID NO: 9096 - DNA, 114 bp, Homo sapiens
gcatatagggttggaaaaacctgaaacaccttctcgctgcttaatctagttctgagagcagagtgtgagctctggagctctgagccatgtgaagcgtgtgactcagcctgtggc

SEQ ID NO: 9097 - DNA, 82 bp, Homo sapiens
cgtcagcagcttgcagtaaggcggctaacaaacagaaaagaggtctgggtgcctggctgcctcttccccaagaaggctcacg

SEQ ID NO: 9098 - DNA, 76 bp, Homo sapiens
gctgaggatgacgctggtagtgagttctctagggaagggcacctgtgggctctcactggctcagtggcacctgtgc

SEQ ID NO: 9099 - DNA, 65 bp, Homo sapiens
gaggctgccatgagctatgactgtgccactgcgctccagcctgtgtgacagtcagactctgtctc

SEQ ID NO: 9100 - DNA, 68 bp, Homo sapiens
gtgtgtgtgtgtatatatatgtatatgtgtgtgtgtatatatatatacatgtatgtatacatatatat

SEQ ID NO: 9101 - DNA, 84 bp, Homo sapiens
tggccatagcagggtttcagagctctcttctctctatgatctcttcccatgggaggctgggcttcagagctacactataggcta

SEQ ID NO: 9102 - DNA, 116 bp, Homo sapiens
ggtagacattgtaaatgatatttcataggaactctggaacctatgctgtcccgaagattattgattttgttctagcaggctgtttgttacctgtgaactctgtctctcctgcagtg

SEQ ID NO: 9103 - DNA, 76 bp, Homo sapiens
tatatatatatacacacatatatttatatgtatatataaatatatccccatatatatgtgtatgtgtatatatata

SEQ ID NO: 9104 - DNA, 113 bp, Homo sapiens
gtttttccaaatatattttatttctgtatgttataaaccgaataatgtaattatatacatattgttctatataattgctttataaatcagttcagagaaggaaggagaagaac

SEQ ID NO: 9105 - DNA, 116 bp, Homo sapiens
aacaaggcatgctctcactttttgtttctctaggaatgtatttttctttttttttttcttttttttaaattatactttaagttctggggtatatgtgcagaatgtgcagctttgtt

SEQ ID NO: 9106 - DNA, 111 bp, Homo sapiens
ttgtttatttgtaggcattattgtagaagccgtttatctgaaatgtatgatttttttaaactagtctgtggcttgttttttgcttgtaattgctttgtttttgatgaacaa

SEQ ID NO: 9107 - DNA, 106 bp, Homo sapiens
tcagcagctgggactacaggcatgtgctaccacacccagctaagttaaaattttttgttttgttgttttagacatggggtctcactatgttgcccaggctggtctc

SEQ ID NO: 9108 - DNA, 119 bp, Homo sapiens
ggaatgttttaacaaagtgagcatcagaatggctgggtgtcttgactgccttatctttatatttatgattgcaaatgtcaagtaggccctcatgctgcttgcaatttttgctagattcc

SEQ ID NO: 9109 - DNA, 95 bp, Homo sapiens; identical to SEQ ID NO: 68

SEQ ID NO: 9110 - DNA, 93 bp, Homo sapiens; identical to SEQ ID NO: 69

SEQ ID NO: 9111 - DNA, 63 bp, Homo sapiens
ctgccatctgtgacagcttcttgatctgtccccaggtaggtggctgtgttcaacgggtgttgg

SEQ ID NO: 9112 - DNA, 83 bp, Homo sapiens
atgggagtatgctgtgtgtttctgtgtctctagagtaccaagggtgaccatgaggaatatttgagatcttcagttgctcctgt

SEQ ID NO: 9113 - DNA, 81 bp, Homo sapiens
gtgaacctcactgcctgtctctgtgttttgaggactcttctaccctcagttcccactgctgctttgggctttctggtttcc

SEQ ID NO: 9114 - DNA, 119 bp, Homo sapiens
tgaaattggtttgataagagtaattgttaatttctagaagcttgcatcataatgattttttaattttgacatagagctgttgtaattaacagtggtaaactttcagtgagattatttca

SEQ ID NO: 9115 - DNA, 105 bp, Homo sapiens
gatgaagaaatgttaggctcagtgctgttagactcactctgaatcacattgttaggcagtcgtagaattgggatttgagtccgtatctagtctactgttatcatt

SEQ ID NO: 9116 - DNA, 84 bp, Homo sapiens
ggggcaggacaggcgagattttgttgcctgtaatctttttgttttttttttttttttttgagacagagtctcgctctgtcaccc

SEQ ID NO: 9117 - DNA, 76 bp, Homo sapiens
agtcaggagggacagaggtacttttcttttttttttttttttttttgagacagagtctcgctctgtcatccaggct

SEQ ID NO: 9118 - DNA, 56 bp, Homo sapiens
gagatggagtctcactctgtcacccaggctggggtgcagtggtatgatctcggctc

SEQ ID NO: 9119 - DNA, 56 bp, Homo sapiens; identical to SEQ ID NO: 1191

SEQ ID NO: 9120 - DNA, 66 bp, Homo sapiens
gtggcctaatgtggctccctgactcactggctgggaacagggtgaacagggccacagggaggccat

SEQ ID NO: 9121 - DNA, 58 bp, Homo sapiens; identical to SEQ ID NO: 2531

SEQ ID NO: 9122 - DNA, 112 bp, Homo sapiens
tgtgttatgaatgtacaggtcagatcctttattcttgcatttaattcctatgtgaatataccttcctatttttgcaataaaaggaactgacagaatgaataatttttataca

SEQ ID NO: 9123 - DNA, 137 bp, Homo sapiens
aggctggggattgattgggagttgccatgatgggatatatatatatatattttttttttgagacggagtctcactctgtcacccaggctggagtgcagtggtgtgatctcagctcactgcagcctctgcctcctggg

SEQ ID NO: 9124 - DNA, 58 bp, Homo sapiens
tgagacggagtctcactctgtcacccaggctggagtgcagtggtgtgatctcagctca

SEQ ID NO: 9125 - DNA, 108 bp, Homo sapiens
agtctcattgtcttatcctacctcacgagtcaagtaaccatttgctcattttgtaattctttaatgagcacctggctaagcttgacactggggaaggagcagtgaact

SEQ ID NO: 9126 - DNA, 76 bp, Homo sapiens
gtgtacatatatatatgtgtatatatgtatgtgtgtgtatatatatacatatatatatatatatcttcagtgctac

SEQ ID NO: 9127 - DNA, 63 bp, Homo sapiens
tttggtgagatgggtactgtgcttggggttcagaccaggcttcagtcccatggactctccaga

SEQ ID NO: 9128 - DNA, 67 bp, Homo sapiens
actccttttacatatatatatatatatatatatatatatgtatctgtgtgtgtgtgtatatacgagt

SEQ ID NO: 9129 - DNA, 116 bp, Homo sapiens
tccagctttgttctttttgcttaggaatgtcttggctacatggattcttttttggttccatatgaaatttaaagtagttttttctaattctgtgaagaaagtcaatggtagcttga

SEQ ID NO: 9130 - DNA, 119 bp, Homo sapiens
tcttttaaagtctcctaccatcttccacaagaagttctggacccctgtggctctctctgtggctctgaggggcctggggctggattttatgtccctgaagatgatggtgtgctgccaga

SEQ ID NO: 9131 - DNA, 109 bp, Homo sapiens
tgcagcacagctacctttccagattgtggccagactgctttttttttgagacagagtctcgctctgtcacccaggctagagtgcggaggcgcgatctcagctcactgca

SEQ ID NO: 9132 - DNA, 77 bp, Homo sapiens
tcagtttgttataccctgtctgtggaatgatgtatggcaggggttacaacacacacatgtcagagtcagcggactga

SEQ ID NO: 9133 - DNA, 104 bp, Homo sapiens
atgtatatatatgtatatatgtatgtgtatgtatatatgtatatatgtatgcatatgtatatatgtatatacgtatgcatatgtatttatatgcatatatatat

SEQ ID NO: 9134 - DNA, 118 bp, Homo sapiens
tttaaaatttgttccaacaattgctgagatagtaatgttagcatctataagtacgatggtatatttttctatttttgcctttaatactgtctttttcatttgttttaggtattttgaa

SEQ ID NO: 9135 - DNA, 87 bp, Homo sapiens
gagctaaattgacagtagtcagccagcacccaggccaagaatacaagcttctctagaacaggaatgttggctgttctcttgtggctc

SEQ ID NO: 9136 - DNA, 115 bp, Homo sapiens
gtgaatatttttaataggtaatgggattcagtattcattttcttatttaacaatgaatgaatgaatgaatgaatacaaatgagtggtgcatagaccaaggatgatagtgtgtcat

SEQ ID NO: 9137 - DNA, 99 bp, Homo sapiens
gtttgatgcagcagtcacaggctttatgtagtgacttatctggagataagagtcttgactgttgttagacaccaccgaaagtcattactttgtgactgc

SEQ ID NO: 9138 - DNA, 85 bp, Homo sapiens
tgtgcaagatgtgtttcagacctgacaacaaaagcaactagaattatttctctctgtgtgtgtctgtctctttatatatttcaca

SEQ ID NO: 9139 - DNA, 116 bp, Homo sapiens
gtaaaatttaaaaattctctcttggaaagtgttgaaatatacatttaaaaagataaaatgaaaataatatatttattactttaccagggggagaaaaccatttttaatattttgtc

SEQ ID NO: 9140 - DNA, 70 bp, Homo sapiens
cactttgggtgacccaggcaggctgattgcctgagctcaggagttcgagaccagcctgggcaacgtggtg

SEQ ID NO: 9141 - DNA, 103 bp, Homo sapiens
tccctgaattatagaaatatgtgcatgtatatatacatgtgtgtttatatatataaaagcacacatgtgtttatacctcacttcattccgaaaagatttaaga

SEQ ID NO: 9142 - DNA, 60 bp, Homo sapiens
tgtgtatatatacgtatatatatgtgtgtgtgtatatatatatatacgtgtatatatata

SEQ ID NO: 9143 - DNA, 59 bp, Homo sapiens
tgagacaagagtctcgctctgtcactcaggctggagtgcagtggagcgatcttggctca

SEQ ID NO: 9144 - DNA, 75 bp, Homo sapiens
tgtgggaccctgtttcccagagctgcattcttctgaccagaaatatgaatgccatgctgctgtttagggtcttca

SEQ ID NO: 9145 - DNA, 58 bp, Homo sapiens
tgagacagggtctcactctgtcacccaggcttgagtgcaagagtgcaatcactgctca

SEQ ID NO: 9146 - DNA, 87 bp, Homo sapiens
aggtgtgagccactgtgcccggccagtaaatgctttttattaaaaagaaaaaatgtggctcagtggctgggtgtgtggctcacatct

SEQ ID NO: 9147 - DNA, 97 bp, Homo sapiens
gaggcttagctggggagagtttaccttgcagctcactggtgtggatgccggcacgtctcaatctctcactatttgagcctctccacagggttgcctc

SEQ ID NO: 9148 - DNA, 63 bp, Homo sapiens
gacagagtgagactctctctcaaagaaaaagaatttactttgagggagcatctgaagttcttc

SEQ ID NO: 9149 - DNA, 111 bp, Homo sapiens
tattttattgagacttcagagtgcgtgtgtgtgtgtgtgtatatatatgtgtatatatatatgtgtgtgtgtgtatatatatatatatataatttgtaatctctaggaata

SEQ ID NO: 9150 - DNA, 105 bp, Homo sapiens
gttgccagaggatcaaggaaggaggaggatgtgacaataaagagagatgacatgcaggagttttttgggagtgatagaactgttctgtatcctgattgcggcagc

SEQ ID NO: 9151 - DNA, 68 bp, Homo sapiens
gatgtgactggatccaaggctcagatgacgttttcaggaatgtgtcagctgagtctctgtcactcttc

SEQ ID NO: 9152 - DNA, 111 bp, Homo sapiens
tgtacatggacaagctgggctgtcatggtttaatctgagcttacagtgatttacattctaaacaaatatgaataaattgcacttcagagccgctcccacctctgttcaaca

SEQ ID NO: 9153 - DNA, 58 bp, Homo sapiens
tgagacagagtctcactctgtcacccaggctggagtgcagtggtgagatctcttctca

SEQ ID NO: 9154 - DNA, 85 bp, Homo sapiens
tgagacagactctcactctgtcgcccaggctggagagtagtggcgcaacctccgcctcccaggttcaagtgattttcctgcctca

SEQ ID NO: 9155 - DNA, 115 bp, Homo sapiens
gtattcttaatatttaaacctgactttgttaccatatgaaagtgatgtttgataataatatttctatattatcagtggcataaggaaatagagtagcaggattagaattgattgc

SEQ ID NO: 9156 - DNA, 87 bp, Homo sapiens
aacaaaatttgattgtttatatgccctgaatttttttaaattatactttgagttctagggtacatgtgcacaacgtgcaagtttgtt

SEQ ID NO: 9157 - DNA, 98 bp, Homo sapiens
ctcccgagtagctagggctaccagcgtgcactaccacatctggctaattttttaatttttagtagagatggggttttgccatgttgcccaggctggag

SEQ ID NO: 9158 - DNA, 119 bp, Homo sapiens
cgtttgagtactgtgtttttggtgttgtccaaggaaaattaaaaacctgtagcatgaataatgtttgtttttcatttcgaatcttgtgaatgtattaaatatatcgctcttaagagacg

SEQ ID NO: 9159 - DNA, 56 bp, Homo sapiens
gagacagagtctcgctctgtcacccaggctggagtgcagtggtgtaacatctgctc

SEQ ID NO: 9160 - DNA, 155 bp, Homo sapiens
cctgggcaacagagtgacaccctgtctcaaaaaaaaaaaagatttttaaatttttatttatttttaatttttatatttttgagactcagtctctgtcgctcaggctggagtgcagtggcacgatctcagctcactgcaacctccacctcctaggt

SEQ ID NO: 9161 - DNA, 101 bp, Homo sapiens
gttaaatattcagtagtggcatcgctgaattgtgtgttagttcgatttatagttttttgaggaaccttcatactgttctccctagtggctgtactgttgac

SEQ ID NO: 9162 - DNA, 104 bp, Homo sapiens
ccaaactttaatcaggtactcgtttgactcagaagacagtcagcaatagcctttggacttcgctgagcatctcactgaggtcaatagtaagatcttcttgttgg

SEQ ID NO: 9163 - DNA, 148 bp, Homo sapiens
tcatttttatgtccatggtgtgtgtgtctatatatatatatgtatatatttgatggtatatatatatatatgtatatatttgatggtatatatatgtatatatttgatggcatatgtagatgtatatatttgaaggtatatatatatg

SEQ ID NO: 9164 - DNA, 115 bp, Homo sapiens
cccaagtagctgggactacaggtgtgtgccaccacgcctggcttattttttaaacttttttttttggcgaggccaggcacagtgattcactgcttgtaatctcaccatatgtggg

SEQ ID NO: 9165 - DNA, 58 bp, Homo sapiens; identical to SEQ ID NO: 315

SEQ ID NO: 9166 - DNA, 97 bp, Homo sapiens
tctgcagattccttccattttcatgctcactctgtgactgagggcctaagtaagccacatggtgcatcagcttggagacagataagaggcaaccaga

SEQ ID NO: 9167 - DNA, 93 bp, Homo sapiens
ttggaacttttgccagatgaatctgatgagtacagatctcgattttattttattttttgggttcttcataattctgtgtgcagatgttaccaa

SEQ ID NO: 9168 - DNA, 105 bp, Homo sapiens
tttaaaaaatagtgtatatatacgtgtgtgtgtatctatatttatctatacctatatatatcttatggtaatacatataaacacacacacacatgaatttttgaa

SEQ ID NO: 9169 - DNA, 58 bp, Homo sapiens
tgagagagggtctcactctgtcacccaggctggagtgcagtggtgcaatcttggctca

SEQ ID NO: 9170 - DNA, 109 bp, Homo sapiens
gctggatgcttttgggtgtatttccaggatttaactttttgtttgtataaaaaagacaatttaccttaatcctgctttattaaaaaaatgcttttgaaatgccatcagc

SEQ ID NO: 9171 - DNA, 86 bp, Homo sapiens
gttgagacagagtctcactctgtggcccaggctggagtgcagtggcgtgatctcggctcactgcaagctctgcctcccaggttcac

SEQ ID NO: 9172 - DNA, 77 bp, Homo sapiens
gcagaggcaagcaacgaagagagagccacagacagagagacacaatggctgtacctttggtgtttgagatcctgggt

SEQ ID NO: 9173 - DNA, 95 bp, Homo sapiens; identical to SEQ ID NO: 580

SEQ ID NO: 9174 - DNA, 93 bp, Homo sapiens; identical to SEQ ID NO: 69

SEQ ID NO: 9175 - DNA, 87 bp, Homo sapiens
tggtctgagagacagtttgttgtgatttctgttcttttttttttttttttttttttgagacggagtcttgctctgtcgcccaggccg

SEQ ID NO: 9176 - DNA, 78 bp, Homo sapiens
ggggagcacagtgggacagagaccggcccttcattttacctggtagctgggtgaggtctgtgactgtcagctttcccc

SEQ ID NO: 9177 - DNA, 101 bp, Homo sapiens
ttttagctaaagcaatagtgaaattcatgtctaaaataagaacccaactttttttttttttttttttgagacagaatctcactctgtcacccaggctggag

SEQ ID NO: 9178 - DNA, 100 bp, Homo sapiens
ggcttcccaaagtactgagattacaggtgtaagccacttcgcctggcctcttctggttttcttgatgtctgaagctatgctggttcctgaaccttggtat

SEQ ID NO: 9179 - DNA, 94 bp, Homo sapiens
atgcatgtgtgtatatatatgtgtgtatatatatatgtgtgtatatatatgtgtgtatatatatatgtgtgtgtatatgtatatgtgtgtatat

SEQ ID NO: 9180 - DNA, 56 bp, Homo sapiens
gagacggagtctcgctctgtcgctcaggctggagtgcagtggcgcgatctcagctc

SEQ ID NO: 9181 - DNA, 109 bp, Homo sapiens
tgatcctgcattggcctaggctaatctgtgtgtttgtgtcttagtttttgttttgttttgtttttgagacagagtctcaaacggttgcccaggctggagtgcagtggca

SEQ ID NO: 9182 - DNA, 68 bp, Homo sapiens
gtgtgaggcgatagatgtgtaatttttttttttttttttgagacagagtctcactctgtcacccaggc

SEQ ID NO: 9183 - DNA, 95 bp, Homo sapiens; identical to SEQ ID NO: 68

SEQ ID NO: 9184 - DNA, 93 bp, Homo sapiens; identical to SEQ ID NO: 69

SEQ ID NO: 9185 - DNA, 100 bp, Homo sapiens
tgataaagaagcttggagtaaatggagaaaaggctctggctctgaaatttgtcagtctctcactctctaatccctttccatactatgcttctgacactca

SEQ ID NO: 9186 - DNA, 89 bp, Homo sapiens
gtatgtgtatatatgtatgtatatatgtatgtagatatatgtctatatatataatgtatatatatgtgtgtctatatatatatatatat

SEQ ID NO: 9187 - DNA, 72 bp, Homo sapiens
gagaacagagttatgcgatgtcccaaactcctgacctgcaggtctgtgggttaataaatgtctcttgttttt

SEQ ID NO: 9188 - DNA, 70 bp, Homo sapiens
tttttttgagatggtgtctcactctgtcacccaggctggagtgcagtggtgtgatctctactcactaaaa

SEQ ID NO: 9189 - DNA, 146 bp, Homo sapiens
ggtgacagagcaagaccttgtctcaaaaaaaaaaaaaaaaaggaattggattttttttttctttttttgagacagagtctcgctctgtcacccaggctggactgcagtggcacgatcttggatcaccacaagctccgcctcccggg

SEQ ID NO: 9190 - DNA, 118 bp, Homo sapiens
tgtattaatttgatgattcttggtgccatatatgagtggaattatacagtatttgtctttttgtgactggatgatttcacttagcataatgtccttaaggttcttccatgttgtagca

SEQ ID NO: 9191 - DNA, 102 bp, Homo sapiens
ggctttgtggtacacagggtgggaagagcatctattttgctgtcagataagtctgagttcagatcatggttttgctacttactacccttttggtcttgagcc

SEQ ID NO: 9192 - DNA, 69 bp, Homo sapiens
agaaaacacacacatatatatacatatcacatatatatgtatgtatatatgtatgtatgtatgtagtct

SEQ ID NO: 9193 - DNA, 93 bp, Homo sapiens; identical to SEQ ID NO: 69

SEQ ID NO: 9194 - DNA, 120 bp, Homo sapiens
tgattaattactaatatttgtgtctgctataacatgtacctgattttattttattttatttttttattattattatactttaagttttagggtacatgtgcacaatgtgcaggttagtta

SEQ ID NO: 9195 - DNA, 74 bp, Homo sapiens
tcatggtttctatttttcttttctattttaacttcagaaaaagaagtcaagactgagaggagagagactgctga

SEQ ID NO: 9196 - DNA, 126 bp, Homo sapiens
gaagtgcacagagtgctaccaaatgtcattgatgtaactgattttacaaaaacaagatctttttttttttattaaagttttagggtacatgtgcacattgtgcaggttagttacatatgtatacat

SEQ ID NO: 9197 - DNA, 106 bp, Homo sapiens
aagttttggctgtgcttattttctaattgtgttttaaatttaaaagacatttaatttttttagataaaggagacttcaataagaaaaaatgtgctggagaaaactt

SEQ ID NO: 9198 - DNA, 95 bp, Homo sapiens
tcttcataaatttcccagtctctggtagttctttctagtagtgtgaaaacagactaatatagagaactggtaccaggattgtgcagctatgaaga

SEQ ID NO: 9199 - DNA, 90 bp, Homo sapiens
ccaggcaattacctgtaaattgtaaagcaagagagaattaggtataactacattagttctggttttgtagttctgcccctgatatactgg

SEQ ID NO: 9200 - DNA, 95 bp, Homo sapiens; identical to SEQ ID NO: 68

SEQ ID NO: 9201 - DNA, 93 bp, Homo sapiens; identical to SEQ ID NO: 69

SEQ ID NO: 9202 - DNA, 92 bp, Homo sapiens
ttactgggaagcctttagtatgataatgtatattgatttactaaatataacagtgtcttcagttatgtcttctttctgaagctcctgtgtaa

SEQ ID NO: 9203 - DNA, 57 bp, Homo sapiens
gctttgaaatactggacagcagagggtgtttctctctgcttctcagtgagttacagc

SEQ ID NO: 9204 - DNA, 113 bp, Homo sapiens
gctgatcagttgaggatgaaatcataagggtgtagaaaatcgtcctcctgcactgagtcagtctctgggtgtagatcaggagcccccttgagtcatgaatcactggtctgggt

SEQ ID NO: 9205 - DNA, 72 bp, Homo sapiens
agcggtgacatttcaggggatttatttttagttttattttttgagacagagtctccctctgtcacccaggct

SEQ ID NO: 9206 - DNA, 67 bp, Homo sapiens
agcctctgtgtctgtgtcagtgcaatggggaagctggtgaggcctccactgcctgccccacagggct

SEQ ID NO: 9207 - DNA, 109 bp, Homo sapiens
acagatatatatgtattatgtacatatgtattatgttagtacatatgtattatgtatatatgtattatgttagtagcaggagtgtgtatgtgtgtatgtatgtgtgtgt

SEQ ID NO: 9208 - DNA, 113 bp, Homo sapiens
acctgacttatttctaaagattaatttatgcacaacggaaatttctataattattaaattagccatttttgtctgtgtccaataaatctattatttatgaaagatagatgggt

SEQ ID NO: 9209 - DNA, 109 bp, Homo sapiens
catacatttatatatgtgtatatatacacatatatatacacatatatgtatatatataatgtgtatatacatctatgtgtatatatatacacacatatatagatatatg

SEQ ID NO: 9210 - DNA, 77 bp, Homo sapiens
gtgtgtgtgtatatatatatatatatatataaaaaatatgtatatatgtatgtatgtatatgtgtatacatacacac

SEQ ID NO: 9211 - DNA, 58 bp, Homo sapiens
tgagacggagtctcgctctgtctcccaggctggagtgcagtggcgcgatcttggctca

SEQ ID NO: 9212 - DNA, 129 bp, Homo sapiens
gcagccaccagtaggagacaaagggtcagagtgttctgtgtacctggggactcaagtctgggtctgtcagccacagcactcatgacctcctctgctgcaggaagagaggttgtgagcctgactgttggc

SEQ ID NO: 9213 - DNA, 61 bp, Homo sapiens
caccatctgtgacagcttcttgatctgtccccaggtgggtggctgtgctcaacaggtgttg

SEQ ID NO: 9214 - DNA, 75 bp, Homo sapiens
gagttgagtgttaatggcagagatcttgtatgggatgtccagatagactatagactttgtcattatttttaaatc

SEQ ID NO: 9215 - DNA, 78 bp, Homo sapiens
tatgtttatatatgtttacatgttgtggcacataaatatctatgtttatatgttgtagcacataaatatatatacata

SEQ ID NO: 9216 - DNA, 77 bp, Homo sapiens
tattacatattgtatacaatatgtgaatacgattgtattcacaatcgtattcacatattgtatatgtgaatgcaata

SEQ ID NO: 9217 - DNA, 79 bp, Homo sapiens
tatatatatatatatatatcacattttgttattcatctactaatatatataccaatggagatatatatatatatatata

SEQ ID NO: 9218 - DNA, 116 bp, Homo sapiens
aagccctgtactgagggacagtgaggtatttgtatgtacaggtgttaatagagtattacctattttatttattttatttggttaccttttattttattaccttttggcagttgctt

SEQ ID NO: 9219 - DNA, 110 bp, Homo sapiens
tgcttaggattgtcttggctatatgggctcttttttagttccatatgaaatttaaagtagttttttctaattctgtgaagaaagtcaatggtagcttgatgggaatagca

SEQ ID NO: 9220 - DNA, 114 bp, Homo sapiens
agatatgaggattgtaactgtcatgggtatttcctccttttttttttgttaaaaacatgttttctgcatgtatacagttgtactgagaaaatatcttcattttatttcctttct

SEQ ID NO: 9221 - DNA, 110 bp, Homo sapiens
tgctgtcatctaggctttgttgtaccatttctagagaacagacagagcagatttagcataatagttaagggccctagaattttcagaatggtaaatgagcattggcttca

SEQ ID NO: 9222 - DNA, 59 bp, Homo sapiens
ccttcaccttgggaagcaaattagtgaggcagggtctcactctgtcacccaggctctgg

SEQ ID NO: 9223 - DNA, 122 bp, Homo sapiens
attgtgatatgtgtgtgtatatatatatatatatatcacaatatgtgtatgtatatatatatcacaatgtatatataaacatatatatatgtgtgtatatatgtgtgtatatatatatgcac

SEQ ID NO: 9224 - DNA, 79 bp, Homo sapiens
gacttctattttccagaactgtgacactaatttttattatttgaagtcacccagtttgtgtcactttgttatgggagtc

SEQ ID NO: 9225 - DNA, 90 bp, Homo sapiens
attaaatctaaggcagatgtgtgcattgttgactctgtgtttgaataagaatcaagccagcattcattgagcatacaatgcttatttagt

SEQ ID NO: 9226 - DNA, 65 bp, Homo sapiens
caggagagaaatgacagtggagaggttgcctagaaacccccgccttgatccacctgcctttcctg

SEQ ID NO: 9227 - DNA, 102 bp, Homo sapiens
gggtgaagccaggggctaggggttggtaggggactggtggggagaggaaatgagtttcagtctcattcagtcacccactaggctggagacctcagtttcccc

SEQ ID NO: 9228 - DNA, 100 bp, Homo sapiens
tgcaacatatattattcagatggtggtgggaggtgcatgtatacttctgctgtaaatggggctcttaaagatggtcatatgacagagtgtgtgaagtgca

SEQ ID NO: 9229 - DNA, 97 bp, Homo sapiens
tgaatctcattgagtttcctgacaagttatttttttgaattttttatctatcatttcagaattttcgatttggttagaactcatttcttgagagcca

SEQ ID NO: 9230 - DNA, 104 bp, Homo sapiens
tgtttttgctgattgtcataagttttataagtagataatcatatcattgacaaatactgtttatgtttatgaatttttatatcatgtgattcagcacaaaaata

SEQ ID NO: 9231 - DNA, 82 bp, Homo sapiens
gcccccaattcagccaccagtcttaactatggggtgctctgggcaaagacacttctgtcagacctggctacaatcctggggc

SEQ ID NO: 9232 - DNA, 105 bp, Homo sapiens
acccaaggacaaacattgctggttcttctgtgtagaatctaaaaaagtatgtctcataaaagcagagtaaatagtggttaacagaggctgggcagtgtaaggggt

SEQ ID NO: 9233 - DNA, 88 bp, Homo sapiens
tatacacatatacatatgaatgtgtgtatatatacacatatatatgaatgtgtgtgtgcatatatatatatgtattcttcaatatgta

SEQ ID NO: 9234 - DNA, 74 bp, Homo sapiens
cctggagccaggcagacttgctgggtggctgggctcagaagagagacaacaatcactgcagtttggctcacagg

SEQ ID NO: 9235 - DNA, 66 bp, Homo sapiens
acatacacatatatataattatatacatgtacatatatgtgtgtgtatacatatgtgtgtatatgt

SEQ ID NO: 9236 - DNA, 95 bp, Homo sapiens
gcctttggggaaatgctcaaccccccagcacccgcactctcagactgtgaggctctgatggggctgaccctgttggtgctcccaggatgggtatg

SEQ ID NO: 9237 - DNA, 85 bp, Homo sapiens
gtattggtgtgattttctgtgatttgagttgccatagtgagcacagagggttcacagtgttgtcacagggaaataattataatac

SEQ ID NO: 9238 - DNA, 62 bp, Homo sapiens
tatatatacacacacacacatacatatatgtatatatatgtatgtgtgtgtgtgtgtgtgtg

SEQ ID NO: 9239 - DNA, 72 bp, Homo sapiens
tgttcacttaacagcaggagtaacagacacctttgtaaaaagggtgtttctgtgtctctgtctgtgtggaca

SEQ ID NO: 9240 - DNA, 76 bp, Homo sapiens
tatatatgtgtgtgtgcacatgtatatatacatttatatatatgtgtgtatgtatacacatgtgtgtacacacaca

SEQ ID NO: 9241 - DNA, 107 bp, Homo sapiens
aactgctcatttctcagtgtgaatttggttattttgaacgaaatttataatttttgttataaaattataaattaaaaatactgtttagacaataaaaaatgagtgtt

SEQ ID NO: 9242 - DNA, 73 bp, Homo sapiens
taccaggtaggcactatttttttttattcagaggaaactgggacttagaaagattaagtagtctacccaagtg

SEQ ID NO: 9243 - DNA, 103 bp, Homo sapiens
gagaaagtgtcctacatagacccaagatgcaaagactggaggagggttttttttttattcttctgtatatttgttcttggcttctggaatttaaatgaatctc

SEQ ID NO: 9244 - DNA, 80 bp, Homo sapiens
tgaagaaatactattctgagaacattgacacataggcacacctcagctttttttttgtttttaggatgctattgccttca

SEQ ID NO: 9245 - DNA, 116 bp, Homo sapiens
tttgcttagaattgtcttggctatacgggctcttttttggttccatatgaaatttaaagtagttttttctagttctgtgaagaaagtcaatggtagcttgatgtgtatctggcaag

SEQ ID NO: 9246 - DNA, 67 bp, Homo sapiens
aatccctgtgttgcattggtgggtgtgtctctgcctgtggtggccatacgctcttgaaggagggatt

SEQ ID NO: 9247 - DNA, 132 bp, Homo sapiens
tgtgtatatatatatatggtatgtgtatatatatatacatggtgtgtatatatatatataaagtgtgtgtgtatatatatatatatatatatatatatatatatacacacacactcaccttatatatacacc

SEQ ID NO: 9248 - DNA, 106 bp, Homo sapiens
tttctgactcaaaccattgaaatgtaggtgacaggtgtaatttcaatttttatataaattacggtgtataatatgtgagttacattggtttaaaggtagtgagaaa

SEQ ID NO: 9249 - DNA, 116 bp, Homo sapiens
caagaagtgatagctataagtttaaattgatatgtttaaatctattatctctatacttggtataaattattttttaaatttagtcacccatttaaacttagagttatcactttttg

SEQ ID NO: 9250 - DNA, 123 bp, Homo sapiens
atgtattcaagatcactcagatattattttctaggtatttgaaatctagattcttataccttatagatttttatttttaaattattttagatggagaatatttggaacatctggagcatcttg

SEQ ID NO: 9251 - DNA, 103 bp, Homo sapiens
gctgatgaagaagtaggtgacttacagtgaactgtgatagctgttgaagcaatcatgctttttttgtctatcagggaacacttgtagtctcctgttgcattgc

SEQ ID NO: 9252 - DNA, 95 bp, Homo sapiens; identical to SEQ ID NO: 68

SEQ ID NO: 9253 - DNA, 93 bp, Homo sapiens; identical to SEQ ID NO: 69

SEQ ID NO: 9254 - DNA, 88 bp, Homo sapiens
tgagattacagacatgtgccatcacacccagataatttttctatttttggtagagacggggtttctgatgttggccaggctggtctca

SEQ ID NO: 9255 - DNA, 132 bp, Homo sapiens
gtatgtatatatgtgtatgtatatatgtgtatgtatgtatatatgtgtatacatatgtatatatgtgtatatatatgtgtacatatgtatatatgggtatatatatgtatacatgtgtgtatatatgtatat

SEQ ID NO: 9256 - DNA, 112 bp, Homo sapiens
atgtatttatgtgtgtatatatgtgtatatatgtatatatgtgtgtatatatgtgtatatatgtatatacgtgtatatatgtatatacgtgtatatgtgtatatatgtatat

SEQ ID NO: 9257 - DNA, 86 bp, Homo sapiens
catatatatatgtgtatatatatatgtatatatgtgtgtgtatatatatgtatatatgtgtgtatatatgtatatatatgtgtatg

SEQ ID NO: 9258 - DNA, 117 bp, Homo sapiens
cactccaagcttttttgttttttttttgggacggagtctcactctgcctgtcaggctggagtgcagtggtgcgatctccactcactgcactccgcctcctgggttcaatgattctcc

SEQ ID NO: 9259 - DNA, 81 bp, Homo sapiens
tatatataatatatatacataatcatagaatatatattgaatcatatatatgtatatgattatgtacgtatattatacata

SEQ ID NO: 9260 - DNA, 103 bp, Homo sapiens
aggagagcgggtgaagagaaaggggagatattttgattttttaaaaagactaagatttttaatgaaaatagtagatgttaacgtattttcacccttcatacct

SEQ ID NO: 9261 - DNA, 104 bp, Homo sapiens
gaagccccctggacatgaacatgtatggtggtaaaccttgaaggattctatatttatatgtctgtatttctttataccaccttagttcaactgttttaccattc

SEQ ID NO: 9262 - DNA, 60 bp, Homo sapiens
tgaggggcttcacagtcaaaggggtgaagtgcccaatgcactcactcactcgctcactca

SEQ ID NO: 9263 - DNA, 150 bp, Homo sapiens
tatagctagaaatatatatatacacatatgtatatgtatatatgtatatacatgtgtgtgtgtatatatatgtgtatatatatgtgtgtgtgtgtatatatatatatatatatatatatatatatatatatatatatatgtaaagagaca

SEQ ID NO: 9264 - DNA, 89 bp, Homo sapiens
tggctttgtagaaggttggaaagttaacttaatattttcttttaaaatttatatggaagatacttttcatcttggttttataaggctca

SEQ ID NO: 9265 - DNA, 90 bp, Homo sapiens
tgtggtgagctatagttactataaaatcattatttttgaaacattaaaaatgatgtacacaattttggtctgtaactggttgttaacata

SEQ ID NO: 9266 - DNA, 96 bp, Homo sapiens
agatagagatagagagatggatagagagctaacatatagaaaaaaacagaatatctatatctatatctatctatctatctatctatctatctatct

SEQ ID NO: 9267 - DNA, 86 bp, Homo sapiens
ggcaacagaggagatggcagaggggtgaggctcattcattcattcattcattcactcactcactcactccctaagccttgattctt

SEQ ID NO: 9268 - DNA, 99 bp, Homo sapiens
ttcagtttgagatgcccattagaaactcacatgcagatcctatatgtggaatttgacatatgaatttgtagttctaaaaaagggttcaactgctgaaac

SEQ ID NO: 9269 - DNA, 122 bp, Homo sapiens
gtagtattccatggtgtgtgtgtgtatatatataatgtgtatatatatatgtgtgtatatatatatacacacacacaccattatatatatatacacacacacatatatatatacacacacac

SEQ ID NO: 9270 - DNA, 90 bp, Homo sapiens
tacagttttatattattttttttgtttaaagtgatttttatcctttaggtggataaaagtttggctctaggtgaaccgaagtgatttgta

SEQ ID NO: 9271 - DNA, 58 bp, Homo sapiens
tgagacagagtctcgctctgtcacccaggctggagtgcagtggcaagatcttggctca

SEQ ID NO: 9272 - DNA, 76 bp, Homo sapiens
attaggctttatatacagttgtgtgtgtgtgtgtgtgtgtatatatatataatatatgtataatacgaggcctaat

SEQ ID NO: 9273 - DNA, 91 bp, Homo sapiens
agcactttattaatgctgggtagtggtggaagttcagactcaccgcatggtctcctctgacaccctgacaccctgcaggaatgaaagtcct

SEQ ID NO: 9274 - DNA, 95 bp, Homo sapiens; identical to SEQ ID NO: 68

SEQ ID NO: 9275 - DNA, 93 bp, Homo sapiens; identical to SEQ ID NO: 69

SEQ ID NO: 9276 - DNA, 112 bp, Homo sapiens
ttttcttgtaaatttaagctacgtatagatgctgtatattagactttgttggatgcatagtttgcaaaaatattctcccatttggtagtttgtctgtttactctattgaaaa

SEQ ID NO: 9277 - DNA, 118 bp, Homo sapiens
ccagctttgttctttttgtttaggattgtcttggctatgtgggttcttttttggttccatatgtaatttaaagtagttttttccaattctgtgaagaaagtcagtggtagcctgatgg

SEQ ID NO: 9278 - DNA, 107 bp, Homo sapiens
atttcactcttaccctgttgaggccaccaagaaggcttcatttccagatgtttttgacagaagattgtgaagcccttgtcagctttatctctgggtgattctggagt

SEQ ID NO: 9279 - DNA, 74 bp, Homo sapiens
gacggagagactgtgttggctggggttctctcttggcctgcagtcctgagtctctccttctctgtgtagtctct

SEQ ID NO: 9280 - DNA, 73 bp, Homo sapiens
tctttgaagccagacagacctgcgttgaaattctgactctgtctctcatgcagtagatgtgtgactttaggga

SEQ ID NO: 9281 - DNA, 82 bp, Homo sapiens
tgaagcttagtttggctggatatgaaattcttggttgaaaatttttttctttaagaatgttgagttcaggcatggtggctca

SEQ ID NO: 9282 - DNA, 102 bp, Homo sapiens
tactttggagtgaaatttctggttctgtccttatagctcatacaggattgtcatttactgttgagtggattgtgaattccacaaaaaaacacatctaaagtg

SEQ ID NO: 9283 - DNA, 69 bp, Homo sapiens
gcctgagtccacagggctgcagagaggcagcacacagcagtccgactctgcacctgggataaagcaggc

SEQ ID NO: 9284 - DNA, 85 bp, Homo sapiens
tggcatagggcctggtgcataatagatattcaaaatactacaggtagttttatttttattttagagtcagggtctctctctgcca

SEQ ID NO: 9285 - DNA, 84 bp, Homo sapiens
aggctgcactgtgaagagtctcagtagtgtgtgactaaggctagccatagtcacacacttcccaggctgcactgtgaaaagtct

SEQ ID NO: 9286 - DNA, 111 bp, Homo sapiens
gggagccctgttagcataggaccagggaggaggtggcaggagaatggagagagctggtcagatcagagacacctctcagggtttcatccttgttctgcagggcctggttcc

SEQ ID NO: 9287 - DNA, 84 bp, Homo sapiens
accagcctaggcaatacagtgagacctgcctgtacagatttttttttaattagtcaggcttggtagtttgtgcctgtagttagt

SEQ ID NO: 9288 - DNA, 78 bp, Homo sapiens
atgggctgacacttctttggagaagcccttctggactgctcttgcagtgagggactcactctgtctgtgctcttccat

SEQ ID NO: 9289 - DNA, 95 bp, Homo sapiens; identical to SEQ ID NO: 68

SEQ ID NO: 9290 - DNA, 93 bp, Homo sapiens; identical to SEQ ID NO: 69

SEQ ID NO: 9291 - DNA, 84 bp, Homo sapiens
gacaatgttatcactcatcttacttcaacaatgaggaggaggtaaaattgttaatttttgaagtgacagaggactaatcttgtc

SEQ ID NO: 9292 - DNA, 111 bp, Homo sapiens
ggctatttaatgggaaagttttactgttaattactgttacgctatggaaatctaatgaaatatttaaaatcatgtaggttactgtaattgatttcaaattttccacaggcc

SEQ ID NO: 9293 - DNA, 118 bp, Homo sapiens
cttaactgtagcacaggctgaatatcccttatccgaaatgcttgaaaacgaaagtgtttcaaattttggatttttttttttattttggaatgtttgcgttatatacttactggttgag

SEQ ID NO: 9294 - DNA, 95 bp, Homo sapiens
tggaaagataaacacagtggcagaggtaggaggtagtgttcttggtttatttgaaaatcctacctttaattctagcctgtggacaatttttttta

SEQ ID NO: 9295 - DNA, 85 bp, Homo sapiens
ccctggggtctcaggtgccatctgccctcactgccttcccttccactgtgctgtgtcactctgtgcctctgggtaaccggcatct

SEQ ID NO: 9296 - DNA, 88 bp, Homo sapiens
gtgacgttaggcggaaggctcaccctctctgagcctcagtttcatctctcgtaagcttctagaggagagagccttatcctttactcat

SEQ ID NO: 9297 - DNA, 111 bp, Homo sapiens
taggagatttttaagcactgtgttgttatctagactttgcatataactcacagaagattgtgagatgactaatgtgaagacatctttggacaagcaattatcaacttccta

SEQ ID NO: 9298 - DNA, 106 bp, Homo sapiens
cagtcctttttagtgtactcagctgttagcagagcaagagtctccctctctctggcttgaaaagagagaaatttgttgtctcgcagttgtggaggccagaagtctg

SEQ ID NO: 9299 - DNA, 127 bp, Homo sapiens
gaatatagtagggcttttttgttttaagaataagggttaatgttgttttgaataaaaggtatctctcttttttttttttttctttttttgagacaaggtcttgctctgtcatccaggctggagtgct

SEQ ID NO: 9300 - DNA, 101 bp, Homo sapiens
tagggagattatatctaaaagaatataattgaatatacattaaaatgttattaacagggaataatatatatatatgtgtgtgtgtgtatataatctttcta

SEQ ID NO: 9301 - DNA, 134 bp, Homo sapiens
gaggtgcttttctatgtgtccgtgtcctcaatgattgggttgggatggggacatgcatgctgtggaactcactctctgagactctcttctgctgtgccaggcagtgctgttggcaggagtggttgagcagaagg

SEQ ID NO: 9302 - DNA, 58 bp, Homo sapiens; identical to SEQ ID NO: 1391

SEQ ID NO: 9303 - DNA, 56 bp, Homo sapiens; identical to SEQ ID NO: 1392

SEQ ID NO: 9304 - DNA, 91 bp, Homo sapiens
gatatcaaatctatatatctatgatatatgatacatagatatcaaatttagatatctatgatatatatttctatatatatagacaggtatc

SEQ ID NO: 9305 - DNA, 83 bp, Homo sapiens
gctgttttttggttccatatgaaatttaaagtacttttttctagttctgtgaagaaagtcaatggtagcttgatgagaatagc

SEQ ID NO: 9306 - DNA, 106 bp, Homo sapiens
atctttggtagacattgccagtaaaatcatctggatctggtgtttcttttgtgatagattttatattttgattcaatttatttattggttacatgtctaatgagat

SEQ ID NO: 9307 - DNA, 115 bp, Homo sapiens
agctccatgactgcctcagcttgaagagtttccaagacataacacagggagttttcagaccatgaccagcaacctctttgagttaaggagatgaagctagcagtctgtagtggct

SEQ ID NO: 9308 - DNA, 105 bp, Homo sapiens
tatatattagtgttttccttttttttcactgagtagtgtgtatgtatatatatatatagtgctcatttcagtgtaataagtaaagatattaaaaagatttatata

SEQ ID NO: 9309 - DNA, 89 bp, Homo sapiens
gtatatatacatatatacatatgtgtgcatatatgtgtatatatactcacatgtatacatgtatatgtatatatgtatgtgtatgtata

SEQ ID NO: 9310 - DNA, 128 bp, Homo sapiens
atatacacatatatgtatatatacgtatatgtatgtatatatacgtatatgtatatatgtatatatactcatacacatgtatatgagtatatatacgtgtatatacacatgtatatgagtatatatac

SEQ ID NO: 9311 - DNA, 90 bp, Homo sapiens
gtatatatacatatatacatatacgtatatatacatacatatacgtatatatacatatatgtgtatatatatgtgtacatatatatgtat

SEQ ID NO: 9312 - DNA, 81 bp, Homo sapiens
gtcagcatcgtccccattcagaggcccagggtaatgcgcaaagctgcgtgctatcagtgccatctttgttggattttgact

SEQ ID NO: 9313 - DNA, 79 bp, Homo sapiens
ggcctttggtcattgggacccagactcatctctttttttttttttttttttgacagggtctcactctgccacccaggct

SEQ ID NO: 9314 - DNA, 103 bp, Homo sapiens
agtttatgccttcactttgagattacttccatgtggttggttgtagataacatcctagactcacacgtgtagtcttttatatccttagtcaagaaaataaact

SEQ ID NO: 9315 - DNA, 58 bp, Homo sapiens; identical to SEQ ID NO: 2442

SEQ ID NO: 9316 - DNA, 95 bp, Homo sapiens; identical to SEQ ID NO: 68

SEQ ID NO: 9317 - DNA, 93 bp, Homo sapiens; identical to SEQ ID NO: 69

SEQ ID NO: 9318 - DNA, 75 bp, Homo sapiens
cccagaactgctgcagtcatcttgttactactctgaggatgaagccagaaccaagagactgagcagagagatggg

SEQ ID NO: 9319 - DNA, 70 bp, Homo sapiens
ggagtgagatttgagtgagacccacaggaagaaccagatgctgcctttggtgactacactctctctctct

SEQ ID NO: 9320 - DNA, 113 bp, Homo sapiens
ttctgctcagtagtgtatttgtgggagcttgtgaggggcttcatttttttttttttcagttaaattgaataaagcatttgacgtgttttatattggtattccccataacagaa

SEQ ID NO: 9321 - DNA, 111 bp, Homo sapiens
agagagagagacagagattgagatcacagtcatataacttttattaggatatattattataattgtcttattttattattagttattggtgttaatctcttactcttccct

SEQ ID NO: 9322 - DNA, 95 bp, Homo sapiens; identical to SEQ ID NO: 68

SEQ ID NO: 9323 - DNA, 93 bp, Homo sapiens; identical to SEQ ID NO: 69

SEQ ID NO: 9324 - DNA, 76 bp, Homo sapiens
gctgcagatttcagtgtgattctcctaaaaaaaagatttttttttttttgatggagtctcactctgttgcccaggc

SEQ ID NO: 9325 - DNA, 78 bp, Homo sapiens
gaatcggagaggctgagatgtaagaaagaggggcccccaaagaatcttctagctctcgctctttgtcactctctgttc

SEQ ID NO: 9326 - DNA, 68 bp, Homo sapiens
tgttttgagccagaatctcactctgtcacccaggctggagtgcagtgccgtgatctcagctcactgca

SEQ ID NO: 9327 - DNA, 58 bp, Homo sapiens
tgagatggagtctcgctctgtcactcaggctggagtgcagtggcgcaatctcggctca

SEQ ID NO: 9328 - DNA, 88 bp, Homo sapiens
aggttttagggcaaatgactcaggaactccagaagtgcattctttttttttttttttttttttgagactgagtctcgctctgtcacct

SEQ ID NO: 9329 - DNA, 118 bp, Homo sapiens
gatatgtgtatatgcaaattgggttgtgagaaatgtgaaaagatctttgtaaaattttttttttgagacgagacggagtcttgttctgtcgcccaggctggagtgcagtggcatgatc

SEQ ID NO: 9330 - DNA, 113 bp, Homo sapiens
aagtgccgggattacaggcgtgagccacggagcctagcctttatatttaaattttaatttatatctaatgtacccctaatctgtgtctttatgttacctctgattctcagctt

SEQ ID NO: 9331 - DNA, 59 bp, Homo sapiens
tgtgtatctatgtgtgtatgtatatatgtatatgtgtatatacacacatacatgattca

SEQ ID NO: 9332 - DNA, 116 bp, Homo sapiens
atggcgagagactaccctcccactccccatctctttaaaaaaaaaaaaatcaaattttatacttttttgagtttttcttttttttttttttttttttagatggagtctctctctgt

SEQ ID NO: 9333 - DNA, 107 bp, Homo sapiens
tctttggttgggaacttcctgtgcttctctctaggagaccagctgccatattaggagagaatgtggtagtaccttgaaaagttccagttaagctttctctctaaaga

SEQ ID NO: 9334 - DNA, 58 bp, Homo sapiens
tgagacagggtctcactgtgtcactcaagctggagtgccatggtgcaggcttggctca

SEQ ID NO: 9335 - DNA, 107 bp, Homo sapiens
atatatgaacaatatatatgtgtgtgtttatatatatacatatacatataaatataaaatacaaagcaatatgtttatatatatacacatatgtatatattatatat

SEQ ID NO: 9336 - DNA, 58 bp, Homo sapiens
tgagacagagtctcgctctgtcacccaggctggagtgcagtggcgcgatctccgctca

SEQ ID NO: 9337 - DNA, 119 bp, Homo sapiens
tctcagctgctcctatatatagtctccccttcattcactctgagattacagttcttacagagcactctcagtcaatgaaagatcatgatggggctataagtgcaggtacgtttctgtga

SEQ ID NO: 9338 - DNA, 95 bp, Homo sapiens; identical to SEQ ID NO: 68

SEQ ID NO: 9339 - DNA, 93 bp, Homo sapiens; identical to SEQ ID NO: 69

SEQ ID NO: 9340 - DNA, 111 bp, Homo sapiens
catatacaggtaaattcacagatacatttatgtatgggtgcatatacatgtgcatatgtatatatatttaaaggcatatatgtatatataatctgattttggatgtgtgtg

SEQ ID NO: 9341 - DNA, 99 bp, Homo sapiens
tgtgtcaaattgaatattgaatcagcaaggtctgtaaatgtttattattgaattccaacagatctcataggatttgattctgtatccagggtatgaaca

SEQ ID NO: 9342 - DNA, 171 bp, Homo sapiens
tatataaaggtatatatatatgtgtatgtgtgtatatatgtatatatacatatatacgtatatatgtatatatacgtatatacgtatatatgtatatatacgtatatacgtatatatgtatatatacgtatatacgtatatatgtatatatgtatacacatatatatatac

SEQ ID NO: 9343 - DNA, 107 bp, Homo sapiens
acatagtcactgtctaaggtgtttgggcttaggattttagcatataaatttttttttgaaaggagtgcaattcatcctttaatgaacatcatgagatacttactagt

SEQ ID NO: 9344 - DNA, 82 bp, Homo sapiens
ttcctgggaattcaaatgttaaagacacaggggcccgcttacactgtctgcctctctgcttggacttagaataacacaggaa

SEQ ID NO: 9345 - DNA, 85 bp, Homo sapiens
attgatggacacttagtttgattctatgattttgttgttgtgaatagtgctgcaataaacatacgcgtgcaggtgtctttttgat

SEQ ID NO: 9346 - DNA, 59 bp, Homo sapiens
gtgtatgtatgtgtgtggcgtgtgtgtgtgtgtatatatatgtctatatgtatatatac

SEQ ID NO: 9347 - DNA, 58 bp, Homo sapiens; identical to SEQ ID NO: 1673

SEQ ID NO: 9348 - DNA, 132 bp, Homo sapiens
tgtttaaatgtatgtatgtatgtatatgtatatatatgatgtgcatatgttttaatatatattttcatttatacatatcataaacatattttttcatttatatatcatatatcatatatatcatatactaca

SEQ ID NO: 9349 - DNA, 95 bp, Homo sapiens; identical to SEQ ID NO: 580

SEQ ID NO: 9350 - DNA, 93 bp, Homo sapiens; identical to SEQ ID NO: 69

SEQ ID NO: 9351 - DNA, 71 bp, Homo sapiens
aggtgtcagactctctgttaattttccctaaattcagccaacggaaggtctcagagaaatcctggctgcct

SEQ ID NO: 9352 - DNA, 71 bp, Homo sapiens
tttctgtgagacttggtcataatcttaatcattcttgaaagcagagagtgatgagtctgacctcagggaaa

SEQ ID NO: 9353 - DNA, 85 bp, Homo sapiens
ggcagttcaagtgtgagtggattgtaaattagactcaatacaaggtgttttttttctttttttttttccactgatatttgttgtc

SEQ ID NO: 9354 - DNA, 94 bp, Homo sapiens
agtttgtacattatgattccaagtgtgtgtatatttatataaagatataaatatacatataattagaagaaagatattctctgtgatgctaact

SEQ ID NO: 9355 - DNA, 64 bp, Homo sapiens
tacatatcatatatgtatatgtgtgtgtgtatatatatatatatatatatatatatattctgta

SEQ ID NO: 9356 - DNA, 110 bp, Homo sapiens
tgtttagaattgtcttggctatacaggctcttttttggatccatatgaaatttaaagtagttttttctaattctgtgaagaaagtcaatggtagcttgatgggaatagca

SEQ ID NO: 9357 - DNA, 95 bp, Homo sapiens; identical to SEQ ID NO: 68

SEQ ID NO: 9358 - DNA, 93 bp, Homo sapiens; identical to SEQ ID NO: 69

SEQ ID NO: 9359 - DNA, 109 bp, Homo sapiens
tctgtgagggtgcttccaaaggagattggactgtaagtcagtggacagagtggagaaaatctgcctccatgtcggcaggcaccatccaattggctggaggcccaacaga

SEQ ID NO: 9360 - DNA, 93 bp, Homo sapiens
acagatccaaaaatctgagcaccattaatctgtcatatgtttgattacttcatatatttttgtctaaaatggtctttaaattgttgaatctgt

SEQ ID NO: 9361 - DNA, 119 bp, Homo sapiens
aaaatgagtcaaggatttttcttgttttcaatgcaccctacagtgtcactatttaatttttacatagtgatactgacttagatgctactccatgaggcaagaacagtgaaaactatttt

SEQ ID NO: 9362 - DNA, 65 bp, Homo sapiens
gtgactcaaatgagtgttcaatgaatgctcactgaagtattttcattgagatttacttgagtaac

SEQ ID NO: 9363 - DNA, 121 bp, Homo sapiens
atgtgctttgatgtatatttggggggcttatcctgtttggttaacagcttcttgattctatagatttaggtctcttgccaaatttgggacattttcagccattatttctcaaagcacatta

SEQ ID NO: 9364 - DNA, 58 bp, Homo sapiens; identical to SEQ ID NO: 1409

SEQ ID NO: 9365 - DNA, 120 bp, Homo sapiens
tgttcttttttgcttaggattgtcttggctatctgggctcttttttggttccatatgaaatttaaagtagttttttctagttctgtgaagaaagtcaatggtagcttgatgggaatagca

SEQ ID NO: 9366 - DNA, 95 bp, Homo sapiens; identical to SEQ ID NO: 580

SEQ ID NO: 9367 - DNA, 93 bp, Homo sapiens; identical to SEQ ID NO: 69

SEQ ID NO: 9368 - DNA, 99 bp, Homo sapiens
tttctcttgtaagattgctctggctaggacttccagtactatgttgaatagatgtggttaaagtgggcatccttgtcttgttccagttctcaggggaaa

SEQ ID NO: 9369 - DNA, 117 bp, Homo sapiens
gctttgttctttttgctcaggattgtctatttgggctcttttttggttccatatgaaatttaaagtagtttttcaaattccatgaagaaggtcaatggtatcttgatggggatagca

SEQ ID NO: 9370 - DNA, 108 bp, Homo sapiens
gagaacctgggcacctcagttgctggtgcaggattcactgactgtttttgttcttctcagtgggagcctccatttgcagctgtttttagctggccatcttggtccctc

SEQ ID NO: 9371 - DNA, 95 bp, Homo sapiens; identical to SEQ ID NO: 68

SEQ ID NO: 9372 - DNA, 93 bp, Homo sapiens; identical to SEQ ID NO: 69

SEQ ID NO: 9373 - DNA, 107 bp, Homo sapiens
tattttcctttcacagcctactttcttccttccagaagtgactgtggacaattccacagggtttggacttgatcagggcagaaggtgaagctgcaaggtattagatg

SEQ ID NO: 9374 - DNA, 95 bp, Homo sapiens; identical to SEQ ID NO: 68

SEQ ID NO: 9375 - DNA, 93 bp, Homo sapiens; identical to SEQ ID NO: 69

SEQ ID NO: 9376 - DNA, 86 bp, Homo sapiens
cacccagactaccctccatctgaacagagtaaccagacactggagctctggggacagatgccatagcaaggtgactttctcagttg

SEQ ID NO: 9377 - DNA, 86 bp, Homo sapiens
gcttctggagccatctgtctgtgtctgtgagtgggtgtgatcagtaggcccctctctcataaaccgtgctgataagcagcataagc

SEQ ID NO: 9378 - DNA, 134 bp, Homo sapiens
ccagctttgttctttttgcttaggattgctttggctatgcaggctcttttttggttccatatgaaatttaaagtagttttttccagttctgtgaagaaagtcaatggtagcttgatgggaatagcattgaatct

SEQ ID NO: 9379 - DNA, 95 bp, Homo sapiens
gttgtcaagctgattctcctcatgacacagtgattttttttttttttaattgagatggagtctcactctgttgcactggagtgcagtggtgcaat

SEQ ID NO: 9380 - DNA, 110 bp, Homo sapiens
ctcagttaatagtcgactgttttgaagccaagttttaattatttatatgagtcataaaccatacaatttaattaattgcttcaaaaatgtaaactgctttaaaacctggg

SEQ ID NO: 9381 - DNA, 58 bp, Homo sapiens
tgaggcggtgtctcactcactctgtcgcctaggctagagtgctgtggcaatgatctca

SEQ ID NO: 9382 - DNA, 81 bp, Homo sapiens
gtgtgtgtctgtgtgtgtgtctgcgcaagtgtttgcttgtttccaatgtgcatttgaatagagtaaaccacccctcaccac

SEQ ID NO: 9383 - DNA, 84 bp, Homo sapiens
gtacttgaaggttcattttattatttttatactggatagatatttttatatctctctagtatgatagaggaatacacagagtac

SEQ ID NO: 9384 - DNA, 79 bp, Homo sapiens
ggacgttgagtcagctgggcctgagtgcactcaataaaagattctcctgtttcaactctaggtctctctctcattctcc

SEQ ID NO: 9385 - DNA, 92 bp, Homo sapiens
tgttggtttgttttttgagatggactctcgctctgtcacccaggctggagtgcagtggcgcgatctaggctcattggaagctccgcctcgcg

SEQ ID NO: 9386 - DNA, 78 bp, Homo sapiens
cattgttcctttctgtgtctctgtcacttaactaccaagcacagtagaactgaattgagtcacttaaaggaacacatg

SEQ ID NO: 9387 - DNA, 137 bp, Homo sapiens
gacctgattttggggtgggagatcttttattttgtttctcatctaattcctggaaggcctctctttccttgtgtcatgtcccagtttacccttatgggaaaggctgtagcactgtgagccaagactgggagtcggcc

SEQ ID NO: 9388 - DNA, 97 bp, Homo sapiens
gagacagatactcatttgggtcagggtgcttggctgtgctgacacagacagtatatatgtatttatagtcccatgtgtatattcttatatctttctc

SEQ ID NO: 9389 - DNA, 95 bp, Homo sapiens; identical to SEQ ID NO: 68

SEQ ID NO: 9390 - DNA, 93 bp, Homo sapiens; identical to SEQ ID NO: 69

SEQ ID NO: 9391 - DNA, 58 bp, Homo sapiens
tgagtcagagtctcactctgtcgtccaggctggagtgcagtggcgcgatcttggctca

SEQ ID NO: 9392 - DNA, 72 bp, Homo sapiens
gtagaatatagccacaatgtatatatatgtgtatttatttatgcatatttgtgtatatgtttctaaatctac

SEQ ID NO: 9393 - DNA, 72 bp, Homo sapiens
tcaaataattatgtatatatacatacatatatgtgtttgtgtgtgtgtgtatatatatacactattatttga

SEQ ID NO: 9394 - DNA, 91 bp, Homo sapiens
tgtgtgtatatactatgtgaggcatagtatatatacaacctcatagtatatatgtatatataccatgtatacatatagatatatacataca

SEQ ID NO: 9395 - DNA, 91 bp, Homo sapiens
tctgcatttacaagtgaaattagcttagaaagttttttgtatactaactttgtcaggatttgatatctgagttatacttgtaaaatttaga

SEQ ID NO: 9396 - DNA, 104 bp, Homo sapiens
gaccagacacagtggctcatgcctgtaatcctagcactttgagaggctgaggtaggaggatcacttgtggtcaagggttcgaggccagccaggccaacatggtg

SEQ ID NO: 9397 - DNA, 71 bp, Homo sapiens
gtagagttttgattttcctttacctgaatatttttatctttcttcaggtttggaaagttttttgctattac

SEQ ID NO: 9398 - DNA, 95 bp, Homo sapiens; identical to SEQ ID NO: 68

SEQ ID NO: 9399 - DNA, 93 bp, Homo sapiens; identical to SEQ ID NO: 69

SEQ ID NO: 9400 - DNA, 118 bp, Homo sapiens
gggagtgaagtctagagttggagcaaattcagagctgatccttctgggccctgttctctctcccacagactcagacggttgcaataaagatgtgtctgtttgagattttccaggtccc

SEQ ID NO: 9401 - DNA, 112 bp, Homo sapiens
gggagtcatcatgagagctggttgttttaaaagtgtggtgtgtagtgccttctctctcactctcttggtcctgcacctgcattataagatgcctgctcctgttttggcttct

SEQ ID NO: 9402 - DNA, 102 bp, Homo sapiens
tgatataataagaatagtgtattgtagttttattttattacttagtaattatgcagaatgatcaaaatggtgactactgcaaatacttgttttattttttca

SEQ ID NO: 9403 - DNA, 64 bp, Homo sapiens
cacttcactgtctcactgtcagatagtaacatttactgtctcacttactgagacatgtttggtg

SEQ ID NO: 9404 - DNA, 76 bp, Homo sapiens
aggtagaagagttatggacagtccaggtgagtgtggtcttactctctcagactgtcattagactacttaatggcct

SEQ ID NO: 9405 - DNA, 95 bp, Homo sapiens
gtctctgtggcatcccagaaaaggcatggagcaggctagggtggagtgcagcctcccctctgagcctctctctggctccccactcccacggagtc

SEQ ID NO: 9406 - DNA, 80 bp, Homo sapiens
gggatgattactcctttgccttgaaacatttattgggcccaccatgtatggatcagcatgtggtggtaagtcatactccc

SEQ ID NO: 9407 - DNA, 58 bp, Homo sapiens; identical to SEQ ID NO: 2442

SEQ ID NO: 9408 - DNA, 67 bp, Homo sapiens
agtctatgtgtgtctgtgtgtcttcataagagaagtgtgtttgttgtaggcaacagatcgctgggct

SEQ ID NO: 9409 - DNA, 58 bp, Homo sapiens
tgagccagagtctcgctctgtcacccaggctggagtgcagtggcacaatctcggctca

SEQ ID NO: 9410 - DNA, 75 bp, Homo sapiens
ttgttttgttttgagatggagtctcactctgtcacccaggctggagtgcagtggcaccatctcagctcactgcaa

SEQ ID NO: 9411 - DNA, 118 bp, Homo sapiens
ttggccgggcattgtggtgcacacctgtggtcccagcaactgaggctgaggtaggaggatcacttgagcccaggaggtcgaggctacagtgaagtgtgattgcaccactgcactccag

SEQ ID NO: 9412 - DNA, 113 bp, Homo sapiens
acatccaagtgagatagggtaaagactacggaaaatcaggggaaatagggggacagaattttttttttttttttttttttggtggagtctcgctctgtcacccaggctggagt

SEQ ID NO: 9413 - DNA, 57 bp, Homo sapiens
gggtctcactctgtcactgtacttcaggctggaggtagagtggcctgactatggctc

SEQ ID NO: 9414 - DNA, 75 bp, Homo sapiens
gtctgatattgtcttgctaccatagttcttaaccacagtatgaacatgaagtaggtagtaatgaaagtcacagac

SEQ ID NO: 9415 - DNA, 79 bp, Homo sapiens
acacccaaaaattctgttttagtagatgtgattctgaggtatactctcagttgagaactactattgcagaagtgtatgt

SEQ ID NO: 9416 - DNA, 90 bp, Homo sapiens
gggagaaagcaggtttctgggagggggaagttaggggttaagttataaaataagttttaacattttttttcttttgagacagagtctcgc

SEQ ID NO: 9417 - DNA, 119 bp, Homo sapiens
ggaaactgaagcagagggaggttaagaaatttgccccaggtcacacacagtcagtaagtggcagagcatggattaaaatgtgtctctgtttgatttccaagtccaggcgatttgccact

SEQ ID NO: 9418 - DNA, 108 bp, Homo sapiens
gagcacattttgagcaggatggccatgttggcagagggattgctatccgtaacataggaactgtttttgttgttcacttggcctagtaatttcctattcatgttgttt

SEQ ID NO: 9419 - DNA, 95 bp, Homo sapiens; identical to SEQ ID NO: 68

SEQ ID NO: 9420 - DNA, 93 bp, Homo sapiens; identical to SEQ ID NO: 69

SEQ ID NO: 9421 - DNA, 68 bp, Homo sapiens
gtgaagcgcttgttgcagatactacactggtatgccctcactcctgtgtgtgtcaccatgtgcttgat

SEQ ID NO: 9422 - DNA, 124 bp, Homo sapiens
gaagtcaggaatggaagataagtcaagatttggggatgggcctgaaaatcacagagcaaatgtttttctagttctcaattttgcctctttgttccccatacttcaaacttagtaaaacttcgtg

SEQ ID NO: 9423 - DNA, 61 bp, Homo sapiens
cagcataaatggtgggagaaagggcagggttctgtttctgactctgtcattcattatgctg

SEQ ID NO: 9424 - DNA, 75 bp, Homo sapiens
gggactgcaccaggcatttttataaatgagtatgttcttgtttaaccctcatagcaatgctatggtgtatgtttt

SEQ ID NO: 9425 - DNA, 90 bp, Homo sapiens
gagctgttttgttttatttgtttgtttttgtttttgcagctttatgcttaccagggacttcataaacaagttgaaagagaaaaaatagcc

SEQ ID NO: 9426 - DNA, 101 bp, Homo sapiens
ctttgaagatattttcactccctcaataccagcttcggatgctatgttttcttcagtgttatagtactgaatttgttcttacttagggaatatgttcaaag

SEQ ID NO: 9427 - DNA, 80 bp, Homo sapiens
agacagagatgaccctgaggctcctggcttcaatagcggggtccatcctcgctggcagggacacagggcagagactgtct

SEQ ID NO: 9428 - DNA, 116 bp, Homo sapiens
gcaagtttctgatctctctgtgcctctatttcctcaccaataaaatcggagtaataacagtactctctggtagagttgtgaagatttagcgagttaatacatgtgattacaatggc

SEQ ID NO: 9429 - DNA, 101 bp, Homo sapiens
aaagagctttgtaaatattgacatttagattctgtgcaactggatttgatatctcaggatagaactcactgatagagcctaaatggtccccagggctcttt

SEQ ID NO: 9430 - DNA, 65 bp, Homo sapiens
aggggactgtctcagtttgtcttataataaatatctcggcagaattagggctgggatagttctgt

SEQ ID NO: 9431 - DNA, 106 bp, Homo sapiens
atatataatgtatatatgtatacctgtatatataatgtatatatgtatacctgtatatataatgtatatatgtatacattatatataatgtatatataatgtatat

SEQ ID NO: 9432 - DNA, 144 bp, Homo sapiens
gtgtgtgtgtatatatatatatatatatacgtgtgtgtatatatatacatacatgtatgtgtatatacattatatatacattatatataatgtatacatatatacattatatatacaggtatacatatatacattatatataca

SEQ ID NO: 9433 - DNA, 110 bp, Homo sapiens
gtgcaactggtataaacaaagatcctatgtatggtagagagcttatatttgcatttctttgtatatttaagcatttttagcagacttacatttctgtttattgagagtac

SEQ ID NO: 9434 - DNA, 84 bp, Homo sapiens
attttatagcttatgttacaaagtttttctaaaatgggttcaatattgataatattttgagagaagctatgacataaatggagt

SEQ ID NO: 9435 - DNA, 77 bp, Homo sapiens
tcatatgagtgagagcacagagaagcttgttagcagtgtgcttgtgctcttacgtgttttgtgtactctgactctga

SEQ ID NO: 9436 - DNA, 85 bp, Homo sapiens
ccatatgctgatgacaaaaatgcgtattttgcagccgttggatgaaatgttatgtaaatatgtattaggttcattcagtctatgg

SEQ ID NO: 9437 - DNA, 105 bp, Homo sapiens
ctttcttaactttacgtgtatatgtgtacacacagatactatatatatgtatctatggaaatatacatactaccccagtctttacagtaagcttgttatagaaag

SEQ ID NO: 9438 - DNA, 76 bp, Homo sapiens
ggctctgaataaatgtctgttgaatgaatgacagtgattcaatcagtcagtgagtcattcagcattatataaagcc

SEQ ID NO: 9439 - DNA, 109 bp, Homo sapiens
gtgtccatgactctttgcaaatcatgtgtgacttttatgattatttctttaggataaaatcattgccaggttgcaggggcatgagggagcacatataaggttatgatac

SEQ ID NO: 9440 - DNA, 102 bp, Homo sapiens
agagggatgtgctgtggaggacaatctgaagataagaataccaacaatagaatcatctttttttttttttttactgatttttcaaatagcatatgtctttct

SEQ ID NO: 9441 - DNA, 118 bp, Homo sapiens
cataggttgccttttcactatgttgtttgctgtgcagtcaagatgtatagtcttacctgtttatttttatttttgttgcctgtacttttgatgttacagccatgaaattattactatg

SEQ ID NO: 9442 - DNA, 113 bp, Homo sapiens
cagctagtttccttgtagggttggctgacaaggctgttgttttttttatatattattaagagtcaatagcagcagcacatgcaggctaattgttagaatataaagctttgttg

SEQ ID NO: 9443 - DNA, 99 bp, Homo sapiens
tatgtagatgtggaaacttttaagatagttgctggcattgttgtagattgtttagtagagaggattgaccaggcagcagaagagttcatatagtatatg

SEQ ID NO: 9444 - DNA, 78 bp, Homo sapiens
tggattccaatgctggtgacagaggagaaagtgatgtcacctcatacatatccaaatcctagcatccacaggaaccca

SEQ ID NO: 9445 - DNA, 104 bp, Homo sapiens
gaaagagaaagaggagggagagaaaattgagagccctttctttatccttgtagtttctttgtttatatcatgtagactctcagcttccttctctttgtgatttc

SEQ ID NO: 9446 - DNA, 77 bp, Homo sapiens
gggccccatagaaagtgtatctgggaactgcaaagaaacaaggcagcttctttatcagtctctctttctctgggctt

SEQ ID NO: 9447 - DNA, 97 bp, Homo sapiens; identical to SEQ ID NO: 1307

SEQ ID NO: 9448 - DNA, 88 bp, Homo sapiens; identical to SEQ ID NO: 1308

SEQ ID NO: 9449 - DNA, 81 bp, Homo sapiens; identical to SEQ ID NO: 1309

SEQ ID NO: 9450 - DNA, 77 bp, Homo sapiens; identical to SEQ ID NO: 1310

SEQ ID NO: 9451 - DNA, 79 bp, Homo sapiens
ataatatgtgtgtatatcatttgcatatataagtatataacatatactttgtatgtatatgtatgtatacatgtattat

SEQ ID NO: 9452 - DNA, 87 bp, Homo sapiens
gcatgggcaacaagagtgaaactctgtctcaaaataaaaaagagagagagagagagagatttatatttgttgtttaatccccacagc

SEQ ID NO: 9453 - DNA, 79 bp, Homo sapiens
tgcactagatgctgagtgaagacacagtggtgaataaaccagcctgtcttcaacttcatgaagctaccatctaaatgta

SEQ ID NO: 9454 - DNA, 123 bp, Homo sapiens
tctcagatgtggcattcataaagagaatgacacaaaaaaaatggcctggtgtgcaatacaaaggaatgtatagtaaaattaagctatgaagaattgtgggtggatcctttatgaggtttgcat

SEQ ID NO: 9455 - DNA, 103 bp, Homo sapiens
gatgtaaaggaaagagtgtagcaattaaagcagaatggcttttgctcttcaagttccatagtcaatttgtaattgtttttcaacccaaacttccttctacatc

SEQ ID NO: 9456 - DNA, 69 bp, Homo sapiens
gtgtgtgtgtgtgtgtgtgtgtataagtgtgtgtatacgatatgtatatatacacacacactctcacac

SEQ ID NO: 9457 - DNA, 103 bp, Homo sapiens
ttttgttatgcctgtgagtgtgtgtctgtgtatatatgcatgtatatatgtacatatatatgtatgcattttttataattgcattggaccataggcttcaaaa

SEQ ID NO: 9458 - DNA, 95 bp, Homo sapiens; identical to SEQ ID NO: 68

SEQ ID NO: 9459 - DNA, 93 bp, Homo sapiens; identical to SEQ ID NO: 69

SEQ ID NO: 9460 - DNA, 81 bp, Homo sapiens
atgtctaatataaatatacctatgtatgtgtatatatgtatatatatgcatatatatatatggcttatgttgtaaagacat

SEQ ID NO: 9461 - DNA, 96 bp, Homo sapiens
gcttttctaataattaccattttttaaactattttggctgttaaaaatgtttctttttaataagctgattaaaagaggctgcttattagcataagc

SEQ ID NO: 9462 - DNA, 107 bp, Homo sapiens
ggagaaaggtacactcgtaactgcttacaagactgagaactgagagtggagaaaagtacagaacatctcctagaggcttcgtctgaaagtgatattgtgctgcttcc

SEQ ID NO: 9463 - DNA, 70 bp, Homo sapiens
catttcaggactggacagctggtgagtaggtaaaggttgcctgtgcctcactctgtcagtcaatttaatg

SEQ ID NO: 9464 - DNA, 77 bp, Homo sapiens
gcgtgggtatgaggctagtgacctgcaccccttcttgaggggaatgtaggtagctgctaagccctgcatgctctggc

SEQ ID NO: 9465 - DNA, 62 bp, Homo sapiens
tatatatgtgtgtgtatatatatgtgtgtatatatatacacatatatacacacatatatatg

SEQ ID NO: 9466 - DNA, 95 bp, Homo sapiens; identical to SEQ ID NO: 68

SEQ ID NO: 9467 - DNA, 93 bp, Homo sapiens; identical to SEQ ID NO: 69

SEQ ID NO: 9468 - DNA, 69 bp, Homo sapiens
gacactgattacttttaatggccatccattctcagtggttctttgtgccactcagggtcactcagtgtc

SEQ ID NO: 9469 - DNA, 95 bp, Homo sapiens; identical to SEQ ID NO: 68

SEQ ID NO: 9470 - DNA, 93 bp, Homo sapiens; identical to SEQ ID NO: 69

SEQ ID NO: 9471 - DNA, 65 bp, Homo sapiens
tgtctccctctctttatctgtctttcctacacacacacacacacacagagagagagagagagaga

SEQ ID NO: 9472 - DNA, 104 bp, Homo sapiens
ggcaaaagagaaatctgtgtctacactgggagggcaaatgattatcaaaatcaatttcttttatttatttattttttttgagacagagtttcactcttgttgcc

SEQ ID NO: 9473 - DNA, 109 bp, Homo sapiens
tgataagatactttattactgggaaagaataactaaactccacagtgccactctgcctctgagacccacctgccctgtggattttcctactaataatgcttccatttca

SEQ ID NO: 9474 - DNA, 78 bp, Homo sapiens
ctgtctgtctctctgtatgattgtacctttttatgaatcaaggtgaaaacatggtacaatgtacagacagccccagac

SEQ ID NO: 9475 - DNA, 201 bp, Homo sapiens
atgtatatatatatatcatgtatatatatgtatatatgcgtatatatacatatatgtatatatgcgtatatacatatatgtatatacgcatatatacatatatgtatatatgcgtatatgtgtatatatgtgtatatatgtatgtgtgtatatatgtgtataaatgtgtatacatatatatatatgatgtgtatatatatg

SEQ ID NO: 9476 - DNA, 87 bp, Homo sapiens
tgccttcttgtcacacattctctctctggagccagttaaagactggaaaaatagcttcgggggggcatgtggaaatttaagaggtca

SEQ ID NO: 9477 - DNA, 97 bp, Homo sapiens
actttgttggagacgaccttttgtctagcctagttttcacatttctaaatgagaatatgtgcaagagcatctgctttggagggttattttgaagagt

SEQ ID NO: 9478 - DNA, 101 bp, Homo sapiens
acacatgtatatatacatatatatacacgtatatacacacacatatacacatatatacatgtatatatatacttgtatatatatacacgtatatatatatg

SEQ ID NO: 9479 - DNA, 142 bp, Homo sapiens
tgtatatatatacaagtatatatatacatgtatatatgtgtatatgtgtgtgtatatacgtgtatatatatgtatatatacatgtgtgtgtatatatatgtgtatatatacatatatatgtgtgtgtatatatatatatatg

SEQ ID NO: 9480 - DNA, 112 bp, Homo sapiens
gatatttcagtctgtgggtagtaggtttatagaaggtttatataaatataaaaaataaatatattttatatttaataaaaaacatttttctgtgtgactcacagattttgtc

SEQ ID NO: 9481 - DNA, 126 bp, Homo sapiens
tccagctttgttctttttgcttaggattgtcttgactacacaggctctttttaggttccatatgaaatttaaagtagttttttctaattctgtgaagaaagtcaatggtagcttgatgggacagca

SEQ ID NO: 9482 - DNA, 95 bp, Homo sapiens; identical to SEQ ID NO: 68

SEQ ID NO: 9483 - DNA, 93 bp, Homo sapiens; identical to SEQ ID NO: 69

SEQ ID NO: 9484 - DNA, 96 bp, Homo sapiens
cttagtggtacatcttgaattagcatgttgctcaggttcctggatgttttgtcaaggacaaacccagaaagagtcatgtcaggaaaaatctacaag

SEQ ID NO: 9485 - DNA, 83 bp, Homo sapiens
cttgtgtatctctatatatttctattgtattgttcatgtttcccagtgggctctatcatagaaatggcagaaggatatggaag

SEQ ID NO: 9486 - DNA, 100 bp, Homo sapiens
tatttctacatgaaaaaaggagctgaaaagactggagcaagcaaaataatttaaatattttatcttctctatttttagtgtcttttccttgtggagcata

SEQ ID NO: 9487 - DNA, 87 bp, Homo sapiens
atgtgtagatatatgtagctatgtataaagtccatatatgtatataaaatttggactttatatatacatataaatatatgtgcacat

SEQ ID NO: 9488 - DNA, 76 bp, Homo sapiens
tatatatatatacgtatatatatgtgtgtgtgtatatatatatatacacacacatatatatacatatatatatata

SEQ ID NO: 9489 - DNA, 130 bp, Homo sapiens
ggggttcacaaggccctgagaaaaccttctgcctgactctcaccaggcctttgaggatcccacacgctcagtggctgacaggagaggcagctgaaatatgacgagtggtgccaaggctgtcagcactggc

SEQ ID NO: 9490 - DNA, 79 bp, Homo sapiens
tcgggaggctgaggtaggaggatcacttgagcccatgaggtcaaggcagcagtgagccgtgtttgcaccactgaactcc

SEQ ID NO: 9491 - DNA, 97 bp, Homo sapiens
gaacactgtattttttccttatcacttatataatttttggttatttatttagttatctatatctgtaggtctatgaggagaagtacataccttgttc

SEQ ID NO: 9492 - DNA, 80 bp, Homo sapiens
gaggtaaatttgcactatgtgttttcagattagaagcaatggagccttgggtttgctagaagacattgtggtcatacctc

SEQ ID NO: 9493 - DNA, 113 bp, Homo sapiens
atgggccagtacatcagccaatgacttttagatgcatttcaagctgaatttaattatattttctgaaacttggaaatagtctgtttctatttggctagatgccagggcagcat

SEQ ID NO: 9494 - DNA, 99 bp, Homo sapiens
gtgtggactgaatctaaaagtaagttttatgtggatgtgtatacaattgtggttgtgtattgtataccattcaaggtcatactgctagttctgccccat

SEQ ID NO: 9495 - DNA, 109 bp, Homo sapiens
tatatatatagtattgtggaaagatatattacctagtattttggagatatatatatatatataaaatactaggtatgtacatatatatatatataatactaggtgtgtg

SEQ ID NO: 9496 - DNA, 86 bp, Homo sapiens
atcaaggcagacaaccaaacaggatatttcaatttttataacctactttggtatctatattatcccgtttggtaatctgccttgat

SEQ ID NO: 9497 - DNA, 229 bp, Homo sapiens
acacgtgtgtgtctgtatatatatatgtatctatagacacatatgtgtctgtaaatatatgtatctatagacacatatgtgtctgtatatatatatgtatctatagacacatatgtgtctgtatatatatatgtatctatagacacatatgtctgtatatatgtgaatatatgtatatgtatatgtatacagtgtatatatcatatatagtatatatacacacatatat

SEQ ID NO: 9498 - DNA, 90 bp, Homo sapiens
cattgtgctttaaagtgttggataacgtaattttttttttcttttttggagacagagttttgttcttgtcatggaggctggaggacaatg

SEQ ID NO: 9499 - DNA, 77 bp, Homo sapiens
gccagcatacagtttatctttatgaattatatctttttcaacaaaatatttatcatagaatttctgtgtgcaatggc

SEQ ID NO: 9500 - DNA, 104 bp, Homo sapiens
cagctgactcagcctgactgagggtgttgcaatactgaatttgttgaagttcacattgccagcaaaggcagtagtagtaagtagatctagaatgcaggaagctg

SEQ ID NO: 9501 - DNA, 87 bp, Homo sapiens
tatgtgtgtatctatctgtatgtgtttgtgtgtgtatatatatatatacacacacacacatacattaaatgagtaggtgtgtatata

SEQ ID NO: 9502 - DNA, 94 bp, Homo sapiens
gacaaatgggatttcatccaactgaaaagtttctgcatggaaaaggaaacaacagagtgaagagacaacctacagaatgggggaatatatttgc

SEQ ID NO: 9503 - DNA, 113 bp, Homo sapiens
ttttatagctactctatacttatgcattaagatacaattatatatgtcattttttaaaaaaggagggattatattatgtacttctctatgtctagcttagagaggcagtagag

SEQ ID NO: 9504 - DNA, 119 bp, Homo sapiens
ggagacaatatctcattgtgcctttgatttgcatttccctaaggattagttatgttgagtatcttatattttttttggtcacttgtgcaagttctttggatatatgtctattgaaatcc

SEQ ID NO: 9505 - DNA, 114 bp, Homo sapiens
gttactcagtggcaagttgacttaataggaacccttctatcttggaagacaagtgattttgtttagtaagaatagattctgttgtgagtttgccttttatgacagctgagtgtc

SEQ ID NO: 9506 - DNA, 98 bp, Homo sapiens
acactctaggttttgctggttgcatcctgttggtggaatttattttttattttctgtaaattggtagtttgacctaggagcttgatcggattgagtgt

SEQ ID NO: 9507 - DNA, 81 bp, Homo sapiens
tcagtcattttatattgccacataccatatgattatatatatttgaaatgcaatcatatgatatgtgttatttgtgattgg

SEQ ID NO: 9508 - DNA, 71 bp, Homo sapiens
gtgcgcagatctgttggaggttctgccagggatccgttcccatctggtgtctcactcagactgaaaggtac

SEQ ID NO: 9509 - DNA, 63 bp, Homo sapiens
gctcaccatttcatctgattttcaagtcagctgggtgaagaaagtcaggagagttcagtgtgc

SEQ ID NO: 9510 - DNA, 118 bp, Homo sapiens
atgtcagtttgtactctttcagactttttgatgtatgtgttcagggctatgaactttcctcttagcactgcctttgctgtatcccagaggtttggatatgttgtgtcattactgtcgt

SEQ ID NO: 9511 - DNA, 70 bp, Homo sapiens
gctctggtggaaggatggagggaggagaaagaagccagggtaattctctttcactccctgtccctcaggt

SEQ ID NO: 9512 - DNA, 118 bp, Homo sapiens
tttggcataattctgttttatttacttttaattgacaaataaaaattgtgtgtgtgtatatatatatatggtatacaacatgatgttttaaaaatgtgtaaattgtagaatggctaaa

SEQ ID NO: 9513 - DNA, 99 bp, Homo sapiens
ggagctatcttgaagatagtgttttttaatttttaaacttaaatttctttttatagttttaaggcaaaaaacaaaagagctctttctgtggagagctgc

SEQ ID NO: 9514 - DNA, 93 bp, Homo sapiens
tttctctctcttcccctgtttctattctcattttctttctctcaaggaatgaaaagatgtgtgtgggtgttgtaacaagaggaagagaggaaa

SEQ ID NO: 9515 - DNA, 91 bp, Homo sapiens
tgcagtttccaggcccttggaatcaatctttttttattttttatttttattttgagatggagtctggctctgttgaccagtctggagtgca

SEQ ID NO: 9516 - DNA, 73 bp, Homo sapiens
tttcctgtgattcttttagcacagaaaatatctgtttttattttacctgtgcatttaggagggatgcaggaga

SEQ ID NO: 9517 - DNA, 95 bp, Homo sapiens; identical to SEQ ID NO: 68

SEQ ID NO: 9518 - DNA, 93 bp, Homo sapiens; identical to SEQ ID NO: 69

SEQ ID NO: 9519 - DNA, 81 bp, Homo sapiens
gaagccagattgatttgggattaaatactggctctgtgtaataccctaggctagttacttagtctctctgagtctgttttc

SEQ ID NO: 9520 - DNA, 58 bp, Homo sapiens
tgagacagagtctcactgtgtcacccaggctggagtgcagtggtgcgatgttggctca

SEQ ID NO: 9521 - DNA, 72 bp, Homo sapiens
gacatgggacagttctttatatatatttagtccatacttagtgtatataaaatactgtaccaaaggagtgtc

SEQ ID NO: 9522 - DNA, 58 bp, Homo sapiens; identical to SEQ ID NO: 6359

SEQ ID NO: 9523 - DNA, 78 bp, Homo sapiens
tgtttgtatctattatccagtctgtggtattctgttacagcaatacaaaacagagtgagataaaaattggtgcaaaga

SEQ ID NO: 9524 - DNA, 113 bp, Homo sapiens
ctatttatgattatgtatataacactttttctggcttgcagaactgattttgataatgttctttattcaggttgaaggtaatgaaaggttttctatctgttctcataaactag

SEQ ID NO: 9525 - DNA, 72 bp, Homo sapiens
agagtgagactccatctcaaaacacaaaccaattcttagttcttttttttttttgagatggagtctcactct

SEQ ID NO: 9526 - DNA, 82 bp, Homo sapiens
gcctggaaagaaagggactctgtttcttatttatttatttatttatttattttgagacggagtctcactctgtcacccaagc

SEQ ID NO: 9527 - DNA, 76 bp, Homo sapiens
gtgtgtatatatatgtgtgtatacacacataattaaatatatgtaatcgtgtgtatgtatatgtatgtatacacac

SEQ ID NO: 9528 - DNA, 65 bp, Homo sapiens
ctcatgcctctaatgtcagcactttgggaggctgaggtggaaggatcaattgtgaggagtatgag

SEQ ID NO: 9529 - DNA, 96 bp, Homo sapiens
tagcaaaatctgaacgagactatagccaaatgaatttttagaagtttgaagaacaaataggtatgattttgtggctaaagtcttcaaaggaggcta

SEQ ID NO: 9530 - DNA, 115 bp, Homo sapiens
ggattgtcttggctatacgggctcttttttggttccatatgaaatttaaagtagttttttctaattctttgaagaaagtcagtggtagttcgatgggaatagcattgaataatct

SEQ ID NO: 9531 - DNA, 101 bp, Homo sapiens
aggcactgaccatgttactacccaactcttggtaatgcctttaaaatttttttaaattatttttggcagacactctgtgtgaggtacagattttcagtcct

SEQ ID NO: 9532 - DNA, 84 bp, Homo sapiens
ttggattagggcccatgggaatgacctcattttaattttaatttttttttttgagatggagtctcactctctcgcccaggctgg

SEQ ID NO: 9533 - DNA, 123 bp, Homo sapiens
aaggaaggtctggggattacatctgtaaagtgtactctgtgatagatgtagttttctttttcttttgagccagtgtctcactctgtcgcccaggctggagtgtagtggcgcgatctgggctca

SEQ ID NO: 9534 - DNA, 117 bp, Homo sapiens
ctttcataatgctctgtgacaatatttgccccatttaatgagtgaagaatctgaggttaaaaaaaatatatttttttaattgatttattccggggccttacagttagtagggaatag

SEQ ID NO: 9535 - DNA, 114 bp, Homo sapiens
tcactggctccagaattacttacgtatttctcttttttgttttttttttttaaggctagtcaagtgaagcagtgggaatggagaaggaacacagaaatctgtaactggttgtga

SEQ ID NO: 9536 - DNA, 95 bp, Homo sapiens
gccattcactggtgtctgtgtctctgactgtcacgctagcccaggatgcaggcagaagtggcaggtgcctccatgcacagtccctagtgtgggag

SEQ ID NO: 9537 - DNA, 75 bp, Homo sapiens
tttgtttttttgagactgagtctcgctctgtcacccaggctggagtgcagtggcgcgatctcagctcactgcaag

SEQ ID NO: 9538 - DNA, 58 bp, Homo sapiens
tgagactgagtctcgctctgtcacccaggctggagtgcagtggcgcgatctcagctca

SEQ ID NO: 9539 - DNA, 104 bp, Homo sapiens
ccttatgtttaaaaacttcagttgattgttaaagaaagcacagatccagagcagatttttaattttttgacaatgttatctactggagatgaatgcccctgagg

SEQ ID NO: 9540 - DNA, 56 bp, Homo sapiens
acgtatatgtgtatatgtctatgtatgtatgtatgtaggtatgtatgtgtgtatgt

SEQ ID NO: 9541 - DNA, 92 bp, Homo sapiens
aggaagagaaattgagtgaagataatgaagtcatgcccagaacgttattgctgctggtgtaacttttttttttttttttttttttttttttt

SEQ ID NO: 9542 - DNA, 111 bp, Homo sapiens
tcaaaatgtggttattcttcagcaaataagtgtaattgtttggctatagtatatgggcaaaattttttttgttacataatgctgaaaaagtaggtataattcatattctga

SEQ ID NO: 9543 - DNA, 77 bp, Homo sapiens
catgacacacacacacacatgcacacatgcatgcacatataaatctgggcctgcaacatgtgatagcttttgtcatg

SEQ ID NO: 9544 - DNA, 95 bp, Homo sapiens; identical to SEQ ID NO: 68

SEQ ID NO: 9545 - DNA, 93 bp, Homo sapiens; identical to SEQ ID NO: 69

SEQ ID NO: 9546 - DNA, 95 bp, Homo sapiens; identical to SEQ ID NO: 68

SEQ ID NO: 9547 - DNA, 93 bp, Homo sapiens; identical to SEQ ID NO: 69

SEQ ID NO: 9548 - DNA, 97 bp, Homo sapiens
ctctggaagaacaaaactggcagctttacaaatcactgcataaatgggtcagagtactgttcccaagtagggtatgtgttgtctccagaatccagag

SEQ ID NO: 9549 - DNA, 78 bp, Homo sapiens
cacctcttcagcaggagctcacacactctcactcactttgtaggggcctgcagtagctttctgtttctgagcagggtg

SEQ ID NO: 9550 - DNA, 102 bp, Homo sapiens
agtgtttcaccaccgagtcgtttccaccctcttacctgtctcagtttctctctccagagatctagcacctctgagaggcctcaaaatgccaagtgatcagct

SEQ ID NO: 9551 - DNA, 75 bp, Homo sapiens
tgagctaggatgatggtttagatagccgacatttcttaagaatatgtcactctctcccactagactgtgagctca

SEQ ID NO: 9552 - DNA, 110 bp, Homo sapiens
gcacgagtctgggggtaggtttaaattatatttagttacttttgattatttaatttttttaaaaggagattgatgccaaagagtcactggatgtgcttataatatagagc

SEQ ID NO: 9553 - DNA, 95 bp, Homo sapiens; identical to SEQ ID NO: 68

SEQ ID NO: 9554 - DNA, 93 bp, Homo sapiens; identical to SEQ ID NO: 69

SEQ ID NO: 9555 - DNA, 95 bp, Homo sapiens; identical to SEQ ID NO: 68

SEQ ID NO: 9556 - DNA, 93 bp, Homo sapiens; identical to SEQ ID NO: 69

SEQ ID NO: 9557 - DNA, 75 bp, Homo sapiens
tgtgcatacatatatgtatatgtatatcctattggcaaccaataggatgtatatgtatatatctatgtatgtgta

SEQ ID NO: 9558 - DNA, 95 bp, Homo sapiens; identical to SEQ ID NO: 68

SEQ ID NO: 9559 - DNA, 93 bp, Homo sapiens; identical to SEQ ID NO: 69

SEQ ID NO: 9560 - DNA, 95 bp, Homo sapiens; identical to SEQ ID NO: 68

SEQ ID NO: 9561 - DNA, 93 bp, Homo sapiens; identical to SEQ ID NO: 69

SEQ ID NO: 9562 - DNA, 86 bp, Homo sapiens
cattttggggaagcttacgaatgtatatagatagaggcaatctctatctctctctatatatacagggttatttggagtccagaatg

SEQ ID NO: 9563 - DNA, 78 bp, Homo sapiens
tgaataagaatgttgagagtgagcatccttgtctcgttccagttctcaaggggaatgctttcagcttttgcctgttca

SEQ ID NO: 9564 - DNA, 124 bp, Homo sapiens
tcttttgaattttctttgctatttatcattttcatttgttcctgaagatacaagaacattatttaatttttcttgtaggcctagtggaaatgaattcacatagcttactttatctggaagttca

SEQ ID NO: 9565 - DNA, 58 bp, Homo sapiens; identical to SEQ ID NO: 2224

SEQ ID NO: 9566 - DNA, 56 bp, Homo sapiens; identical to SEQ ID NO: 335

SEQ ID NO: 9567 - DNA, 106 bp, Homo sapiens
tctttccctgcagtgagtcctacccctctgaacccagcgccagttactcatgttctagaatgtttattaattaagtttggcttctctggttgattttgcagaaaga

SEQ ID NO: 9568 - DNA, 69 bp, Homo sapiens
tcaatctcactgcttgttgttggtctgttcagaatttctgtttcattctgattcaagctggggaggtgg

SEQ ID NO: 9569 - DNA, 117 bp, Homo sapiens
tataagttttctgaggcctccccagccatgtggaactgtgagtcaattaaatttattttatctataaattacccagtctcaggtagttctttatagcagtgtgagaatggactaata

SEQ ID NO: 9570 - DNA, 104 bp, Homo sapiens
gatttgggggggaaaaaaggtctatttgtgtatgtgtgtaaatgtgtgtatctctcacacacatacattgagtcattgataaatggtatctgtcttcctctgtc

SEQ ID NO: 9571 - DNA, 94 bp, Homo sapiens
gtttttttggaattctgataatcatgcaagttatctttttagattttatttaatgatatttatacagagcttgctttatgtcagtttcctaaac

SEQ ID NO: 9572 - DNA, 57 bp, Homo sapiens
tgagacggagtctcactctgtcaccaggctggagtacagcggtgggatctcagctca

SEQ ID NO: 9573 - DNA, 94 bp, Homo sapiens
aagaacatttaaaaaaatgagaatgaaatagcttgctttattttatattcagagggcttgcatgttttatttatttttttttttaattgttttt

SEQ ID NO: 9574 - DNA, 80 bp, Homo sapiens
ttgagactgagtctcgcactgtcacccagggtggagtgcagtggcgggatctcagctcagtgcaacctccacctcctggg

SEQ ID NO: 9575 - DNA, 75 bp, Homo sapiens
gggcaacacagcaagatcctgtgtgtgtgtgtatatatatatgtgtgtttagacagggcatggtggcttatgcct

SEQ ID NO: 9576 - DNA, 70 bp, Homo sapiens
ggggtggaggcagagccactttggacatgggaaatcacagttgcagtagacagtgagctctagtcactcc

SEQ ID NO: 9577 - DNA, 66 bp, Homo sapiens
ggcatgttcaatctgctttaggccattccttgggccatggctgactggatgagaagtgaatatgtt

SEQ ID NO: 9578 - DNA, 110 bp, Homo sapiens
gaacatttttctaagtttctctgtgattttttcattgaccatggattgtttagaagtgtgttctaaataaacacgttgttgtagaatatccagatacttggttttatttc

SEQ ID NO: 9579 - DNA, 72 bp, Homo sapiens
tatatgtatatatacatatgtatacgtgtatgtatatatacatatgtacacgtgtatgtatatatacatatg

SEQ ID NO: 9580 - DNA, 77 bp, Homo sapiens
catgtgtgtatatatatatgtatatatgtatatatgtatatatatgtgtatatatgtatatatgtatatatgtgtat

SEQ ID NO: 9581 - DNA, 58 bp, Homo sapiens
tgagacggagtctcactctgtcacccaggctggagtgcagtggcgagatctctgctca

SEQ ID NO: 9582 - DNA, 94 bp, Homo sapiens
ggctgtttttcctctgttgagctctttatgggtttgcactggatatcttccaagggggtgtcactctgaggctcagagtggagaacaggtttcc

SEQ ID NO: 9583 - DNA, 95 bp, Homo sapiens; identical to SEQ ID NO: 68

SEQ ID NO: 9584 - DNA, 93 bp, Homo sapiens; identical to SEQ ID NO: 69

SEQ ID NO: 9585 - DNA, 67 bp, Homo sapiens
gtgtgggagtctcagtctctttgtgggtcactgaggacttgctttatgactctgggtgctcctgtat

SEQ ID NO: 9586 - DNA, 115 bp, Homo sapiens
tgctgggttgttcagtacctcttctcctgggactcttcccgtgtgtgtgtgtgtgtgtgaaagagagagagagagagagagaaagagagacagggcagggggtggacgtttgagg

SEQ ID NO: 9587 - DNA, 63 bp, Homo sapiens
ctcagtttctttgtcacttagaaggttgaatggtttccacattctgagggtaaggaatacgag

SEQ ID NO: 9588 - DNA, 95 bp, Homo sapiens; identical to SEQ ID NO: 68

SEQ ID NO: 9589 - DNA, 93 bp, Homo sapiens; identical to SEQ ID NO: 69

SEQ ID NO: 9590 - DNA, 74 bp, Homo sapiens
ttgtgtgtgtgtgagacagagcctcactctgtcaccaggctggagtgcagtggcacgatctcagcacactgcaa

SEQ ID NO: 9591 - DNA, 118 bp, Homo sapiens
gttggaaaagttccacgtgcataaggtgagagcatgaatcatctcagtccctaagttgagatcctgagagtgggacttcatgtgaggctgatgcaggaggagttgtaggagcatttct

SEQ ID NO: 9592 - DNA, 91 bp, Homo sapiens
tgattttgtatcctgcaactttactgaatttgtttattgattctaatagtttttttggtggagtctataggtttttctaaatataagatca

SEQ ID NO: 9593 - DNA, 117 bp, Homo sapiens
catcccccaagaaaggaagggctctgatgcagagggagcaggagctgaggtggagatggccactgcctctctcaccctctgctcaagaaaagcaggcttagcagagtgggacagatg

SEQ ID NO: 9594 - DNA, 110 bp, Homo sapiens
ggtgacaatgagtgattgacatcagaatcaaggagagaaaagtgagagcactattacactatgcagtaggtttttttttttttttttgcattttgagtatttattgtcct

SEQ ID NO: 9595 - DNA, 72 bp, Homo sapiens
gggcaaatgctaagggagaaaaggcagtttaaaagttatttatttttaaaagcagcttccagagcacttcct

SEQ ID NO: 9596 - DNA, 83 bp, Homo sapiens
gattgtaggcatgagtcaccatgtccggctaattaaaaaaaattttttttttgtagagacagggtctcactatgtctgtcatt

SEQ ID NO: 9597 - DNA, 117 bp, Homo sapiens
ctgtgtcttttaattggggcatttaacccatttacaattaaggttattattgttatgtgtgaatttcattttatcattatgatgttagctggttaatttgcccgttaactgatgcag

SEQ ID NO: 9598 - DNA, 97 bp, Homo sapiens
actcatcatcagctcaagttcaggcagttctctctttatttatttatttatttttctgagacggagtcttgctctgtcactcaggctggagtgcagt

SEQ ID NO: 9599 - DNA, 98 bp, Homo sapiens
gggtgactgctaatgcatatggagtttctcttgcggtgatgaaaatttctttgttttatttatttttattttttagagacagtcttgctctgtcaccc

SEQ ID NO: 9600 - DNA, 117 bp, Homo sapiens
tgcaaccatagtttgcaaatgaaaggtgaaagctatagtctgtcttatcaatacctttttttttttttttttgagacagagtctcgctctgtcaccaggctggagtgcagtggagca

SEQ ID NO: 9601 - DNA, 102 bp, Homo sapiens
ctttgatttggaattatattcatgcagaagggacaagatagtttatttctttactatcagacagtgtgctggtctgttaggaaatgtgagcaatactcagag

SEQ ID NO: 9602 - DNA, 79 bp, Homo sapiens
gggggcacctgttgggagactggtttgcgctctgtgggggaattcagctctgatacacactctcttagcctctgtctcc

SEQ ID NO: 9603 - DNA, 77 bp, Homo sapiens
gttggggaagctggggcagagtctgagcccatcaccccagtctgtggttctttctgtctccctctgacaccaccagc

SEQ ID NO: 9604 - DNA, 59 bp, Homo sapiens
ttgagatggagtctcactcactctgtcgcccaggctggagtgcagtgatgcagtcttgg

SEQ ID NO: 9605 - DNA, 108 bp, Homo sapiens
gagaagcaggaggaggcagagtattccaggcagaggaagtagcatgtataaaagcacaaggcgatataattagatttctgtttgaagaattacttgcccctggttaac

SEQ ID NO: 9606 - DNA, 56 bp, Homo sapiens
gcacatgggaaagtgagatttgcacccctctctgtgggtctctgtttctcatctgt

SEQ ID NO: 9607 - DNA, 66 bp, Homo sapiens
ctaagtgtgtccagtccgtgtctgtgggtctgtgaatgagacacacccagggatgggcagaagtgg

SEQ ID NO: 9608 - DNA, 79 bp, Homo sapiens
gcctgtggcagacgttgcaagttggtcacagctcctcttcccagtgagcgagttctcagactcagcctctgtctcaggc

SEQ ID NO: 9609 - DNA, 78 bp, Homo sapiens
tctctaggtgttactgtgtcattaccctttaatatttttctccttcagagacagggtctcactgtgtcacccagacga

SEQ ID NO: 9610 - DNA, 114 bp, Homo sapiens
agcttctgggtgggtgccatgtgccaggaaggtgacaaactccaactccatgaggacagaagttcctgtgctcaggactctttcagaccttcccctatgtacctcttcatggct

SEQ ID NO: 9611 - DNA, 79 bp, Homo sapiens
gctgctgtctgtcagtccctgagagcacctcagtggggcagctgcccctctccttctgtgtcaggggcggcaacagggc

SEQ ID NO: 9612 - DNA, 100 bp, Homo sapiens
caatcatggtttattaactatgttcccactcctgtttttcatgttgaattgatttgaattaatcagattgggaatgtactagttctgaacttattttttg

SEQ ID NO: 9613 - DNA, 79 bp, Homo sapiens
ggactgacttccttgaactgtccatattttaaccttttcgaagagagaaatatgagagtgttgacagagtgagtcgtct

SEQ ID NO: 9614 - DNA, 86 bp, Homo sapiens
cttttacaaaaagactgaagcaggcagaaatgagctttaaccaaaagctcactgactcagcctgtctgagacttttatcaaaaaag

SEQ ID NO: 9615 - DNA, 86 bp, Homo sapiens
cttttttgataaaagtctcagacaggctgagtcagtgagcttttggttaaagctcatttctgcctgcttcagtctttttgtaaaag

SEQ ID NO: 9616 - DNA, 70 bp, Homo sapiens
gtgagcagaggaggcctggctcctatgtacctttttttttttttttggagacacagtcttgctctgtcac

SEQ ID NO: 9617 - DNA, 71 bp, Homo sapiens
cacatactcacagccacacacagactacagcactggtcgtgcgtgcgtgtgtgtgtgtgtgtgcgtgtgtg

SEQ ID NO: 9618 - DNA, 82 bp, Homo sapiens
gccaccccggtctgctcagttctgacactgtttgtccctggggggtaacaagcagctcagggcagcggtgaggggcagtggc

SEQ ID NO: 9619 - DNA, 91 bp, Homo sapiens
tctgttgacgtatcatgttgtggatgccattttttaattaattaattaatttatttattttttgagatggtgtctcgctgtgtcacccagg

SEQ ID NO: 9620 - DNA, 99 bp, Homo sapiens
gggcttcagtacttaaaggggaaagggtggatactgggggaagagaaatttttttttttttttgagacagagtctcgctctgtcaccaggctggagtgc

SEQ ID NO: 9621 - DNA, 101 bp, Homo sapiens
gtgtggtaggagcaaatgatgcctcggtctctgtctctgtggctccagtgaagccaaccgtgggtccggactagggttccaatccctgctccactccctac

SEQ ID NO: 9622 - DNA, 58 bp, Homo sapiens; identical to SEQ ID NO: 4269

SEQ ID NO: 9623 - DNA, 75 bp, Homo sapiens
ggatgtactctgtgtgtgtgtgtgtgtatatatatatatatatatatatatatatatatattcatttatttattc

SEQ ID NO: 9624 - DNA, 83 bp, Homo sapiens
ggatgctaaccagagaagagactgtgtagatactgtgaaaggtggcaacactgagttttccagtctcaatactgacagcaacc

SEQ ID NO: 9625 - DNA, 126 bp, Homo sapiens
gacagggggtcattctcccttctgctgtcacagtctaggtgacctgctggctggccctctctctctcacatagtcagagcctcggtctgcactgcagtagtttcatgcgggtgtggatagcaggag

SEQ ID NO: 9626 - DNA, 87 bp, Homo sapiens
accctcttggcttcagtctctttctctgtcaaatggaatgatcatatcagcctcataaagttgaagggaaggtttgaacgagagtgt

SEQ ID NO: 9627 - DNA, 113 bp, Homo sapiens
tagctccttgggtacaaatgttatatcttcctgacactctcagactctctaaaccctagcattctgaccttgtaggtggtgtataaaagaactggattgattgtagggggtta

SEQ ID NO: 9628 - DNA, 95 bp, Homo sapiens; identical to SEQ ID NO: 68

SEQ ID NO: 9629 - DNA, 93 bp, Homo sapiens; identical to SEQ ID NO: 69

SEQ ID NO: 9630 - DNA, 116 bp, Homo sapiens
tgtgtatagatagatgtgtgtgtgtgtgtgtgtgtgtgtatatatgtatacatatatatgtgtgtgtatatatatatatatggatatgtacatagacatgggattgctgaatcata

SEQ ID NO: 9631 - DNA, 98 bp, Homo sapiens
gtcaccagactccccatttgctgagtttcctcactcactctgtgtcacattctttaactgtgttgatatcattcagctgtggctctgagtttgttgat

SEQ ID NO: 9632 - DNA, 60 bp, Homo sapiens
gcagcagacaggagttagaggccacaggtagtgattctgactccttcactgactccctgt

SEQ ID NO: 9633 - DNA, 58 bp, Homo sapiens
tgagacagagtctcgctctgtcacccaggccggagtgcagtggcgtgatctcggttca

SEQ ID NO: 9634 - DNA, 66 bp, Homo sapiens
tgtgcatacagtgtctgtgtttgtgtgtgtataaaaaccatatatatatacatatatatatgtaca

SEQ ID NO: 9635 - DNA, 103 bp, Homo sapiens
gcagagggaaacaataaaaattcagaggacccacacagatgggtgtgagcagtgtagcttactggtatgcagtgggaagctggggaggcatttttttagctgc

SEQ ID NO: 9636 - DNA, 83 bp, Homo sapiens
cagaaaccctagatagttttgtttttcttgtactcatcttccatgttgagagaaagaaaatattgtctggaaaggaaggtctg

SEQ ID NO: 9637 - DNA, 78 bp, Homo sapiens
agtgagaatcgcctgcatcaagtgtcaggtcattgtgctcaaatcacagcctatttgacaccacacacaggcgctcct

SEQ ID NO: 9638 - DNA, 98 bp, Homo sapiens
cttctccttgtggatgtgcccagcctggctccctgcatggccccttacctgtctgagccccattgcagaggctgctgctggaagaggggagaaggggc

SEQ ID NO: 9639 - DNA, 87 bp, Homo sapiens
gggactgatttttagctctcactcactggcagtgacaatcataagcagtagccctggggtgatgaggaatctaataatgtcattccc

SEQ ID NO: 9640 - DNA, 114 bp, Homo sapiens
gtctgcctggtgggatcgaagtcagctctggctaaagcagtgatatggcaaaacctagctctgtcattctcactccttcagcagcacccacctctctgtcccatatgggcaccc

SEQ ID NO: 9641 - DNA, 92 bp, Homo sapiens
gcttctctcaactctgcctcacatcagactcagcagagaatttttttttttcttttagactgagtttcgctgtgtcgcccaggctggagtgc

SEQ ID NO: 9642 - DNA, 58 bp, Homo sapiens
tgagacggagtctcactctgtcactcaggctggagtgcagtggcgcagtctctgttca

SEQ ID NO: 9643 - DNA, 116 bp, Homo sapiens
cccatgctgcagagggggtgtatgtatgtatatatgtgtgtgtatatatatatatatatatatatatatatatatatatatatatatatacatacatacacatacacacacttggg

SEQ ID NO: 9644 - DNA, 74 bp, Homo sapiens
gatacatctatatcgatatagatacagatatatctatgtatatctatatatctatatagatatagatatagatc

SEQ ID NO: 9645 - DNA, 87 bp, Homo sapiens
ccccacccctgtccccagatagtctcagagcatcttgttcttttccttgagagtacttagaaatgtgtgtgaggccaggcgtggtgg

SEQ ID NO: 9646 - DNA, 82 bp, Homo sapiens
agaggggatgtgggatggcattggtgttgattggctttattataggctctcaataaatgtctgttgaatgaatgtcctttct

SEQ ID NO: 9647 - DNA, 60 bp, Homo sapiens
cctgacatcagagagagcaatcagagggcctcctctgaaatgcaggtgctctttctcagg

SEQ ID NO: 9648 - DNA, 108 bp, Homo sapiens
ggcagcattctctcttgagtaatgacatgatattaataaacatgctctgaaagtatattttttaatagcaatgtttcaacaatattatcatccagggtgaatggctcc

SEQ ID NO: 9649 - DNA, 88 bp, Homo sapiens
tcactgcaatgccttgtgttaatcaaattgtgtgaaattgaactgactaggaactcacgctgagtgaactttgacagcatgggggtgg

SEQ ID NO: 9650 - DNA, 140 bp, Homo sapiens
ccagcctaagcaacatagcaagacctcacctctgaaaaataaaataatttttttttttttttgagacagagtctctctctgtcgtccaggctggagtgcggtggtgcaatctcagctcgctgcaagctccacctcctggg

SEQ ID NO: 9651 - DNA, 70 bp, Homo sapiens
caggtatggtggtacacgcctatagtcccagctacttgggaggctgaggttggaggatcacttgagcttg

SEQ ID NO: 9652 - DNA, 84 bp, Homo sapiens
tgcaggcatgagccactgacctggccctagaacataacttaaaataaatgtgtatgtgtgtgtttcagtgtctctgtgtgtgta

SEQ ID NO: 9653 - DNA, 88 bp, Homo sapiens
ggtggaggaggttctcactgtgactcagtgtgtgcccgacagcagagcccacaccactccagttgcagtggttgccatctgggtcatc

SEQ ID NO: 9654 - DNA, 128 bp, Homo sapiens
gcagcatgaccttaggagccatgtgtggaagatggtaaagcctggaagatggaaagcacctgagtccctgagtcactgcttgcaggagaagttccatggatgaagagacccagttggacttgaggagc

SEQ ID NO: 9655 - DNA, 69 bp, Homo sapiens
gggcaagcagggattcagatggcatgccaccacttattagctgtggggtgtctctgaccctcagtgtct

SEQ ID NO: 9656 - DNA, 58 bp, Homo sapiens
ccatttgtccaagtcactgtcactgtgtccagcagagggcagaggcctgtctggatgg

SEQ ID NO: 9657 - DNA, 113 bp, Homo sapiens
gagtttgaggttgtagtgagctgtgtatgattgtgtcaagtaagaatttttgagtttttattataaaagaattagcacaattgttgtgcctaatcattttttactttagaagc

SEQ ID NO: 9658 - DNA, 71 bp, Homo sapiens
caaaagcagggaaagactggtttttaggcttgcagtaatcttacagagacaatcagcatgccttgcttttg

SEQ ID NO: 9659 - DNA, 58 bp, Homo sapiens
tgagatggagtctcactctgtcacccaggctggagtgcaggggtttgatctcagctca

SEQ ID NO: 9660 - DNA, 75 bp, Homo sapiens
ggcatctgccatcatggctggctaatttttgtatttttatagagatggggtttcaccatattggccaggttggtc

SEQ ID NO: 9661 - DNA, 116 bp, Homo sapiens
gcccaggagtttgagcccagcctgggtaacataggaagatgctatccccctttttttttttttttttttttttgagatggagtctcactgtctcccaggctggagtgcagtggcgc

SEQ ID NO: 9662 - DNA, 113 bp, Homo sapiens
gcagggaccagcaccttccatgacttccttttgtgtgtaagtgcgtgcgtgcgtgcgtgtgtctgtgcgcgtgcgcccctctgcagggaggaggaggaggaggaggcggaggg

SEQ ID NO: 9663 - DNA, 69 bp, Homo sapiens
ctgcctcaggcggctgctaaccagatgctactttaaatgtactgtctgtctctcagccttgcctctcag

SEQ ID NO: 9664 - DNA, 99 bp, Homo sapiens
ggcacagtggttcatgcctgtaatcccagcattttgtgtggccaaggcaggcggatcagttgaggacagaagtttgagaccagcctggccaacatagtg

SEQ ID NO: 9665 - DNA, 90 bp, Homo sapiens
ctaggctgggcaacatagtgagaccttctttctttctttctttcttttttttttttttgagacagagtctcaccctgtcacccaggctgg

SEQ ID NO: 9666 - DNA, 76 bp, Homo sapiens
gcatattggattgcatatacatatatatgtatacacacacatatatatatatttttgagatgcagtctcactgtgt

SEQ ID NO: 9667 - DNA, 68 bp, Homo sapiens
gagatggggtctcactctgttgctcagtctggtctcaaactcctgggctcaagtgatactcctgcctc

SEQ ID NO: 9668 - DNA, 73 bp, Homo sapiens
ttgtttttgagagagagagtctcgctctgtcacccaggctggagtacagtggcaagatcttggctcacggcaa

SEQ ID NO: 9669 - DNA, 100 bp, Homo sapiens
gtatatacacagtaatgggattgctgagtcaaatggtaaattttttttagttatttgagaaatctccagactgctttccataagggctgtactaatttgc

SEQ ID NO: 9670 - DNA, 105 bp, Homo sapiens
tccaaatgtatgcttgtgtttagctatcttcttgctgttgacttctaattttgttgcattatggtcaggaaaatgtggtctggacaatgtcaatcgtatagtgga

SEQ ID NO: 9671 - DNA, 90 bp, Homo sapiens
gtgtatatatacacacgtatatatatacgtgtatatatatacttatatgtgtatatatacgtgtatatatatatgtgtgtgtatatatat

SEQ ID NO: 9672 - DNA, 63 bp, Homo sapiens
atccgtgcatgtgtgttttttatatatatacacacatatatatacacacacatatgtatagat

SEQ ID NO: 9673 - DNA, 95 bp, Homo sapiens; identical to SEQ ID NO: 68

SEQ ID NO: 9674 - DNA, 93 bp, Homo sapiens; identical to SEQ ID NO: 69

SEQ ID NO: 9675 - DNA, 87 bp, Homo sapiens
gctattggacacttctgacctagaagcttgattagatttaggttaatctattttggcaagaatacttcatagtttggacacagtggc

SEQ ID NO: 9676 - DNA, 117 bp, Homo sapiens
acagtgagtgtgcaaagcatgaaagttgtaaggtgctgaatgagtttaatttttttttattattatactttaagttctagggtacatgtgcacaacgtgcaggtttgttacttaggt

SEQ ID NO: 9677 - DNA, 60 bp, Homo sapiens
ggagtctgtctcagagtcccacactctctccatccaggagagccggtgggataggtctct

SEQ ID NO: 9678 - DNA, 124 bp, Homo sapiens
gagttggtgctcagttaatttgatggcatgaaggagggaaggaaagaaggaatccctgactcttctctttctgtgaccctcatttaaattattggcctgattctgtcaaatctgagaattgtcc

SEQ ID NO: 9679 - DNA, 74 bp, Homo sapiens
gctcagctgttgcctacatgcagctctgaagccccaggaggcccctgggcagtgtgtgtgtgtgactgtgtggc

SEQ ID NO: 9680 - DNA, 117 bp, Homo sapiens
ccagctgtcttatccgtgttttactgtctgctctttctggctgcttgtagttagaagagaagtgatttccttgaaatgcatgaggctagaaagggagctggaatttaaagtggcggt

SEQ ID NO: 9681 - DNA, 114 bp, Homo sapiens
gggttcactgggatccaaggagcttagaactcccccatctgggactctagtcaatttcttgtatatgaactatggacccagaatcagggcttttctggagaaatgggtgagcct

SEQ ID NO: 9682 - DNA, 80 bp, Homo sapiens
tctgtgcatgtcagggtggtcatctccttttttttttttttttttttttttttgagatggagtgtcgctctgttgacagg

SEQ ID NO: 9683 - DNA, 92 bp, Homo sapiens
gagccctggtctcaggctgtgtcactccctcgctcggtggccaacggtcacccagagggactcatcctcacaaggcctgcccaggattcctc

SEQ ID NO: 9684 - DNA, 95 bp, Homo sapiens; identical to SEQ ID NO: 68

SEQ ID NO: 9685 - DNA, 93 bp, Homo sapiens; identical to SEQ ID NO: 69

SEQ ID NO: 9686 - DNA, 95 bp, Homo sapiens; identical to SEQ ID NO: 68

SEQ ID NO: 9687 - DNA, 93 bp, Homo sapiens; identical to SEQ ID NO: 69

SEQ ID NO: 9688 - DNA, 76 bp, Homo sapiens
gcaagttgtctgccaggtgacctcaggcaggtgcacagcctttctgtgtctgtctcagtctgtgagatgggggtgc

SEQ ID NO: 9689 - DNA, 75 bp, Homo sapiens
ggcccccagcacagacacgctgtctgagtgtccagtccagagcagatacacagcagatgtgtgtttgggtgtgcc

SEQ ID NO: 9690 - DNA, 85 bp, Homo sapiens
tcccctctcgccttccagacattttacaagcagattttgttctgttaaaaactgtagtgtaattggtgaagaattgttttgggga

SEQ ID NO: 9691 - DNA, 93 bp, Homo sapiens
ggacaaggatgctgtctgtctgtctcctgggtggggacagggatgctgtctgtctgtctcccagatgaggacagggatgctgtctgtctgtct

SEQ ID NO: 9692 - DNA, 124 bp, Homo sapiens
gctgaggacagcaatgctgtctatctgtctcccggctgaggacagggatgctgtctgtgtgtctgtctcccagctgaggacagagatgctctctgtgtgtgtctctctcctggctgaggacagg

SEQ ID NO: 9693 - DNA, 118 bp, Homo sapiens
ctgtctcctggctgaggacagcgatgctgtctgtctttctccagctgaggacagtgatgctgtctgtctgtctcccagctgaggacagggatgctgtctgtctaccggctggggacag

SEQ ID NO: 9694 - DNA, 200 bp, Homo sapiens
agtgatgctgtccggctgtctcccgactgaggaaagtgatgctgtctgtctgtctgtctcccggctgaggacagggatgctgtctgtgtgtctcccggctgaggacagcgatactgtctgtgtgtctcccggctgaggacagcgatactgtctgtctgtctcccggctgaggacagggatgctgtctgtctgtctcccgg

SEQ ID NO: 9695 - DNA, 56 bp, Homo sapiens
gagtgtgactgactgactctgggccacacagcaggctgacggtaggacaggcactc

SEQ ID NO: 9696 - DNA, 81 bp, Homo sapiens
gttcccagcccctgtgagttctgacagtgctctgggctgctccagagctcaggctgtgagctcttgcctggctgtggttgc

SEQ ID NO: 9697 - DNA, 58 bp, Homo sapiens
tgagacagagtctcgctctgtcacccaggctggagtgcagtagtgtgatcttggctca

SEQ ID NO: 9698 - DNA, 67 bp, Homo sapiens
ccctctgtgtctgtctctgtgtccagattttcctcttcaaaggacaccaattatatgacatttaggg

SEQ ID NO: 9699 - DNA, 112 bp, Homo sapiens
tgagccactgtgcctggctgagttctgcagttctcatggaaagacatagatgaatcttttttttttgacacggagtctcgctctttcacccaggctggagtgcagtggcgcg

SEQ ID NO: 9700 - DNA, 93 bp, Homo sapiens
ccatggtttatgtccggtgtctactctgactggctgttaaacatatacatatttttcagtttttaaagatggagtcacactgtgttgtccagg

SEQ ID NO: 9701 - DNA, 82 bp, Homo sapiens
tggtgacaggtggcgcagacaagagctggtgaacattccccgaggtcagccatggtgtccacactcactgtgtccctcacca

SEQ ID NO: 9702 - DNA, 117 bp, Homo sapiens
cacctgcaccccgtaccaggagaaggagcagggccggccaccgaccgacacagccacatcactgcctgcgttcaggtggcttccctcgatgccaatccaggtgccccctgacagagg

SEQ ID NO: 9703 - DNA, 85 bp, Homo sapiens
tggcatcctgtgagctgatgtgtgaggacagggagtgtgtgcaggtacgtgacgcacgcacacacagactcacttggggaagtca

SEQ ID NO: 9704 - DNA, 106 bp, Homo sapiens
atcctggtaccgtcatgtgttccccagtgccctccagagtctgtgtgtctctcactgtaagccggattcagcacttccattagctggcccagggtgggccacagat

SEQ ID NO: 9705 - DNA, 89 bp, Homo sapiens
ttggcccagttctgagtccctctctctgtgcctcagtttctccagctgcacatagaaggatgggactagtatcatcagtgcagggttaa

SEQ ID NO: 9706 - DNA, 127 bp, Homo sapiens
ggcctgggtcaagtcctgccctgactccgagctgtgggaccccagccagggcaacctgatcctctctgagcctcagtttctcctcgtgagcacatgagggtgctaattgtgtctgcgtcatagggtt

SEQ ID NO: 9707 - DNA, 83 bp, Homo sapiens
tgctgcacagaggcagggagtggggctgagaaaagagggcaatttctctttgtttatcaatgtctttctcttttactggggca

SEQ ID NO: 9708 - DNA, 68 bp, Homo sapiens
ttgagatgcagtctcactctgtcacccaggctggagtgctggagtgcagtggtgtgatattggctcaa

SEQ ID NO: 9709 - DNA, 95 bp, Homo sapiens; identical to SEQ ID NO: 580

SEQ ID NO: 9710 - DNA, 93 bp, Homo sapiens; identical to SEQ ID NO: 69

SEQ ID NO: 9711 - DNA, 101 bp, Homo sapiens
ctagtagtggcatagcatttctcacacagcatctaacattgttttctttttaagttttaaattttttgtagagtgaggtcttgctctgttgctcaggctgg

SEQ ID NO: 9712 - DNA, 58 bp, Homo sapiens; identical to SEQ ID NO: 9124

SEQ ID NO: 9713 - DNA, 88 bp, Homo sapiens
gaaaatctgcagcagatctgacggagctggaccctgggcttgggatgtcctcagggctcagcctctctgtgtgtctgctctgatttcc

SEQ ID NO: 9714 - DNA, 71 bp, Homo sapiens
acagcaacactctgtgactgtgactttcaataatgggcttatctaatgtccactcaccagtgtgttcctgt

SEQ ID NO: 9715 - DNA, 83 bp, Homo sapiens
gactgagttctagaagggagaggagtccgtgcacacagaccccagtgggacctgggcctgtcacttcccctctgagcctggtc

SEQ ID NO: 9716 - DNA, 94 bp, Homo sapiens
ggaagtgaaggggcgggcaagatgggagaagagcatctggaacagcatgtgcagagacccagggccagggctgtcactggcatgttccggggct

SEQ ID NO: 9717 - DNA, 78 bp, Homo sapiens
gcaatgtagaacaccgtgcatagtcactctctctctcgtggggagagtatgtctgtgtgtactgtacatacaatgtgc

SEQ ID NO: 9718 - DNA, 56 bp, Homo sapiens
gtgtccatgcacatgtgggtgggtgtgcgtatatctgtgtgcatgtgcatgtgtat

SEQ ID NO: 9719 - DNA, 58 bp, Homo sapiens
tgagacggagtctcactctgtcacccaggctggagtgcagtggcgggatctcggctca

SEQ ID NO: 9720 - DNA, 58 bp, Homo sapiens; identical to SEQ ID NO: 2051

SEQ ID NO: 9721 - DNA, 92 bp, Homo sapiens
gtctcagctgaactccttcaagtttgtcatcagctgtttatcacctttgctggtcttgtctggctctctcactttgggacttcagctaggac

SEQ ID NO: 9722 - DNA, 69 bp, Homo sapiens
gtgagactctgtctcacaaaaaaaagaaagaaagaaaaatttgtatttttagtagagacggggttttgc

SEQ ID NO: 9723 - DNA, 73 bp, Homo sapiens
gccgctgtctgtgtctctctccacaaatgtaacccagagctctaaccttcccgtgggtcttggcaccagcggc

SEQ ID NO: 9724 - DNA, 100 bp, Homo sapiens
gaggcaggagaattgcttgaacccaggaggcagagatgacagtgagctgagatggcgccactgtactccagcctgggtgacagagcgagactctgtctcc

SEQ ID NO: 9725 - DNA, 76 bp, Homo sapiens
gccgaggaggcgccgagagtgagcgagggctgcaagggctgccagtatgctgtcaccctctcagtgtgacctgggc

SEQ ID NO: 9726 - DNA, 81 bp, Homo sapiens
gtgtgcgactgtgtgtgtatgatgtgagtgtgtctgtgtctatgtgggggccaggtgtatagtctgcatatgtctgtgcac

SEQ ID NO: 9727 - DNA, 76 bp, Homo sapiens
tctccgcaaaaaattctacaccatagcagcgttgaggactgtgtctcagcgtcacactgtgtgtgtccaaggaggc

SEQ ID NO: 9728 - DNA, 131 bp, Homo sapiens
gggtgacagagcgagacgctgtctctctcttttttttttttttttttgagatggagtctcactctgtcacccaggctggagtgcaatggcgtgatcttggctcactgcaacctccacctcctgggttcaag

SEQ ID NO: 9729 - DNA, 123 bp, Homo sapiens
ccagaattgcctctatatttcctacaattcagattcctaggtttcattttagactcactgactctgaatctgccaatagtgagggccaggaatctgccgttttagtaggcaacctaggtaatt

SEQ ID NO: 9730 - DNA, 73 bp, Homo sapiens
ttgtttatttgagatggagtctcactctgtcactcaggctggagttcagtggcacgatctcatctcactgcaa

SEQ ID NO: 9731 - DNA, 90 bp, Homo sapiens
ctgagtcctcttgctagggctgcctctctttctctctcaggggagagagggacacaaaggggctggcctgagcagcgctggggctaaagg

SEQ ID NO: 9732 - DNA, 85 bp, Homo sapiens
catatttgtgtgtgtgtatatacatatatatactaccatacacatgtgtgtgtatataacatgtgtatatatacacacatatatg

SEQ ID NO: 9733 - DNA, 83 bp, Homo sapiens
gagcaggagctggggtcctgattttcaaggtcagagacaggagggctctggcctcacacagtcactctgactttagctagctc

SEQ ID NO: 9734 - DNA, 109 bp, Homo sapiens
gctcacagaggagactggtgtcagggctgtcccctctcagggagcgctcacactggctctctctgcccacctggctctccccagccctgccaggcctgtcctcctgggc

SEQ ID NO: 9735 - DNA, 78 bp, Homo sapiens
gggtgcagaactggttctcactgtggccctgtgaccttgagcacgtctctcgccctctgagcctcagtttctgcatct

SEQ ID NO: 9736 - DNA, 82 bp, Homo sapiens
ccttccttaaccagcagggcaggccgccagtggagctctagggtaccatttgctcgggcactttctgtctgtctgtgggagg

SEQ ID NO: 9737 - DNA, 65 bp, Homo sapiens
gtcgctggctggcacatggaacgttcagaacggtgtctggttgtagtaagtgctatgtaagtggc

SEQ ID NO: 9738 - DNA, 80 bp, Homo sapiens
ggctctgggtgccacagcgtctgccacagttctctctgtgtgtgatggtctgcagtttcgctgcgacgtatccaggtgtt

SEQ ID NO: 9739 - DNA, 78 bp, Homo sapiens
gcaagtctttctctctctgcatatatatatgtgtgtgtgtgttgcatatatgtatatatatatgagagagagagttgc

SEQ ID NO: 9740 - DNA, 67 bp, Homo sapiens
tctgtctctctctctttctcttgacggagtttcactctgtcacccaggctagagtgcagtggcgtga

SEQ ID NO: 9741 - DNA, 57 bp, Homo sapiens
gtatatgtgtgtgtccttgcacatgtcatgtggctgtgcaagtgcatgtgtgtgtgc

SEQ ID NO: 9742 - DNA, 118 bp, Homo sapiens
tcacatctatctgtctgccttactggactgtgaagtgaaatgtctgcttcatctttttttttttttttttgagatggagtttcgctctgtcgcccaggctggagtgcagtggtgcgat

SEQ ID NO: 9743 - DNA, 107 bp, Homo sapiens
gtgcacttatatatttatatatatacacacacgtatatatataaggccaggtgtaccattttgttttttatatatacacgtgtgtgtgtgtgtgtgtgtgtgtgtat

SEQ ID NO: 9744 - DNA, 80 bp, Homo sapiens
gtctctgctgcttttccttgtgcagtctctggcctgcagtctgcattccaggaagacagtacagaaagagcagcagtgat

SEQ ID NO: 9745 - DNA, 82 bp, Homo sapiens
gtcatgcactgtccctctgacagaatgctgcctgtcacccaggccagctttgattcagtgtgagaggagactacagatggac

SEQ ID NO: 9746 - DNA, 78 bp, Homo sapiens
gggctatcttctcactgtgtccctcccatgccctttctgctgtgtgcacagagagaggacacatgagcaaggtgtctc

SEQ ID NO: 9747 - DNA, 134 bp, Homo sapiens
tgttcccacgctcagagcgagacccactcttttttttttttttttttttttttttttgaggcagtctcgctctgtcacccaggctggaatgcagtggcccgatctccactcactgcaagctccgcctcccgggt

SEQ ID NO: 9748 - DNA, 115 bp, Homo sapiens
aggatcctgtcatggcccacatggaacttcaatcaatatttcttgatgtgtccagtttttctagttgtccttagtgggggagttgatctgagtttctcagttagccattcctaga

SEQ ID NO: 9749 - DNA, 102 bp, Homo sapiens
gtgatgacaggcattcttgtcttgagtctgattttaattttaattttttttttttttgagataaggtcttactctgtcacccaggctggagtgcagtggcac

SEQ ID NO: 9750 - DNA, 56 bp, Homo sapiens
gagacatggtctcactctgtcacccaggttggagtgcagtggtgagatcctagctc

SEQ ID NO: 9751 - DNA, 103 bp, Homo sapiens
ctctcataaataaaataatcgtaaatatatatttaaatatatgggtgtgtatatacacacgtacccacccacatatgtatatatacacacacattttggggag

SEQ ID NO: 9752 - DNA, 93 bp, Homo sapiens
tgggtcaaggagcaatttaacagattgtttggaatgtaatgaagtcatctcataccatctaggaggatctgggtaaattgagacggggtctca

SEQ ID NO: 9753 - DNA, 133 bp, Homo sapiens
gcgacagagtaagactctgtcttccaaaaaataattaattaaaaaacattctattatagaacttttttttttttttgagacagagtctcaccctgtcgcccagactggagtgcagtggcgcgatctcggctca

SEQ ID NO: 9754 - DNA, 57 bp, Homo sapiens
ttgagacagtctcactcactctgtcgtccaggctggagtgcagtggcgtgatctcgg

SEQ ID NO: 9755 - DNA, 60 bp, Homo sapiens
gtgagacaggctctcactctgtcacttaggctggagtgcagtggtgcgatcctggctcac

SEQ ID NO: 9756 - DNA, 58 bp, Homo sapiens; identical to SEQ ID NO: 637

SEQ ID NO: 9757 - DNA, 93 bp, Homo sapiens
accttgtctactctgagcctgtagagtctgctcttaatttattttattttagggacagtcttgctctgtcacccaggctagagtactctaggt

SEQ ID NO: 9758 - DNA, 95 bp, Homo sapiens
tatatatacacacacacacacacatatatatatatacgtatatatatgtatatgtatgtgtgtgtgtatatatatatatatatatatatatatat

SEQ ID NO: 9759 - DNA, 73 bp, Homo sapiens
ctgtatgccaggtactgtacggtgtcctggatactgcaacagagcaagtgggacactcagtgcctgagctagg

SEQ ID NO: 9760 - DNA, 74 bp, Homo sapiens
ctcctgagagtgggaagcagaagacatgtgagagagcccacgtctgtgtgtatgtgtgtctctattttctggag

SEQ ID NO: 9761 - DNA, 58 bp, Homo sapiens; identical to SEQ ID NO: 1868

SEQ ID NO: 9762 - DNA, 85 bp, Homo sapiens; identical to SEQ ID NO: 7545

SEQ ID NO: 9763 - DNA, 105 bp, Homo sapiens
aagtggttgctggttcagataatggcttctcaccagtgtttttttgttttttgttttctttaaaaaaaaaaaccctctggatgagatttctatgagaaactactt

SEQ ID NO: 9764 - DNA, 67 bp, Homo sapiens
gcaagaagaggcagcaggggcagtctctgtatgtgtgtgcaggagcagtctctgtgtgtgtgtgtgt

SEQ ID NO: 9765 - DNA, 101 bp, Homo sapiens
gaaggctgcacggtggggcagtgattctggcctttagcctgtagtcccaactactcaggaggctgaggtggaaggatcaattgagccaaggacaggaattc

SEQ ID NO: 9766 - DNA, 85 bp, Homo sapiens
ccagcaaggcaacatagcaagaccctgactctttattttttaattttttttttgagacggagtctcactctgtcacccaggctgg

SEQ ID NO: 9767 - DNA, 72 bp, Homo sapiens
ctgggcatggtggtgtgcacctgcagtcccagttacttgagaggctgaggtaggaggatcacttgagcccgg

SEQ ID NO: 9768 - DNA, 58 bp, Homo sapiens
tgagttggagtctcgctctgtcactcaggctggagtgcagtggcgcgatctcagctca

SEQ ID NO: 9769 - DNA, 79 bp, Homo sapiens
gtcactctctttataccagacctcactattgttatcggactctacaagtggtgagtggctgagtctgtgtttcagtgac

SEQ ID NO: 9770 - DNA, 80 bp, Homo sapiens
gtagagaatttgtttttttgatcttacaaatgacccaaaaatctgctgggtcacctgagttaaggctgtggatctcgtgc

SEQ ID NO: 9771 - DNA, 116 bp, Homo sapiens
gggggctgagagaaggtggcagttctcacattctcccaggatctgagtccctgcctcagtcactcactggtccttcacccactgagaggcagtgtggcagcagataacaaccgtgg

SEQ ID NO: 9772 - DNA, 114 bp, Homo sapiens
ctaacaagaatttcttccttctaggcccttagagactatcccacatcttcatattttgattttcagagtggctgaagtttctattaagctgggaattttttttttcttttttag

SEQ ID NO: 9773 - DNA, 85 bp, Homo sapiens
cgtggtggcatgcacctgtggttctagctactcaggaggctgaggtgggaggatgactagagtccaggaggcagaggttgcagtg

SEQ ID NO: 9774 - DNA, 119 bp, Homo sapiens
cttcttttgcattctttgcattatttcacaactagttctagataaaataattttttcttttgagaacaaggacatggcatttgggggtgtgttggggatggggatggagaggatgttga

SEQ ID NO: 9775 - DNA, 58 bp, Homo sapiens
tgagacggagtctcactctgtctcccaggctggagtgcagtggtgtgatctcggctca

SEQ ID NO: 9776 - DNA, 73 bp, Homo sapiens
acttgggggcttgaatcccagctgagtgaccttgggccagtacctctgcctctctgggactcagtttccttgt

SEQ ID NO: 9777 - DNA, 61 bp, Homo sapiens
gcttgcaaatttgcacagagacagagacaatcactgtctctgtcagtgtgatttgggcagc

SEQ ID NO: 9778 - DNA, 86 bp, Homo sapiens
tatatatatatgtatatatatgtatatatgtatatatgtgtatatatgtatatatacgtatatgtatgtgtatatatgtatatatg

SEQ ID NO: 9779 - DNA, 96 bp, Homo sapiens
ggctctgtgagtccattaaacctctttttctttataaattacccagtctcaggtatgtctttattagcagagtgagaatggactaatacagtaacc

SEQ ID NO: 9780 - DNA, 69 bp, Homo sapiens
ctctcacggtctctctctctcacggtctccctcacggtcagggcagaaagagagagagtccatctggag

SEQ ID NO: 9781 - DNA, 106 bp, Homo sapiens
gtacacgtatacagtgcctggtctcatgatcactgagtccactgcagctttttatttttttttccatacagggtctcactctgtcacccaggctgagtacagtggc

SEQ ID NO: 9782 - DNA, 72 bp, Homo sapiens
tcatgctgggggaaccacaatgtaacttttttttttttttgagaaggagtctcactctgttgcccaggctgg

SEQ ID NO: 9783 - DNA, 94 bp, Homo sapiens
acagagatggcatggacagagcccatggagaaggaggaggaaaaagagttttgcttttgtttttttttttaagacagggactctggctctgtca

SEQ ID NO: 9784 - DNA, 82 bp, Homo sapiens
ggagttcactttgtatgtattaatcaacgtgtatatttatattttatgctgttgatttatgtttcatgcatcatagtaatcc

SEQ ID NO: 9785 - DNA, 62 bp, Homo sapiens
tgctcaaactctcagaggctgactgggaattcaaagttagtatcacatctgagggaagggca

SEQ ID NO: 9786 - DNA, 79 bp, Homo sapiens
cacaatgcaatctgtctgactgacactctgctacaacatgcactagggttgggagtgactgggggcagaaggggctgtg

SEQ ID NO: 9787 - DNA, 116 bp, Homo sapiens
aatctttaagggtatttgaaacaacttgagtatttcaatctgctttttttaactttaaattttatgaaactgaaatacagataagtatttttgatgaaaattgagtgcccaagatt

SEQ ID NO: 9788 - DNA, 194 bp, Homo sapiens
tatgtgtatatacacatatgtatatatgtatatacacatatgtgtatatacacatatgtatatatgtatatatacatatgtgtatatatttcataatatgtatatatgtatatatacctatatgtatatatttcatatgtatatatgtatatatacctatatgtatatacattgtgtgtgtgtgtgtgtgtgta

SEQ ID NO: 9789 - DNA, 89 bp, Homo sapiens
tcccactgtgttccttcttttagtgcatgctggaggcttcttacttcaagcactgtgactctgtctgagggctttatcaggccttggga

SEQ ID NO: 9790 - DNA, 84 bp, Homo sapiens
ttctctgtcacagcttcttcatctgcaaaatgaaaaagagcttctacttattctgtgtcttatgaggagaagtgagacagtgaa

SEQ ID NO: 9791 - DNA, 111 bp, Homo sapiens
ctctataaacttctgctcagaaaagacaatgtgtaataaatgcaatatactaaagtagtttctacttgtgcttaattttaaaacatttttctatttgggagggggtggggg

SEQ ID NO: 9792 - DNA, 95 bp, Homo sapiens; identical to SEQ ID NO: 68

SEQ ID NO: 9793 - DNA, 93 bp, Homo sapiens; identical to SEQ ID NO: 69

SEQ ID NO: 9794 - DNA, 105 bp, Homo sapiens
ggaattttgtggttttcttaggaatactacattcgacttggaataagactaatgtttacaagtatgtgcttctgatctagtgtctttaggcctttatgaagtttc

SEQ ID NO: 9795 - DNA, 88 bp, Homo sapiens
tggagagcttgtgatggaatatatatttttattgactgtaaatgaaattattctcatcgatgagagaataattctattattctcttca

SEQ ID NO: 9796 - DNA, 105 bp, Homo sapiens
tcctttgcattgacatatacattttagcatcaatttatcaatttttgtaaaaagaaagctatgatttttatagggattgtgctaaacctatagatcaatttggga

SEQ ID NO: 9797 - DNA, 81 bp, Homo sapiens
gtcgtctgcacagagcagggcatggcctgcattccaaattttgttattctcaaaggtcagttgttctcagtggcagacaac

SEQ ID NO: 9798 - DNA, 81 bp, Homo sapiens
ggagagggagagggagagggacaatcatttctattttttgatttaaagagaggaatgtatgactctttctttcactggaac

SEQ ID NO: 9799 - DNA, 94 bp, Homo sapiens
gccaccacgcacagccggtgaagtgtgtttcttataggtgatagatcactgggtcttgttttttaatctattcagccactctgtgtcttttggt

SEQ ID NO: 9800 - DNA, 108 bp, Homo sapiens
tgtctccatgagtttgactactccagggacctcatctaggggcagtcacacagtatttatttttttgtgactggcttatgtcacctagagtaacgtcctcaaggttca

SEQ ID NO: 9801 - DNA, 83 bp, Homo sapiens
tgatgttttaacaacagtctgagacactctgactttctctacatgggggccttgatggagactcagagtagtcactgacatca

SEQ ID NO: 9802 - DNA, 102 bp, Homo sapiens
tttcaatttatacagcaaggcatttatgaagccagaagagaaaaacatcttagtttttttaaattaatttctttctttatagaatttgtagtatatgtggag

SEQ ID NO: 9803 - DNA, 95 bp, Homo sapiens; identical to SEQ ID NO: 68

SEQ ID NO: 9804 - DNA, 93 bp, Homo sapiens; identical to SEQ ID NO: 69

SEQ ID NO: 9805 - DNA, 98 bp, Homo sapiens
tgtggctttccatccttaacagaactcatatcctacttatatgtgaacaaaaggatgtatgtagttttgttttgtaaagactctgggcataagttata

SEQ ID NO: 9806 - DNA, 73 bp, Homo sapiens
agtcatgtttgaacttgaaaagtgaattttttttctataattgaaagaaaacaagttcaaaaggtatatggct

SEQ ID NO: 9807 - DNA, 58 bp, Homo sapiens
tgagacagtgtctcactctgccacacaagctggagtagagtggcatgatcttggctca

SEQ ID NO: 9808 - DNA, 107 bp, Homo sapiens
catggtagtttggtccatcaccagtctagatgttgctgtgaaggtgtttttaagatgcaattaatatttttatatcagtagactttgagtaaagcagattactcttg

SEQ ID NO: 9809 - DNA, 77 bp, Homo sapiens
tgtgtatatgtgtatatatacatacgtttatataaacacatctgtgtgtatatctgtgtattatatatatatacaca

SEQ ID NO: 9810 - DNA, 95 bp, Homo sapiens; identical to SEQ ID NO: 68

SEQ ID NO: 9811 - DNA, 93 bp, Homo sapiens; identical to SEQ ID NO: 69

SEQ ID NO: 9812 - DNA, 107 bp, Homo sapiens
tccctttttatggctgagtagtatccatgatatgtatgtatgtatgtatattatatatgtattgtatatataccacattttcttgatccactccttgattgatggga

SEQ ID NO: 9813 - DNA, 117 bp, Homo sapiens
gaagacagaggatgctgtcagcctgctaaccatgtgtgtgctcctaagacagccagctttgcatagtttcttttctgttcacggtggttaagctgggcttttcagtagttggatttc

SEQ ID NO: 9814 - DNA, 113 bp, Homo sapiens
ctcagtagctggaactacagatgtgtgccaccacaccaggctaattttttatttttattttttgtagagatgaggtctttctatgttgcccacgctgatttcagactcctgag

SEQ ID NO: 9815 - DNA, 116 bp, Homo sapiens
gctatggttcagagcctggcccagctactccagacttctatgccttggtggcccagcggctggaacagcaagagcaactgaaatctccgcctagccctgctggcctcggaccccgc

SEQ ID NO: 9816 - DNA, 57 bp, Homo sapiens
gttgagacacagtctcactctatcgcccaggctggagtgcagtggcgtgatctcagc

SEQ ID NO: 9817 - DNA, 58 bp, Homo sapiens; identical to SEQ ID NO: 2051

SEQ ID NO: 9818 - DNA, 117 bp, Homo sapiens
gaggacggaggagagggcaggagggtcaaaaggggtcaaacacatacagtctctgcctctctcgggggactgtcacccagcccaccccttccctctcactctatccctctggttctc

SEQ ID NO: 9819 - DNA, 105 bp, Homo sapiens
gcacacaggtagagtagatttagcataattctttttcttttctttttttctttttttttttttttttgagatggagtctcactctgtctacccaggctggagtgc

SEQ ID NO: 9820 - DNA, 147 bp, Homo sapiens
tatatatacatatatacacacgtgtatatatatacatatatacacgtgtgtgtatatgtatatatacacgtgtgtatatatgtatatatacacgtgtgtatatatacatatatacacgtgtgtatatatatatacatatatacacac

SEQ ID NO: 9821 - DNA, 88 bp, Homo sapiens
agttactatatgtatattcgtatacatgaatatgtgtgtatatatatatatgcacatatgtgaatgtatttagtaaatatatgtgatt

SEQ ID NO: 9822 - DNA, 102 bp, Homo sapiens
gaggaaaaaaaatgtgtattctgcagttgttggatgaaatgttctgtaaatatctattaggtccatttggtctatagtgcagattaagtccagagtttcttt

SEQ ID NO: 9823 - DNA, 107 bp, Homo sapiens
ttgtacatattatataatacagatataatatatacattgtatatattatataatacagatataatatatacattgtatatattatatgtagtatatattatgtataa

SEQ ID NO: 9824 - DNA, 183 bp, Homo sapiens
tgtgtttgtgtatatgtgtgtatatatatgtgtatgtgtatatatgtatatatgtgtgtatatatgtatgtgtatatatattatatatgtatatataagtatgtgtgtatatatgtgtatatatacacatatatacttatatatgtatgtgtatatatattatgcatatatatacacacatac

SEQ ID NO: 9825 - DNA, 99 bp, Homo sapiens
gtctctcaaaaaaaaagcttatatatgctatttgtttctatagatgactacctgactgagacataaaaaagttcatatttctttttttttttttgagac

SEQ ID NO: 9826 - DNA, 100 bp, Homo sapiens
tttacctacaggtgttttttaatctgtaaaataactccatgacacgtgttctgtaattatacttattttataggttttgaaacaggttcataaaggtaaa

SEQ ID NO: 9827 - DNA, 103 bp, Homo sapiens
tacatatttgttgaaataggatgagcagtcagtcactttcactcaccaaaaactagagcgggggatttgctgccaggcacccattttgaaacaaaatgatgtg

SEQ ID NO: 9828 - DNA, 112 bp, Homo sapiens
gtgttcctggagcccagcatggagcctggcactttgttacttttggctgaatgaaaacatgtatgtgtttcatgcaacatgtaagtgtcctgtggcccgtggagtctcccgc

SEQ ID NO: 9829 - DNA, 78 bp, Homo sapiens
accggcatgtgccactatgccaagctaatttttgtatttttaacagagacagggtttcaccatgttggtcaggctggt

SEQ ID NO: 9830 - DNA, 114 bp, Homo sapiens
ggcctattactatttcacctttaatacaggcttacagaatgaacttacaaaaatatgatgtaatctcattttgtataaatgtgtatcaaagaaaagacagaatagagatgggcc

SEQ ID NO: 9831 - DNA, 58 bp, Homo sapiens
tgagacagagtctcactgtgtcactcaggctggagtgctatggcgtgatcttggctca

SEQ ID NO: 9832 - DNA, 112 bp, Homo sapiens
ggctactagcaccccgtagtattaagataagcttgcacagaattcgtaagttttggaatgtataaaataatgactttcagtgtttttattatagtgctgaattttgttttcc

SEQ ID NO: 9833 - DNA, 58 bp, Homo sapiens; identical to SEQ ID NO: 2257

SEQ ID NO: 9834 - DNA, 67 bp, Homo sapiens
gaggttcagattagggtttgcctaagagtacacagtgagtagattgcagatctgggagttgaacctc

SEQ ID NO: 9835 - DNA, 108 bp, Homo sapiens
tatacatttgagatgtgccttttctgacataaatcagccacagagaaaagagtcagctgacatttgtagttgcaaggggaaaaaaaatctcttcacaagtaatgtatg

SEQ ID NO: 9836 - DNA, 105 bp, Homo sapiens
tactgacatcatctaggagtctcataaaattttaatatgtatctgtattttatacatggggaaacaggcagaagataaacatgggacccgttcttgaacacagta

SEQ ID NO: 9837 - DNA, 95 bp, Homo sapiens; identical to SEQ ID NO: 68

SEQ ID NO: 9838 - DNA, 93 bp, Homo sapiens; identical to SEQ ID NO: 69

SEQ ID NO: 9839 - DNA, 79 bp, Homo sapiens
caggtatgactgggatactgaattcttaattttacttaattttaggtaatctgaatttaaatttaaatagtcatatgtg

SEQ ID NO: 9840 - DNA, 95 bp, Homo sapiens; identical to SEQ ID NO: 68

SEQ ID NO: 9841 - DNA, 93 bp, Homo sapiens; identical to SEQ ID NO: 69

SEQ ID NO: 9842 - DNA, 95 bp, Homo sapiens; identical to SEQ ID NO: 68

SEQ ID NO: 9843 - DNA, 93 bp, Homo sapiens; identical to SEQ ID NO: 69

SEQ ID NO: 9844 - DNA, 58 bp, Homo sapiens; identical to SEQ ID NO: 1435

SEQ ID NO: 9845 - DNA, 70 bp, Homo sapiens
ttgttctgggccagggtctcactctgtcacttaggctggaaggcagtggcgtgatcatggctcagtgcag

SEQ ID NO: 9846 - DNA, 89 bp, Homo sapiens
tgagacagagtctctccctgtcactcaggctggagtgcagtggtgcgacctcagctcacagcaacctctgcctcctgagttcaagcgat

SEQ ID NO: 9847 - DNA, 71 bp, Homo sapiens
gagtttatggagctcagtgtgtgtgtgtgtgtgtgcacgcgcgcgcgcgcacacgtgtgtgtgtatatctc

SEQ ID NO: 9848 - DNA, 125 bp, Homo sapiens
cccagcttcaccaactctaaatcaaaaccatgcagagagaactgcatgagtgaagacagtgaggtgggctagtgtatcatgtagagctagcctccagggtggccaaccatgatccccagctactg

SEQ ID NO: 9849 - DNA, 64 bp, Homo sapiens
atgtatgtgtaccagatacatatacataagggaatatatatatatatgtctggtacatatacat

SEQ ID NO: 9850 - DNA, 117 bp, Homo sapiens
gtctgcaaatgggcaatggttgtatatagtaagaatgatgtgttgtctgtagtgtgtgacgtgatttgatgtgatggaaaagggaagcacatatatatatagtcacactttgcaggc

SEQ ID NO: 9851 - DNA, 97 bp, Homo sapiens
aggccatgacaggaaagggttaagtcacacactcctacccttggaataaactgagaggtgacagtgtgctggcagccctcactcgctctcggtgcct

SEQ ID NO: 9852 - DNA, 74 bp, Homo sapiens
tatgtgtgtgcatgtatgtgtatgtgtgtgcatgtgtgccatgttttatatatatatatgcttgtttatgcata

SEQ ID NO: 9853 - DNA, 119 bp, Homo sapiens
aacaaactatgactaatatactgcagttacatagtagtctatgttatatcattttgtttatctgttactctgtgaatggatattgtgtgcctgcatcatcttacttttgttatcatcag

SEQ ID NO: 9854 - DNA, 99 bp, Homo sapiens
gccagtctgtgtcttttaattggggcatttagtccatttacacttaaggtttatattgttatgtgtgaatttgatgttgtcattatgatgtttgctggt

SEQ ID NO: 9855 - DNA, 78 bp, Homo sapiens
cctggttcagcagggtgtcttccctctctatcactctgtgagaagcagagggactctgattgtttctactcaagcagg

SEQ ID NO: 9856 - DNA, 101 bp, Homo sapiens
tccattgtgtgtgtgtgtgtatatatatataccacattttcttttttaacttttttaatttttaatttttgtggttatatagtgggtgtatatattttgga

SEQ ID NO: 9857 - DNA, 117 bp, Homo sapiens
agaagcattagtttgcttgtgtccattgatttgcttgtgtcctttaagcttgcttagcaataaggctgcaggaggcagggtgagcagcatggactttcacaggtggctcttgcttct

SEQ ID NO: 9858 - DNA, 84 bp, Homo sapiens
ctccacacggggatctgggaatctttacttttttctttttttttttttttgagatggagtctctctctgtcacccaggctggag

SEQ ID NO: 9859 - DNA, 95 bp, Homo sapiens
gtgtgggacacaggtggaatgactctctcagaatctaatcttttttttttttttttttttttttttgagacggagtcttgctctatcacccaggc

SEQ ID NO: 9860 - DNA, 58 bp, Homo sapiens; identical to SEQ ID NO: 454

SEQ ID NO: 9861 - DNA, 115 bp, Homo sapiens
ctgagtaccttactgctacctgctttctcactcagtctttttgggagctgaggagtcactctccctctcagaccaaatagaactggactgagggtgggggcaaaagtagcctcag

SEQ ID NO: 9862 - DNA, 61 bp, Homo sapiens
gcaacacagtgagactctgtctctattttttttttttgagatggagtttcactcctgttgc

SEQ ID NO: 9863 - DNA, 80 bp, Homo sapiens
gtcaacattggtagatacatgttggtcttgtttttttagtttttttaaaaagaaattgggtctaactgtgtttcccagac

SEQ ID NO: 9864 - DNA, 88 bp, Homo sapiens
ctcttctgccagcacagaagagtgagtgctgtgggtcccttacacctctggcctctctctcctagggctgtgcctggctgctcctgag

SEQ ID NO: 9865 - DNA, 136 bp, Homo sapiens
gaggctgaggaagaggcatttgggaaggagagcttcaatgccagatttggcagaagtgctgtgtgtctgagtgtctgagcccagccttaaaagcagggccctccaactgtgatggcagtgatgcagtcctctgggg

SEQ ID NO: 9866 - DNA, 68 bp, Homo sapiens
ctcctggctgttgtaagcccatatgtgggcaggattgcacctgccaccacacagagcacagagagggg

SEQ ID NO: 9867 - DNA, 75 bp, Homo sapiens
ggggctgggtgtggcagcactcactataagggtgcatctctgtctgtgcctgtgtgtgcatctgaatctggcacc

SEQ ID NO: 9868 - DNA, 67 bp, Homo sapiens
gtgtctgtctcgcagtctctgcgggagaatagagtcctaatcgagagaactgccagctatcagacac

SEQ ID NO: 9869 - DNA, 94 bp, Homo sapiens
gggcaacatagtgagactctgtctctgcaaaaaacattttcttttttctttttttttttttttttttttgagacagagtctcgctctgttgccc

SEQ ID NO: 9870 - DNA, 62 bp, Homo sapiens
gccccagcagtcccacggtctgtgtgtcaccagaggacaagcagtggccgagaggagggggt

SEQ ID NO: 9871 - DNA, 73 bp, Homo sapiens
tggtgacaagaggagagaaacctcagagaggactgccctccccatcgcaggctttctctttttttttttttca

SEQ ID NO: 9872 - DNA, 127 bp, Homo sapiens
atagactgtattctgcctgcttcagtctagctctccagggaagctatggcagagggtaactgtgtgtgctaaggatgtagactcttgttctctgagctatgagaatagggtggctagcattcaaagc

SEQ ID NO: 9873 - DNA, 83 bp, Homo sapiens
ccaaggctgtctggctctgcctcactgtgaccctgcagttcccagactgtctctgggctgctgtgagtagagtcaggtcttgg

SEQ ID NO: 9874 - DNA, 101 bp, Homo sapiens
cctctggtcatttggtgtgtgagttccccattctctgatcattggtgtgtgagccccccatcctctggttattgggatatatgagccccgccgtcctctgg

SEQ ID NO: 9875 - DNA, 104 bp, Homo sapiens
tgaattcttagctgtgttgtctttagtaaaatttgaggcctctctgtgactcactttctgtctctgaaaaatggttgcttgaagacaattctcttacttcttca

SEQ ID NO: 9876 - DNA, 100 bp, Homo sapiens
cccgctctgccttgagactgagactttctgactctcagtttcacccttgggttccagcacccagatgagaagagagagaaggtggaagaggaagagaggg

SEQ ID NO: 9877 - DNA, 100 bp, Homo sapiens
ctggagcactgtaaagaagaggaagcttaggaacaaagaaacttggcgaagctcactcagctagttcattgttttttattttttatttttatttttttag

SEQ ID NO: 9878 - DNA, 134 bp, Homo sapiens
gtgtgcctgtgtatgtgcgtgcatgtgcctgtgtgtgtgtgctcacgcctgtgtgtgcatgtgtgtgtgcatgtgcatgtttgtgcctgtgtgtatgtgtgcatgtgtgtgcctatgtgtgcctgtgtgtgtgc

SEQ ID NO: 9879 - DNA, 183 bp, Homo sapiens
agatgttctgtttactcctgtgtctgttttggtaatttgtattttaagaaatttgtttatttcatttaagttgctgaatttattggcataaaattggattgttcataatattttttgatgtcttaaaggatggtgttccctcctttatttctgatattttaaattttttgttgttgttcagtc

SEQ ID NO: 9880 - DNA, 69 bp, Homo sapiens
cagatttctcccctgtcaagttttttactttatatatagttagtaagtaatttgtggggagataatttg

SEQ ID NO: 9881 - DNA, 78 bp, Homo sapiens
ggagtgggagggggggaatggttctcaattttaatgatcatgtttttaaattttagaatctttttctgtttccatttc

SEQ ID NO: 9882 - DNA, 79 bp, Homo sapiens
ctttgtttcttctgacaatcactcaccacccatctttgcccaccgaatgtggaggttaaggtcaagaattggagcagag

SEQ ID NO: 9883 - DNA, 125 bp, Homo sapiens
tatatatatgtgtgtatatatgtatatatatatgtgtgtttgtatatatgtgtatatatatgtgtgtgtgtatatatacacatatatacgtatatatatgtgtatatatacgtatatatgtatat

SEQ ID NO: 9884 - DNA, 110 bp, Homo sapiens
tggctatttggagtcttctgtggttctacacaaattttagaaatttttttctatttctgtgaaaaatgtcattggaatttttgtagggattgcattgaatctatagatca

SEQ ID NO: 9885 - DNA, 119 bp, Homo sapiens
tgccactaaatgttgggatccttgagttgtttccagtattccagtttctctgtctctgtatttccagaatccagtacaatgcctggtgcctggtaagcactcaataaatatttgttgta

SEQ ID NO: 9886 - DNA, 77 bp, Homo sapiens
gcttcatcccaacctttctcacagcctccctcagtgtttccaagattccctggggtgagtgagactcatggtgaagc

SEQ ID NO: 9887 - DNA, 75 bp, Homo sapiens
ggtgctgggattacaggcgtgagccatcgcgcccggccgaaactgtgtctctctgtctgattatcctactcaacc

SEQ ID NO: 9888 - DNA, 106 bp, Homo sapiens
gctgagatcctagacttgggtggcggggtggggggagtggtgccagcaaaagacaggcagagagagacacagagactgacagagacaaggaaagagatccattagt

SEQ ID NO: 9889 - DNA, 95 bp, Homo sapiens; identical to SEQ ID NO: 68

SEQ ID NO: 9890 - DNA, 93 bp, Homo sapiens; identical to SEQ ID NO: 69

SEQ ID NO: 9891 - DNA, 58 bp, Homo sapiens
gcctgtcagtactgggtgtgcacacacagacacggtgcacaccggcacgcacgcgggc

SEQ ID NO: 9892 - DNA, 201 bp, Homo sapiens
tgtgtatatgtatatatacacatatatacgtatatatacacatatatacgtatatatgtgtgtatatgtatatatgtgtatatgtatatatgtgtgtatatatacgtatatatacacacatatatacgtatatatgtgtgtgtatatatatataatgtatgtatgtatgtatataatgtatgtatgtatatgttggggcac

SEQ ID NO: 9893 - DNA, 58 bp, Homo sapiens
tgagacagagtctcgctctgtcacccaggctggagtgcagtggcgcaatctctgctca

SEQ ID NO: 9894 - DNA, 72 bp, Homo sapiens
ttccttagttctgtgtctgtatctgtcaaggtcccagcagaaaacagcactctcacaggctttactgaggag

SEQ ID NO: 9895 - DNA, 92 bp, Homo sapiens
gcttgatctgggcagcagctgcatttctctgtgtctcatttccgtcagggagctcctctgtcacactgtggctcttgctaggttctgagagc

SEQ ID NO: 9896 - DNA, 116 bp, Homo sapiens
gtttttgtttgtttgttttgttttgttttgtttgttttatttggaagagacagggtctcactctgtcaccaggcttgactgcaatggcatgatcatagctcactgcagccttgaac

SEQ ID NO: 9897 - DNA, 78 bp, Homo sapiens
gtaaagaggatgaagaagtaggaactagagtagaacccctgaccctgagtttcattcactgtgtctgtgcctctttgc

SEQ ID NO: 9898 - DNA, 64 bp, Homo sapiens
ctcagaaggcattgcaccatttctagtccttgggtagctatgctgtgtatagatgttttctggg

SEQ ID NO: 9899 - DNA, 95 bp, Homo sapiens; identical to SEQ ID NO: 580

SEQ ID NO: 9900 - DNA, 93 bp, Homo sapiens; identical to SEQ ID NO: 69

SEQ ID NO: 9901 - DNA, 79 bp, Homo sapiens
tatgtgtgtgtgtgtgtgtgtgtgtgtgtgtgtatatatatatatatatgcagacacacatatgcacatgtatatatat

SEQ ID NO: 9902 - DNA, 75 bp, Homo sapiens
ggcccctcagtctgtatgtgtctccctgttggtcccatcttgcctcagagaacccacgccagctttacaggggtt

SEQ ID NO: 9903 - DNA, 64 bp, Homo sapiens
cctctgggtgtctcagggcctgttcaagttccccaggagtttaagaccctgggatgctatttgg

SEQ ID NO: 9904 - DNA, 100 bp, Homo sapiens
gggagtggcagtatgaagtgtccagagcagagaaggtgagagtctcactcagagactaggactgatttggctcttcctgcagcagctgcatctgcacccc

SEQ ID NO: 9905 - DNA, 79 bp, Homo sapiens
cctcctctgaggtttctgatggaggacagtagctctgggtgactgagtctctgaattccaaggtgtccatgagaggagg

SEQ ID NO: 9906 - DNA, 109 bp, Homo sapiens
tatatacatatatgtatatatacacatatatacgtatatatatatacgtatatacatatatacgtatatatatatatctgttatgcatatataaacagatatgtatata

SEQ ID NO: 9907 - DNA, 112 bp, Homo sapiens
ttggggcctaatttatttatgattttactttattttattttttgagacagagtctcactctgtcacccagactagagtgcagtggcatgatcataggtcactgcagccccga

SEQ ID NO: 9908 - DNA, 113 bp, Homo sapiens
aagccagacagaaaaccaggtgaacttgggaccattgggtaagtggtgtcatgtattatctgtctgtgtgtgtctggcttatttcacttagtataatgtcctcttgtttcatc

SEQ ID NO: 9909 - DNA, 102 bp, Homo sapiens
ccacatctttaaagggcctcagatctcatctgtgagctctcttctctgggttgagctcccttgatggcactgcaggcacctcccaagaaagtaaggataggg

SEQ ID NO: 9910 - DNA, 95 bp, Homo sapiens; identical to SEQ ID NO: 68

SEQ ID NO: 9911 - DNA, 93 bp, Homo sapiens; identical to SEQ ID NO: 69

SEQ ID NO: 9912 - DNA, 95 bp, Homo sapiens; identical to SEQ ID NO: 68

SEQ ID NO: 9913 - DNA, 93 bp, Homo sapiens; identical to SEQ ID NO: 69

SEQ ID NO: 9914 - DNA, 70 bp, Homo sapiens
cagggcttggctgggtgactctctggctccctgtagcatgagatgaggtcattctgtggttcagctgctg

SEQ ID NO: 9915 - DNA, 93 bp, Homo sapiens
tttgtttccatagtccagagcctgaaagagtctgcaagtctgaagaaacctccagataagagaagattcattgctctgcacctcctccacaga

SEQ ID NO: 9916 - DNA, 113 bp, Homo sapiens
tgcagcttccacggtgtggacatgggtagttaatgggtattaatatttacaaataaataaataaatattattattatttttttgagacagtctcgctctgtcaccaggctgga

SEQ ID NO: 9917 - DNA, 58 bp, Homo sapiens; identical to SEQ ID NO: 637

SEQ ID NO: 9918 - DNA, 101 bp, Homo sapiens
ggtatggtggcatgtgcctgtagtcccagctacttaggggctgaggtggtaggatggcttgagcccaggaggttgaggttacagtgagccgtgttcatgct

SEQ ID NO: 9919 - DNA, 115 bp, Homo sapiens
cagatgtcttgaagaatgcgtgatcttgctctagaacaaacccaaatccttgcaaatgttttgttttttaaaacaagcttttgccttttgtttttgcaggagatcaagggcactg

SEQ ID NO: 9920 - DNA, 101 bp, Homo sapiens
ccaaaagctgggaacacaacaaagtatgtgtgtgtgtctgtgtatgtgaatctgaacatgccaggcctttgctcacactgcttctgttccctggcatatgg

SEQ ID NO: 9921 - DNA, 58 bp, Homo sapiens
tgagacagagtctggctctgtctcccaggttggagtgcagtggcccgatctcggctca

SEQ ID NO: 9922 - DNA, 83 bp, Homo sapiens
catatgtatatacacatacacgtatacatatatacgcatatacacatgcatatatatatgtatacatatatatggatatatat

SEQ ID NO: 9923 - DNA, 58 bp, Homo sapiens
tgagacagggtctcactttgtcactcaggctggagtgcagtggtgtgatcacggctca

SEQ ID NO: 9924 - DNA, 58 bp, Homo sapiens
tgagacagggtctcactctgtcacccaggctggagtacagtggtgcgatctcggctca

SEQ ID NO: 9925 - DNA, 73 bp, Homo sapiens
tagtgactctgacagctctggctagtagaataatgctgattttatatttatctttggatgttgtctgtcactg

SEQ ID NO: 9926 - DNA, 156 bp, Homo sapiens
aaatatatattatatgtaagtatatatgtatatataagtatatatgtatgtatgtatatataaatatatatttatatatgtatgtatatatgtatatatgaatatatgtgtatatatgtatgtatatgtatatgtgtgtgtgtgtgtgtgtgtata

SEQ ID NO: 9927 - DNA, 95 bp, Homo sapiens; identical to SEQ ID NO: 68

SEQ ID NO: 9928 - DNA, 93 bp, Homo sapiens; identical to SEQ ID NO: 69

SEQ ID NO: 9929 - DNA, 125 bp, Homo sapiens
cctgacccatagaaattatgagacaaatgtttttttgtttgctttttgagacggagtctcattctgtcactcaggttggagtgcagtggcatgatctcggctcactgcaacctccacctcctggg

SEQ ID NO: 9930 - DNA, 87 bp, Homo sapiens
cttgagacagggtctctgtctgtcaccctgcctggagtgcagtggcacaatcacaactccgtagaacctcaatgtcctgggctcaag

SEQ ID NO: 9931 - DNA, 113 bp, Homo sapiens
gctgagattacaggcctgagcaaccatgcccagcccaacgttgtgattttttttttaattatactttaagttctagggtacatgtgcacaatgtgcaggtttgttacataggt

SEQ ID NO: 9932 - DNA, 107 bp, Homo sapiens
atgtaaaatttaatatgcattcctagaacgaattcaacttggtcatgatatatttttaaattattgctaggtttggtttgctagtatcttgcttagggtttttatat

SEQ ID NO: 9933 - DNA, 78 bp, Homo sapiens
ttaattagagatactgtgcattgttgaaaggaaatatccagacctttcatgtattaatagacactgtctctgaattga

SEQ ID NO: 9934 - DNA, 113 bp, Homo sapiens
caggcatgagtcaccatgcccggccaggaaagatatttttatttcatttttaaataaccacaatatttactaatgggatgtatgttgggcactgcatgacttctcagaccctg

SEQ ID NO: 9935 - DNA, 76 bp, Homo sapiens
acatagtgagacctcgtttccgtagcaaaaaaaaaaaagattttttttgtttatttgagacagagtctcactctgt

SEQ ID NO: 9936 - DNA, 88 bp, Homo sapiens
agaagctggtccgaaactgatatgaattgagtctggatcttagtcattttaagtcctggtcaattttattttattttgttttgtttct

SEQ ID NO: 9937 - DNA, 109 bp, Homo sapiens
gtgtacacggtgtgtgcttagcaccacggggaggtgctgagtcagtggcagtgagggagagagctgtgagtgcgcaggggtgaaggtgtgagggctatttgtgtatgac

SEQ ID NO: 9938 - DNA, 86 bp, Homo sapiens
gagatggagtctccctctgtcactcaggctggagtgcagtgagtgcagtggcttgatctctgctcactgcaaccgccgcctcccag

SEQ ID NO: 9939 - DNA, 58 bp, Homo sapiens
tgagacagagtctcgcactgtcacccagcctggagtgcagtggcgcgatctcggctca

SEQ ID NO: 9940 - DNA, 129 bp, Homo sapiens
ttcagcatatcataggctgggtgtggtggcttatgcttataatcccagcactttgggaggctgaggttggtggatcacttgagcccaggagtttgagatcagcctgggcaacatggcgaaaacccatct

SEQ ID NO: 9941 - DNA, 89 bp, Homo sapiens
tagaaaaggtttttcggcttatggttctgatgtctggaaaagttcaagactgagcatctgcatctgatggtagcctaagactgcttcta

SEQ ID NO: 9942 - DNA, 83 bp, Homo sapiens
ttctgcctctctcttactgtcttagtccattttgtgctgctataacagaatatctgagattgggtgatttataaaggacagaa

SEQ ID NO: 9943 - DNA, 58 bp, Homo sapiens
tgagaccgagtctcgctctgtcacccaggctggagtgcagtggtgtgatcttggctca

SEQ ID NO: 9944 - DNA, 67 bp, Homo sapiens
taaacttttgctgtggtatttgcatctttgctttatgcagggatgtgtggggcttgagtggtgttta

SEQ ID NO: 9945 - DNA, 95 bp, Homo sapiens; identical to SEQ ID NO: 68

SEQ ID NO: 9946 - DNA, 93 bp, Homo sapiens; identical to SEQ ID NO: 69

SEQ ID NO: 9947 - DNA, 74 bp, Homo sapiens
tctccataaggacatctgctggtccccacctgcaggccggcacacctggacagtggcagagttcacgtggcaga

SEQ ID NO: 9948 - DNA, 95 bp, Homo sapiens; identical to SEQ ID NO: 68

SEQ ID NO: 9949 - DNA, 93 bp, Homo sapiens; identical to SEQ ID NO: 69

SEQ ID NO: 9950 - DNA, 91 bp, Homo sapiens
tttctgaccaggctggtggtgagggtcctagtggctggcatcaaggtaggcctcagtttcacacactgtcccagtgctctgagcccagaga

SEQ ID NO: 9951 - DNA, 70 bp, Homo sapiens
cagcaagtgaatgggctcagtaactgtttaaaagctcacaacagtctgagtcacacgttacactctgttg

SEQ ID NO: 9952 - DNA, 75 bp, Homo sapiens
aggaagtcttctcactcactctcagtggggacagtgtgggcccatttagagagaagtctgtgaggatgattttct

SEQ ID NO: 9953 - DNA, 95 bp, Homo sapiens; identical to SEQ ID NO: 68

SEQ ID NO: 9954 - DNA, 93 bp, Homo sapiens; identical to SEQ ID NO: 69

SEQ ID NO: 9955 - DNA, 95 bp, Homo sapiens; identical to SEQ ID NO: 68

SEQ ID NO: 9956 - DNA, 93 bp, Homo sapiens; identical to SEQ ID NO: 69

SEQ ID NO: 9957 - DNA, 102 bp, Homo sapiens
ataacctattttgaattctttgtctgaaaggtcacatatctctgtcactctgggacagagtgggattgatgactcgtgccttatttagtttggtgaggttat

SEQ ID NO: 9958 - DNA, 87 bp, Homo sapiens
gtatttcattcgcttggtagcaattgtgaatgggagttcactcatactttggctctctgtttgtctgttaatggtgtataggaatgc

SEQ ID NO: 9959 - DNA, 108 bp, Homo sapiens
cttggaagtaattaacttgcttttgattttacaggctcataggtataagggactttccttgtctcagatgagactgtggatttggacttttgcgttaatgctggaaag

SEQ ID NO: 9960 - DNA, 56 bp, Homo sapiens
gtgcggtctacattgctgaatccttattgggtgccttcagtgtagaaagacagcac

SEQ ID NO: 9961 - DNA, 100 bp, Homo sapiens
gttgtaaaatctggcttccttgtccatgtctgtagtgtgacatttcattaaagttacaagtgatgacagagaccagacatggttagcctggtcatacagc

SEQ ID NO: 9962 - DNA, 83 bp, Homo sapiens
gtgtagggctctctgtctgtgtgcctgcaaatgctctgatggcaatgccagcacagtgcaggggatgggggggggaggtgcac

SEQ ID NO: 9963 - DNA, 65 bp, Homo sapiens
tctttggttctccttctggaactcttattatttttatgttagagcttccggttctgaaccctaga

SEQ ID NO: 9964 - DNA, 66 bp, Homo sapiens
ggactctgcctctctgagtctcagcttccccatctgtgaagtgggaacccttaggaggacattgcc

SEQ ID NO: 9965 - DNA, 96 bp, Homo sapiens
gtgtttcctcatggttaaatttaggttatgcatttttggcaagaatatcacagaagtgatgctgtgtctgtctcagtgcaacatattaggagacat

SEQ ID NO: 9966 - DNA, 105 bp, Homo sapiens
tagataatttggagactttgggggtaaaatattcaaagaagaaacagagcaatttttagttacactgtgtatctgtcatagattacccctgtcttagaaatactg

SEQ ID NO: 9967 - DNA, 71 bp, Homo sapiens
gtcctctttactccctgtgtgggagagaataggaattatatatatatattttctcccagggaggtcgaggc

SEQ ID NO: 9968 - DNA, 95 bp, Homo sapiens; identical to SEQ ID NO: 68

SEQ ID NO: 9969 - DNA, 93 bp, Homo sapiens; identical to SEQ ID NO: 69

SEQ ID NO: 9970 - DNA, 84 bp, Homo sapiens
gaaaccattgaaagtggaaggaacaggggatttggaattcagggtcctgggtttaacttcttgttttgttgttcactcagtttc

SEQ ID NO: 9971 - DNA, 144 bp, Homo sapiens
atatatatatatatgtgtatatatatatatatatacacacgtgtatatatatatacatatatatgtgtatatatatatacgtgtgtatatatatatacatatatgtgtgtatatatatacatatatatgtatatatatacatat

SEQ ID NO: 9972 - DNA, 72 bp, Homo sapiens
catttggttgttgaggggccaggatggctgattggaagtagctgcagtctgtggcactcacagagaggaatg

SEQ ID NO: 9973 - DNA, 113 bp, Homo sapiens
gagattgcacttaggaagaatttaataactggcaatgattattataattatttatttatgtatatattttgaggtgagatcttgctctgttgcccacgctggagtgcagtggc

SEQ ID NO: 9974 - DNA, 80 bp, Homo sapiens
gactgtgtacagtgtgagggcaggcagtttgcagctctagtcaggggcttaggctctgccactgttacatacaacacggc

SEQ ID NO: 9975 - DNA, 115 bp, Homo sapiens
aaagtgttcccttttcaccacatccatgtcaacgtctattaatttttgattttttgattatggccattcttgtaggggtgaggtggtatcacattgtggttttgatttgcatttt

SEQ ID NO: 9976 - DNA, 130 bp, Homo sapiens
tgcaggtttatatgggaagatatggtcaagggataactttttttttttttttgagaaggagtctcactctgtcacccaggcaggggtgcagtggcgtgatctcagttcactgcaacctccacctcctggg

SEQ ID NO: 9977 - DNA, 87 bp, Homo sapiens
agtgttttaggacctccttgccagaaactaggaaggaacaaagaccaaatatacattcttttttattttttgagacagggtctcact

SEQ ID NO: 9978 - DNA, 93 bp, Homo sapiens; identical to SEQ ID NO: 69

SEQ ID NO: 9979 - DNA, 57 bp, Homo sapiens
tgagacgattctcactctgtcgctcaggctggagtgcagtggcgtgaactcggctca

SEQ ID NO: 9980 - DNA, 93 bp, Homo sapiens
ccaggcgtggtggtacgtgcctgtagtccccactacttgggaggctgaggtagaaggatcccttgagcccaggaggtggaggttgcagtgagc

SEQ ID NO: 9981 - DNA, 76 bp, Homo sapiens
ctttgtgatgggcttcttggtgatgcaggccaggtcgaaaggaggtgggatgtcgaccatggaagaaggcgtggag

SEQ ID NO: 9982 - DNA, 111 bp, Homo sapiens
gcacaagggaggcccgtgtgggtagaaggccgcactgggaaagtgacgagggcagtgtgagtagagactgagcttcccatgtgttgggctctgcctggccccgtgagaggc

SEQ ID NO: 9983 - DNA, 56 bp, Homo sapiens
gaaatgaggtctcactctgtcacccaggccggaatgcagtggtgcgatctcggttc

SEQ ID NO: 9984 - DNA, 101 bp, Homo sapiens
tttggaaagttaggttgagacctaaattaaaaagaagactgaaaatgtacatacaattttattattattatttgagatggagtctcactctgtcccccaga

SEQ ID NO: 9985 - DNA, 112 bp, Homo sapiens
tcaagctctcagcactaggtaagcaaagcactcagcccttggctgtctgcctgagtggctggcagggaggcttggagggagcaatcccagggaccactgctctgcgcctcag

SEQ ID NO: 9986 - DNA, 83 bp, Homo sapiens
gctttagagattgtgatggtttgaaatatacctcagtcccaaagaaaactagtgtatttctagttcatcattattcctagggt

SEQ ID NO: 9987 - DNA, 87 bp, Homo sapiens
ctatctgaaaggtcacatatctctgtctgtctgggattggtcccttgtgtcttatttagtttggtgaggtcatgttctcctggatgg

SEQ ID NO: 9988 - DNA, 94 bp, Homo sapiens
ccagcctgggtaacagagcaagattctgtctcagtgaatgaatgaatgaatgaatgaatgttatatgtgaattttctcctctgtagggggttgg

SEQ ID NO: 9989 - DNA, 58 bp, Homo sapiens; identical to SEQ ID NO: 3380

SEQ ID NO: 9990 - DNA, 86 bp, Homo sapiens
ctgttggcatatagaaatgctactgacttttgtatgttgattttatatcatgcaagtttactgtatttgtttatgagttctaatag

SEQ ID NO: 9991 - DNA, 95 bp, Homo sapiens
gcaacagagcgagactctgtctcgatcaatcaatcaatcaataaagccttctcaagtgattttgatgtgcagccagagttgagatccactgttac

SEQ ID NO: 9992 - DNA, 75 bp, Homo sapiens
ggccttggcacatgtgactggatcattttttttttttttttttaagagatggagcctcactctgtcacccaggct

SEQ ID NO: 9993 - DNA, 111 bp, Homo sapiens
ggtatttcaagactgctgtagacctgtgagtgctgcttgatttaacgatcacaacctggtacaaaaaaaaagcaccaaactcccttaagtaagtcagctctttggtttgct

SEQ ID NO: 9994 - DNA, 56 bp, Homo sapiens
gagtcagagtctcactctgtcactcaggctggagtgcactggtgtgatcatggctc

SEQ ID NO: 9995 - DNA, 135 bp, Homo sapiens
tttgaatccgggaggcagaggttgcagtgagccaagattgcaccactgcactccagcctgggtgacagaagagtctctgcctgaagaaaaaaaaaaaaaaaggtgggagaaatcctttttgtaaccataacccag

SEQ ID NO: 9996 - DNA, 92 bp, Homo sapiens
atatgtgtatatatgtatatatatgtgtgtatatatagtatgtatatgtatacgtgtgtgtgtgtgtatatatatatatatatatataggca

SEQ ID NO: 9997 - DNA, 95 bp, Homo sapiens; identical to SEQ ID NO: 68

SEQ ID NO: 9998 - DNA, 93 bp, Homo sapiens; identical to SEQ ID NO: 69

SEQ ID NO: 9999 - DNA, 58 bp, Homo sapiens; identical to SEQ ID NO: 1099

SEQ ID NO: 10000 - DNA, 95 bp, Homo sapiens; identical to SEQ ID NO: 580

SEQ ID NO: 10001 - DNA, 93 bp, Homo sapiens; identical to SEQ ID NO: 69

SEQ ID NO: 10002 - DNA, 74 bp, Homo sapiens
ggcttgcatcccaggcaggcctcgcctggctcctggcatgagtggacagagcctgcactcaggatgttgtggcc

SEQ ID NO: 10003 - DNA, 95 bp, Homo sapiens; identical to SEQ ID NO: 68

SEQ ID NO: 10004 - DNA, 93 bp, Homo sapiens; identical to SEQ ID NO: 69

SEQ ID NO: 10005 - DNA, 103 bp, Homo sapiens
gcaagtaatgtctctgcattataattgtaggtttccaaggattttgatatttttattaaagtaccagacttaagctataaaagagtaaaggggcattattttc

SEQ ID NO: 10006 - DNA, 181 bp, Homo sapiens
atgtggtatgtgtatatgtatgtatgtatgtgtgtgtgtgtatatatatatatatatatatatatatataactatatatatataacaatatatatatataaatatatatatattgttatatatatatatatagttttatatatatatatatatatatatatataacaatatatatataaca

SEQ ID NO: 10007 - DNA, 119 bp, Homo sapiens
aggtgggcaggcctctgcctcgagcacgaaagggccattccaagcatggcagggagtcagaacagactggcctctgctgtgtgccaggcactgtgctgagcatttggcataaaccatct

SEQ ID NO: 10008 - DNA, 88 bp, Homo sapiens
tgtaacccagcgtctggctctctctctccctggtgggcccacaggcctgctagtgaatgggcatgtctgccagtggcttagtttttca

SEQ ID NO: 10009 - DNA, 97 bp, Homo sapiens
ctaaccctgtgccagggagtgtagtgagtgctttggctatgttaatttcttcttgtcatctacagacttattttcattcctcttttacaaggggaag

SEQ ID NO: 10010 - DNA, 163 bp, Homo sapiens
tatatgtatacatgcagatacatatgtgtatctgtacagatatgtatctgtatatgtatatgtatatacatacatacatgtatgtatatgtatatttgtatatacagatatgtatatgtatatatgtacatacatatatatacatatatatatatgtatgtat

SEQ ID NO: 10011 - DNA, 74 bp, Homo sapiens
gcatgtatacatatatgtatatgtatctgtatgtatacatatacatatacatacatgtaagtatgtatacatgc

SEQ ID NO: 10012 - DNA, 110 bp, Homo sapiens
aggctcagtcatgttcaatgtattctttggtccaccttacaaagtacttaattaaagaacactttttgatcatgtcataggtgaatacctggatgaagcaggcttggcct

SEQ ID NO: 10013 - DNA, 113 bp, Homo sapiens
ggattgtcttggctatacggtctcttttttggttccatatgaaatttaaagtagtttttttctagttctgtgaagaaagtcaatggtagcttgatgggaatagcattgaatct

SEQ ID NO: 10014 - DNA, 73 bp, Homo sapiens
tgccatatatatatatatatatatatatatagcaatattgccatatatacatgtatgtgtatatatgtgtgta

SEQ ID NO: 10015 - DNA, 95 bp, Homo sapiens
gctcccctcttgcagctctctataggaacctggacttaattttttaaattatttttttagaaatgtgcctctgtgcctgagacatgtaggcgagc

SEQ ID NO: 10016 - DNA, 98 bp, Homo sapiens
ttgaagcctaggggctggctacagtgcctgcagactgtgtgcagaccccaactcgctctctcagtggctgcggcactcttggtcttcaatatagtttc

SEQ ID NO: 10017 - DNA, 92 bp, Homo sapiens
gggtggggctgagaacagaactgagtgagcagtcagatacaaagacaccttccacccccagctgtttagttttactctcggtagagccaccc

SEQ ID NO: 10018 - DNA, 78 bp, Homo sapiens
tagttccagctactcaggaggctcaggtaggaggatcaattgatcctaggaagttgaggctgcagtgagctgagattg

SEQ ID NO: 10019 - DNA, 111 bp, Homo sapiens
actgaacatgggaaaagcatcttgcagcatggtggatggtaaatatatatattcttattttactttaagttccagatacatgtgcagagtgtgcaagtttgttatgtaggt

SEQ ID NO: 10020 - DNA, 107 bp, Homo sapiens
gaaatatgaaggagttttaggttagccacagttatcggaaaattcaaagaaatgaagtttcatgtagttatagccagaagctatttcatcttcccactgcgagtttc

SEQ ID NO: 10021 - DNA, 77 bp, Homo sapiens
gtgtgtgtgtataaaatatgtatgtatgtgtgtatatatattacatataaatacatatataaagtgtatatatttat

SEQ ID NO: 10022 - DNA, 63 bp, Homo sapiens
gtgtgttacacacacacatacacagagagagagagagagaggatgtgtgtgtgtgttatatgc

SEQ ID NO: 10023 - DNA, 98 bp, Homo sapiens
gagacagcctggaaaaagtcacacaagtgagtggcctgacagagccctctggacgcccctccctcccgtgcccaccccacttcattcacatgctgctc

SEQ ID NO: 10024 - DNA, 165 bp, Homo sapiens
tatatacgtgtacatatatatgtatatatacatatatacgtacacgtatatatgtatatatacatatatacgtacacgtatatatgtatatatacatatatacgtacacgtatatatgtatatatatacacacacatatgtgtgtgtatatatatatatatatat

SEQ ID NO: 10025 - DNA, 211 bp, Homo sapiens
tacatatatacgtgtacgtatatatgtatatatacatatatacgtgtacgtatatatgtatatatacatatatacgtgtacgtatatatgtatatatacatatatatgtacacgtatatatacatatatgaatatgtatatacgtatatatacgtatatgaatatgtatatatgtatatatacgtatatacatgtatatacgtatatatac

SEQ ID NO: 10026 - DNA, 80 bp, Homo sapiens
aacaaatatccttgaaagatgtgtggctggaggtgaggttgggctctagcggactagcatgctacagtaaggagtgtgtt

SEQ ID NO: 10027 - DNA, 116 bp, Homo sapiens
ggtttgctaggatatatattatgtatacactaaaatatataatatatatttaaatatataatatatatttatatgtaatatataatttagatgtataattaaattcttacaacatc

SEQ ID NO: 10028 - DNA, 85 bp, Homo sapiens
gtgggggcttcagccaatccagccacggatagagctctgatctctccctgtgacagagctcccagtggggaggggcagctgccat

SEQ ID NO: 10029 - DNA, 113 bp, Homo sapiens
gctgaagtatatcagcttaaggaattttttggactgagtctgttgagaaattttatatttatattcataaaggttattggtctgcagttttactttcttgtgatgtctttggt

SEQ ID NO: 10030 - DNA, 108 bp, Homo sapiens
tgcttaggattgtctcggctatatgggctttttggttccatatgaaatttaaagtagtttttttctagttctgtgaagaaagtcaatggtagcgtgatggggatagca

SEQ ID NO: 10031 - DNA, 121 bp, Homo sapiens
tatatatgtacatatattacaattgttatatatgtacatatatatacaattgttatatatgtacatatatatacaattgttatgtatgtacatatatatacaattattatatataaacatg

SEQ ID NO: 10032 - DNA, 110 bp, Homo sapiens
atgtttatatataataattgtatatatatgtacatacataacaattgtatatatatgtacatatataacaattgtatatatatgtacatatataacaattgtaatatatg

SEQ ID NO: 10033 - DNA, 117 bp, Homo sapiens
gtaagtgaaatgaatgattgcaacaacacaaggaatggaaggaaaaattgagattgtgttgttattataacatactcacattacctgtgcagcagtatagtgtcatttatttattta

SEQ ID NO: 10034 - DNA, 110 bp, Homo sapiens
agtgagtttcttgtagacaacatataatttggtcttgttttttgatccactctgacaatctctgtcttttgattggtgcatttagaccatggatgttcaaagtgattact

SEQ ID NO: 10035 - DNA, 89 bp, Homo sapiens
atattatgtccgtatgtgctcaatgtccagcccccacgtacctcagtgttaagtgggagctaaacactgagcacacatggacacaatat

SEQ ID NO: 10036 - DNA, 70 bp, Homo sapiens
ccccagctaggcttaggaatccttagttggcctaggaaatccagctagtcctgtctctcactctcagggg

SEQ ID NO: 10037 - DNA, 72 bp, Homo sapiens
gggattcaactcaggacaggcagccacgtgtgcctctgtccagaggccaccctgtctccctgagtgactccc

SEQ ID NO: 10038 - DNA, 64 bp, Homo sapiens
tggggcagccactcccagagcccctggaactctggcccaaggctctctgactgactccttccca

SEQ ID NO: 10039 - DNA, 112 bp, Homo sapiens
ttttaggagacatcactcaaatagctaaagttttcctgccatttaaatgtatttgcaaatgaaatgtaaattggtacaattttagaaaactatttggtagtatttactaaaa

SEQ ID NO: 10040 - DNA, 88 bp, Homo sapiens
tcttgtgccctgtccctctgtgtctgattcttgactggtcctttgcccgggcattactcaggctataaaaatagaggctggcaccaga

SEQ ID NO: 10041 - DNA, 127 bp, Homo sapiens
ctggtttagggattgtaggagcctgggtaccttgcttgaggctccacacctgcgaagtggtagagaactggatttgagcttggtctatatggttccaaagctctttttctaggtgatcacactggag

SEQ ID NO: 10042 - DNA, 95 bp, Homo sapiens
aacaaaggattgagatatatagacatgtttggtgtttaacttagatatggaaagtataaaacatttgacatgtatatggaattgctctttatgtt

SEQ ID NO: 10043 - DNA, 91 bp, Homo sapiens
gatgctactgcaggctgggaaattgtatttctatttcaaagatgggacaccaaggctcagaaaaatgaagacaaagtcccagcaccacatc

SEQ ID NO: 10044 - DNA, 99 bp, Homo sapiens
agtaggagttccctcggagtctgtgtggttcagtagtgttcttcagagagatgccccaagactgatgctcacggagagggccgactgggctttcctgct

SEQ ID NO: 10045 - DNA, 69 bp, Homo sapiens
ttgttttgagacacggtctcactctgtcacccaggctggagtgcagtggatgatcatagctcactgcaa

SEQ ID NO: 10046 - DNA, 118 bp, Homo sapiens
cactgatttttgttgtgttaattttgaatcctgccactttactaaatttgtttatcagttctaatagttttttggtggagtctttaggttttttccaaataagatcatatcatctgtg

SEQ ID NO: 10047 - DNA, 105 bp, Homo sapiens
taaactttcactcctgctctaaaactttcctcagtctctcactctgccttatgcactttggtcagactctttcttctgaggaggcaagaactgagtttgctgcag

SEQ ID NO: 10048 - DNA, 75 bp, Homo sapiens
agatagtacactgtagtgtgtctgcatttggtttgttctgaatgcttgcctagactaaaactgcagtctctctct

SEQ ID NO: 10049 - DNA, 97 bp, Homo sapiens
gccactgtgcctgacacacttttgtaatttcaagtcatcctatcaacaaacatttatgtaggtctgatctgtctgtgacagaaaactgtccagtggt

SEQ ID NO: 10050 - DNA, 69 bp, Homo sapiens
cctccatctcctgggagttctgctgctgtgttgactttactctcaggcaggctctttcccacatggggg

SEQ ID NO: 10051 - DNA, 74 bp, Homo sapiens
atgtgtgtatacatatacaggaaatgtatgtatatatgaatatacatatattcattgtatatgtgtatatatat

SEQ ID NO: 10052 - DNA, 95 bp, Homo sapiens; identical to SEQ ID NO: 68

SEQ ID NO: 10053 - DNA, 93 bp, Homo sapiens; identical to SEQ ID NO: 69

SEQ ID NO: 10054 - DNA, 82 bp, Homo sapiens
atgtcctcagagaggaaacagagcagaccagtgaggcagtactgatcactgcaagaacttaggttttccttctgagtgagat

SEQ ID NO: 10055 - DNA, 73 bp, Homo sapiens
ggtacaggagttggtcatcatcctgtttgttctcagacactttctctgactttggccttctctgatctgtatc

SEQ ID NO: 10056 - DNA, 85 bp, Homo sapiens
tggctgagtagtattccatgtatggatatgtgtacacacacacacacacacgtgcacacacacatacattttctttacccagtca

SEQ ID NO: 10057 - DNA, 116 bp, Homo sapiens
ctcccaaagtgctaaattacaggcgtgagccactgtgcctggttcactttcttattaattaaaaataatctggctgggtgcagtggctcctgcctgtaatcccagcactgtgggag

SEQ ID NO: 10058 - DNA, 83 bp, Homo sapiens
agccagagtaggcttgcacagactccctcaaatgtgaattttttttttttttttgaggtagagtctcgctctgtcgccaggct

SEQ ID NO: 10059 - DNA, 116 bp, Homo sapiens
agtttacctgcgaacagctaaaatcactgtcactttctactgtgaatctcatctctggctctttctctcatcctgattagcactggagtggctgtgggcattttgcggacccagct

SEQ ID NO: 10060 - DNA, 119 bp, Homo sapiens
cctcccaaagtgctgggattacaggcatgagccaccatgcctgacctctacaaaaagtttttttttttaaattagcgaggtgcagtggcacaaacctgtagtcccagctactccagagg

SEQ ID NO: 10061 - DNA, 110 bp, Homo sapiens
aatgtttgttcatcagtttgcctgaaatgttctaataaaagatttgtgttgataatatgtttttttcttcttatttcaagatatttcaaggtgtgctttttataaatatt

SEQ ID NO: 10062 - DNA, 94 bp, Homo sapiens
gttcctgtgtaagttcttgtactggtgggtcagaatacttttttttcttttgagacaaggtctcattctgtcacccaggctggagtacagtggc

SEQ ID NO: 10063 - DNA, 100 bp, Homo sapiens
ctggctggttttaaagttgtaggtttccaacttcttaaaagttattattttttaagaggataatttattttggttcttaactttaatggaaactggttgg

SEQ ID NO: 10064 - DNA, 65 bp, Homo sapiens
gggttcagtttagattgtgaggtttggctccaaccaacagagatcagacacagcagtaaggaccc

SEQ ID NO: 10065 - DNA, 56 bp, Homo sapiens
aaggtgtgtatgtatgtatgtatgtatgtatatatatatatatatatatatatttt

SEQ ID NO: 10066 - DNA, 86 bp, Homo sapiens
gttgagacaaggtctcactctgtcacccaggatggagtgcagtgtcacaatctcagctcactgcaacctctgcttcctgggctcag

SEQ ID NO: 10067 - DNA, 74 bp, Homo sapiens
ctcactctgtcactcaggctagagtgcagttgtgcaatcgtaactcactgcagccttcagtgcgggtctttgag

SEQ ID NO: 10068 - DNA, 107 bp, Homo sapiens
ccagtctcaggcagttctttatagcagtatgaaaatggtctaatacaattctccatagcatttcttttttttctttagacaaagtctacttctgtcacccaggctgg

SEQ ID NO: 10069 - DNA, 87 bp, Homo sapiens
acatttatgtatgcatatacatatatatgtatatttatgctatgtttatatatacatctgtgtgtgtgtgtgcatgcacgtatttgt

SEQ ID NO: 10070 - DNA, 95 bp, Homo sapiens; identical to SEQ ID NO: 68

SEQ ID NO: 10071 - DNA, 93 bp, Homo sapiens; identical to SEQ ID NO: 69

SEQ ID NO: 10072 - DNA, 115 bp, Homo sapiens
gcatgccactgcacaccagccaggacaacagggcaaaaccttgtctctaataataatatgtatttttttggagatggtgtctcgctctgtcgctcaggctggagtgcagttgcgc

SEQ ID NO: 10073 - DNA, 66 bp, Homo sapiens
ggggcaggtagactgggctgggccctctctcattccgtgtagtctcacagtctgtctctctgtacc

SEQ ID NO: 10074 - DNA, 114 bp, Homo sapiens
tgtaactaagccattgatgagactagtttccaatctaacactgtagcgaagagccacatttctttctttcttttttagatggagttttgctcttgtcacccaggctggagtgca

SEQ ID NO: 10075 - DNA, 123 bp, Homo sapiens
agattattgcatagaagtcagttctgtcctataaatgtttttgaaaatatatatatatattcatgtgtcattgagaagaaaacatgggccaggtgtgctggctcatgcctgtaatctcagcac

SEQ ID NO: 10076 - DNA, 107 bp, Homo sapiens
gccagttttacttacttccttgccaggagtgtttaggttcttttttttttttttttcttttttgagatggagtctcactctgtcgcccggggctggagtgcaatggc

SEQ ID NO: 10077 - DNA, 78 bp, Homo sapiens
ttagcctgggttcagatcccagcttttttttcttttttctttttttgagacaggatctcgctctgtcactcaggctga

SEQ ID NO: 10078 - DNA, 98 bp, Homo sapiens
aatcattttgaaaataggaactgtagacagctctttggtacatttgaattatatgtttaaatattgaataatgtatgcagttttatatttcagagatt

SEQ ID NO: 10079 - DNA, 80 bp, Homo sapiens
taggagaaggaagtctcactctgtcacccaggctgcagtgcagtgaaatgatcagagctcactgaagccccgacctcctg

SEQ ID NO: 10080 - DNA, 66 bp, Homo sapiens
gctcacagtctggcagatgagacgtctgtgtgcacacacgcatcacatgcacgcactgtcatgagc

SEQ ID NO: 10081 - DNA, 133 bp, Homo sapiens
atggtacttgaaactggagtagaaattgagatgctgttgaaagtctgtggtagggcaccttttttttttttcttgagatagtctcactctgccacccagtctggagtgaaatggtataatcttggctcactgc

SEQ ID NO: 10082 - DNA, 92 bp, Homo sapiens
agcctcatattacttcaggtcaggtttgacctccaagcaattccagctccagtcagatttggcatgaaatgaattatgaaacacttttggtt

SEQ ID NO: 10083 - DNA, 92 bp, Homo sapiens
gggactgcggatgtgagggcatgggcggggtggagagggagttcagcaaccctcctctgggctcccactgtgcctgtgcccacctgcatcct

SEQ ID NO: 10084 - DNA, 76 bp, Homo sapiens
tcactacctctctctggctcacttccccatctgcagatggaggagcatatgagctgggctttgaaggatgagtaga

SEQ ID NO: 10085 - DNA, 74 bp, Homo sapiens
gtgtcctcagacagtctctctctcacttgtgggataaccctaagtgaataagagctggtgtgacttgagctcac

SEQ ID NO: 10086 - DNA, 95 bp, Homo sapiens
tgacagatagacaaccgggcagcaagagggttgaattttgggagactgcactagctcctttttttttttttttgagacagtgtctcactctgtca

SEQ ID NO: 10087 - DNA, 70 bp, Homo sapiens
tatatatctatatatctatatctatatctatatagatagatagatagatagatagatagatagatagata

SEQ ID NO: 10088 - DNA, 58 bp, Homo sapiens
tgaggcagagtctcgctctgtcacccaggctggagtgcagtggtgtgatctctgctca

SEQ ID NO: 10089 - DNA, 106 bp, Homo sapiens
ggtttcatgtagcagtgccagagaatgtgggaatgaaaatgctagagagtcagctgacaaaaggccatgaagtccagcatccaaagtgtatgagaacatgaaggcc

SEQ ID NO: 10090 - DNA, 64 bp, Homo sapiens
ctggcagccactcccagagccgctggaactctggcccaaggctctctgactgactccttcccag

SEQ ID NO: 10091 - DNA, 110 bp, Homo sapiens
ttttagagcaagcatggtattttcattaagcaaaattatatatttttttacttacagcattttaaagtataatttgtgttgtgtgttaaataccagtgattcagctaaga

SEQ ID NO: 10092 - DNA, 58 bp, Homo sapiens
tgagacagagtctcactgtgtcccccaggctggagtgcagggacgtgtactctgctca

SEQ ID NO: 10093 - DNA, 93 bp, Homo sapiens
tataatagatcaaatatgagcctggctcccagtatggaaaaatctgggaaatgtacatactgggtctaaccatagtcaatatcagattttata

SEQ ID NO: 10094 - DNA, 114 bp, Homo sapiens
aggtgtggccatttataaggctgtgggcaatgtagcaatgtaagagtcagtggtatacaactgattttcaagacaacagtagacatatgtcaaaccttatgcatgattatttct

SEQ ID NO: 10095 - DNA, 117 bp, Homo sapiens
gcattagatctatgtccttgaataactttcctgatccaagatttgaacaaagtacagaagtgtttaagttgttgtttagacttgccagagaacagagaagtgactggaacgagttgc

SEQ ID NO: 10096 - DNA, 74 bp, Homo sapiens
gctgggcatggtggtgcatgcctgtagtcccaggtactcgggaggctgaggtaggaggatcacttgaacccggt

SEQ ID NO: 10097 - DNA, 102 bp, Homo sapiens
tgttctggtgccttggtctcagaattctcagcctcaagaactgtgagaaaatacttgtatgttctttataaattattcaggccgtggtattatgttagagca

SEQ ID NO: 10098 - DNA, 121 bp, Homo sapiens
tcctgtcatcaaagaaaaccatgcatgagaaaaagaagagtctggaagaagtttcaatgttaatatataatgacatttcacctacgtctcatctattctctttcaaaatgtggactccttg

SEQ ID NO: 10099 - DNA, 113 bp, Homo sapiens
ggcaagatgacatgagacattttccatcatatttcatcggctgatgaattttaaatatacagtagtcagagagcagatgacaatgtaatgatgtgtctctgtaccatttcccc

SEQ ID NO: 10100 - DNA, 86 bp, Homo sapiens
cccatgattcaattgtctctcactgggtccctcccaaaacacgtgggaattatgggagctacaattcaagatgagatttggatggg

SEQ ID NO: 10101 - DNA, 76 bp, Homo sapiens
gtttgttttttgaggcggagtctcgctctgtcgctcaggctggagtgcagtggcacgatctccgcttactgcaagc

SEQ ID NO: 10102 - DNA, 96 bp, Homo sapiens
ggacaacacctccctctctatattgccataatcaagatgggcaagggaggtcatctcttttctctcgctctcactgatggcaataggaacgtttcc

SEQ ID NO: 10103 - DNA, 79 bp, Homo sapiens
ggtcactgggcatttagggtggtttcatagttttacaattgcaaattgtgttgctgtaaacatgcatgtgcaagtgtct

SEQ ID NO: 10104 - DNA, 61 bp, Homo sapiens
gaggcggtgtgtcactctgtcacccaggctggagtgcagtggcacgatcttgactcgctgc

SEQ ID NO: 10105 - DNA, 112 bp, Homo sapiens
gtatatagaaagaagtcttggaattgctagatcaaatggaattcagagtttatttttattagataccttaaactgttgtccaaaagattgcaattattatctttctctatcc

SEQ ID NO: 10106 - DNA, 75 bp, Homo sapiens
tgagaactttgtgcctgtcacaggggtgatcattttaaatatattgtttccctgttgatgaatggaaggtactca

SEQ ID NO: 10107 - DNA, 122 bp, Homo sapiens
tgtgtatatatatgtatgtatgtgtgtgtatatatatgtatatatacacacacacacacacacacacagagagagagagagagacagagagagagtcttgctctgtctcccaggctgaagtg

SEQ ID NO: 10108 - DNA, 106 bp, Homo sapiens
atatatatatatatatatatatatatatatatatatatatatatatatatatatatatatatatgtatgtatgtatatatgtatgtatatatatatgtatgtatgt

SEQ ID NO: 10109 - DNA, 87 bp, Homo sapiens
aatggggatttttattatattgaatttataaatgaatttgggagaactgtcattttctaattcaaatatatgatacacttctccatt

SEQ ID NO: 10110 - DNA, 139 bp, Homo sapiens
tcctggctgcatctattctggaaacttagctccctcttcattattattattactattattattattgttattattttgagacaggtctggctctgtcactcaggctggagtgcagtggagtggtcttggctcactgtaa

SEQ ID NO: 10111 - DNA, 110 bp, Homo sapiens
cccctttgttaaccacatgcaagttttgcaatgggtcaaggattctatatatataaatgaaatcctataatttttgcctgttgagaaactagggtttgggggttgcaaag

SEQ ID NO: 10112 - DNA, 123 bp, Homo sapiens
gtatgtatatgtacatacatatagatagtacttacctgtactaatatagtgtatgtatatgtatatatagtgtatgtatatgtatatacatgtatatatacatacactatattagatagtaca

SEQ ID NO: 10113 - DNA, 93 bp, Homo sapiens
tcagccttggcagacttggttttgtttttgtttttttttttttattttttattttgtttttggaggtagagtctcgctctgtcactaggctgg

SEQ ID NO: 10114 - DNA, 112 bp, Homo sapiens
tatgtgtatacatatatccatggatatatatgcacacaaggtatatatacatatatgtatatatacacatatgtatatatgtgtatatatatccatgtatagtatatatatg

SEQ ID NO: 10115 - DNA, 104 bp, Homo sapiens
tatatatactatacatggatatatatacacatatatacatatgtgtatatatacatatatgtatatataccttgtgtgcatatatatccatggatatatgtata

SEQ ID NO: 10116 - DNA, 188 bp, Homo sapiens
tatatacagatatttgtgtatatatatatccatgtatatatatgtgtacacatatatacagatatatgtgtacacatatatatctgtatatatgtgtatacatatatatctatacagatatatgtatacacatatatatatctgtatatatgtgtatacatatatatctccacatatatatatacaca

SEQ ID NO: 10117 - DNA, 103 bp, Homo sapiens
atatatatatctgtgtgtgtatatatatatgtggagatatatatgtatacacatatatacagatatatatatgtgtatacatatatctgtatagatatatatg

SEQ ID NO: 10118 - DNA, 63 bp, Homo sapiens
tttctgtgggtcagaaattcagaacctgctttatagggtggccctgactctgactctcagagg

SEQ ID NO: 10119 - DNA, 111 bp, Homo sapiens
tgttacactagcaaataacctggctgcactttgttcatgtcctagacatctaaagaagtttgaacctatgaattataacatggtgcctggcagaagaaatttctagcagca

SEQ ID NO: 10120 - DNA, 90 bp, Homo sapiens
ggcaattttgcaaatttgcacatgtaagggaaacaaaatttaatgttttttttccagaggtgtgatacattaataactttgtttattgtc

SEQ ID NO: 10121 - DNA, 120 bp, Homo sapiens
gaatgtgtatatgtgaatgtgtatatatatgtgtatatatgtgtgtgcatatatatgtatatatgtgtgtgtatatatttgtgtatatgtgtgtgtgtgtatatatatatatacacacat

SEQ ID NO: 10122 - DNA, 95 bp, Homo sapiens; identical to SEQ ID NO: 580

SEQ ID NO: 10123 - DNA, 93 bp, Homo sapiens; identical to SEQ ID NO: 69

SEQ ID NO: 10124 - DNA, 181 bp, Homo sapiens
atatatatatatatatatatatatatgtgtgtgtgtgtgtgtgtgtatatatgtgtatatatgtatatatatatatacacacacatatatacacatatatgtgtatatatgtgtatatatatgtgtgtgtatatatctatacacacacatatatacacacacacacacacatatatatata

SEQ ID NO: 10125 - DNA, 115 bp, Homo sapiens
actctgttgtgagatggtatcttactgtggttttgatttgcacctaacgattagtgattttgatcatttttttatatgcttctttgctatgtgtatgtattctttaaaatagtgt

SEQ ID NO: 10126 - DNA, 82 bp, Homo sapiens
aaggaccctatttatttgtatttaacctatgcagggaggtatatactctccctgcatactttgaatcacctctagattactt

SEQ ID NO: 10127 - DNA, 65 bp, Homo sapiens
atgcactcacatttcattatatatatgtgtgtgtgtatatatatataatgtgtgtgtgtatgtat

SEQ ID NO: 10128 - DNA, 58 bp, Homo sapiens
tgagaaggagtctcactctgtcacccaggctggagtgcagtggtgtgatctcagctca

SEQ ID NO: 10129 - DNA, 95 bp, Homo sapiens; identical to SEQ ID NO: 68

SEQ ID NO: 10130 - DNA, 93 bp, Homo sapiens; identical to SEQ ID NO: 69

SEQ ID NO: 10131 - DNA, 97 bp, Homo sapiens
atatgctggcttaatatacagacaacatatatatatatgtaaatccacattgtttacatgtatatgatatatgtatatgtttgtatggtgtgcgtgt

SEQ ID NO: 10132 - DNA, 58 bp, Homo sapiens
tgagttggagtctcactctgtcacccaggctggagtgcagtggtgtgatttcagttca

SEQ ID NO: 10133 - DNA, 97 bp, Homo sapiens
ccagtgtgtttttgtatgtatgtgtatatatatacatgtgtatatatgtgtgtgtatatatatatgtgtatgtgtgaatgtgtatatatatattcgg

SEQ ID NO: 10134 - DNA, 115 bp, Homo sapiens
ccaagtggcaggaagaagaggtgaaaagggagggttttcttttccatagcttttttttttttttttggttagagagacgaactctcctctctcagagttttcggtacctgcctgg

SEQ ID NO: 10135 - DNA, 73 bp, Homo sapiens
gagtcatagtcagaccttgtgcctgagtggacacatctgtctgattcagggataaagggttaccctctgatcc

SEQ ID NO: 10136 - DNA, 109 bp, Homo sapiens
tcttacgagatcaagaaagttctatatttctagattgttgagtatttattgtttttatcaataaagagtagtggattcttttgaatattttttctgtcatctattgaga

SEQ ID NO: 10137 - DNA, 115 bp, Homo sapiens
gaaaacacatgaattttcctgaatatgatttcctctatataatttctgtatataattgtatacaaatcttgtatacagaaatctcctgtttataatttcttatgtacaatttttc

SEQ ID NO: 10138 - DNA, 66 bp, Homo sapiens
ttgagcctatgtgtgtctctgtatgtgagatgggtctcctgaatacagcacactgatgggtcttga

SEQ ID NO: 10139 - DNA, 116 bp, Homo sapiens
tagatctgtaaaggagcttagagtacatacaggtggagagacatcagatgtgtgtgagcagacccttatgtacttctccatcttcatctctaagaatgtctccctcttttgctctg

SEQ ID NO: 10140 - DNA, 68 bp, Homo sapiens
ggctcataggcagagggcaggctctgagacatctgccttgtctcagatgagactctggactgtggact

SEQ ID NO: 10141 - DNA, 99 bp, Homo sapiens
ttgcagaacttttgggtaagaggggctaggtttcgtgctttttatatgtctctagtatagcaagcactcgacaaatattctttaaataaatagctgtag

SEQ ID NO: 10142 - DNA, 79 bp, Homo sapiens
tatgcatatgtgtatatgtatctgtatatatataattacttgcatatatatacttactgcatatatatttatatgcata

SEQ ID NO: 10143 - DNA, 114 bp, Homo sapiens
aaatatatatatatgtgtgtatatatatgtgtgtgtgtatatatatatatttatatacatatatattcatatatatatttatatacatatatattcatatatatatatatattt

SEQ ID NO: 10144 - DNA, 99 bp, Homo sapiens
gtacatatatgtgtattacatatgtatatataacatactatatatttatattatatatacgtatattatatatgtacatacaacatactatatatgtat

SEQ ID NO: 10145 - DNA, 95 bp, Homo sapiens; identical to SEQ ID NO: 68

SEQ ID NO: 10146 - DNA, 93 bp, Homo sapiens; identical to SEQ ID NO: 69

SEQ ID NO: 10147 - DNA, 117 bp, Homo sapiens
cattacatgcacttttaactcatgatatattttacttagatggttctatagtttagatttttgacccattagacctcaggttgaaattgatccccaatgttggaggtgggcctactg

SEQ ID NO: 10148 - DNA, 65 bp, Homo sapiens
acacatatatgtgtctatgtatatgtatgtgtgtgacatatatatatatatgtatgtgtgtgtgt

SEQ ID NO: 10149 - DNA, 109 bp, Homo sapiens
atgtggagaatgatgtcttgtatgcagtaggtgcttattaagacttgtgtttttattgataaacatatgacagaattgatgagcagccaaggaaagataatttctacat

SEQ ID NO: 10150 - DNA, 95 bp, Homo sapiens; identical to SEQ ID NO: 68

SEQ ID NO: 10151 - DNA, 93 bp, Homo sapiens; identical to SEQ ID NO: 69

SEQ ID NO: 10152 - DNA, 100 bp, Homo sapiens
tctctctctatgtatatatatgtgtgtatatatatatgtgtgtgtatatatgtgtgtgtatatatgtgtgtgtgtgtatatatatatatatagagagaga

SEQ ID NO: 10153 - DNA, 95 bp, Homo sapiens; identical to SEQ ID NO: 580

SEQ ID NO: 10154 - DNA, 93 bp, Homo sapiens; identical to SEQ ID NO: 69

SEQ ID NO: 10155 - DNA, 102 bp, Homo sapiens
ctgcaatgactcttcatatatatatatgaatatgtatatgtatatatatgtatatatatatatatatatgtatatatatatttatgagaaagagacagacag

SEQ ID NO: 10156 - DNA, 116 bp, Homo sapiens
aaactgcctgttcagctcctttgctctttttttaagggggttatttttttttcttgttgatttatataatttccctgtagattccagatattaggcctttgttggatgcatagttt

SEQ ID NO: 10157 - DNA, 76 bp, Homo sapiens; identical to SEQ ID NO: 9981

SEQ ID NO: 10158 - DNA, 116 bp, Homo sapiens
gatttctgaggagtgacttcatggtatgttctaaggtgaataacagcagtctttatttatttaaagtttgtcagtggttttcttgagcaatgaaggcagactactttttttttttc

SEQ ID NO: 10159 - DNA, 117 bp, Homo sapiens
atctgtttttgttcgtatcaacactgagtagcatttgtaaagctgcattttatttgtgttttaatttctatgaaatgtctcacaagatgtttttcatctttgaaaagaactgctggt

SEQ ID NO: 10160 - DNA, 112 bp, Homo sapiens
taacgttcttcaatttaaatatatgtgcatgtgtatgtatatatatatatatatatatatatatatatatatatatatatattttcatggtcatttgaagaaatatcagtta

SEQ ID NO: 10161 - DNA, 89 bp, Homo sapiens
ctcttggatggcatttctagacttgccctaggccagaagggagccaacatcctaggtcaggcagcattcatgaaaaacacatttaagag

SEQ ID NO: 10162 - DNA, 92 bp, Homo sapiens
cagatgaataaatggaagtttagcaagtttatgacttgtgcaaatcctcacaggtagtaagttgttgaattttaacaaactctatttgattc

SEQ ID NO: 10163 - DNA, 93 bp, Homo sapiens
gagtaatcattcatatatgtatatatatacatacatacatacatatatgtgacatatgtgtagttttatatttgtatttatggtcttctactc

SEQ ID NO: 10164 - DNA, 103 bp, Homo sapiens
tttgggtaagggtaacttttctttctttcttttattatttttttttggggggaggtctcgctctgtcacccaggctggagtgcagtgtgatgtgatctctgct

SEQ ID NO: 10165 - DNA, 79 bp, Homo sapiens
ttgggttttgagatggtcattatggccactgggtggagaacagattgggtgacagccagggtgaagtcagagagctcag

SEQ ID NO: 10166 - DNA, 100 bp, Homo sapiens
tatgtatatgtatatagctatgtatatgtatttatatttatatatgtatgtatgtgtgtatatatgtatgtatatttccatatgtatgtgtatctgtatg

SEQ ID NO: 10167 - DNA, 72 bp, Homo sapiens
tagtcccagctactcaggaggctgaggtaggaggatcgcttgagcctgagaattcgagtctgcagggaactg

SEQ ID NO: 10168 - DNA, 191 bp, Homo sapiens
tatatacaaatatatatttatgtatgcatatgaatatatatgcatataaatatatatttatgtatgcatatgtatatatttataggtgcatatatataaatatttatatttatatatgcatataaatataaatatatttatatttatatgcatatatatgcacatatatgtatatatgcacatatatgtat

SEQ ID NO: 10169 - DNA, 74 bp, Homo sapiens
gaggcagtgagctatgatcgcacctctgccctttagcctgggtgtcagagagtgacagagtgagacagtgcctc

SEQ ID NO: 10170 - DNA, 71 bp, Homo sapiens
ttgtttttgagacaaggtctcactctgtcacccaggctggagtgcaatggtgtgatcttggctctctgcag

SEQ ID NO: 10171 - DNA, 105 bp, Homo sapiens
catagaacagatgatatatatacatacacacatatatgtacatatagtatatttatgtatatacagtatacatatatgtgtgtatgaatatgcatcatatatatg

SEQ ID NO: 10172 - DNA, 97 bp, Homo sapiens
aatttaaacagagatgctctggaagcagcatttgaaatgaaaagatcttacagcattctttatttcatatgttctttcttttatgtgtgttgagatt

SEQ ID NO: 10173 - DNA, 115 bp, Homo sapiens
tgtctattgcataccactcatttttgtgcctggtgtgaaagttactctttgtgatatgtaatagagaatgttgttgaagctggttcaaaaattaaaagtgttaagcaaatagtca

SEQ ID NO: 10174 - DNA, 58 bp, Homo sapiens
tgagactgagtctcgctctgtcacccaggctggagtgcagtggcgtgatctcagctca

SEQ ID NO: 10175 - DNA, 56 bp, Homo sapiens
gagactgagtctcgctctgtcacccaggctggagtgcagtggcgtgatctcagctc

SEQ ID NO: 10176 - DNA, 97 bp, Homo sapiens
agacatcagtaatgttcagtggttctctgactgaggtatttttttttacatttaaggagtcatctaggggagtctcactgataagatgctgttctct

SEQ ID NO: 10177 - DNA, 94 bp, Homo sapiens
ggtggtcagagtcactattttccaggggataatatataattgatttatcatcatatactctctttctctgtcaacttgactcctttgagccatt

SEQ ID NO: 10178 - DNA, 108 bp, Homo sapiens
gctgatcactgaagtaatgtgcacatattactttgttttttttaatatttattttattattattatactttaagttttagggtacatgtgcacaatgtgcaggttagt

SEQ ID NO: 10179 - DNA, 95 bp, Homo sapiens; identical to SEQ ID NO: 68

SEQ ID NO: 10180 - DNA, 93 bp, Homo sapiens; identical to SEQ ID NO: 69

SEQ ID NO: 10181 - DNA, 74 bp, Homo sapiens
tccatgtgattttgtagtttacaaaagctccctgccattgcagcttttgtaaactataaaacccttgcaaagga

SEQ ID NO: 10182 - DNA, 89 bp, Homo sapiens
aggagatacaataggagatatatatatatatatatatatatatatatatatatatatatatatatatatctcctattagttctgtccct

SEQ ID NO: 10183 - DNA, 178 bp, Homo sapiens
gcctatgtacctcttactactctactgatagagtagtaagattagtagtgattttaatgaattttactacttaccgctctacctgatagagtagtaagaggtatataggcatgtatatatatatatatatatatatatatatatatatatatatatatatatatggtatataggctta

SEQ ID NO: 10184 - DNA, 97 bp, Homo sapiens
tttatcataatggatgttgagttttgttaagtgcttttcctatgtctactgggataatcatataatttttttcttttttatctatgaaaatggtgaa

SEQ ID NO: 10185 - DNA, 92 bp, Homo sapiens
ggttggtttgttttgagatggagtctcactctgtcacccaggctggagtgcagtggcacaatctcagctcacagcaacctctacctcctggg

SEQ ID NO: 10186 - DNA, 77 bp, Homo sapiens
ggtctttagtagcacatgagaaagactatccccagtgatgtgcttatgatgttgtgttctcattgtagcctagggct

SEQ ID NO: 10187 - DNA, 77 bp, Homo sapiens
gggaaaatcacaccttttgtcttcgtaaatctatgtcctgcttttgagcaaatagagagaagacagagagctttcct

SEQ ID NO: 10188 - DNA, 104 bp, Homo sapiens
tgattgattatcaatgaacatgaaaaaacatagaatcatttcccataatgctagttggttgtattctgtaactgttcttttctatttattgattttctggatca

SEQ ID NO: 10189 - DNA, 74 bp, Homo sapiens
gctgctcagtgaagattatagagaggggatgcaatttgttctgagctttgaagtctgggcaggatttgagtggc

SEQ ID NO: 10190 - DNA, 105 bp, Homo sapiens
agagaggtagagataatagatgcaaactcttggaaggaaagctgtactgatctaaccaagatattttgtttttctcatccaccagtcactttctcagtcctttct

SEQ ID NO: 10191 - DNA, 98 bp, Homo sapiens
ggatatgccaggaagttgatgctggttatctattttccatgggaaggcagtgctttcagtgtttctacttgtgtgactggcatttttctctgttttcc

SEQ ID NO: 10192 - DNA, 87 bp, Homo sapiens
aaacaaactctctctatatatctgtatatatatagagagagagtataatatatagagagagtatatgtatatagagagagtttgttt

SEQ ID NO: 10193 - DNA, 113 bp, Homo sapiens
gcatgtgaaattttaaattactctttatccatatatatgcatatgtgtgtatgtgtatataatcatatatatatgtatctaatcaatatagttgagagattaagagcacaagt

SEQ ID NO: 10194 - DNA, 106 bp, Homo sapiens
ccgcgagtgatctgccagcctcggcctcctgaggtgctgggattgcagacggagtctctcattcactcagtgctcaatgttgcccaggctggagtgcagtggcgtg

SEQ ID NO: 10195 - DNA, 56 bp, Homo sapiens
gagacagagtctcactctgtcgcccatactggagtgcagcggtgtgatctcggctc

SEQ ID NO: 10196 - DNA, 79 bp, Homo sapiens
gtgtgtgtgtgtgtgtgattttttcctttatattgaataatgccaattaaatgtttctggtcacacatctgcagagcat

SEQ ID NO: 10197 - DNA, 60 bp, Homo sapiens
gtatgtgcttggtatggatgcatcactcagccctgaatcagcatcagtatctggcactgc

SEQ ID NO: 10198 - DNA, 56 bp, Homo sapiens
cagtgtctcactctgtcacccaggctggagtgccatggggcgatcctggctcactg

SEQ ID NO: 10199 - DNA, 114 bp, Homo sapiens
aagtttggaagtattccctgcctttctattttttggaaaagtttgagaaggattgatatttattcttctttaaatgtctggtagaattcaccagtgaagtcaggtcctcggctt

SEQ ID NO: 10200 - DNA, 66 bp, Homo sapiens
atatatgtgtatatatatacgtgtatatatgtgtgcatatatatgtgtgtgtatatatatatgtat

SEQ ID NO: 10201 - DNA, 58 bp, Homo sapiens; identical to SEQ ID NO: 2758

SEQ ID NO: 10202 - DNA, 71 bp, Homo sapiens
ttgtttttgagactgagtctcgctctgtcacccaggctggagagcagtggtgtgatctcaactcattgcaa

SEQ ID NO: 10203 - DNA, 104 bp, Homo sapiens
ccggctgctaggagagcccaggggaggcagtgtcaattaagaaaggctctttttttttttttttttttttttgagacggagtctcgctctgtcacccaggctgg

SEQ ID NO: 10204 - DNA, 81 bp, Homo sapiens
tagatgtttatatgtatacatgtatctatacatacatatacaatatatgtgtgtctatatatatgtatacatatatattta

SEQ ID NO: 10205 - DNA, 99 bp, Homo sapiens
ttgtaggggggcgcatctatacattgacctgtttcttgactctagtctttctgtccttggccaagactctgtctctctgtttctgacgcctcttcatga

SEQ ID NO: 10206 - DNA, 111 bp, Homo sapiens
atgtctgaccagcctaagaccatcgtgccagagaagccacgtgtaagcactccagttgacagaatccactgagccctgttttgtaggcttccctgtcaaggcaccagacat

SEQ ID NO: 10207 - DNA, 85 bp, Homo sapiens
ctaccttgacagagcctgatggtgtctcagagtaggaagggcagttgggacatttcttgagattttgaagttgagtttaaggtag

SEQ ID NO: 10208 - DNA, 115 bp, Homo sapiens
tctgttttcttcccatgtgtacatacatgtgtagtatgtacaaatatatgtatgtgaatatattaatgtatttgtacgtgtgcatatatatacataaacacagacatatgcacat

SEQ ID NO: 10209 - DNA, 56 bp, Homo sapiens
gtatgtgcatgtgtgtgtgtgtgtgtatgtatgcatgtatgtatgtatgtatgtat

SEQ ID NO: 10210 - DNA, 82 bp, Homo sapiens
cttcctttctgacttggatgccttctatgtctttctcacctgattgctctggctaggactgaagtactaggttgaatagaag

SEQ ID NO: 10211 - DNA, 65 bp, Homo sapiens
gctgtgtgaccttgggctactcattcaacctctctgggtgtctgagtctcaaaggtggagcatgc

SEQ ID NO: 10212 - DNA, 96 bp, Homo sapiens
atttcattatatgtatatgtgtatatatacatatgtgtatatatatatacatatgtgtgtatatatatacacacacacatatacatataatgaaat

SEQ ID NO: 10213 - DNA, 99 bp, Homo sapiens
cttgtcaattcaggacaccactgctgtcctacagataggaagacactctgcctctctctgaccctgtgaatatagctaaagtctcgaaatatatgcaag

SEQ ID NO: 10214 - DNA, 95 bp, Homo sapiens; identical to SEQ ID NO: 68

SEQ ID NO: 10215 - DNA, 93 bp, Homo sapiens; identical to SEQ ID NO: 69

SEQ ID NO: 10216 - DNA, 109 bp, Homo sapiens
cactgtagcctgggtgacacagcaagaccttgtctcaaaaaaaaaaaataataataatttttttaaaaaagacagggtctctctctgtcacccaggctgctctcaagtg

SEQ ID NO: 10217 - DNA, 69 bp, Homo sapiens
ggagacctgcagcactgacagtcagtggttcagacacatgagcccggaccccagtgctgtcatggaccc

SEQ ID NO: 10218 - DNA, 93 bp, Homo sapiens
tcatcacattagggagtacagtttcaatatgtgaattttgaggggacacaagtattcagtctgtaacactctctgagccctctctgtggatga

SEQ ID NO: 10219 - DNA, 86 bp, Homo sapiens
ccactgcagggtggctggctgtttcccccaccaccatcagattcctgtcccagggattcacccagtcctcccttaaagtcagttgg

SEQ ID NO: 10220 - DNA, 69 bp, Homo sapiens
gtgggagcagaggtctcactcactcagtgtaaaattcctttacaggactgtctcagtctcttctcctgc

SEQ ID NO: 10221 - DNA, 95 bp, Homo sapiens; identical to SEQ ID NO: 580

SEQ ID NO: 10222 - DNA, 93 bp, Homo sapiens; identical to SEQ ID NO: 69

SEQ ID NO: 10223 - DNA, 110 bp, Homo sapiens
tgcttaggattgtcttggctatatgggctcttttttggttccatatgaaatttaaagtagttttttctaattctgtgaagaaagtcaatggtagcttgatgggaatagca

SEQ ID NO: 10224 - DNA, 112 bp, Homo sapiens
ggattgtcttgactattcaggctcttttttggttccatatgaaatttaaagtagttttttctaattctgtgaagaaagtcaatggtagcttgatgggaaaagcattgaatct

SEQ ID NO: 10225 - DNA, 73 bp, Homo sapiens
gagccactgggacacaagggagctttttcttcagatatctgaagcaaaggcagactctctttctctgtgcctc

SEQ ID NO: 10226 - DNA, 111 bp, Homo sapiens
ggtagagagaagagagttagagagcaagaagagagacaatgtatcaaaatttgtatttcataatgtgaataatattccctcatttttttttctgatttctgagcttttacc

SEQ ID NO: 10227 - DNA, 100 bp, Homo sapiens
cattgctattgggtattactgcttctagattcttttagaggacagagctaggaaatatctgtctatctgtctgtctatgtagattattccaattccagtg

SEQ ID NO: 10228 - DNA, 109 bp, Homo sapiens
gcagagaaggtgctgttacttgtagaaatctgtctttgcttttctaggtggtagcattggtaaccttcctggaatggtgatgaggagaatggaaacaccaccttctagc

SEQ ID NO: 10229 - DNA, 58 bp, Homo sapiens; identical to SEQ ID NO: 1409

SEQ ID NO: 10230 - DNA, 78 bp, Homo sapiens
aggagtgcctgtcttctgttcttagtattaagttttccttaccagcttggtacaggcccagtttataggggagctctt

SEQ ID NO: 10231 - DNA, 58 bp, Homo sapiens
tgagatggagtctcactctgtcactcaggctagagtgcagtggtgcgatctcagctca

SEQ ID NO: 10232 - DNA, 85 bp, Homo sapiens
tgctgtattttttaattagacagaagtatgtgagctcaaagagatgttgactcaaaggcttttggcataatttgaaatgaatgca

SEQ ID NO: 10233 - DNA, 95 bp, Homo sapiens; identical to SEQ ID NO: 68

SEQ ID NO: 10234 - DNA, 93 bp, Homo sapiens; identical to SEQ ID NO: 69

SEQ ID NO: 10235 - DNA, 88 bp, Homo sapiens
gtgtctctgcagctgctagcccttcttgttgaccatggagaaatatatcccatcagatattatagagatttagttgtaggggattaac

SEQ ID NO: 10236 - DNA, 81 bp, Homo sapiens
tgttagggtgttgacttgagattttctagctttctgatctgggtatttagtgctataaatttccctcttaacactctttta

SEQ ID NO: 10237 - DNA, 101 bp, Homo sapiens
atgtaaatgcacatgtttgtatacataaatattcatacatgtataaatatattttacacatgtatataaagtgtgtaatatagacacatatgtatgtatat

SEQ ID NO: 10238 - DNA, 103 bp, Homo sapiens
gcctttgtggagaaagaaggatggatacagggcacagactgactgactgctatgtggcaggcactactgtcagtgctttaaccccaccaatttgtgcaatcgc

SEQ ID NO: 10239 - DNA, 97 bp, Homo sapiens
ggcgacagagtgagactccatcccaaaaaacaattaaaaaaaaatcactaagttaattaagttttaattttttgagacagagtctcgctctgtcacc

SEQ ID NO: 10240 - DNA, 99 bp, Homo sapiens
ctttaactgtgacagtgtctgacagcatagcggtcatttcattttgtacttttgttcacttttaatgtcagatccaaaaaaacatggcaatagttaaag

SEQ ID NO: 10241 - DNA, 58 bp, Homo sapiens
tgagacggagtctcacactgtcacccacgctggagtgcagtggtgtgatctcggctca

SEQ ID NO: 10242 - DNA, 107 bp, Homo sapiens
tattatggcgaggaacacggattctatcacagagtcaaaatgtactcttatatttattattttacattacgattttaggaaagaaaaatattttctttgctttaata

SEQ ID NO: 10243 - DNA, 111 bp, Homo sapiens
gtgggaatttcaggggtgatcttcaaatcctgtctgccacactgactatttactgggtattaagagggtgagagcaaaaaggaatatatttgacttgatctgtgattgcac

SEQ ID NO: 10244 - DNA, 75 bp, Homo sapiens
ttcttaaacatttagatcaatatactctcaaattgccattatgtgtttgagtgtgtgtctgtatgtgtgtgagag

SEQ ID NO: 10245 - DNA, 97 bp, Homo sapiens; identical to SEQ ID NO: 1307

SEQ ID NO: 10246 - DNA, 88 bp, Homo sapiens; identical to SEQ ID NO: 1308

SEQ ID NO: 10247 - DNA, 81 bp, Homo sapiens; identical to SEQ ID NO: 1309

SEQ ID NO: 10248 - DNA, 77 bp, Homo sapiens; identical to SEQ ID NO: 1310

SEQ ID NO: 10249 - DNA, 82 bp, Homo sapiens
tgggggaaatataattgggagagaagggaattaatgctatcaggtgtctcttaatttctcagtctctctcatattaccccca

SEQ ID NO: 10250 - DNA, 99 bp, Homo sapiens
acatagatgtgtatatgtgctatggatgtgtaaatatttagttatatagtctgaattttatacaatgtggtacatattttctgttgcaatgttctatgt

SEQ ID NO: 10251 - DNA, 64 bp, Homo sapiens
tattgagacagagtctcgctctgtcacccaggctggagtgcggtggcatgatctctgctcaatg

SEQ ID NO: 10252 - DNA, 114 bp, Homo sapiens
gcctggccaagaggagtttgatttgaagtgcaatggatggtcactggagggtatgagttacagaagtgatattgttgaatacacgttttaaaaagataacactgactgctaggt

SEQ ID NO: 10253 - DNA, 102 bp, Homo sapiens
tatttatgtatatatgtgtatgtgtatatataaatgtatatatatgtgtgtatgcgtatttagaaaatgtatatacttatatgtgcgtatgtatgcatatat

SEQ ID NO: 10254 - DNA, 58 bp, Homo sapiens
tgagggagagtctcactctgtcacccaggctggagtacagtggtgtgatctcggctca

SEQ ID NO: 10255 - DNA, 111 bp, Homo sapiens
aagtatgtgtggtttatccataaatccatgattaagttctctaattctgtaatttggagaaaatatattaatcttttttgaatggagataaagatagattcccccaaattt

SEQ ID NO: 10256 - DNA, 80 bp, Homo sapiens
acacatcaaactatatatataaaaatatatatatacaaatagttttctatgtgtatatatatatgtgtgtatatatgtgt

SEQ ID NO: 10257 - DNA, 105 bp, Homo sapiens
tgtctagttcagagatttttctttctaggaagattttaaattactgataaatgactcagtaatttaatgatctttgtaaaaagcactcagtttggatcttctaca

SEQ ID NO: 10258 - DNA, 95 bp, Homo sapiens; identical to SEQ ID NO: 68

SEQ ID NO: 10259 - DNA, 93 bp, Homo sapiens; identical to SEQ ID NO: 69

SEQ ID NO: 10260 - DNA, 93 bp, Homo sapiens
tctaacagataccttctttgttttctttctttcttttttctttttaacatgtggtactaagggaaagaaaataagtgtgaagtgatttgtaga

SEQ ID NO: 10261 - DNA, 83 bp, Homo sapiens
cacactggtatatgtgtgtgtatatatacatacacacacataagtgtatatatatatatacacacacacacatataaagagtg

SEQ ID NO: 10262 - DNA, 76 bp, Homo sapiens
ctatttattagggactgtgtacagatatggtacttgtatgtataaatgtgtgtgcttacacattctctatgaaagg

SEQ ID NO: 10263 - DNA, 82 bp, Homo sapiens
aggccaaaacaaaacacttctgtgactgcattaaacctctggagactggtttgtggtttctggaagagaattgtttaagtct

SEQ ID NO: 10264 - DNA, 58 bp, Homo sapiens
tgagacagagtctcactctgtcacccaggctggagtgcagtggtgagatctcggctca

SEQ ID NO: 10265 - DNA, 73 bp, Homo sapiens
gcaaagcacactgactctgtgggtctctggggagctctgtcttttctctctgctggcagccaagtgtctgagc

SEQ ID NO: 10266 - DNA, 113 bp, Homo sapiens
gttttcacctgtgcttttttaaagcaggcagcaatagtatacatttagtcaattggtggaaagaaagtatttgttctgtcagcttttgtatgctcggtgattacagaactgcc

SEQ ID NO: 10267 - DNA, 59 bp, Homo sapiens
gtggcaggatgggtcttccctgggcacggtgggtgtgacagaggcccagcactgaccac

SEQ ID NO: 10268 - DNA, 58 bp, Homo sapiens; identical to SEQ ID NO: 5571

SEQ ID NO: 10269 - DNA, 95 bp, Homo sapiens; identical to SEQ ID NO: 68

SEQ ID NO: 10270 - DNA, 93 bp, Homo sapiens; identical to SEQ ID NO: 69

SEQ ID NO: 10271 - DNA, 72 bp, Homo sapiens
gatgactgactcctctctctctgtgtatatatatatatacacagagacagatatagctatagagtagttgcc

SEQ ID NO: 10272 - DNA, 81 bp, Homo sapiens
tatttatctcaagctccatatcaaatgcccacattaaaattaagatgtcaaaattttcttttttggagactgaggtaagtg

SEQ ID NO: 10273 - DNA, 117 bp, Homo sapiens
agtgtaaaagcattcctttttctccacaacctcaccagcatgttattttttgaatttttaataatagcaattctgactagcgtgagatggtatctcattgtggttttgatttgcatt

SEQ ID NO: 10274 - DNA, 79 bp, Homo sapiens
ccatctaaattctacgttgttaaaggtagcttaggttaattagtctatacttatttaagaacaatatggggtgagatgg

SEQ ID NO: 10275 - DNA, 101 bp, Homo sapiens
gaaaagctagatgtggagcagaagtgagtgatgacaagctggcccctctctggtaccctttcttctgtctgtctctgattctgcctatgagaagatttttc

SEQ ID NO: 10276 - DNA, 157 bp, Homo sapiens
cagtgaactttgggctagaagatcttgatctgctctgtaattattattattattattattattattattattattattactgagtctcattctgtcacccaggctggagtgcagtggtgtgatcttggctcactgcaacctccacctcgtgggttca

SEQ ID NO: 10277 - DNA, 111 bp, Homo sapiens
caaggtggatggtgtggggaaacactcagaaatccaggaaggctgctggtaagtatagaagtatgaacacagcactcagatggctcgagatcccattgacaagtcaatttg

SEQ ID NO: 10278 - DNA, 119 bp, Homo sapiens
cttagtcaactttatttttttgcatcagaacattctcatcccaagcattaattatttattatattgagtcccttgggatgagaggttattttcaaaaagaagaatttaaggaaggtgat

SEQ ID NO: 10279 - DNA, 84 bp, Homo sapiens
ctgctgactatgtctgtgtctcttatttgcattcccctggggagtttaagtgttggattagatattctaatcactcttcagtag

SEQ ID NO: 10280 - DNA, 86 bp, Homo sapiens
tttgtacatatttgaatatatttctatgtgattacatgtaaaccgattacatgtaagctacacatcaaagatttagatacatcaaa

SEQ ID NO: 10281 - DNA, 96 bp, Homo sapiens
aggcagcagaaacctttgcagacttaaatgtccctgtatgacagctttgaagactctcagcacagagtttgagatctgagagtggacagactgcct

SEQ ID NO: 10282 - DNA, 88 bp, Homo sapiens
agaggaaaggaaacactctgactctgagttgctggagttcttttgctgattccttgccatctgagcatacaagtgtttctttttcttt

SEQ ID NO: 10283 - DNA, 113 bp, Homo sapiens
gcaagaaagatgtggaatgataggtagtgttgaatagatctctttgaagacctcttaatttattttttaaagtgtagtagtcattattgcagtcattattgtgtttatcctgt

SEQ ID NO: 10284 - DNA, 170 bp, Homo sapiens
tgtacatatgtatatacacgtatatgtatatacacatatatgtatatatgtatatacacatatatgtatatatgtatatgtgtatatacatatatatgtatatacatatacaatatatgtattgtatgtatatatatgtgtatatatatacactatatatatgtatatat

SEQ ID NO: 10285 - DNA, 123 bp, Homo sapiens
tatatacatatatatagtgtatatatatacacatatatatacatacaatacatatattgtatatgtatatacatatatatgtatatacacatatacatatatacatatatgtgtatatacata

SEQ ID NO: 10286 - DNA, 116 bp, Homo sapiens
agctgttttgacactgttgttaggtgagtatacatgaagaattgttatatattattagaattgacccccttatcattatgtagcgctcttctgtatccctgataacgttccttgct

SEQ ID NO: 10287 - DNA, 93 bp, Homo sapiens
actgtatcctaataacatgagctgtctttacaatcttttattttattttttcagggatggggtctcgctttgttgtccaggatgggatgcagt

SEQ ID NO: 10288 - DNA, 66 bp, Homo sapiens
tcagtaacaatccatggatcagcaatttgtgggccacactctgtgactgatctgtgctgctattga

SEQ ID NO: 10289 - DNA, 114 bp, Homo sapiens
tttgagaaatatctattcagatcacttgcccatttaaaaatcatattgtttgcttttcttggtgttgcaatgttggagctcattgtatgttctggatatgaatcctttgtcaga

SEQ ID NO: 10290 - DNA, 101 bp, Homo sapiens
cagtttaaaatgtcatttttattttgggtggtgatttcatagatatatatatatataactgtcaaaactcatctaacatttaaaatctggacattgaattg

SEQ ID NO: 10291 - DNA, 142 bp, Homo sapiens
catatatatgtatatatacacaccatatatatacacacactatatatgtatggtatatatatatatatatatatatatggtgtgtgtatatatatggtgtgtatatatacatatatatggtgtatatacatatatatatatg

SEQ ID NO: 10292 - DNA, 97 bp, Homo sapiens
atatatacacaccatatatatacacacaccatatatatatatatatatatatataccatacatatatagtgtgtgtatatatatggtgtgtatatat

SEQ ID NO: 10293 - DNA, 95 bp, Homo sapiens; identical to SEQ ID NO: 68

SEQ ID NO: 10294 - DNA, 93 bp, Homo sapiens; identical to SEQ ID NO: 69

SEQ ID NO: 10295 - DNA, 62 bp, Homo sapiens
tgtgtgtatatatatgtgtgtgtatatatatgtatatatacacacacatatatacatacata

SEQ ID NO: 10296 - DNA, 68 bp, Homo sapiens
atatacatatatataaatatatagatagataagggtgtgtgtgtatgtgtgtttgtgtgtgtgtgtgt

SEQ ID NO: 10297 - DNA, 151 bp, Homo sapiens
tatacatatatacgtatgtatatataatacatgtgtatatatatacacgtatatgtgtgtatatatgtatatatacatatacgtatatatacgtatatacacatatgtgtgtatatatactatatatgtatatatatacacatatatatac

SEQ ID NO: 10298 - DNA, 98 bp, Homo sapiens
gccaagagcaataaatcaaaaccactatatttatatttactgtgtttggcatcatccaccataaatatatagtaatttgacttataattgcttttgtc

SEQ ID NO: 10299 - DNA, 95 bp, Homo sapiens; identical to SEQ ID NO: 68

SEQ ID NO: 10300 - DNA, 93 bp, Homo sapiens; identical to SEQ ID NO: 69

SEQ ID NO: 10301 - DNA, 58 bp, Homo sapiens; identical to SEQ ID NO: 2442

SEQ ID NO: 10302 - DNA, 95 bp, Homo sapiens; identical to SEQ ID NO: 68

SEQ ID NO: 10303 - DNA, 93 bp, Homo sapiens; identical to SEQ ID NO: 69

SEQ ID NO: 10304 - DNA, 95 bp, Homo sapiens; identical to SEQ ID NO: 580

SEQ ID NO: 10305 - DNA, 93 bp, Homo sapiens; identical to SEQ ID NO: 69

SEQ ID NO: 10306 - DNA, 179 bp, Homo sapiens
tatatatgtgtatatatacgtatatatatgtatatatatgtgtatatatacgtatatatgtgtatatatgtatgtgtatatatatgtgtatatatgtgtatatatgtatgtgtatatatgtatatatacatatatatgtatatatacatatatatatgtatatatatattaggttatat

SEQ ID NO: 10307 - DNA, 110 bp, Homo sapiens
acatatatatacacacatatatatatgtgtgtatatatatgtatatatatgtgtatatatacgtatatatatgtatatatgtatatatatgtgtatatatacgtatatat

SEQ ID NO: 10308 - DNA, 97 bp, Homo sapiens
caagtagctggaactacaggtgtgcaccactatgactagctaattttttaattaaatattttttttgtgtgtgtgcagacagggtctcagtctgttg

SEQ ID NO: 10309 - DNA, 58 bp, Homo sapiens
tgagtcagagtctcactctgtctcccagggtggagtgcagtggtgcgatctcggctca

SEQ ID NO: 10310 - DNA, 80 bp, Homo sapiens
agtcactctgtcactcaggctggagtgcaatggcacgatctcggctcactgcaacctccggctcccgtgttcaagtgatt

SEQ ID NO: 10311 - DNA, 87 bp, Homo sapiens
ctagctacagtctgacacaagaatgactgcagcaaaatgttggctgtattataataaaaatatttgtggaaaggctttgttagctgg

SEQ ID NO: 10312 - DNA, 104 bp, Homo sapiens
ttctagaacattttgtgacatgagagacatcttaacctacctatttttattttttttttattatttttttgagatggagtctcactctgtcgctcaggctggaa

SEQ ID NO: 10313 - DNA, 118 bp, Homo sapiens
ggaaaacctttctgtattctgctcataggtagggccaatttcttatgatttttttctatatgttcataagtaggaggaaattcagagatgctgctcaatggatggtagtcagagttct

SEQ ID NO: 10314 - DNA, 89 bp, Homo sapiens
aaagtccagaggtagggaaaaatttcagatttaagatgcaaacaatgtgtacaggactctgtttctttctctctgcatctgtgggcttt

SEQ ID NO: 10315 - DNA, 80 bp, Homo sapiens
gggaaaaacaacctgggacagtctcagtctggcaattccatgctccagtcaggaagagacacttgccccttctacttccc

SEQ ID NO: 10316 - DNA, 64 bp, Homo sapiens
tcagagacttctacagaatgcaaagataaaaatatcttgtctggctccatgtctaagtctctga

SEQ ID NO: 10317 - DNA, 93 bp, Homo sapiens
gaaatcaggtagtgtctttttttatttttaattttggaagtgttctgacatactgatgtgaaagagtaaaggaagaaaaatacaattgatttt

SEQ ID NO: 10318 - DNA, 82 bp, Homo sapiens
gtgacatgaatatgaaaagttaaagattcatgtcagaagaatcaaatgatgtctttaattatttatatatttcaaaggttac

SEQ ID NO: 10319 - DNA, 118 bp, Homo sapiens
aagcacggtggtgctcacctgtggttccagctactcaggaggctgaggtaggaggatcgcttgagcctggaagattgaggctgcagtgaactacaattgagccactgcattccagctt

SEQ ID NO: 10320 - DNA, 120 bp, Homo sapiens
atacatgtatatgtatatatacatgtatatgtatatatgtgtatatatgtatatatgtgtatatatgtatgtatgtatatatacatgtatatatgtgtatatatgtatgtatgtatatat

SEQ ID NO: 10321 - DNA, 108 bp, Homo sapiens
gcacatatacatatatacacatatgtacatatatatacatatatacgtacatatgtatatatacatgtatatatgtgtatatatgtgtatatatgcatgtatatgtgt

SEQ ID NO: 10322 - DNA, 114 bp, Homo sapiens
atatacatgcatatatacacatatatacacatatatacatgtatatatacatatgtacgtatatatgtatatatatgtacatatgtgtatatatgtatatgtgcatgtgtgtat

SEQ ID NO: 10323 - DNA, 107 bp, Homo sapiens
agtagatgttgagatcacacatttgtatttggaagagtctttctttttgtcatatacagaaacaaaaggcttctacttacaagaaataaaatctgattttgtttatt

SEQ ID NO: 10324 - DNA, 93 bp, Homo sapiens
tctcaacttccttatggtctgtagatggtgggtggttaagggggttgcctctttgtttgtttatttatttatttattattattatttttgaga

SEQ ID NO: 10325 - DNA, 116 bp, Homo sapiens
gtttcaaaatatttaaggattgtccagataactttctgctaacgatttctaattttatttcattgtggtcagagaaaatatttgtatgatgtgaatccttttaaacttattgagac

SEQ ID NO: 10326 - DNA, 95 bp, Homo sapiens; identical to SEQ ID NO: 68

SEQ ID NO: 10327 - DNA, 93 bp, Homo sapiens; identical to SEQ ID NO: 69

SEQ ID NO: 10328 - DNA, 84 bp, Homo sapiens
atcaacttcaaggtcatggattgaaatgatgataactcaaattataggactgtcaactttcaagcccccctgaccttaagtgat

SEQ ID NO: 10329 - DNA, 57 bp, Homo sapiens
gggtgcatgtgcagatttttttttctttttttgagacagagtctcactctgtcaccc

SEQ ID NO: 10330 - DNA, 95 bp, Homo sapiens; identical to SEQ ID NO: 2114

SEQ ID NO: 10331 - DNA, 80 bp, Homo sapiens
tgtgtatgtattcttatatgtatatatgtatgtgtgtatgtatatatgtgtgcatatatatgtatgcttgtgtgtgtatg

SEQ ID NO: 10332 - DNA, 107 bp, Homo sapiens
gctgtataacttttatcattaccttacttgcatctgattttctttttcaaaaactggaagtagttacatgtctttgtagggtcagagagttagaattatatcacagt

SEQ ID NO: 10333 - DNA, 58 bp, Homo sapiens
tgagaccgagtctccctctgtctcccaggctggagtgcagtggcacaatcttggctca

SEQ ID NO: 10334 - DNA, 81 bp, Homo sapiens
cctagcctctatccctcaccatggctactccatttatgtgctgactggatcacactggagtgactgatgacagaggcttgg

SEQ ID NO: 10335 - DNA, 100 bp, Homo sapiens
gaagtcaagacctttatgtaagagtaaaataacagaatgaagttagagaggacacagagctggtgtgtacattacatgtttaggtgagtgacttgatttc

SEQ ID NO: 10336 - DNA, 102 bp, Homo sapiens
ttgctttgtgattgaggctctaggggtgtattttgctgaaaaatgtctttttgattttttggaaattctttagattaatatgcagctctcattgcaaggcaa

SEQ ID NO: 10337 - DNA, 79 bp, Homo sapiens
gcatctgctgggtattgttgcctcactgggacctcatttcactgtctgtttgtgtcccttgcaaggatccctgctgtgt

SEQ ID NO: 10338 - DNA, 62 bp, Homo sapiens
tctctctctctgtgtgtgtttgtacatatatatataatatagattatatatagagagacgga

SEQ ID NO: 10339 - DNA, 75 bp, Homo sapiens
ggattcagactatgccttctgcatttcttcttgtgtaaaacaagatgatgactaatgagagtctggcctgtatcc

SEQ ID NO: 10340 - DNA, 107 bp, Homo sapiens
ataattagcacagagaaaatactaggttatcaataaatgtttgttgaaaatgttgactgtaaacatctgttcattcatatttaataagaccctttgtgttgaggtgt

SEQ ID NO: 10341 - DNA, 65 bp, Homo sapiens
gcctgttcaggctgaggttcttttttttttttttttgagacagactttggctctgttgcccaggc

SEQ ID NO: 10342 - DNA, 117 bp, Homo sapiens
tttgagaaatgtctattcatgtcatgtgtccacttttcttttgatgggctcatttgtttttttctagatgatttgtttgagttccttgtagattctggatattagtccattgtcaga

SEQ ID NO: 10343 - DNA, 58 bp, Homo sapiens
tgagacagagtctcactctgtggcccagactggactgcagtggtgtgatctcagctca

SEQ ID NO: 10344 - DNA, 93 bp, Homo sapiens
caaccagttgttgaacctcatatatctgagcctgcacaagggagagataccttttagtgtcaggtatagaggaagcttccagggactatgttg

SEQ ID NO: 10345 - DNA, 76 bp, Homo sapiens
attatttgacctctgtaagtctgtttcttcatctgttaaatgaaggtaatatacagacttagaaagttaaggtgat

SEQ ID NO: 10346 - DNA, 115 bp, Homo sapiens
tatatgtgtgtgtgtatatatatgtgtgtatatatgtctatgatcatagacacacgtgtgtatatatgtatataaacacacatacgtgtatatatgtatataaacacatacgtgt

SEQ ID NO: 10347 - DNA, 117 bp, Homo sapiens
atgctactggtttttgtatgttggttttgtatcttgcagctttactgaatttgttcatcagttattatagttttttggtggagtctttaggttattccaaatacaagatcatatcat

SEQ ID NO: 10348 - DNA, 75 bp, Homo sapiens
gtgtgtgtgtgtgtgtgtgtgtgtacatatgtgtgtatatatatatacgtgtgtgtgtacatatgtgtgtatata

SEQ ID NO: 10349 - DNA, 123 bp, Homo sapiens
agtgcacagagaacaaaggagacgagagggtttttatccttaatgcagtccctatctctgtgtcactcccccatgggctgaagttggactgcacaatctgagctgacccaattggctacttgt

SEQ ID NO: 10350 - DNA, 95 bp, Homo sapiens; identical to SEQ ID NO: 68

SEQ ID NO: 10351 - DNA, 93 bp, Homo sapiens; identical to SEQ ID NO: 69

SEQ ID NO: 10352 - DNA, 117 bp, Homo sapiens
gtgtgaaggttttgggttctcttggcaggagaagtgtttccaagctgtttctttattttattttattttattttatttttgagacagattctcactctgtcacccaggctggaatgc

SEQ ID NO: 10353 - DNA, 93 bp, Homo sapiens
tcagaaagaacttacatgtataaaaatacagaaatactcatatgatgaagtattatatgaaaatatttttatattgagtttcttattctctga

SEQ ID NO: 10354 - DNA, 131 bp, Homo sapiens
catatatatatatatatagtgtgtgtgtgtgtatatatatatatagtgtgtgtgtgtgtatatatatatgtgtgtgtatgtatatgtctgtatatatatctgtgtgtatatatatctgtgtgtatatatat

SEQ ID NO: 10355 - DNA, 115 bp, Homo sapiens
gattgtctgtctgtgctctttcagactttttgatgtaggtgttcagggctatgaactttcctcttagcaccacttttgctgcatcccagaggttttaataggttgtgtcacaatt

SEQ ID NO: 10356 - DNA, 73 bp, Homo sapiens
cacttgttacccaggctggagtgcaatggtgcgatctctgctcaccacagtctctgtctcctgggttcaagcg

SEQ ID NO: 10357 - DNA, 109 bp, Homo sapiens
ccaagtacacattgagagaaatgaattaaatataagttaggaattatcagtagtgatattgatgataataagaacaaaacctagcatatagtgtttcttctgtgccagg

SEQ ID NO: 10358 - DNA, 85 bp, Homo sapiens
ggtgaaacttgattaagcttggtggattgtatcaatatcaattttctggttgtgatattatactatatttatgtaagatgtcatc

SEQ ID NO: 10359 - DNA, 95 bp, Homo sapiens; identical to SEQ ID NO: 68

SEQ ID NO: 10360 - DNA, 93 bp, Homo sapiens; identical to SEQ ID NO: 69

SEQ ID NO: 10361 - DNA, 98 bp, Homo sapiens
tctgagaataatggcatcccagatatgagaaagcatagaaataaagaaatctttaaaagtttctactatgtggtatccttctgaacaacattcttgga

SEQ ID NO: 10362 - DNA, 103 bp, Homo sapiens
tacaattagccctagattagagaaggtggccactgtcaagcttcttgatgtgcttgtagcttgattagcagtgcatttcttatcattttagatgctcagagta

SEQ ID NO: 10363 - DNA, 86 bp, Homo sapiens
ggggatcctccattagggtgtggtatttttgttgttctgatcctggaacccaggacaacagagcagccactttctggagtgtctcc

SEQ ID NO: 10364 - DNA, 58 bp, Homo sapiens
tgagatggagtctcactctgttactcagaatggagtgcagtggtgtaatctcagctca

SEQ ID NO: 10365 - DNA, 71 bp, Homo sapiens
gaggccccagagagctgccttgcccctttcaccatgtgaggacacagtgagaagtcagctgtctgtagccc

SEQ ID NO: 10366 - DNA, 95 bp, Homo sapiens; identical to SEQ ID NO: 68

SEQ ID NO: 10367 - DNA, 93 bp, Homo sapiens; identical to SEQ ID NO: 69

SEQ ID NO: 10368 - DNA, 93 bp, Homo sapiens; identical to SEQ ID NO: 69

SEQ ID NO: 10369 - DNA, 98 bp, Homo sapiens; identical to SEQ ID NO: 1311

SEQ ID NO: 10370 - DNA, 95 bp, Homo sapiens; identical to SEQ ID NO: 68

SEQ ID NO: 10371 - DNA, 93 bp, Homo sapiens; identical to SEQ ID NO: 69

SEQ ID NO: 10372 - DNA, 74 bp, Homo sapiens
cagcagagtgctgacccttgaccccagagatcagtgtctctgagtcagaagtgttggcctggaactttctgctg

SEQ ID NO: 10373 - DNA, 90 bp, Homo sapiens
tatatctatatatatatatatatatacacacatgtatatatgtctgtatttatacacaaacatgtgtatatatatgtgtgtgtacatatg

SEQ ID NO: 10374 - DNA, 106 bp, Homo sapiens
gtgtgtgtgtgttttgcatgtatgaatatactgggagtgggagtcaggtatgattttttaaatttgactttcattctctattaaagggcatgaattcaccagacat

SEQ ID NO: 10375 - DNA, 129 bp, Homo sapiens
gcctccagctttgttcttttggcttaggattgtcttggcaatgtgggctcttttttggttgcatatgaaatttaaagtagtttttttccaattctgtgaaggaagtcattggtagcttggtggggatgg

SEQ ID NO: 10376 - DNA, 113 bp, Homo sapiens
tttgtaacaaggaaggaaataaacaagcattctatttattcagaaagacatctgattttcttgagcagatgagaatttgaataacttagaagtcttgatagcaccgttataga

SEQ ID NO: 10377 - DNA, 116 bp, Homo sapiens
ggtaatgacatttctagtttagttcctctctccatgttaatattcactgtgggacttgttatttttagcgtcttagtgctttatatgaacaatgaattaaataatgtttttctgct

SEQ ID NO: 10378 - DNA, 78 bp, Homo sapiens
gggctaaaatcaggttgttggcaaggctgattccttctggaggctctaggggagagtctgagtctcactctgtcgccc

SEQ ID NO: 10379 - DNA, 112 bp, Homo sapiens
catcccacactggctgcctctgtaagaaataattgtgctgaataaaataatcaagtatagcttttatttatttatttagacaggttcttgctctgttgcccaggctggagtg

SEQ ID NO: 10380 - DNA, 80 bp, Homo sapiens
tcttgacctttctggatgtttagtgtaagtgactgaaatggaaaatgtcacaaatacaaaatgaaaagaaagtgtcctga

SEQ ID NO: 10381 - DNA, 95 bp, Homo sapiens
ttgccctggtgggctacaagatcatgtgttccaggagcagcaacagcctgagctttctatttctctctgtcacattcttagtttgctcagtgtaa

SEQ ID NO: 10382 - DNA, 115 bp, Homo sapiens
aatgaaacacctttggaggctggcaggtcagcactggccatatcagaagaattcagactctgtgtgtctctgtgtttgatgtggggagggccgatgcttccctgggtacttggtt

SEQ ID NO: 10383 - DNA, 109 bp, Homo sapiens
ggattacagatgttcgtcaccacacctggctaatttttgtatttttaatagagatggggtttcactatgttggctaggctggtctcaaactcccgacatcaggtgatcc

SEQ ID NO: 10384 - DNA, 78 bp, Homo sapiens
ctgggcaacatagtgagatcttgtctctaagaaaaaaaaaattttttttttgagagggagtctcactctgtcacccag

SEQ ID NO: 10385 - DNA, 92 bp, Homo sapiens
gccaaacccacagagcttctctctctccaaagttctttattttttatttatttatttttttagagatggaggtctcactctgttgtccaggc

SEQ ID NO: 10386 - DNA, 79 bp, Homo sapiens
tgagccaacatgccctgccaaaatgcatttttaaatatatttagttgtgaacatatttggtaggcgatgtctttactca

SEQ ID NO: 10387 - DNA, 81 bp, Homo sapiens
ttggggaacatggtggctgccacagatggccaagagaacttttctaacagcacatctgagccactcactgtgtgctcccag

SEQ ID NO: 10388 - DNA, 87 bp, Homo sapiens
gtggtgtttcttttttaggtcactgtctacactgtaccttgtgagttatctgttatcctcagtatagactgtgagctcaaacattcc

SEQ ID NO: 10389 - DNA, 90 bp, Homo sapiens
gggtacttgtaggtaagtgtgagcagagtgtgaggatgagtgtttattctaacaagcatttagtgagcacttactctctgacagatactc

SEQ ID NO: 10390 - DNA, 113 bp, Homo sapiens
ctcaatttgttattttcataagatttttaatttgctatagtaataatgtaaagataccagtttttaattttataaactcagtatagacttatgaaaatggtcaaaataatggg

SEQ ID NO: 10391 - DNA, 106 bp, Homo sapiens
gtttacattcaaagttaattccagggagaatatgtattcaaataaatacattgaaattttttttgaacatatacattctccctggagttaacctttgggggtgtgc

SEQ ID NO: 10392 - DNA, 85 bp, Homo sapiens
aaggttaactccagggagaatgtatatgttcaaaaaaaatttcaatgtatttatttgaatacatattctccctggaattaacttt

SEQ ID NO: 10393 - DNA, 93 bp, Homo sapiens; identical to SEQ ID NO: 69

SEQ ID NO: 10394 - DNA, 82 bp, Homo sapiens
acaaatatatatattatatatacatataatatatgtgtgtatatatatatacatataatatatgtgtatatatatatttgtt

SEQ ID NO: 10395 - DNA, 116 bp, Homo sapiens
acatttttgaggccttaaagtactgtagcagcacatcatggtttacatgctacagtcaagatgcgaatcattatttgctgctctagaaatttaaggaaattcattcaaaactatgt

SEQ ID NO: 10396 - DNA, 102 bp, Homo sapiens
ctgacatacttgttccactctagcagcacgtaaatattggcgtagtgaaatatatattaaacaccaatattactgtgctgctttagtgtgacagggatacag

SEQ ID NO: 10397 - DNA, 79 bp, Homo sapiens
tgagacagagtctcgctctgtcacccaggctggagtgcagtggcgtgatctcagctcactgcaacttctgtctcccggg

SEQ ID NO: 10398 - DNA, 58 bp, Homo sapiens; identical to SEQ ID NO: 454

SEQ ID NO: 10399 - DNA, 65 bp, Homo sapiens
tttctgactctttctctctgatcagacaccttccttgttgctgaccacagaggtggaaccaggga

SEQ ID NO: 10400 - DNA, 93 bp, Homo sapiens
gactacatgccttgagggcaaggactgtgtcttgtttaccactgtcttcccagtaacttatcacagtgcctgttcaatatatggcagcaattc

SEQ ID NO: 10401 - DNA, 58 bp, Homo sapiens; identical to SEQ ID NO: 3385

SEQ ID NO: 10402 - DNA, 56 bp, Homo sapiens; identical to SEQ ID NO: 3386

SEQ ID NO: 10403 - DNA, 82 bp, Homo sapiens
gggcctcagcctctcttaatgagatttttctctttttttttttttttttttttttttgagatggagtctcactctgtcgccc

SEQ ID NO: 10404 - DNA, 95 bp, Homo sapiens
tatgtacatatatacacacatatatacatatatatacatatatacatacatatatatacatatatatatatagtgtgtgtgtgtgtctgtattta

SEQ ID NO: 10405 - DNA, 99 bp, Homo sapiens
ctggctgtccctttgtgtctgtctctatctctgttgtgagagagctcatgcaagcgagagccggccaactcaaggtttgcaaagcagaacacagcagag

SEQ ID NO: 10406 - DNA, 92 bp, Homo sapiens
caggtgcacgccaccacacctggctaatttctttgaatttttagtagagacgggggtttcaccaggttggccaggctggtctcgaactcctg

SEQ ID NO: 10407 - DNA, 95 bp, Homo sapiens; identical to SEQ ID NO: 68

SEQ ID NO: 10408 - DNA, 93 bp, Homo sapiens; identical to SEQ ID NO: 69

SEQ ID NO: 10409 - DNA, 95 bp, Homo sapiens; identical to SEQ ID NO: 68

SEQ ID NO: 10410 - DNA, 93 bp, Homo sapiens; identical to SEQ ID NO: 69

SEQ ID NO: 10411 - DNA, 111 bp, Homo sapiens
gtttgattgtatgtcttggtgtggatttcttagagtttattctacttggaatttgttgaggttctaggatgtatagattaatgtatttcatcccattttgtaagttttggc

SEQ ID NO: 10412 - DNA, 106 bp, Homo sapiens
ccttagtttgttgaaagcttcaggctaatttctagaattctgaaaaagttgtttttaacaattttttccagtgttctcatagtttcgtggaagagcagacttttgg

SEQ ID NO: 10413 - DNA, 73 bp, Homo sapiens
gccccaagaaggcagtgatggcgcctgagtgctcaccatggatacattcactcagacacagtcactgcctggc

SEQ ID NO: 10414 - DNA, 98 bp, Homo sapiens
ccaactgaaggcaggactcaaggggcccacacatgctcaaagaagtctttttttttttttttttttgggacagtgtctcactctgttacccaggttgg

SEQ ID NO: 10415 - DNA, 78 bp, Homo sapiens
tggatcatcaggcagagactcttgctcttttctcttactttctcccaaagacactgggtctctctctgttctgatcca

SEQ ID NO: 10416 - DNA, 112 bp, Homo sapiens
tatatgtgtgtgcatatacatacgtgtgtatgtatatgtgtgtatatacatatgtgtgtgtacatatatatatgtatatatatatatatatatatatatatatatatatatg

SEQ ID NO: 10417 - DNA, 95 bp, Homo sapiens; identical to SEQ ID NO: 68

SEQ ID NO: 10418 - DNA, 93 bp, Homo sapiens; identical to SEQ ID NO: 69

SEQ ID NO: 10419 - DNA, 118 bp, Homo sapiens
ccagctttgttctttttgcttaggattgtcttggctatatggtctctcttttggttccatatgaaatttaaagtagttttttccaattctgtgtagaaagtcaatggtaacttgatgg

SEQ ID NO: 10420 - DNA, 78 bp, Homo sapiens
actcattgtgtgtgtgtgtgtgtgtgtgtgtgtatatatatatactatatatatatatacacacacacacacatgagt

SEQ ID NO: 10421 - DNA, 108 bp, Homo sapiens
cagacatggtggtggattcctgtgatcctagttccttgggaggctgaggtgggaggatggtttgagcccccaaggttgaggctgtagtgagccatgatcatgccactg

SEQ ID NO: 10422 - DNA, 127 bp, Homo sapiens
tacatatacacatatatatgcacatgtatatacatatatacatatatatgcacatgtatatacatatatacatatatatgcacatgtatatacatatatatgcatatatatgcacatgtatatacat

SEQ ID NO: 10423 - DNA, 88 bp, Homo sapiens
catatatatgccatatatatgtatatatgcatatatatactatgccatatatacttgccatatatatatatatatggccatatacttg

SEQ ID NO: 10424 - DNA, 79 bp, Homo sapiens
gttggaaactgaagactagagagttagttgttgcctcctgtacaataaagagggcttttttgtttggttggtttttggc

SEQ ID NO: 10425 - DNA, 86 bp, Homo sapiens
agatagatagatagatagatagataatttctctgtgtcacccaggctggagtgcagtgacactatctctcacagcaatctctgtct

SEQ ID NO: 10426 - DNA, 79 bp, Homo sapiens
taaaattatctaatttgggacatggtaaatagtattttacatagaaagtattagttatgtttgattatggatagttttg

SEQ ID NO: 10427 - DNA, 57 bp, Homo sapiens
tgagacagagtctcactctgtctccaggctggagtacagtgtcgcgatctctgctca

SEQ ID NO: 10428 - DNA, 82 bp, Homo sapiens
acttagtcattgactctctgttactcttttactgtcacctttcttgacaggattttgacaagatccagaaggtcagttaagt

SEQ ID NO: 10429 - DNA, 141 bp, Homo sapiens
acatatatatcacatatatatgtgtatacatatatgtgtgtgtatatacacatatatgtgtatatatatacatacatatgtgtatatatatgtgtgtacatatatatgtatgtatgtgtgtgtgtgtgtatatatatatac

SEQ ID NO: 10430 - DNA, 102 bp, Homo sapiens
gtgtatatatacacatatatatgtatatacacacatatgtgtgtgtgtatatatacatatatatgtatatacacatatatatgtgtgtgtgtatatatatat

SEQ ID NO: 10431 - DNA, 112 bp, Homo sapiens
tatatatgtatacatgggtgtatatacatatgtatatgtatatacatatatgtacataagtatatatgtatatacatatatgtacatatgtatatgtgtatatacatatatg

SEQ ID NO: 10432 - DNA, 135 bp, Homo sapiens
gctaaagggcagggctatgcctggtatcactgttcattcatgaatctcacattcagtcagcctggctctgtctgtgccacttgggaagcctcttctgccccaggagatcccagtctaggggtggggagaacaagc

SEQ ID NO: 10433 - DNA, 86 bp, Homo sapiens
agttatttttggtttcttgttattacaagcattactgttatgatcattcttgtacatgtgtttggttaacaaggtcaagggtttct

SEQ ID NO: 10434 - DNA, 111 bp, Homo sapiens
gagtctattcttaaagtggatttcttgcagataacatataattgggcctttgggattttttttttatttgtttgtttgtttgtttgtttttaaatccagtctaacagtctc

SEQ ID NO: 10435 - DNA, 90 bp, Homo sapiens
gatcagtgtatatatatatatatacataaatattcatatgacatatatatgagatatgtgtgtatatatatgtatatagctattttgatc

SEQ ID NO: 10436 - DNA, 114 bp, Homo sapiens
tgcttaggattgtcttggctatacaggctcttttttggttccatatgaaatttaaagtagttttttctagttgtgtgaagaaagtcaatggtagcttgatggggatagcactga

SEQ ID NO: 10437 - DNA, 117 bp, Homo sapiens
tcaccctgctctttggatgtgaattcccacttgcccatgctgtgtttggagttaagcacactctctctcgcccactgcaaaatcccattagagtggttcctatatctgctgaggtgg

SEQ ID NO: 10438 - DNA, 119 bp, Homo sapiens
ggttgcttggtgattccaattggtattcagtaagtagttatggaatgaataaatgaatattagtatcttcattttatagattaagaaactgaggctaaaataaatcaactgatttgacc

SEQ ID NO: 10439 - DNA, 77 bp, Homo sapiens
ctgtatttgcaatgttcctacactctaagctgtactgggaaataccagggctagattgcagagtcttgcatctttag

SEQ ID NO: 10440 - DNA, 87 bp, Homo sapiens
tgtgggaatgcatgatgtgtcccagaaaaaatattcaaatttttgaatattattcaaatattctgggacaccttgatgtgtcccaga

SEQ ID NO: 10441 - DNA, 95 bp, Homo sapiens; identical to SEQ ID NO: 68

SEQ ID NO: 10442 - DNA, 93 bp, Homo sapiens; identical to SEQ ID NO: 69

SEQ ID NO: 10443 - DNA, 116 bp, Homo sapiens
atgaagagatatggtacgtttatagatatgtagactaaaattttaatatcctttctttttttttattatactttaagttttagggtacatgtgcaaaatgtgcaggtttgttacgt

SEQ ID NO: 10444 - DNA, 95 bp, Homo sapiens; identical to SEQ ID NO: 580

SEQ ID NO: 10445 - DNA, 93 bp, Homo sapiens; identical to SEQ ID NO: 69

SEQ ID NO: 10446 - DNA, 95 bp, Homo sapiens; identical to SEQ ID NO: 68

SEQ ID NO: 10447 - DNA, 93 bp, Homo sapiens; identical to SEQ ID NO: 69

SEQ ID NO: 10448 - DNA, 115 bp, Homo sapiens
gtgggggacaaggctgaacagagaaagaacattgactgtggtatagttctgacaatggctttgcaagaagtgtcccattgcaaaagtccatctaattaatttatttgtttctttc

SEQ ID NO: 10449 - DNA, 120 bp, Homo sapiens
ggattatgggtgtgagccactgagcctggctgcatattggtttcttttcttttcttttttatttccttgagatggggtctcactctgtcacccaggctggagcacagtggcatgatctca

SEQ ID NO: 10450 - DNA, 111 bp, Homo sapiens
ctatttcatctaagttgaaattagcccacatttgttagtaatctttaattattatttttataaagttcatgagattgctagcaatgaccctcatgttatttctgatgttag

SEQ ID NO: 10451 - DNA, 86 bp, Homo sapiens
tatatacatatagaggtatatgttttatttatatgtatgttggagtgcactctgaaataaagataaaatgtatgctatagtaaata

SEQ ID NO: 10452 - DNA, 197 bp, Homo sapiens
atatatgtgtatatgtgtatatgtgtatatatgtgtatatgtgtatatgtgtgtatatatgtatatatgtgtatatgtgtatatatgtgtatatgtgtatatatgtatatgtgtatatgtgtatatatgtatatgtgtatatatgtatatgtgtatatatatgtatatgtgtatatatgtatatatatacacacata

SEQ ID NO: 10453 - DNA, 67 bp, Homo sapiens
tgtatgtgtagatgtatgtgtgtatatatattatacatatatattatacatatacattacacatata

SEQ ID NO: 10454 - DNA, 86 bp, Homo sapiens
acatagtagttacatatgtatatatatatgcatggggtatatatatatgtgtatatatatgcgtgtgtgtgtatgtgtgtgtgtgt

SEQ ID NO: 10455 - DNA, 95 bp, Homo sapiens; identical to SEQ ID NO: 68

SEQ ID NO: 10456 - DNA, 93 bp, Homo sapiens; identical to SEQ ID NO: 69

SEQ ID NO: 10457 - DNA, 117 bp, Homo sapiens
agtgaaaactacaatacactttttgttcttctttaagtgtttggagatggaaatagataaatattttgtttcattcagcaaatagcagataggatacagggtcatctgtaagccact

SEQ ID NO: 10458 - DNA, 118 bp, Homo sapiens
atatctaagattctctatttgggctagggtagaatttccttatttatttatttttcacaaattcggttttgattattgactagagttcaaactagagacacagttatcacaggggtgt

SEQ ID NO: 10459 - DNA, 85 bp, Homo sapiens
tttaggttatgacgatgtcacaggatcctttaggtgttgctttgccagctggaaacctctgtggctgtcagtgtctctgcctgag

SEQ ID NO: 10460 - DNA, 110 bp, Homo sapiens
agatacaaatgtatatatcagattgtcttccagtatctttcttttggagcttgcttgtattgtttttggggagtggacaccacagtttggagagttctgcttttgtattt

SEQ ID NO: 10461 - DNA, 89 bp, Homo sapiens
tttgcaataacttgatttatattttgatatatattccacacagcgaatctgtgtggtatggaatgaaatgaattgtatttatatgcaaa

SEQ ID NO: 10462 - DNA, 104 bp, Homo sapiens
cctttgtttcactgtctgctctttctggctgcttgaggttagaagagaagtgattttcttgaaatgcatgagattagaaagggatctgggacttaaaatggggg

SEQ ID NO: 10463 - DNA, 95 bp, Homo sapiens; identical to SEQ ID NO: 68

SEQ ID NO: 10464 - DNA, 93 bp, Homo sapiens; identical to SEQ ID NO: 69

SEQ ID NO: 10465 - DNA, 75 bp, Homo sapiens
tatattccaaaggtgtagttggattttttttttttttttttaagagtcttgctctttcaccctggctggagtgta

SEQ ID NO: 10466 - DNA, 80 bp, Homo sapiens
tagcatgtgataatatctctttgtggttttgatttgcatttctctaatgatcagtaatattgagatttttttatatgtta

SEQ ID NO: 10467 - DNA, 143 bp, Homo sapiens
tatatatatatatacacactcaggtatatatatatatatatatatacaggtatatatatatgtgtgtgtgtgtatatatatatgtgtgtgtatatatatatatacacacacacacatacacacacacacatatgtatatatct

SEQ ID NO: 10468 - DNA, 62 bp, Homo sapiens
ggaggccaaggttgtagaaccaggcacgctccctgctgtctgtctgtgactctgtgcttgcc

SEQ ID NO: 10469 - DNA, 103 bp, Homo sapiens
atatacactatacacacacatatatatgtgtctgtgtgtatgtgtgtgtgtgtgtgtgtctatatatatatatatatatatatatatatatatatatatatat

SEQ ID NO: 10470 - DNA, 182 bp, Homo sapiens
atattacgtgtgtgtgtgtgtatatatatacatatatatatacatatatacacatatatatgtacatatatacacatatatacatatatatgtacatatatatacatatatgtgtatatatacatatatatgtgtatatatgtatatatatacatgtgtatatatatatgtaataaaatatg

SEQ ID NO: 10471 - DNA, 154 bp, Homo sapiens
catatatatatacacatgtatatatatacatatatacacatatatatgtatatatacacatatatgtatatatatgtacatatatatgtatatatgtgtatatatgtacatatatatgtgtatatatgtatatatatatgtatatatatacaca

SEQ ID NO: 10472 - DNA, 79 bp, Homo sapiens
tacaatatatctttatgtgtatatatacacttatatacgtgtatatgtgtgtatatatgcatatttgtgtgtatgtgta

SEQ ID NO: 10473 - DNA, 125 bp, Homo sapiens
acataagtgtgtgtatatatatatgtacttgaatacatatatgtgtgtatatgtacatatatgtgtgtgtacatgtgtgtgtttatgtgtgtgtatgtgtatatatatatatatatgtatgtata

SEQ ID NO: 10474 - DNA, 80 bp, Homo sapiens
aggctctctgactgactccttcccagatcttctcggcttagcagctgaagactgacactgcctgatcacctcagaagcct

SEQ ID NO: 10475 - DNA, 100 bp, Homo sapiens
aggatgctggcaccagaaaaagggggaaggatgctgagcatggagcagacagagacgtctcttctctctctgggactgcatcttttcatctgtaaaatgg

SEQ ID NO: 10476 - DNA, 119 bp, Homo sapiens
tgctgtgattatgcaattattttcacttcaagtagagttctgggattttatttttttctctataggtaatgtgtctggatctctagggcacttgaaggagattttttgtttatgtagca

SEQ ID NO: 10477 - DNA, 116 bp, Homo sapiens
cgtattatataattaaatgtgagacattaaatatataatgtatattatatatacatttaaatatataatttatatgatatatttaatgtctcacatttaattcttaaatatagatg

SEQ ID NO: 10478 - DNA, 105 bp, Homo sapiens
tttcttattgttaaggatattccttattttccttttttcataatttttttctttttttaaaaaattggttaaattgtgattagaaaatgagtcttaatttagaaa

SEQ ID NO: 10479 - DNA, 119 bp, Homo sapiens
tatatatacacatgtatgtatatatatgtatatatatacacatgtatgtgtatatacacatatatgtatgtatatatatgtacatatatgtgtatgtatatgtgtgtgtatatacatat

SEQ ID NO: 10480 - DNA, 112 bp, Homo sapiens
ctgaatattgacctggatagtggtgcttgggtgtatatttattttaaaaattaaatattataattgagattcatgcacttatgcaccttactaaatgcattttttatctcag

SEQ ID NO: 10481 - DNA, 86 bp, Homo sapiens
actaacacaatatgtatgtgtgtgtattatatatatatgtgtgtgtgtgtatatgtgtgtgtgtatacatatgtatgtgtgtgggt

SEQ ID NO: 10482 - DNA, 58 bp, Homo sapiens
tgagacggagtctcgctctgtctcccaggctggagtgcagtggcgggatctcggctca

SEQ ID NO: 10483 - DNA, 116 bp, Homo sapiens
cagcctggataagaaccatttctggggaactagggtagtcatttggaggttagaaaacactggcattttgagttgccacagttcttatgctggttctttatcatctatatgggctg

SEQ ID NO: 10484 - DNA, 116 bp, Homo sapiens
atcattagtgctctcttctaggaataaaatgagtctaacttagcctacctgatgatattattttttacttacatcaaaggggtgagagaagaactctctctgggagatcttttggt

SEQ ID NO: 10485 - DNA, 121 bp, Homo sapiens
cataattctgctgtgtataccttcataattctgctgtgcatagattgatctttatatgaattttcattccttaaagttttgcaattatgtttggtgggtatcaaaaagtaagctatgcaga

SEQ ID NO: 10486 - DNA, 104 bp, Homo sapiens
tttactgctagctctgagtggcttaaaggatttaagaatcattatttttacataatgtgaaaatgagtggtaagtctataagtgctgatgtgaaagcagctgaa

SEQ ID NO: 10487 - DNA, 140 bp, Homo sapiens
gtatatatgtatgtaaatgtgtagatacatatgtttgtaaatatataaatggtctacacatatacattacatataacatatatatgtgtgtatatatgtgtgtgtgtgtgtatatataaatatgtgtctgtaaatgtata

SEQ ID NO: 10488 - DNA, 95 bp, Homo sapiens; identical to SEQ ID NO: 580

SEQ ID NO: 10489 - DNA, 93 bp, Homo sapiens; identical to SEQ ID NO: 69

SEQ ID NO: 10490 - DNA, 118 bp, Homo sapiens
tcccaaagtgctgggattacaggcgtgagccaccgtgctggcctctttatttgtttttaaaactacaagaaacctggtgggcagggtggcttacaactataatcccagtgctttggga

SEQ ID NO: 10491 - DNA, 81 bp, Homo sapiens
gtgactaccaaaaaagtataaattacatatgtggctcaaattatattttatttgaacaatgttgtactatatggtattcac

SEQ ID NO: 10492 - DNA, 66 bp, Homo sapiens
tgagacggagtctcgctctgtcacccaatcacccaggctggagtgcagtggcgctatctcggctca

SEQ ID NO: 10493 - DNA, 243 bp, Homo sapiens
caatgtgtatatatatacacaatgtatatatatattatgtgtatatatatatacatgtatatatatacacattgtatatatatattatgtgtatatatatacatgtatatatacagtatatatacatgtatatatatacatgtatatatacagtatatatacatgtatatatatacatgtatatatattgtatatatatacacaatgtatatatatacacacacatatatataatatacatgt

SEQ ID NO: 10494 - DNA, 63 bp, Homo sapiens
ccttgtgcccatgtgttctcattgttcaactcccacttatgagtgagaacacacggtgttagg

SEQ ID NO: 10495 - DNA, 84 bp, Homo sapiens
ggcaagaaaagaatgagagtgaagtgaaaggggtttcccgttacataaccctcttatctcatgagactcattcactatcatgct

SEQ ID NO: 10496 - DNA, 95 bp, Homo sapiens
acttgtaatctgtcagcacatcaatatatacaatatacattctgcacatgcaaatgtaaatgtttatatatgtatctgtgcctgtatatacaggt

SEQ ID NO: 10497 - DNA, 96 bp, Homo sapiens
cagaaaatgaagtgacatacagaaagagccagactagttatatgtatacattttatatattatagcttggcttttgtcttatttgagcacggtttg

SEQ ID NO: 10498 - DNA, 121 bp, Homo sapiens
gatcaaaaattggccaatcaaattaatgatctaagacaaactgttacatggatgggagacagaattatgagtgtagaacatagattacaaatgcagtgtgattggaatacttctgattttt

SEQ ID NO: 10499 - DNA, 91 bp, Homo sapiens
atacttgttgagaatctgatagagattaaattttatatatatatacacacacacatatatatatatggaagaatttttatgttaacagtat

SEQ ID NO: 10500 - DNA, 71 bp, Homo sapiens
gggacagcagcctgtgtcagtctcagaccctcaagagaactgaaggagccagaagcgctgggtgctggact

SEQ ID NO: 10501 - DNA, 104 bp, Homo sapiens
ggagggtactccactgtaattggtttatgcatttaaatgttagtgttctccaaaaataccctcacagacacactcacaatgtttgaccaaatagttgtgcatcc

SEQ ID NO: 10502 - DNA, 95 bp, Homo sapiens; identical to SEQ ID NO: 580

SEQ ID NO: 10503 - DNA, 93 bp, Homo sapiens; identical to SEQ ID NO: 69

SEQ ID NO: 10504 - DNA, 115 bp, Homo sapiens
ctaaatgataattacagctccaattctacttttacttccttaataagacattttgaagttctgaggaagtagagactagaagagtttctcaaccttggcattatttacattttgg

SEQ ID NO: 10505 - DNA, 74 bp, Homo sapiens
aattgtttggcctaagggaggagagagatttgactgctgtcacatttcactctctctctctggacctgataatt

SEQ ID NO: 10506 - DNA, 58 bp, Homo sapiens; identical to SEQ ID NO: 1240

SEQ ID NO: 10507 - DNA, 119 bp, Homo sapiens
tgcatgggtgtataatataaatatatactacatatatatgggtaatattatatatgtaatatatatttgtatgtaatattatccaattatatgtaagatgtatttatgtatatatggca

SEQ ID NO: 10508 - DNA, 90 bp, Homo sapiens
gttactagctttgtgtagttgcctttgtgtatatatatatatatatatacatatatatatagatagatagatgttcataatctttgtgat

SEQ ID NO: 10509 - DNA, 84 bp, Homo sapiens
agccactgatgtatgtgtatatatatgtatgcatgtatgtatgtatgaacatataagtgtatatatattcatctgtgagtggtt

SEQ ID NO: 10510 - DNA, 107 bp, Homo sapiens
tccttcacttatgaagcttagtttggctggatatgaaattctgggttggaaatttttttctttaagaatgttgaatattggcccccactcgcttctggcttgtaggg

SEQ ID NO: 10511 - DNA, 110 bp, Homo sapiens
tattttgcatttattacttagaacttgctgtaagctataatgaaaagggttggaagttcaattattttaatttttagcttccataaatgagtgagaacatgtgcagtttg

SEQ ID NO: 10512 - DNA, 153 bp, Homo sapiens
tgcttgtattcctatttgataacatatatgtacataatgcatgcatagttctgtataatttatatatgtgtatataatgtatgtatgtacatgtgtttatatatattatacatgtatataggtgtgtgtatttgtctgtgtctatgtgtgtgt

SEQ ID NO: 10513 - DNA, 119 bp, Homo sapiens
atctgttaaatgtcttttatatatatatatataaatatatgtgtttatagatatatacatttgtatatacacatatgtatatgtgtatatatatacatatatggatatatatacacaga

SEQ ID NO: 10514 - DNA, 94 bp, Homo sapiens
ggaaactgatgttaaagaatctcagctagatatggagtgtccaggaaggattatttatttttgctttcaagttttactttgacttcaagttttc

SEQ ID NO: 10515 - DNA, 110 bp, Homo sapiens
agattatagaggaattacagggcatgaccagttctgccatcagccatcaagaaacttatgattttgttgttaggatagaattcatcaagccacttaatcagtttgtatct

SEQ ID NO: 10516 - DNA, 111 bp, Homo sapiens
taggtttgtcttggctattcaaagtcttcctagatttcatgaaatttaaaacagattttctaattctgtgaaaaatgtcaatggaatttgatggaaatagcattgaatcta

SEQ ID NO: 10517 - DNA, 116 bp, Homo sapiens
gagcttttgtcagtgcatattcattatcacagtgaatatgcagtattgaatcttaaaataatattttatttaaagagatgaatattctggattgtgacatatgtatacaaaaggtt

SEQ ID NO: 10518 - DNA, 110 bp, Homo sapiens
gtcagagattcttgttctctgcccttactttctctaaaataaacagagtctctctctctgttcttagccatgcaaagctttgggtagagtaatacacgcatccttttggc

SEQ ID NO: 10519 - DNA, 68 bp, Homo sapiens
atatgtatctatatgtatgcacatacatatagaaaatatgtatatatatacatatagaaaatacgtat

SEQ ID NO: 10520 - DNA, 104 bp, Homo sapiens
aatggtcaactgtgttttaaagtgagtcctgcaatgaaatgataagtagtaagtacctatccattaccaaagtgattccttcaaagtagaacaggaggacgatt

SEQ ID NO: 10521 - DNA, 83 bp, Homo sapiens
gagaaagtagtgtcagaattgtaaagagagaaagatgtgatttttttctttttcttttttttttttttttgagacagagtctc

SEQ ID NO: 10522 - DNA, 58 bp, Homo sapiens; identical to SEQ ID NO: 315

SEQ ID NO: 10523 - DNA, 83 bp, Homo sapiens
gatggaggtattttatttttttctttgaggcggagtctcgctctgtcacccaggctggagtgcagtggcgcaatctcgactca

SEQ ID NO: 10524 - DNA, 105 bp, Homo sapiens
ggtgagagtgagactggcctttaggactgtgagttgagtgggagcagggtgaagcctgtgactgcaagatctccctcagttccctggtgacttgtatgactcagc

SEQ ID NO: 10525 - DNA, 65 bp, Homo sapiens
ggacagcatcaggtatttatgtctttatttatttgagcttagaccaaaatatctgctgttgtacc

SEQ ID NO: 10526 - DNA, 102 bp, Homo sapiens
agttgattgtttgcataaagacaaaatgactttgtcacattgatttaaatgtagtacagtaaagaagtgtgaacattttgtatccttcattgtaacttaact

SEQ ID NO: 10527 - DNA, 95 bp, Homo sapiens; identical to SEQ ID NO: 580

SEQ ID NO: 10528 - DNA, 93 bp, Homo sapiens; identical to SEQ ID NO: 69

SEQ ID NO: 10529 - DNA, 84 bp, Homo sapiens
tctggaacttctggatcacttaaggagatatggctatgtcaacatgattattaatatttattgctggatagccagagttttgga

SEQ ID NO: 10530 - DNA, 89 bp, Homo sapiens
ggagatcatggtagagaactgaaagggcttactcatttgcgatcaaatttgaattgtaaactactttcctagctacgtccatggtgttc

SEQ ID NO: 10531 - DNA, 111 bp, Homo sapiens
agccgtcatttatttagcaccttttagttgccagactttgtgctatgaatagaagtatgtaatgagatactgtaactgaaactgccaagtttttaaatatcattggtggct

SEQ ID NO: 10532 - DNA, 111 bp, Homo sapiens
ttggatttgaagctctagatgtcagggttgttttgttgctttttttttttttttttttttttcaaatttttaaagttaacttatttccctgcatccatagttcctgtttaa

SEQ ID NO: 10533 - DNA, 95 bp, Homo sapiens; identical to SEQ ID NO: 68

SEQ ID NO: 10534 - DNA, 93 bp, Homo sapiens; identical to SEQ ID NO: 69

SEQ ID NO: 10535 - DNA, 95 bp, Homo sapiens
agaggtccttcatgtcccttgtaagttgtattcctaggtattttattttctttgtagctattgtgaatgggaattcgctcatgattgggctctct

SEQ ID NO: 10536 - DNA, 85 bp, Homo sapiens
cgtctgtctatatatacatgtgtgtatacatatatatgtatatatgtgtgtgtagatacatgtatctatatatgtgtggatagat

SEQ ID NO: 10537 - DNA, 94 bp, Homo sapiens
gttctcttcaacagaaatgagagaagacacacagctctaagactcgaatttccactatgtgtctgtttattctttcattgaccttaaaagaggc

SEQ ID NO: 10538 - DNA, 95 bp, Homo sapiens; identical to SEQ ID NO: 68

SEQ ID NO: 10539 - DNA, 93 bp, Homo sapiens; identical to SEQ ID NO: 69

SEQ ID NO: 10540 - DNA, 71 bp, Homo sapiens
tatacacacacacatacacacacactacatatatatatatgtgtgtgtgtatatatatatatgtgtgtata

SEQ ID NO: 10541 - DNA, 112 bp, Homo sapiens
tgtactttaaggaaaatgattagactcttgcaccagcctttgtaacactgggagttcttttttacaacgtattggtagttctgcagttcttctatttttaagtaaggataca

SEQ ID NO: 10542 - DNA, 119 bp, Homo sapiens
atgtattctagatatatttctataccagtactatagatttgtatgataaaaattttaatatttatatagatttttagaagtagaattgctgttaaggaaatgtatttttagggttatat

SEQ ID NO: 10543 - DNA, 97 bp, Homo sapiens
catatatatttgtatgtgtgtgtatatatgtgtgtattatatatatacacatatatacgtatatatatgtgcatatacacacacacacacacacaca

SEQ ID NO: 10544 - DNA, 130 bp, Homo sapiens
tggctgatatatatatatataatgtatgtatatatatgcacacatatatatgtgtatatatatgcacacatatatatgtgtatatatatgcacacatatatatgtgtatatatatgcacatatatatgtg

SEQ ID NO: 10545 - DNA, 112 bp, Homo sapiens
gtataaccattcctttttcttcacaacctcgccagaatctgttatttttgactttttaataatagctcttctgactggtgtgagataatatctcattgtggttttgatttgc

SEQ ID NO: 10546 - DNA, 113 bp, Homo sapiens
tgaatattctcattagtactgaaattattctcatgctagttacatattaataagctttttatttataaaagtttactaataatgagaaatttgtttctttggttttgatttca

SEQ ID NO: 10547 - DNA, 60 bp, Homo sapiens
cacagtgctacatatgagaacatagtaaagcttgtgagcaatcatgtgtaggcagatgtg

SEQ ID NO: 10548 - DNA, 81 bp, Homo sapiens
tttctgtattgtatgtatatgtatgtgtatgttacaattgctggcaaaagactacaaatacatatgcatacaaaatataaa

SEQ ID NO: 10549 - DNA, 112 bp, Homo sapiens
ttttacagctaaatgaacaaagccctctaacatcttataaacaaatactgacatatttgtcaaattgtatttgtgagatgtcttgaagatttgtaattattttatcttaaaa

SEQ ID NO: 10550 - DNA, 88 bp, Homo sapiens
ttacttacttacttagttgcttttgaaacagagtctcactctgtcagccaggctggagtacagtggtgtgatctgggctcacagcaac

SEQ ID NO: 10551 - DNA, 115 bp, Homo sapiens
agtggtatatgctatggaaggcctcagggaagttaaataaagtagaaacttgtatagttaaaagtgtcactactaaaaaatgattgacttagagctacataaatagaacatcact

SEQ ID NO: 10552 - DNA, 101 bp, Homo sapiens
tgttctgcctagaaaggaacctaccaacatacaaagattagagccaccacggacctgaaaagtcattttgatgttaactagtgtttcaaataggaaggata

SEQ ID NO: 10553 - DNA, 97 bp, Homo sapiens
aatattggtttttcaccattctctcaacttgctacttctggaactcctgttagtgatgtgtgggagcagagagacattagtagtgctcaccaatatt

SEQ ID NO: 10554 - DNA, 119 bp, Homo sapiens
gtctgttaattcaaaggcaggaagagtacagagtggccaggcagcagtcttaacttccagttcagtggaatcattgctgggtctcctcatggaagcattcttcccttgggaactaagac

SEQ ID NO: 10555 - DNA, 109 bp, Homo sapiens
atacgttaaatttacacaatgggcaagggattggtaaatggaaattcttaaatatagtaaatatttttactaattttaaggcctacaaaattgtaacaatgtgatgtat

SEQ ID NO: 10556 - DNA, 81 bp, Homo sapiens
aattactatacacattttatgtatttttaatggtaaaattttcctttgcttcttttacaagtgcattgtgtgtatgtaatt

SEQ ID NO: 10557 - DNA, 106 bp, Homo sapiens
tggtgtggtgtccagggttcgtcctcctgtcatgctctctctctcttgtgccctggcaacgacagaaagactcagaatttcaaaagaccaatatgcaaaccaccca

SEQ ID NO: 10558 - DNA, 73 bp, Homo sapiens
ctccccagacgtgtgtgcatgtgtgtgtgggcacgcatgcacacacacacacatgcacacacacatacaggag

SEQ ID NO: 10559 - DNA, 95 bp, Homo sapiens; identical to SEQ ID NO: 580

SEQ ID NO: 10560 - DNA, 93 bp, Homo sapiens; identical to SEQ ID NO: 69

SEQ ID NO: 10561 - DNA, 95 bp, Homo sapiens; identical to SEQ ID NO: 68

SEQ ID NO: 10562 - DNA, 93 bp, Homo sapiens; identical to SEQ ID NO: 69

SEQ ID NO: 10563 - DNA, 93 bp, Homo sapiens
ccatgtaggttacatattgcatgattctatttatataagattcttgaaatgacaaaaattatataaatggggaatacattagtagctttcggg

SEQ ID NO: 10564 - DNA, 81 bp, Homo sapiens
cagtctactaataagctcatcaaaggaattcttcacttctgtcacagtgtgtctggaattggtgggttcttggtctcactg

SEQ ID NO: 10565 - DNA, 68 bp, Homo sapiens
ggatttaaatgtatacacatatgtatatgtatatatatatgcacatatgtgtgtgcatgcacatttcc

SEQ ID NO: 10566 - DNA, 106 bp, Homo sapiens
ttaattgtgtcctaatttattgcgtaatgtctttactattcaaattcaatgtatatcttgctgaaagatgtgaagaggcttattgtgcaacaaattactcaattgg

SEQ ID NO: 10567 - DNA, 91 bp, Homo sapiens
tcacagagtgcagaagatgctgattccttgattcagtccccaagagatctgattctgttaatctgtggtgaaattcaggaaaccgcatttt

SEQ ID NO: 10568 - DNA, 115 bp, Homo sapiens
tattggacattatttattggatgactaattaggaaacataattttatatgtatgtgtgtgtatatatatataaaactgtttcctaattagccatctagtatatatagtgtatgtg

SEQ ID NO: 10569 - DNA, 109 bp, Homo sapiens
gtgtgtatatatgtaggtatgtatatatagtggatagtgtatgtgtgtgtatatatatatatacacacacacagagacacatatatatgtatatatgtacaatttccac

SEQ ID NO: 10570 - DNA, 133 bp, Homo sapiens
catatatatatgtatatatacgtgtgtgtgtgtatatatgtatatatatatgtgtgtgtgtatatatatgtatatatacgtgtgtgtatatatatgtatatatacgtgtgtgtgtatatatgtatatatatgt

SEQ ID NO: 10571 - DNA, 71 bp, Homo sapiens
gtctcctgagtagctgggactatgtgcacgtaccaccatgcccagctaatttttttatttctcatgaagac

SEQ ID NO: 10572 - DNA, 105 bp, Homo sapiens
gaggcatctatcacttttaaatgcatatcttagactttatttatatttaagtttttttatttagaaaaagtaaaatataagcaggaaaagtggaaaatagtcttc

SEQ ID NO: 10573 - DNA, 95 bp, Homo sapiens
gtagacacaatggtagagaaggtagattttttgctatgaagtgccattattaaatgtttttgagtgaagaatgtaagctctatcactgtgaatac

SEQ ID NO: 10574 - DNA, 102 bp, Homo sapiens
ttttgttcgtgcggcaaatttacagtctttgacatttgaacattaaggccataaaacaattaattttattattaaacactgggacagggttgcagaataaga

SEQ ID NO: 10575 - DNA, 89 bp, Homo sapiens
caaaaattagctgggtgtggtgttgcatgctgtagtcccagctactcaggtggctgaggtagtaggatcaccagagcccagggaggttg

SEQ ID NO: 10576 - DNA, 72 bp, Homo sapiens
gcaagttgaaacatcagtcacagtctctcaaaacattatgttacaaaggctgtgatgaagttgcagctctgc

SEQ ID NO: 10577 - DNA, 116 bp, Homo sapiens
aaccgttaacatctgtttccatatgaccaattcattatagacactaaagagtggtgtgctgattttttttttattatactttaagttctaggatacatgtgcagaatgtgcaggtt

SEQ ID NO: 10578 - DNA, 58 bp, Homo sapiens
tgagagggagtctcactctgtcactcaggctggagtgcagtggtgcgatactggctca

SEQ ID NO: 10579 - DNA, 106 bp, Homo sapiens
ggttaaccggcttcagctctacactgctgacttagactgacagcaattgcgttccttctcttgctctctggttctctcaaacagtgttactgtagctaatctctcc

SEQ ID NO: 10580 - DNA, 95 bp, Homo sapiens; identical to SEQ ID NO: 68

SEQ ID NO: 10581 - DNA, 93 bp, Homo sapiens; identical to SEQ ID NO: 69

SEQ ID NO: 10582 - DNA, 101 bp, Homo sapiens
tgggctatgttgtgacacatctggtaaaggctttcaggtatcttccttgatgtgagaactgagagtcctcataagatttgggagtaagggcaacaagatca

SEQ ID NO: 10583 - DNA, 108 bp, Homo sapiens
ttctttacagaatactttttaaatgggaaataagatgctgcgcacttgtgaatatcacattttgcttttttttttttcaccatcttaaataaagtctaaatgagagag

SEQ ID NO: 10584 - DNA, 113 bp, Homo sapiens
atatatatatatatatatatatatatttattcatatacatacatgtatgtgtatatatttattcatatacaggtatgtatgtgtatgtgcgtgtatatatgtgtgtatatata

SEQ ID NO: 10585 - DNA, 76 bp, Homo sapiens
aatggtgatattggcagataaagcagtttttctggtgtttgcacgtgagagaagtgactctggccaatctactgtt

SEQ ID NO: 10586 - DNA, 87 bp, Homo sapiens
gtctcctatttcttttttctattacatgaaaaatatatccagacattgttttggagcattagaaaagagtggtagtttctaggagac

SEQ ID NO: 10587 - DNA, 56 bp, Homo sapiens
gactacacactatgcactatggaggatgtgtctgtgtgtatatctgtgtgtgtgtc

SEQ ID NO: 10588 - DNA, 115 bp, Homo sapiens
gttaatgacagttttgtgttgctctaaactatttttgaaatttttgattttcttttgctagagcatgaaagtcattgcatggcagagatgtttgtctgcacatttctattctgac

SEQ ID NO: 10589 - DNA, 89 bp, Homo sapiens
cagactggcacatggccagctctgtctcatacctgactctaaggtcatcagcagcaagatgagtgttgtcagtctgcagagcgatgcta

SEQ ID NO: 10590 - DNA, 104 bp, Homo sapiens
acctttatttccttgtgtgtatttgattaaattgtgtgtttgatttaatttttaaaatagaggttaattcattcacatggttcaaatactaaaaatataatggt

SEQ ID NO: 10591 - DNA, 96 bp, Homo sapiens
ttgtgttcagatttccctaattgtttcattttttacaatgtatttgaaaaaggatttaaataagtttcatgattatattgggtgatttgaattcaa

SEQ ID NO: 10592 - DNA, 71 bp, Homo sapiens
ctggtccagaatggacgatatgggtggaggggtgagtcagtattgtttttcatgttggtggttggactcag

SEQ ID NO: 10593 - DNA, 71 bp, Homo sapiens
ggaggtggggtacaaacaggcagtttggctcaagttttagctctctgccactgtcacattactccacagcc

SEQ ID NO: 10594 - DNA, 117 bp, Homo sapiens
ggcatggcgctcggctcattttttctttttaagggaactgaaatgacagctgaagtgtactactatttttatttttatttatttatttgagtttttgagagagagtctcgctctgtc

SEQ ID NO: 10595 - DNA, 74 bp, Homo sapiens
gcctcctgagtggctgggattacaggtgtgtgcctccacacctggctagtctttgtatttttttctgtagaggc

SEQ ID NO: 10596 - DNA, 105 bp, Homo sapiens
acaagaagctagacaaaagcattgtccctaatatatatttatattcttttttgtccagtggactgaatatatatctggatctccagtttttgttgttgttgttgt

SEQ ID NO: 10597 - DNA, 94 bp, Homo sapiens
ctagagaggttgtcagggaagaggtttaactttatccagaagattcttttttttttttttttgagacggagtctctctctgtcacccaggctgg

SEQ ID NO: 10598 - DNA, 101 bp, Homo sapiens
ctcctccatcctcttctaacagaaaccatctcactcacttactctggccttagggtattctctgagcaaaggatggttgctgaatgagtcaggagcaggga

SEQ ID NO: 10599 - DNA, 87 bp, Homo sapiens
attcaacaaaattagaattagatcaaatttattttaattttctatttttgtttacatatatttgatctacttctgattttgctgaat

SEQ ID NO: 10600 - DNA, 86 bp, Homo sapiens
gtgtgtgcacctgtgtgtgtgtgcatgtgcatgtgtgtgcatgcgtgtgtatgcatgtttgtgtgtgtgcatgcatgtgtttgtgt

SEQ ID NO: 10601 - DNA, 86 bp, Homo sapiens
ttgagacagggtctcactctgtcacccaggctggagtgcagtggcgtacatctgcctcccgggttcaagtgattctcctgcctcaa

SEQ ID NO: 10602 - DNA, 127 bp, Homo sapiens
catcacagaggaagaaagcaaggtggggctggggagtgggtgagtgcctcagtccctgtttgcctgtctggagtgaaactatgggggaagcaggacatggagggacctgaccccacccaaggaggct

SEQ ID NO: 10603 - DNA, 94 bp, Homo sapiens
gtggtggcaagtgcgtgtagtcccagctactcaggaggctgaggtggaaggatcacttgaactcagggaggttgaggctgcagtgagtcatgat

SEQ ID NO: 10604 - DNA, 98 bp, Homo sapiens
tcctgttgtcctgtctgtgaagtgtgcaatgcacataatcactcacacacacacacacacacacacacacacaccccttcccagacaggttaaaggga

SEQ ID NO: 10605 - DNA, 113 bp, Homo sapiens
cttcttagtcaaagtgtctctgacattggtgggaaagtcctaaaggatggagcctcaatgtggctgggtccctgaatcactgcatggaggagagtcacacacaaaccaggaag

SEQ ID NO: 10606 - DNA, 81 bp, Homo sapiens
tgccgtaattggggtggttgacgttgtaggttgacttgtctgatttccctatgagcatctcattgtctcccaaggatggta

SEQ ID NO: 10607 - DNA, 98 bp, Homo sapiens
gagggagatctagagaagagagtaaacagataggttggttacattctttatttatttatttatttatttatttttttttttttgacagagtcttgctc

SEQ ID NO: 10608 - DNA, 105 bp, Homo sapiens
caagttaatgaccttcacttttgttttggtttaatcaatgcatgaaatagaattattcttgttctgattgatctatgagaatggatagaagctcatttcaatttg

SEQ ID NO: 10609 - DNA, 61 bp, Homo sapiens
gagttctgtgttcatggtgagaggcttttcctctgtttaccagcagggaggacaggcactt

SEQ ID NO: 10610 - DNA, 93 bp, Homo sapiens
gcgttaccacctgagctccacctcctgtcagatcagaggcagcattggattctggtaggatcgcaaaccctattgtgaactgtgcatgcgagg

SEQ ID NO: 10611 - DNA, 108 bp, Homo sapiens
tgttatattctaatccattgtagttactcttacttgcagggaccagccccacagggtcggtgggtctgtccgtgtgtgcggagatgacagagtgtagaaataaagaca

SEQ ID NO: 10612 - DNA, 95 bp, Homo sapiens; identical to SEQ ID NO: 68

SEQ ID NO: 10613 - DNA, 93 bp, Homo sapiens; identical to SEQ ID NO: 69

SEQ ID NO: 10614 - DNA, 90 bp, Homo sapiens
tgggataaatgcaattgttgggttatatgtggtagttgcttgttgagttttttaagaaattgccatactgtttctaaaatggctgtccca

SEQ ID NO: 10615 - DNA, 68 bp, Homo sapiens
gctaactcttcaacagagtgatcagagttccagaacattctagatcaatcacatgaagaagtgttggc

SEQ ID NO: 10616 - DNA, 97 bp, Homo sapiens
tatatttatattaaatatatgtaatatatatcaaatatatatttataatatataaaaatatgtatttaatatataatatgtaaatgatatgcatata

SEQ ID NO: 10617 - DNA, 108 bp, Homo sapiens
gcttgaacttgatgtttatgatcttggagtgaagccaataattactattttctttttaaaaagtatctggctcttagaaaattctaagaataatgcagaagtgcaagt

SEQ ID NO: 10618 - DNA, 123 bp, Homo sapiens
tatataatatatatgtataaatataaatatataatatatatgtataaatataaatatataaatgaaattatatatgtgtatatgtacatataatttatatatgtatatatattatatatgtat

SEQ ID NO: 10619 - DNA, 136 bp, Homo sapiens
gtgtatatatgtacatatacacatatatacatatgtatatatgtatatacatatgtgtatatatatacatatgtatatatgtatatacatatacatatataaatttcatttatatgtgtaaatgtacatatacata

SEQ ID NO: 10620 - DNA, 110 bp, Homo sapiens
ttttgaggtaagactgtgacccttttggtgtcttactaaattatttcatgactatgaatttttatattaaatagtgtttcttaccaagatatcatactcttacttctgga

SEQ ID NO: 10621 - DNA, 67 bp, Homo sapiens
ttatgtatatatacatatgtatacacacataacatttatgtatatatacatatgtatacacacataa

SEQ ID NO: 10622 - DNA, 77 bp, Homo sapiens
tgtatatatacatatatatacatatatatacacacataacatgtatatatacatatgtatgtatatgtgtatataca

SEQ ID NO: 10623 - DNA, 109 bp, Homo sapiens
gtgactttgttctttttgcttaggattgtcttggctatatgggctcttttttggttccatatgaaatttaaagtagttttttctaattctgcaaaaagtcaatggtagc

SEQ ID NO: 10624 - DNA, 98 bp, Homo sapiens
aggtcagcagcagtcaaagattcgaaggggcccttctgcagagctccacagtgctctgtctgtgtgtctccctcatttctggtcctttgccctggcct

SEQ ID NO: 10625 - DNA, 110 bp, Homo sapiens
atcacttggagggcttgttaaaatgcagattgtgggccccgctctcagaatctctgattcaggtctggggtggaactaagaaatcaaattccagcatgtttccaggagat

SEQ ID NO: 10626 - DNA, 116 bp, Homo sapiens
tgaaatttatatttgtgacccactgttggacagtgctggtctagatccatctatatgtctgtatatttatgttttagaaacatcactgtcttcccaacagaaaagaataactttca

SEQ ID NO: 10627 - DNA, 95 bp, Homo sapiens; identical to SEQ ID NO: 68

SEQ ID NO: 10628 - DNA, 93 bp, Homo sapiens; identical to SEQ ID NO: 69

SEQ ID NO: 10629 - DNA, 72 bp, Homo sapiens
ttcatttgtggcatatttaagctgtggtttatttcattaaattttctgcttaattgatgcctcataaatgag

SEQ ID NO: 10630 - DNA, 74 bp, Homo sapiens
ctcagagactcactctcactgaggctggagtgtagacacgtgatcatagctcactgcagccttgaattcctgag

SEQ ID NO: 10631 - DNA, 108 bp, Homo sapiens
ctgggtttgaggtcctctgagctgttcagggaggatatccagcaggccccaggagatgcaggccaggtgctacagtcctttgcctagacagcagaggtgcacatttag

SEQ ID NO: 10632 - DNA, 114 bp, Homo sapiens
ttgtgaacctggcttggttttttcagcagttggtaaactgataagcctgtttctcactctgtcattcatctcatcagtttaccagcccagaaatactcctttcagtctttacaa

SEQ ID NO: 10633 - DNA, 92 bp, Homo sapiens
gagctaatggggtatgtcacagtccaagttccaaggcctgagaacaaagagtgcagatgtcctaaggcaggagaagatgaatgtcccagctc

SEQ ID NO: 10634 - DNA, 113 bp, Homo sapiens
ccaatgtacccttggaagcatatgccatttgttctttatattaaaagggaagcagagcttttttttttttaaagatcaggtcttgctctgtcatccaggctgaagtgcagtgg

SEQ ID NO: 10635 - DNA, 85 bp, Homo sapiens
ctgagcatctaggttgtattgttaccagtaaaattcacagagaaccaaactggcaatatgtacgatgtggcttaagatattttag

SEQ ID NO: 10636 - DNA, 105 bp, Homo sapiens
aagtttggtgatgttttgggggcctaaaatatgccacaggaatttaattctatttatatcaattagcctatggtaaaattagtttcattatacatcattttgctt

SEQ ID NO: 10637 - DNA, 108 bp, Homo sapiens
ctatacaaagtataaaagaactttccaagagagagaatagagagggcaaaggcactagggcagaatgggccccacatgttagagaattggagaaagtatgctgtgtgg

SEQ ID NO: 10638 - DNA, 84 bp, Homo sapiens
acgaactgacaggagtgataaagtgaatgtttatcattgtttatcagaagttaaatatatccaaatcattcctgtcagtgaagt

SEQ ID NO: 10639 - DNA, 96 bp, Homo sapiens
acataatttaacctttccccagtgactcagcatcactattataaatatcagacaatttgctgtgacactgactcattgtcaaaaggttaattatgt

SEQ ID NO: 10640 - DNA, 84 bp, Homo sapiens
tcctttcactgccattctcactctttctgattaaagaaaaggcacaagtgtactcatctgaaagtcagatgtttgaggaaggga

SEQ ID NO: 10641 - DNA, 66 bp, Homo sapiens
gtgtgtgtgtgtgtgtgtgtgtgtgtgacctactaaaaggtagtataccatacattcataccagac

SEQ ID NO: 10642 - DNA, 88 bp, Homo sapiens
actccagcctgggcaacacagaaagaacttgtctctttttttttttttttttttgacatggagtctccctctgtcaccaggttggagt

SEQ ID NO: 10643 - DNA, 68 bp, Homo sapiens
gaggcagagtctcgctctgtcacccagcctatagcccaggctggagtgcagtggcgtgatctcggctc

SEQ ID NO: 10644 - DNA, 58 bp, Homo sapiens
tgagagggggtctcgctctgtcactcaggctggagcgcagcggtgtgatctcagctca

SEQ ID NO: 10645 - DNA, 108 bp, Homo sapiens
gtgcatgtgtaaatatatatacacacatgtagcaggtgtatatataggtagcatatatatatatttgtatatatatctatatatgtgtgtgtgtgtgtgtgtgtgtat

SEQ ID NO: 10646 - DNA, 87 bp, Homo sapiens
gtggctcaggcctgtaattacaacactttgggaggctgaggcaggagaatcacttgagcacagaagtttgagaccagcctgggcaac

SEQ ID NO: 10647 - DNA, 108 bp, Homo sapiens
ttgagttatttagggataggtcgcgctatcactctaaagatgaatgtgctattccggataatagtaacatcttgggggaatgcgtgtaggcagagaaatggcggtcag

SEQ ID NO: 10648 - DNA, 84 bp, Homo sapiens
ggaggctgaaagtctgagatcaaggtgtcagcagggttggtttctgctgagacctctctccttggcttgtagatggctgccttc

SEQ ID NO: 10649 - DNA, 58 bp, Homo sapiens; identical to SEQ ID NO: 2263

SEQ ID NO: 10650 - DNA, 117 bp, Homo sapiens
gtgaaatggcatctcattgtggttttgatttgcatctctctgattattagctatgttgagcatttttttatatttgttagccatttgtatgtcttcctttgagaagtgtctgttcat

SEQ ID NO: 10651 - DNA, 85 bp, Homo sapiens
ttcgctgtgttacttgggtgaggtttattttattttagtttagtttttaggggggacggagtctcactctgacacccaggctgaa

SEQ ID NO: 10652 - DNA, 88 bp, Homo sapiens
tgttgccagaacagtggcagataatttttgttttcattttttaatagtatgtggcttcttctctctgttcactgtgcctggctttaca

SEQ ID NO: 10653 - DNA, 85 bp, Homo sapiens
tgtatctgtgtagttttgtgtgaaagagacagaatggtatgatttttttttaatctattcatagtaaagagactgcaaagatata

SEQ ID NO: 10654 - DNA, 95 bp, Homo sapiens; identical to SEQ ID NO: 68

SEQ ID NO: 10655 - DNA, 93 bp, Homo sapiens; identical to SEQ ID NO: 69

SEQ ID NO: 10656 - DNA, 67 bp, Homo sapiens
tgcagaaagttccatttgctgttgaatagaatgtatattctgtggttgttggatggaatgttctgta

SEQ ID NO: 10657 - DNA, 90 bp, Homo sapiens
caagagagtacatactatttgattctatttatatgaaagctaagaacaggcataactaatttatgtattagaatagtggttactcacttg

SEQ ID NO: 10658 - DNA, 82 bp, Homo sapiens
tatttttgatatatatatatctcgatatatatatatcttgatatatgtatctcgatatatatatatctcgatatatatatat

SEQ ID NO: 10659 - DNA, 118 bp, Homo sapiens
gataataaatgtctgcatttgatggataaccaaattattctgatttgatcattaaacattgtatatatgtatcaaaatattatgggtatcctattaatatgtaaaatcgttatgtatc

SEQ ID NO: 10660 - DNA, 61 bp, Homo sapiens
gagcaggaaagaatggcggggatggggttttaacccaaactctctctcttacactctgttc

SEQ ID NO: 10661 - DNA, 95 bp, Homo sapiens; identical to SEQ ID NO: 68

SEQ ID NO: 10662 - DNA, 93 bp, Homo sapiens; identical to SEQ ID NO: 69

SEQ ID NO: 10663 - DNA, 73 bp, Homo sapiens
tggatctgctctttagatttgaggccttaattgtaaatatttatttaggagtttttcgtcttgaggaagtcca

SEQ ID NO: 10664 - DNA, 111 bp, Homo sapiens
acatgtatatacatacatgtacatatgtatatacgcatatgcatgtatatgtatgtatatgtatatgtatgtacatgtatatgtatatatacatatgtatatataaaatat

SEQ ID NO: 10665 - DNA, 105 bp, Homo sapiens
tatgtacatatatgtatgttatatatgtgcatatatacacatatgttatatatgtatatatgtgtatatataaatatataatatataacatacatatattatata

SEQ ID NO: 10666 - DNA, 122 bp, Homo sapiens
tataacatatatacatatataacatatgtatatatgtatatatatgtatatatgtacatatatatgtgttatatatgtacatgtatatgttatatatgtacatatatgtatatatgtgcata

SEQ ID NO: 10667 - DNA, 67 bp, Homo sapiens
cacagtgagactctgtctctatgcaaattttttaaaaaatagcccggcatggtggcatgagactgtg

SEQ ID NO: 10668 - DNA, 111 bp, Homo sapiens
tttaatttatcaataatgatcaattttggccaacattagtgggtaggtatatgaaaaatataaatatatatttctactttgaagtcataatcatattgtaagtgaattggg

SEQ ID NO: 10669 - DNA, 118 bp, Homo sapiens
tgaactttgaaaaacaatagggattttgagaggtgaaaggtgaaagaacgctgccagctgaggaaacagagtgagcacaggatttctgctttataagctgaataagccctgggttcag

SEQ ID NO: 10670 - DNA, 117 bp, Homo sapiens
tgtattgtattaaaatacttcaatgttgcgtttctggcaaatgactttatttttttttgagacggagtctcgctcttgtcgcccaggatggagtggagtggaatggcacgatcttgg

SEQ ID NO: 10671 - DNA, 80 bp, Homo sapiens
gttgagcatgcctgtgggagaggaggtagataaaagaagctcccatgatctatatcctctctcagacccagtctgtcaat

SEQ ID NO: 10672 - DNA, 141 bp, Homo sapiens
acatactaacacaaaaaactaacaaatgtagttttttttaacaactaaaagtgcattagctgtgtgtgtgtgtctgtatgtgtaggaggatgtttctctgtcagccatgataggcaacattctgctgcaggaatagcaaac

SEQ ID NO: 10673 - DNA, 91 bp, Homo sapiens
tggtaatcagtgcaatacttcaagctttttcattattattatttgttatgatgatctgtgattttactattgtaattgttttgaggtgcca

SEQ ID NO: 10674 - DNA, 112 bp, Homo sapiens
cactaagaggtcagagctttaaaatggcacttgtaacaaagggaagagtcaaattgttcttgtcactaattagttcagatgttatttcaaattcactttggctctgttattg

SEQ ID NO: 10675 - DNA, 118 bp, Homo sapiens
gcgtgcatgcatccctagtgtctctctgtgtgtctgaatcttgtctttttatttttttatttttgagatgaagtcttggtctgtcacactggctgcagtgcaatggtgcaatctcagc

SEQ ID NO: 10676 - DNA, 81 bp, Homo sapiens
atatatgtatatatatttaggtcatatatatagatatagatctatctatatatatagatctatatctatgtctatatatat

SEQ ID NO: 10677 - DNA, 116 bp, Homo sapiens
gctaatttttgtatttttagtagagaagggttttcatcatgttggccaggatggtctcggtctcttgacatcatgatccacccacctctgcctctcaaagtgctgtgattacaggc

SEQ ID NO: 10678 - DNA, 102 bp, Homo sapiens
tttattcacagaaaagggcaaactcagtagaagaaagtttctttataaatactcagataaagaaacatttcagtttattagcttattttttcagtcagtaaa

SEQ ID NO: 10679 - DNA, 95 bp, Homo sapiens; identical to SEQ ID NO: 580

SEQ ID NO: 10680 - DNA, 93 bp, Homo sapiens; identical to SEQ ID NO: 69

SEQ ID NO: 10681 - DNA, 109 bp, Homo sapiens
gtctctctctgttggccaggctggagtttgagatggagtctctctctgtcagctatgctggagtttgagatggagtctctctctgtcggccaggctggagtgcagtggc

SEQ ID NO: 10682 - DNA, 102 bp, Homo sapiens
gtggttttaattagcatttctctgatgattagtgatgttgaacattatttttataatctgttggccatttgtcttttttcaagaaatgtctattcagatctc

SEQ ID NO: 10683 - DNA, 96 bp, Homo sapiens
agagtgacgtattggcacacaaacttcttatcctcaaaaacatacatccaaatggaatgttattttatgtaagctattgtgtggcaaaatagctct

SEQ ID NO: 10684 - DNA, 73 bp, Homo sapiens
agtgctgaaagtgagatgtgctgatagtgggatgttggggtctctaactattattgtatttctctttagctct

SEQ ID NO: 10685 - DNA, 95 bp, Homo sapiens; identical to SEQ ID NO: 68

SEQ ID NO: 10686 - DNA, 93 bp, Homo sapiens; identical to SEQ ID NO: 69

SEQ ID NO: 10687 - DNA, 58 bp, Homo sapiens
tgagtcagagtctcgctctgtcacccaggctggagtgcaatggcgcgatctcagctca

SEQ ID NO: 10688 - DNA, 155 bp, Homo sapiens
gtgtatatatattcatatctatgtgtatatatattcatatctatgtgtatatatattcatatgtatgtatatatacatatatacacatatatacatatctttcatatatatgagacatatacatgtgtgtgtgtgtgtgtgtgtgtgtgtgtgtg

SEQ ID NO: 10689 - DNA, 92 bp, Homo sapiens
tagacaccactgacaacagaatatgtacatacagaagaatgtgtgcacatatgtgtatgtgtgtgtatatgtgtcagtatgtgtgtgtgtgt

SEQ ID NO: 10690 - DNA, 74 bp, Homo sapiens
gtcaaggtgggaggatcacttgaagacagaagtttgagaccagtctgggcaacatagtgagaccttatctctac

SEQ ID NO: 10691 - DNA, 93 bp, Homo sapiens
acctcttttctttgtaaattacccagtctcaggtagttctttatagtggtgtgaaaatggactaatacagaaaattggtactgggaatggggt

SEQ ID NO: 10692 - DNA, 67 bp, Homo sapiens
gaataaattaaaaaccatcaaattgcacacttcatatgagtgaattttatggtttttaatttatatc

SEQ ID NO: 10693 - DNA, 108 bp, Homo sapiens
taagagataggtatgcatatcaatgttagaagttatttactacttatgaatgtgtaatttttctattttataataaagtttcatggcttctctgggtaccttctattg

SEQ ID NO: 10694 - DNA, 73 bp, Homo sapiens
agtctcactctgtcacccagattggagtgtaatagctcactgcagccttgaactcctgggctcaggggatcct

SEQ ID NO: 10695 - DNA, 88 bp, Homo sapiens
ggagaactatgaactgctgatttaatgattttaatttaagaattttttaaaatgtattctttgaatcacagctctttcattgcactcc

SEQ ID NO: 10696 - DNA, 112 bp, Homo sapiens
agcctgggcaaaactccgtcttaaaaacaaacaataataaaatgaattttttttaaaaaatgaaagaagcaattatggaattgttttgttaacttggttagtgaacagagct

SEQ ID NO: 10697 - DNA, 92 bp, Homo sapiens
gacagctacatgcgtttttgcagtatttatgtatttatttatttattatactttaagttctgggataaatgtgcagaaagtgcaggtttgtt

SEQ ID NO: 10698 - DNA, 77 bp, Homo sapiens
ttatgctactactatattctttttttttttgagacggagtctcgctctgtctcccaggctggagtgcagtggcatga

SEQ ID NO: 10699 - DNA, 73 bp, Homo sapiens
ggggaagagatgcttgtctgtggattttgtttccttttatgagatagaatcttccttgtgtctctctgtctct

SEQ ID NO: 10700 - DNA, 95 bp, Homo sapiens; identical to SEQ ID NO: 68

SEQ ID NO: 10701 - DNA, 93 bp, Homo sapiens; identical to SEQ ID NO: 69

SEQ ID NO: 10702 - DNA, 86 bp, Homo sapiens
gagtgtcactctgtcacccaggctggagttcagtggcacgatcttagctcactgcatcctctgcctcctgggttcattcgattctc

SEQ ID NO: 10703 - DNA, 88 bp, Homo sapiens
agaaggaggaaatactcatgacaattaccatccttgtttatgcatctggtcacgtggttgtagctagtattgatgactaccttcttct

SEQ ID NO: 10704 - DNA, 94 bp, Homo sapiens
ataatgttcatattctttaagagtatggctcttcagagaaaatatcataattttttatttgagataatcatgcctgaagtttatggagcattat

SEQ ID NO: 10705 - DNA, 116 bp, Homo sapiens
ttggaagaggataatagttgtattacatgtttatattcatattagatatacatatttattatatttaattaattaggtaatataaaatatgtgattgggctatgatgctatatcaa

SEQ ID NO: 10706 - DNA, 58 bp, Homo sapiens
tatgtatgtatacatatatatgtgtatttatgtatacatatatatgtgtatatatgta

SEQ ID NO: 10707 - DNA, 74 bp, Homo sapiens
gtatatatgtatgtatacatatatatgtgtatatatgtatgtgtatttatgtatgtgtatatatgtatgtgtat

SEQ ID NO: 10708 - DNA, 100 bp, Homo sapiens
tggggaactgttgggaaggcatgtttggttttgaaatgtaaagatatgagatttgggaggggccaggggtgcaatgatatggtttggctctgtgtcccca

SEQ ID NO: 10709 - DNA, 79 bp, Homo sapiens
gtagatacttggaaggctgaggtagaaggatctcttgagctcaggaggtcatccctgcagtgagctttgattgtactac

SEQ ID NO: 10710 - DNA, 58 bp, Homo sapiens; identical to SEQ ID NO: 315

SEQ ID NO: 10711 - DNA, 106 bp, Homo sapiens
tctttttccaggcacgatggtaggtgctcactgatttatcttatataatttttatttatttattcatttttgagacagggtgtacctctgtcttccaggcaaaaga

SEQ ID NO: 10712 - DNA, 102 bp, Homo sapiens
gcattgtcttggctattcaggctgtttttggttccatatgaaatttaaagtagtttcttttaattatctgaagaaagtcagtggtagcttgatgaggatagc

SEQ ID NO: 10713 - DNA, 86 bp, Homo sapiens
ctcccacaacacatgggaattcaagatgagatttggggggcgacacagccaaaccatatcactcaatttatatatatcatgtggag

SEQ ID NO: 10714 - DNA, 98 bp, Homo sapiens
tgctgggtcaagggtgtgggagtgaggcaggtgtcactaccatctgctaggttgtggaacacaaactgcttctcttttcccatgctgactctttggca

SEQ ID NO: 10715 - DNA, 119 bp, Homo sapiens
ggagttttctttgtagatggctggatattgctgattttagttttagttttttaggtttttttttaaatctagtttgaccttagacaatctgatgactatatatcatgatgaggatcttc

SEQ ID NO: 10716 - DNA, 99 bp, Homo sapiens
cacaggatccaagtctctctatatatctatatctatagatagatatccatatatcaatctctatatatctgtaaaaatatagagagatatatctatgtg

SEQ ID NO: 10717 - DNA, 95 bp, Homo sapiens; identical to SEQ ID NO: 68

SEQ ID NO: 10718 - DNA, 93 bp, Homo sapiens; identical to SEQ ID NO: 69

SEQ ID NO: 10719 - DNA, 108 bp, Homo sapiens
gaaagcacacaggaggctagtagtaaatgaagtcaaagagataataattttatttaaatttaaatttcaaacatgttttgtgctacttgaggattttgacttgttttc

SEQ ID NO: 10720 - DNA, 115 bp, Homo sapiens
gcctctgtagtagctggaactacagttgtgcgccacccaggagacttttttttattattattatactttaagttctagggtacatgtgcagaatgtgcaggtttgatacataggt

SEQ ID NO: 10721 - DNA, 104 bp, Homo sapiens
tcaaaaagtaaaaatattacataatatggttttgggttgactgaatttttttgtttcaatcacagtttacctaagactcattttagtttttaaacatttgttga

SEQ ID NO: 10722 - DNA, 102 bp, Homo sapiens
gtgggacatttagaccatttacagctaaggttaatattgatatgtgagattttgttcttgtcatggtgttgtttgcttgctttgtggtgatgaatgtgttgt

SEQ ID NO: 10723 - DNA, 88 bp, Homo sapiens
ctggcagccactcccagagcccctggaactctggcccaaagctctctgactgactccttcccagatcttctcggcttagcggctgaag

SEQ ID NO: 10724 - DNA, 79 bp, Homo sapiens
gaaaagtgagcctgatcacattttgttgttgttgttttattttttatttttttatgtgtgtgacaggtctcgctctgtc

SEQ ID NO: 10725 - DNA, 78 bp, Homo sapiens
ttttctgctacgtttatatttatctctgttgttcttcatcagaagaaataaggaattcctagtgagacgttcagaaaa

SEQ ID NO: 10726 - DNA, 174 bp, Homo sapiens
ggtatgtagtggtgaaataggtctgggacagttgaataactatagcaaaatttgattatttttgagtctgggtcatctgtctatagggttttttaattctatttttacttattttgtatatatttattaaatggtattataaaaatcaattagagattaccatgggctggagga

SEQ ID NO: 10727 - DNA, 63 bp, Homo sapiens
tataccagcatggcacatgtagacatatgtttgttacatatgtatgtatgtatgtatggtatg

SEQ ID NO: 10728 - DNA, 206 bp, Homo sapiens
tatatatatcatatatatgatatatatatgatccatatatatccagtatatcatatatgtatatatatcatatatatggatatatatccagtatatatcatgtatatgtatatatatcagtatatatcatatatatgtatatatatccagtatatatcatatatatgtatatatatccagtatatctagtatatatatcatatata

SEQ ID NO: 10729 - DNA, 182 bp, Homo sapiens
atatactggatatatatacatatatatgatatatactggatatatatacatatatatgatatatactgatatatatacatatacatgatatatactggatatatatccatatatatgatatatatacatatatgatatactggatatatatggatcatatatatatcatatatatgatatat

SEQ ID NO: 10730 - DNA, 137 bp, Homo sapiens
atatattatatatatgttcatatatatatgtgattatatatctaatcatatataatcatatattatatatgattatatataatcatatattatcatatattatatataatcatatattatcatatattatcatatat

SEQ ID NO: 10731 - DNA, 101 bp, Homo sapiens
tgttggccaataagagagtcggttttttaaggtagacaaaaatgtggaaacatattttattttctaaagtttaatcttgcaaggcttttttaatggaaaca

SEQ ID NO: 10732 - DNA, 95 bp, Homo sapiens; identical to SEQ ID NO: 68

SEQ ID NO: 10733 - DNA, 93 bp, Homo sapiens; identical to SEQ ID NO: 69

SEQ ID NO: 10734 - DNA, 61 bp, Homo sapiens
tgagacggactctcgctctgtcgcccaggctggagtgcagtggtgcagtggctcgatctcg

SEQ ID NO: 10735 - DNA, 103 bp, Homo sapiens
ggcttacccattctgattggggtttctgttcccattatttctgtgttttgagaattctttatatattatagatacaaacccttcttcaaatatgtgatttgcc

SEQ ID NO: 10736 - DNA, 103 bp, Homo sapiens
tatcttggagaaagttccatgcactgttgaagagaatgtgtgttctgcagttgtaggatgaaatgttctgtacatatgtgtcaagtccatttgttccaaggta

SEQ ID NO: 10737 - DNA, 93 bp, Homo sapiens
ccatttgttatgtgtgtatatatatatgtgtgtgcataaatattaatgtgtgcatatttgtgggcataaatataaatatataaattaatgtgg

SEQ ID NO: 10738 - DNA, 100 bp, Homo sapiens
ttgggttatattcagaaagtttgtaatttagtagatcgagggtagcgtgatgaatctatatttataaccataccagttgactctgacatagacggcccaa

SEQ ID NO: 10739 - DNA, 90 bp, Homo sapiens
tttagccatgggttgtttagaagtatgttaatttccaaatatttggggatttcacaaatgtattactatttctaacacaattccactgag

SEQ ID NO: 10740 - DNA, 561 bp, Homo sapiens
tatatatagtatgtacactgtatatatatgtatgtatggatgtgtgtaggacacatataaatattatagtatgtacctgtatatatatgtgtggatggatgtgtgtaggacacatataaatattatagtatgtacactgtatatatatgtatggatggatgtgtgtaggacacatataaatatataaaaggtatatatagtatgtacactgtatatatatgtatgtatggatgtgtgtaggacacatataaatattatagtatgtacactgtatatatatgtgtggatggatgtgtgtaggacacatataaatattatagtatgtacactgtatatatatgtatggatggatgtgtgtaggacacataaatattatagtatgtacactgtatatatatgtatggatggatgtgtgtaggacacatataaatattatagtatgtacactgtatatatatgtatggatggatgtgtgtaggacacacataaatattatagtatgtacactgtatatatatgtatggatggatgtgtgtaggacacatataaatatacattata

SEQ ID NO: 10741 - DNA, 107 bp, Homo sapiens
ctcataatattgtatttgtataaccgcaaaatgtctggctttagtgaaggaaatttttttttaatcattaggtcaaactagttttatgtaaacacgatcttggcgag

SEQ ID NO: 10742 - DNA, 93 bp, Homo sapiens
ctggtaaatgtggtttagctttagaaagtttggaagaaggaattttttttcttcttaaatgcaaatttgtttaaagatgaacaatgacatcag

SEQ ID NO: 10743 - DNA, 95 bp, Homo sapiens; identical to SEQ ID NO: 68

SEQ ID NO: 10744 - DNA, 93 bp, Homo sapiens; identical to SEQ ID NO: 69

SEQ ID NO: 10745 - DNA, 121 bp, Homo sapiens
tataaatatatgtgcgtgtatatatatgtgtgtgtgtgtgtacatatatgtatgtgtatatatatgtgtgtgtgtgtgtatatatatatatatatatgtatgtgtgtatatacatatatat

SEQ ID NO: 10746 - DNA, 86 bp, Homo sapiens
tgttgttgttgtcgtcgagttggggtctcactctgtcacccagtctggagtgcagtggcgccatcactgctcactgtagcctcaac

SEQ ID NO: 10747 - DNA, 123 bp, Homo sapiens
agaggaaaactccgtctcaaaagtatctttttttttttttttgagacggagtctcactctgtctccaggctggagtgcagtggcgtgatctcagttcactgcaacctctaactccctggttca

SEQ ID NO: 10748 - DNA, 109 bp, Homo sapiens
tcagcctcccaaagtgtcttgattacggatgtgagccactgcacccagctgatttttttttttttttttttttagtagagacagtgtctccctgtgttgaccaggctgg

SEQ ID NO: 10749 - DNA, 107 bp, Homo sapiens
gatttcataaatgaatgtatttctggcagctattttgattggaatgtggtagttaaatgaaatatttgttttaatttactgaaggaaaagcatttgctgatactgtc

SEQ ID NO: 10750 - DNA, 87 bp, Homo sapiens
cgatagactcctggtttctgatttcttactaccttgcatagtataaaaatagcaaattgagggggtcagaatgttcagtggttattg

SEQ ID NO: 10751 - DNA, 80 bp, Homo sapiens
gattcttaactgggtgatgggtcttagattttttttttttttttgagtcagagtctcactctgtcacccaagctggagtt

SEQ ID NO: 10752 - DNA, 68 bp, Homo sapiens
agtgtaggctggcagaggcgttctttttttttttttttaagacggagtctggctctgtcactcaggct

SEQ ID NO: 10753 - DNA, 125 bp, Homo sapiens
atatatatataatgtgtgtgtatatatatataatgtgtgtgtacatatatatgtgtatatatatatgtatatatatgtgtatatatatgtatatatatatacacacacatatacatatgtattac

SEQ ID NO: 10754 - DNA, 84 bp, Homo sapiens
gttgttgttgttttgagatggagtctcactctgtcacccaggctggagtgcagtggtgtgatcttggctcactgcaacctccac

SEQ ID NO: 10755 - DNA, 58 bp, Homo sapiens; identical to SEQ ID NO: 2442

SEQ ID NO: 10756 - DNA, 95 bp, Homo sapiens; identical to SEQ ID NO: 68

SEQ ID NO: 10757 - DNA, 93 bp, Homo sapiens; identical to SEQ ID NO: 69

SEQ ID NO: 10758 - DNA, 70 bp, Homo sapiens
gtggcgtgtatacccagatctggaagagttagtatttttataattcatttggtggctgggagatggctac

SEQ ID NO: 10759 - DNA, 111 bp, Homo sapiens
tagggtacctagcacaatgcttggagatgacagaagattgatacctgttggttaaatatgtttttttattctgttgccttctcttctacattgggcgagatttcagctcta

SEQ ID NO: 10760 - DNA, 101 bp, Homo sapiens
aagatgctgtctatgttaacaacgtgtttcctgttctcagtctttgtctcaggtataagatgggagtggaaaacaatagttatacttgaacataatatctt

SEQ ID NO: 10761 - DNA, 113 bp, Homo sapiens
ctgacaacccaaagtgatagtggcttaaacaagttagaattttatttctttctcatgtgaaagaaattgagagagaagctcttcagggccagtgtaatggctacaggatgcag

SEQ ID NO: 10762 - DNA, 81 bp, Homo sapiens
agataggaaacaaatgaagtgagttgtgtgataaggcagcctgttgcctgttgcccaagagaacttccaggtctcctgtgt

SEQ ID NO: 10763 - DNA, 95 bp, Homo sapiens
gagcttcctgtccctctccaggctgtgtgtgtctctccaacactgcagtcggccagcatgctgagatacaataccggaaatccacatgcaggctc

SEQ ID NO: 10764 - DNA, 95 bp, Homo sapiens; identical to SEQ ID NO: 68

SEQ ID NO: 10765 - DNA, 93 bp, Homo sapiens; identical to SEQ ID NO: 69

SEQ ID NO: 10766 - DNA, 87 bp, Homo sapiens
gggcgacagagcgagactctgtctctaaaataaataatgaatattaataattttttttttttgagacggagtatctctctgtcaccc

SEQ ID NO: 10767 - DNA, 79 bp, Homo sapiens
aggcttagagaggatataccacagacatgtctaggatgtagttaagatttgaactcattctgtctgactttctagtcct

SEQ ID NO: 10768 - DNA, 93 bp, Homo sapiens
ggagaagggtctgaagtgaaaggaggttgagtcttagacctggccattaactagtgatgttaagtaaagaagtaacaacctttttgaatctcc

SEQ ID NO: 10769 - DNA, 101 bp, Homo sapiens
gttctcagaacaaagtatgttagcaggcctgacaaattattttgatgatgtctctattatcccactttggtcttgtcaaatgagcctgctgacctgagatc

SEQ ID NO: 10770 - DNA, 95 bp, Homo sapiens; identical to SEQ ID NO: 68

SEQ ID NO: 10771 - DNA, 93 bp, Homo sapiens; identical to SEQ ID NO: 69

SEQ ID NO: 10772 - DNA, 102 bp, Homo sapiens
agattaaaggctcttgcagagcatatatatatatatatatatatatatatatatatatatatatatatatatatatataaaatgaaagaagtcacttggtct

SEQ ID NO: 10773 - DNA, 99 bp, Homo sapiens
ccttttcatgattaattttgactttttgttgacatataatttagtttttttttttttttttttaatgtgttagcagatttgaagttaatcccacaaagg

SEQ ID NO: 10774 - DNA, 105 bp, Homo sapiens
tcttcataactgatgtgcagagggccaagttacaggggcttacaggcattgtgtgaaccatcaataaggtaggataccttacttagctttgaaatattttggaga

SEQ ID NO: 10775 - DNA, 62 bp, Homo sapiens
ggaaactagctctcacagtcattatttgcgtggaagttgaggatgactagtgagttaattcc

SEQ ID NO: 10776 - DNA, 101 bp, Homo sapiens
agactgctataggacagagacttaaaggagagtgaactataaattatcacaatttggcttatttttcctttttttttttttttttcttttttgaggagtct

SEQ ID NO: 10777 - DNA, 100 bp, Homo sapiens
gtctgttcatatcctttgcccagtttttgatggagttttttttttcttgtaaattcgtttaagctccttgtagattctggatattagccctttgtcagat

SEQ ID NO: 10778 - DNA, 71 bp, Homo sapiens
tacaaatcttcatatatatatgtatatatctattccaatgtacaatatgcatatatgtgtgagtatatgta

SEQ ID NO: 10779 - DNA, 119 bp, Homo sapiens
tgtttttgtgattacttgttaatgttattactctaattatcatatgatgatttatttatttttattatgaaatatgatcgtgggtggggcagggaaataagtatggagaagaataacaa

SEQ ID NO: 10780 - DNA, 112 bp, Homo sapiens
ctgcagcctaagatgctgaagtggctatgctgtctggggtgtataccaggggttggtagtctggcaccaggaaaatttaggacacggacgcacacaaggaatttaggagcag

SEQ ID NO: 10781 - DNA, 72 bp, Homo sapiens
cctaatctgtagtgtttgctgatttccatggtataaacactaccagtgtgatgtcagtgaacacagagctgg

SEQ ID NO: 10782 - DNA, 135 bp, Homo sapiens
ttctgttgaagagtagggagagtctggaaacacagatttgactctaatggcagagtatttgacacttgagagtcaggttaggggatttagacctgaacctataggcaatggagatacttgaggcatttaagtgag

SEQ ID NO: 10783 - DNA, 117 bp, Homo sapiens
ggtcagtgttattatccgtgatttaaattttgagaaactaaggctcaggaggtgaagtgatttacttgagctgatgaatgggtcatcatggtttgaatcctggtagtccaagtgact

SEQ ID NO: 10784 - DNA, 92 bp, Homo sapiens
tggcaaataatttggctgaatagtgtttatgttctagtgctttgtggaagatagaacttgcaagctttgatatttagctgaaataattccca

SEQ ID NO: 10785 - DNA, 95 bp, Homo sapiens
gcttccatttctctcacaagactcagtaaaaattatccaaaacatgtaaatttttatttttggcaatttcgtgggtcaaggaaaaggttggaagc

SEQ ID NO: 10786 - DNA, 80 bp, Homo sapiens
gcctgctagatgctctctgtctctcagtacctcagttgttattacattcctgcaaaatgagggaaatagggttcccaggt

SEQ ID NO: 10787 - DNA, 114 bp, Homo sapiens
gcatttccttttctccatagccttgccaacatctgtttttttttcttttttgactttttagtaatagccattttgactgatgtgagatggtatctcattgtggttttgatttgc

SEQ ID NO: 10788 - DNA, 109 bp, Homo sapiens
tctggaatcagaagatctgagttaaagccagtatggcactaaatgacagtgttacccaagacaagtcattttgtctttctgggactcagtttcttggtttgatatcaga

SEQ ID NO: 10789 - DNA, 95 bp, Homo sapiens; identical to SEQ ID NO: 68

SEQ ID NO: 10790 - DNA, 93 bp, Homo sapiens; identical to SEQ ID NO: 69

SEQ ID NO: 10791 - DNA, 115 bp, Homo sapiens
gatggtagacacatctgtattttgtgttcttgggattgtctctgtccctctgtgctattgtcatcaagcacggtgctgactctcattacatagaaaaagtgagtctcttcttcca

SEQ ID NO: 10792 - DNA, 139 bp, Homo sapiens
atatagacacaagaggatatatatatatatctagatatatatatatatatatctagaggatatatatatatatctagatatatatatatatctccaagaggatatatatatatacacaagaggatatatatatatacac

SEQ ID NO: 10793 - DNA, 108 bp, Homo sapiens
atatatatgtatctgtctcttcttggagagatatatatatatctatctcctcttggagatagatatattatatatatatatccctcttggagatagatatatatatat

SEQ ID NO: 10794 - DNA, 83 bp, Homo sapiens
atatatctctctccaagaggatatatatacatatatctctctccaagaggatatatatatatatatctccaagagggatatat

SEQ ID NO: 10795 - DNA, 95 bp, Homo sapiens; identical to SEQ ID NO: 68

SEQ ID NO: 10796 - DNA, 93 bp, Homo sapiens; identical to SEQ ID NO: 69

SEQ ID NO: 10797 - DNA, 73 bp, Homo sapiens
tggaggtgggggattggaatatggggctctgccatattagcaaacctctctgtgtctcagttttcccactcca

SEQ ID NO: 10798 - DNA, 188 bp, Homo sapiens
atatatatatatgtggtatatatatgtggtgtatatatatatgtggtgtgtatatatgtatgtatgtgtatatatatatacatatatatgtatgtgtgtatatatatacatatatatgtatgtgtatatatatacacatatatatgtatgtgtgtatatatatatatatgtatatatatatacaccac

SEQ ID NO: 10799 - DNA, 173 bp, Homo sapiens
atgtggtgtatatatatatacatatatatatatatacacacatacatatatatgtgtatatatatacacatacatatatatgtatatatatacacacatacatatatatgtatatatatatacacatacatacatatatacacaccacatatatatatacaccacatatatat

SEQ ID NO: 10800 - DNA, 70 bp, Homo sapiens
tttttttgagatggagtctcactctgtcacccaggctggagtgcagtagcacgatcccgtctcactggaa

SEQ ID NO: 10801 - DNA, 113 bp, Homo sapiens
tctatgcttcttatcactatgacttgccagttctttattattattattattatactttaagttctgggatacatgtgcagaatgtgcaggtttgttaagggaagctaagtaga

SEQ ID NO: 10802 - DNA, 88 bp, Homo sapiens
acaactctaggagagcagattaagtagcttagtaagttgaaactattaatttttctaaagaatttgatttgaattccttgagaattgt

SEQ ID NO: 10803 - DNA, 108 bp, Homo sapiens
gcccagagaattgcaaaaatagctagtttgagagtagtgagtgaccacttgaacagcatgttttctggtttcaagacaaggctttgtatcagctagtataggctgggt

SEQ ID NO: 10804 - DNA, 69 bp, Homo sapiens
acagaagtgaggctgtgttctttttttttttttttttttttttttttttgagacagagtctcactctgt

SEQ ID NO: 10805 - DNA, 75 bp, Homo sapiens
gtttaatttttacagtttatatatatgtatatattacatattgaggtatgtatatgtaaactgtaaaaattaaac

SEQ ID NO: 10806 - DNA, 75 bp, Homo sapiens
caaagagattagtgagagtgcattatgaacctagctaaatattgcttttcgaacattcttacttttttttttttg

SEQ ID NO: 10807 - DNA, 58 bp, Homo sapiens
tgagatggagtctcactctgtcacccaggctggagtgaaatggtgtgatctcagctca

SEQ ID NO: 10808 - DNA, 70 bp, Homo sapiens
aacccatcagtttaacagtgcctcactacacgtggtgtgatagaaaggtcagtgttaggaagcttgggtt

SEQ ID NO: 10809 - DNA, 114 bp, Homo sapiens
gatttgccttctgatcctctttccttagcagaaagagaattgtgggaaatatttttgccaataatttattttctttgatgtataaaaaaaaatggaggcagtaagggggtggtc

SEQ ID NO: 10810 - DNA, 108 bp, Homo sapiens
agtctaggaaattttaacttagtgatctttgacaaagcaaataacatgctcaatatttcaatctttttaatgtttatgctttagatggctgaaatataaaactaggct

SEQ ID NO: 10811 - DNA, 84 bp, Homo sapiens
gacaagtatcagtaagtctttgtggcggtctggtctcaggttggcacatctgcaggcaatcagactttttatattttaatggtc

SEQ ID NO: 10812 - DNA, 122 bp, Homo sapiens
cagcctggacgacaagagcaagactctgtctcaaaaaataaataaagacagggtctctctctgtcacccaggctggagtgcagtggtgcagttgtagttcactgcagtctcaaacacctggg

SEQ ID NO: 10813 - DNA, 119 bp, Homo sapiens
ccctttatatacagtatacatatatatgtatataaactgtatatatacagtatatatgtatatacataagtaactatatatacagtatagatataagtatataaactgtatataagggg

SEQ ID NO: 10814 - DNA, 70 bp, Homo sapiens
tatacatatgtatgcatgtgtgtgtattttttaatatatatatgcattaacacacccatatatatgtata

SEQ ID NO: 10815 - DNA, 73 bp, Homo sapiens
ggagttcagttctctgtgtctgaaagtggaacttccaaggagccaccacttcacctcagaaaacttaaattcc

SEQ ID NO: 10816 - DNA, 62 bp, Homo sapiens
cacttaccgtgaatggaacacgcagggctggaggttgctctgggtgagtcagtgagtgagtg

SEQ ID NO: 10817 - DNA, 73 bp, Homo sapiens
ggcacataacggagtctcacagagtctcaggctctcaggacctttgctgagaactctgggacaagacttagct

SEQ ID NO: 10818 - DNA, 104 bp, Homo sapiens
actagctacaactgtattcaagtcttgcttgtatgggaagaatatacaagaaatatttatctatacaagtatttagacatgggtcccacgttcaatataatagt

SEQ ID NO: 10819 - DNA, 59 bp, Homo sapiens
gacagtgtctcgctctgtcacccaggctggagtgcagtggtgtgatctcggttcactgc

SEQ ID NO: 10820 - DNA, 112 bp, Homo sapiens
tattggaagtgacgctggggccagaactgagattgcagattgattgatttttttaatttactatttgttcatggggaggctggcttctttattgtggcggcacctgctagtg

SEQ ID NO: 10821 - DNA, 91 bp, Homo sapiens
gccagctcttctgccatgccatgtggttagcattgtgaatataacacagaatgtgtgtgtatcactcttacacagtggttaagagcaaggt

SEQ ID NO: 10822 - DNA, 115 bp, Homo sapiens
tgtcaatggaacacttgaaatgtgactagtgggactgaggaaatgaattgtttaattttatttcattttaattaatttcagtttaaatggaaatagccaaatgtgtctagcagca

SEQ ID NO: 10823 - DNA, 100 bp, Homo sapiens
tatgagatatacatatacatatataaatatgtatatgtatacatatttatacatataaatatgtatacatataaatatatatgtatatgtatatctcata

SEQ ID NO: 10824 - DNA, 129 bp, Homo sapiens
tcaaggtccaacaggaaccctagacccatcctccaaaaccattctgcccccaagtcactggcactctgggcctctgatgggaggggaagctgtgaagacctctgaaatgccttgaccatcattctccca

SEQ ID NO: 10825 - DNA, 94 bp, Homo sapiens
cacctgctgattggagagcccttggcccttgagtgaacatagatggcagccaggtactgtttactttgggccatgggtgagacccagtgctgtg

SEQ ID NO: 10826 - DNA, 81 bp, Homo sapiens
tgagtactggcctcaggttccggggggggctcgtgtgtcaaagaacataatacagtctctgtcactcattgtcatgtatca

SEQ ID NO: 10827 - DNA, 119 bp, Homo sapiens
tcagtcagaacagagaaaccagtcaaggtgttttcttttttcttacctatttttaattctaaattattgtaatgcagaaaattgtttacaccattgatgaaagggctgagggagctgat

SEQ ID NO: 10828 - DNA, 95 bp, Homo sapiens; identical to SEQ ID NO: 68

SEQ ID NO: 10829 - DNA, 93 bp, Homo sapiens; identical to SEQ ID NO: 69

SEQ ID NO: 10830 - DNA, 80 bp, Homo sapiens
ctggagtagaggaggagcggagaggtgcaatggccaccctgctatataattctgcagctctctctctgactggatctcag

SEQ ID NO: 10831 - DNA, 69 bp, Homo sapiens
aggtaaggagactagttaggagatcctcattcctcagagaagtgagtctgcttcctttcctccatgcct

SEQ ID NO: 10832 - DNA, 64 bp, Homo sapiens
agggaagtgagaggaactagcatgtatctttatggcatagagctatgcttttcttcacttcctt

SEQ ID NO: 10833 - DNA, 65 bp, Homo sapiens
aacatttcctgtcactgtgtgtgtgtgtgcacacgtgcacatgagcatacatatggtagagtgtt

SEQ ID NO: 10834 - DNA, 87 bp, Homo sapiens
gcccacaagtatggacatgtatatgtatatatatgcacatagacatatatatatatatttgcataatgtacaagacatactatgggc

SEQ ID NO: 10835 - DNA, 116 bp, Homo sapiens
catgtatttattaacagcaagccagtcattagcattgtttcttttttttttttattatactttaagtttgagggtacatgtgcacaatgtgcaggttagttacatatgtatacatg

SEQ ID NO: 10836 - DNA, 90 bp, Homo sapiens
tggaaagatatgcttctggatgtctggtgtttggctgatttatttatctttacaaaagtgccacactgttttgagtagcatagcttttta

SEQ ID NO: 10837 - DNA, 106 bp, Homo sapiens
atgatgtttttgatatttatccataattgtggtacatagcaatagtttgtttctttttattactgtgttgtttccaggtttggataattatgaataaagctattat

SEQ ID NO: 10838 - DNA, 84 bp, Homo sapiens
cagagattatgggttggcactgttggaacatggcctggaacacccagactctcttagtctctgactccttagcctatctctctg

SEQ ID NO: 10839 - DNA, 58 bp, Homo sapiens
tgagattgtgacattgcactgtagcctgggtgacagagcacagtgagtctctgtctca

SEQ ID NO: 10840 - DNA, 104 bp, Homo sapiens
ttcctcccagaagtctacccaaggatccccagcgaaagggagccatagtccgaggctctggctgcctgcctgtttggagctttgatggcctcgaggtgagagaa

SEQ ID NO: 10841 - DNA, 70 bp, Homo sapiens
cctgatggtctgtcactgtctcccatcacccccagatgggactgtctagttgaaggaaaacaagctcagg

SEQ ID NO: 10842 - DNA, 95 bp, Homo sapiens; identical to SEQ ID NO: 68

SEQ ID NO: 10843 - DNA, 93 bp, Homo sapiens; identical to SEQ ID NO: 69

SEQ ID NO: 10844 - DNA, 62 bp, Homo sapiens
gtatatatatgtatatatctacacatatatacacatatgtgtgtgtatgtatatgtatatat

SEQ ID NO: 10845 - DNA, 74 bp, Homo sapiens
ttatagagagcatatatatatatatatatatgcgtgtgtgcagtgcatgtgtgtgtgtgtgtggttctctataa

SEQ ID NO: 10846 - DNA, 97 bp, Homo sapiens
tcagttatacacagtgaaccctgtctctatttattttattttcttttattattattattattattatttttgagatagagtctcactctgtcactga

SEQ ID NO: 10847 - DNA, 73 bp, Homo sapiens
gttgcccatttcttatgctgagaatgaaagaatgtgacattattttttaaaagctctgcatgttgtgggccac

SEQ ID NO: 10848 - DNA, 142 bp, Homo sapiens
atatatatgtatatacgcgcatatatacatacatatgtgtatatacatatatatgtatgtatatatgtgtatatacatatatatgtatgtatatatgtgtatatacatatatatgtatgtatatatgtgtatatacatacat

SEQ ID NO: 10849 - DNA, 161 bp, Homo sapiens
tatatacatatataagtatgtatatatgtgtgtatatacatatataagtatgtatatatgtgtgtatatacatatatatgtatgtatatatatgtgtatatgtatatatacacatataaatatatacatatatataaaaatatatatttatatatacatat

SEQ ID NO: 10850 - DNA, 123 bp, Homo sapiens
gtttacctctgtgtatgtgtttgtctctgtgtagtttcatgcaattttttttattatagtttaagttctgggatacatgtgcagaacgtgcaggtttgtaacataggtatacatgtgtcatgg

SEQ ID NO: 10851 - DNA, 111 bp, Homo sapiens
tctatatttggtgtaagtgtaaatatgtacatatatacatacatatacatatatgttgtatgtatttatgtatgtatgtatgtgcttatctacctatctacctcatacagg

SEQ ID NO: 10852 - DNA, 77 bp, Homo sapiens
gattctctcctgtgcctggctctgtggctgccacgcccgtggagcctcgctcactgctagcgcagcagtctgagatc

SEQ ID NO: 10853 - DNA, 100 bp, Homo sapiens
gttaggcatggtggtgtgtgcctttagttccagctactcgggaggctgaggtggaaggatggcttgaacccgggaggcagagttttcatcgagctgagat

SEQ ID NO: 10854 - DNA, 102 bp, Homo sapiens
ccagcctggccgacatagtgagacccctgtttctacaaaaagaaaattttattttatttttttttttttggagacagagtctcgctctgtcgcccaggctgg

SEQ ID NO: 10855 - DNA, 62 bp, Homo sapiens
ctgactttcagtcagactctgtcaatgggagttcctggcaggaaactggatgtgaaaggagg

SEQ ID NO: 10856 - DNA, 94 bp, Homo sapiens
attgataacattctgggggcaaggattaatattgggacttttttttttttttttgagactgagtctcactctgtcgcccaggttggagtgcagt

SEQ ID NO: 10857 - DNA, 69 bp, Homo sapiens
tatatagatatatctaatgtatagatatatgtagatattacatatatatttacattgatattatatgta

SEQ ID NO: 10858 - DNA, 73 bp, Homo sapiens
tgtgtatgtggtgggggggagggattttatttatttttttttgagacagtctcactctgtcacccaggctgca

SEQ ID NO: 10859 - DNA, 67 bp, Homo sapiens
atatatatatatgtgtgtgtgtgtatatatatatgtatatgtatgtatgtatgtatatatgtatata

SEQ ID NO: 10860 - DNA, 69 bp, Homo sapiens
taaggtcatttgttggaccacactgcttagtgttggaaagattgaaggtgtgagaactcagagacctta

SEQ ID NO: 10861 - DNA, 91 bp, Homo sapiens
taatatgcacacacatatatgtatatgtatatttccattcagttcttttcctgtatatatatatgtgaatatatgtgaaaaatatatatta

SEQ ID NO: 10862 - DNA, 67 bp, Homo sapiens
gtttttgagacagagtctcacactgtcacccaggctggagtgcagtagtgcgatctctgttcattgc

SEQ ID NO: 10863 - DNA, 117 bp, Homo sapiens
gctgaaactgaccaatttgtgatatgcctgaaagaagcaaatgtattctaaacaacttagatgtcaagaatgccagcacttggagtattagaatatctggcttgttgaagttgcttc

SEQ ID NO: 10864 - DNA, 111 bp, Homo sapiens
tgcttaggattgtcttggctatatgggctgttttttctttccatatgaaatttaaagtagtttttttctagttctgtgaagaaagtcaatggtagcttgatgggaatagca

SEQ ID NO: 10865 - DNA, 95 bp, Homo sapiens; identical to SEQ ID NO: 68

SEQ ID NO: 10866 - DNA, 93 bp, Homo sapiens; identical to SEQ ID NO: 69

SEQ ID NO: 10867 - DNA, 69 bp, Homo sapiens
tattcagtaggctgaggtagaaggatttcttgagccagggaggtcaaggctgcagtgagcctgataata

SEQ ID NO: 10868 - DNA, 97 bp, Homo sapiens
atgtacatgtgtgtatatatatatgtgtgtatatatatatgtgtgtgtatatatacacatatatatgtgtgtatatatatgtgtgtatatatgtatg

SEQ ID NO: 10869 - DNA, 100 bp, Homo sapiens
ctggaaagcttgggggagtgggtgtgagttccaaatctttctgtctcacagtgaggcttggttcaggtgtctatatcccactctctctggactagtccag

SEQ ID NO: 10870 - DNA, 81 bp, Homo sapiens
tcctgattctgctcttgctccctcagtctgttctccacagagaagacagggtgctcttttaaaagcaaaaatcaatcagga

SEQ ID NO: 10871 - DNA, 117 bp, Homo sapiens
tgaggtacaattaggggccaattgtcatctatggttatgtgacgttatgggctagtttcaaactattttttaacgaattttaagagcaacatgcaattagtttccaattctattcca

SEQ ID NO: 10872 - DNA, 72 bp, Homo sapiens
tttgtgtgtacattagttatatatatagttgacttatatatatatatataatatgtaggatgtgtgtacaaa

SEQ ID NO: 10873 - DNA, 127 bp, Homo sapiens
gtgtatatatatataaaatgtgtgtgtatctataaatgtgtgtatatatgtaaaatgtgtgtatatatatgtgtgtacgtgtatatataaaatgtgtgtatatatataatgtatgtgtgtatataca

SEQ ID NO: 10874 - DNA, 67 bp, Homo sapiens
gtctcccaagtagctgggactaaaggcaggcaccgccatgcccagctaatttttaatttttgtagac

SEQ ID NO: 10875 - DNA, 71 bp, Homo sapiens
tgtgtggtgacacatacctgcagtcccagcgtcttgggaggctgaggtgggaggatgtattgaatcaggga

SEQ ID NO: 10876 - DNA, 60 bp, Homo sapiens
ttgagacggagtctcactctgtcgctcaggctggagtgcagtggtgccatctcagctcaa

SEQ ID NO: 10877 - DNA, 58 bp, Homo sapiens
tgagactgagtctcgctctgtcacccaggctggagtgcagtggtgcgatctcggctca

SEQ ID NO: 10878 - DNA, 79 bp, Homo sapiens
ttgtttttgagatgtagtctcactctgtccctccgtcccccaggctggagtgcagtggcaagatctccgctcactacaa

SEQ ID NO: 10879 - DNA, 73 bp, Homo sapiens
gttgctgttgagacggagtctcactctgtcacccaggctggagtgcaacggcatggtctcagctcactgtaac

SEQ ID NO: 10880 - DNA, 101 bp, Homo sapiens
gcatacctcctagcaacccagtgagcttgtacatagtcctcaatttgtttttatttttgttttttgagacaggggttcacttatcatccaggctggagtgc

SEQ ID NO: 10881 - DNA, 58 bp, Homo sapiens
tgagccgagattgtgtcactgcattctggcctgggtgacacagtgagactctgtctca

SEQ ID NO: 10882 - DNA, 58 bp, Homo sapiens; identical to SEQ ID NO: 526

SEQ ID NO: 10883 - DNA, 71 bp, Homo sapiens
ttgcagcgagccgagatcgtgcctctgcactccagcctgggtgacagagtgaaactctctctcgctctcaa

SEQ ID NO: 10884 - DNA, 95 bp, Homo sapiens; identical to SEQ ID NO: 68

SEQ ID NO: 10885 - DNA, 93 bp, Homo sapiens; identical to SEQ ID NO: 69

SEQ ID NO: 10886 - DNA, 70 bp, Homo sapiens
agcagagcacagtgaccaggtgacaccagagagagaacagctgtcttagctcctgactgtgcaccttgct

SEQ ID NO: 10887 - DNA, 77 bp, Homo sapiens
gcaaataagttggatttgtttttccactgacaatttttattttaaaagaggaaaagctgtgttcatactaagtttgc

SEQ ID NO: 10888 - DNA, 58 bp, Homo sapiens
tgagatggagtctcacactgtcacccaggctggagtgcagtagtgcgaccttgtctca

SEQ ID NO: 10889 - DNA, 71 bp, Homo sapiens
tacacatccagaaacagactatatgtttgtgtgtatatataagcatgtgtgtgtgtctctgtgtctgtgta

SEQ ID NO: 10890 - DNA, 85 bp, Homo sapiens
gctggatttttatgtgcttgcaaatgtgttatatttcatattttatgaaatgtgatttcattcttatctcatatattgattaagt

SEQ ID NO: 10891 - DNA, 93 bp, Homo sapiens
gtgatggtgtgtgcctgcagtcttagctactagggaggctgaggtagaaggatcacttgagcccaggatgtccaggctgcagtgagccatgac

SEQ ID NO: 10892 - DNA, 119 bp, Homo sapiens
aggtcagttaagagtttggttttctattggaataaggatgcttttagatgtagtatgtttattacatattatataaggtacattttctctttttaatgagctttcattttaaatttcct

SEQ ID NO: 10893 - DNA, 148 bp, Homo sapiens
tatatatatgtgtgtgtatatgtgcatatatatgtatatatgtgtgtgtatatatgtgcatatatgtatatatgtgtgtgtatatatgtgtatatatgtgtgtatatatgtgtgtgtatatatatgtgtgtgtgtatatatatatata

SEQ ID NO: 10894 - DNA, 199 bp, Homo sapiens
cacacacgtatatatacatatatatacacgtatatatatgtatatgtgtatatatagtgtatatatgtatatgtgtatatatgtatatgtgtatatatgtatatatacgtgtatatgtgtatatatgtatatatatgtgtatatgtatatatacacgtatatatgtatatatatacgtgtatatatatgtataataatg

SEQ ID NO: 10895 - DNA, 92 bp, Homo sapiens
atatacatatatacactatatatacacatatacatatatatacgtgtatatatatgtatatatacgtgtgtgtgtgtgtatatatatatata

SEQ ID NO: 10896 - DNA, 118 bp, Homo sapiens
gagggtgcatttctaagtttgtacgtatggagagatttattttttattttattttattttatttattgagatggagtctcactctgtcgcccaggctagagtgcagtggtgtgatctc

SEQ ID NO: 10897 - DNA, 73 bp, Homo sapiens
caggaggccttgtcttagtctctctctcagccctaataagggggtagggagaaaaaagacatcttgtcctctg

SEQ ID NO: 10898 - DNA, 79 bp, Homo sapiens
gggcatgcaagtcaggtttttacttcagttaactttttttttttttttttttttgagacagagtctggctctgttgccc

SEQ ID NO: 10899 - DNA, 119 bp, Homo sapiens
aaatttccatatttcaagatccgtgtattttggaaatagtggcaatggttgtatagtattgtgaatataattaatgcctctgaattctatacacttaaaatggctaaaatggcaaattt

SEQ ID NO: 10900 - DNA, 72 bp, Homo sapiens
gggtacagtgagccatgattgcacctctgcaccccagcctgggtgacagagacagtcactcacatcctacct

SEQ ID NO: 10901 - DNA, 70 bp, Homo sapiens
ggtaggatgtgagtgactgtctctgtcacccaggctggggtgcagaggtgcaatcatggctcactgtacc

SEQ ID NO: 10902 - DNA, 56 bp, Homo sapiens; identical to SEQ ID NO: 1191

SEQ ID NO: 10903 - DNA, 105 bp, Homo sapiens
gtgtttatgtatatatatctatatgtatgtgtgtatatatatagagatatgtgtgtatatatgtgtgtgtgtatatatatatacataaatctaaattggttatgc

SEQ ID NO: 10904 - DNA, 129 bp, Homo sapiens
gactcagctgtcttcagttcctctggcccattccctggggagtggctggaagcgtgaggcactctctgggtcactgtgggagggcagggaagccatgctaccctctcagtagacccagagcagctccat

SEQ ID NO: 10905 - DNA, 106 bp, Homo sapiens
ccaaagacatggagaaattggaactctcatcccttgttggtaggaatgtaaaatgatgttgttgctttagaaaacagtttgacagttcctcaaaacattaatttgg

SEQ ID NO: 10906 - DNA, 77 bp, Homo sapiens
acacagtgagactcccatctcaaaacattctcattcacactttttttttttttttttgagacagagtctcgctctgt

SEQ ID NO: 10907 - DNA, 241 bp, Homo sapiens
atatatatatatatatatgtatgtatatatatatgtatgtgtatatatatgtatgtatatatatgtgtgtatatatgtatgtgtatatatatgtgtgtatatatatacatatatgtgtatatatgtatgtatatatacaatatatgtatatatgtaagtatatatacatatatatgtgtatatatgtatatatacgtatatatgtgtatatatgtatatatacacatatatgtatgtgtat

SEQ ID NO: 10908 - DNA, 117 bp, Homo sapiens
tgaacaattaagttccagtggtgcatggtgggaggtagattttttttttttttttttttttttttgagacggagtcttgctctgtcacccaggctggagtgcagtgatgaggtctca

SEQ ID NO: 10909 - DNA, 87 bp, Homo sapiens
ttgagatggagtctcactctgtcacccaggctggagtgcagtggtgcaacctccacctcccaggttcaagtgattctcctgcctcag

SEQ ID NO: 10910 - DNA, 100 bp, Homo sapiens
agtccaacctgggcaacatagtgagactgtcttctaacacaaaaattttatttatttatttatttttagacggagtctcactctgtcaccaggctggagt

SEQ ID NO: 10911 - DNA, 74 bp, Homo sapiens
cttgggcgacagggatgggggtctttttttttttttttttttttttttgagacagagtcagtctgtcacccaag

SEQ ID NO: 10912 - DNA, 58 bp, Homo sapiens; identical to SEQ ID NO: 1409

SEQ ID NO: 10913 - DNA, 58 bp, Homo sapiens
tgagacagagtctcgctctgtcacccaggctggagtgcagtagcatgatctcggctca

SEQ ID NO: 10914 - DNA, 70 bp, Homo sapiens
ctctcagaggcgttgcttaccaatgaggcgtgggtattcctgactctgtctcagcctctgcttctcagag

SEQ ID NO: 10915 - DNA, 77 bp, Homo sapiens
caggttcacagttcagagagatgtaggtctacgtcccacctctgtcactcactagctgtgtgttcctggtctctctg

SEQ ID NO: 10916 - DNA, 70 bp, Homo sapiens
cacagtgattaagatgtggtactgcagtcaagctagttgggctgaagtcctgtcactcactgtcactgtg

SEQ ID NO: 10917 - DNA, 72 bp, Homo sapiens
cagccgttccgacctgcgcttagtttttatttttattttttgagactgagtcttgctctgtcacccaggctg

SEQ ID NO: 10918 - DNA, 108 bp, Homo sapiens
ccccaggccgaatgtctgtgtctgtctgtctgtctgtctgtctgccagaggccaggatcgctccccttacagccgggccctcaggggaccaggggctgcggcagcggg

SEQ ID NO: 10919 - DNA, 99 bp, Homo sapiens
gcgtccctgccatgtctctcatgctctggctctccctctgagcctctttcttctgggcactcagcaggccagtgtcagagtcagatcctggccagccgc

SEQ ID NO: 10920 - DNA, 100 bp, Homo sapiens
gcagggccagggacttgtctcaaagctgtggtagaattcaactgatttatcttatttttattttttgagatggagtcttgctctgtcacccaggctggag

SEQ ID NO: 10921 - DNA, 76 bp, Homo sapiens
tatctgtgtgtgtatatctgtgtgtagatagatatgtttatctgttttggtgtatgcgtgtatacatatgtatgta

SEQ ID NO: 10922 - DNA, 122 bp, Homo sapiens
gaaatgtttgctccttttctgttttgtggaagggattgtataggatttgttttcatactttttaaatgtttggtacaattctctagtgaaaccatctaaacatggagatttatttttggggg

SEQ ID NO: 10923 - DNA, 109 bp, Homo sapiens
gcattccctatagtttctgcctgcttccagttgctctctaaacaatgttttttcatattttgcctagggcttataattattagcaaaaaggtcatctactataggctgc

SEQ ID NO: 10924 - DNA, 83 bp, Homo sapiens
gaagatacacatggttccctaggacctttacagtgtttgatcatgtatgaccagaaatgtaaaaatcaggagtcattgccttc

SEQ ID NO: 10925 - DNA, 102 bp, Homo sapiens
ggagcagtaactacatccgctggaaggaagaaaacaaatcagggctttcaggatccacagacctcttttttttttttttttttttagacggagtcttgctct

SEQ ID NO: 10926 - DNA, 86 bp, Homo sapiens
attctatcttgggagtggtggctttacttttttttttttttttttttttttgagacagagtctcgctccttcacccaggctggagt

SEQ ID NO: 10927 - DNA, 110 bp, Homo sapiens
gtgtagattcctgggagtgaaattgctgggttgaacaatcagtttatgtttatctttttaagaaacaactaaactgttttccaaagcaatgtgctgttttacactctcag

SEQ ID NO: 10928 - DNA, 104 bp, Homo sapiens
gaagtatctacagtttttatccattatgtgtgtgtttaatttttcatttttaggaaaggaaaacactctgaatggtaggaatttaattctgactgatttacttc

SEQ ID NO: 10929 - DNA, 90 bp, Homo sapiens
tctgtatgtgtgtgtatatatgtgtgtacatagatacatagtatattatacctacatctatgtatattacatacatatatatgttccaga

SEQ ID NO: 10930 - DNA, 113 bp, Homo sapiens
gttatttcttgtccagtctgtattcagatgtacttcatcatattgagagcaatattgtaagggcttaagagagaaggcactagaggaagatagacctggattcaaattgtaat

SEQ ID NO: 10931 - DNA, 118 bp, Homo sapiens
ggtatattggaggcttctgctctgctttatttcagtgatttaaaaattgatacaaactaatgtttatgaatatttgatctatagttccaaggtacataggaaggttctatcttttgcc

SEQ ID NO: 10932 - DNA, 108 bp, Homo sapiens
acagtttgtgcatttcagaagttgtatccaggagaatgaagattttattttactttatgaagaagattgtttacttcaaaatggctatatctgagtaaaaccagctgt

SEQ ID NO: 10933 - DNA, 213 bp, Homo sapiens
atatatgtgtatatgtgtatatatgtgtatatgtgtatatacgtatatatgtatatatatgtgtatatatgtatatatgtatatatatgtgtatatatgtatatatgtatatgtgtgtatatatgtatatatgtgtgtatatatgtatatatgtgtgtatatatgtacatatatatgtatatatatgtacatatatgtatatatatgtacata

SEQ ID NO: 10934 - DNA, 58 bp, Homo sapiens
tgtgtgtgtgtgtgtatgtgtgtatatatatatatatatatatatatatatatatata

SEQ ID NO: 10935 - DNA, 110 bp, Homo sapiens
tgtgactggctggcttgctgcttttttaaagaaaaacaacagaattaacaatcaaagttatatatatatactttttcttgcttttcatgggcaccaaaacataagttaca

SEQ ID NO: 10936 - DNA, 106 bp, Homo sapiens
cactgttctgctctgtcctgggtgggacatgaatcatccctttatttttattttatttttgagacacagtctggctctgtctcacccaggctggagtgcaatggtg

SEQ ID NO: 10937 - DNA, 116 bp, Homo sapiens
gcagagaaagctctggagctgatgttctttccagggggtccttagaagcagagccaagagagagaaactgcttcacccaccttcctgcaaaacttgagcttgccaagagactgctg

SEQ ID NO: 10938 - DNA, 102 bp, Homo sapiens
tccatcttaaaaaaaaaaaaaaaaaaaagtatgggaaggggaaatagtatgctctgataagacactttttttttttttgtctttttttctttttgagatgga

SEQ ID NO: 10939 - DNA, 110 bp, Homo sapiens
ggtcttgatttgtatttctctgatgattagcgattggtgatattgagcatctttttatatatttattggccatttgtatatcatctttagagaaatgtctattcaaatcc

SEQ ID NO: 10940 - DNA, 74 bp, Homo sapiens
tgtctcttaaagttctctctttctctcaaacccagacaccacacgggaggatcacagagactgattaagagtca

SEQ ID NO: 10941 - DNA, 118 bp, Homo sapiens
ttctggtactatcttatcatgtcttaaagcccaggaaaatatcatttgattatgattatttctgatgatggacacctaggctgatattcccaaaaacatggtgttaggctccaacgaa

SEQ ID NO: 10942 - DNA, 111 bp, Homo sapiens
gggaatcctggcttcttacccactgcccaatacgaagacaactgcatttgttgctgttttatatacagaattggagttgagtctaagatttggtttagaaaaggggtttgc

SEQ ID NO: 10943 - DNA, 95 bp, Homo sapiens; identical to SEQ ID NO: 68

SEQ ID NO: 10944 - DNA, 93 bp, Homo sapiens; identical to SEQ ID NO: 69

SEQ ID NO: 10945 - DNA, 67 bp, Homo sapiens
gacagagtgagaccttccttgtctctctctctttttttttttttttgagacagggtctcacactgtc

SEQ ID NO: 10946 - DNA, 95 bp, Homo sapiens; identical to SEQ ID NO: 68

SEQ ID NO: 10947 - DNA, 93 bp, Homo sapiens; identical to SEQ ID NO: 69

SEQ ID NO: 10948 - DNA, 96 bp, Homo sapiens
taacaagtacaggaatatctcatcgtattgtgcctcactttattttttttaacttttaagttcaggggtacatgtgcaggatgtgcaggtttgtta

SEQ ID NO: 10949 - DNA, 78 bp, Homo sapiens
tggcatgaacaagtcatatataaagtgctgagtaaacttcagatactgaagttacacagcagactgtgggctcctcca

SEQ ID NO: 10950 - DNA, 89 bp, Homo sapiens
tcacaggttattaaacagagaatattatatacaaatatgtcttgttggctatagtggatatgtctttgtttttctaacttatcctgtga

SEQ ID NO: 10951 - DNA, 117 bp, Homo sapiens
tgttcttgagatcactccatgttagtgctgatagagcaggttggtcacttttttttttttttttttttttttgagaaggagttttgctcttgtcgcccaggctggagtgcaatggca

SEQ ID NO: 10952 - DNA, 79 bp, Homo sapiens
gagaggaggaccggcttctcagactccctgtgtgccacctggggacacacaacctggcgcctggcctctctgccctctt

SEQ ID NO: 10953 - DNA, 88 bp, Homo sapiens
tcttaatgctacgtttgatcaacagttctcaatttgatgagctccaatttatcaatcttattttgattgagcttttggcaccttaaga

SEQ ID NO: 10954 - DNA, 58 bp, Homo sapiens; identical to SEQ ID NO: 1101

SEQ ID NO: 10955 - DNA, 56 bp, Homo sapiens; identical to SEQ ID NO: 1102

SEQ ID NO: 10956 - DNA, 120 bp, Homo sapiens
ggagccagggattcaatccagaatcatccaacctcaaaactcctgcagtctttcctatagagagagaggacacagtggtcctggtggtgtggttggttcctgtggaatgagcaaggctgc

SEQ ID NO: 10957 - DNA, 113 bp, Homo sapiens
ggaaaggataaaggtggaaatgggggtaggggtgatcttggggaagaaagcgtgtctcactctctaagatttcttgcgagttggagtccccaaagcctgaggcaccagtgcac

SEQ ID NO: 10958 - DNA, 89 bp, Homo sapiens
tactggctctaaagacaaagagcatgagcttctgcagaaactctctctgtgtgtgcagatatgtgtgtgtggatgtgtcagagtgtgtg

SEQ ID NO: 10959 - DNA, 122 bp, Homo sapiens
accctgtttcaagtatatgtatgtatgtatgtatgtgtgtatatatatatatatacacacatacatgtatatatatatatatatatatatatatatatatatatatatgtatatagtgtgta

SEQ ID NO: 10960 - DNA, 80 bp, Homo sapiens
gcctgcacactcacacaggctcagtggcacctggctagacagcaggagccaggaagcgaggctggttcgaggaggttggc

SEQ ID NO: 10961 - DNA, 117 bp, Homo sapiens
ctattgagaacaaatggggctttccgagctgtttcatggtggcagcttgatgtatattaactggcagactgttcatcgtgtaggggaggtccggaaggaggctgtggttgtaagtgg

SEQ ID NO: 10962 - DNA, 57 bp, Homo sapiens
attgagacagaatctcactctgtcactgaggctggagtgcagtggtgagatctcagt

SEQ ID NO: 10963 - DNA, 58 bp, Homo sapiens
tgagccagagtctcgctctgtcgctcaggctggagtgcagtggcgcgatctcggctca

SEQ ID NO: 10964 - DNA, 77 bp, Homo sapiens
ggcctttgtggtgggtggcagattgccctgaggcctcgcaaaatgctaggctttcacaatgtcactgactgacagcc

SEQ ID NO: 10965 - DNA, 108 bp, Homo sapiens
ttaatttatacaggtataaaaatgtaatagatattgataaatttaataattataataaatataattataaatttaatagttttctccagggtatgtgtatattgttaa

SEQ ID NO: 10966 - DNA, 112 bp, Homo sapiens
ctatctttggttaattttggcaaatcttgattcagtgcctattgtaagtatgaaactattttatatgttacatgtagacatatgcctcctttaagaagttcattaagggtgg

SEQ ID NO: 10967 - DNA, 84 bp, Homo sapiens
ccccagaacttcatccaggaggcagggactccagctcaggcccactgaggtggaagatttgtgtgtgtctgtgactgtctgggg

SEQ ID NO: 10968 - DNA, 130 bp, Homo sapiens
gtatcttaccaaggggagcatgcttccagaggaacgcagattccactttggatgttctgagactgaagtgtgtgtggatttccctgggtagatatctatgctgttgagtacttaattctagagaaggatc

SEQ ID NO: 10969 - DNA, 64 bp, Homo sapiens
gcagacacagtctcagtcactagttctccgaatcagagaaaggatgccttcaggctgtgtcttc

SEQ ID NO: 10970 - DNA, 70 bp, Homo sapiens
gttgtagtgagtcgagatcgtaccactgcactccagcctggacagcagagtgagactccctcacacacac

SEQ ID NO: 10971 - DNA, 104 bp, Homo sapiens
cctacatatcttccaaaatatttcgagagaatactggagaatttatgaaaagaagtttggattaaaatggtatattctgtccatatgtagctggaaggtgaagg

SEQ ID NO: 10972 - DNA, 75 bp, Homo sapiens
gggctcctgacaggagtatttgatctcagacttgtatgtggtgaggttgttccttgtagagaaggtgatcagccc

SEQ ID NO: 10973 - DNA, 76 bp, Homo sapiens
tctggtttcctttttggttattttccccatggtaatcttgcaggagcatgggtgaggtattaggaagaattctgga

SEQ ID NO: 10974 - DNA, 115 bp, Homo sapiens
tactgatctttgtatgttgactttgtattctgaaactttactgaatttgtttatcagttttaactgttttgatggcgtttttagagctttctgtatataaagtcatacctctgta

SEQ ID NO: 10975 - DNA, 96 bp, Homo sapiens
ctaagaactgaggaccgcacacttccttgtaacacacagaccacagactgtttctgagtctgtgttttttctcccagggattgtccttaaccttag

SEQ ID NO: 10976 - DNA, 285 bp, Homo sapiens
atatatatatatgtgtgtgtgtatatatatatacgtgtatatatatgtgtgtatatatacacgtatatatatatgtgtacacgtatatatatatgcatatatatgtatatatatatgcgtatatatgtatatatatgcgtatatatatgtatatatatgcgtatatatatgtatatatatatatgcgtatatatatgtatatatatgcgtatatatatatgtatatatatatgcgtatatatatgtatatatatatgcgtatatatatatgtatatatatgcaca

SEQ ID NO: 10977 - DNA, 116 bp, Homo sapiens
cacatttattaatgcatgtctttgtgtcattacttatcagcaatatttgtatttttaaacacagtaccaattaagactggcagttagtggacaactgatgtaaagcaccagatgtg

SEQ ID NO: 10978 - DNA, 83 bp, Homo sapiens
gcagatgctttgctcctctgtgctttgagatgctaactaaagaagtcaggatttttttttgcgtcagggataaaatgtactgt

SEQ ID NO: 10979 - DNA, 88 bp, Homo sapiens
tttcagtcctgggagtttggtatgcaggattttttttttttttttttttttttttaaacacagtcttgctctgtcacccaggctggag

SEQ ID NO: 10980 - DNA, 118 bp, Homo sapiens
atggttctccatatatttaggtgtgtgtatatgtgcatatatatatatatatgtgtgtgtatatgatatacatatgtgtatatgtgtgtatatattacctaaatatatggagaaccat

SEQ ID NO: 10981 - DNA, 61 bp, Homo sapiens
atagatacacatagatatatgtgtatatctatatataaaatgtatgtgtatgtgtgtgtat

SEQ ID NO: 10982 - DNA, 110 bp, Homo sapiens
gtgttgctttcttaccgttgtatctgctgcacagagcaaagtgtgtgaccacagtgggcactcattaaatatgcactgaatgaaggatggttgctgtgagacagcagtgt

SEQ ID NO: 10983 - DNA, 154 bp, Homo sapiens
tgtatatgtgtatatatgtaaatatgtatatatgtgtatatgtgtatatatgtgtatatgtgtatatatgtatatatgtgtatatatgtatatatgtgtatatgtatatgtgtatatatatgtatatgtatgtgtatatatatgtatatatata

SEQ ID NO: 10984 - DNA, 100 bp, Homo sapiens
tcgtccagatgaagtgcttccaatgacagcaggctcactattccagaaagcagcccctttctctgttgtgtatctgtcaggaagctctgctcaataatga

SEQ ID NO: 10985 - DNA, 113 bp, Homo sapiens
ctccacacgagggtctgggaaacttagagctattgttctgtgggtatgcagaggcagaatactgagaacagagacagtgcacgggggcaacctaggccaagtgtgacagtgag

SEQ ID NO: 10986 - DNA, 79 bp, Homo sapiens
tctttgcttagattaagcactatttttacaacccagttggctagagggttgcaaactaatgtagaatctatagtaaagg

SEQ ID NO: 10987 - DNA, 75 bp, Homo sapiens
tggaatctcatctcatttgcagaacatggccagagtcaaagagacatggaccatgtgtcactcagactgagtcca

SEQ ID NO: 10988 - DNA, 58 bp, Homo sapiens
aggtgaggctctgtgggtggctttctttgcacaaatgtgtcaccctgtgtgcctgcct

SEQ ID NO: 10989 - DNA, 115 bp, Homo sapiens
gagataaataatcaaaagtgcaattgttgggatgtatggtagttgcatgtatcctttttaaaaaaggtattttcaacctattttccaaagagattgtaccattttacattccctc

SEQ ID NO: 10990 - DNA, 102 bp, Homo sapiens
gcccatctgcttgccttttgaaatgtttggcccttgctttgaaactttttaaaaatataaccaagtattctctttatcaaaaggactctctctggcagaggt

SEQ ID NO: 10991 - DNA, 118 bp, Homo sapiens
ggctgaagacgcttgatataaaagggctaaaaatgtttaatgttttgagctgcttaaatttatttatttgtgcattcattcattctctcagtctttattgagctacctactccgtgcc

SEQ ID NO: 10992 - DNA, 94 bp, Homo sapiens
attgtatatgtacatatattatatatgcacatatataatatatgtacatatatgtatatatattatgtgcatatgttatatatatatattcaat

SEQ ID NO: 10993 - DNA, 109 bp, Homo sapiens
gacattctgtataatttaacaggaaagagatgctaacaaagttattgaaaagactggagctactgggtttaagaatttttttttttttttttttctgagacggagtttc

SEQ ID NO: 10994 - DNA, 88 bp, Homo sapiens
gtgctaagccactttgtgtccccttgtgctgaaccactctgcctctcagtgttagcaaaaggaagggtagacacagtggttttttaac

SEQ ID NO: 10995 - DNA, 58 bp, Homo sapiens
ttacattgtctttttctttatattcaagatgagtctttaaggaagaagacaactgtaa

SEQ ID NO: 10996 - DNA, 95 bp, Homo sapiens; identical to SEQ ID NO: 68

SEQ ID NO: 10997 - DNA, 93 bp, Homo sapiens; identical to SEQ ID NO: 69

SEQ ID NO: 10998 - DNA, 58 bp, Homo sapiens
tgagacggagtctcactctgtcacccaggctggagtgcagtggcgggatcttggctca

SEQ ID NO: 10999 - DNA, 93 bp, Homo sapiens; identical to SEQ ID NO: 69

SEQ ID NO: 11000 - DNA, 93 bp, Homo sapiens
ttcatgcattatatactctgaaatataatttttatttaactctaattccaagagcctagagaaattatttctcagtatttgaaatggtatgaa

SEQ ID NO: 11001 - DNA, 69 bp, Homo sapiens
gtgtctttgtgtgtgtgtatatatatacatgtatgtatgtgtgtgtatatatgaatatgtaaaaggtac

SEQ ID NO: 11002 - DNA, 78 bp, Homo sapiens
tttccatccctgtctctgtatctcagttagagaaagtgggtagataaggactggatatcagactggatagggaggaaa

SEQ ID NO: 11003 - DNA, 111 bp, Homo sapiens
ccattgtacagatgacaacccaaggcacaaaagggtagaccaacctgcacagaagagacagagcagggattttgcttgtgtgacattgatgtgtgtctcaaactataatgg

SEQ ID NO: 11004 - DNA, 122 bp, Homo sapiens
attaagaatgtcatatatatatataatatatatatattatatatatattatatatatatgagattaagaatgctatatatatgtgtgtgtgtgtatatgtatatgtgtgtgtatatatatat

SEQ ID NO: 11005 - DNA, 95 bp, Homo sapiens; identical to SEQ ID NO: 68

SEQ ID NO: 11006 - DNA, 93 bp, Homo sapiens; identical to SEQ ID NO: 69

SEQ ID NO: 11007 - DNA, 87 bp, Homo sapiens
ggtaactcaatagactgtgagctccttgagggcaaggaccattttaaattttttcttgtatcttcagcatcaagcatgttgtctacc

SEQ ID NO: 11008 - DNA, 86 bp, Homo sapiens
ggtccttgccctcaaggagctcacagtctattgagttacctttctgactttcccactagattgtgagctcctggagggcaggcact

SEQ ID NO: 11009 - DNA, 97 bp, Homo sapiens
acttcatgatgtctcaatttcctaatctgtacagtggggcagccagagtacttatttcattgtattatttgagaagtgggaggacatagtgcatagt

SEQ ID NO: 11010 - DNA, 77 bp, Homo sapiens
catgtgctaatatttgacagtggcgcacgattatttgtattaaatgctcacacacagtctgtcaaatatgagctatg

SEQ ID NO: 11011 - DNA, 63 bp, Homo sapiens
agtatatatatatatatgtgtgtgtatatatatatagtatgtatgtatgtatgtatgtatgct

SEQ ID NO: 11012 - DNA, 70 bp, Homo sapiens
tcttttagctctcactctctggctgaatgtagaggactctgaaggcttaggcaagaggggagttataagg

SEQ ID NO: 11013 - DNA, 97 bp, Homo sapiens
attcaggctcttttttggttccatatgaatttttaaatagtttttttctagttctgtgaagaatgtcatgggtactttgagaggagtagtgttgaat

SEQ ID NO: 11014 - DNA, 95 bp, Homo sapiens; identical to SEQ ID NO: 68

SEQ ID NO: 11015 - DNA, 93 bp, Homo sapiens; identical to SEQ ID NO: 69

SEQ ID NO: 11016 - DNA, 77 bp, Homo sapiens
gccacctttatcacagtgggtgttggaaggaaatgcatttctaaagttctctataacctgtgaaggaaggtttgtgc

SEQ ID NO: 11017 - DNA, 76 bp, Homo sapiens
cactttcatagtgaaggcaggagagtggttgacttttgattttaaaaaggaagaaactgaggcccactagaatgtg

SEQ ID NO: 11018 - DNA, 105 bp, Homo sapiens
ctgggcatggtggtgtgcacctgtagtcctagctgctcaggaggctgaggtggaaggatcacttgaacccaggagttctgggctgtagtgagctatgattgtgcc

SEQ ID NO: 11019 - DNA, 107 bp, Homo sapiens
cctcatataactttacaaggttggcactattattattgtctttatttttcagaagaaggaactgaggcacggggtgttaggcaacttgctcaaggttataaacatgg

SEQ ID NO: 11020 - DNA, 85 bp, Homo sapiens
gttttaggttcacagtaaaacatctctttacttttaatctatacatgtttttaaatttaaagtgggttacttgtggacaacaaac

SEQ ID NO: 11021 - DNA, 117 bp, Homo sapiens
tttaataatagtgttcaaaataataatatcgacaatgtattcaattatatatacatatttgtatatgtatatgcatatatatatattgtattagtctgttctcacactgctaatgaa

SEQ ID NO: 11022 - DNA, 89 bp, Homo sapiens
aacatagaaatgagttaatatacatgagaatatttttattaattttttaattaaaaaacactctcatgtacattaactcatttgatgtt

SEQ ID NO: 11023 - DNA, 98 bp, Homo sapiens
tggaatgccattcttttttgaagaatgtatttttttctgtgatcttatcattttaattttttcaactgtctgaaatatttcttcaaagttgcattcta

SEQ ID NO: 11024 - DNA, 84 bp, Homo sapiens
gaaataggggagcaaaagcattgagggttttttttttttaatcagtttaaaggatagcttttgaagtaagtgactccaagtttc

SEQ ID NO: 11025 - DNA, 58 bp, Homo sapiens
tgagacagagtctcgctctgtctcctagcctggagtgcagtggcgtgatcttggctca

SEQ ID NO: 11026 - DNA, 58 bp, Homo sapiens
tgaggcagagtctcgctctgtcacccaggctggagtgcagtggcgcgatcctgtctca

SEQ ID NO: 11027 - DNA, 95 bp, Homo sapiens; identical to SEQ ID NO: 68

SEQ ID NO: 11028 - DNA, 93 bp, Homo sapiens; identical to SEQ ID NO: 69

SEQ ID NO: 11029 - DNA, 65 bp, Homo sapiens
ccagttccttatgccaaagcattgaacattctgagctgactgacagtggtatggctgagaagtgg

SEQ ID NO: 11030 - DNA, 102 bp, Homo sapiens
ctgttgcttttgttacatatctggaaatttgttttatagtttattaatattctgaaatacaggaatgaagtgggtgctcaggaatgaaggacaatggaacag

SEQ ID NO: 11031 - DNA, 60 bp, Homo sapiens
gctctctctctctgcctctcacatggaaagtccatgtgaaggacgtagtgagaagatggc

SEQ ID NO: 11032 - DNA, 67 bp, Homo sapiens
gctttagaatggatagatatgggattaatttttagttttcccagtctctatctgtgtgactgtcagc

SEQ ID NO: 11033 - DNA, 80 bp, Homo sapiens
aggctttccaaagtcagataaaggtcacatgagagaaagctcacaaagggccttcttgctcctgtctgatggtgttgcct

SEQ ID NO: 11034 - DNA, 58 bp, Homo sapiens
tgagatagagtctctctctgtcacctaggctagggtacagtggtgagatctcggctca

SEQ ID NO: 11035 - DNA, 107 bp, Homo sapiens
cctgtctcctcctgctgcttttctggaaagtctgtggtacttctttgtagtgacacaagaacaaactaacgcagatatcttcagtaggcctgtacgttagaccacgg

SEQ ID NO: 11036 - DNA, 106 bp, Homo sapiens
ctttgaacttccgtaaaagtaaaagatttaatatggagaaaagccaggggagtacacttctgtgactgtctgtgttgagctcatttaattgcaggggagaaggaag

SEQ ID NO: 11037 - DNA, 84 bp, Homo sapiens
ctgaggctcactctctgtgtgtcataatgaagttgtttaagtcaatatggtaaaaatggcaagaagcatgagctgtagcttcag

SEQ ID NO: 11038 - DNA, 67 bp, Homo sapiens
gcaggaaaagtcctggacttgttgctgacatttcacacagggacttttcacagtgtactttacctgc

SEQ ID NO: 11039 - DNA, 99 bp, Homo sapiens
ctgtactgtgtgtctatttcaaagtgcttgtgatatgaattatgtgaacaattgactcaattttttcactttttgtgcgatagacttaatggttctcag

SEQ ID NO: 11040 - DNA, 105 bp, Homo sapiens
atgttatcacaccataggatcttcatgaactgagtatttattttttctatttaggagatatagaaaaatctgaggctccagaaggtaatatggcttgcccaacat

SEQ ID NO: 11041 - DNA, 115 bp, Homo sapiens
gctcacctcctagatggggcagcagccaggcccactgctctttctttttcttttctttttttttttttttttgagtcagagtctcgctctgttgcccactctggagtgcagtggc

SEQ ID NO: 11042 - DNA, 72 bp, Homo sapiens
ggtcttcctctgtgtgtttgtgtcttaatctcgtcttctgataaggatgctagtcatatgggattaaagacc

SEQ ID NO: 11043 - DNA, 65 bp, Homo sapiens
cctgagcagagacctgggatctagaattacttcttcaagtaactcactgagtgtctctaaacagg

SEQ ID NO: 11044 - DNA, 149 bp, Homo sapiens
tatatatgtgtgtgtatatatgtgtatatatatgtgtgtatatatgtgtgtgtgtatatatatgtgtgtatatatgtgtgtgtatatatatgtgtgtatatatatatgtgtgtgtatacatatatatatatatatatatatatagatgc

SEQ ID NO: 11045 - DNA, 106 bp, Homo sapiens
ccacaatgagataccattacacacctactaaaataactaaaattgtatatctgactaaatgatagcaaggatattagtaagtggaactgtaatatattttttgtgg

SEQ ID NO: 11046 - DNA, 81 bp, Homo sapiens
atatgtgtgtatatctatatattatatgtattatacatgcatacataatatatacctaagatatatatatacacatcatat

SEQ ID NO: 11047 - DNA, 58 bp, Homo sapiens
atatgtatatatgtgtgtatatatgtatatatatgtgtatatatatgtgtgtatatgt

SEQ ID NO: 11048 - DNA, 65 bp, Homo sapiens
tgtgtatatatgtatgtgtatatatgtgtatgtatatacatatatatacacacacagttttcaca

SEQ ID NO: 11049 - DNA, 107 bp, Homo sapiens
tgctggcaaaaagagtaagaatttcttaccagaaaagctcctggcctctatctctctctctctgtaatctgatcaggtgaatggtaaaaatcactctttcctctgca

SEQ ID NO: 11050 - DNA, 103 bp, Homo sapiens
gccctgctgatgggggtggaggagggggttggttttgctaatgatattggcggtagtgatattgatgtcattttgttgatctctatataaagattgctggggt

SEQ ID NO: 11051 - DNA, 67 bp, Homo sapiens
gtgtgtgtgtgtctgtgtgtgtatttttataactgaatattacctgagacacacatacacacacaca

SEQ ID NO: 11052 - DNA, 97 bp, Homo sapiens
atattttgcagctgtcatttgatactctatatgtgtatgtgtgtatgtatatatatgtatatagcagggttctccaaagggacaattaataggatat

SEQ ID NO: 11053 - DNA, 68 bp, Homo sapiens
tgtgtgtctctctctctctctgtgtatgtgtgtatagacagacaagcagatagatagatagatagata

SEQ ID NO: 11054 - DNA, 87 bp, Homo sapiens
gaggcttgccagagtctggaggcaggcagaggggcttgattctgatatatagctcatagtctgactttcactcactggtttcacttc

SEQ ID NO: 11055 - DNA, 95 bp, Homo sapiens; identical to SEQ ID NO: 68

SEQ ID NO: 11056 - DNA, 93 bp, Homo sapiens; identical to SEQ ID NO: 69

SEQ ID NO: 11057 - DNA, 62 bp, Homo sapiens
agtttggggagggggtgattttttttttttttgagacggagtctcactctgtcacctaggct

SEQ ID NO: 11058 - DNA, 73 bp, Homo sapiens
cttcagggtctcagagtctgtgtcagttcaatgcttattccctgatgtgactcacttttcagaagtcctgagg

SEQ ID NO: 11059 - DNA, 90 bp, Homo sapiens
aaaatttaatttgtgttttatatatctatatttatctaaataggttgatatagatatgtggatgtagagattcaccaatatatagatttt

SEQ ID NO: 11060 - DNA, 104 bp, Homo sapiens
gtgtagtgatataaaatgtagaatagagtattactatattaatatattattatttgtagaatatagtaaatatagatatttgaatgtgtttaatatcagtaccc

SEQ ID NO: 11061 - DNA, 117 bp, Homo sapiens
ggactgttcaactcacctggcagccactcccagagcccctggtactctggcccaaggctctctgactgactccttcccagatcgtcccggcttagcggctgaagattgatactaccc

SEQ ID NO: 11062 - DNA, 98 bp, Homo sapiens
tatactgaatatataaatcattctggaggaaatcatttccttgtgaaattgaatatttcaatatatgaacaaggcctttctatttatgtgttagtata

SEQ ID NO: 11063 - DNA, 78 bp, Homo sapiens
caagttttcagtcacagcagctgcatctgcattagcgaacactgcaagcccaataatgatgtggctgttgaagacttg

SEQ ID NO: 11064 - DNA, 105 bp, Homo sapiens
tatatatatatatatatatgtatgtgtgtgtgtgtgtgtgtgtgtatgtatgtatatacatatgtgtgtatatgtatgtatatacatatatgtgtgtatatgtat

SEQ ID NO: 11065 - DNA, 90 bp, Homo sapiens
tctttaaaagtctaacactgtcagcttagcacttattggccatttactttgtgtgaggctccatgctaagcgatatgggggaaataaaga

SEQ ID NO: 11066 - DNA, 94 bp, Homo sapiens
caagaagacagttgatactgaactctgcactttcatttgtatcatttcaatggaatatgggaacagtaacagtaaccacagtatctgtcacttg

SEQ ID NO: 11067 - DNA, 86 bp, Homo sapiens
tgtgctgatgagtagaatgtatattatgcagttgttgggtagaatgttctgtaaataactgttaagtctatttgttctagagtata

SEQ ID NO: 11068 - DNA, 95 bp, Homo sapiens
aggaagagaggtaaaaagggaaactagaaggtaggcagaagtcagacagctcatccagcgcctttgaagccacactagaatttttgctcttgact

SEQ ID NO: 11069 - DNA, 115 bp, Homo sapiens
aaaggattgagagctcttttagtgtccctcatgtctttatatatttttttccttttattgttgaagataacagagtacaaaaggacatttaaaaaagataggctttttttttttt

SEQ ID NO: 11070 - DNA, 110 bp, Homo sapiens
cacaaatggtaaagtggtgaagtggaataatttgtcctgataaagaatttccactctgaatttctgtcactgagacacatgttccattgaccagactttctaggggagtg

SEQ ID NO: 11071 - DNA, 70 bp, Homo sapiens
gctatgtgtgtgtgtgtttgtgtgtgtctatatatgtgtgtgtatatatgtacatatataaataatagca

SEQ ID NO: 11072 - DNA, 124 bp, Homo sapiens
catatattcgtgtgtgtatatatatagtgtgtgtatatatatatgtgtatatatacatgtatgtatatatgtgtatatatatatgtatatatacacatatatacatatatatgtatatatgtat

SEQ ID NO: 11073 - DNA, 58 bp, Homo sapiens
tgagaccgagtctcactctgtcacccaggctggagtgcagtggtgagatctcagctca

SEQ ID NO: 11074 - DNA, 93 bp, Homo sapiens
gtaattaaaggacggtttcgaacttctgagtactcattttcttctactgcataagggagatgagagcagtagattttgtgatccctaagttgc

SEQ ID NO: 11075 - DNA, 95 bp, Homo sapiens; identical to SEQ ID NO: 68

SEQ ID NO: 11076 - DNA, 93 bp, Homo sapiens; identical to SEQ ID NO: 69

SEQ ID NO: 11077 - DNA, 95 bp, Homo sapiens; identical to SEQ ID NO: 68

SEQ ID NO: 11078 - DNA, 93 bp, Homo sapiens; identical to SEQ ID NO: 69

SEQ ID NO: 11079 - DNA, 130 bp, Homo sapiens
agcttatgggttcttgggaagatcaggagagcattaatgtggtcatccctgatatatttctgtatccttatgtagctgtttaacaccattactcttgctcttcactttttttttttttttttggcctttc

SEQ ID NO: 11080 - DNA, 91 bp, Homo sapiens
cttttaaaaattgagtctgcctctctctcaatttcaaagcagaaagtttaactgcatgaaatcaggaaaggcaaagctgtcaagttagagg

SEQ ID NO: 11081 - DNA, 68 bp, Homo sapiens
gttttatcccccaggcatctggagtcgtgccagtgtacactgactcactgtggctgagggtcaagggc

SEQ ID NO: 11082 - DNA, 76 bp, Homo sapiens
tccaacctgaaacagtggattttattttattttatttttttctgagatggattctcacactgtcacccaggctgga

SEQ ID NO: 11083 - DNA, 65 bp, Homo sapiens
agcctctgtccctgcctcagtccctcagctgggactacaggcatgcaccatgatgacatagggct

SEQ ID NO: 11084 - DNA, 88 bp, Homo sapiens
gtgtatatgccctcacaccatactgctgctcatctgactgtctctctcgctagactagactgtgagctccagagagagggctgtgttc

SEQ ID NO: 11085 - DNA, 61 bp, Homo sapiens
tgtatatacggcatatactgtatatatactatatatatatagttgtgtgtgtgtgtatata

SEQ ID NO: 11086 - DNA, 67 bp, Homo sapiens
gagatgcagtctctctctgtcacccaggctggagtacagtggcgtgatcttggttcactgcaagctc

SEQ ID NO: 11087 - DNA, 70 bp, Homo sapiens
ttgttttgagatggagtctcgctctgtctcccaggctggagtgcagtggcatgatctcggctcaatgcaa

SEQ ID NO: 11088 - DNA, 104 bp, Homo sapiens
gacagcacagaggagcaccccaagagagctcaaatctgaagatctctggatgtttttcgacacagaaatcagtgaagtgaggtctcgggccactcaatgttttc

SEQ ID NO: 11089 - DNA, 110 bp, Homo sapiens
atatttatatatgtaaatatataaaatacatatttatatgtaaatatataaaatacatatttatatgtaaatatataaatacatatttgtgctatatgctatgtaaatat

SEQ ID NO: 11090 - DNA, 86 bp, Homo sapiens
tgctgcaaattttaagttccagggtacatgtgcaggatgtgcaggtttgtcacataggtaaacatgtgccatagtggtttgctgca

SEQ ID NO: 11091 - DNA, 85 bp, Homo sapiens
tgtttgtggtcttctttaataacagcaataactttattaatatattttgaattattgtctgttgttagcatgatctctgcaaata

SEQ ID NO: 11092 - DNA, 86 bp, Homo sapiens
cctgtgacaccatgcccttccctctcacagtctgtgtggccacaggccactgcttcgagattgtcacggctgcttccatggtcagg

SEQ ID NO: 11093 - DNA, 80 bp, Homo sapiens
ggagactgaagtcagaaaccagagctttatccaatcacatgaaatgggctcacagggctctggtgttatgattttcctcc

SEQ ID NO: 11094 - DNA, 97 bp, Homo sapiens
ccagtgtctcagtcttatgctgtgatgtgaaccttttttttttttttttttttttgagatggagtctcactctgttgcccaggctagagtgcagtgg

SEQ ID NO: 11095 - DNA, 72 bp, Homo sapiens
gcatacatacttgttatatacatatgtataggtatgtaatatgtgtgcatatgtatatgtatatatagatgc

SEQ ID NO: 11096 - DNA, 70 bp, Homo sapiens
gcatgggaggctgaggttggaggatctcttgggcccaggaggtcaaggctccaatgagctgtgatcatgc

SEQ ID NO: 11097 - DNA, 98 bp, Homo sapiens
ttcattgtaataaatcttagttgtaaggtgtttttttgttgttgttgttgtttttttaaataacaaatccctatcacagctggagcttttacaaagaa

SEQ ID NO: 11098 - DNA, 102 bp, Homo sapiens
ctgcagcatattttaaagctttttatgtgctccctatttaatatgtttttattttaatatattttttataagggattgggtttctgtgaaaatgttgctgag

SEQ ID NO: 11099 - DNA, 143 bp, Homo sapiens
gggaggtgattttgtcacgttcactgacctctgactctttcctcaaggaagggtttgtgtcatgagtgaacagagacaggtgaaaagccccctctaatttctagcacacagtcctgcaagcctctgcaggaaggagttgggag

SEQ ID NO: 11100 - DNA, 58 bp, Homo sapiens; identical to SEQ ID NO: 9124

SEQ ID NO: 11101 - DNA, 88 bp, Homo sapiens
tgggaactttgactgaattggagattctgggctaaattatagagaaagagctgtcttcactctgtgcctgagaggccaacaaacccca

SEQ ID NO: 11102 - DNA, 118 bp, Homo sapiens
cttatgtgtctctttttgtacagtatcccagcattcttaaagaaagtaattttctttattattattattattattatactttaagttttagggtacctgtgcacaatgtgcaggttag

SEQ ID NO: 11103 - DNA, 75 bp, Homo sapiens
gagctcagtccctctgtctgtgaagctcaggctcttcccatgatgcccaagctgacctggagctttactgagctt

SEQ ID NO: 11104 - DNA, 73 bp, Homo sapiens
gagatgagacttaagaggtaaacaagggtcaggccatcctgacaggtctcccctggctcactcactctcactc

SEQ ID NO: 11105 - DNA, 74 bp, Homo sapiens
tcagcatcctaaagtgctgggattccaggcgtgagccaccacactcggcctttgcttgtaggttctatgcatga

SEQ ID NO: 11106 - DNA, 76 bp, Homo sapiens
agctgggacatcctcaggctctgggttccaagtccagcaccccctcgtcccatgcctgtcagtctgtctcactgct

SEQ ID NO: 11107 - DNA, 90 bp, Homo sapiens
caagttctgggctatgagtgagtgaatgagtgtgtgtgtgtggggtcacacgtgtgtgtgctcagactcattcagggtgggaatcttttg

SEQ ID NO: 11108 - DNA, 84 bp, Homo sapiens
gaggtgattgcgggagtcagattctatttattttattttaattaatttatttatttttgagatggacgtctcactctgtcaccc

SEQ ID NO: 11109 - DNA, 58 bp, Homo sapiens; identical to SEQ ID NO: 6617

SEQ ID NO: 11110 - DNA, 56 bp, Homo sapiens; identical to SEQ ID NO: 6618

SEQ ID NO: 11111 - DNA, 83 bp, Homo sapiens
ctctgaactactatcataattgactcttacagtaactataaaaatggaagagagagatacagttgtgatttttaagttaagag

SEQ ID NO: 11112 - DNA, 60 bp, Homo sapiens
tgagacagggtctgtcactctgtcgcccaggctggagtgcagcgtcacagtcacatctca

SEQ ID NO: 11113 - DNA, 56 bp, Homo sapiens
tctctctgctgtcctcactttctgtcactgggtacagagaagaggtagctctgaga

SEQ ID NO: 11114 - DNA, 97 bp, Homo sapiens
gcaactggcttgatagagtggtaagatggccttgaaattgtttttgtttatttttaaattagagacagggtctcactatgttgtccaggctggtctc

SEQ ID NO: 11115 - DNA, 81 bp, Homo sapiens
gggagtgatatgcagagtaccacggattttttttttctttttttttttgatacggagtctcagagtctggctctgtagccc

SEQ ID NO: 11116 - DNA, 112 bp, Homo sapiens
ttgtttattgctgagtgcaggtgagactgtcacatttccatctggggctgaggttttttttgttttttgttttgagatggagtctcgctctgtcacccaggctgaagtgcag

SEQ ID NO: 11117 - DNA, 85 bp, Homo sapiens
ggagtggggattaagagaagagagtcaagaaatattcaggaagccttttttttttttttttttttttgagaggaagtcttgctct

SEQ ID NO: 11118 - DNA, 111 bp, Homo sapiens
agtcagatagtgtgatgcctccagctttgttcttttttttgagacagagtctcactctgtcacccaaactagagttcagtggcacgatcttggctcactgcaacctctgct

SEQ ID NO: 11119 - DNA, 86 bp, Homo sapiens
ctggcagcagaatgagctccggccaaaggcacagtgacatcctaaagcccgccctcactgtctctctccatctcatgtttagccag

SEQ ID NO: 11120 - DNA, 86 bp, Homo sapiens
tggtaatccaggaagaggaagggcaattaggggttcagagggaaatatacaggacctgacagtgtctgtctgtctggttggagcta

SEQ ID NO: 11121 - DNA, 95 bp, Homo sapiens; identical to SEQ ID NO: 68

SEQ ID NO: 11122 - DNA, 93 bp, Homo sapiens; identical to SEQ ID NO: 69

SEQ ID NO: 11123 - DNA, 84 bp, Homo sapiens
aggcaaactgggtgtagggtgtatgggaactcttttattattattattattctgagacagagtctcactctatcacccaggctt

SEQ ID NO: 11124 - DNA, 58 bp, Homo sapiens; identical to SEQ ID NO: 2626

SEQ ID NO: 11125 - DNA, 77 bp, Homo sapiens
ctcaccctcactcagtcacatgcagccccggagcctcggccctgggaggggcaagggacagagatgagggggaagag

SEQ ID NO: 11126 - DNA, 122 bp, Homo sapiens
ggcgtggaagaagaggagccaggaagatgcagggcgttggaggaccccggccacctgtccctcacactgacagccgagaggcccgtagcgagtcaggccatgggggccttttctgctgtggg

SEQ ID NO: 11127 - DNA, 68 bp, Homo sapiens
tgcctggggcctgtggacaggggcagctgcattaaaggccatttgtacacacagagcacacctgggca

SEQ ID NO: 11128 - DNA, 100 bp, Homo sapiens
tagtatgcgagtcttgtactccttttattaagtttattcctaagtattttattattttaggaatggctttttttttttttttagacggagtctcgctctg

SEQ ID NO: 11129 - DNA, 95 bp, Homo sapiens; identical to SEQ ID NO: 68

SEQ ID NO: 11130 - DNA, 93 bp, Homo sapiens; identical to SEQ ID NO: 69

SEQ ID NO: 11131 - DNA, 92 bp, Homo sapiens
cacagagccctctgcaggctcagtcaccctctcactcttgctcagcacgtccacggggcataattaagtctgtaggctgcgggatctctgtg

SEQ ID NO: 11132 - DNA, 92 bp, Homo sapiens
ggtttggtggttcccacagtctctggctctgtgactcttcttgatcgttggcaggctctcagccagttgagaatcatcactgctttagggac

SEQ ID NO: 11133 - DNA, 102 bp, Homo sapiens
ctatcattttatgtttgtacccagtagaaaaaaaaatgagtgtttctatatttatatggtaaatttaagtggttttttttttttttaaatattcagtgatgg

SEQ ID NO: 11134 - DNA, 122 bp, Homo sapiens
ttttatttttacaggctcacagacagaagggacttgccttgtctcagatgagactgtggacttggacttttgagttaatgctggaatgagataagactttggggaactgttgggaagtcctg

SEQ ID NO: 11135 - DNA, 66 bp, Homo sapiens
gagtgcagtctctctctctctctggctaagctgcctgcagcttggagaggggtgatacaagcactc

SEQ ID NO: 11136 - DNA, 58 bp, Homo sapiens
tgagacagagtctcgctctgtcacccaggctggagtgcagtggcgtgatctctgctca

SEQ ID NO: 11137 - DNA, 60 bp, Homo sapiens
ggtctcactgtgtcactcaggctggagtgcagtagtgcaatcacagctcactgtggcccc

SEQ ID NO: 11138 - DNA, 94 bp, Homo sapiens
atatgactgtgtgtgtatatatatgtatagacctatatatatgagtgtgtgtgtgtgtgtatatatatatacacacacacctatatatatgagt

SEQ ID NO: 11139 - DNA, 96 bp, Homo sapiens
gctgctgtgtatatcacagtggtagatacagtgaagctcccctgtatatcacagtggcagttatattgaagctcctgtgtgtgatatcacagtggt

SEQ ID NO: 11140 - DNA, 76 bp, Homo sapiens
tatcagcatatgtattgtatatatactgtatgtactgttttatatgtatagttatatatatttttatgttttgata

SEQ ID NO: 11141 - DNA, 78 bp, Homo sapiens
gccgggcatggtggctcatgcctataaccctgcagggaccagccccacagggtcggtgggtctctccctgtgtgcggc

SEQ ID NO: 11142 - DNA, 115 bp, Homo sapiens
cagttgaagtcttgagtttggaggaggttcttcaaaatgagtcagagacagacacacacacgtctgcctcttgtttgaggtgactcgtcctggacttttctgggttgcttttctg

SEQ ID NO: 11143 - DNA, 107 bp, Homo sapiens
ccagctttgttcttttggcttaggattgttttggctatgcaggctctcttttggttccatatgaaatttaaagtagttttttccaattctgtgaagaaagtcactgg

SEQ ID NO: 11144 - DNA, 58 bp, Homo sapiens
tgagactgagtctcactctgtcatccaagctggagtgcagtggtgcgatcttggctca

SEQ ID NO: 11145 - DNA, 58 bp, Homo sapiens; identical to SEQ ID NO: 1435

SEQ ID NO: 11146 - DNA, 88 bp, Homo sapiens
gggccatcaccacattatgaactcgtgtgtgtgtgtgtgtgtgtgcacgcgcgcgtgcacaggctagtgtccttctgtgggtgtgtct

SEQ ID NO: 11147 - DNA, 120 bp, Homo sapiens
gtatcatgtatgtatccatgtagatatgtatcaatgtatgtatccatgtatgtatccatgtatgtatgtgtgtgtcatgcatgtatgcatgtatccatgtatgtatccatatgtgtgtat

SEQ ID NO: 11148 - DNA, 58 bp, Homo sapiens; identical to SEQ ID NO: 2224

SEQ ID NO: 11149 - DNA, 56 bp, Homo sapiens; identical to SEQ ID NO: 335

SEQ ID NO: 11150 - DNA, 115 bp, Homo sapiens; identical to SEQ ID NO: 11142

SEQ ID NO: 11151 - DNA, 85 bp, Homo sapiens
caggccgggcatggtggctcatgcctataaccctgcagggaccagccccacagggtcggtgggtctctccctgtgtgcggcgatg

SEQ ID NO: 11152 - DNA, 78 bp, Homo sapiens; identical to SEQ ID NO: 11141

SEQ ID NO: 11153 - DNA, 60 bp, Homo sapiens
cgagggctgtcagtgactcactgcgtgggccacccagggcatgtggtgctgaggctgtcg

SEQ ID NO: 11154 - DNA, 105 bp, Homo sapiens
tgttgattttgttgattggcattgatcaacaaagttgcagttgttgatcctgcaactttactgaatttgtttatcagttctaacagttttttggtggaatcttta

SEQ ID NO: 11155 - DNA, 87 bp, Homo sapiens
gcactgagtcctgtgatgtgaactgtctgtgtgagtctctcagccatggataccagcacagtatttggggtgtctcatgggtcctgc

SEQ ID NO: 11156 - DNA, 112 bp, Homo sapiens
gctctgccactcacagccggtgtgaccttggcctagtttcttttttctttttcttttttttttttttttgagatggagtctccctctgttgcccaggctggagtgcagtggt

SEQ ID NO: 11157 - DNA, 73 bp, Homo sapiens
ggttgagggagggaaaggtgactggggcttcccatgcctgggcattcgtctagttctttttttttttttcccc

SEQ ID NO: 11158 - DNA, 70 bp, Homo sapiens
ggagacagaagagaaagggaatttctccctccaggtccccacgcctgagtcagaccctctcactgtttcc

SEQ ID NO: 11159 - DNA, 62 bp, Homo sapiens
tgagacggagtctcactcactctgttgcccaggctgcagtgcagtggcgtgatctcggctca

SEQ ID NO: 11160 - DNA, 97 bp, Homo sapiens
cccttttctctttatgatctggaaattttgagagtacttttctttttctttttttgagatagagtcacactcagtcatccaggccagagtacagtgg

SEQ ID NO: 11161 - DNA, 116 bp, Homo sapiens
tattatagtcaccattctgtgcaatagatcactaaagcttatttctccattctttttttttttcttttttgttgagacagagtcttactctgttgccaggctggagtgcagtggtg

SEQ ID NO: 11162 - DNA, 121 bp, Homo sapiens
gtagatgttgaaataattaaactatacatatgtgtatatatgtatatacatgtatatatatatatatgtctgtagtttacaattaaaatatatatatatataatgtttgcatgtgtacaca

SEQ ID NO: 11163 - DNA, 119 bp, Homo sapiens
tgtagatgattttaaggtagcttttagctctaaaattctatggtctcaccaaggttttatttttatttttattattttttgagacagaattttgctcttgttgcccaggatggagtgca

SEQ ID NO: 11164 - DNA, 84 bp, Homo sapiens
ggaatgaacaagggcagcttggaggttagacgcaagatggagtcggttaggttggatctctttcactgtctcagtcatcatttt

SEQ ID NO: 11165 - DNA, 84 bp, Homo sapiens; identical to SEQ ID NO: 11164

SEQ ID NO: 11166 - DNA, 94 bp, Homo sapiens
ttggttggttggttgttttgagacagggtcgctctgtcgctcaggctggagtgcagtggcccaatctcagctcactgcaacctctgcctcctgg

SEQ ID NO: 11167 - DNA, 115 bp, Homo sapiens
gtgctcactgcctgtctctgtgtcaccttttggtaatgcttgcagttcattattttatctattataatgaactgtgagcagttacctttgatgttactattctgcttttgggcac

SEQ ID NO: 11168 - DNA, 106 bp, Homo sapiens
ggcaggaatattgcttgagcccaggagttcaggaatgtagtgtgctatgatcatacctgtgagtagtcactgcactccagtctttgggcaacagtaagactctgtc

SEQ ID NO: 11169 - DNA, 113 bp, Homo sapiens
tggattataggtgtgagccactgcacctggccttcagtggcattttttatttttataagaacaaaaaaccattgtcagtgtatagggaattggcattataataagtatatcta

SEQ ID NO: 11170 - DNA, 89 bp, Homo sapiens
gctcacactgtaatcccaacactttggaaggccgaggcagacggactgcttgagctcacaagtttgagaccagtctgggcaaaatggtt

SEQ ID NO: 11171 - DNA, 105 bp, Homo sapiens
gtctcgcatctcgctctgtcacccagactggaacgcagtggtgctttttttttttcttttcctagggtctcactgccacccaggctggagtgcggtgatgcggtc

SEQ ID NO: 11172 - DNA, 90 bp, Homo sapiens
gatagagtgagaccctgtctcgaaaaagattttatttgttttagtttttgtttgtttgttttgttttttgagacagtgtgtcgctctgtc

SEQ ID NO: 11173 - DNA, 71 bp, Homo sapiens
gcctgtgtgtgtgtgtgtgctgtgactttagaaaaaattttaacaatgtcagagagaagacacacagctgc

SEQ ID NO: 11174 - DNA, 79 bp, Homo sapiens
gtctcactctgtcacccagactgcagtgcagtggcacaatcgtagcgcactgcagccttgaactccttggctcaagtga

SEQ ID NO: 11175 - DNA, 117 bp, Homo sapiens
attgtggttttgatttgcatttccctaatgactagtgacattgagtattttttcatatacttgttggacatcggtatgtcttctttggagaaatgtctactattcaaagtccttagt

SEQ ID NO: 11176 - DNA, 58 bp, Homo sapiens; identical to SEQ ID NO: 8823

SEQ ID NO: 11177 - DNA, 68 bp, Homo sapiens
ggaatggcgtgggacaccttcctggggcacaggtgtccgcactctcccccactgtcacactgtcatcc

SEQ ID NO: 11178 - DNA, 99 bp, Homo sapiens
gcatggtggtgcatgcctgtagtcacagatacttgggaggctgaggtaggaggatgacttgagctggaaagatgaggctgcagtcaggtacgatcattc

SEQ ID NO: 11179 - DNA, 69 bp, Homo sapiens
cttggttttcattgaggggggtggggggggctggctggagacagagcgtccctctctctgtcacccagg

SEQ ID NO: 11180 - DNA, 121 bp, Homo sapiens
gagggcggtacatggtcataaatgtggatgtgcagaacagatgcaaatggctgtatgtagtgagtgttcagaccactttatgaaaatctgttttaagtgctgcttttataattttaagatc

SEQ ID NO: 11181 - DNA, 111 bp, Homo sapiens
acataaatatatttaaaattttatataaatgcactgtttaaacatttttaagcaacactgtatgtatgtatcattatatatgtgtatgtgtgtatccatgcttatgaatgt

SEQ ID NO: 11182 - DNA, 86 bp, Homo sapiens
gtaatgaagttgtagtggaacacagccacactcattctcatttccatgtatgatgtatggctgctttctagctgcctctgtgatgc

SEQ ID NO: 11183 - DNA, 69 bp, Homo sapiens
cacaaagaaaagataaatatttgaggtgatggatatcacaattaccctgattttttttttttttttgtg

SEQ ID NO: 11184 - DNA, 111 bp, Homo sapiens
atttatgatgattgttaaacatacatcacatgtctacacagacatacaccttccaagctgggaatcaggtctgagtgatcctgtcggtgttctgcccacaatttcatgagt

SEQ ID NO: 11185 - DNA, 75 bp, Homo sapiens
gccctggtgtggaggatatttcttttttttttttttttttttttttgagatggagtctcgctctgtcacccaggc

SEQ ID NO: 11186 - DNA, 58 bp, Homo sapiens; identical to SEQ ID NO: 1763

SEQ ID NO: 11187 - DNA, 103 bp, Homo sapiens
agtgttcaattttctgtttctaggtaatgatgatgttgatgatgataatgataatgatgatgatgatgattattattattattatttaagacaggacctcact

SEQ ID NO: 11188 - DNA, 125 bp, Homo sapiens
tccagctttgttcttttaccttaggattgtcttcgcaaggcgggcccatttctcattccatatggaatttaaagtagttttttccaattctgtgaagaaagtcattggtagcttgatggggatgg

SEQ ID NO: 11189 - DNA, 69 bp, Homo sapiens
ttttttggagatggagtctcactctgtcacccaggctggagtgcagtggtgtgatctcggttcaagaga

SEQ ID NO: 11190 - DNA, 116 bp, Homo sapiens
catgaggggctccaaggctgtgcggggaagaagacagactgtgttagattgaaaatgagtatttttatttacatgtgatggaatcgagcctctcacttcccggcccaagtcatgcc

SEQ ID NO: 11191 - DNA, 71 bp, Homo sapiens
ctgcagatcggctttctccctctctctgtggcttcagggcccagtggagtgtagctgccgtcctccagcag

SEQ ID NO: 11192 - DNA, 95 bp, Homo sapiens; identical to SEQ ID NO: 68

SEQ ID NO: 11193 - DNA, 93 bp, Homo sapiens; identical to SEQ ID NO: 69

SEQ ID NO: 11194 - DNA, 58 bp, Homo sapiens
tgagatggagtctcactctgtctcccaggctggagtgcagtggtgcgatctcagctca

SEQ ID NO: 11195 - DNA, 108 bp, Homo sapiens
tatcgtaatatagttatttgcataagtgcaataataatctgtttttatttgtaacaggacacaattgaagaaactggttattctaccatggctttgactggaatggtg

SEQ ID NO: 11196 - DNA, 78 bp, Homo sapiens; identical to SEQ ID NO: 11141

SEQ ID NO: 11197 - DNA, 94 bp, Homo sapiens
tgtcgacgtccatggcttcccagagtccctcacagcctccgtctccctccgcgggtctcttggggaccggaacgcctccccccaccccccgaca

SEQ ID NO: 11198 - DNA, 92 bp, Homo sapiens
tgtcatcctcattctgacagaactcacagatgaagcctttggcttggcagagctggggaggaaaaacacagatggcaaaatgaggagcggca

SEQ ID NO: 11199 - DNA, 135 bp, Homo sapiens
atgttttttatatatgtatatatatacgtgtgtgtatatatatacacacacatatatgtgtgtgcgtatatatgtatatatatgtgtatatatgtgtgtgtgtatatatatatgtatatatatataagccagaca

SEQ ID NO: 11200 - DNA, 158 bp, Homo sapiens
atatatatatatatatatatatatgtatgtatatatatatgtatgtatatatatatatgtatgtatatatatgtatgtatatatatatgtatgtatatatatatgtatgtatatatatatgtgtgtgtgtatgtatgtatgtatatgttatacacata

SEQ ID NO: 11201 - DNA, 70 bp, Homo sapiens
ttctaactagtttttcttgtgtcagaatctagcaaatttagattctgctacacgatgtggacagtgggag

SEQ ID NO: 11202 - DNA, 80 bp, Homo sapiens
tgagactgagtctcactctgtcgcccaggctggagtgcagtggtgtggtcttggctcactataacctccacttaccgggc

SEQ ID NO: 11203 - DNA, 75 bp, Homo sapiens
cccaggcatgcagaggggaaagcagcatcctcaggcccagcccaggcgagtgtcctgcctctctcactgtcaggg

SEQ ID NO: 11204 - DNA, 66 bp, Homo sapiens; identical to SEQ ID NO: 474

SEQ ID NO: 11205 - DNA, 82 bp, Homo sapiens
ctgctggtcactctctccttgacactctctttcttgtcctatcacatttagaaaggaaggtatgcgaagtgggaggaagcag

SEQ ID NO: 11206 - DNA, 119 bp, Homo sapiens
tgtagtcttgtgaaactgtagatttcaagcttctcaacatcacagagtattttcttttttcttttttttgagacatgctcttcctgttgcccgggctggagtgcagtggtatgatcata

SEQ ID NO: 11207 - DNA, 83 bp, Homo sapiens
cctgagtttttttgttttgtcttgttttttgagacagggtctcactctgtcacccaaactacagtgcagcagcacactcacgg

SEQ ID NO: 11208 - DNA, 58 bp, Homo sapiens; identical to SEQ ID NO: 1099

SEQ ID NO: 11209 - DNA, 84 bp, Homo sapiens
gatttatgtaagtattgtatgtaagtatttatgtaagtattatgtaagtatttatgtaagtattgttcatacaatgacaaaatt

SEQ ID NO: 11210 - DNA, 99 bp, Homo sapiens
tccatctgttaacagcagaagatggcaggttgacagagcaaagattttttttttttttttttttttttttgagacagtctcgctgttacccaagctgga

SEQ ID NO: 11211 - DNA, 95 bp, Homo sapiens; identical to SEQ ID NO: 68

SEQ ID NO: 11212 - DNA, 93 bp, Homo sapiens; identical to SEQ ID NO: 69

SEQ ID NO: 11213 - DNA, 95 bp, Homo sapiens; identical to SEQ ID NO: 68

SEQ ID NO: 11214 - DNA, 93 bp, Homo sapiens; identical to SEQ ID NO: 69

SEQ ID NO: 11215 - DNA, 98 bp, Homo sapiens
gcgcccgccaccatgcctggctaattgttggggttttttgttttattttgtttgagacagagtcttgctctgtcacccaggctggagtgcagtggcgt

SEQ ID NO: 11216 - DNA, 96 bp, Homo sapiens
gaggaacagcaggagtgagtgggggcactgttgcaagggctgcactggaaggtgctctttctttcagtgtctctcacacttatactgctgtctctt

SEQ ID NO: 11217 - DNA, 69 bp, Homo sapiens
gtggttggtgtcagaagtgagggtggtcttggcgacttccctaacccctgcaactgatcatccaattgc

SEQ ID NO: 11218 - DNA, 116 bp, Homo sapiens
aacagcaagaaaaaagcaagcagaaagcaaatagggaaatagacttttttttttaattagtaagaaagtctttttataaacctgtcattctggatttgtttttcactgtttccctg

SEQ ID NO: 11219 - DNA, 95 bp, Homo sapiens; identical to SEQ ID NO: 580

SEQ ID NO: 11220 - DNA, 93 bp, Homo sapiens; identical to SEQ ID NO: 69

SEQ ID NO: 11221 - DNA, 112 bp, Homo sapiens
gacttttgtttaatactccataaagcacattgtatatttttgctgaattttaaaatgttgtcattctgtgaggtaaagaactaagtgctaagtgaaatgtgaaaccaaagtc

SEQ ID NO: 11222 - DNA, 81 bp, Homo sapiens
actgcactgtgctgttactcagtagctacgattttggcctttcacactggctgtctgggtttgagtccctgcttaggaagt

SEQ ID NO: 11223 - DNA, 118 bp, Homo sapiens
ctactatctgttccataattctggaagaaattatttggggtaaagacaacagatttttttcttaaaccaaataagtaacccttttttcttcccatttataccctaagatgaaccgtgg

SEQ ID NO: 11224 - DNA, 84 bp, Homo sapiens
ggatgccctttatttatttctcttttctgctctagataggacttacagaactatgtggaatagcagttgtgaaagtcagcatcc

SEQ ID NO: 11225 - DNA, 98 bp, Homo sapiens
ggtagagctaatgtgcagctcccacttggatagacagaatagtgtgtggaaactcacactgtgatcttttgctccaagaaccactgcaggaaggtacc

SEQ ID NO: 11226 - DNA, 83 bp, Homo sapiens
gtgggggaaaagtggcagttacaggtctcatccagctcccatgcagcccaataggcccgtctcactctcacagtgtcccccac

SEQ ID NO: 11227 - DNA, 106 bp, Homo sapiens
tttcaaggaacttaaagttcacctcgctttggcttatagctcttgtgttttagttgttgccaaaaaatgtatttccaaagtgagaactagtttcagatatttgaag

SEQ ID NO: 11228 - DNA, 68 bp, Homo sapiens
tttccatgtatatacaggtgaatatgtgtatatatatgtatgcatatcacttttatacaaagaggaaa

SEQ ID NO: 11229 - DNA, 59 bp, Homo sapiens
ttttttttgggtgggggggggggggtgggatggagtctgtctctgtcacccaggctgga

SEQ ID NO: 11230 - DNA, 116 bp, Homo sapiens
caataaaggagatgacagataagcatgtaagtatcttctgcttccctttttaaaaacattcattgaaagtttttctaaaagatgcaatatttgtgtgagctttcctctctcagttg

SEQ ID NO: 11231 - DNA, 105 bp, Homo sapiens
gtgtgtgtttgtgtgtgtgtgtgtatgtgtatatatatgtgtgtgtatatatatatgtgtgtatatatatatatacacacacacatatatgtatatatataatgc

SEQ ID NO: 11232 - DNA, 58 bp, Homo sapiens
tgagaccaagtctccctctgtcacccaggctggagtgcagtggcgcgatcttggctca

SEQ ID NO: 11233 - DNA, 81 bp, Homo sapiens; identical to SEQ ID NO: 7982

SEQ ID NO: 11234 - DNA, 103 bp, Homo sapiens
gagagaatactcctagccccctgacatgaaagaagtggcgtaagcagggagaggaagtagtttctcttaccactctgcctttgtccttgacgactcttctggg

SEQ ID NO: 11235 - DNA, 115 bp, Homo sapiens
ttttgacaagtagtacaggaaatgacattacagaaaatatgtatatatgtatattcatacatactgtaggtctaggtgttatcgataggttcttggaaactgactttaagcaaaa

SEQ ID NO: 11236 - DNA, 96 bp, Homo sapiens
ctctttgttgctttcattattctcaaaaggttatcccatatactaactactggtgttggttgtatccttttgtgtaaaaatggacaaaaaaaagag

SEQ ID NO: 11237 - DNA, 95 bp, Homo sapiens; identical to SEQ ID NO: 580

SEQ ID NO: 11238 - DNA, 93 bp, Homo sapiens; identical to SEQ ID NO: 69

SEQ ID NO: 11239 - DNA, 117 bp, Homo sapiens
atatatacatagagagatacagatataaatagatatatagtacatatatagacacatatgtgtatatgtatatttgtgtgtgtgtatatatatgtgtgtgtgtattccatttacatt

SEQ ID NO: 11240 - DNA, 107 bp, Homo sapiens
atatatgtgtgtatatatacatatgtacatatatatgtgtgtatatatatatgtacatatatatatgtacatatatatataaagtgagaaaagatagagaatatgta

SEQ ID NO: 11241 - DNA, 103 bp, Homo sapiens
ggcaggccaggaatactgagttccttatcactctcacactagctcactggtagagcagagggtcagtgctagagaaagtaaggtgagaagacaagaggctacc

SEQ ID NO: 11242 - DNA, 104 bp, Homo sapiens
gtaatatgcctacatcatatcatagtgttcttatgcctatatatatatatatgtgtgtgtttaaaatggcacctggtacaggataaatgctgtgtaaatattac

SEQ ID NO: 11243 - DNA, 89 bp, Homo sapiens
acatttttaatcatatgtatacctgtgtgtgtgtgcatgtgcatgtgtgtgtaagtgtatgtttataaggtatgggtatatttaattgt

SEQ ID NO: 11244 - DNA, 58 bp, Homo sapiens
atgtgtaagctagatatgtgtatatatgtgtgtgtgtatatatatgtatcttatatat

SEQ ID NO: 11245 - DNA, 145 bp, Homo sapiens
tgatatatatatcaaatatatgtgtatatatgtatatatatgatatatatatcaaatatgtgtgtatatatatgtatatatgatatatatatcaaatatatgtgtgtatatatgatatatatatcaaatatatgtgtgtatatat

SEQ ID NO: 11246 - DNA, 118 bp, Homo sapiens
gtcctttgaggatatcttgctagaatgatgcaaatgaagatgtggactatttaattatttgttaaaacatattatattgcaacaccctagttatcacaggttctgtaatgaagaggac

SEQ ID NO: 11247 - DNA, 114 bp, Homo sapiens
tagtggcagaatcagcaatatggagtgataaggctaaaagctgtttttttcttgttttaattaagactagtatgaatgagtgtggtcttgttctggggttttcagatgttattg

SEQ ID NO: 11248 - DNA, 73 bp, Homo sapiens
aggcttatcaggaccacacattgatgtgcattgccttggcctctggctctgacactcagtgagatccctgcct

SEQ ID NO: 11249 - DNA, 104 bp, Homo sapiens
gcggtggaggagctgccttgactgtgtgtgttgttttaaggatatcgattgttaacacaatgacgggtcaggagatggaaggcacagtcattagctgcagccgc

SEQ ID NO: 11250 - DNA, 105 bp, Homo sapiens
tagggtaatagaggttcacacttagaagtgatcacatcccagaaagctagtacttggtgaagtgtaattttttatttcttgagtgttccctgagctattatgttg

SEQ ID NO: 11251 - DNA, 83 bp, Homo sapiens
aatcagaagtgatataaagatatgtgatgtgatttttctgcctcagttgagacaggtatatatatatgtgtatatttctgatt

SEQ ID NO: 11252 - DNA, 79 bp, Homo sapiens
gtcctgtatcacccactgtgtacctgtcaacaagttaccagtgccttgtggactgagttcagtgtctgtgagcaaggac

SEQ ID NO: 11253 - DNA, 80 bp, Homo sapiens
tctatcctctaagtttatgtgtaaagatatacatatatagtattcatgtgtgtgtctgtgtgtgtaacttggttttaaga

SEQ ID NO: 11254 - DNA, 115 bp, Homo sapiens
gaatttggctgtgaatctatctgttctagggcatcttttggttggtagggtcttttttttttttcattactgattcagtttcaaaacttgctggtctgttcagggtttcaaattc

SEQ ID NO: 11255 - DNA, 106 bp, Homo sapiens
ttcactgactatatttgaatgtgtgtgtgtgtgcatgtatatacgtgtgtgtatatatatgtatatgcatatatatatacacacacatatatatatagtgagagag

SEQ ID NO: 11256 - DNA, 114 bp, Homo sapiens
agatatatatttttgtggataccatagtgtgtgtatatatatatatatatatatatatatatatatatatatatatatatatatatttcgtgggtacataataggtatatattt

SEQ ID NO: 11257 - DNA, 95 bp, Homo sapiens; identical to SEQ ID NO: 68

SEQ ID NO: 11258 - DNA, 93 bp, Homo sapiens; identical to SEQ ID NO: 69

SEQ ID NO: 11259 - DNA, 111 bp, Homo sapiens
aaaaataaagagaatatggaaagaaagattgcttgtgtctctgttttattcatcacactgcctgttgagtttatatcactggcttcaaatttatccagtttcttttctttt

SEQ ID NO: 11260 - DNA, 107 bp, Homo sapiens
tatagagagtttatgttcagtattctactgcataatctgaggagactgcttttttaaacttcagattttcatgttattaagaaggatattaaggaaattttcttgtg

SEQ ID NO: 11261 - DNA, 82 bp, Homo sapiens
catgtgggagacagcagagctgcagattaacatttaaacatgctaatcatggtagcactctctccctctgttagttcacatg

SEQ ID NO: 11262 - DNA, 68 bp, Homo sapiens
tgtatatatatgtgtgtatatgtgtatctatgtacatatatatacatacacacacaactgtatctgcg

SEQ ID NO: 11263 - DNA, 92 bp, Homo sapiens
agatacaagtttttttcattcagtaggttattatcttagatttttttttctttttttgaaatttggggctgggtggtgaagactatgtgttt

SEQ ID NO: 11264 - DNA, 115 bp, Homo sapiens
ctcacagtatttcttaatgcacatctcttgatcagaatgtagaagcaaaattaacttattttgattttaaaaactagagctcaagtaaaaccagcgggtaagaagaggtgtaggg

SEQ ID NO: 11265 - DNA, 143 bp, Homo sapiens
gtgtgtgtgcatatatatatatataaaatatacacacatatacatatatgtatatgtatatacatatatatgtacatatgtatatgtatatacatatatatgtacatatgtatatgtatatacatatatatgtacatatgtat

SEQ ID NO: 11266 - DNA, 90 bp, Homo sapiens
tcccttggaatttttaagaagtgaatttgttcttattggtcagtagttgcatttgatgaatactgaattctagtctgcttatataaggga

SEQ ID NO: 11267 - DNA, 128 bp, Homo sapiens
acatatgtgtgtatacatatatatgtacatataggtacacatatatgtgtatatatacatatatatgtacatatatatgtgtgtatatacatatataggtacacatatgtgtacatatatacatatat

SEQ ID NO: 11268 - DNA, 58 bp, Homo sapiens
tgagatggagtctcactctgtcactcaggctagagtgcagtggtgcaatttcagctca

SEQ ID NO: 11269 - DNA, 63 bp, Homo sapiens
gccagacgaccactaatgttcccttaaggctcttaagtcagcttgtggtgaatgttgcctggc

SEQ ID NO: 11270 - DNA, 80 bp, Homo sapiens
tgtggacactggctgagttctgccccatgatactttctactgtgacagggcagcactgagttcccatgcaaagtcccaca

SEQ ID NO: 11271 - DNA, 95 bp, Homo sapiens; identical to SEQ ID NO: 580

SEQ ID NO: 11272 - DNA, 93 bp, Homo sapiens; identical to SEQ ID NO: 69

SEQ ID NO: 11273 - DNA, 61 bp, Homo sapiens
tgagacaagagtctcgctctctgtcatccaggctggagtgcagtggtgtgatctcggctca

SEQ ID NO: 11274 - DNA, 114 bp, Homo sapiens
tttcaaatcaattgaggataatgttaatctacacacaataagtaagttacatttttattataaaaatttttgcttattatatgatttaatatattatcccatattcatctgaaa

SEQ ID NO: 11275 - DNA, 118 bp, Homo sapiens
gttgtgacaaataagtatacatatataacttttgggaaaatcaaatttataattttattgtagaagtagtatctttggatttctaagtcatattttaacatataaaagtggacacagc

SEQ ID NO: 11276 - DNA, 136 bp, Homo sapiens
gctgttttggttttgttcttaggattgtcttggctatgtgggctctttgttggttccatatgaaatttaaagtagttttttctaattctgtgaagaaagtcattggtagcttgatggggatagcattgaatctata

SEQ ID NO: 11277 - DNA, 178 bp, Homo sapiens
tatatatatcttacgtatcttacatatatatgtgtatatatgcatatatgtgtgtgtatatatgtgtgtatatatgtatatgtgtatatatgtatatatgtgtatacatatgtgtgtgtatatatatacgtatatatgtatatacgtatatatatacacacacatatgtatatatata

SEQ ID NO: 11278 - DNA, 137 bp, Homo sapiens
tgtatctagctctagatatagctaaatatatattcctttatatatctataaatctatatatctagctatatatatttagatatatcttgctctagatatatatctagctcttatatatagagagagagatagatata

SEQ ID NO: 11279 - DNA, 82 bp, Homo sapiens
aaggcctcacttgacccacagatggccatctcctccacagtcttcccttcacctggtcttcctctgtgtgtgtctgagtctt

SEQ ID NO: 11280 - DNA, 91 bp, Homo sapiens
attagctgggactataggaacatgctgccgtacctggctagatttttaattttttctagagatagggtttcattctgttgcccaagctggt

SEQ ID NO: 11281 - DNA, 140 bp, Homo sapiens
tatatatacatatgtgtatatatgtacatatatgtgtatatatatacacatatatatgtatgtatatatattcacatatatatacgtatgtgtatatatgtatatatatgtgcatatatatgtgtgtgtgtatatatctc

SEQ ID NO: 11282 - DNA, 156 bp, Homo sapiens
atatatgtgtatatatatacacatatatgtacatatatacacatatgtatatatatgtgaatatatatacacatatatgtacatatatacacatgtatatatgtatatatacacatatatgtacatatatacacatatgtatatgtgaatatatat

SEQ ID NO: 11283 - DNA, 144 bp, Homo sapiens
tatatatgtgtgtgtgtgtatatatatatatgtacatatatgtgtatatatattcacatatatgtacatatgtgtatatatgtacatatatgtgtatatatattcacatatacatatgtgtatatatgtacatatatgtgtata

SEQ ID NO: 11284 - DNA, 113 bp, Homo sapiens
tacatatatatgaatatacatatataaatatgtgtgtatatgtatatacatatatgtgtatatatatgcatatgtataatgtagatatgtgtatatatgtgtgtatatatata

SEQ ID NO: 11285 - DNA, 87 bp, Homo sapiens
gcagccttttaactaggacaaatacttgtatcaaccaatacagaaagattatttattgttcttataggcaggtttgtttgtggctgc

SEQ ID NO: 11286 - DNA, 94 bp, Homo sapiens
tatatatatatgtgtgtgtctgtatatgtatatgtatgtatgtgtatatacatgtatgtatacgacgtatacagtgtatgtacacgtatatata

SEQ ID NO: 11287 - DNA, 118 bp, Homo sapiens
tgctcactttatgtctctgtgtctcattttggtaattactgcactaattcaaactttttcattagtatgagatctgtgaacagtgatctctggccaggcgcggtggctcacacctgta

SEQ ID NO: 11288 - DNA, 110 bp, Homo sapiens
cctgtcttagattcatagatccctaggctcttaagtgtcttccagaactgtttatcttgtagtcaagacccagaaattagacttccagaaacatagctcttcaaggcagg

SEQ ID NO: 11289 - DNA, 83 bp, Homo sapiens
gtgttatacatatatatatatatatgtatacatatatatgtgtatatacatgtatatatatatgtgtgtatatatgtatacat

SEQ ID NO: 11290 - DNA, 75 bp, Homo sapiens
gccatcctagtgagtgtgaagtggtatctcatggtatcaagagagtgaccactcagatcatcaacaaaggtttgt

SEQ ID NO: 11291 - DNA, 111 bp, Homo sapiens
tctgaggtcataaaagcaactcggcttctgcttgactctctgtctctctgggtcacttgtccttggaacccagccaccgtgtcagagggaagcccaggctggggacccagg

SEQ ID NO: 11292 - DNA, 87 bp, Homo sapiens
tcacgtagattgggatcttggtttgccagtggtgaggcggccagttctgtgcactcaccctgagcctctcactccctctctgcctgg

SEQ ID NO: 11293 - DNA, 84 bp, Homo sapiens
gagtctctctctgtcactcaggctggagtgcagtggtgccatctcggctcactgaaacctccgcctcccagattcaagagattc

SEQ ID NO: 11294 - DNA, 84 bp, Homo sapiens
gccccgctcagtttcccattcttgtaaaaagataagcttactctgtgtaactctgatactttgttaaggtatgggtgtgggtgc

SEQ ID NO: 11295 - DNA, 112 bp, Homo sapiens
gggtgacagagcgagactccgtccaatattttctctacacatatgtgcatatgtgtgtgcgtgtgtcagtgtgtgtgtatatatatatggggatcattttgtatgtgtacct

SEQ ID NO: 11296 - DNA, 81 bp, Homo sapiens
atgcttctggtacaagcatgtattaaaatttaaaatctgttaatgggttttaagtaggatcttgatgtttggcagaagtat

SEQ ID NO: 11297 - DNA, 64 bp, Homo sapiens
gtggtcatatcctagaccttgttttgtttgttttttttaaagagacagggtctctctgtgtcac

SEQ ID NO: 11298 - DNA, 57 bp, Homo sapiens
gttgagatcgtgccactgcactctaacctgggtgacacggtgacactctgtctcaat

SEQ ID NO: 11299 - DNA, 56 bp, Homo sapiens; identical to SEQ ID NO: 7986

SEQ ID NO: 11300 - DNA, 58 bp, Homo sapiens
tgagacagagtctcactcagtcacccaggctggagtgcagtggtgagatctcggctca

SEQ ID NO: 11301 - DNA, 81 bp, Homo sapiens
ggcctgcaaggctgtacagggcctggggcacagttaaccccctgtcctctttccctatactctcagctctctcactctgcc

SEQ ID NO: 11302 - DNA, 105 bp, Homo sapiens
tcatatttctggtccctgggctgcttgggaatctctctttctgtgtggcctttttacatggctagcttgggattcctcactgcctggtggtctcagagtagttgg

SEQ ID NO: 11303 - DNA, 92 bp, Homo sapiens
gaaactgcagaggaaatactgctctactgtcaggtaaagatgcagggtggtcagacttgctgtgatgggagcagtagaggtcagcacgtatc

SEQ ID NO: 11304 - DNA, 72 bp, Homo sapiens
gcagcagactagagagggttgatctgccaaagccctctggctctctgcctcagtcctctctgtggatgttgt

SEQ ID NO: 11305 - DNA, 101 bp, Homo sapiens
gtgtgtgcgtgtgtgtatgtgtgtatatatatgtgtgtgtatgtatgtgtatatatatgtgtgtgtatatatatgtgtgtgtatgtatatatataccacat

SEQ ID NO: 11306 - DNA, 148 bp, Homo sapiens
catatatgttagatatatgtatatatgtatatataaaatatatatagttatatatgtatgaatatatttgttatatatgtatgaatatatatgtacaaatatgtgtgtatatatattcacacatatattcattcatacacaaatatgt

SEQ ID NO: 11307 - DNA, 92 bp, Homo sapiens
tatttaatcatatataggcatatatggtatatacacgtatatacatatatacatatatacatgtatatatatatagtgtagtatgatttgtg

SEQ ID NO: 11308 - DNA, 98 bp, Homo sapiens
tagctgtcactcaaacaatcagctagtaaatttttctttaaaaactgagtattagacaaaattattgactagctgaaatttcactttggagacagttg

SEQ ID NO: 11309 - DNA, 115 bp, Homo sapiens
gtttaggatagtcttggctatacaggctcttttttggttccatatgaaatttaaagtagttttttctaattctgtgaagaaagtcaatggtagcttgatgggattagcattgaat

SEQ ID NO: 11310 - DNA, 95 bp, Homo sapiens
tcctcacttccttgtatcctctcttttgtgctgtccctctcacactgaatcacagctcacctatctacccaatagagtatggcaaaagtgtagga

SEQ ID NO: 11311 - DNA, 127 bp, Homo sapiens
tatatacttgtatgtatgtatatattttactatatatatttgtatgtatatactatatataatttactatatatatttgtatgtatatatgtatgtgtgagcatatacatatatttgtatgtatata

SEQ ID NO: 11312 - DNA, 99 bp, Homo sapiens
gtagataaatgtgaacaatattgcattcttcctctaagggataacagagtcaagagattttgttgtttaatagggagtggctttagcatgtttgggggc

SEQ ID NO: 11313 - DNA, 82 bp, Homo sapiens
cagctgcctacctaggttatccaagataatttcttagggggcactaataattgtctttggtaatgttcttgttatggagctg

SEQ ID NO: 11314 - DNA, 81 bp, Homo sapiens
gtctcatgatgaccatagctccacctggactgcagaccactcctgtggcccagccagaagtgactaagctcacatgaggac

SEQ ID NO: 11315 - DNA, 96 bp, Homo sapiens
gttcatgaatttcttgaggtattatgaaaaactatacttgtatatacattttttttcctacaaaggtagtccattaagtcctcgagagatctggat

SEQ ID NO: 11316 - DNA, 72 bp, Homo sapiens
atcaaatagtatatatatacagtagtgtgtatatatatatatacacacacatagtgatatatatatgttgat

SEQ ID NO: 11317 - DNA, 112 bp, Homo sapiens
ggattgacttggcgatgcaggctcttttttggttccatatgaagtgtaaagtagttttttccaattctgtgaagaaagtcattggtagattgatgaggatggcattgaatct

SEQ ID NO: 11318 - DNA, 91 bp, Homo sapiens
gtgaccttgctgggtcagactgactgtttctctccctgacacaccttgtgaagaaacagagaaattttaagctgcagatcaatacggtcat

SEQ ID NO: 11319 - DNA, 118 bp, Homo sapiens
aattgttgaattaaaggaatgtcggcacagcctgctctggctctctatctctgtatctaagctgagtttttaagcatgtactagaggccaaggcaggtgggtcacgaggtcaggagtt

SEQ ID NO: 11320 - DNA, 94 bp, Homo sapiens
gagattacagtcaaatagagaagatgtcacattttgtagatctgagacattgtttattttacattataacatctctcaaattgaggtatatctc

SEQ ID NO: 11321 - DNA, 76 bp, Homo sapiens
ttgcaggttccacttggatgacagaacagtgtgtggagactcacactgtgaacttttgcttcaggaactactgcag

SEQ ID NO: 11322 - DNA, 128 bp, Homo sapiens
cagactgagggagctgtgggttcccaccacccatcttgccctacttcaggggacacactcactcagttaaatggcggatggacatgtggctaccacccacctttaagctgctgtgagtgcgttctggc

SEQ ID NO: 11323 - DNA, 111 bp, Homo sapiens
gccgggcatggtggcacgcgcctgtagtcccagctactcgggaggctgaggtagaagaatcacctgaacctgggaggcagaggttgcagtgagccgagatcacgccactgc

SEQ ID NO: 11324 - DNA, 80 bp, Homo sapiens
tctcctgcagtccctgtgttctggagcaatgaacatggccctttaagtaccttctcccagtgacagcaattctcaggaga

SEQ ID NO: 11325 - DNA, 91 bp, Homo sapiens
gaaaccatattcagaattaatccatatgaatagaccattgactcacttttatgagtagagagacattatttattgattaagagtaggtttt

SEQ ID NO: 11326 - DNA, 108 bp, Homo sapiens
tagggcaaaaaggcagtttaaaaatcatttgtgagttgagaagataccccagaaagagtctctaatactctctgcttacttagtttcagaaaaataataattgccctg

SEQ ID NO: 11327 - DNA, 129 bp, Homo sapiens
gaaggtgttactatggtatggtaatataagtatggggttattagggcttaaacagattttttttgattatgtcactgaatccactaggccatttgctcaaggtccatagtttcttcatctctgcacata

SEQ ID NO: 11328 - DNA, 86 bp, Homo sapiens
cagcagattcactgtcttgtgagggcacgtttcttatttcatagacagctgtcttctcactgtgtcctcacataatgggagggttg

SEQ ID NO: 11329 - DNA, 69 bp, Homo sapiens
agtagagctggaagattgagagagggtagaatattaataaattttctgcctagaaatcttcagtctact

SEQ ID NO: 11330 - DNA, 86 bp, Homo sapiens
ggatttctgtatgtttttgtttactaatatatccccaggatctagaacagtgcctggcacacagtagacagtgactacatatttcc

SEQ ID NO: 11331 - DNA, 102 bp, Homo sapiens
atatatgcaagtatatgttatgtatttatgtatgtatgtataaatgtatttattatatatttatatatgtataaatatatatgtgtgtgtgtatatatattt

SEQ ID NO: 11332 - DNA, 90 bp, Homo sapiens
tgcagattaaatgaaaaaaaatacaaaatgtgcataaatatatattatctattatatatgtatgcatatgtgtatggttatagatgtgta

SEQ ID NO: 11333 - DNA, 116 bp, Homo sapiens
tggcttgggcccatagcacagtcactccatccctggctgaaccttcccagtattcacagtgattctgtgtctctctggggtggaatttccagaggcaactgtcagtctccctgcca

SEQ ID NO: 11334 - DNA, 74 bp, Homo sapiens
gatctcactctgtcactgaggctggagtgctgtgacatgatctcagctcactgaagccttgaccttctgggctc

SEQ ID NO: 11335 - DNA, 62 bp, Homo sapiens
tgtggctaagaatacagtgagcagacatgatctcctgggttcactgtcctttctttgttgca

SEQ ID NO: 11336 - DNA, 95 bp, Homo sapiens; identical to SEQ ID NO: 68

SEQ ID NO: 11337 - DNA, 93 bp, Homo sapiens; identical to SEQ ID NO: 69

SEQ ID NO: 11338 - DNA, 95 bp, Homo sapiens; identical to SEQ ID NO: 68

SEQ ID NO: 11339 - DNA, 93 bp, Homo sapiens; identical to SEQ ID NO: 69

SEQ ID NO: 11340 - DNA, 103 bp, Homo sapiens
gctgaatacctgctatgccaacaatacctatctggaaaaaaataaagaaagaaaaaaagaaaaaagctgccaagaggattgccttatgtgtaggttttcatgc

SEQ ID NO: 11341 - DNA, 60 bp, Homo sapiens
ttgagatggagtctcactctgtcacccaggctggagtacagtggtgtgatcttggctcag

SEQ ID NO: 11342 - DNA, 111 bp, Homo sapiens
gcgatagtctccattctgctttgtatgttaggagctacattacaaagagtagactgagaccacactattgctttagtttctctttcaaaggctccctgactccctatatgt

SEQ ID NO: 11343 - DNA, 142 bp, Homo sapiens
tatatatatatgtatacatacatatatatacacacacatatatatacatgtgtatatatatacatatatatgtgtgtgtgtgtgtatatatatatatgtgtgtatatatatatgtgtgtgtatatatatatatctccacatg

SEQ ID NO: 11344 - DNA, 56 bp, Homo sapiens
atatatatgtatatatatacacatgtatatatatgtgtgtgtatatatatgtatgt

SEQ ID NO: 11345 - DNA, 117 bp, Homo sapiens
aagtggaatacttttcaccctttccacaattatatttaagcttagggtttcaaagtttttattttcctgctgctatgtgttgtgtggttttttattggggtggctagtttgttattt

SEQ ID NO: 11346 - DNA, 73 bp, Homo sapiens
tttgcagagacatacttagtacatggacgtaggaaactgtctcactgtctttatgtaccgttgactctgcaga

SEQ ID NO: 11347 - DNA, 90 bp, Homo sapiens
gcttttatatacttacatatatatatatgtgtgtatatatgtatatatgtacatacatatatatatgtatatgtgtgtgtgtatatgtgt

SEQ ID NO: 11348 - DNA, 86 bp, Homo sapiens
ggtgtatattgttatgctatttttttttgttgttgattgggaaacaatttatcaagagaggaaattagtgtactttaagggatact

SEQ ID NO: 11349 - DNA, 116 bp, Homo sapiens
gctgatttttgtatgttgattttgtatcctgcaactttactgaatttgtttatcagatataatagttttcttgtggagtcttgcggtttttccaaatgtaagatcatatcatctgc

SEQ ID NO: 11350 - DNA, 92 bp, Homo sapiens
ggggacatagggtcccccacccccacagtcaggtgtttattttattttatttttttctctctgtggctgggtctggggctttttatggactc

SEQ ID NO: 11351 - DNA, 102 bp, Homo sapiens
atacatagatgtatagatatataggtatatagatctctctatatagatatatatatacatatatagagagagatatatctatatatatacacatctatctat

SEQ ID NO: 11352 - DNA, 115 bp, Homo sapiens
ttggaataatgtatctggtattcattcatattgctccatgtataagtagtttttttttattgctaactggtattcttttgtatgaatgaatcatagttagcttatgtattcacaa

SEQ ID NO: 11353 - DNA, 99 bp, Homo sapiens
agaaatatttcttccctgttccagtgggtgtggtagaaccatctttgttttccagaagggggtggtattcctaccttccccgattaggctgttgttttt

SEQ ID NO: 11354 - DNA, 112 bp, Homo sapiens
atttgtatgtataggtaacgtatatgcttgttgtgaaataatgtgtttgtttttttaaattttattattattatactttaagttttagggtacatgtgcacaatgtgcaggt

SEQ ID NO: 11355 - DNA, 116 bp, Homo sapiens
acaactgcaataaagaagtttataattccttcaataactgtatactgtattttcatattttaataagttatcaaagtagttacagatttttattttttatcttttgttgttgttgt

SEQ ID NO: 11356 - DNA, 99 bp, Homo sapiens
tcagtggcctggtaggatcagggtttctcacattttattgtttatatcaatcatctggggatcttgttaatgtgtggattctgattcagtaggactggg

SEQ ID NO: 11357 - DNA, 58 bp, Homo sapiens
tgagatggagtctctctctgtcacccaggctggagtgcagtagcacgatctccactca

SEQ ID NO: 11358 - DNA, 70 bp, Homo sapiens
tttttttgagacagaatctcactctgtcacccaggttggagtgcagtggtgcgatctcggctcactgaaa

SEQ ID NO: 11359 - DNA, 117 bp, Homo sapiens
tgggacaaatcaagttgtgacctattattatatgtcctgtgagttaagactggtttttatatttttaaatgcttgttgaaaaaggaagaatacatgacaaagaccatatttgttcca

SEQ ID NO: 11360 - DNA, 87 bp, Homo sapiens
gccttcagacacagaagctagtgagctcagaatgggatcctagcctagtctagtttctcttcactaaagcaattgtgtggttagggc

SEQ ID NO: 11361 - DNA, 113 bp, Homo sapiens
gggctttgaaaaattttcaagaagatctttcctcttataaatgtcatgattattttaaatgtttttatgacaataagtggaccattgcttttctgtgaataacatatgattcc

SEQ ID NO: 11362 - DNA, 68 bp, Homo sapiens
ttatatatatatatgtgtatatatacacgtgtgtgtgtgtgtgtgtgtatatatatatatatatataa

SEQ ID NO: 11363 - DNA, 112 bp, Homo sapiens
gcccaaagagttatggttcatgtttttggcttttggcaaaccccttctcattttctttttgattcactgtctgcttaacttcttttgcttttatgcatgacttgccttgggt

SEQ ID NO: 11364 - DNA, 70 bp, Homo sapiens
gctgtgtggaaagaagagagtgagcggagacccatggagcgaagtgtttttcctttccctttcttccagc

SEQ ID NO: 11365 - DNA, 81 bp, Homo sapiens
gggaggtgcttgtcttagaagtgaggctgctgagctcgattcttacaagttgaagggcctcactctaaatcagggtttctc

SEQ ID NO: 11366 - DNA, 89 bp, Homo sapiens
gccctgaactaacatagtaattctggctttcacttgagtactctttttgtatttctctgaagtgaaagtaaatgagagagtttggaggc

SEQ ID NO: 11367 - DNA, 91 bp, Homo sapiens
aaggcaagaagattggcagatgaaatggagattggggtgggggtaatgcagctgacatatcttttcttttttttgtttttgtttttgtttt

SEQ ID NO: 11368 - DNA, 90 bp, Homo sapiens
ggctggtcttgaattgctggcctcaagtgatctgcctgccttagcctcccaaactgctgagatgacagatgtgagccaccacacccagcc

SEQ ID NO: 11369 - DNA, 75 bp, Homo sapiens
gcatacccaccctcacacagagtctctgcatcgtatacctaagatacataagatgtttgaatgaagggggtatgt

SEQ ID NO: 11370 - DNA, 85 bp, Homo sapiens
ccctattgaagtttgtaacttgcaaggtattagtagtactgaataaaatttattgtctaatatctcagaaagaatttcatgtggg

SEQ ID NO: 11371 - DNA, 91 bp, Homo sapiens
ttgccacttgactattagcttcttgaatgaagagattctctcttttttttttttttttaatctctgtattcctgtgtcaggcctatggcag

SEQ ID NO: 11372 - DNA, 107 bp, Homo sapiens
tatgtaaatatatatagtccattatatatatatatatgttatatatgtatttctgtaaatatatgtgtgtatgcgtgtgtgtatatctatctatatatgaatatata

SEQ ID NO: 11373 - DNA, 110 bp, Homo sapiens
gatagatttatgtgtgtatagatatagtatgtatatatacagactatataaacataaatatataaacatatatatatatacacacacacacacacaatggaatactactc

SEQ ID NO: 11374 - DNA, 86 bp, Homo sapiens
tgtgcttacaaaggctgaagagagtcagcagagttgttctctgtctgtgattcaagaattcagagtcctttcaccctgtgatgcca

SEQ ID NO: 11375 - DNA, 76 bp, Homo sapiens
cagttggagagagaacactgtgagggctggaatcagcacctgggacagctctgaataagctttcccttttactctg

SEQ ID NO: 11376 - DNA, 88 bp, Homo sapiens
aggacacattaagtttgaggtagatggttgtaagatatcaagaagatactcatctttaacgaaaatttgcttttgaggcttatgttct

SEQ ID NO: 11377 - DNA, 117 bp, Homo sapiens
gtaaagtttattgacaaaaaggtatttcaccttacagaattcaaaatattttatatattatatattaaatataaactatattctgtaatttgagatattagatttcaaaaatgttat

SEQ ID NO: 11378 - DNA, 112 bp, Homo sapiens
gggagttatgggagtcccactttatagccagttagtcagaagtgtgtgaggtcaaggacttgaaagtggcatctgaagtggaggcagccttgtgggactgagcctttatcct

SEQ ID NO: 11379 - DNA, 105 bp, Homo sapiens
ggaagttttcctttcagatacacatattattagtatattaattgatatgcaaaataatgcaaatgaaaagtaatcaattaatactttataatactgaaaggatcc

SEQ ID NO: 11380 - DNA, 109 bp, Homo sapiens
gtatatatatatcctagtatatatctatggtgtgtgtgtgtatatatatgtgtatacacatatatatacacatatatacacacacacacaccataggatatatatatac

SEQ ID NO: 11381 - DNA, 116 bp, Homo sapiens
gatgcagaatcagtacatattctgtgagctaaacaaatggtaaagaagtgataattctaaatttattttcaaaactagtttagtcagcactgtttaggatttggggatactggatt

SEQ ID NO: 11382 - DNA, 95 bp, Homo sapiens; identical to SEQ ID NO: 68

SEQ ID NO: 11383 - DNA, 93 bp, Homo sapiens; identical to SEQ ID NO: 69

SEQ ID NO: 11384 - DNA, 134 bp, Homo sapiens
cctttgttctttttgcttaggattgtcttggctatacgggctcttttttggttcctcatgaaatctaaagtagttttttgtaattctgtgaagaaagtcaatggtagcttgatggggatagcattgagtctgta

SEQ ID NO: 11385 - DNA, 103 bp, Homo sapiens
tgtcagtcacatggccaactctctgtcagcctgtgtccctgagtgacaatgctaatatagcatccctcaagtgacatgctttagacgtgaagtgtgagtgata

SEQ ID NO: 11386 - DNA, 98 bp, Homo sapiens
cagcccaggtggggtacatgaatgttctgtagataaaaaagactctctctctctatatatatatatgagatggagttctgctcttgtggcccaggctg

SEQ ID NO: 11387 - DNA, 83 bp, Homo sapiens
gcactctttttttgagacagggtctcactctgtcacccaggctggagtagagtggcatgatcttggctcactgaaacctccgc

SEQ ID NO: 11388 - DNA, 87 bp, Homo sapiens
ctgagacagggtctcactctgtcactcaggctggagtgccggggtgcagcctccaccacctgggttcaagtgattctcccatctcgg

SEQ ID NO: 11389 - DNA, 75 bp, Homo sapiens
ctgtcatttattgtttttttgaagaaatgtgggccagatattataatttttttcaagaaaaccggaatttggcag

SEQ ID NO: 11390 - DNA, 62 bp, Homo sapiens
cagaggacagtgtcaccaggcagcctttaccctgctaacttctgcctgttttcctgtctctg

SEQ ID NO: 11391 - DNA, 127 bp, Homo sapiens
ctgggaggcccaagataaaggtgccaggaggtttctgtcccgtgagggcccagtctctgtctctcagatggtgccttgaacgctgcctcttctggaggggagaaaaactgttcctcatgtgtcagaa

SEQ ID NO: 11392 - DNA, 102 bp, Homo sapiens
tatatatgtatatatgtgtatatatatataacatacatatgcatgtgtatatatataacatatatgcatatgtgtgtatatatatataaaacatatgtatgt

SEQ ID NO: 11393 - DNA, 103 bp, Homo sapiens
gaagtgaaaagcatacatatgatatgcttgtgtgtgtgtatatatatatgtatacatatatacattatacacacacataaaaatgtgtataagacatcaaatc

SEQ ID NO: 11394 - DNA, 69 bp, Homo sapiens
tttgaggctgctgtgagccttaactgcaccactgtgctccagcctgggtgacacagactctgtctcaaa

SEQ ID NO: 11395 - DNA, 230 bp, Homo sapiens
tatatatgtgtgtgtgtatatatgtgcatatatatatgtgtgtgtgtatatatatacacatatatatgtgtatatatatgtgtatatatacacatatatatgtgtatatatgtgtatatatatacatatatatgtgtatatatatatatatatatatgtgtatatatatacacatatatatgtgtatatatacacatatatatgtatatatatacacatatatatgtata

SEQ ID NO: 11396 - DNA, 186 bp, Homo sapiens
atatatatacatatatatgtgtatatatatacatatatatgtgtatatatacacatatatatgtgtatatatatacacatatatatatatatatatatacacatatatatgtatatatatacacatatatacacatatatatgtgtatatatacacatatatatacacatatatatgtgtatatat

SEQ ID NO: 11397 - DNA, 114 bp, Homo sapiens
gagagaaaaagcaggcgtgagcaatttagatgtcaagtttttgttatattttttcctttgtttcaatcttgtctcattcaatttttgcttaagaaaaatcctgtttattgtttt

SEQ ID NO: 11398 - DNA, 58 bp, Homo sapiens
tgagacatggtctcactctgtcacccaggctggcggacactggtgctatcatggctta

SEQ ID NO: 11399 - DNA, 58 bp, Homo sapiens; identical to SEQ ID NO: 4572

SEQ ID NO: 11400 - DNA, 119 bp, Homo sapiens
acatatatatatgtgtatatatatatatgtgtgtgtatatatatatgtatatatatatgtgtgtgtatatatatatgtatatatatagatatatatgtatatatatatatatatatata

SEQ ID NO: 11401 - DNA, 94 bp, Homo sapiens
tatatatacgtgtgtgtatatatatgtgtgtatatatgtatgtatatatatacacatacacacacacacacacacatacacacacatatgtata

SEQ ID NO: 11402 - DNA, 114 bp, Homo sapiens
actggagttttatcatattatttcatgcgaagaagaattatacactcaatctgtctgacagctttgcatataaagaacagtttctgcatgacaaatgtggtgagcttattaagt

SEQ ID NO: 11403 - DNA, 76 bp, Homo sapiens
tgcaggtatgacagggcttaggtgctcacacagtatcatcaggactctgtctcgctctcttcctgtctcacctgca

SEQ ID NO: 11404 - DNA, 123 bp, Homo sapiens
gatccaatttctcagaagggtgagtctcaggcttggcagcatttaccacaagctgactgaagagtcactgggctttaagggaacatgggcagtggcctggcagaacccctcaatgggccagtg

SEQ ID NO: 11405 - DNA, 123 bp, Homo sapiens
ctgcacatgcaagaggtctaggttgtgtgttccttatgagaatctaatgtctgatgatctgtcactgtctctcatcaaccccagattggactgtctagttgcaggaaaacaagctcagggctc

SEQ ID NO: 11406 - DNA, 88 bp, Homo sapiens
atgggaaatggaagtcacaggaggacaatcataaatgacatttctgattatgtaattttgtagtatacactgacatttggtttcctat

SEQ ID NO: 11407 - DNA, 86 bp, Homo sapiens
agtcagggttcttcagagaaacagaaccaataggatgtctctacctcactccctctcgtgcactctgtcactctgtctccctctct

SEQ ID NO: 11408 - DNA, 109 bp, Homo sapiens
ctatctatctatctatctatctatctatctatctatctatctatctacctacctacctacctagatagatagatagatagatagatgtcaggaaaagaggctcagagag

SEQ ID NO: 11409 - DNA, 67 bp, Homo sapiens
ctgacatctatctatctatctatctatctaggtaggtaggtaggtagatagatagatagatagatag

SEQ ID NO: 11410 - DNA, 58 bp, Homo sapiens; identical to SEQ ID NO: 1435

SEQ ID NO: 11411 - DNA, 90 bp, Homo sapiens
ctgatcttccttctgacagggtctcactgtttgactgtttgacccaggctggtctcgaacttctggtctcaagagatcctcctgtctcag

SEQ ID NO: 11412 - DNA, 81 bp, Homo sapiens
gtgcttaaatccttgtctcagactctgtttctgggggaattcaaccaaagaaacagagcaggaagtaactttttaatgtcc

SEQ ID NO: 11413 - DNA, 110 bp, Homo sapiens
gggaaatgtggttacagtgataatgtgagtcctgtaaagatttgtggttcaagattagatgtgtttttttatgaaatggcagttcttatgttaccgtgatatgcattcct

SEQ ID NO: 11414 - DNA, 112 bp, Homo sapiens
gggaactgccggtattgttcagctggaaggtgtcagtgctgacttttatgactctcaatctcactttcagatttgggcattagatggctgcacaaatattagacaaatttcc

SEQ ID NO: 11415 - DNA, 95 bp, Homo sapiens; identical to SEQ ID NO: 68

SEQ ID NO: 11416 - DNA, 93 bp, Homo sapiens; identical to SEQ ID NO: 69

SEQ ID NO: 11417 - DNA, 102 bp, Homo sapiens
taaccaattgtctgacttattcttggagggaaataataaaaacttaggtttttttttttcaaccaaagggagaggtaataatatgagatcacaccttggtta

SEQ ID NO: 11418 - DNA, 117 bp, Homo sapiens
ttacaaggctacctattttgacatctggcaggtgtcactgattttttatttttttccatttaaaaaggtcatttagtcaaagacagtgctagaagttagtttaaagggtgtgatgtg

SEQ ID NO: 11419 - DNA, 95 bp, Homo sapiens; identical to SEQ ID NO: 68

SEQ ID NO: 11420 - DNA, 93 bp, Homo sapiens; identical to SEQ ID NO: 69

SEQ ID NO: 11421 - DNA, 112 bp, Homo sapiens
gagtgcaagcactttcagcctttggtttgagggattttatcagtgttgatggcactctctctgaaacagtgtcttagagggctgtttgccatgatgctaatgaggcttaagc

SEQ ID NO: 11422 - DNA, 111 bp, Homo sapiens
tttgtaaatgaagttgtactggaacacagccacgtccaatcacttacacactgtctgtggctgctaccacagaagagttgagtagctgtgacagagactctgccctgcaaa

SEQ ID NO: 11423 - DNA, 77 bp, Homo sapiens
tgtcctccaaggtactgagaagagagtcaggaaagggtatagtaatgtagacctcaactgttcttgccttctggaca

SEQ ID NO: 11424 - DNA, 75 bp, Homo sapiens
gcactgtgctacacaggcagtttacagaaatgatttttaaggatcaattgtgtgtgtgtgtgtgtgtgtgtgtgt

SEQ ID NO: 11425 - DNA, 86 bp, Homo sapiens
gtttgttccatgtgccaggctctgtgctaagccctctacatatattattaacccatttttgtctagcacgagcagatggagtaggc

SEQ ID NO: 11426 - DNA, 77 bp, Homo sapiens
tcagacagtagataagcgcataggctttgagttaggctgcctggattcagtccctgcctctgtcacttactgtctga

SEQ ID NO: 11427 - DNA, 102 bp, Homo sapiens
gtacagtcttgaacatgttccgtctcatccttttgcctgtgcttaagctgcaaggttgaaaagtttaaaggcatttaatacaggcttaacaaatcattgtgc

SEQ ID NO: 11428 - DNA, 114 bp, Homo sapiens
ccaaaatgctgggattatagatgtgagccaccatgcaccctaaaaaatactttttaaatttttatttattttttatttttttatttttgagtctcactctgtcacccaggctgg

SEQ ID NO: 11429 - DNA, 113 bp, Homo sapiens
catatatatatatatatgtgtgtgtgtgtgtgtgtgtgtatatatatctatatgtatacatatgtgtatatatctatatgtatacatatgtgtatatatatacatatatatat

SEQ ID NO: 11430 - DNA, 109 bp, Homo sapiens
cagaaaaagtgtgggtcctgcagaaagaaggggcagtgttgtaaataattatcagggtcacactgtcagtcacatttgggtctcaacttgtgcaatatcccctagcctg

SEQ ID NO: 11431 - DNA, 111 bp, Homo sapiens
gtgactttgcttctcacgtagtaccttgtatgcatcaataactttttttcatttaatgaaataaaatcagggttgcctctatatttttgctaattcagtgagaatcttcgc

SEQ ID NO: 11432 - DNA, 62 bp, Homo sapiens
ggtggtgagacaagggaaagtgtcattgcagctgcatgtgcctctctctgtgtctgttcacc

SEQ ID NO: 11433 - DNA, 109 bp, Homo sapiens
gagtttaggtcccaaatatctttgctggttttcggcctcaattatctgtctaacactgtcagtgaggtgttgaagtctcccaccattatgatacagttatgtaagtctc

SEQ ID NO: 11434 - DNA, 114 bp, Homo sapiens
tagatgctcactctggtgtatttattataataagtgaacttcctaggtttcttgaatatgtttatttagatattgctgtaccttggaaaatatatggagtagtgtgtgtgtgtg

SEQ ID NO: 11435 - DNA, 120 bp, Homo sapiens
atacctcctgaattgtgtcagtgacttaaaacagaaacataaagatcttctcatttactttttttttttttttttgagatagaatctccttctgttgcccaggctgaagtgcagtggtgt

SEQ ID NO: 11436 - DNA, 83 bp, Homo sapiens
ttgttgctgtcatcatccttcactctctgctgttaagggaacaattagccagggactggtttactcagtggtatctgcagcag

SEQ ID NO: 11437 - DNA, 111 bp, Homo sapiens
agatcatagatttctatttccatttctattcatctgatattcttggcaaacaacataatggagaagagagagtgcagaccgcatagaaggaaaaggatctttctttgccct

SEQ ID NO: 11438 - DNA, 58 bp, Homo sapiens
tgagatggagtctcgctctgtcgctcaggcgggagtgcagtggcgcgatctcagctca

SEQ ID NO: 11439 - DNA, 95 bp, Homo sapiens; identical to SEQ ID NO: 68

SEQ ID NO: 11440 - DNA, 93 bp, Homo sapiens; identical to SEQ ID NO: 69

SEQ ID NO: 11441 - DNA, 104 bp, Homo sapiens
ctgagtgatttaagctatttttaacgcctctagtgtatttcttgtagaattcctcaaatggagattcttttctgagatatattgactgttaagaaaaattccag

SEQ ID NO: 11442 - DNA, 76 bp, Homo sapiens
gggccatgggatattattactatggataatgcttgttagttatacattttatatttatagtatatgactatgggtc

SEQ ID NO: 11443 - DNA, 92 bp, Homo sapiens
gaggcattattacatggagacctctcaacagggaaaaggggaagcaaggataaccgcagccactctgtgtgtctgccgtgtcttaatacctc

SEQ ID NO: 11444 - DNA, 91 bp, Homo sapiens
gtgcaacagatgtttctagctatttgtggaatgaaggacatttaaataaatttttttttttttttaaatagacagattctcactctgtcac

SEQ ID NO: 11445 - DNA, 96 bp, Homo sapiens
gtggtgagtactaattgggttgtctgcctctgacagagggtgagtgacggcccagctgttcagactgatggcatccaaatgacctgaaatcactgc

SEQ ID NO: 11446 - DNA, 113 bp, Homo sapiens
tatactgtcaagcaaagcctgttatctctcccgagtgtttgccttttaatagaagagagagtggagacctggcttccctaagcttgtctgtgtaaatctgtttcatgaggcga

SEQ ID NO: 11447 - DNA, 64 bp, Homo sapiens
gagtcttgacgatgccaatgactctctgtgtgacctcacacatgttgttgagcatacaagcctt

SEQ ID NO: 11448 - DNA, 93 bp, Homo sapiens
gtaggatgctgggagagagtagtcagagaggtctttgtggacaaatggcccataggtatctctacagatttacgtgtgtcttctaaatctggc

SEQ ID NO: 11449 - DNA, 103 bp, Homo sapiens
tgctagtttcttaaaacctgggcctggaaactgtcacactctcacttctgccatattttatggcttacggaacagagaactttccagatccacgagaagggca

SEQ ID NO: 11450 - DNA, 73 bp, Homo sapiens
ctgggcatggtgatcacatgcctgtggtcccagatacttgagaggctgaggtaggaggatggcttgagcctgg

SEQ ID NO: 11451 - DNA, 68 bp, Homo sapiens
agtctgggcagagtcgggaaactttcttttttctttttgagacagagtctcgctgtgtcacccaggct

SEQ ID NO: 11452 - DNA, 67 bp, Homo sapiens
tcagcaaagggtggtgggattctttttttttttttgagatggagtctcactctgttgcccaggttgg

SEQ ID NO: 11453 - DNA, 76 bp, Homo sapiens
atctatctatctgtctgtctgtctttcgactcccgcattttgagaatcgagggcacaggtcttcacatggctgggt

SEQ ID NO: 11454 - DNA, 114 bp, Homo sapiens
ttgtagagatgggggtctcactgtgttgagtaggctatacagctatcattttttttttgaaatggagtcttgctctatcacccaggctgcagtgcagtggcacaatctcagctc

SEQ ID NO: 11455 - DNA, 92 bp, Homo sapiens
ggataaatgggagatgagaggcaaaggtgagtttgagtagagaagaaattttttttttttttaatacagagtctcgttctctctctcagtct

SEQ ID NO: 11456 - DNA, 83 bp, Homo sapiens
gaaagggcactggcatgaggagatcggggctctatcatcgttcatgagttcagcatgacttcacctctctgtgtctcagtttc

SEQ ID NO: 11457 - DNA, 58 bp, Homo sapiens; identical to SEQ ID NO: 1673

SEQ ID NO: 11458 - DNA, 76 bp, Homo sapiens
aaatagcatatacatctgtatgtatatacatatatatgtatgtatatatctcacaggactgtatttttgtatattt

SEQ ID NO: 11459 - DNA, 93 bp, Homo sapiens
gtggaggcatatgcctgtagtcccagctacttgggaggttgaggtagaaggatcgcttgagcccgggaagttgaggctacagtgagccttgat

SEQ ID NO: 11460 - DNA, 80 bp, Homo sapiens
ttgagatggagtctcactctgtcacccaggctggagtgcagtggtgcgatctcggctcaataccacctccacctcctggg

SEQ ID NO: 11461 - DNA, 58 bp, Homo sapiens; identical to SEQ ID NO: 1265

SEQ ID NO: 11462 - DNA, 118 bp, Homo sapiens
cagcctgggcaacaagagtgaaactccatctcaaaacaaaaccaaaccaaaccatatatatatacatatataattttttttttttttgagatggagtcttgctctgtcacccaggctg

SEQ ID NO: 11463 - DNA, 71 bp, Homo sapiens
ttgtttttgagacggagtctcactctgtcacccaggctggagtgcagtggtgtgatcttggctcactgcaa

SEQ ID NO: 11464 - DNA, 58 bp, Homo sapiens; identical to SEQ ID NO: 3385

SEQ ID NO: 11465 - DNA, 56 bp, Homo sapiens; identical to SEQ ID NO: 3386

SEQ ID NO: 11466 - DNA, 115 bp, Homo sapiens
ccgtagacctggtttccacgtgcgcacttgtgaggggaagactggtttttttgttgttgggacagcatggcagtccttgcctccttatgttgggtaagagtgggagcgtctgtgg

SEQ ID NO: 11467 - DNA, 66 bp, Homo sapiens
tgaacacagcacacttgactatgaggccaggatactgtggcctcatagtctctgagtctgagtaca

SEQ ID NO: 11468 - DNA, 76 bp, Homo sapiens
gggcacagagcaagactccatctcaaaaaaaaattgtttttaaattttttgtaagcaaggtctcactctgtcaccc

SEQ ID NO: 11469 - DNA, 66 bp, Homo sapiens
gcagagtcgcagagtctcgctctgtcacccagactggggtgcattagcatgatcttggctcactgc

SEQ ID NO: 11470 - DNA, 78 bp, Homo sapiens
ttctgagaagcagaggaggcaggtttgccaaatttcaaatttgcaggaggcagacagtcagtctctgtggcagcagaa

SEQ ID NO: 11471 - DNA, 75 bp, Homo sapiens
gctgacatctgtgttagacatgctgaaaggaaacatgtagactccctctcagtctgtgaatggagtcatggaagc

SEQ ID NO: 11472 - DNA, 68 bp, Homo sapiens
ctgtagtcctagctactcaagaggctgaggtaggaggatcacttgagcctgggaggcagaggttgcag

SEQ ID NO: 11473 - DNA, 116 bp, Homo sapiens
ttcactcatgaaggatgtattcactaggcatagaattctaggttggcagtcattttctgtctgcaatttaaatataccattctgttgtctttggcttttcattgtttctaggggaa

SEQ ID NO: 11474 - DNA, 58 bp, Homo sapiens
tgagactgagtctctctctgtcgtccaggctggagtgcagtggggtaatctcggctca

SEQ ID NO: 11475 - DNA, 58 bp, Homo sapiens; identical to SEQ ID NO: 2248

SEQ ID NO: 11476 - DNA, 58 bp, Homo sapiens; identical to SEQ ID NO: 637

SEQ ID NO: 11477 - DNA, 99 bp, Homo sapiens
tgagtttatctaaagacctgggatcatagacaggaaatgttcagggtaagataaaagactgtggctgcctgcctgtaatcccagcactttgggaggcca

SEQ ID NO: 11478 - DNA, 103 bp, Homo sapiens
aggctctgctcactaattcttttgcctgctcaaatatgcttattaagtaattacactagtgaatttgtttgtttgtttgttttttgtttttgagatggagtct

SEQ ID NO: 11479 - DNA, 113 bp, Homo sapiens
atgacatgttatatatgtaattcattatatatgacatatatgtaattcattatatatgatacatatataatgtcatatattcattatatatttaacactcccctatttgttat

SEQ ID NO: 11480 - DNA, 109 bp, Homo sapiens
taattgagtgtggtggcatacacctgtagtcccagctactcaggaggctgaggtaggaggatcatttgagtctgggaggtcgatgctgcagtgaactgtgattacacca

SEQ ID NO: 11481 - DNA, 58 bp, Homo sapiens
tgagaccaagtctcactctgtctcccaagctggagtgcagtggcatgattttggctca

SEQ ID NO: 11482 - DNA, 82 bp, Homo sapiens
tggaattgtttagtcaaaggttttatgtgtttttaattttaataaagacaacattttaccttctgcagcactgaatatacca

SEQ ID NO: 11483 - DNA, 103 bp, Homo sapiens
cagtatactgtggaaatcattgcatagcagaattagggtagtcttcatttttatttttaaagtgtcatagtatcctgtagtgtggatacaccatggtttactg

SEQ ID NO: 11484 - DNA, 94 bp, Homo sapiens
atataatgtgtattatatatatgtatgtatatatgtaagtatataatgtattatatacatatatgtatatatacttacatatacacacatatat

SEQ ID NO: 11485 - DNA, 86 bp, Homo sapiens
ctcagtatttagggagcaggatgaaaaggccacagaaaagacagagccctgagcatcgcttctggtgatttctgagctgagtatcc

SEQ ID NO: 11486 - DNA, 58 bp, Homo sapiens
tgagacagagtctcactctgtcgctcaggctggagtgcagtgatgtgatcttggctca

SEQ ID NO: 11487 - DNA, 61 bp, Homo sapiens
cagggtgtctctctctctctctctatatatatatatagagagagagagagtttatactctg

SEQ ID NO: 11488 - DNA, 61 bp, Homo sapiens
cagagtataaactctctctctctctatatatatatatagagagagagagagagacaccctg

SEQ ID NO: 11489 - DNA, 91 bp, Homo sapiens
atgcaggctcttttttgcttccatatgaaatttaaagtagtttttttcaatattctgaagaaagtcaatggtagcttgattgagatagcat

SEQ ID NO: 11490 - DNA, 67 bp, Homo sapiens
gtttttgagacagagtctcactctgtcacccaggctggagtgcagtggtgtgatcctggctcactac

SEQ ID NO: 11491 - DNA, 81 bp, Homo sapiens
gagagcaaggatttttgtttggttgtttcatttttggacttccaaagcattgaaatgaacttagcatatagcttggttctc

SEQ ID NO: 11492 - DNA, 111 bp, Homo sapiens
ggtttgttatgcattaaagactgatatgcatggtcttggaactagacaactgattttcaagaagagtcttataaatggagcctattcaacatatcagtgttactgagaatc

SEQ ID NO: 11493 - DNA, 113 bp, Homo sapiens
gtggggtgttgccataacaaatacctaaaaatgtggaagcagctttgaactgggtaatgggtagaggctgaagcaattttgaaggtcatgtttgaaaacatttagaatgccat

SEQ ID NO: 11494 - DNA, 112 bp, Homo sapiens
agtgctttggttagaccttgttcttataatgtgtttggtgctctaattatatatctatgtatttgtctcctgcactagactgtgctctccttgagggcaggggccaagtcct

SEQ ID NO: 11495 - DNA, 93 bp, Homo sapiens
gattggtaggtagggtaaataattatatgcatttatggaaatgcattaaattgtatatttaaatttgtgtatattaccgtatgtctgtctctc

SEQ ID NO: 11496 - DNA, 104 bp, Homo sapiens
acatgtaaatgatgtttattagaacataatgttaatattaaaatcaatattaatacatattaatatttgtgttctttttatactttaagttttagggtacatgt

SEQ ID NO: 11497 - DNA, 95 bp, Homo sapiens; identical to SEQ ID NO: 580

SEQ ID NO: 11498 - DNA, 93 bp, Homo sapiens; identical to SEQ ID NO: 69

SEQ ID NO: 11499 - DNA, 101 bp, Homo sapiens
gatgcatgaagagggctttcattttttaattttaattttgtcgctttgctagaagttttattatgaaatagtgttgaataatatcagtctgtttctgcatc

SEQ ID NO: 11500 - DNA, 108 bp, Homo sapiens
tatatatacatatatatgtgcatatatatgtgtacacatatagggtgtgtatatacatatatatatgtgtgtatatatatgcgtgtgtatatatatatataattctgt

SEQ ID NO: 11501 - DNA, 94 bp, Homo sapiens
ctgagatcattacacatttttttcttcccttttttttttttttgatggagtcttgctctgttgcccaggctggaatacagtggtttgatctcag

SEQ ID NO: 11502 - DNA, 107 bp, Homo sapiens
catgtaattttgtgggaatggtaagggagacagtggaattctactgaatatgagatttatattttaggatagtctatgcttaaaaattttttttagacaactgcatg

SEQ ID NO: 11503 - DNA, 60 bp, Homo sapiens
gagttggagtctcactcactctgttgccaaggctagagtgcagtggcacagtctcagctc

SEQ ID NO: 11504 - DNA, 87 bp, Homo sapiens
aggttttctactttgtatacatagatgtgtgcacagtaatctctgaggattttttgtatttttatgtggtccattgtaattttgcct

SEQ ID NO: 11505 - DNA, 78 bp, Homo sapiens
taagtgcccttccaggaagcagacacacacactctgattggcatgtgcaatgtggcagcttccaatgtcaggagctta

SEQ ID NO: 11506 - DNA, 80 bp, Homo sapiens
gatgtctgaagttgagctccttttcaagagtttatttttcatttggatgtattcttttgagatgtttctgtttaggcttc

SEQ ID NO: 11507 - DNA, 103 bp, Homo sapiens
ttgaggtgaagtctcgctctgtcacccgggctggagtgaagcagcgtgatctcagctcactacaatctctgtctccctggttcaagcgattctcctgcctcag

SEQ ID NO: 11508 - DNA, 93 bp, Homo sapiens
gtgtttctgcatgtgcgtgtgtgtgtgtgtatatatatatatataaaattctatttcttacatgtatcctaggcacttttttgcaagagactc

SEQ ID NO: 11509 - DNA, 127 bp, Homo sapiens
tgtctccatgtgatcaaaatttttagctcccagatacaagtgagaatatgcaatctttgttaattttttttacccttctggtagatttcacttggtgggcacaattctcccttcaaggtcttgttgc

SEQ ID NO: 11510 - DNA, 82 bp, Homo sapiens
gtgcagtgggaaggggggccgatacactgtacgagagtgagtagcaggtctcacagtgaaccggtctctttccctactgtgt

SEQ ID NO: 11511 - DNA, 109 bp, Homo sapiens
agtttttacctttagagagctatacaagggcgacacaagggtgctgatagtcttatatatgtttttatctatgtgttggttatccaggtttgctcagtttatagaaatt

SEQ ID NO: 11512 - DNA, 62 bp, Homo sapiens
gaggtaaatgtattggttttcattaacatatttaactgagaatctttgtatatatttgcttc

SEQ ID NO: 11513 - DNA, 58 bp, Homo sapiens; identical to SEQ ID NO: 87

SEQ ID NO: 11514 - DNA, 56 bp, Homo sapiens; identical to SEQ ID NO: 88

SEQ ID NO: 11515 - DNA, 95 bp, Homo sapiens; identical to SEQ ID NO: 68

SEQ ID NO: 11516 - DNA, 93 bp, Homo sapiens; identical to SEQ ID NO: 69

SEQ ID NO: 11517 - DNA, 95 bp, Homo sapiens; identical to SEQ ID NO: 68

SEQ ID NO: 11518 - DNA, 93 bp, Homo sapiens; identical to SEQ ID NO: 69

SEQ ID NO: 11519 - DNA, 116 bp, Homo sapiens
ggttagcattaagtttggggtcatttgactgaatatgtcatgctttattctctttttatatgaagtctgttgatgtaatgaaaacagtagccatatgaccttaagtaaactattcc

SEQ ID NO: 11520 - DNA, 95 bp, Homo sapiens; identical to SEQ ID NO: 68

SEQ ID NO: 11521 - DNA, 93 bp, Homo sapiens; identical to SEQ ID NO: 69

SEQ ID NO: 11522 - DNA, 109 bp, Homo sapiens
gaatcaggtctaacttaaaacatacatactcttttcttgtctgtctttctcactagagtgtgaggtcattgagggcaggatccatgtgttattttgcgttgactgcttc

SEQ ID NO: 11523 - DNA, 240 bp, Homo sapiens
tatatatgtgcgcatgtgtatatatgtacgtgtatatttgtatatatgtacatgtatatatgtatatgtgtatatatacacatatatgtatatatgtgtgttatttatatatatataaatgtgtatatatgtgtatatatgtgtataataaacatatacatatacacacacatatatatgtatatatgtgtatgtacatatacatatacacacacatatatatgtatatatgtgtatgta

SEQ ID NO: 11524 - DNA, 68 bp, Homo sapiens
ctggtgggaagacgtctgattgccatcgcctgatcagatgagagttcagagtgttctttccttttcag

SEQ ID NO: 11525 - DNA, 86 bp, Homo sapiens
tgtgagagaggaataaatatctatattttttgagccagtgaacattcatttggtttctttgttatagcagcttatcctttccctca

SEQ ID NO: 11526 - DNA, 95 bp, Homo sapiens; identical to SEQ ID NO: 68

SEQ ID NO: 11527 - DNA, 93 bp, Homo sapiens; identical to SEQ ID NO: 69

SEQ ID NO: 11528 - DNA, 111 bp, Homo sapiens
tgtttgggatgtttcccctttctaactattatgaataatgctcctttgaatatttttacatgtttttgagtgagcatctgttttcaattctcttggttatatacctaggca

SEQ ID NO: 11529 - DNA, 104 bp, Homo sapiens
ccctagtaggggtggaagctctggagaaaagttggatctattactttagataataggtaagcaaagtaaagaagttaatttttcacatctgaatctgctggagg

SEQ ID NO: 11530 - DNA, 93 bp, Homo sapiens
gtatccttattgtggtagatttagcaccatgtttttttgcatttttatatacaaaatgcaaaattgtggtgattttgctgtttcaaaggaccc

SEQ ID NO: 11531 - DNA, 110 bp, Homo sapiens
agaattcaccagtgaacccatctaggcctggttctttctgttttggaaggttataaattattgatttaatttctttaatagataaacgcctattccaatggtctatttct

SEQ ID NO: 11532 - DNA, 108 bp, Homo sapiens
ggcactgtctctttcataattgcccttgttaatcatatttaaatttttttcctatattttatggtgctttgacatcttgagggccttgctaaatggagagagactgcc

SEQ ID NO: 11533 - DNA, 163 bp, Homo sapiens
atgtaattgttcacattgttttatatatatatatatttatgtttatatatatttatatgtttatatatatttatatatgtttatatatatttatatatgtttatatatatttgcatgtttacatatatttgtatgtttacatatatttgcatgtttacatata

SEQ ID NO: 11534 - DNA, 110 bp, Homo sapiens
tagtggggcatggtagcacatgtctagtcttagctactcaggaggctgaggtggtaggatcgcttgagcccgggtgggtgaggctgcagtgagccaagactgcaccactg

SEQ ID NO: 11535 - DNA, 67 bp, Homo sapiens
gttttttttgagtctcgctctgtcacccaggctggagttcagtggcgagatctcgactcactgaaac

SEQ ID NO: 11536 - DNA, 80 bp, Homo sapiens
gcacacacatttattaattaagctcactgtcttatgtgggcatggtttatgcccacataagacagtgagcttaatggtgc

SEQ ID NO: 11537 - DNA, 58 bp, Homo sapiens
tgagacagggtctcactctgtcacccaggctggagtgcaatggtgcgatcttggctca

SEQ ID NO: 11538 - DNA, 94 bp, Homo sapiens
tcagtttgggttgcgacaattgggatctctcagaagatggtgaaagcaatagagtcaacattgtgatggattagttcagtgatgcaacctctga

SEQ ID NO: 11539 - DNA, 100 bp, Homo sapiens
acatgtgtatacatatatgtatgtatatgtatatatacatacacatgtatgtatgtatgtatacatgtatgtatgtatgtgtatatatatacgcatacat

SEQ ID NO: 11540 - DNA, 76 bp, Homo sapiens
atgtgtatgtatatatacatatacatacatatatgtatacacatgtgtgtgtctgtgtgtgtatacacaaatacat

SEQ ID NO: 11541 - DNA, 98 bp, Homo sapiens
gttctagtgggagagcctcagtttttttttttttttggagacagaatctcattctgtctcccagattagagcactgtggcatgatcttgcgctaccac

SEQ ID NO: 11542 - DNA, 110 bp, Homo sapiens
gcttttgttctaggctggttttggttgtagatagttatcagttattatatactgccattcagattatttatatgtattactgtccacaactcacttgtgttctaaagggt

SEQ ID NO: 11543 - DNA, 58 bp, Homo sapiens
tgagacagggtctcactctgtcacccaagttggagtgcagtggcaagatcatggctca

SEQ ID NO: 11544 - DNA, 79 bp, Homo sapiens
agatacttagtaagagttcactgtgttcactgtgtgccagcaatgaaccaacatttgtgggcttttcattatgtaatct

SEQ ID NO: 11545 - DNA, 286 bp, Homo sapiens
gtgtgttttcatatatatacatatatatatatatatatatgtatgtatatatgtatatatacatacatatatatgtatgtatatatgtatatatacatacatatatatatgtatgtatatatgtatatatacatacatatatatatgtatgtatatatgtatatatacatacatatatatatgtatgtatatatgtatatatatatgtgtgtatatatatatgctctgtatatatatatgtgtgtatatatatatgctctgtatatatatatgttctgtatatgta

SEQ ID NO: 11546 - DNA, 105 bp, Homo sapiens
attactttgcttccccacaaagggaatgcagaaagcggtggaaggactcaccacactgtcactctgtgttttaggatgtttggaggaatccaaagcaaagatagt

SEQ ID NO: 11547 - DNA, 58 bp, Homo sapiens; identical to SEQ ID NO: 2626

SEQ ID NO: 11548 - DNA, 70 bp, Homo sapiens
ggtcagtgtctcactctgtcattcaggctggagtgtagtggcgtagccttggctcactgggacctctgcc

SEQ ID NO: 11549 - DNA, 105 bp, Homo sapiens
ggtatgcctgtaaacatgtggcatgaaatggaaagagaaatatgaagtagtaaccatttcagttttttctttttaataataacctgaagcagtttctggtatact

SEQ ID NO: 11550 - DNA, 63 bp, Homo sapiens
agctgagatgttgccacttcaaggaagtctttttttttttttttttggagacagcatctcact

SEQ ID NO: 11551 - DNA, 132 bp, Homo sapiens
ctcatgtgtgaggctgggaaaggtggctcttgtctgtaatcccagcactttgggaggctgaggtggtaggttgcttgaggccaggagttggagaccagcctgggcaacacaatgagacccggtctctacaaa

SEQ ID NO: 11552 - DNA, 75 bp, Homo sapiens
tcatccttcctgaaggcaggcttgcaccctgggcaagggctgggtgcgtgtgtctgagtcagtgatactggaagg

SEQ ID NO: 11553 - DNA, 108 bp, Homo sapiens
tcctgataacttctattgtgatttgttcagggaaaatgttgtttttacatttgttaaaagcagccatggtgttctctgaaattccttgctttcaaggggttgcatgga

SEQ ID NO: 11554 - DNA, 74 bp, Homo sapiens
tgttagaatatctcattcatttcagtgttgagtgtcaacactcaaagtctgatgaataaatgaatgaatcaaca

SEQ ID NO: 11555 - DNA, 94 bp, Homo sapiens
tgggcatggtggcacatgtctgtggtccgagctacctgggaggctgaggtaggaggatggcttgagtccaggaggcagatgttacagtgaacca

SEQ ID NO: 11556 - DNA, 61 bp, Homo sapiens
ccctctccaagtatttctagctgtatgagtcagaggaggcagaattacactttggagtggg

SEQ ID NO: 11557 - DNA, 95 bp, Homo sapiens; identical to SEQ ID NO: 580

SEQ ID NO: 11558 - DNA, 93 bp, Homo sapiens; identical to SEQ ID NO: 69

SEQ ID NO: 11559 - DNA, 108 bp, Homo sapiens
gcttaggattgccttggctatagggattcttttttggttccatatgaaatttaaagtagttttttctaattccatgaagaaagtcagttatagcttgatggggattgc

SEQ ID NO: 11560 - DNA, 92 bp, Homo sapiens
ttctagtagagggtcactgctttggcctgtgctttggattatttatttatttattttttgagacaagtctcgctctgtcacccaggctggag

SEQ ID NO: 11561 - DNA, 72 bp, Homo sapiens
ggtcctctctgtctttgagtcagttgtctggagcctcctatgtcatgtgcctctggggcagggactcagaga

SEQ ID NO: 11562 - DNA, 95 bp, Homo sapiens
agagttaggtaagcatgtaatatatgtatatgtgtatgtgtgagatacacacacacacatacacttatatatatttgcttatcctgggacactct

SEQ ID NO: 11563 - DNA, 135 bp, Homo sapiens
gtggcttttcctgatgtctataatggtctggaatgggcagggaaccatcccatcggccacactgtctgtctgggtcaagtccacggtcattcagtgccgctggcattgttggaaagcaggaccctgggctgcagt

SEQ ID NO: 11564 - DNA, 119 bp, Homo sapiens
tctttattattcctacatatgtttttaaatagctttatagggttataaaaatatttgttttaatttaacctgaaaattatactagaatttatgttgatgccatcccaggattataaagg

SEQ ID NO: 11565 - DNA, 92 bp, Homo sapiens
gtttgcagccattttttattccaaacatgtatgtttttgtaaacctgacatttcccaaacagtgcaagtgaatcagaagtgactgcttagac

SEQ ID NO: 11566 - DNA, 95 bp, Homo sapiens
ttgctggatcatatggtagttgcatgtttactttttaaagaaactgccaaactgttttcttgagtaaatgtagcattttacatacccaccagcaa

SEQ ID NO: 11567 - DNA, 119 bp, Homo sapiens
gacttgcgtccatggaatgaaccttacttggttgtggtgtataattctttctatatattgatgaattctatttgctaatattttgttaaggatttttttgtctgtaagtgatgttggtc

SEQ ID NO: 11568 - DNA, 75 bp, Homo sapiens
tcagagagaactgagtgttcttatggtgtccctccaaagccacgtgaccataagcagttcatttaaactctctga

SEQ ID NO: 11569 - DNA, 58 bp, Homo sapiens; identical to SEQ ID NO: 2540

SEQ ID NO: 11570 - DNA, 108 bp, Homo sapiens
gccctggcgaaggccgtggcctcgttcaagtaatccaggataggctgtgcaggtcccaatgggcctattcttggttacttgcacggggacgcgggcctggacgccggc

SEQ ID NO: 11571 - DNA, 70 bp, Homo sapiens
gggacagggaaacgggtatgcacaggtacagtggacacactgccactgtcacagacagggtccctgtccc

SEQ ID NO: 11572 - DNA, 82 bp, Homo sapiens
cagcaagattttgatagggattatattgaatgtatagatcaatttggagcatattcccagtataataatgtcaagtcttctg

SEQ ID NO: 11573 - DNA, 85 bp, Homo sapiens
gctttggttctacttactgtgggtctgagaatcatccatgggatagcagtacatatttcacagtgggtgttgtgaacataaacgc

SEQ ID NO: 11574 - DNA, 84 bp, Homo sapiens
ccagccatggaccacgtggttgattctttttttttctttctttcttttttttgagacagaatctctctctgtcgcccaggctgg

SEQ ID NO: 11575 - DNA, 248 bp, Homo sapiens
atagatgtatatgtgtatacatatgtgtatacatagatgtatatgtgtatacatatgtgtatatatgtatatgtgtatacatatgtgtatatatgtatatgtgtatacatatgtgtatatatgtatatgtgtatacatatgtgtatatatgtatatgtgtatacatatgtgtatatatgtatatgtgtatacatatatgtatatatgtatacgtatatgtgtatacatatatgtatatatgtatatgt

SEQ ID NO: 11576 - DNA, 100 bp, Homo sapiens
gttataactttctgctcttttatctcatccgcttcttttccataattttatagttttatcatttgtagagagtagaaaatgagcagtgttctgttgtaac

SEQ ID NO: 11577 - DNA, 86 bp, Homo sapiens
ctcaaaatgacgcataatccattccctagggatgatccactgataatattatgtatatatctttctagggtgtgtgtattaaagag

SEQ ID NO: 11578 - DNA, 70 bp, Homo sapiens
gccctagggaaatttccagacctcctcagacccacagactcagaatctgagggagtggaagcatcctggt

SEQ ID NO: 11579 - DNA, 96 bp, Homo sapiens
tggggccttcttggagtctttgctggatcctctgccttcagccagccagtcagttgagagacagaacaccacaaagtgggccaagattcagctgta

SEQ ID NO: 11580 - DNA, 82 bp, Homo sapiens
ggcaaaaacacagtttgaagagacacagcagagatcagaaccagacttaaatctagcagtgtttttggagcagtgttttgcc

SEQ ID NO: 11581 - DNA, 104 bp, Homo sapiens
ccaaccacaaaagaccacatattgtatgattctatttatttgaaatgcccagaataggcaaatccatagagatagaaagtagattaatggttcccaggtactgg

SEQ ID NO: 11582 - DNA, 67 bp, Homo sapiens
agaaagagaacccagaaaggaggaggtctgaagggagacagaactcagtctgggacatgctaagtct

SEQ ID NO: 11583 - DNA, 71 bp, Homo sapiens
gcacagacttatcgtggactcagaagccagcaggctccttctctctggctctgacaccctgtgtaactgtc

SEQ ID NO: 11584 - DNA, 85 bp, Homo sapiens
gatggtattataggaggcttccccttcactcagtgctgattctgtctcctgctgcccagtgaagaggtgccttctgtcatgattc

SEQ ID NO: 11585 - DNA, 102 bp, Homo sapiens
tgatattttaaaattataataaaatttaaaattatattaaaaaataagaatgttcttattcttaggtaatataagctgaagtattagaaaggtgaagtgtca

SEQ ID NO: 11586 - DNA, 84 bp, Homo sapiens
gatttgagaagagattgaaccacttccaccacctcaggttaacaccatactgaggcccggctctgtccttcactctctcagatc

SEQ ID NO: 11587 - DNA, 68 bp, Homo sapiens
ggtcctgggcatgggcatgggagcaactgtttgtcagcgtatgtctccgtgtgtgtgtgcctgtgacc

SEQ ID NO: 11588 - DNA, 78 bp, Homo sapiens
gcccatccatctatactggacccttcccaagccatggtggcccagtgagagaggagagagtcctgtgttggaaagggc

SEQ ID NO: 11589 - DNA, 81 bp, Homo sapiens
gacaagccttttaaacattttgagtgtcagtttccccatctatatagtgggaggcatacactcactcactcaaatgcttgc

SEQ ID NO: 11590 - DNA, 95 bp, Homo sapiens
tggttccactgatacagataagtcttagagttgccttagctcagtctctgactcaatgtcatgtgattcagggtcccagcaagaaacagatggac

SEQ ID NO: 11591 - DNA, 91 bp, Homo sapiens
ggccaactcaatctctctctctctctgggtctcatcttctatgtctgtaaaaaaggagtagaatggggaggcattggacaggatgatggct

SEQ ID NO: 11592 - DNA, 74 bp, Homo sapiens
gggccagggagggttggggaggcgggggaaggaataggctaccttctctctctcacacaaagtattcttatctc

SEQ ID NO: 11593 - DNA, 90 bp, Homo sapiens
tctgcagcatggttgactagctgcatgacctgagaaaagttatttaacttttattttttgtcagcctgtttctcagcttcaaaatgtaga

SEQ ID NO: 11594 - DNA, 91 bp, Homo sapiens
gggacagggctgtctctctctcagtgcctgaaccttcttagggactcctcaaggaatgtggatcaagtattgaggaaagtagtaatctccc

SEQ ID NO: 11595 - DNA, 59 bp, Homo sapiens
gagactgggtctcactctgtcacccaggttggggtgcagtggcatcatgatcctggctc

SEQ ID NO: 11596 - DNA, 83 bp, Homo sapiens
ggccaatcaaagtcctcccattttctttccctctgacatcacagtgaggtctgaggtgttaagaaagagtggaaacttcagcc

SEQ ID NO: 11597 - DNA, 77 bp, Homo sapiens
ggacaacttcagtctgtgtgtgtgtgtgtgcacataaacatatataaaattcacattttcagactttgtagacgtcc

SEQ ID NO: 11598 - DNA, 95 bp, Homo sapiens; identical to SEQ ID NO: 68

SEQ ID NO: 11599 - DNA, 93 bp, Homo sapiens; identical to SEQ ID NO: 69

SEQ ID NO: 11600 - DNA, 66 bp, Homo sapiens
tgcagttggtgtcagaagtgagggtggtctcttgtggggactgttctctctaactgcacagttggc

SEQ ID NO: 11601 - DNA, 61 bp, Homo sapiens
gaagttaactcacaaggtgacaggagtgtgaagctcaaatctgtctctctgtgctggcttc

SEQ ID NO: 11602 - DNA, 78 bp, Homo sapiens
tccagtctgggcgacagagcaagacgccgtctcaaaaaaaaaaaaaagacaagttctcactctcccactcaggctgga

SEQ ID NO: 11603 - DNA, 115 bp, Homo sapiens
catgtcagctgttgctgcactacagtttttaatacgcgatcattcttttttttttgagatgaagtcttgctctgttgcctaggctggagtgcagtagcgtaatctcggctcactg

SEQ ID NO: 11604 - DNA, 153 bp, Homo sapiens
tacatatgtgtgtgtatatacatatatacatatgtgtgtgtatatatacatatatacatgtgtgtgtatatatacatatatacatgtgtgtgtatatatacatatgtgtgtgtatacatattacatatgtgtgtatatatacatatatacatg

SEQ ID NO: 11605 - DNA, 108 bp, Homo sapiens
gtgtatatacatatatacatatgtgtgtgtatatatacatatatgtgtgtgtatatgtatagatatatatacatatgtgtgtatatgtatatatacacatatttatat

SEQ ID NO: 11606 - DNA, 80 bp, Homo sapiens
gtgtgtgtgtgtgtatgttgggaaacttagctttcagagaatgtctatgggctctcattttctctctcacacaaaaatac

SEQ ID NO: 11607 - DNA, 96 bp, Homo sapiens
ccctttttttaatctgaatttgccctgtgtctgtggctctgtctcataatagcaatagaaagaaacagcagatataaattatccagatttccaggg

SEQ ID NO: 11608 - DNA, 113 bp, Homo sapiens
ctgtacacatgtctcttctgaagcctttaggtatgtgaacaacattttttattttaagtgtctgcctccacatcaagaccaaaagctccttaagaactgggaccctgggccag

SEQ ID NO: 11609 - DNA, 95 bp, Homo sapiens; identical to SEQ ID NO: 68

SEQ ID NO: 11610 - DNA, 93 bp, Homo sapiens; identical to SEQ ID NO: 69

SEQ ID NO: 11611 - DNA, 78 bp, Homo sapiens
gtacatgtctatacatacaaatgtatatatatatacacctctgtgtatatatatacatttgtattttcaaaaatgttc

SEQ ID NO: 11612 - DNA, 172 bp, Homo sapiens
tctgtatctacatatccacatttatagatatctatatatgtatttatatctatctgtatttatatctatagatgtctagatatatatagatatacagatataaatagacataaatacatatatagatatctacaaatgtatgtatagattctatatatgtatttatatctgt

SEQ ID NO: 11613 - DNA, 56 bp, Homo sapiens; identical to SEQ ID NO: 88

SEQ ID NO: 11614 - DNA, 97 bp, Homo sapiens
ttagctgggtgttttcggaggtggcatgattttttttttttttttttttttttttttttttttttgagacagagtctcactctgtcgcccaggctgg

SEQ ID NO: 11615 - DNA, 95 bp, Homo sapiens; identical to SEQ ID NO: 68

SEQ ID NO: 11616 - DNA, 93 bp, Homo sapiens; identical to SEQ ID NO: 69

SEQ ID NO: 11617 - DNA, 75 bp, Homo sapiens
caacctccagggggattgtatagctgagcaggaagcagtgactctctcagtcttttgcaggctcagtggaggttg

SEQ ID NO: 11618 - DNA, 90 bp, Homo sapiens
gtgcatatatttgtgtgtatgtgtatgtatatacacactatatatatacatatatattatatacatacacacacacacacacacacacac

SEQ ID NO: 11619 - DNA, 110 bp, Homo sapiens
ctgtgcagagtgcaagctcaggcagtcatgcatcatcacactcactcattcactcctccccgcaacaccgcagctctgccggcacttgcatcttccttttcactctccag

SEQ ID NO: 11620 - DNA, 70 bp, Homo sapiens
gggttgcaaatagtgatatctttttctctttttttttttttttctgagatggagtctcactgtgtcaccc

SEQ ID NO: 11621 - DNA, 95 bp, Homo sapiens; identical to SEQ ID NO: 68

SEQ ID NO: 11622 - DNA, 93 bp, Homo sapiens; identical to SEQ ID NO: 69

SEQ ID NO: 11623 - DNA, 110 bp, Homo sapiens
ggcaacgtggacaggtgcatttgtatttaggagtgaaaaaatgtttgttgtatcagtttttgaaatttgcaatcttaggaaccctgaagctgagcaagactgttcaagcc

SEQ ID NO: 11624 - DNA, 97 bp, Homo sapiens
atggaatatatatatgtatgtatgtatgtatatatatatacacatacatacatatatatacatacatatatatacacatacatatatatatacacat

SEQ ID NO: 11625 - DNA, 131 bp, Homo sapiens
tatatatattttatatatatatattatatatatattatatacacacacacacacacacacacacacatactcctctccctctatatatatatatgtatgtgtatatatatatgtatgtgtatatatatgta

SEQ ID NO: 11626 - DNA, 108 bp, Homo sapiens
gcctccatgatgggactggtggctttatgaggagaggaagagcaactggaactgggacacatgcttgctctgtcttgccttttgatgcctcctgccatgtcatgatgc

SEQ ID NO: 11627 - DNA, 118 bp, Homo sapiens
ttctcatttaatctataagtcactgcaatcccaaaggaaataattttttattctaaagttctaaagaatctggattatgaagcttatacagagggacagatgaaaagactagtgagaa

SEQ ID NO: 11628 - DNA, 99 bp, Homo sapiens
tgtttatacctctagttggctttgattcttctctctctctcttttttttgagacagggtctcactctgtcacccaggctggcgtacagtggtgcaaaca

SEQ ID NO: 11629 - DNA, 68 bp, Homo sapiens
tgagatggagtctccctctgtcaccctctgtcacccaggctggagtgcagtggcacgatctcggctca

SEQ ID NO: 11630 - DNA, 95 bp, Homo sapiens
atttactggtgttcttgatgtatattaggcgttcagaaaacatttatggaatgaataaatgaatgagccaatgaagagagactccattagtgaat

SEQ ID NO: 11631 - DNA, 70 bp, Homo sapiens
ggccacagttgcacagacaggaggtgctatcttctccttcctggccccaccctctctgcctgtgtctgcc

SEQ ID NO: 11632 - DNA, 113 bp, Homo sapiens
ttactttgttagttgtactgagtaatatttttaaagtaagcttggaaaagtttaaaatttttttaaatgttttaattttatatttttaatttttgtcagtacatactaggtgg

SEQ ID NO: 11633 - DNA, 113 bp, Homo sapiens
ccttcaggtggtgtggccccagcactctctgttctctgacgctctgtggctccttacagcggtgcctgagtgcttcctctggctacagggctatgcatggtgggtacacaagg

SEQ ID NO: 11634 - DNA, 62 bp, Homo sapiens
gtgctctctcttcacatgtgtacagaggaaaaaccatgtgaggacacagtgaggaggtggcc

SEQ ID NO: 11635 - DNA, 108 bp, Homo sapiens
gatgtgagtcatggggaccaaaaaaagaatccttctataggatatatatatgtatgtatgtatgtattttgagatggagtctcgctcttgtcgcccaggctggagtgc

SEQ ID NO: 11636 - DNA, 80 bp, Homo sapiens
gctttgtttaccttgaaaatgtaaaatacctcatagaatttcttttctttgtattttttttttttttttggagacaaagt

SEQ ID NO: 11637 - DNA, 112 bp, Homo sapiens
gatagtttattagataatcttagtgataatatattatgggtatgttaaaaatgaatgtttatctatttaatatacagaaatgaaataactgagattttcttttaaatatttc

SEQ ID NO: 11638 - DNA, 77 bp, Homo sapiens
cctgacatatgtgtgtgtgcacacccatgggcacatgtgaatgcttataaacatatgtacacatatatgtgctcagg

SEQ ID NO: 11639 - DNA, 68 bp, Homo sapiens
ataataggatatgtgtgtgtgtgtgtatatatgtatatatatatgaatacatatacatactcgattat

SEQ ID NO: 11640 - DNA, 112 bp, Homo sapiens
tttagaagtgttccctcctcttcaagtttttggaagagtttaggaagaatttagcattaatttttctttaaatgcttgacagaatttaccagtgaagtcatcacgtcctgaa

SEQ ID NO: 11641 - DNA, 93 bp, Homo sapiens
caagagccagaatgtctgcacatggaggaggagggagtttcagaaactttgatctcactgcctgttctcattcctcttgcccttgatggtttt

SEQ ID NO: 11642 - DNA, 76 bp, Homo sapiens
tgtagcttacccacagagaaggatctgagctcagaaccatacagttctgaagtccacgctccttccttaaactaca

SEQ ID NO: 11643 - DNA, 87 bp, Homo sapiens
catccaaggagggagttgagagagtgcagtggggtagaaccctttgttttaacttacgtaggtctgaattctttgaaatttttgatg

SEQ ID NO: 11644 - DNA, 76 bp, Homo sapiens
ggaggctgaggtaggaggatcacttgagcccaggagtctgaggttacagtgagctatcctcgcaccactgcactcc

SEQ ID NO: 11645 - DNA, 112 bp, Homo sapiens
gagtgcaattgtttggccatatggtaggactatgtttaatttttttttttttttttgagacatagtctcaccctgtcacccaggctagagtgcagttgcttgatcatggctc

SEQ ID NO: 11646 - DNA, 138 bp, Homo sapiens
tgtatatatacgtatacacacatatatgtatatgtatatgtgtatatacatctgatgatatatatacatatatgtatatgtatatatgtgtatatatatatatataaaatcagataacacacttgggataaatacata

SEQ ID NO: 11647 - DNA, 80 bp, Homo sapiens
acttatgtatgtatgtatgtatgtatgtatgtatgtatgtatgtatgtatgtacgtatgtatgtatgtatgtgtgtgtgt

SEQ ID NO: 11648 - DNA, 58 bp, Homo sapiens
tgttgcactgagaattgtgtccaacacgtattttgggggacacactcagactgtaaca

SEQ ID NO: 11649 - DNA, 118 bp, Homo sapiens
gttaacaaacagcagaccctcctgattcttaatttagcccctgtgcagacatatcctcacagaggagagaaagctgagccaggcacaatgttcctaaatagtgtctctgcctgcagac

SEQ ID NO: 11650 - DNA, 68 bp, Homo sapiens
gggtggtatggcttgtagagtctgtctatataaattttttttcgagacagagtctcgttctatcaccc

SEQ ID NO: 11651 - DNA, 76 bp, Homo sapiens
ctagttctgtgaagagtgattgtggtatttcgatgaggaattacgttgaatttatagattgcttttggcagtatgg

SEQ ID NO: 11652 - DNA, 110 bp, Homo sapiens
ttagcaagttagatgtacaatgcactgacaggaaaaacgtattgctaaattaaccaaagaaaatatgtatgttctagtttctagcacttaaaatgggctctaactgccgg

SEQ ID NO: 11653 - DNA, 101 bp, Homo sapiens
acatattattttgtaaagggtttattggagatctatgtgtatatatgtttgtgttttaaatgtatacaagttctcattaaaacctcttgttatttttatgt

SEQ ID NO: 11654 - DNA, 99 bp, Homo sapiens
cagagcaagactctgtttccaaaaaaaaaaaaataaaattatttgaattgtattgtctttacttttttttttttctttttgagatgaggtctcactctg

SEQ ID NO: 11655 - DNA, 114 bp, Homo sapiens
ctgaaggccttttctgcatctattgagataatcatgtggttttgtcatttgttatttttatatgatggattacatttattgatttgcgtatgttgaaccagccttgcatcccag

SEQ ID NO: 11656 - DNA, 102 bp, Homo sapiens
aaaccctagagaagtagaaacagttatttggcctctatagaatcttttttatcttaaaagtgattagagactaggtttagaagtccgtttactctagttttt

SEQ ID NO: 11657 - DNA, 75 bp, Homo sapiens
acatatatacatatacatatatatacatatatatacacacatgtatatatatatattgtgtatgtatatttatgt

SEQ ID NO: 11658 - DNA, 111 bp, Homo sapiens
ggggagcagatggctgtttttataaacattgtagatttttttattaaaaaagcaaaaagtattttaatacataataaaaatcaaattcagataaattcagtgtctgtctct

SEQ ID NO: 11659 - DNA, 95 bp, Homo sapiens
cgatgcgggctcttttttggttccatatgaaatttaaagtagttttttcaaattctgtgaagaaagtcattggtagcttgatgggtatggcgttg

SEQ ID NO: 11660 - DNA, 111 bp, Homo sapiens
accaaatagagcccaaaaagagacatgtcaactgatgtgacagaggtgacactgcagagcaggggagagaagacacactttcactcagtgatgtggggaaactgtgtgtgt

SEQ ID NO: 11661 - DNA, 111 bp, Homo sapiens
tgttcatatccttcacccacttgttgatggggttgtttgtttttttttcttgtaaatttgagttcattgtagattctggatattagccctttgtcagatgtgtggattgca

SEQ ID NO: 11662 - DNA, 99 bp, Homo sapiens
gtgtctagtgagattgattttatattgttaagaacttacaggtgtatatatgtatatgtatatcgtctagtcctttgcagtcattagtctttttgatgc

SEQ ID NO: 11663 - DNA, 58 bp, Homo sapiens
ggtctcagtctgtcactcaggttggagcacagtggcacaatcatggctcactgcgacc

SEQ ID NO: 11664 - DNA, 81 bp, Homo sapiens
gtgtaggcaagtgaaatgtagttttattcagcggctgtgtcatcagcagcttaatcacactagctctctcacactgtccac

SEQ ID NO: 11665 - DNA, 81 bp, Homo sapiens
gtgagcctcattttccttgtctataaaatggggataataagaacaattacctcaaaaagtgtgagaattaagtgagctcat

SEQ ID NO: 11666 - DNA, 115 bp, Homo sapiens
ttgagaccaacctgggcaacatagggagactgtctctaccaaaaaaaaaaaaaaaaaaaactttttttttttttttgagatgaagtctcactctgtcacccaggctggcgtgcaa

SEQ ID NO: 11667 - DNA, 119 bp, Homo sapiens
tatgatcacaccactgctgctctccagcctgggtggcagagtaagatcctgtttcttcttttttttttttagacagagtctcgctctcttgcccatgctggagtgcagtgattatgatc

SEQ ID NO: 11668 - DNA, 113 bp, Homo sapiens
agcctaggagatagcaagaccccatctctttaaaacaaacaaacaaacaaaaaattagttggtttttttttttttttttttttgagacagagtctcactctgtcacccaggct

SEQ ID NO: 11669 - DNA, 80 bp, Homo sapiens
gggtgcttctttctgcagagttctctttctgatctttattttattcatttattcagagatggagtctcactctgtcgccc

SEQ ID NO: 11670 - DNA, 87 bp, Homo sapiens
ctcaaactcttgggctcaagtgatctactttttaaaaattgttgttattttttgagatggagtctcactctgtcacccaggctggag

SEQ ID NO: 11671 - DNA, 58 bp, Homo sapiens
tgagatggagtctcactctgtcacccaggctggagtgcagtggcaggatctcagctca

SEQ ID NO: 11672 - DNA, 97 bp, Homo sapiens
gtgtgcagccttgtatgaccacagtaaattgtacatgtaatgaaatattactctgtgtgtgtgtgtgtgcaatcatagtagtctttttaatgtatat

SEQ ID NO: 11673 - DNA, 113 bp, Homo sapiens
tgaattcagtttgctagtattttcttgaggatttttgcatcaatattcatcagtgatattgttcttgaaattcctcctgaaggatgtttttaaaatacaggtgagtgagggca

SEQ ID NO: 11674 - DNA, 102 bp, Homo sapiens
ggtgagactctggatcttgtttaaatattacgaaaaatgttaatattttgttttagcaggtgatggacatggttaggttcagtttgcaagttccaacccacc

SEQ ID NO: 11675 - DNA, 113 bp, Homo sapiens
ctgatggtggtttggatttctgtgggatcagtggtaatatcccctatatgattttttattgcatatatttggttcttctctctattagtcttgctagtggtctatctatttag

SEQ ID NO: 11676 - DNA, 74 bp, Homo sapiens
tgtccctgtgtctctggcctagtgtcaaaaacagatctagagtgagatgtaagaggcagagacagagacagaca

SEQ ID NO: 11677 - DNA, 106 bp, Homo sapiens
tctgggcgacagagcaagaccgtctcataaataaattaaataaataaatattcactcaattagctacttttttttttttagaccgagtctcgctctgtcacccaga

SEQ ID NO: 11678 - DNA, 76 bp, Homo sapiens
tgagagacggaggtgacagtggtcagtcagtgtgatgcaatgtgagaaacactcgaccagctgttgctggctttga

SEQ ID NO: 11679 - DNA, 59 bp, Homo sapiens
ttgggaggctgaggtagttggatcacctgaggtcaggagttcgaaaccagtctgaccaa

SEQ ID NO: 11680 - DNA, 118 bp, Homo sapiens
ttctggagagatagagatatagatagatagatgataggtagatagatttatagatagatatctatatttatctatgtttatagatatctatcaatctatatttctgcctatgaaatat

SEQ ID NO: 11681 - DNA, 86 bp, Homo sapiens
tatacatatatatgtgtgtgtatatatgtgtatctctgtgtgtgtaaacatatgtatgtatgtatgtgtgtgtgtgtgtgtgtgtg

SEQ ID NO: 11682 - DNA, 191 bp, Homo sapiens
gtactatatatatatatgtgtgtgtatatatatgtatatatatgtgtatatatatgtatatatgtgtatatatgtatatatatgtgtatatatatatgtgtgtatatatgtatatatatgtgtatatatatatgtgtatatatgtatatatatgtgtatatatatgtgtgtgtatatatatatatatatat

SEQ ID NO: 11683 - DNA, 56 bp, Homo sapiens
agagatgggcagacaatctctcagactgtccagcttagggactgtctcttgtttct

SEQ ID NO: 11684 - DNA, 78 bp, Homo sapiens
ctgtcttcctttcgcacacagacactgagtgtttcttccagatggaaagcaggtggggttgggtggaaggggatgcag

SEQ ID NO: 11685 - DNA, 93 bp, Homo sapiens
tccctaaaacctgtccctagtctctagcaccatctcatatcccttctggatgtcagaatcacatgggtgccaaggacacgggaggtggcggga

SEQ ID NO: 11686 - DNA, 122 bp, Homo sapiens
ctggtgcctggctggtgtcttttacatgtgaccctcaaccccaattctagaagtaggtggtattgttattgtccccattttatagatgaagttgagtaaattgcccaagtcatccagccagg

SEQ ID NO: 11687 - DNA, 69 bp, Homo sapiens
tgctccctggctaggagaggtggggtgtggatagggagggtctctgactctgtctctcctgccttagca

SEQ ID NO: 11688 - DNA, 58 bp, Homo sapiens; identical to SEQ ID NO: 1763

SEQ ID NO: 11689 - DNA, 81 bp, Homo sapiens
cttatagattctagagtctagaatgtcagctctgtgagtgcagagctggtatctgttttactatggatttcccagagtctg

SEQ ID NO: 11690 - DNA, 58 bp, Homo sapiens; identical to SEQ ID NO: 2531

SEQ ID NO: 11691 - DNA, 95 bp, Homo sapiens; identical to SEQ ID NO: 68

SEQ ID NO: 11692 - DNA, 93 bp, Homo sapiens; identical to SEQ ID NO: 69

SEQ ID NO: 11693 - DNA, 77 bp, Homo sapiens
tgagtccctgccagcctctctggctgcaggtgtctggaaggtccaggtgttccagctgaggaaggcagctggcctca

SEQ ID NO: 11694 - DNA, 116 bp, Homo sapiens
tcttgaacctgaggatggtaaaactcgtcgttccacaatgggtcttctgccagcctcttctactcagaagtgtgataggagaccccacagactgaagatggaaccacctctctaga

SEQ ID NO: 11695 - DNA, 128 bp, Homo sapiens
gagttttgactttattctgtggccacagggagcctgggaggttccaggttctgagagaagagtgtgtgatgggccgcaggtctcaattcatcagcaccacgtgttctccctggcatctcctgatcaga

SEQ ID NO: 11696 - DNA, 87 bp, Homo sapiens
ggggttgggaagggaaatgaaaggatttgtgataaacttcccctttgagaaggtcatgttttttttttctttttctttttctttttc

SEQ ID NO: 11697 - DNA, 90 bp, Homo sapiens
tagactttaataaagtttttttttttttttgctccaggcagactgaggtctcagaagtgtctgtgcagttataacaaaaacggtagttta

SEQ ID NO: 11698 - DNA, 80 bp, Homo sapiens
gagagggagccatgattgtgggaaaatcccaggccgcccttctttatgtggatttcacttcctatctctctctctctctc

SEQ ID NO: 11699 - DNA, 99 bp, Homo sapiens
actctggcagggagtgacttgagtttgattctgtctatcatctattctttttttttttttttttttgagacagtctcaccctgtcacccaggctggagt

SEQ ID NO: 11700 - DNA, 98 bp, Homo sapiens
ttttcatgcatattggccatactttgtttctttgactgtctcatatttttttgttgaaaactgagtatttaaataatataaggtggccactttgaaaa

SEQ ID NO: 11701 - DNA, 95 bp, Homo sapiens; identical to SEQ ID NO: 580

SEQ ID NO: 11702 - DNA, 93 bp, Homo sapiens; identical to SEQ ID NO: 69

SEQ ID NO: 11703 - DNA, 66 bp, Homo sapiens
tggcagtattggtgagtgggactttttgtttttgttttttgagacagactctcactctgtcgccag

SEQ ID NO: 11704 - DNA, 95 bp, Homo sapiens; identical to SEQ ID NO: 68

SEQ ID NO: 11705 - DNA, 93 bp, Homo sapiens; identical to SEQ ID NO: 69

SEQ ID NO: 11706 - DNA, 108 bp, Homo sapiens
ccactgcactccagcctgggtgacaacgtgagactgtctctaaaaaataaaaataaataaataaataaaagaacagtaatcaattattgtctctcaaagtgtctgtgg

SEQ ID NO: 11707 - DNA, 83 bp, Homo sapiens
tgcatgttggcctgctgcagttggcagtgaggacacaggggcaggccctgctcactgaagtgggagctgcgtgggagggtgca

SEQ ID NO: 11708 - DNA, 95 bp, Homo sapiens
ccaaacttcacagcatgtaattccaatctttttttttttcttgagacagagcctcactctgtcacacaggctggattgcagtggcacaatcttgg

SEQ ID NO: 11709 - DNA, 114 bp, Homo sapiens
tagtaggtgcttaacatatcagtaaacatattaacattgactttttaaacttataattgaatttatataaatgttttgagggggttctaggtatatggtagtaggtacttagta

SEQ ID NO: 11710 - DNA, 80 bp, Homo sapiens
tcccatcatggcctgaactagtttttcaggttagctttggaatgcccttggctgagtgaaggaccctcagtcagatgggg

SEQ ID NO: 11711 - DNA, 95 bp, Homo sapiens; identical to SEQ ID NO: 68

SEQ ID NO: 11712 - DNA, 93 bp, Homo sapiens; identical to SEQ ID NO: 69

SEQ ID NO: 11713 - DNA, 62 bp, Homo sapiens
cctgtgtccatgtgttctcattgttcaactcccacttatgagtgagaacacacggtgtttgg

SEQ ID NO: 11714 - DNA, 61 bp, Homo sapiens
ggttggaagaaacagagctctgttcacacaggactgagaacagtgtctgtcaccaccagcc

SEQ ID NO: 11715 - DNA, 100 bp, Homo sapiens
atgctactatgattactgtagttttgaaatttggaaatgtgagtgcgtgtactattttctttatttcaagattgttttagctattctgggttccttgcat

SEQ ID NO: 11716 - DNA, 117 bp, Homo sapiens
aaacttaaccgaggatggttgccaaggactcagagtaaggtgaaaggtgagggctttttttttttttttttttttgagtgatgaaattgttctgtatcttgattatggtgatggttt

SEQ ID NO: 11717 - DNA, 56 bp, Homo sapiens
tatatatatatatatatatatatatatatgtatgtatgtatgtatgtatgtatgta

SEQ ID NO: 11718 - DNA, 88 bp, Homo sapiens
aggagacccaggggattaccatgggtgggaatattacagagaatttctttttatatattgactctatcctgcattttctaagttttct

SEQ ID NO: 11719 - DNA, 112 bp, Homo sapiens
tcctggacggtctttatttttggactgtacatgacagttgagtgagaagcaaggtgtatctctttttttttaaagctgtaaacgtgattagaagaaggcaggggctggggga

SEQ ID NO: 11720 - DNA, 71 bp, Homo sapiens
tttgggcttttccaacatgctgatgtcggggtaccaccccagactgactcagtctcagggaaggacctaaa

SEQ ID NO: 11721 - DNA, 114 bp, Homo sapiens
gagacctccctggcatggtgtggtggggcagctggtgttgtgaatcaggccgttgccaatcagagaacggctacttcacaacaccagggccacaccacactacaggcagcattc

SEQ ID NO: 11722 - DNA, 94 bp, Homo sapiens
ctgagattttctacaacctctacgggttatcagtaactttttattttttgagatggagttttgccctgttgcctaggttatggcacaatcttgg

SEQ ID NO: 11723 - DNA, 86 bp, Homo sapiens
ccaatctgggaaacacaatgagacctcacctccacaaaaaaaaaatttttttttaagatagagtctcactctgtcacccaggctgg

SEQ ID NO: 11724 - DNA, 103 bp, Homo sapiens
agggaggaagtgctgagggatggagtttatatagagagtagagtagagagtgtggtcactattgaattaactattaaagtttatcttttgttacttgctgctt

SEQ ID NO: 11725 - DNA, 118 bp, Homo sapiens
ttgccaatcaaccaacggtctgtgaggggcagcatgggatcaggcagcagggttcttccccgccttgccttggttcctttgcaggattgagccacctggccgtgggggaaggggtcaa

SEQ ID NO: 11726 - DNA, 91 bp, Homo sapiens
ggctgctgaaaggagggtgtctgtggtgtgtgagctctgctgtgaagtcgaaggaggtgatgggcatacatgtggaatggagccagcggcc

SEQ ID NO: 11727 - DNA, 95 bp, Homo sapiens
gctttaatccatcttgatatttatcaatatatcttgatacatagaatgacatagacatcttgtggaggggtgttattgctttttgagatggcagc

SEQ ID NO: 11728 - DNA, 94 bp, Homo sapiens
tcttaaactctctgtgcctcactgtccctgtctataaaatggtgatattaactatctaagggatgcagtgaggattgagtaaaacacattaaga

SEQ ID NO: 11729 - DNA, 105 bp, Homo sapiens
ttcatttttttcaaggttatcaaatttgtagatatataattgtttataagtagtttcttatgatccgttttattctgtgatattgaacccttgtttatagatgag

SEQ ID NO: 11730 - DNA, 156 bp, Homo sapiens
atatatatatatatatacgtgtatatatatatatgtgtgtgtatatatatatatacgtgtatatatatatgtgtgtatatatatatacgtatatatatacatatatatacgtgtgtatatatacacacatatatacgtgtgtgtgtatatatacac

SEQ ID NO: 11731 - DNA, 150 bp, Homo sapiens
gtgtatatatatacgtgtgtgtgtatatatacgtgtatatatatacgtgtgtgtatatatatgtgtgtgtatatctatatgtgtgtgtatatatatgtgtgtgtatatctatatacgtgtgtgtgtatatatatacgtgtgtgtacatat

SEQ ID NO: 11732 - DNA, 86 bp, Homo sapiens
gtgtgtgtacatatatatacgtgtgtgtgtatatatatatacgtgtgtgtatatatatatatatacgtgtgtgtatatatatatat

SEQ ID NO: 11733 - DNA, 65 bp, Homo sapiens
gctagtcagctggggggcagagagcctggctggggctgtctctctctggctccaggtctgaaggc

SEQ ID NO: 11734 - DNA, 105 bp, Homo sapiens
tcctttccaaatgtatatatatgtatgtaggtatgtgtgtgcatgtatatatatatatacacacacatatatatgtgtgtacatagacatgtacatatacatgga

SEQ ID NO: 11735 - DNA, 58 bp, Homo sapiens; identical to SEQ ID NO: 7309

SEQ ID NO: 11736 - DNA, 58 bp, Homo sapiens; identical to SEQ ID NO: 454

SEQ ID NO: 11737 - DNA, 65 bp, Homo sapiens
acaaagtgagaccctgtctctaaaaaaattttatttatttattttgagactgggtctcactctgt

SEQ ID NO: 11738 - DNA, 86 bp, Homo sapiens
taagatgtggctagttctgagatgtgaaatagatgttaacacattgaatttcaaagacttagtacaaaaaaaagcaaaatatctta

SEQ ID NO: 11739 - DNA, 87 bp, Homo sapiens
ggatgacagtcaagtctgtgagcagagacataaagagacagatgaagaggcagctggggtgagctctgcaatgaacttgaggcatct

SEQ ID NO: 11740 - DNA, 142 bp, Homo sapiens
acacacactatatatatatgtgcatgtatacatatatatatgcatgtatacatatatatatgcatgtatacatatatatgcatgtatatatatatatgcatgtatacatatatatgcatgtatatatatatatgcatgtata

SEQ ID NO: 11741 - DNA, 70 bp, Homo sapiens
atatatatatatatatatgtatacatgcatatatatatatatgtatacatgcatatatatatatatgtat

SEQ ID NO: 11742 - DNA, 80 bp, Homo sapiens
gagtgggatgaataacagctgtaagaccctgtcagtctctcacacttcggtgtggattaattttggtcttgattcccctc

SEQ ID NO: 11743 - DNA, 72 bp, Homo sapiens
cctgagacacagggaaagctctttttttttttttttttttttttgagacggagtcttgctctgtctcccagg

SEQ ID NO: 11744 - DNA, 127 bp, Homo sapiens
ttagatgttaagcacttagcagacagcctgaaacataaaggacagtgacctatctatctatctatctatctattctcataaaattctatgggtcaggcactgttttgaggtctggagacactggggt

SEQ ID NO: 11745 - DNA, 114 bp, Homo sapiens
gctattgtgaatagtgctgtgatgaccatactgagtgcatgtatctttttggtaggataattatttttctttaggtatatacccagtaatgggattgctgggccaaatggtagt

SEQ ID NO: 11746 - DNA, 107 bp, Homo sapiens
ctttatctttaggcaaagagccaattcattctgtcccacatctttctttttttttttttttttttgtctttggagacggagtttcgctcttgttgcccaggctggag

SEQ ID NO: 11747 - DNA, 140 bp, Homo sapiens
actctgtctcagtcagcttcccaggaaacccagcctatgacaagtggtttatttgtggggttttttgtttttgtttttgttttgagacagggtctccctctgtcacccaggctggagtgcagtggcatgatcatatctca

SEQ ID NO: 11748 - DNA, 59 bp, Homo sapiens
aggtcctgagtgtgtctctgtgagcctcaacaccatggagacggcacagctgggggtct

SEQ ID NO: 11749 - DNA, 162 bp, Homo sapiens
gcgtatgtgtgtgtgtatatatatatatacgtgtgtgtgtgtgtgtgtgtgtgtatatatatatgtatatatatatgtatgtatatatatatatgtatatatatatgtatgtatatatatatatgtatatatatatgtatgtctatatatatatatatatat

SEQ ID NO: 11750 - DNA, 91 bp, Homo sapiens
ggccactttaaagactttgacacttacagagaaatctgtgtgcagaatcctgtacatttttactatgttcttttatatttttttagttgcc

SEQ ID NO: 11751 - DNA, 71 bp, Homo sapiens
ggagatggtgtctcactctgtcacccaggctggagtgcagtggcatgcctccctggtttgcaccattctcc

SEQ ID NO: 11752 - DNA, 73 bp, Homo sapiens
agtgcataaatacaccataatgatgtgaagggcatatgttgccatatgctctaacagcattaccatgtgctct

SEQ ID NO: 11753 - DNA, 83 bp, Homo sapiens
ggcatggctgtcagccctgtggggagctctgaggatgagacacactttgacactgtcccacactgaggcgagagagttatgtc

SEQ ID NO: 11754 - DNA, 73 bp, Homo sapiens
ggaggcccagttatgtgccagcatcttctgttgtcagttctagccaacagaagacagccaccactgagcttct

SEQ ID NO: 11755 - DNA, 109 bp, Homo sapiens
cagtctcaatcccactcataaatactctactcagaagattcagagcgcaggctgtagggtcagccacacctgggtatacatcctggctctgtcacttcctggctgtgtt

SEQ ID NO: 11756 - DNA, 116 bp, Homo sapiens
gcccaggaagcagaagatgctgttggtacaggctccattccacagaggagactgaggtcatgtgtggggcagagccagttcccaatctcagcccacccttctcccttccatttggc

SEQ ID NO: 11757 - DNA, 65 bp, Homo sapiens
ctggtgtctgagtctcactcccagaaattccaattcggttagtcttggtggggcctggacatggg

SEQ ID NO: 11758 - DNA, 76 bp, Homo sapiens
tctgcaaatttcaaatattgattgtctcttcttcatagtgttgttaagagatctgattaagttgatgcttggcaga

SEQ ID NO: 11759 - DNA, 86 bp, Homo sapiens
acattctgttcattaatgcagccacaagggcccgcccaagttcaagaggtgaggatactgactctgtctcttaatgtgcagagtgt

SEQ ID NO: 11760 - DNA, 117 bp, Homo sapiens
gtgtagagctctggtattggctaattaatcacggtgttgctagaagtgaaaatgataggaagactactgtatttctacttaattaatacaagcagaaaatttctaggtcaaatgcac

SEQ ID NO: 11761 - DNA, 95 bp, Homo sapiens; identical to SEQ ID NO: 68

SEQ ID NO: 11762 - DNA, 93 bp, Homo sapiens; identical to SEQ ID NO: 69

SEQ ID NO: 11763 - DNA, 95 bp, Homo sapiens; identical to SEQ ID NO: 68

SEQ ID NO: 11764 - DNA, 93 bp, Homo sapiens; identical to SEQ ID NO: 69

SEQ ID NO: 11765 - DNA, 127 bp, Homo sapiens
tacaatatttacccatgtgtgtgtgtatatatatatgtgtgtatatatatacacacacatatatatgtatatgtatgtgtatatatacacacatatatgtatatatacacacacacatatatgtgta

SEQ ID NO: 11766 - DNA, 136 bp, Homo sapiens
atatatatatatatatgtgtgtgtgtgtgtgtatatatatatgtgtatatatatatgtgtatatatatgtgtatatatatatacacatatatgtgtgtgtgtatatatacatatatgtgtgtatatatacacatac

SEQ ID NO: 11767 - DNA, 118 bp, Homo sapiens
gcagtgtaaaaatattctcttttcaccacatccctgccaacatctattattattatctattattttttgattttttaattatggccattcttgcaggagtaagatgatattgcattgt

SEQ ID NO: 11768 - DNA, 87 bp, Homo sapiens
gaaatctgctgggaaagagaggaaactgagataatgcgatttctttaaaagtttattcagtttttctatttctcatgagttgatttt

SEQ ID NO: 11769 - DNA, 78 bp, Homo sapiens
gctgtggcagtttagggaagaggaaaggcctggccggggctgccacccaccacactgtcacacttcctgactgcctgc

SEQ ID NO: 11770 - DNA, 91 bp, Homo sapiens
ggtcaggggtcactagagtttgagctcaggtctgtttcactgtgagtctagagggtccctgaacttatcctatagttattcccccagttcc

SEQ ID NO: 11771 - DNA, 103 bp, Homo sapiens
gcccatctcaggctcctactgagtgaaggatccagctgatcttgtccttgcaggacacagacagcagacacagaggcctccagcacagtgaagcctgtggagc

SEQ ID NO: 11772 - DNA, 99 bp, Homo sapiens
tattgttcactgttggcctatagaaatgctactgacttttttttttttttttttttttttttaagacagggtctctgtttcccaggctggagtgcaatg

SEQ ID NO: 11773 - DNA, 62 bp, Homo sapiens
tgtatagacagcaggcagtgagctggggatttggaactggctcactcaccctctggcaggca

SEQ ID NO: 11774 - DNA, 90 bp, Homo sapiens
gctggagggatgctgaggccagaggggtgaccaggggctgctggagaggtgcttagtgtcactgtgtgagtgaagcagatgctcactagt

SEQ ID NO: 11775 - DNA, 115 bp, Homo sapiens
tctctagagatatatgtagatatatatctctctagagatatatatagatatatgtagatatatatctctagagatatatatagatatatatctgtatagctctagagatatatat

SEQ ID NO: 11776 - DNA, 98 bp, Homo sapiens
atatatatctctagagctatacagatatatatctatatatatctctagagatatatatctacatatatctatatatatctctagagagatatatatct

SEQ ID NO: 11777 - DNA, 110 bp, Homo sapiens
agaggttctaggtctgtaaactggctcaagtttggaaattgactgaggagccgtgattctctatgtttataattcaaattagtctgttgtccatccgatctagaagtttt

SEQ ID NO: 11778 - DNA, 77 bp, Homo sapiens
ggccagaaggactgggatgatctaagggcacctctgaacttaagctctccaaagtcccctgtgtctgtgtctgtgtc

SEQ ID NO: 11779 - DNA, 104 bp, Homo sapiens
gagcatgcacgtgcacatgtatttctgggcatagggcggcgtgtgtgcgtctgtgagtgaggcggcagctccttagcctttgcgtctgtgggtggcccgtgctt

SEQ ID NO: 11780 - DNA, 81 bp, Homo sapiens
ctgtgcttgatagagcttttctagtcccattaatctttgtttctattaatttatgaggcagggtctcactctgtcgctcag

SEQ ID NO: 11781 - DNA, 91 bp, Homo sapiens
gctttgtctgagctgagagtggtcacagaggggcttaggggcgcttgtcaggtgagtccggggagccactgacagctgcagaggtgtaagt

SEQ ID NO: 11782 - DNA, 113 bp, Homo sapiens
gggtgcctcatggctctgttttttgtttgtttttgagacagagtctcactctgtcgcccaggctggagtgcagtgactcgatctcggctcactgcaatctccgcctcctgggt

SEQ ID NO: 11783 - DNA, 87 bp, Homo sapiens
gggtttttggtttttttttttgttgttgttgttttataaaaaggtatttttatttgctgtggtaggtggatggagagctagaagctc

SEQ ID NO: 11784 - DNA, 70 bp, Homo sapiens
tagctgggactaagccaccatgtctgcctaattttcttatttttagtagagatggggtttcaccatgttg

SEQ ID NO: 11785 - DNA, 119 bp, Homo sapiens
gcccatgttgttcaaaggcaaactgtattgtggtttttatagaatcttgaaatatgtttatcattatatcaaaatccactagattgagaagcacatactaagcaatatgacacattggt

SEQ ID NO: 11786 - DNA, 78 bp, Homo sapiens
ggtccattaacaaggcagtgtctgtctctgatctggggtccagtggttcaagacaatgtctctgtctctgatcggatc

SEQ ID NO: 11787 - DNA, 88 bp, Homo sapiens
tatatgtgtgtgtgtgtgtatatatatatgtgtgtgtgtgtatatacatatatgcatatatacatatatgcatacacacacacatata

SEQ ID NO: 11788 - DNA, 63 bp, Homo sapiens
atatatgtgtatatatatatatatatattttatatatgtgtgtgtgtatatatatacatatat

SEQ ID NO: 11789 - DNA, 80 bp, Homo sapiens
gcctgataacctgcagtgaccctcccactctgccagtcggtgattctgtgaagtggtgtaaagggctgtgagcctcaggc

SEQ ID NO: 11790 - DNA, 87 bp, Homo sapiens
aggtatgagttggagctttgctcagggtggcactcagttaacaatcagacactagtgactgtgttgtcaggctcaacacaaaggcct

SEQ ID NO: 11791 - DNA, 111 bp, Homo sapiens
gcctggcatggtggcctgtacctgtgattttagctacctgggaggctgaggtaggaggatcacttgagcccgggaggcagaagttgcagtgagccaacatcacgccactgc

SEQ ID NO: 11792 - DNA, 149 bp, Homo sapiens
caccggcattttatatatatatatatatatatatgtgtgtatatatgtatatgtatatacgtgtgtatgtgtatatatgtgtgtacatatgtatatgtgtgtatatatatgtgtatatgtgtgtgtgtgtgtgtatatatatatattta

SEQ ID NO: 11793 - DNA, 217 bp, Homo sapiens
tgtacaaatatatatatatgtatatatatacatatatacatatatatgtatatatatacatatatacatatatatgtatatatatacatatatacatatatacatatatatgtatatgtgtgtatatatatacatatatacgtatatatgtatatgtgtgtatatatacatatatacgtatatatgtatatgtgtgtgtatatatacatatatacgt

SEQ ID NO: 11794 - DNA, 58 bp, Homo sapiens
tgagtcagagtctcattctgtcacccaagctggagtgcagtggtgcgatcttggctca

SEQ ID NO: 11795 - DNA, 116 bp, Homo sapiens
cttggtttaatttatcccagcaatgtgggagttggactagatcactgttttttttgtttttgtttttaaagacagagtctcactctgtcacccaggctggggtgcagtctatcttg

SEQ ID NO: 11796 - DNA, 102 bp, Homo sapiens
caagtgaacctgctaaaagatgctagctaaaaaggtatgtcctcaatccaagcccgaatgaccctggctgcctcaatggcttgccacactctgcatcacatg

SEQ ID NO: 11797 - DNA, 104 bp, Homo sapiens
ggttggttggttggttggttggttggttttgagatgtagtctcactctgtctcccaggccggagtgcagtggtgcaatctcggctcactgcaacctccgcctcc

SEQ ID NO: 11798 - DNA, 58 bp, Homo sapiens
tgagacagggtctcactctgacacccaggctggagtgcagtggcgcgatctcagctca

SEQ ID NO: 11799 - DNA, 117 bp, Homo sapiens
tccatccttggtgacagagtctcactctgtcttcaaaaaataaataattttttttctagtgtttattactgatcagatttttttgagacagagtcccgctttgtcgcccaggctgga

SEQ ID NO: 11800 - DNA, 73 bp, Homo sapiens
tttgaggcagagtctcactgtgtcacctaggctggaatgctctggtgcagtaagagctccctgtaaccttgaa

SEQ ID NO: 11801 - DNA, 59 bp, Homo sapiens
ttgttgagacagtctcactgtgtcgcccaggctggagtgcagtggtgtgatcttggcaa

SEQ ID NO: 11802 - DNA, 58 bp, Homo sapiens; identical to SEQ ID NO: 3380

SEQ ID NO: 11803 - DNA, 64 bp, Homo sapiens
tgggtgagcagaagatactgtttgttttttgtttttttgacacagggtctcgctctgtcaccca

SEQ ID NO: 11804 - DNA, 66 bp, Homo sapiens
gcagctcagagtcagcacagagggagaaggaatctggccttttgcagcagcaccctttgggctcgt

SEQ ID NO: 11805 - DNA, 111 bp, Homo sapiens
cagtttgaccacatttctgatctacacagtatgaactgtagtctggaatatgcacttctttgtgcctgactagcttcattcttctggtttctgctcttggtcttttggctg

SEQ ID NO: 11806 - DNA, 93 bp, Homo sapiens
agtactatgggcatgcaccaccacacctggctaaaaaacatttttttcttattttttttgtatagatgtgggtcctgctatgttgcccaggct

SEQ ID NO: 11807 - DNA, 58 bp, Homo sapiens; identical to SEQ ID NO: 2381

SEQ ID NO: 11808 - DNA, 87 bp, Homo sapiens
tagactgagaacttattgcagttttgggggcttcttcagaaggatataaaggaattctgagactctctgagacaaagttctcagcta

SEQ ID NO: 11809 - DNA, 75 bp, Homo sapiens
gcctggctcagagtgtgattttttttttcttttttttttctttttgagactagagtcttgctctgtcacccaggc

SEQ ID NO: 11810 - DNA, 104 bp, Homo sapiens
gctgcactcactgcagagtgggaaggggtgggttggtaaattaggatttactctttttttttatttgagacagtctcactctgtcacccaggctagagtgtagc

SEQ ID NO: 11811 - DNA, 114 bp, Homo sapiens
gtatgtatatatgtgtgtatatatatgtttgtgtatattacatgtgtgtatatatgtatattacatatgtgtgtatatatgtatatatacatatatatgtatatgtatatatac

SEQ ID NO: 11812 - DNA, 74 bp, Homo sapiens
taggcattgcctggcaccctgtaggcatcgattaagaattgatgaatgaggcagggcacggtggctcacgccta

SEQ ID NO: 11813 - DNA, 66 bp, Homo sapiens
gtgggaggctgaggtaggaggatctcttgagcctgggaggttgaggctgcagtgagccatgttcac

SEQ ID NO: 11814 - DNA, 89 bp, Homo sapiens
ggcatgtggagatgaagcagcaactgccaagtggcagaggtgggattcaaacccaagtctgtctgactcacagcctgtgttttcctgcc

SEQ ID NO: 11815 - DNA, 56 bp, Homo sapiens
gagacagagtctcactctgtcccccaggctggagtgcagtggtgcgatcttggctc

SEQ ID NO: 11816 - DNA, 60 bp, Homo sapiens
tggctctctctggctctctctggcctccagcgcctctggccaggaagccgcctgaggcca

SEQ ID NO: 11817 - DNA, 121 bp, Homo sapiens
ggatcacagtcctgcctagtctcgtgtctaaaaacagttgtttgatttgtccctttatttatttatttttttgagacggaggtttgctcctgttgtccaggctggagtgcaatggcacgat

SEQ ID NO: 11818 - DNA, 58 bp, Homo sapiens; identical to SEQ ID NO: 10877

SEQ ID NO: 11819 - DNA, 109 bp, Homo sapiens
cagctgcaagctctcctgctgagaaccgcctgccctcctgtggactctgtgtttctgtctgaatctttctttccatcatgctgtctgtctctgggatggtttctgtctg

SEQ ID NO: 11820 - DNA, 119 bp, Homo sapiens
gggggccctgccttgggggttcccagtcttgagggggcagagggtaggagggttcccaagtcactctctgcctctcttgccccatttttctggtagggtctggcaggccccccagggag

SEQ ID NO: 11821 - DNA, 58 bp, Homo sapiens; identical to SEQ ID NO: 315

SEQ ID NO: 11822 - DNA, 58 bp, Homo sapiens; identical to SEQ ID NO: 47

SEQ ID NO: 11823 - DNA, 82 bp, Homo sapiens
agagcaaggagtggtggggattgtgggtcaagtcagagatgacacagagcactacttacccaggggcagaaacttcaactct

SEQ ID NO: 11824 - DNA, 128 bp, Homo sapiens
aggtccatggctgggtgtggtggctcacatctgtaatcccagaactttgggaggcagaggtggaaggatcacttgaggccaggagttcaagattacagaaaactgtgatggtgccactacacttcagc

SEQ ID NO: 11825 - DNA, 85 bp, Homo sapiens
gggtcttacaggctggagtctttgccgatttttaattggattgtctttttttttttttttgaggcagagtcttgctctgtcaccc

SEQ ID NO: 11826 - DNA, 136 bp, Homo sapiens
acagaatgagacactgtctcaaaagaaaaaaaaaatcacaacaaggtattagtcagaattttttttttttttttttttgagacaagactctccctctgtcacccaggctggagtacagtggcaggatcttggctca

SEQ ID NO: 11827 - DNA, 91 bp, Homo sapiens
acagagcaagactccgcctcaaaaaaaaaaagtatatatatataatgtgttctgattctttttttctttttgagacagagtctcactctgt

SEQ ID NO: 11828 - DNA, 64 bp, Homo sapiens
ttgagatgtagtctctctctgtcacccagactggagtgcagtggtgcagtcactgcagcctcaa

SEQ ID NO: 11829 - DNA, 116 bp, Homo sapiens
ttgatagttgttttcatatatgttatattagaggtagaatagtttagtagtctgaagtcagacagctcaaatcttggctctgccacttaacagatatggtttgggccaggtattga

SEQ ID NO: 11830 - DNA, 139 bp, Homo sapiens
gcacatgtgtggcatagtgaagtatattgctcacttttttttttttttttttttttagttgagacggactctcgctgtgtcacccaggctggagtgcagtggcacgatctcggttcactgcaagctccgcctaccgggt

SEQ ID NO: 11831 - DNA, 77 bp, Homo sapiens
tgggcaaatagtgagatcctatacgtagaaaaaaacttttttttttttttgagacagagtctcactctgttgctccg

SEQ ID NO: 11832 - DNA, 79 bp, Homo sapiens
gcctttgagggtcattgagctcctcagatatatgttttttttttttttttgagatggagtctcactctgtcaccgaggc

SEQ ID NO: 11833 - DNA, 71 bp, Homo sapiens
aggcacccttgggaagttgtgttcaggtgacccctttgggagcagggtctgtctgtctcactcctctgcct

SEQ ID NO: 11834 - DNA, 59 bp, Homo sapiens
gtgaacagagtctcactctgttacccaggctggagtacagtggtgcgatctcggctcac

SEQ ID NO: 11835 - DNA, 87 bp, Homo sapiens
agtggtacctgacaatttgtatttctgagtgcctggatgctgctgctgctgttggcatggaaactacattttgagaaccactggtgc

SEQ ID NO: 11836 - DNA, 58 bp, Homo sapiens
tgagacggagtctcactctgtcacccaggctggagtgcaggggtgtgatctcggctca

SEQ ID NO: 11837 - DNA, 65 bp, Homo sapiens
ggggcagagccaggaggacatggaggcgggggcccaccctgagtgtcactcacactggcagctct

SEQ ID NO: 11838 - DNA, 58 bp, Homo sapiens; identical to SEQ ID NO: 1847

SEQ ID NO: 11839 - DNA, 74 bp, Homo sapiens
ttgtttttttttgagaccgtgtctcactctgtcgccaggccagagtgcagtggtgcgatctcggctcactacaa

SEQ ID NO: 11840 - DNA, 95 bp, Homo sapiens; identical to SEQ ID NO: 68

SEQ ID NO: 11841 - DNA, 93 bp, Homo sapiens; identical to SEQ ID NO: 69

SEQ ID NO: 11842 - DNA, 91 bp, Homo sapiens
gtgggagtcactgtgcctgaccagcattgtttttttgtttttgtttgtttttttaaagataaattaattggccatgtgtggtggctcacgc

SEQ ID NO: 11843 - DNA, 75 bp, Homo sapiens
gagtctcgctctgtctcccaggctggagtgcagtgtaaacccagcaccactacgggaggcagaggtgggtggatc

SEQ ID NO: 11844 - DNA, 80 bp, Homo sapiens
agtctgggtgacagagaccgagtttcttatttatgtatttatttatttttgagacagagtctcactctgtcacctaggct

SEQ ID NO: 11845 - DNA, 59 bp, Homo sapiens
tgagccagggtctcactcactgtcaccagactggagtgcagtggtgcaatcacagctca

SEQ ID NO: 11846 - DNA, 58 bp, Homo sapiens; identical to SEQ ID NO: 9719

SEQ ID NO: 11847 - DNA, 112 bp, Homo sapiens
gtatatatacttatttaaaataaagcacacaaataggtatgtatatatgtatatgtttatatatatgtgtatatataaacctatttgtgtgtatatgtatgtgtatatatac

SEQ ID NO: 11848 - DNA, 118 bp, Homo sapiens
gtgcttaagttgtatacaattttatcacttgtgtaggtttgtgtatctatgaccacagtcaagatactgagcagttccaagcacagggatcctttgtgttgtctttttacaactgtat

SEQ ID NO: 11849 - DNA, 114 bp, Homo sapiens
ctggtataaatgtccagaaataaaatcgctgggtcatttggtagttgcatgcttagtttttaaagaaattgccaagcttttccagattgattgtgccatttatatttccaccag

SEQ ID NO: 11850 - DNA, 114 bp, Homo sapiens
cctatggcgtgggtgctggcgggaaagagaagctgcccagatgtagggcaggcagatcagtgtctccctgcctgagtgggtggaaagacttgggcaccctctggtggccatagg

SEQ ID NO: 11851 - DNA, 58 bp, Homo sapiens; identical to SEQ ID NO: 7346

SEQ ID NO: 11852 - DNA, 87 bp, Homo sapiens
tgagatggagtctcactctgtcacccaggctggagtgcaatggtgcgatctcggctcacatcctgggttcaagtgttctcctgcctc

SEQ ID NO: 11853 - DNA, 86 bp, Homo sapiens
tatggtgagttgtataattattttattgtatattacaatgtagtaatagaaatacaatgtacaataaatgtacagcctcaatcatg

SEQ ID NO: 11854 - DNA, 103 bp, Homo sapiens
ccagaatcctgagagctctgcatgttcaggctgtttaattcctgatgtcacatgagagtcaggaaaggaagttgagggagtggagaaatttggagaaatttgg

SEQ ID NO: 11855 - DNA, 66 bp, Homo sapiens
ctcagtcactgacaaggatgatagcctattacttctatagagcatcagtcacactgtcagtctgag

SEQ ID NO: 11856 - DNA, 73 bp, Homo sapiens
gcaatggggggacggggagacacacactttttttttttttttttgagatggagtctcgctctgtcacccaggc

SEQ ID NO: 11857 - DNA, 125 bp, Homo sapiens
gagactttgtttcaaaaaaaaaaaaaaggaaaacaaataaattttatttttatttatttattcattttgagacagggtctctctatgtcacccaggctggagtgcagtggcgtgatcttggctca

SEQ ID NO: 11858 - DNA, 116 bp, Homo sapiens
ttaagatagctactgtcttgactttgagagcatagatgaattttgcctactttttttttttttgagacagagtctcactatgtccctcacgctggagtgcagtggcgtgatctcgg

SEQ ID NO: 11859 - DNA, 81 bp, Homo sapiens
ccactcctcataaacagaagagagaactctgggaaatcacctagtcggaactacgttttctttttctttttttggagatgg

SEQ ID NO: 11860 - DNA, 107 bp, Homo sapiens
ggcgtggtggcacgtgcctgtagtctcaggtactcaggaggctgaggtggaaggatcatttgagcctgagaggccagggctacagttagctgtgattgcatcactgc

SEQ ID NO: 11861 - DNA, 117 bp, Homo sapiens
caggtgcggtggctcacacttatagtcccagcactttgggaggctgaggtaggtggatcacttgaggtcaggagtttgagatcagcctggccaacatggtgaaacgccatctctact

SEQ ID NO: 11862 - DNA, 85 bp, Homo sapiens
tgctgtggccctggactgtaatgaacccagtacatcattttatatttaacacatgagaaactggacactaaaaggttacacagca

SEQ ID NO: 11863 - DNA, 68 bp, Homo sapiens
gggtatggtggtgcacacctgtagtcctagctactctggaggctgaggtaggaggatcacttgtgccc

SEQ ID NO: 11864 - DNA, 116 bp, Homo sapiens
acagagtgagactgtctcaaaaaaaaaaaaaaaaaaaaaaaaagttttttatttttaaattttttgttttatttcttttttacttttttttcttttgagacagagtcacgctctgt

SEQ ID NO: 11865 - DNA, 58 bp, Homo sapiens
tgagatagagtctcgctctgtcacccaggctggagtgcagtggtgtgatctcagctca

SEQ ID NO: 11866 - DNA, 62 bp, Homo sapiens
ggtgagacaaggtctcactctgtcacccaggctggagtgcagtggtgcgatctctgctcact

SEQ ID NO: 11867 - DNA, 61 bp, Homo sapiens
atatatatatatgtgtgtacatacatatatgtatgtatgtatgtatatgtatatgtatata

SEQ ID NO: 11868 - DNA, 100 bp, Homo sapiens
tgtgccactgtgcctggctctccacaggtggcttccttttttttttttttttttgagacaaggtctggctctatgacccaggctggagcgcagtggcaca

SEQ ID NO: 11869 - DNA, 75 bp, Homo sapiens
gacaggttgtggttcaggctcaggactgacctgtggagccactgggtcccaactgaccctctcacacccacagtc

SEQ ID NO: 11870 - DNA, 79 bp, Homo sapiens
cattggacttgatcttatcatgtatgtgatctgtgaactcaaagaggtcacggtcatacctgtcttgtctgtctctgtg

SEQ ID NO: 11871 - DNA, 58 bp, Homo sapiens
tgagacagagtcccgctctgtcactcaggctggagtgcagtggcagggtctcagctca

SEQ ID NO: 11872 - DNA, 94 bp, Homo sapiens
gtgggcagggggagatgggagtcacaggccccttgggtgaggggtccaaccccgtgtccatctgtccctgagtctctccatctgtgtctcctac

SEQ ID NO: 11873 - DNA, 85 bp, Homo sapiens
tctggggctcctcaagcatctgtctgtgtctctatgtggcatcacgtcagggtctctttatcgtagttgcttcaggttagccaga

SEQ ID NO: 11874 - DNA, 85 bp, Homo sapiens
gggtaggatggtctccttcctgacaaagggagcggtctgctgccccacagtccctgactccctccctggctcacacctcctgccc

SEQ ID NO: 11875 - DNA, 88 bp, Homo sapiens
ccagctctgccagttactctctgtgcctcagttgcctcatctgtaaaataaggacatctgtaaaataaggacaactggggctggtgag

SEQ ID NO: 11876 - DNA, 91 bp, Homo sapiens
cagttcgtaggctctctaagatgagggaaaaacaaactcaggaaaaccgcctctctgggtctctctctccgtcttgtcgtctctctcattg

SEQ ID NO: 11877 - DNA, 59 bp, Homo sapiens
caatgagttatggattttgtctcttttttatttttttgagatggagtcttgctctgttg

SEQ ID NO: 11878 - DNA, 105 bp, Homo sapiens
gcatggtggcatgtgcctgtagtcccagctacttgggaggctgaggtggaaggatcacttgagcctgagagttgaggctgcagtgagccatgattgcaccactgc

SEQ ID NO: 11879 - DNA, 86 bp, Homo sapiens
tggagttcttagcactaattgaattatggcttgatgtctttctttgacttaaaagaactatgtttttaaatattgcttctgctcca

SEQ ID NO: 11880 - DNA, 116 bp, Homo sapiens
gtcaaacacataaaattcacctcttaaaagttactaaatgcaaagagatgtatctttttctctttattcatttatttaattttttatttttaagttctggggtacatgtgcaggat

SEQ ID NO: 11881 - DNA, 110 bp, Homo sapiens
tgcttaggattgtcttggctatgcaggctcttttttggttccatatgaaatttaaagtagttttttctaattctgtgaagaaagtcagtagtagcttgatggggatagca

SEQ ID NO: 11882 - DNA, 95 bp, Homo sapiens; identical to SEQ ID NO: 68

SEQ ID NO: 11883 - DNA, 93 bp, Homo sapiens; identical to SEQ ID NO: 69

SEQ ID NO: 11884 - DNA, 67 bp, Homo sapiens
tgtttgagacagggtctcactctgtcacccaagctggagtgcagtggtgtgatcttggctctctgca

SEQ ID NO: 11885 - DNA, 118 bp, Homo sapiens
catatataagcatatgcttatacatatatatacatatataagcatatgcttatacatatatatacatatataagcatatgcttatacatatatatacatatataagcatatgtgtatg

SEQ ID NO: 11886 - DNA, 61 bp, Homo sapiens
cagtacctcagttggaaatgcagaaatcacctgtcttctgtgtcagtcacactgggagctg

SEQ ID NO: 11887 - DNA, 80 bp, Homo sapiens
gctttggtccaagctgtgcgagtgggcttttttttgttttgttttgagatggagtctcactctgtcgctcaggctggagt

SEQ ID NO: 11888 - DNA, 106 bp, Homo sapiens
ctatagttttgtagcaagttttgaaatcagaagtgtgatttttccaacttttttttttttttttggagacatagtctcgctctgttgccttgctggagtgcagtgg

SEQ ID NO: 11889 - DNA, 118 bp, Homo sapiens
ctcccctgaattgcctcttcaggaggtgggagtctctaccctctggagagagtgggcactgagcgctccactttcttctcttgacactcttcttcctctgcgtaatccaacaggtagg

SEQ ID NO: 11890 - DNA, 78 bp, Homo sapiens
agaccaaatcctgtggacttttggcaggtaagctaagacagcatctcactgcctctcagggtctgcaggtctgggtct

SEQ ID NO: 11891 - DNA, 118 bp, Homo sapiens
cagcctgtgtgttgattttgtattctgcaaccttgctgcctttattagttctgacacatatttttttttttggtagactctgtaggttttctacatataaaatcatgtcagctggctg

SEQ ID NO: 11892 - DNA, 108 bp, Homo sapiens
gcctcccaaaccaaaatgctgggattacatgtgtaagccaccgtgcctggactttatttacttatttttagagacaggatcttactgtgttgccctgggcccgagtgc

SEQ ID NO: 11893 - DNA, 118 bp, Homo sapiens
tcctccggatctaattttctcatgtgatttttgagcctctacaggaatgcggagggaattttctctttttcttgttgaatctcgaatgcctttaagacattttgtgtcctaggagtgg

SEQ ID NO: 11894 - DNA, 57 bp, Homo sapiens
gggctagtgttgcctgaggatcattccaggctgaaagatcagagtgaacacaagcct

SEQ ID NO: 11895 - DNA, 115 bp, Homo sapiens
gtcttccacctccaactctgccaccggctgctctcaccctctctggctgcctcagagcaacagctccctggggtaggtgagcaatgggccaggcctctggagcagaggggttgac

SEQ ID NO: 11896 - DNA, 112 bp, Homo sapiens
ttgctttacttctgtgtttgtcctgtaaaagcctcctccttttgttttctttctttctttttttttttttttgatggagtctcgctgtgtcacccaggctggagtggagtgg

SEQ ID NO: 11897 - DNA, 58 bp, Homo sapiens
tgaggcagggtctggctctgtcactcaggcaggagtgcagtggtatgatcttggctca

SEQ ID NO: 11898 - DNA, 118 bp, Homo sapiens
gctattcatgctgtgctataaaaataccctagactgggtaattttatagcacagcatatagtccctcactctcagcctgtgtccctggccacttcctgggagatccaggcacggggat

SEQ ID NO: 11899 - DNA, 63 bp, Homo sapiens
tctctcctcagtaccatgtgtctgcttgcctcctgtcagagatgtgtcagagctgagggtgga

SEQ ID NO: 11900 - DNA, 72 bp, Homo sapiens
tttccaatcactctcaatatctcagtcaggcccagatccagacagcccagactgagaagagaatggaggaaa

SEQ ID NO: 11901 - DNA, 107 bp, Homo sapiens
tgctcacacataacatgggggcaaatggactttaactcataacaatgctggataattctttatttagttatttttttgatacagagtctcactctgtcatgcgggca

SEQ ID NO: 11902 - DNA, 57 bp, Homo sapiens
gtgtgctcgtgagcaacgagaccgctgagcagagtgtctcggtccctctgagtgtgc

SEQ ID NO: 11903 - DNA, 75 bp, Homo sapiens
gcacccctggccatatgtctgggacacctctgggaacttacctagctctgggtgtcagaactgtgtgacttgtgc

SEQ ID NO: 11904 - DNA, 86 bp, Homo sapiens
tcctggaccccggggcagctgcctctctgtgtgccacagctgtgccagggacatagattcacaagaggcagccatggggtccttga

SEQ ID NO: 11905 - DNA, 86 bp, Homo sapiens
ggtaagaagagactcttcaagcacctatggtttggaaactttattttattttatttatttttgagacagagtctcgctctgtcgcc

SEQ ID NO: 11906 - DNA, 69 bp, Homo sapiens
tgtgtgtgtggcaaggtctcactctgtcacccaggctggagtgcattggtgcgatcttggctcactgca

SEQ ID NO: 11907 - DNA, 60 bp, Homo sapiens
tgggctgagacggtggggttttctttttttttttgagatggagtctcactctgtcaccca

SEQ ID NO: 11908 - DNA, 98 bp, Homo sapiens
ttgtttttcctagaaactgagtctctgtctgtcattcaggctggagtgcaatagcgtgatcatagctcactgaaccttgaagtcttgggcttaagcaa

SEQ ID NO: 11909 - DNA, 87 bp, Homo sapiens
gaaccaacccagctttgcatgtggttttagcaaaaacattaattatagaatgttatgttaagatctatgaagactcttctggagttc

SEQ ID NO: 11910 - DNA, 99 bp, Homo sapiens
ctgattccaggctgaggtagtagtttgtacagtttgagggtctatgataccacccggtacaggagataactgtacaggccactgccttgccaggaacag

SEQ ID NO: 11911 - DNA, 58 bp, Homo sapiens; identical to SEQ ID NO: 605

SEQ ID NO: 11912 - DNA, 101 bp, Homo sapiens
cccaggcctcgctgttctctatggctttttattcctatgtgattctactgctcactcatatagggattggagccgtggcgcacggcggggacagccagcgg

SEQ ID NO: 11913 - DNA, 75 bp, Homo sapiens
gggaatctgtgggccagagggagtgggaaagacctctaggaatctgcctcactcactctatttggcttgaatccc

SEQ ID NO: 11914 - DNA, 82 bp, Homo sapiens
ggtctcagtctgtctccctggctggagtgcagtggcataatcaccgctcactgcagcctcagcctcccaagaagctgggacc

SEQ ID NO: 11915 - DNA, 59 bp, Homo sapiens
gctagtcgctgcctgcctgttggggtggggcctatacctacagctgcaggtgtgactgc

SEQ ID NO: 11916 - DNA, 58 bp, Homo sapiens; identical to SEQ ID NO: 2540

SEQ ID NO: 11917 - DNA, 76 bp, Homo sapiens
ggggtagggggttccgggtctgaagggtggtggaggaggttgcagctttcagcatcgtgtctcactctctgtttcc

SEQ ID NO: 11918 - DNA, 82 bp, Homo sapiens
ttctgagacagagtctcgctctgtcgcacaggctggggtgcaggcatgtgatcccggctcactgcaacctctgtctcctggg

SEQ ID NO: 11919 - DNA, 70 bp, Homo sapiens
ttgttttgagctagagtcttgctctgtggcccagactggagtacagtggtatgatctcagctccctgcaa

SEQ ID NO: 11920 - DNA, 82 bp, Homo sapiens
ccacctgtgggtgcctgtgtgcctggcagtctctctgttggggctgccccacctttaagggtctatctgtgcccacctgtgg

SEQ ID NO: 11921 - DNA, 115 bp, Homo sapiens
tccaggtgtggtggtctatatccatggtcccagctactcaggaggctgaggtggtaggatcacttgagcccagggaggtcgaggctgcagtgagccatgatcatgccactgcact

SEQ ID NO: 11922 - DNA, 86 bp, Homo sapiens
caagaggttgagggtgtatatatatatatatgaggggggaaaagtagcatgcattttttaggcctcattacactttattatttttg

SEQ ID NO: 11923 - DNA, 97 bp, Homo sapiens
ggtggcgcacacctgtagtcccagccactcgggaggctgaggtggaaggatcacttgagcccaagaggttgaggctacagtgagttgtgttcacacc

SEQ ID NO: 11924 - DNA, 109 bp, Homo sapiens
gggccatccatcccaacaggagctggtgtgtctactcaaaacaggttggggacaatgtagtcagtgtggacaccatcaatcagcccttctccgttgttgtggacgaacc

SEQ ID NO: 11925 - DNA, 58 bp, Homo sapiens; identical to SEQ ID NO: 1305

SEQ ID NO: 11926 - DNA, 93 bp, Homo sapiens
ccagtcgagtgccctgtttgatgagtgagtgagcacacttgggcttcaggctgtttaatgtgttctttttcatttttcagcactttcatttgg

SEQ ID NO: 11927 - DNA, 115 bp, Homo sapiens
gcagaaatcaatggctcctggagactgctttttttttttttttttttttttttttttagagcttagaatgcccatttggaaagaatttagcttttgtgctattgattacttctgt

SEQ ID NO: 11928 - DNA, 117 bp, Homo sapiens
ccatcttactgggtatggagtggtatctcattgtggttttgatttgcatttccctaatgactagtgttattgaacatcttttcatgaacttattggatgtttctgtatcttttttgg

SEQ ID NO: 11929 - DNA, 81 bp, Homo sapiens
ttcaaaagtgttataatgcgggaagtgggtacattttaacttacttgagttgagagctgagagtctgcagaagctttggga

SEQ ID NO: 11930 - DNA, 102 bp, Homo sapiens
ggatcttagaatggaggcccctacccgtgtgcacatgcggagagagacagacacacagacacactcatcctcgtgcacacacgctgctcctccctctgtgcc

SEQ ID NO: 11931 - DNA, 83 bp, Homo sapiens
ggcaatgcagggaggacacagaggacacagggcggccactggtgcctcttggatctctcagggttttagctccctgcccagcc

SEQ ID NO: 11932 - DNA, 100 bp, Homo sapiens
acatgtaataggtagccagttcatactgcgtcaaacatggaagtggagggtgagcttcaagcttggtttgattctgtgactgggtatttcttgctgttgc

SEQ ID NO: 11933 - DNA, 95 bp, Homo sapiens; identical to SEQ ID NO: 68

SEQ ID NO: 11934 - DNA, 93 bp, Homo sapiens; identical to SEQ ID NO: 69

SEQ ID NO: 11935 - DNA, 107 bp, Homo sapiens
aaagttttttggtattcagagtttggggattttggaattgctcataagagagaacatgagtctgtctcagtcaatttcaccactaaataaatgagtttcagttcttt

SEQ ID NO: 11936 - DNA, 87 bp, Homo sapiens
agatagggatgatcagcagtgaaaagaaaatttgttttattttattttttattttttgagacagggtctcactctgtcacccgggct

SEQ ID NO: 11937 - DNA, 114 bp, Homo sapiens
tagctatagctctttgcatatttttagtggttacttttggggttaaaataattttttttaatattttaagttctagggtacatgtgcagaacgtgcaggtttgttacataggta

SEQ ID NO: 11938 - DNA, 95 bp, Homo sapiens
gcagatctcccaggcacctgccgccttccgccacagtctcctcactgaagcagaagtgagagaggtgacagcaaggtagagagatgggcgtttgc

SEQ ID NO: 11939 - DNA, 69 bp, Homo sapiens
agcgggggctggagtctgaggttgctgtgttctgttaacacactcactgcctctctattcctcccagct

SEQ ID NO: 11940 - DNA, 108 bp, Homo sapiens
ggcaggtttaaggtcaggttccccggcttgccctccacccagaggagccaggactctcaggctccctgtaagggaagaagttacccagatcatgagcctgttttgtct

SEQ ID NO: 11941 - DNA, 63 bp, Homo sapiens
agtggcctcagggccaggtgcctgcttctgagtttcgctggctggctggctgactggcacact

SEQ ID NO: 11942 - DNA, 116 bp, Homo sapiens
ggagccagaagcacactggggcctggcactgagtggtatggtagggcctaacggctaaaactctctctctcacccactgagagcctctgtgctccagacatcctgttaggggctct

SEQ ID NO: 11943 - DNA, 108 bp, Homo sapiens
ttctaaatcggctgacataattcacttttgacctcatctaggcttctaattttctttgagagaagattgagagaagattctgtttgcgattctgtttgcgattctgaa

SEQ ID NO: 11944 - DNA, 118 bp, Homo sapiens
ggacttgaatctgcagagaagtattccctggtgcttgtctgtggttgcatgttgttttctttatagcacatgccactgtatcagaggtgcttagggagctgcttatgctctgtcttcc

SEQ ID NO: 11945 - DNA, 57 bp, Homo sapiens
tgagacagagtctcacttactctgttgcccaggctggagtgcagtggtgcgatctca

SEQ ID NO: 11946 - DNA, 65 bp, Homo sapiens
gcacagacagaggagagaggacacaggtggcggccacgccaggtgcatactcacgtctgcttcgc

SEQ ID NO: 11947 - DNA, 112 bp, Homo sapiens
ggtggaatggggtgtgggtcttcttcaggtagagccagggcgttttctgggccccacagagaagacacagagccctggaatatagaggaaggctgtggcatggcaggccacc

SEQ ID NO: 11948 - DNA, 71 bp, Homo sapiens
ttgtttttgaaacagggtctccctctgtcactcaggctgcagtgcagtggcatgatcttggctcactgcaa

SEQ ID NO: 11949 - DNA, 103 bp, Homo sapiens
gcatgccctgcctatttgtgaacttgagacacattgcaggtgtaaatccagatgagcaggtgtgtgtgagcacactcagtatgctgtctgtgtccttctgcaa

SEQ ID NO: 11950 - DNA, 81 bp, Homo sapiens
cagtgggtacttaagaagagctgctcttggaatattcttttttttttttttgagatggagtctctctctgtcgccaggctg

SEQ ID NO: 11951 - DNA, 93 bp, Homo sapiens
agtactagtcaatcattctctgtctcagtctttctgtctctctgcctctcagcatagactgaagttggcagcaagaactgagcataacgtgct

SEQ ID NO: 11952 - DNA, 95 bp, Homo sapiens; identical to SEQ ID NO: 68

SEQ ID NO: 11953 - DNA, 93 bp, Homo sapiens; identical to SEQ ID NO: 69

SEQ ID NO: 11954 - DNA, 93 bp, Homo sapiens
agtctgaattgggagatgacagaatcactgtttcacagaggaatattactgcctatattgtcaagcatggagtctgggttttcaatttgggct

SEQ ID NO: 11955 - DNA, 78 bp, Homo sapiens
caagctccctctctgtgtctctggtactacgctcttcccagagatgaccttggctacactgagactgcacttagcttg

SEQ ID NO: 11956 - DNA, 69 bp, Homo sapiens
attaagaggcatcaaggagaacaggaaaaggaagactttttttctctgtgaggctcagtgtcacttaat

SEQ ID NO: 11957 - DNA, 116 bp, Homo sapiens
gatgtttccatactgcttggattttgagatcttgagtctgtttttttttttttgtttgttttttttttttttttttttgagacagagtctcactgtgtcgcccaggctggaggcgc

SEQ ID NO: 11958 - DNA, 71 bp, Homo sapiens
gtggacatctaaccgagtcggtctcttcagatactcttctctatctagaattggaggttagagatgtccat

SEQ ID NO: 11959 - DNA, 88 bp, Homo sapiens
actgtggtaaactctgagaggataggctgtattttattttattttatttattttgagatggagtctcgctctgtcaccaggctggagt

SEQ ID NO: 11960 - DNA, 95 bp, Homo sapiens; identical to SEQ ID NO: 580

SEQ ID NO: 11961 - DNA, 93 bp, Homo sapiens; identical to SEQ ID NO: 69

SEQ ID NO: 11962 - DNA, 114 bp, Homo sapiens
acttccttaagccaaagcctaatttggagcaaggcccttactcttttcagttctatgaaggctgagagaagtgagaaagctaccaaagaaaagcttgaagctagcagagttggt

SEQ ID NO: 11963 - DNA, 115 bp, Homo sapiens
gtgtgtgaatgatccaatcaatctttccttggaatttacctgcttcagttttaaagtagaaagtttatatttatttgagggggtagggagataataggtaattttattctcagac

SEQ ID NO: 11964 - DNA, 118 bp, Homo sapiens
gcacattgaagatgcgagattcatcacactgctcagaatgacaagcaatatatatatatatatatacacacacatatttatatatatatttttttgagacagagtctcgctctgttgc

SEQ ID NO: 11965 - DNA, 113 bp, Homo sapiens
ggagtcctcatccgttcatgaaggaagctgtgttaggcatgccctcatggctaagagaagacagagagcacccttgccccttcacagcttctttccctggccttgtgggctgt

SEQ ID NO: 11966 - DNA, 92 bp, Homo sapiens
gattaacatgccaaaggacccctgagtaggcagggctgagatcagggttggcagtgtgagtgctggcatcattggggtctaaagtctgggtc

SEQ ID NO: 11967 - DNA, 76 bp, Homo sapiens
cctatatttatctggcaaccatagctcttgccagtgggcaggctgagctaggaggatgtgagaccactgatgtagg

SEQ ID NO: 11968 - DNA, 116 bp, Homo sapiens
gcattcactatactcactttttgaacttgtaattctttaattctattccttattaatttcttttttcttttttgagtcagagttttactctgtcacccaggctggagtgcagtggc

SEQ ID NO: 11969 - DNA, 93 bp, Homo sapiens
ctgttggctaaggtgtctttgagacaaagggtacctgtctgaagtctgtatgcagaagaatcattctcagtaataaagtcgttctagtgacag

SEQ ID NO: 11970 - DNA, 83 bp, Homo sapiens
cctctctccctgtgtgcgtgtgtgaaaacaaaagacttttgttgttgttgttttggaaaataatacctctaccaggtggtagg

SEQ ID NO: 11971 - DNA, 100 bp, Homo sapiens
cacatcacccagggatattgttaaaatgtagattctgactcagtaagtctgtggcagggcttgagattctgcatgtctaacgagctcccaggtgatgctg

SEQ ID NO: 11972 - DNA, 108 bp, Homo sapiens
aaatcctgtggcgggcaaatagaatacaggcaaagtatcttgatctaattacaacttgtttatttataatttgtcctgactctgcaggcttagccatttcagaggttt

SEQ ID NO: 11973 - DNA, 72 bp, Homo sapiens
gcctatgatagataggcctgtttgagtcacagccaaacgttgagagatgagacagacctatgacttaatggc

SEQ ID NO: 11974 - DNA, 99 bp, Homo sapiens
gcaagtgcacataattcagatttcattatttaatattttacacatctctagaagtctgaaattgttaacaaatattgggattgagtatcttgtatttgt

SEQ ID NO: 11975 - DNA, 106 bp, Homo sapiens
agaaatgcagttggattaaagaaagtgacctaaagatttcaaactaaagaaataactacctttcattcagtaggaataggaggtcattgcattcctgctgtggtct

SEQ ID NO: 11976 - DNA, 97 bp, Homo sapiens
gtgtgtatacatgtgtatgtgtgtatgtatatatatgtgtgtgtgtgttagtgcatatatatccatttatatataaccacacacatatactacacat

SEQ ID NO: 11977 - DNA, 113 bp, Homo sapiens
gatgtatatgtgcaggtcacaggggatatgatggcttagcttgggctcagaggtctgatactgtgaggttttgagtttatcatttaatttctttgggctttggttttatcgtt

SEQ ID NO: 11978 - DNA, 101 bp, Homo sapiens
gaacaggtccttcacatcccttgtaagttggattcctaggtattttattctttttgaagcaattgtgaatgggagttcactcatgatttggctctctgttt

SEQ ID NO: 11979 - DNA, 68 bp, Homo sapiens
gcataagggatgctagagatgagtttttcttgctgaatgagtggcttatctgttagtatgatgaatgt

SEQ ID NO: 11980 - DNA, 84 bp, Homo sapiens
gtatgtatcataggtgagtgggagggttgggattcacctaatccatatgactttaaattccactctctcagtcactgtacttac

SEQ ID NO: 11981 - DNA, 69 bp, Homo sapiens
ttgtttttgagacagggtctcactgttacccaggctggagtacagtggtatgatcacagctcactgcag

SEQ ID NO: 11982 - DNA, 82 bp, Homo sapiens
tatatgtgtgtacacatatgtatgtatatatgtacatatatgtatatgtatatatgtacatatatgtgtgtatatgcatata

SEQ ID NO: 11983 - DNA, 78 bp, Homo sapiens
tctattgtaaacaggagtgttctcttatattttgtatagtttgttgttactgtacagaaacacaactgattatgtaga

SEQ ID NO: 11984 - DNA, 96 bp, Homo sapiens
aggagagacaactttgaccaaagcagaggaccaaaaagttacaaggatgtttagtttgtgataaaaatcattttgcagattaaagtgcttcctcct

SEQ ID NO: 11985 - DNA, 100 bp, Homo sapiens
acacatatatgtaaaatatatattatgtatatgtgtatatctaacacacatatatgtagtgtatatatatatatgtgtgtatatttacacagtccagtga

SEQ ID NO: 11986 - DNA, 112 bp, Homo sapiens
tacctgggttcggatcctagctctgagattttggagctttgtgactttgggcaaagagctttccctctctgtgtctgaatttcctcatcttgaagacaggatcatagtggta

SEQ ID NO: 11987 - DNA, 116 bp, Homo sapiens
cacaatcaaccacattccttgttctgaataaaacatcatatgcaatgttatcaagtttaataccatattccatgtaaccatgtgtatattcaactccagggagtttgtgacttggt

SEQ ID NO: 11988 - DNA, 105 bp, Homo sapiens
ggccccggacatcccttcctgcattgtgctgtggctgcctcagcattattttgagtgttgacagagtgctcagtgcagcagagacagccttccttgtctgaggtc

SEQ ID NO: 11989 - DNA, 110 bp, Homo sapiens
ggccatgggagctcagcctaataaggagaagatatgacaacagagagagcccagggtcttgggccctttgcacagaacatggtgtccttactggcagtttgttttaggct

SEQ ID NO: 11990 - DNA, 58 bp, Homo sapiens; identical to SEQ ID NO: 315

SEQ ID NO: 11991 - DNA, 96 bp, Homo sapiens
cagggatatgaataagtgaacatagaaaaatgaacttatgcttattgaaaagtaatctttatatataaatatgtaaactaattcatacaatccttg

SEQ ID NO: 11992 - DNA, 101 bp, Homo sapiens
gaatatattacagaaattgctgaaggcctcagtcaatggcactggttgaaaagttttagacagtgggaaatggccatggagatcagcgatgaatagaagtc

SEQ ID NO: 11993 - DNA, 78 bp, Homo sapiens
atatatgtgtgtatctatatatatgtgtatgtatatatatgtgtgtgtgtatatatgtgtatgtatatatatgtgtgt

SEQ ID NO: 11994 - DNA, 126 bp, Homo sapiens
ggggagatatatagatacatatatatctatatgtatctctctatatatatctatatatatctctatatatagagatctatgtatctatatctctctctatatatatagagatatatctatatgtat

SEQ ID NO: 11995 - DNA, 94 bp, Homo sapiens
gcccacctgactacctttcttcacactgtcagtcctaccccacctgaagagtgtgggaaagatgagaggctggaggtgtggtctgtcaggaggc

SEQ ID NO: 11996 - DNA, 88 bp, Homo sapiens
ttattttctattgaagcacagttttttgttttttgttttttcctacaacactaaaggaagaattgtgatgtggcacaatgggatatga

SEQ ID NO: 11997 - DNA, 75 bp, Homo sapiens
gggcttagaacaggagctcagtaaaccacttttgagtgacagaagctggcaggctgatctagatatttagcgccc

SEQ ID NO: 11998 - DNA, 111 bp, Homo sapiens
gcttgtactcaggtcttaccacccttgcaatcttgggtatgttacctaactctctcagtctgagtggctgcaccttttccatggggcggtaagtcctatgtggtggaatgc

SEQ ID NO: 11999 - DNA, 68 bp, Homo sapiens
accttttcacatctctttcctgtctttttatgtatatatatagagagagagacagagagagatgaggt

SEQ ID NO: 12000 - DNA, 82 bp, Homo sapiens
ggagtctcgctctgtcgctcaggctggggtacagtggcatgatctcagctcacctccgccttctggggtcaagcaattctcc

SEQ ID NO: 12001 - DNA, 68 bp, Homo sapiens
gagtgcagttggggtgggggagttggaggcagcttctctctcaatctctccctccatctgcctgtctc

SEQ ID NO: 12002 - DNA, 96 bp, Homo sapiens
tatggcatttgaaacatccgtctgcctctctctgcctgtttactctgataaatcctagtaacataggcataggtgggtgaggagccaggggtcgtg

SEQ ID NO: 12003 - DNA, 115 bp, Homo sapiens
tgcttaactcaccaattttctaatcttactccactgtgaaactttctttttttttttttctgagacaggatctcactgtgtgacccaggctggagtgcagtggcatgatcacagc

SEQ ID NO: 12004 - DNA, 104 bp, Homo sapiens
gtataatacatgtactatatatatacatgtatagtataatacatgtattatactatatatagtatatattacatatattatactatatatgtatatacagtaca

SEQ ID NO: 12005 - DNA, 118 bp, Homo sapiens
atatatgttagtgtgtatatataacatatatagtatatatgtattatgtattatatatacatatatgttcatagtatatatgtatatatgtacactataatacatgtattatactatg

SEQ ID NO: 12006 - DNA, 58 bp, Homo sapiens
tgagacagagtctcgctctgtcttccaggctggagtgcagtggcgtgatcttggctca

SEQ ID NO: 12007 - DNA, 108 bp, Homo sapiens
gcagagtctgctcctctggagggttggattgtgggagattgacttttttttttttttttttttttttaaaagagtctcactctgtcgcccaggctggagtgcagtggc

SEQ ID NO: 12008 - DNA, 111 bp, Homo sapiens
tgacttgatgaaagggcatatggtgtccccaaaaatgtctgatgagtgagaacattaaaatgactaaactgatgggacatatttaattgactatgataaacctgaaagtta

SEQ ID NO: 12009 - DNA, 104 bp, Homo sapiens
ggcgacagagtgagactctgtctcaaaaaaaaaaaagaaatagcttagagccataatagtgtatttaattttattttttaagacagagtttcgttcttgttgcc

SEQ ID NO: 12010 - DNA, 97 bp, Homo sapiens
acagggatacttttgtcttttttatttctaatttaattgcattgtaatcaacaatggtggtgattatttgaaatttgttgagactaagatctactgt

SEQ ID NO: 12011 - DNA, 91 bp, Homo sapiens
atatgtgagtatgtgtgtgtgtatatatattttgtgtgtgtgtgtgcatatatatgcacacacacacacacacacacatatacatatatat

SEQ ID NO: 12012 - DNA, 108 bp, Homo sapiens
atcactgtttctttcctctttttctttattttaaatatgtactaattgaaaaaagaatctgctagtagctagttttgaataaagtgggatttttttaagaggcaggat

SEQ ID NO: 12013 - DNA, 115 bp, Homo sapiens
gttgtaacattgcttcctgcagcaatgttcagtaatactttcttttttttttttttttttttttttgagatagagtctcgctcttattgcccaggctacagtgcagtggtgcgat

SEQ ID NO: 12014 - DNA, 83 bp, Homo sapiens
tgcatacacacattttaaaggctggattatatatatatattcttgtgtattagtatatgagtatttgtgatgtgtgtgtgaca

SEQ ID NO: 12015 - DNA, 119 bp, Homo sapiens
cagaagtttgagaccagcctgcaagacatagggagatctcgtctctattttttttttttttttttactttttaaaaatggagttggtgctccttctttcaattctctcattcacttctg

SEQ ID NO: 12016 - DNA, 73 bp, Homo sapiens
tgtatatgtatatgtatatgagtatgtatacgtatatgtacatatatatacatactgtatatatatatataca

SEQ ID NO: 12017 - DNA, 90 bp, Homo sapiens
gcctgagggctggacacagacgatagacacgccctccaagccttgttcagaagctcagctgagtgtctttgtgtctgggaaacctgcagc

SEQ ID NO: 12018 - DNA, 75 bp, Homo sapiens
ctggctaattttaattattttagttttgaatgtgttaatcaaatacttgaaaattgaaaaggaagagaaagccag

SEQ ID NO: 12019 - DNA, 93 bp, Homo sapiens
gattggcatctaaggagacatctgtttttgttttttcttttgactctgtaatgagatgaattatattgatagatttcctaatgttgacccatc

SEQ ID NO: 12020 - DNA, 102 bp, Homo sapiens
ggtgtggtggtgcaagcctgtagtcccagctactcaggaggctgaggtagaaggatcacttgagcccaagaggttgaggctgcagtgattcatgatcacacc

SEQ ID NO: 12021 - DNA, 72 bp, Homo sapiens
ggtgacagagtgagaccccatctcaaaaatttttttttttttttttttgagatggagtctcactctgtcacc

SEQ ID NO: 12022 - DNA, 58 bp, Homo sapiens
tgagtcagagtctcactgtgtcgcccaggctggagtgcagtggtgtgatcctggctca

SEQ ID NO: 12023 - DNA, 77 bp, Homo sapiens
gccttggcctcccaaagtgctgggattacaggcatgagccaccatgcttgatctatttttattttttgagataaggt

SEQ ID NO: 12024 - DNA, 58 bp, Homo sapiens
tgagacagagtctcgctctgtcacccaggctggagtgcagtggtgaggttttggctca

SEQ ID NO: 12025 - DNA, 57 bp, Homo sapiens
tgagacggagtctcactctgtcaccaggctggagtacagtagtgtgatctcggctca

SEQ ID NO: 12026 - DNA, 115 bp, Homo sapiens
tgtttactgtctcacactgcattttttaagggatgttttatgtattaggtataaagtatctatattcttttagaaaattttctttaaaaatatgcttgattgccaccagtgggca

SEQ ID NO: 12027 - DNA, 58 bp, Homo sapiens
tgagacagagtctcacactgtctccctggctggagtgcagtggcatgatcttggctca

SEQ ID NO: 12028 - DNA, 115 bp, Homo sapiens
agaagaaatctcattttatttggttggaacacaaattttgtgccaaagtaaatatcttagtatttaatactgtaagcactttgtgtccttccagtccatatgccataattctttc

SEQ ID NO: 12029 - DNA, 115 bp, Homo sapiens
gccttctgagtagctgggatgacaggtgcctgccaccacgcctggctttttttttctttttactttttaaatttttttgagccagagtcttgctctgtcacccaggctggagtgc

SEQ ID NO: 12030 - DNA, 66 bp, Homo sapiens
cctgggtgtggagtaagtctttgttcctttttttttttgagacagagtctcactctgtcacccagg

SEQ ID NO: 12031 - DNA, 109 bp, Homo sapiens
agtctgactttcacttctttagaagatttttgtgtgactctgttttattttgttttaactgcagacaaatgccacagagcacttttctgctaaagaaaactgtctagct

SEQ ID NO: 12032 - DNA, 91 bp, Homo sapiens
gagatcttcctggttcttggtatgacaagtgatttctttttttttttgaaactggatatttggggtatcatgtaatgagactctgggtctt

SEQ ID NO: 12033 - DNA, 58 bp, Homo sapiens
tgagacagagtctcactctctcacccatgctggagtgtggtggtgtgatcttggctca

SEQ ID NO: 12034 - DNA, 73 bp, Homo sapiens
ctctgcaacactcaggcagtccctctctcaacagctttgggttgaggaaagtttgcccaggccagttgcgggg

SEQ ID NO: 12035 - DNA, 58 bp, Homo sapiens
tgagccagagtctcgctctgtcgctcaggctggagtgcagtggcacgatcttggctca

SEQ ID NO: 12036 - DNA, 68 bp, Homo sapiens
cagggcatgatggctaagattattggagtgaaaaagatacattatttttcattctagtcagagctctg

SEQ ID NO: 12037 - DNA, 89 bp, Homo sapiens
ctttggaaggcagaggtaggtggatgacttgaggtcagagttcaagaccagcctggccaacatagcaaaaccccacctctactgaaaag

SEQ ID NO: 12038 - DNA, 116 bp, Homo sapiens
tatttttatggtttggactcctcaggactttctgaaatctgaacatatataaagagaatcatctttctttatatatgtagacattcaagattctatggtggttttctatgaatatg

SEQ ID NO: 12039 - DNA, 79 bp, Homo sapiens
ccatagaatcttgaatgtctacatatataaagaaagatgattctctttatatatgttcagatttcagaaagtcctgagg

SEQ ID NO: 12040 - DNA, 102 bp, Homo sapiens
gcagctcttcctgagcccttctccagtctggactctgcagtggtgtcaatgtgactctcactctccttctggagtttatgggctttctctattcagggctgc

SEQ ID NO: 12041 - DNA, 77 bp, Homo sapiens
gtcaaaggggtttgttctctggctggcagaagtggggggtcacaaggtgctcagtcggggagctcctgagccaggac

SEQ ID NO: 12042 - DNA, 82 bp, Homo sapiens
gcctgtctctgggagtgaggggtgctgggctgtctcacagagtctctgccctctcacctgcctcctcttccaacccccaggt

SEQ ID NO: 12043 - DNA, 75 bp, Homo sapiens
catgagagaaggtcagtgaggagacaggggccaacttcctccatgcctcatactccaaccactgagaactctctg

SEQ ID NO: 12044 - DNA, 68 bp, Homo sapiens
gggcatggtggtgtgtgcctgtaatcccagctactcaggaggctgaggtaggaggatcacttgagccc

SEQ ID NO: 12045 - DNA, 111 bp, Homo sapiens
ttaggattgtcttggctatacaggctcttttttggttccatatgaaatttaaagtagttttttctaattctgtgaagaaagtcaatggtagcttgatggggatagtattga

SEQ ID NO: 12046 - DNA, 95 bp, Homo sapiens; identical to SEQ ID NO: 580

SEQ ID NO: 12047 - DNA, 93 bp, Homo sapiens; identical to SEQ ID NO: 69

SEQ ID NO: 12048 - DNA, 104 bp, Homo sapiens
tgcaagtctatatcccgatattttaagtgtctttttcaatttaaatttgaaggacacttataatgtgtgaaattaaatgggaatttggataaatattaattgca

SEQ ID NO: 12049 - DNA, 118 bp, Homo sapiens
tctctcacctcagcttcctgggtggctgggactatgcccagctaatttttttgttttttttttaaagatatatggggtatggctatgttacccaggctggtcttgaacttgggtctga

SEQ ID NO: 12050 - DNA, 69 bp, Homo sapiens
ctgggtctctgtgtgtgcctgagtggctgctctgctgggactccacacagctctgtttattggacccag

SEQ ID NO: 12051 - DNA, 95 bp, Homo sapiens; identical to SEQ ID NO: 6311

SEQ ID NO: 12052 - DNA, 100 bp, Homo sapiens
ccctgtgttttgattcatgccattttattcctattatttatccaaagggtaattaaaatttcttttttgatgatgtagatggaatatgaaaatagaaggg

SEQ ID NO: 12053 - DNA, 89 bp, Homo sapiens
gggcaggaggaagaggacttggttgtatagtaaaactgtaattcagttttacatagacctgtaatatattgttccttctactacctccc

SEQ ID NO: 12054 - DNA, 101 bp, Homo sapiens
gtatggactaaagtaaggattcaattttatttgttttcaatgtggacaatcacttgagcttgaaaacaggtaaaactaaggaatatattttgtagggatgc

SEQ ID NO: 12055 - DNA, 109 bp, Homo sapiens
ttataataaagtacataccataatatatatcacattttgtattacacatattacatgtttataactgtattatatgaaacatgtatatattatgtaatgtatattataa

SEQ ID NO: 12056 - DNA, 84 bp, Homo sapiens
tggagccgggtaaattcactgggtggctagacccagaagagagacaacaatcactgcagtttggcttacaggaagccacatcca

SEQ ID NO: 12057 - DNA, 70 bp, Homo sapiens
ctttgattagtgaaattgatcttttcttcatggttgattggtgagggagagggaagttgacctgttgaag

SEQ ID NO: 12058 - DNA, 95 bp, Homo sapiens; identical to SEQ ID NO: 6311

SEQ ID NO: 12059 - DNA, 102 bp, Homo sapiens
accaatgtcactcccagacggcatactgatggcagtagcttttgtaaattgtcctgagagaagctagtgtggtctgaaccatccccaggtgtgaatgttggt

SEQ ID NO: 12060 - DNA, 62 bp, Homo sapiens
cctaccaccaacaggccctgcgaatggcactgtcactctcacagggtctacaggaggccagg

SEQ ID NO: 12061 - DNA, 107 bp, Homo sapiens
ggggttagaattggtgtgtatcagagggtggcgggggggtgttgattaatttttattatacttctctactctttaaattcatttggtgaatatctatatctctctct

SEQ ID NO: 12062 - DNA, 62 bp, Homo sapiens
ggtgtcagaaatgagacagcactgtgcaaagcattgctacaagtggggtctgtgctctgccc

SEQ ID NO: 12063 - DNA, 99 bp, Homo sapiens
gtgcctcaaagccaccagacagggccccataaatctctctggctccctgtgtggaagccaggctgagatgatatgcagctctctgggtgctcccagcac

SEQ ID NO: 12064 - DNA, 114 bp, Homo sapiens
atatatacgtatatatgtgtatatatgtataggatttactatagaaaaatatttcatatttttatatattcatatattttatattatatattaaaaatatatgtacgtatgtat

SEQ ID NO: 12065 - DNA, 113 bp, Homo sapiens
ctagttctttgctcatgttgctctatctacttttggctggtgtggattattattaattatttcttcacagaatactagccaagagttatcatgatgcagtaatggtaaatgct

SEQ ID NO: 12066 - DNA, 115 bp, Homo sapiens
cagggagctgcttctaataaatttctaatgccttttcctgggggattgattgaacacaaagagctcagagctatcttccagccatctgcaagagatgcgtttttgtacacctttg

SEQ ID NO: 12067 - DNA, 222 bp, Homo sapiens
tgtgtgtatatatgtgtatatatgtgtatacatacatacatgtgtatgtatgtatatatgtgtatatatacacatatgtatatatgtgtatatatacacatatgtatatatgtgtatatatgtgtatatatatacctttctactggtttattgtcacatatgtatatatataaacatatatgtatgtatacatatatgtgtatatatgtgtatgtgtgtata

SEQ ID NO: 12068 - DNA, 115 bp, Homo sapiens
agctgggactacacgtgtgcactaccatgcccagctaatttttgtattttttttaaattttattattattatactttaagttttagggtacatgtgcacaatgtgcaggttagtt

SEQ ID NO: 12069 - DNA, 93 bp, Homo sapiens
ggtctttgatctatttcgagttaatttttatatattctatgaagtaggagccttccactcttttgtgtgtagatatccacttgtccaaggacc

SEQ ID NO: 12070 - DNA, 112 bp, Homo sapiens
tgctacattaacagttacatatttttaatgatatgtattaatatatattatatgattttgtcacatataatagcatatataaaacattggaactggatgacttgagggagca

SEQ ID NO: 12071 - DNA, 93 bp, Homo sapiens
agttcatattcccctgtatcagtgagaatggattttaaaagttcaagacttgtgtggatattatctcactgtcttccttcgggcagatgaagt

SEQ ID NO: 12072 - DNA, 94 bp, Homo sapiens
gtgtatgccaaggtgctaatgcacgtatctaaatatgtatttatatcatatgtaatgtttagagcatgtgcataggtgtgtggataacatacat

SEQ ID NO: 12073 - DNA, 117 bp, Homo sapiens
agggctgtctaatcgtctgtggtgtgtgtgtatacacgtatatatatatatatatatatatatatatatatatatatatatatatatacacacattcagatacatatatataggttt

SEQ ID NO: 12074 - DNA, 99 bp, Homo sapiens
gtgtgtatgtgttgtgtgtttcattttgtgtttttgtttttgagacagggtctcactctgtcatccaagctatagtgcagtggtacaaccttgactcac

SEQ ID NO: 12075 - DNA, 115 bp, Homo sapiens
tccttgctagtctcttcctctcccaagtttattttttgtttctggagccgagactgacatctttattttttatcatagacagaacaatggattgttggaagctgatgctgaagga

SEQ ID NO: 12076 - DNA, 108 bp, Homo sapiens
tcttgatctcagtgttggtaatacgtcattcattgttcttttttttttttttttttttttttttttgcgatggagtcttgccctgttgcccaggctggagtgcagtga

SEQ ID NO: 12077 - DNA, 80 bp, Homo sapiens
acagactgtaatttataagcatgtatatatttatatgtgtgtgtatatataggtatatatgtgtatatgtatagacatgt

SEQ ID NO: 12078 - DNA, 66 bp, Homo sapiens; identical to SEQ ID NO: 8248

SEQ ID NO: 12079 - DNA, 107 bp, Homo sapiens
atcctgttcaatttccttcacagccataggaagaaaacctgtaattctatatatttatctgtttacttgtatatttcctattctgtaaactctttgagagccaggat

SEQ ID NO: 12080 - DNA, 120 bp, Homo sapiens
atatgtatatatgatacatatatatcatgtatatatgatacatatgtacatatatatgtatatatgatacatatgtatcatatatatcaggtatatatgatacatatgtatcatatatat

SEQ ID NO: 12081 - DNA, 102 bp, Homo sapiens
gcatctgttattgtttgtctttttcatagtagccattataactgtggtgagatggtatctcactgtggttgtgatttgcatttccctgaggattacggatgc

SEQ ID NO: 12082 - DNA, 95 bp, Homo sapiens
accatatggactgattcaaaacatttataactttatgtttatgtaataaaacagaagcagtttagttttaaatgaatgtttctctaaattatggt

SEQ ID NO: 12083 - DNA, 58 bp, Homo sapiens
tgagatggagtctcactctgtcacccaggctggagtgcaatggtgaggtctccgctca

SEQ ID NO: 12084 - DNA, 107 bp, Homo sapiens
tatatatatgtatatggatgtatgtatagatatacacatatatacatgcatatatatacatatatatacatatataaggatgtgtatacatatatatatatatatat

SEQ ID NO: 12085 - DNA, 106 bp, Homo sapiens
attgcactttggtctgagagacagtttgttatgatttctgttctttttttttttttttttttttttgagacggagtctcgctctgtcgcccaggctggagtgcagt

SEQ ID NO: 12086 - DNA, 104 bp, Homo sapiens
caaaatggtggttccccatcctgcttatctgattggcttatctcactagagtagtgtgcacttagatctgactgaagcttgattctcctgcaatcttcattttg

SEQ ID NO: 12087 - DNA, 105 bp, Homo sapiens
gatggagggctgaatgtaacttttacctcaaaatttatgagattttttacatttttttttaattttatggggtagtagacagtagcaggattcagctttgccatt

SEQ ID NO: 12088 - DNA, 58 bp, Homo sapiens
gtgtatgtatatttgtacatgtgtgtgtatatatatgcacatatgtatatacatacac

SEQ ID NO: 12089 - DNA, 88 bp, Homo sapiens
tccatctcctgccttctctctcaacagactttgtgagtgctcaaaccaagtggggaaagacagtcaagagagagggaacagcatgtga

SEQ ID NO: 12090 - DNA, 110 bp, Homo sapiens
ttataggttttgttcctgcatatagatactctctccacaactcatattcttcttgagtttagttgagtgggaggcaggaaggcagagtgagaaggaactgggccatataa

SEQ ID NO: 12091 - DNA, 68 bp, Homo sapiens
gtacatatctttatctttgtatataatacatatctgtggtgtgtgtatgtatatataggtctatgtgc

SEQ ID NO: 12092 - DNA, 58 bp, Homo sapiens
tgagatggagtctcactctgtcacccaggctggagtgcagtagtgagatcctagctca

SEQ ID NO: 12093 - DNA, 58 bp, Homo sapiens; identical to SEQ ID NO: 9124

SEQ ID NO: 12094 - DNA, 81 bp, Homo sapiens
gtttccttgagaatcaaacagtagtaaaatggcctgaaagagtagtcattttatttctgtctgatatttgatgccgtgagc

SEQ ID NO: 12095 - DNA, 121 bp, Homo sapiens
agagactgctgctcatggcttctcacgccgcgctaaccggaaaagagcgggtctggtaatatttttatctttttttgcttcgggctggaaatgaggtaggctcagtagaagttctgagaag

SEQ ID NO: 12096 - DNA, 102 bp, Homo sapiens
ggaaacagggttaaagccaatcaagacagtaaaatgaaacaataagatttcttttatttttatttttaattttaatttttgagacggtctcgttctgttgcc

SEQ ID NO: 12097 - DNA, 176 bp, Homo sapiens
atatgtaatatatgtattatgtgtaatacatatgtaatatgtaatatgtaataatatgtaatatatattatatataatatatgtattatatattatatataatattatatattatatactatatattatatagtatatatatttatattatataatatatatataatatatatata

SEQ ID NO: 12098 - DNA, 97 bp, Homo sapiens
tacattgtattcatttatatctcttattttttatttgtacatgggtctgtttctatgatccgtgtgtatgtatgtgtgtgatatacatgtgtgtgta

SEQ ID NO: 12099 - DNA, 74 bp, Homo sapiens
gactgtcagtctctctgtgcctcagtttcttttttctagaatgaaggggcaatcaccagagtgtcttgaaggtc

SEQ ID NO: 12100 - DNA, 96 bp, Homo sapiens
caggaatgtgacctcagcaatatagatgagtggtgtattaatttttctttaagaataaagaatatatgcaaagatactctgaggtcttcatttttg

SEQ ID NO: 12101 - DNA, 120 bp, Homo sapiens
ggatcaagtctgctgtgagggagcttgaaactgggagagcagttgatttttttttttttttttttttttgagtcagaatctctcactttgtcgccaagctggagtgcagtggcgtgatct

SEQ ID NO: 12102 - DNA, 75 bp, Homo sapiens
caagggtcttcatccttgtcattttcttgttgagtaggctgaggaggagaaagaagaggaggagttcgttgccct

SEQ ID NO: 12103 - DNA, 116 bp, Homo sapiens
taaatatacataatgttgaacatcttttcatgtgcttaattgccatctgtgtatcttcttctgtcagatgtctgtccagatgattggatttttaatataataattatgtatcttta

SEQ ID NO: 12104 - DNA, 116 bp, Homo sapiens
gagttgtatgactagtgtttaagcacaaaattgaataagttcatttcctttaaattttaaaatttaaaataagtgtgttctctttgtggctaacttagacacataattaacaagtc

SEQ ID NO: 12105 - DNA, 90 bp, Homo sapiens
gtgatcttggcatggatatgtattgtttatttctatacatcctatataacagagatggagatggataattagacatattttgctgatcat

SEQ ID NO: 12106 - DNA, 74 bp, Homo sapiens
tgtatacgtatgtatatgtatatatgtattgtggtatatagaggagtacatatatacatgttagtttgtgtgca

SEQ ID NO: 12107 - DNA, 109 bp, Homo sapiens
gccatttactccttgtgtgtgaccctgaacatattacccagcctctctgtgactcatttataactctggaggtgataattgtaggcatttcacaggatgtccaagaggc

SEQ ID NO: 12108 - DNA, 61 bp, Homo sapiens
ctttccttctgaccacactcaatctgtctgttccaagacaaggttgatcaaagagggacag

SEQ ID NO: 12109 - DNA, 62 bp, Homo sapiens
gagactctctctctccctgttgctggatctggagattctacagctgcaaggaaaggagtttt

SEQ ID NO: 12110 - DNA, 58 bp, Homo sapiens
tgagacagagtctcactctgtcacccaggctagggtgcagtggtgagatcatggctca

SEQ ID NO: 12111 - DNA, 68 bp, Homo sapiens
acacgtgtatgcatttgtgtgtatttctctccttctctcagataaataataccatgctatacatgtgt

SEQ ID NO: 12112 - DNA, 67 bp, Homo sapiens
gagacagggaggctttgagatctttccaggacctactgaggtgttgagagcaaagatgtctgtttcc

SEQ ID NO: 12113 - DNA, 61 bp, Homo sapiens
gagcctgtatgatgtgtgtgaggtggcataaagacacacacacacatacacacagtgtatc

SEQ ID NO: 12114 - DNA, 117 bp, Homo sapiens
gagtcataggtttggtctctacataattctgtatctctcagaggcttcgttcattaaaaacattttttttttatttttgcctgaccgagttgattagaaggacttgtctttgagctc

SEQ ID NO: 12115 - DNA, 116 bp, Homo sapiens
cactgagttgtggggtgacttgttatgctgccttattgaacaataattgttaataattaaacataaattgacagatgaataacaacagcctatgccagttgagccctgaccttgtg

SEQ ID NO: 12116 - DNA, 79 bp, Homo sapiens
acacggtggaagggtttgggaaaacgaaaacaggagcgattcatgctctcttcactttctgtttgactctccatcctgt

SEQ ID NO: 12117 - DNA, 82 bp, Homo sapiens
tgtgtgtctgtgtatctgtgtgttacaatataaccagggcctgtcatttcttcctgttgttcatatgggaaatcgaggcaca

SEQ ID NO: 12118 - DNA, 99 bp, Homo sapiens
tgatgatttgcattgtctgggagccaggatagataagcaatttaaataatttttttgaagtttgattggtgtctatcttgtctgtttttgtatgtctca

SEQ ID NO: 12119 - DNA, 78 bp, Homo sapiens
ggggatgggactgctttcagtctgttgttaggaccatgtttggcaagcctgataccagggttacgtgtccccattctc

SEQ ID NO: 12120 - DNA, 95 bp, Homo sapiens; identical to SEQ ID NO: 68

SEQ ID NO: 12121 - DNA, 93 bp, Homo sapiens; identical to SEQ ID NO: 69

SEQ ID NO: 12122 - DNA, 82 bp, Homo sapiens
cccaagtttagtcagtcagactgtctctccaaagaattagaaacttgaaaatagagacatgtgggttgaaaaatgactgggg

SEQ ID NO: 12123 - DNA, 95 bp, Homo sapiens; identical to SEQ ID NO: 68

SEQ ID NO: 12124 - DNA, 93 bp, Homo sapiens; identical to SEQ ID NO: 69

SEQ ID NO: 12125 - DNA, 95 bp, Homo sapiens; identical to SEQ ID NO: 68

SEQ ID NO: 12126 - DNA, 93 bp, Homo sapiens; identical to SEQ ID NO: 69

SEQ ID NO: 12127 - DNA, 100 bp, Homo sapiens
agttttggaaagaggtattttatttatacagtgttgcttcaagtcagattgtgaagatttgacaagtgattgtgttgttgatagacattcaaacaaagct

SEQ ID NO: 12128 - DNA, 76 bp, Homo sapiens
tctgaacctcatcatgtccatttgaaaatatatataattatagtattttcctcacaggattgttatgagtttcagg

SEQ ID NO: 12129 - DNA, 93 bp, Homo sapiens
gccagagccgagcctgactctgattctctctccgtggcacattactgcctgtcagagaggaaaagaagacagagacacacaaggcaggtaggc

SEQ ID NO: 12130 - DNA, 117 bp, Homo sapiens
gggaggtgctaataataagaaatactgccaggtaattagagggtgagaggagactgaggtcagggtatttattcccttagtccccgtgatgggttctgaagttggctacattcctct

SEQ ID NO: 12131 - DNA, 120 bp, Homo sapiens
aggcctagggctcgtaggcatagatttttttcaggatagcaatttttcagattttgaagtagtcttatgacagctcagaatgcctgtctgggagtgcactaaccttcatatctactccct

SEQ ID NO: 12132 - DNA, 107 bp, Homo sapiens
tggtctcctgaactcaagggaggtgaatgattgggccagtggttatgatattgattatattagaatgtgctggagggtgaggtgtctgctttgtttgaggagtatca

SEQ ID NO: 12133 - DNA, 141 bp, Homo sapiens
tatgtatatacacatacatatatatataactttcagccttaattgtgtgtgtctgtgtgtgtatatagatatacccatacatatatgtgtgtgtgtgtgtatatatatatatatatgctgaaaggtacatgagtattaagg

SEQ ID NO: 12134 - DNA, 112 bp, Homo sapiens
tgtttcttcctcccagattgtctctgctttggatctggctaactctgtgtccctgtgaccctgctactcacctgatcctaccagaacaagcagggaagggaaatatggtcag

SEQ ID NO: 12135 - DNA, 115 bp, Homo sapiens
ccaattgaagcatcagtgaaatgttttaaatgactccatttaaacattggtacatatttttttttaaaagaaaccactctaaaatggaggcctttcattgatagacacaatgcgg

SEQ ID NO: 12136 - DNA, 95 bp, Homo sapiens
ctgagactgctttgagaaccatccaaggacaaaacctaaaaagatcctggatgcaaccagatctgtgtcactttctgtctccctaggctgttcag

SEQ ID NO: 12137 - DNA, 95 bp, Homo sapiens; identical to SEQ ID NO: 68

SEQ ID NO: 12138 - DNA, 93 bp, Homo sapiens; identical to SEQ ID NO: 69

SEQ ID NO: 12139 - DNA, 98 bp, Homo sapiens
cagtgtctatttttatttctattttattttatctttttgagatggagtctcactctgtctcccagactagagtgcaatggcatgatcttgactcactg

SEQ ID NO: 12140 - DNA, 91 bp, Homo sapiens
acttcagtagttattgtagagacatatgatatgtgagcacatattttatattttatttatgatatgtcattcaacaaatttatactgaggt

SEQ ID NO: 12141 - DNA, 75 bp, Homo sapiens
gaaatttagttgagatatatgtgtgtgtgtatatatatatgtatacacacacgtatacacacacacttttttttc

SEQ ID NO: 12142 - DNA, 58 bp, Homo sapiens
tgaggcagagtctcactctgtcacccaggctggagtgcagtggcgtgatcttggctca

SEQ ID NO: 12143 - DNA, 107 bp, Homo sapiens
tgtgtcttcggctagttttgggatttctttgcacttgattctctagttcttttagtttttatattaagttgttaacttgagatctttctaactttttgatgtgaaca

SEQ ID NO: 12144 - DNA, 101 bp, Homo sapiens
cggttgaggctgggtgtctggctggacaggctgagcatgtccatctgcagtgacagggggtctacgtcggctgacagccggttagaactcacttgcagctg

SEQ ID NO: 12145 - DNA, 84 bp, Homo sapiens
gtttgtttatttattttttgagatggagtctcacactgtcacccaggctgaagtgctgtggcatgatcttggctcactgcaagc

SEQ ID NO: 12146 - DNA, 92 bp, Homo sapiens
gtgaactgtcaatgtcacaccctggtttcaggtggttgttttggatctgctggacaagtatggtttggaaactgaaagttaggtgagttcat

SEQ ID NO: 12147 - DNA, 83 bp, Homo sapiens
tatatgtgtgtatatatacatatatgtatacatgtgtgtatatatgtgtatatatacatatatgtatacatgtgtgtatatat

SEQ ID NO: 12148 - DNA, 136 bp, Homo sapiens
gtacgtatatacatacacatatgtgtatatatacatatgtgtatatatatgtgtatatgtatacaaatatgtatatatgtacatatgtatatatgtgtatatatacacatatatacacatatatatgtacatatgt

SEQ ID NO: 12149 - DNA, 61 bp, Homo sapiens
ttgaggcagggtctcactctgtcactcaggctagagtgcagtggtgtgactgcagcctcga

SEQ ID NO: 12150 - DNA, 106 bp, Homo sapiens
tatctagagacctgggcatttggacactcagaggtacatttctgtttttcatgttacaatgacatgagagtggtgctactggcattcagtgagctgggcagtgata

SEQ ID NO: 12151 - DNA, 72 bp, Homo sapiens
ggcagcagccaaagaaagagcttgtgcagggaaactgcctccccccaacacagttgtttttttgttgttgtt

SEQ ID NO: 12152 - DNA, 79 bp, Homo sapiens
gtcccagaacttaagaggtgagttttccaacttaattattaattgaactgagaaaagtgactttctggagactgagggc

SEQ ID NO: 12153 - DNA, 58 bp, Homo sapiens
ctaactctccctctctgggcctcggttttcctttctctaaatgagggggtagggctag

SEQ ID NO: 12154 - DNA, 73 bp, Homo sapiens
gtggcatctccaatcctggcttttatttccaaggtcacttcagagtctgagatggtgctggggttccagccat

SEQ ID NO: 12155 - DNA, 83 bp, Homo sapiens
gagtttgttgttgtatgaaaagatacaactgaatattttttaaatgaagtgatttagatgttattttcatagtctgtagactc

SEQ ID NO: 12156 - DNA, 94 bp, Homo sapiens
ggctgggcatggtggctcatgtctgtaatctcagaactttgtgaggccaaggcagcggatcacctgaagtcatgagtttgaaaccagcctggcc

SEQ ID NO: 12157 - DNA, 75 bp, Homo sapiens
ggagtctgacactcatgacaaggaggatagagtgcttccagccaaatgactctttctcagtcagtgtaaacctct

SEQ ID NO: 12158 - DNA, 82 bp, Homo sapiens
ccccatgctttgctttgcaaagaacttagaaaaaggccctctgcatggctatgtaactgggttcttgccagtagaaatgggg

SEQ ID NO: 12159 - DNA, 84 bp, Homo sapiens
gggctgtgaggtctgatattccaattgtccttccagggaggaaaatcatccctggagtctcagagtcacagactcttatagttt

SEQ ID NO: 12160 - DNA, 69 bp, Homo sapiens
gtgtgtgtatatatatacataaatagggggtggggatgggcatgtgtgtgtgtgtgtgtgtatatatat

SEQ ID NO: 12161 - DNA, 112 bp, Homo sapiens
tgctttatctgcatgtaaatgaatattcctaggaggagagttttatttattttaaatttttggtttttttttagtaatttcagcttattttagatttgcgggtacatgtgca

SEQ ID NO: 12162 - DNA, 81 bp, Homo sapiens
gggcttgacactcactctcaggctcttttttgtggactttactggatattcatgagaaagatgagaggcaggtaagagtcc

SEQ ID NO: 12163 - DNA, 75 bp, Homo sapiens
tgtgtatatatacatatatacatacatgtacatataaaatacatatatgtatatgtatatatgtatataaataca

SEQ ID NO: 12164 - DNA, 131 bp, Homo sapiens
tgtatttatatacatatatacatatacatatatgtattttatatgtacatgtatgtatatatgtatatatacacaagatttttgatgaaaatttgggaggatatatatatatatacacacacatacatata

SEQ ID NO: 12165 - DNA, 87 bp, Homo sapiens
aatgttacatatgcaatgtgatggaagcctgggtccctgaatgactatatggattagcattcttctctcattgtgcatatgagtgtt

SEQ ID NO: 12166 - DNA, 61 bp, Homo sapiens
cagggctgggttgagaagtcagatttatatttccacactgacgctctctgactttgccttg

SEQ ID NO: 12167 - DNA, 83 bp, Homo sapiens
ggctttctgtctctgttgctggcagtctctcttaccctcttgcttgcttgctgccatgttgtgagttgcccgatggagatgcc

SEQ ID NO: 12168 - DNA, 67 bp, Homo sapiens
tgtttcacacatcagtcaaagctgggaactttttctcagtgtctctctttctattgttgtgtgaaca

SEQ ID NO: 12169 - DNA, 58 bp, Homo sapiens
gagaacagtgtcccagacgtgatggattctttttttttttttctggagacacagtctc

SEQ ID NO: 12170 - DNA, 108 bp, Homo sapiens
gtttatgtttaatctgcctcacaagactgagtgtgggaagagtgtagactctgtggccagagtgcctgaatctgaatcccagctctatctttgatttaccatgtgaac

SEQ ID NO: 12171 - DNA, 74 bp, Homo sapiens
cttctgtctccctctctcacctttgggtccctaattcctaatgtaatggtatttggaggaggagcctttaggag

SEQ ID NO: 12172 - DNA, 210 bp, Homo sapiens
atatatatatatatgtgtgtgtgtgtgtgtatatatatatatatacgtgtatatatatgtgtgtatatatatatatacgtgtatatatatgtgtgtatatatatatatatacgtgtatatatatgtgcatatatatatacgtgtgtatatatatacacgtgtatatgtgtatatatatacacgtatatatatatgtatatatatatacac

SEQ ID NO: 12173 - DNA, 99 bp, Homo sapiens
ctattaattcatctcataattaaaccaaggcataacacatgcatctggttgaaggttcatatgtcatgtcaagagtggctgtggaatgaattaagttag

SEQ ID NO: 12174 - DNA, 111 bp, Homo sapiens
tgccctggactcatagatctgtaagacagtgacagtagagagactgcagtccggacagacctggatcagatcctattttattgttattaattgactcgtgggtagaaggca

SEQ ID NO: 12175 - DNA, 89 bp, Homo sapiens
gagaatgtcagagtctggatgtgctgtgatgtgttaattattattttattgctatgaacttcacaccactgtcactgtggaaagttctc

SEQ ID NO: 12176 - DNA, 109 bp, Homo sapiens
ggggagtagtttgtcatctttggtcagtgttgattctgaaggtagcattttttctttttgttattaatacacccctaccagacttgcctttgaatgcaaacgctccacc

SEQ ID NO: 12177 - DNA, 113 bp, Homo sapiens
tttgattatcctccttgaacaaaatctatctgtgtacttctgattatcttcttgagatctttggagatattgaaacaaaaagcacaaaaaatgtttaaggcccttgatacaaa

SEQ ID NO: 12178 - DNA, 95 bp, Homo sapiens; identical to SEQ ID NO: 68

SEQ ID NO: 12179 - DNA, 93 bp, Homo sapiens; identical to SEQ ID NO: 69

SEQ ID NO: 12180 - DNA, 62 bp, Homo sapiens
gtttagtaaagcaggattggcagtggctcttccctgagttagattcagtgttgtttctaaac

SEQ ID NO: 12181 - DNA, 81 bp, Homo sapiens
gtggcgtcttgaataaagtcagctgttgtgcatgcaccccagcagacactggggaatgcacagacacattcactcacacac

SEQ ID NO: 12182 - DNA, 96 bp, Homo sapiens
tactttaacaaaacccttagtgacacgaatagacttttcttttagactttttttttttttgagatggagtcttgctctgtcacccaggctggagtg

SEQ ID NO: 12183 - DNA, 113 bp, Homo sapiens
gaagctgaccctgccacacaatgggaatgctccagcctggctgtgatgccgggaacatttctcaggctctttctgtcagtgcaccattgcccagcagggggcaggacaatttc

SEQ ID NO: 12184 - DNA, 84 bp, Homo sapiens
gggtctcactctgtgactgaggctgaagtgcagtgatgtgatcatggctcagtgcagcctcagcttcccaggttcaggtgatcc

SEQ ID NO: 12185 - DNA, 78 bp, Homo sapiens
gtctcctagcctcttaccggggaatgtcagtgaatatagtctttcattgtttgttcatgtcagtagaggctgggtgat

SEQ ID NO: 12186 - DNA, 116 bp, Homo sapiens
cttgaatgctgttgtgactgtgtatttttatgttgcttctctttaataaaaaagaaattgacttttttttttttcttttagaaaatgtgaactaggctgggcgcggtggctcaagc

SEQ ID NO: 12187 - DNA, 81 bp, Homo sapiens
tatgtctgtgtgtgtctgtgtatgtatttaggttgacagatgggtataacctttttacaaaataggatcatgctatacatg

SEQ ID NO: 12188 - DNA, 107 bp, Homo sapiens
gtgctttttttttgaagtttaacaggtgccgtttaggatttttctgattttttatattggctcacatcctagactatttatttggtaaaaatctaggagaaaattat

SEQ ID NO: 12189 - DNA, 111 bp, Homo sapiens
ggttgtcccaaacaggggtgctctacaaacaggttcattgtcacaggtttttttcttttttctttttttttgcggcattgtctccctttgtcactcaggctggggtgcacc

SEQ ID NO: 12190 - DNA, 107 bp, Homo sapiens
gtatctccttttcatcctggagtggctttagaaagcaagtagtgcaagatattttctttttttcaacctttcttgcccaaagggatgagtcaaattcagtgaaatac

SEQ ID NO: 12191 - DNA, 104 bp, Homo sapiens
taccatgctgttttatcacatagctgtccaactgtctatcactctgtctacctttttgggctttttcagtgatgtttctccagcatttcaaaggcaccatggta

SEQ ID NO: 12192 - DNA, 79 bp, Homo sapiens
ggagtctcactctgtcacccaggctggagtgcagtggcgtgatctgcaacctccgcctcccgggttcaagtgattcttc

SEQ ID NO: 12193 - DNA, 76 bp, Homo sapiens
gaaggagagagagagcacaaagggggaactgcaaacacttttaaaaccatcagctcttgtgagaactctctcagtc

SEQ ID NO: 12194 - DNA, 127 bp, Homo sapiens
tccagctttgttctttttgcttaggattgtcttggctatacgggtcttctttggttccatatgaaatttaaagtagtttttttctaattctgtgaagaaagtcaatggtagcttgatgggggtagca

SEQ ID NO: 12195 - DNA, 87 bp, Homo sapiens
gtcttttcactgtaacactatgtgatgaaagaggtgggggtctctggcatgtgctctctttctctctcaggtgttttttataaagat

SEQ ID NO: 12196 - DNA, 88 bp, Homo sapiens
gtgaagagagaatgagggggtggtggcgggggaggctggggtgggcagtgatggcttttctttactatctgattttatttaactatac

SEQ ID NO: 12197 - DNA, 106 bp, Homo sapiens
tatatatatatatatatacacacacacatatctgtatctatctatatacatatatatacatatatacacatatatatacgtgtgtatatgtatgtgtatatatata

SEQ ID NO: 12198 - DNA, 104 bp, Homo sapiens
gagcacaaaaaattgcgcacgggtagctttgactttctgtcacaaactctcagttttcctttaaactaaaatgtgtcaagtcaggggctgtgctgcatttgttc

SEQ ID NO: 12199 - DNA, 96 bp, Homo sapiens
tataataatatatacatagctatatatacatattctataatatgtatatacaatatatacatattctatatgtatatacatatgtgtatatgtata

SEQ ID NO: 12200 - DNA, 83 bp, Homo sapiens
cagtccccacctgatacaggtgttgtaaggattgaatgaaacatttcacagtagtcattcagcacagtagtaaggtaggaagg

SEQ ID NO: 12201 - DNA, 60 bp, Homo sapiens
ttgagattgagtctcgctctgtcacccaagctggagtgcagtggcgcgatctcagctcaa

SEQ ID NO: 12202 - DNA, 64 bp, Homo sapiens
tgagacagtcttgctgtgtcactcaggctggagtacagtagtgtggtcatggctcactgtagca

SEQ ID NO: 12203 - DNA, 83 bp, Homo sapiens
gctgctgcactctccctccccaaagtgcactgattctctctctgtgccagacagcagctgcctgggtgtgagggtggggtggc

SEQ ID NO: 12204 - DNA, 100 bp, Homo sapiens
gcaagcaactgcaggtgcaaccagactcttctgatttttttttaaaaaagggaagaaagatcatgaacaccctgaaagtagcaccagatcatttgaatgc

SEQ ID NO: 12205 - DNA, 111 bp, Homo sapiens
aacactggttaaatttttgtgtatatcatttgtctctgcaagtaaattgtatatttttttaaagcagagacttattctgtggttacagttttgggatttttcttttttgtt

SEQ ID NO: 12206 - DNA, 80 bp, Homo sapiens
gttgagctatgggcttatcaagtgtcaagttgtacatcaaagctattaatgtcgcttgcacttgtaattatgtagttcac

SEQ ID NO: 12207 - DNA, 90 bp, Homo sapiens
cccaaatctatctgtaaagtatgtatttttgttgcaggaggggctccctgggtcatcttgtgagaagagtgagattcaacatgggaggga

SEQ ID NO: 12208 - DNA, 115 bp, Homo sapiens
cagctcagcatccctggactgcatagtctaaacttggagggttgggaccaggttcacaggtttgttctctggcccctttaggtcaagttcctgctatgctggggtgactgaggtg

SEQ ID NO: 12209 - DNA, 97 bp, Homo sapiens
tcaccctgcagccactaccagagctcctggaactctggcccaaggctctctgactgactccttcccagatcttctcggcttagtggctgaaggctga

SEQ ID NO: 12210 - DNA, 111 bp, Homo sapiens
tgcttagaattgtcttggatatatgggctttttttttggttccatatgaaatttaaagtagttttttctaattctgtgaagaaagtcaaaggtagcttgatgggaatagca

SEQ ID NO: 12211 - DNA, 118 bp, Homo sapiens
tgtcatgagctgctcacctcaatgcaagacttggggtttagtgatagagcaactagatctgtcactaaattctacaaaactttgtaatgaaaaccacctaggagtaggaatcaagata

SEQ ID NO: 12212 - DNA, 93 bp, Homo sapiens; identical to SEQ ID NO: 69

SEQ ID NO: 12213 - DNA, 65 bp, Homo sapiens
ctcacagacactttacgtatgtatgtatgtatgtatgtatgtacgtatgtatctatgtatttgag

SEQ ID NO: 12214 - DNA, 88 bp, Homo sapiens
tagctgggcgtggtgatgtgtgcctttagtctcagctacttgggaggctgaggtagaaggatcacttgggcaccggaggctgaggctg

SEQ ID NO: 12215 - DNA, 67 bp, Homo sapiens
gaatctgggtgtggcttaggtggatcctctcactcagggtctctcacaaggctgcaatcacagtgtc

SEQ ID NO: 12216 - DNA, 95 bp, Homo sapiens; identical to SEQ ID NO: 580

SEQ ID NO: 12217 - DNA, 93 bp, Homo sapiens; identical to SEQ ID NO: 69

SEQ ID NO: 12218 - DNA, 106 bp, Homo sapiens
caatactggagaaaagtttattttcttgaatatggtaagtatgttctttacagtcttactgtaatatatatttttttactcagcaaatacttttccttaaatattg

SEQ ID NO: 12219 - DNA, 88 bp, Homo sapiens
gcctggagattcatatggtatgtttatgattattactattatgattgatgttattactgtagtgatggctgttttgaatttgcaaggt

SEQ ID NO: 12220 - DNA, 58 bp, Homo sapiens
tgagtcagagtctcactctgtcactcaggctggagtggagtggcatgatctcagctca

SEQ ID NO: 12221 - DNA, 135 bp, Homo sapiens
tgtgtgtgtgtatatatatgtatgtatatgtgtgtgtatatatgcatatgtgtatatatgtgtgtgcatatatacatacacacacacacacacacacacatacatatatatacacacaaacatatatatatatat

SEQ ID NO: 12222 - DNA, 97 bp, Homo sapiens
tgctgggatccctggtgtgagccaccgttctgtgagtttatgtatttttaaacaatgaacacagtttctgggatctgactcttaggactgcctagca

SEQ ID NO: 12223 - DNA, 56 bp, Homo sapiens; identical to SEQ ID NO: 324

SEQ ID NO: 12224 - DNA, 87 bp, Homo sapiens
taaggtaaggtaagggactgaactaggactgtcttctctctaaaactcacttcctcaccactcactctcttactctgtcttaccttg

SEQ ID NO: 12225 - DNA, 105 bp, Homo sapiens
gggtttgtcttaggtaaaccacaggggaagaaaaaatacagatatatttttattttagcagttctattcctgagaatagtggcgcctacttaagtaatatgaccc

SEQ ID NO: 12226 - DNA, 83 bp, Homo sapiens
cttaaatgattagagttcttgtctcgatcccagcatctcagcatggtcttgtgtgatattgatgttctgtgaaatcgtttggg

SEQ ID NO: 12227 - DNA, 105 bp, Homo sapiens
tttgcagcactgtggtgggatctcgggaggtaggtcagtctaatgggtcactttctgtctgactatgtgatgtggccatttgtattcttctgcagctgctccagg

SEQ ID NO: 12228 - DNA, 110 bp, Homo sapiens
tgcttacaattatcttggctatatgggctcttttttggttccatatgaaatttaaagtagttttttctagttctgtgaagaaagtcaatggtagcttgatgaggatagca

SEQ ID NO: 12229 - DNA, 80 bp, Homo sapiens
ggagtctcactctgtcacccaggctggagtgcagtggtgcaatcatagctcactgtgaggtggaactcctgggctcaagc

SEQ ID NO: 12230 - DNA, 115 bp, Homo sapiens
gtgccctgattcaagtaaatttgtgcagggaatttttggagattttccttcatgaaaagataactgattatgttgatatttctctacgtcttgaaagttttgttctatcttgcac

SEQ ID NO: 12231 - DNA, 84 bp, Homo sapiens
ctaagaggtgtgaggtgatatcacagtgattttgatttatatccatgatgagtgatgttgagtacctttccacatacctgttgg

SEQ ID NO: 12232 - DNA, 204 bp, Homo sapiens
atatgtgggtatatatatatatatatatatatatatatatatatatatatatacacacacacacacacacatatatatacatatgtatatatatgtgtgtgtgtgtgtacatatatatgtgtatatatatgtgtgtatatatatgtgtatatatatatgtgtgtgtgtgtgtatatatatatatatatatatatatatatatat

SEQ ID NO: 12233 - DNA, 116 bp, Homo sapiens
gctttcattgtaaattttagccataaatgaggtatagatacagaaacacaaaatttgcttatttatataagagttgattctcatctttgtcttattacatttctagcagttggagc

SEQ ID NO: 12234 - DNA, 105 bp, Homo sapiens
ttctttgttaggtttatacagatacatttcttttgtaaaaatttttaattgataaataattacggggtacaatgtgatgttttgatgtatatttctattatggaa

SEQ ID NO: 12235 - DNA, 129 bp, Homo sapiens
gtctctggtgacatgagctctttttatttttactattctttttgagacagagtctcactctgtcacccaggctggagtaaagtggtgcggtggtatgattttggctcactgctacctccacctcccggg

SEQ ID NO: 12236 - DNA, 76 bp, Homo sapiens
gcctggtacaccatgtataagatttgagtgtgcaaatgcaatgcaaactaaacaattatgggtgtggtactcatgc

SEQ ID NO: 12237 - DNA, 115 bp, Homo sapiens
ataattttattcattcttacttacagactatcttaaaagggtttaatctcaatttgttcatctttctctactcagtcttgatgggaagctggtaggttgaatggaagaaagttat

SEQ ID NO: 12238 - DNA, 104 bp, Homo sapiens
catcacagaagggcaacctggggcatgactgtaaagaagcagaatatggaatctttttttttttttttgagatgcagtctcgctctgtcacccaggctggagtg

SEQ ID NO: 12239 - DNA, 74 bp, Homo sapiens
gcatcttgctgaatgagcgtaggcagtgggtaaatctctcccagctgcttctactgtgcattttatccatatgc

SEQ ID NO: 12240 - DNA, 115 bp, Homo sapiens
tctgggcatagtggtgtgcacctgtagtctaagctacttggaaggttgaggtaggaggatgtggacgatgtggatgaggctgcagtgagacatgatcacaccactgcactccaga

SEQ ID NO: 12241 - DNA, 129 bp, Homo sapiens
ttcacagcaaatgaatatacatatatatacatatatatatatgtatatatatatatatttttttttttttgaggtggagtttcactcttgttgcccaggctggagtgcaacggcgtgaactccagctca

SEQ ID NO: 12242 - DNA, 119 bp, Homo sapiens
attgctacaagcccacagctttagtgtactaagaatccactctcaaattttctttctttttttttttttttttcgagatggcatttcactcactcttgttgccccgggtggagtgcaat

SEQ ID NO: 12243 - DNA, 99 bp, Homo sapiens
cttaacaaattagccaggcatggtggcaaatgcctgtagtcccagttatacaggaggctgaggtagaaggatcacttgagcctgggaggttgaggctgc

SEQ ID NO: 12244 - DNA, 108 bp, Homo sapiens
atacattctgagaattgtgttgttaggtgattctgtccttgtgcacacatcatagagtgcacttacacgaacctggatggtagagcctactacacagttaggctgtat

SEQ ID NO: 12245 - DNA, 99 bp, Homo sapiens
attatgtgttgagctaataattgggtattacagtgttattttatatattattttttgagatggaatctcactctgtcgcccaggctagagtgcagtggt

SEQ ID NO: 12246 - DNA, 58 bp, Homo sapiens
tgagatggagtctcactctgtcacccaggctggagtgcaatggtgcgatctcagctca

SEQ ID NO: 12247 - DNA, 96 bp, Homo sapiens
ttgcaacctgggtggagatctttccttgggtgtgtaaaaatctatttatttaagcatttaggctatttctagttgttattaaaatttgggttgcag

SEQ ID NO: 12248 - DNA, 97 bp, Homo sapiens
ataggatattatatatatatgtatatatattatatatatgtatatatacgtgtgtgtatatatgtatgtgtgtgtgtatatatatatctatatataa

SEQ ID NO: 12249 - DNA, 212 bp, Homo sapiens
tatatagtatatataatatactattaaatattgtaaataatatactgatatataatagtacatattatatattttaattaatatttattatattatataatacatactacatataacagtgtatgttatgtataatactatgaatagtatactagtatatacactagtgtatatattttatattatatatatgtatatatacacacatacat

SEQ ID NO: 12250 - DNA, 141 bp, Homo sapiens
agcatggattctgtacccgtacctaaacgagtcatgatcaggagaatgtggtgcttggacagactagtcatattcttcttctggagttgggaggtatatactaggattgagaagagctgagacactatggttgtgattatg

SEQ ID NO: 12251 - DNA, 65 bp, Homo sapiens
tggagacagtgcacactgcggtgacgatttattttaatataaatgctgcagtgctgtactttcca

SEQ ID NO: 12252 - DNA, 84 bp, Homo sapiens
ctagcctggcaacatagcaagacttgtctcctttttttttttttttttttttgatacagagtctcactctgtctcccaggctgg

SEQ ID NO: 12253 - DNA, 91 bp, Homo sapiens
ggccctgaggactggaactggaaccaggccagggacaaagctctcctgtccgtctctctgtctcatgggccatcgagttgcagccctgtgg

SEQ ID NO: 12254 - DNA, 74 bp, Homo sapiens
tgctttttgagactgagtctcacttactctgttgcccagactggagtgcagcgacgtgatctcggctcactgca

SEQ ID NO: 12255 - DNA, 88 bp, Homo sapiens
acatatatacacacatgtatgtgtgtatatatacatgtatatatgtatgtgtatatatataaacacacacacgtgtgtgtgtgtgtgt

SEQ ID NO: 12256 - DNA, 84 bp, Homo sapiens
gacaggttttttttgtttgttgttttgtttttgtttttgtttttgagagagagagagagcaagagtgagagagagattgaagtc

SEQ ID NO: 12257 - DNA, 112 bp, Homo sapiens
aaatggtggaatggcagaggaaaataaaaattggttcctgactaaaagttattgtatatgaattatagtgcctatgaccatagtcagtgcatcttttgactttttcatattt

SEQ ID NO: 12258 - DNA, 69 bp, Homo sapiens
agagattgtaggatgtttagtggtatcgtagtcttttatccactagatgctagtagcacctgaccctct

SEQ ID NO: 12259 - DNA, 76 bp, Homo sapiens
ttttgcatttgaatgtgtatatatatatatatatatatatatatatatatatatatatataaagcagtttgcaaaa

SEQ ID NO: 12260 - DNA, 95 bp, Homo sapiens; identical to SEQ ID NO: 68

SEQ ID NO: 12261 - DNA, 93 bp, Homo sapiens; identical to SEQ ID NO: 69

SEQ ID NO: 12262 - DNA, 96 bp, Homo sapiens
ttctgcatttaatgctcattgttaggaaccaacgaaggtgcagagaagtttcagagtctctgtctgtcttcaaggtcattgcaatttaatggggaa

SEQ ID NO: 12263 - DNA, 108 bp, Homo sapiens
tcatcattttaaaatactttatatagtatttacaaatgcttattgtgagtttgaatatttttcattcatagttgtataaatactttatatagtattttaaaaggggga

SEQ ID NO: 12264 - DNA, 84 bp, Homo sapiens
gcacattctgcattttttttttttttttttgctgttgagtgaatagataactgaatagatggatgaatagatgtttgaatgtgt

SEQ ID NO: 12265 - DNA, 88 bp, Homo sapiens
gtttttgtggtagcaggtgtcattgttttatttcatcctttttattttttattttttttgagacagacactcgctctgtcaccaaggc

SEQ ID NO: 12266 - DNA, 83 bp, Homo sapiens
aagaggtagtggtggtggtggctggtggaggtgggggatctgttgtatatactcacataaacagacacagcacactttctctt

SEQ ID NO: 12267 - DNA, 118 bp, Homo sapiens
agacttccagtgctatgctgaatagaagtggtgaaagtgggcattcttgtcttgttccagttctcaaggagaatactttcaacttttttccattcagtataattttagctgtgggttt

SEQ ID NO: 12268 - DNA, 78 bp, Homo sapiens
ttgccccagaaagcacagtgaatttagaggaaggtcaattgatgggttcttctggaacatggtagttttctttggtaa

SEQ ID NO: 12269 - DNA, 134 bp, Homo sapiens
ggtggtgattagcttcaggtacagatggagccaggtgctaaaacagtgttgtcagggggtggctgcctctttccatctcttgtcttgctttctcattgtctccttcattcttagctctctcatttctctttgta

SEQ ID NO: 12270 - DNA, 109 bp, Homo sapiens
gtcccttagtatttgggtgaccttgggtcaatttcttagcctcagtttactcttctgtaaaatgattttgttgttgataataggtacctgtctgggttgttgtaaggat

SEQ ID NO: 12271 - DNA, 113 bp, Homo sapiens
ctgtatagcccctaactcctcagtggatgatttgacttctttcatttttcttttttctttgagacaaagtcttgctctgtcgcccaggctggagtgcagtggtgcgatctcgg

SEQ ID NO: 12272 - DNA, 111 bp, Homo sapiens
gggattaatgacatacccactgtgtgctagaccacagagtgggcacagagggatgaaaaaataaaaattcctgcccttgaggagctcacagtctaagctgtcaataataac

SEQ ID NO: 12273 - DNA, 70 bp, Homo sapiens
atgtactacacacatgtggaagcataaattcagggtgtgtgtttgtgtgtgtgtgtgtgtgtgtgtgtgt

SEQ ID NO: 12274 - DNA, 86 bp, Homo sapiens
ccccactcagtgccaggcactgtgtttggcattggaaatagatgagacacagtccctgtcctcgagcagctgaccattttgtgggg

SEQ ID NO: 12275 - DNA, 60 bp, Homo sapiens
tgagacagggtctcactctgtcacccaggggctggagtgcagtggtgtgatctcggctca

SEQ ID NO: 12276 - DNA, 89 bp, Homo sapiens
attccaaatttctgagaaaatctgtcccaattaaagtctgagactcactctttcatgagctcatagtggcagttctcagagaatgggat

SEQ ID NO: 12277 - DNA, 174 bp, Homo sapiens
aaacgattgtggtgaaagagatggtgaattaatatatggaaagtgtctcgcacagtgtctggcatccacaaagcactatattctctgttttgttgttgttgtttttgtttttcattgtcaaaggaggtgaacgaagcactagattcttgtcactttgtgtgatgattaaggtca

SEQ ID NO: 12278 - DNA, 91 bp, Homo sapiens
atagaatcaacaggagatacatacatatatacatatatatgtatgaatatatctaaatgtatatctgtatgtatctccatatatattttat

SEQ ID NO: 12279 - DNA, 66 bp, Homo sapiens
ggagatacatacagatatacatttagatatattcatacatatatatgtatatatgtatgtatctcc

SEQ ID NO: 12280 - DNA, 86 bp, Homo sapiens
gttactaagtaggaaggggaaaatggatatggggtggcacctaacggtctctttctcttttctcatttatttatttatttagagac

SEQ ID NO: 12281 - DNA, 65 bp, Homo sapiens
ggtgctagaacaggatgcaagagggttagcccaggcccccacacctctctgtcagtctcagcact

SEQ ID NO: 12282 - DNA, 76 bp, Homo sapiens
tacatacatgtatatgtatgtgtttgtatatatatgtgtgtgtgtgtatatatacatatatatatatgaatatgta

SEQ ID NO: 12283 - DNA, 80 bp, Homo sapiens
gtgagtctttatgtatttattaatccatacacatttaatagataatattaatacatatttactaatacataaagactcac

SEQ ID NO: 12284 - DNA, 95 bp, Homo sapiens
gagggtctgctgcaggtcaggtgagaggaggaagagaagaaactactcagagctctgtgtgtgtgagtgtccctctttaattttgggcttatgta

SEQ ID NO: 12285 - DNA, 68 bp, Homo sapiens
gggcatagcggcatgcccctgcggtctcagctacttgggaggctgaggtaggaggatcacttgagccc

SEQ ID NO: 12286 - DNA, 81 bp, Homo sapiens
atggcaaaagaaagtgcgagtgtcactgccaagagagacagggacatctcccagtttctgtcagtgtcagtgtgttgtcat

SEQ ID NO: 12287 - DNA, 88 bp, Homo sapiens
gccaggtgtgcaactgttagctaacaggtggtataagcgttaagatgcccaataacctgttctcacatctgtctctgtataccgtggt

SEQ ID NO: 12288 - DNA, 70 bp, Homo sapiens
atggaggttcaagggaggaaacagaggagcagggactggctggcaactctcactgttactctcaccccat

SEQ ID NO: 12289 - DNA, 95 bp, Homo sapiens
agcagtagatctcaccttgttttctgtctctcaggatcactgtctttcattgcctgaagttcagagtttggaaagccatggttttgtgtattgct

SEQ ID NO: 12290 - DNA, 120 bp, Homo sapiens
ccaggtaatacatatgcaccatgatgtttggaacaccccaaagagttctgactatgttgaagtcatcattaccagctgacacttttcattcactctcaatattgtggattcttggatctg

SEQ ID NO: 12291 - DNA, 80 bp, Homo sapiens
agagtatgggctctggagccagctggcagcttcagatctcttctctgtctgtatggccttggacaagccatttaaactct

SEQ ID NO: 12292 - DNA, 96 bp, Homo sapiens
actcatttccgagtacttagagaacatggactcagtcatttcttctttgattggattagagtacagatgatgttcttcagatttggaactttgagt

SEQ ID NO: 12293 - DNA, 58 bp, Homo sapiens
tgagatggggtctccctctgtcactcaggctggagtgctgtggcatgatcttggctca

SEQ ID NO: 12294 - DNA, 102 bp, Homo sapiens
gaccactcattctgaagtagctacagggtctctaatgcatcacagttttttattttctgcatatcaatgcaatagcctgttatctgctattttttcagtgtc

SEQ ID NO: 12295 - DNA, 105 bp, Homo sapiens
aacttcaaaatgtgttatccagtttgtactctaacttttgtatttttttaattttttttaaattatactttaagttttagggtacatgtgcatattgtgcaggtt

SEQ ID NO: 12296 - DNA, 116 bp, Homo sapiens
tatatgtgtattcatggacatatatttatttattacatgaatgtgttatatatgtatatatgtcaatatatgtttatgtgattggatatttatatgcatgaatatgttaacatata

SEQ ID NO: 12297 - DNA, 79 bp, Homo sapiens
gagtcgagctgggtttattcagattccctctctctctctcaaaccagggagatacgataaggatgaagatagccatctc

SEQ ID NO: 12298 - DNA, 113 bp, Homo sapiens
ctgcctggagaagaccccagacacagggctgaggtttggcacagggctgtctgtcctctgtgtctgtcaatgtgtgtgcgggtgtgggggtgggaggcttctgagaaagcttc

SEQ ID NO: 12299 - DNA, 99 bp, Homo sapiens
acatatatattatacaatttatatcaaatatatattatatgatatataaaatatgtcacatttgaagtatattacatataactgtgtgtgtgtgtgtgt

SEQ ID NO: 12300 - DNA, 71 bp, Homo sapiens
cacttgtataaggcacttactctggagcttataggactggaagttgctctgggtgagtcagtgagtgagtg

SEQ ID NO: 12301 - DNA, 83 bp, Homo sapiens
cacaaatctctctgcttcttctaagtctttcaaatgatttggttgaaagtatgtgagaatagaagctagagtgattttctgtg

SEQ ID NO: 12302 - DNA, 105 bp, Homo sapiens
tttgagaacacagataaaaggagacattgatgcttagagactctaagtgtttgcccaaggtcacatagttaataggtgtcagtgctggtttcaaattcatgtctg

SEQ ID NO: 12303 - DNA, 86 bp, Homo sapiens
gcacagatactgtgttttatttatcattgtattcttagcacctcaagtggtgcctagcatgtagtagtgacttaataaatttgtgc

SEQ ID NO: 12304 - DNA, 89 bp, Homo sapiens
gacttgctaatctcgtatagtcacagccctcttctgacctgtatctggatatatgtgaagcagaggctgtgttgagatgtagtgagatc

SEQ ID NO: 12305 - DNA, 114 bp, Homo sapiens
aggtgtatacatatatataaaaaactgtgtgtgtgtgtgtgtatatacatatatatgtgtatatatatgtatatatacacacagacacagtttttcatgtatatattttttcct

SEQ ID NO: 12306 - DNA, 82 bp, Homo sapiens
atgaaaaactgtgtctgtgtgtatatatacatatatatacacatatatatgtatatacacacacacacacacagttttttat

SEQ ID NO: 12307 - DNA, 67 bp, Homo sapiens
atatatttgtgtgcatgtatgtgtatgtcatatatttatatattcattcatatgcacatatgtatgt

SEQ ID NO: 12308 - DNA, 103 bp, Homo sapiens
tgtaatgagtctgttcataattttttgcacatatttctttattattattattattatactttaagttttagggtacatgtgcacaacgtgcaggtttgttaca

SEQ ID NO: 12309 - DNA, 110 bp, Homo sapiens
gggactaaattggataaaacaataaactttcttcttgaaaggaatagatgagttatatattttcttatttttttctagaagaatttttaaagttatagaatcacttgcct

SEQ ID NO: 12310 - DNA, 58 bp, Homo sapiens
tgagacagggtctcactgtgtcactcaggctggagtgcagtggcacgatcttgactca

SEQ ID NO: 12311 - DNA, 74 bp, Homo sapiens
atgtgtgtgtgtgtgtatgtctgtgtgtatgctggtgtgcatgtgtgcatgtaggggtgtgtgtgtgtgtgtgt

SEQ ID NO: 12312 - DNA, 112 bp, Homo sapiens
aatgtacaataagtataatagaaagagggaatgtaagtgttgtttttttttttttttcagataaatggaccattgactgtgttctcctggtgtattgtacacattgcatatt

SEQ ID NO: 12313 - DNA, 108 bp, Homo sapiens
actggtatgagtccaagagtccacaggctgatgaacttggagtctgatgtttgagagcaggaaggatccagcacaggaaaaagatgtaggcctgaagacttagccagt

SEQ ID NO: 12314 - DNA, 95 bp, Homo sapiens; identical to SEQ ID NO: 68

SEQ ID NO: 12315 - DNA, 93 bp, Homo sapiens; identical to SEQ ID NO: 69

SEQ ID NO: 12316 - DNA, 111 bp, Homo sapiens
taggatagatgtacaggaataaaattctgggtcatatggtagttgcatgtttaaatatttaagaaactgctaaactgctttccagagtgtctgtaccatttcacagtccta

SEQ ID NO: 12317 - DNA, 143 bp, Homo sapiens
tatctatctacctatagatgtaaggtttccttagatgtaaggtttatatatgtatatatgtgtgtatatatatatagatgtaaggtgtatatatatgtatttaaggtatatagatgtatatatatagatgtatatatgtgtat

SEQ ID NO: 12318 - DNA, 93 bp, Homo sapiens
agtgagatcatacaattaaaacaaaacaaaaacagaaaaccttgggaaaattggatgctttttttgtttgttttttttagacagaatctcact

SEQ ID NO: 12319 - DNA, 82 bp, Homo sapiens
agatctatcttcttctcccaatagtaatgagcttagtgctcagtagagactgagaacagagtcaggtctagaagattgatct

SEQ ID NO: 12320 - DNA, 105 bp, Homo sapiens
caaaagaaaaattatttggaaacacagcacattgaaagggaacaacaagttttatttatttttgagccttcagtttagtgctggttactcaataaatgtttgttg

SEQ ID NO: 12321 - DNA, 85 bp, Homo sapiens
aagtattagaatatgtcgagtatatatatattacattatattagaatatgtcaactatatatacacttgacatattctaatactt

SEQ ID NO: 12322 - DNA, 81 bp, Homo sapiens
gaggccaaggcaggaagatcacttgagcccaggagttggagaccagcctgggcaacatagtgagactctgtttctgacttc

SEQ ID NO: 12323 - DNA, 104 bp, Homo sapiens
atttgttgaaaacttatgatctgttctgtgggtttttaacagtgcattttcatttaattttttataagacctacaaagcaagatcaaagacaaataaaacaagt

SEQ ID NO: 12324 - DNA, 79 bp, Homo sapiens
gagttactgcagagagaccacagtcagccaaagctgagctaaaatttgggattgaagtcaaagctgctgctaagagctc

SEQ ID NO: 12325 - DNA, 81 bp, Homo sapiens
gtgtagggaggggaacaaattctggcaatcttatttggctgagaggagagagagctgagtttggataagaaaaatctgcac

SEQ ID NO: 12326 - DNA, 73 bp, Homo sapiens
ggaggggcttccaggcgatgggtagataagagacaaatggttgtattcttttgagtttctgattagcctttcc

SEQ ID NO: 12327 - DNA, 101 bp, Homo sapiens
gtggtgtctagaaggaagaaagcttttagctgagaagaaattgaatcaatttttcattttaaagtcataaaggttttagtgttattaagccctagaaccac

SEQ ID NO: 12328 - DNA, 63 bp, Homo sapiens
ctcatttatgtatgtgtaaatatgtgtattcatggatatatatatatttattacatgaatgtg

SEQ ID NO: 12329 - DNA, 95 bp, Homo sapiens; identical to SEQ ID NO: 68

SEQ ID NO: 12330 - DNA, 93 bp, Homo sapiens; identical to SEQ ID NO: 69

SEQ ID NO: 12331 - DNA, 104 bp, Homo sapiens
gctgtagctgacattgtattgctattggatacttctggcctagaagcttgattagatttaggttaattcattttggcaagaatacttcatagttcggacacagt

SEQ ID NO: 12332 - DNA, 69 bp, Homo sapiens
gtttagttttgtgttttcatggagtctcattctgtctcacaggctggagtacagtggcacaatctgggc

SEQ ID NO: 12333 - DNA, 81 bp, Homo sapiens
gcgtgagtcaccatgaccaactggatgtaggctcttttttctcagcttcacattgctcagggatcttggtacagctcatgt

SEQ ID NO: 12334 - DNA, 58 bp, Homo sapiens; identical to SEQ ID NO: 884

SEQ ID NO: 12335 - DNA, 56 bp, Homo sapiens; identical to SEQ ID NO: 885

SEQ ID NO: 12336 - DNA, 63 bp, Homo sapiens
ccagcccagagcacacttttttttttcttttgagatggagtctcactctgtcacccaggctgg

SEQ ID NO: 12337 - DNA, 77 bp, Homo sapiens
ggaagcctctctctctctctgcgaggggttgaagttaacttccttatttctgaagtagggaagaaaatgaggatgcc

SEQ ID NO: 12338 - DNA, 82 bp, Homo sapiens
gggcataggctggctcggtgtctctgtctgtagcaggggctggagcctcatactgcaccagagtctcttggccgtttttccc

SEQ ID NO: 12339 - DNA, 76 bp, Homo sapiens
caggtgaaccccatttgtctctcccactccttcctgaccatctcaggactggaatgaagtgaggctgaaccacttg

SEQ ID NO: 12340 - DNA, 119 bp, Homo sapiens
gtgtaaaacaaaaaatatatatatatgtgtgtatatatatatacacacacacatatatatacatatatacacgtatatatatgtatatatagatatatacgtgtatatatacatatata

SEQ ID NO: 12341 - DNA, 60 bp, Homo sapiens
gtgagatggagtctcactctgtcacccaggctggagtgcagtagcgtgatctcagctcac

SEQ ID NO: 12342 - DNA, 82 bp, Homo sapiens
gctttgggagaagtccaactctagataaaattctaatgtatttcatgcttgtgttcagagtttctttttctctctccaaggt

SEQ ID NO: 12343 - DNA, 73 bp, Homo sapiens
tgacgaaatgccatgttagagttctctttttgtttatcttaacagttaaataaactttagcaggtaatagtca

SEQ ID NO: 12344 - DNA, 120 bp, Homo sapiens
tgcttaggctagttttggctccacaggctcttttttgcttccatatgaaatttaacatagtttttttctagttctgtgaagaaagtcaatggtagcttgatgggaatagcattgaaccta

SEQ ID NO: 12345 - DNA, 101 bp, Homo sapiens
gcaagacactgttgtcagaaaaggatgggtttcattttatattattttcatgtacttgattatttatgatattagaactgggatctcaggagtggccttgc

SEQ ID NO: 12346 - DNA, 101 bp, Homo sapiens
ccagtatgatgtggtccagtcaggctttttttattttattttttgagacggagtctggctctgtcacccaggctggagtgcagtggcgcgatctcggctca

SEQ ID NO: 12347 - DNA, 88 bp, Homo sapiens
gaaacggaagtcaaacataagtcatttctgctggtatgaaaagagcaagttttaagggacaggtagaagaatgtttgaatttcatttc

SEQ ID NO: 12348 - DNA, 89 bp, Homo sapiens
tggtaatatatatgtgtgtgagtatatatatgtgtgtgtatatatgtgtatatgtatatatgtatacatacatacatacttatgtatca

SEQ ID NO: 12349 - DNA, 78 bp, Homo sapiens
ctcataaggtaccactgtttgccgattatcatgtaagatttaattttattgatcattgcttataatgtgtgcctagag

SEQ ID NO: 12350 - DNA, 69 bp, Homo sapiens
tagtgcttatatatgcacatatgcatatatatatataaatatagcaatgtgtgtgtataaattgtacta

SEQ ID NO: 12351 - DNA, 100 bp, Homo sapiens
cacagttctggaagctggaagtctgagatctaggtgttagcagaattggtttcttctgaggttgctctccttggcttgcagatggctgcctccacctgtg

SEQ ID NO: 12352 - DNA, 111 bp, Homo sapiens
acccctccaagcatctttatttcccttttaagtttttaaacaaatgtgtgtgtatatgtttgtaaatatgtgtatatgcatgtgtgtaatttggaaacgggaggagagggt

SEQ ID NO: 12353 - DNA, 107 bp, Homo sapiens
aaatgtacactatataatgtctgtgtgtatatatgtgtgtgtatattatatatatatatatatatatatatatatatatatatatacggaagaagtagaaatcattt

SEQ ID NO: 12354 - DNA, 95 bp, Homo sapiens
gagacatatgacaactaataacatatatatatatatatatatataataacataaatatatatatatatatttgtttttgtttgtttgtttgtttt

SEQ ID NO: 12355 - DNA, 95 bp, Homo sapiens
ccctagtgatacttgttataagttacagatacacacacagacacacacattctgtttgttagtttctctgtattacggcctaggtcaacccaggg

SEQ ID NO: 12356 - DNA, 116 bp, Homo sapiens
tggaccacaatttttttcctttttataccaatcagcaatatcctaccaaatgaatattctcaatttattttttaagtaggtgtttgaggataaggttacatcaaggttgttttcta

SEQ ID NO: 12357 - DNA, 113 bp, Homo sapiens
tgcatcacagggagtaagaggaaatatagcttgtttatttcagctggactttatgcatgaatgtatgtaagaatgtataaaagtgctatgtattcacactacagtgtgatgta

SEQ ID NO: 12358 - DNA, 156 bp, Homo sapiens
gtgcatgttgtgtgtgtgtgtgtgtatatatatgtctgtacgtatatatatatatgtctgtacatatatatatgtctgtacgtatatatatatgtctgtacatatatatgtgtgtgtctgtacatatatatgtgtgtgtctgtacatatatatatg

SEQ ID NO: 12359 - DNA, 79 bp, Homo sapiens
catccaggcagaatacaaacagttacttgttctcaccaaatatattttcacttgccctgtctgtgtgactgtcaggatg

SEQ ID NO: 12360 - DNA, 116 bp, Homo sapiens
attaggtttggtgggtttagggagatagggaatgtaggcttttttcttttctttttttttttttttttttttttttaagatggagtcttgctctgtcacccaggctagagtgtagt

SEQ ID NO: 12361 - DNA, 81 bp, Homo sapiens
gtgaagccgagtactctctataatatgggtgggcatcctctaatcagttgaaggtgttcacagaaaagactcaggtttccc

SEQ ID NO: 12362 - DNA, 97 bp, Homo sapiens
agagaagtttgagatgcagctgtggagatggcaggtggctgacactaactctctgtgtgagcttgggctagttactaagcttatctagcacatttct

SEQ ID NO: 12363 - DNA, 133 bp, Homo sapiens
gtatatatatactgacatatatatatacacatatacactgatatacatatatatatacatatatatgtatatatatgtgtatgtgtatatatatatatatatatatatatatatatatcagtagtttggtata

SEQ ID NO: 12364 - DNA, 164 bp, Homo sapiens
gtatatatattcatatatatgtatatatatatgttcataggtatgtgtatatatatgttcatatatatgtgtgtatatatatagtgtgtatatatatgtatatgtgtatatgtatgtgtatatatgaacattatatatatgtgtgtgtgtgtatatatatatat

SEQ ID NO: 12365 - DNA, 86 bp, Homo sapiens
gacattctggttcatccacactctgagtcactctaatatgttctaccacagtctagattaacttaaaagtatggatcaccaaggtc

SEQ ID NO: 12366 - DNA, 79 bp, Homo sapiens
ttctgtgtcactcagtggttccgtctccccgtggctgtatggaggtcacacgagggagatgtgccaactgcacacagaa

SEQ ID NO: 12367 - DNA, 106 bp, Homo sapiens
ggatatggaagtcacagagccgcctcctgaaagtcacgcttttcactctttttttttcttttttttttttttttgagagcgagagtttcactctgttacccaggct

SEQ ID NO: 12368 - DNA, 114 bp, Homo sapiens
acatttgccaggagtgactgacatcactttctttttatttatttattttactttatttttttaagttccggggtacatgtgcagaatgtgcaggtttgttacacaggtaaatgt

SEQ ID NO: 12369 - DNA, 71 bp, Homo sapiens
ggctcatttgcccctacatgattttttctttattacacttgactttgttccagaaaggatctgagggagcc

SEQ ID NO: 12370 - DNA, 116 bp, Homo sapiens
gcagtattttctcaatgatattttccttttcaatagcaaaggcaaagtaagttgtaataatataattatttaaggtgctgcattgaggtgtatacatatgagtggaaataaaatgt

SEQ ID NO: 12371 - DNA, 58 bp, Homo sapiens
tgagtcagagactcactctgtcactcaagctggagggcagtggtatgatcttggctca

SEQ ID NO: 12372 - DNA, 60 bp, Homo sapiens
tgagacgagtctcgctctgtcacccaggctggaatgcgacggcggcgcgatctcggctca

SEQ ID NO: 12373 - DNA, 117 bp, Homo sapiens
tagatacatatgcatctatatagatatgtatctatatagattatatatctagatacatatagattatctatatatctatatagatacatatatatatatgaaagctgctgtcctcta

SEQ ID NO: 12374 - DNA, 73 bp, Homo sapiens
atatatgtatctatatatgtatctatgtatctatatagatagattatatatctatgtatatagatatgtgtat

SEQ ID NO: 12375 - DNA, 58 bp, Homo sapiens
tgagatggagtcgcactctgtctcccaggctggagtgcagtggtgcaatctcggctca

SEQ ID NO: 12376 - DNA, 138 bp, Homo sapiens
catcttgactgtgtgtatgtgtgtgtatatatatatatatatatatatatgtatctgtgtatatatatatatataatctgtatatatatatatatatatatatatctgtgtgtgtgtatatatatatatgtcacctga

SEQ ID NO: 12377 - DNA, 99 bp, Homo sapiens
ttcctgagatttttttatcattttaaaggaaggtggaaacaagaataggaataagattttgtttgtttgttttttaattaatggtacgttgatcaggga

SEQ ID NO: 12378 - DNA, 83 bp, Homo sapiens
agtgcacttaaaattgtaattgaacattgcttcagtattgagttcattctctcaatcactgactttacaattttgtgtgtcct

SEQ ID NO: 12379 - DNA, 95 bp, Homo sapiens; identical to SEQ ID NO: 68

SEQ ID NO: 12380 - DNA, 93 bp, Homo sapiens; identical to SEQ ID NO: 69

SEQ ID NO: 12381 - DNA, 149 bp, Homo sapiens
tggctaacttgtagaatgtaactgtgaccaactgagagaagaaacactgcagaggaagcattttttttttttttttttttttttttttttttgagacggagtctcgctctatccgccaggctggagtacagtggggcgatctcggctca

SEQ ID NO: 12382 - DNA, 95 bp, Homo sapiens; identical to SEQ ID NO: 68

SEQ ID NO: 12383 - DNA, 93 bp, Homo sapiens; identical to SEQ ID NO: 69

SEQ ID NO: 12384 - DNA, 93 bp, Homo sapiens
caaccactttggctactcatgcatacatacatatatgtatatatgtatacacatgtgtgtgtgtgcacttatgtgcttcattatgtgttgttg

SEQ ID NO: 12385 - DNA, 75 bp, Homo sapiens
tacacacacacagagtgagacagagattatatagtatctatataatcgctctctgtctctccacgtgtgtgtgtg

SEQ ID NO: 12386 - DNA, 80 bp, Homo sapiens
gtcattctatagagtcagaaaagagagagaggtgtgtttaattgaagcctctctcaattttttcagaaacatggagggat

SEQ ID NO: 12387 - DNA, 84 bp, Homo sapiens
aggtgttttatatatacatatatattatatatatacacatatatagtgtgtatatatatgtgtgtgtgtgtatatattgtgtgt

SEQ ID NO: 12388 - DNA, 93 bp, Homo sapiens
tgagaaccaggggattgaacagtgtaactctcactctgaggacaaaagcctgagaatcaaaggggggctgctggtttaagccctggagtctga

SEQ ID NO: 12389 - DNA, 117 bp, Homo sapiens
tatataaaactctccactacaaaatttctcatatgtgtgtatgtgtatatatatgtatgtatacatataacacatatatatacacatataacacacacacagaaacatgtatatata

SEQ ID NO: 12390 - DNA, 94 bp, Homo sapiens
tacatgtttctgtgtgtgtgttatatgtgtatatatatgtgttatatgtatacatacatatatatacacatacacacatatgagaaattttgta

SEQ ID NO: 12391 - DNA, 111 bp, Homo sapiens
cactacaaaagttccttgtgtgtgtgtataaatagatatatatacattataagtatacatatatgtatatataaaactctccactacaaaagttgctcatatttgtgtgtg

SEQ ID NO: 12392 - DNA, 119 bp, Homo sapiens
gaaaagcaggtgggtctcagctacttctacataaagcattaccaaatatgtcaagtacataagatatattttaataatttttaatgagaagaggatgtgaattctcattacagtatttt

SEQ ID NO: 12393 - DNA, 97 bp, Homo sapiens; identical to SEQ ID NO: 1307

SEQ ID NO: 12394 - DNA, 88 bp, Homo sapiens; identical to SEQ ID NO: 1308

SEQ ID NO: 12395 - DNA, 81 bp, Homo sapiens; identical to SEQ ID NO: 1309

SEQ ID NO: 12396 - DNA, 77 bp, Homo sapiens; identical to SEQ ID NO: 1310

SEQ ID NO: 12397 - DNA, 106 bp, Homo sapiens
aatactttgtctatactctgctactggtggcagtagttcatttgctatattttatgtatattttgaagtacacacaattataggagcagatagtggatagtctgtt

SEQ ID NO: 12398 - DNA, 99 bp, Homo sapiens
cattttgtttcatggaagaaaacataattagttagattataaattataatttaaattataaattatgatgtaactctttaatccatatgaaaccatatg

SEQ ID NO: 12399 - DNA, 112 bp, Homo sapiens
tttataaattagtcagatccaaggaagtataaaattaagtctttatataaatttatctgggtaattatatttttaatattttcttggaaggaactggactgattaatgtaaa

SEQ ID NO: 12400 - DNA, 93 bp, Homo sapiens
atgtgggtctctctctctgtgtgcctgttaactggagatttgtttgttaattttttagctaaaataacagtccactgagtagaagacttatat

SEQ ID NO: 12401 - DNA, 88 bp, Homo sapiens
atgatcctttaaaaccagtcagcaaactagaacctctgggtcaagtccagatggcttctgtttttctaattgaattttactggagcat

SEQ ID NO: 12402 - DNA, 94 bp, Homo sapiens
gtgtttataaaatcttagagtgtaaagtctagggccagcctgctagggtatgaatttcagctctgccactcactcactttaagtaaccatgcac

SEQ ID NO: 12403 - DNA, 86 bp, Homo sapiens
tttgttgctgtgtagtattccatctcataaatagaccacaatttatttatgtattctcatattgatggagtattttcagctttgga

SEQ ID NO: 12404 - DNA, 81 bp, Homo sapiens
atgtgtgtgtgtgtaaaatggtggtaaatatatatattaaatttatatatattgggtagatatatgtatatacacacatat

SEQ ID NO: 12405 - DNA, 106 bp, Homo sapiens
tgccccacttcctccctgacactttgtatttaattttgaatttttaactaaacagaatttcttcttcattgtgcttgtttgatacaatgttagggttgcaaaggca

SEQ ID NO: 12406 - DNA, 58 bp, Homo sapiens
tgagatggagtctcactctgtcacccaggctggagtgcaatggtgtgatctcagctca

SEQ ID NO: 12407 - DNA, 56 bp, Homo sapiens
gagatggagtctcactctgtcacccaggctggagtgcaatggtgtgatctcagctc

SEQ ID NO: 12408 - DNA, 119 bp, Homo sapiens
tatatgtatacgtatacatatgtatatatgtatatatatatgtatatgtatatatatgcatatatgtatatgtatatatgtgtgtatatatatgtataggtatatatgtatacatttgc

SEQ ID NO: 12409 - DNA, 89 bp, Homo sapiens
tctttttccagctgtggttgtgtaaatatttagatatttcagtcactcatgtttatattttatcttccaactgggcagttgttgaagga

SEQ ID NO: 12410 - DNA, 103 bp, Homo sapiens
cttcttatatatatagcttcttgtatagcttctatatatatatagcttcatatatatatatatatgaaaggtatataattgagtattagtcatagataagaag

SEQ ID NO: 12411 - DNA, 79 bp, Homo sapiens
gtcacattttatttatctattctactgttgatgggcacctaggttggttccatgtctttggtattgtaagtagtgtgat

SEQ ID NO: 12412 - DNA, 86 bp, Homo sapiens
attggtactcctcactgaagagcctgtggagagacaatcatttcccctgtggttgctcttaggctctgggttgagtatgggctggt

SEQ ID NO: 12413 - DNA, 116 bp, Homo sapiens
gccctctgaccacacacagcacatgaagcaaatccaaacagtggatttctttttctttttttgaaatggagtctcaccctgtcgcccaggctggagtgtggtggtgtgatcttggc

SEQ ID NO: 12414 - DNA, 147 bp, Homo sapiens
aatatgtgtgtgtgtgtatgtgcatgtatacacataggaagactagacaatcatatatgtgtatatatatgtgtgtatacgtacacacatatttatatatgtatatatacatatataaatatgtatatatgtgtgtgtgtgtatgta

SEQ ID NO: 12415 - DNA, 97 bp, Homo sapiens
gttgttggtagagcatccaattgagaaatgtacaagttgcatatgttatgaaaaataatcgaagccttggactcagatgaagatatctacagacagc

SEQ ID NO: 12416 - DNA, 121 bp, Homo sapiens
ctgttagtaattgctatatatatatatttgctatatatatatatagcatgtatatatatagcatatattatagcatatatatatatatacaccataccacaaaactgcaaatatatatata

SEQ ID NO: 12417 - DNA, 113 bp, Homo sapiens
accaacagtgtataagcattcctttttctctacaaccttgccagcatctgttatttttttgactttttaataatagccattctgacgggtgtgagattgtatctcacggtggt

SEQ ID NO: 12418 - DNA, 109 bp, Homo sapiens
gtttatgtatttctgtaaggaacatttgaattctgaggttgtgtcactaaaaggtattagaaaattttatttttcataattttggaggttccagataatatacataaat

SEQ ID NO: 12419 - DNA, 94 bp, Homo sapiens
tatctgtggaaaaaagcagatgtgtgtgggaatcttccaagaaaagagacaaaagatttatttatatacatgtgcatataatagctcatgggta

SEQ ID NO: 12420 - DNA, 75 bp, Homo sapiens
tatacacacacataaagttgtttatgcgtgtgtgtatatatatataatgcatttcattgtgtgtgtgtgtgtgta

SEQ ID NO: 12421 - DNA, 129 bp, Homo sapiens
aagaagcagataatatattagatggaaatgtgtatatatataaaatatatatacatatatatatacatatatacatatatatacacatatatatatatatatatattttttttttttagacagagtctc

SEQ ID NO: 12422 - DNA, 65 bp, Homo sapiens
tacaagttctcttgctctctatctctctcttaggctgagattggagttggcagagatgcttagta

SEQ ID NO: 12423 - DNA, 90 bp, Homo sapiens
tcctcagtagagaatctggggtcattgccagtggatgaagacacaggtttttgtactcattgctagtgactgaattgttccttcaaggga

SEQ ID NO: 12424 - DNA, 86 bp, Homo sapiens
tgtgtatatatgtgtgtgtgtatatatatatgtgtgtgtgtatatatatatgtgtgtgtatgtgtatatatatatgtatatagaca

SEQ ID NO: 12425 - DNA, 93 bp, Homo sapiens
ttttttctaatatatctaaatgatcattgttcatagaaatagctgaaaatatatgtttttatggaactgacatacagatattgtgagaataaa

SEQ ID NO: 12426 - DNA, 116 bp, Homo sapiens
tctccaaaaatgcccagggttagctatttttaaaactccctttttattccattgtgattgagagggtcgttactcttagtgtggtccacagactggcagcattggtgcccatgaga

SEQ ID NO: 12427 - DNA, 137 bp, Homo sapiens
tgtatacatatgtgtgtatatgtgcatgtatacatatgtgtacatatgtatatgtgtatatatatatgtatatttacgtatatgtgtatacatgtgtatatatacgtatgtgtatacatgtgactatatacgtatat

SEQ ID NO: 12428 - DNA, 58 bp, Homo sapiens; identical to SEQ ID NO: 1265

SEQ ID NO: 12429 - DNA, 111 bp, Homo sapiens
tatgtttttggtatataccatggaatagaattcttgagtcacaaggtaaatatatctttatctttagtaggggttttagaatttttttcatagtttttgtggcaatttata

SEQ ID NO: 12430 - DNA, 84 bp, Homo sapiens
ctatctatctatctatctatctatcatgtgtccatcatctttctacctatttggagataaaggtaggagatggagtcagtatgg

SEQ ID NO: 12431 - DNA, 113 bp, Homo sapiens
tagaatgttgatgtcctaattttaggctctgatatatatccacccttcaatttattttttttaaaggccaatgatgtacacagcactggagggaatccggaaaaaaccttctg

SEQ ID NO: 12432 - DNA, 99 bp, Homo sapiens
gtcttgtgtcattttctatatttgttgtatgtttcatatatatttatatatatatatttatgcatatcacatatattgaaacccaaagtgaagacaggc

SEQ ID NO: 12433 - DNA, 111 bp, Homo sapiens
aggtaatatgccatgcttattatattttatatataatatatgtatatataattatatatgtgtacatatataaatatatgtatatatagtatagtttggatgttgatccct

SEQ ID NO: 12434 - DNA, 56 bp, Homo sapiens
ctctctgtctctctctctatatatatacatatatatatagagagagagagattggg

SEQ ID NO: 12435 - DNA, 57 bp, Homo sapiens
attttctttagagaaatttttattcatatatatgagcaaaatttctctaaagataat

SEQ ID NO: 12436 - DNA, 112 bp, Homo sapiens
tgtttaccgatagagtcaggaaaagtttattttctttctttttatgaatgtatttacttctttattagatgatgagagaactttaatctcttttccatttctgtcttagaca

SEQ ID NO: 12437 - DNA, 112 bp, Homo sapiens
tgttcctatttctccacatcctctccagcacctgttgtttcctgactttttatttattattattatactttaagttttagggtacatgtgcacaatgtgcaggttagttaca

SEQ ID NO: 12438 - DNA, 94 bp, Homo sapiens
gtgtgtttgtgtctatgtatggatgtgtgtgtgtgtgtgtttgtatatatatatatgtacacacacatatatgtatctatatatccttacatac

SEQ ID NO: 12439 - DNA, 179 bp, Homo sapiens
gtatgcctctctctctctatatatatatatatgtatatatatataaactgtgatatatatatgtagatgtatatatagatatacatgtagatatatatatagatagatatgtagatatatatagatagatagatatgtagatatatatatagatagatatatagatagatatatatata

SEQ ID NO: 12440 - DNA, 66 bp, Homo sapiens
gtgtttttgagatgaagtctcactctgtcactcaggctggagtgcagtggcacagtctcaactcac

SEQ ID NO: 12441 - DNA, 108 bp, Homo sapiens
aaggtaggggcatgagattttattctgagtgagttaggagagggatgggaatttttgtttttgttttttttccaagaagtgatgtgatttggtatatgtcttcacttt

SEQ ID NO: 12442 - DNA, 95 bp, Homo sapiens; identical to SEQ ID NO: 68

SEQ ID NO: 12443 - DNA, 93 bp, Homo sapiens; identical to SEQ ID NO: 69

SEQ ID NO: 12444 - DNA, 117 bp, Homo sapiens
ccatggtgtgtatggacatacataacatacatatgtgtgtgtatatatatatatatgtgtgtgtgtgtatatatgtgtatgtatatatgtgtgtatatatgtatatctttcatttgg

SEQ ID NO: 12445 - DNA, 85 bp, Homo sapiens
ctctgtgaagtaaattacattcagggttcttagtcacagaaggattttatttttttctgtgatcgaggggatgataccaacaggg

SEQ ID NO: 12446 - DNA, 94 bp, Homo sapiens
gtgtattcctgcatattccttggtgctgccacagctttattcactcagaatctctgtgacttgaaccttggaatatgcatattatattctgcac

SEQ ID NO: 12447 - DNA, 97 bp, Homo sapiens
cagaaataatctgagctttggttagaaatatgtatatgcttaggcatgtatatatttatttagtaaattaattgaaagttcatagtatataaaactg

SEQ ID NO: 12448 - DNA, 90 bp, Homo sapiens
gctgaagacgctgttaaccagagccagggtttcttttttctttttttttttttttgagatggactctcactctgtcactcagcctggagt

SEQ ID NO: 12449 - DNA, 101 bp, Homo sapiens
ggctgaatagtattccattgcatatatatgcaatatataaatatatatgcaatggaatattatatatatttcatatatatgcaatggaatactattcagct

SEQ ID NO: 12450 - DNA, 99 bp, Homo sapiens
gctgaatagtattccattgcatatatatgaaatatatataatattccattgcatatatatttatatattgcatatatatgcaatggaatactattcagc

SEQ ID NO: 12451 - DNA, 111 bp, Homo sapiens
tgatgttagttctttgaatactgggtagaatctagcagtaaagtcatatggtcctacattcttttttgtttttttttttaataattaagtctcagtattcaatgttcatta

SEQ ID NO: 12452 - DNA, 109 bp, Homo sapiens
gccaatatatggaatcaacctaagatatatatatatacatatatatatatgtgtatatatatacgtgtgtgtgtgtatatatatatatatctcaaccatatgtaatggc

SEQ ID NO: 12453 - DNA, 95 bp, Homo sapiens; identical to SEQ ID NO: 68

SEQ ID NO: 12454 - DNA, 93 bp, Homo sapiens; identical to SEQ ID NO: 69

SEQ ID NO: 12455 - DNA, 95 bp, Homo sapiens; identical to SEQ ID NO: 68

SEQ ID NO: 12456 - DNA, 93 bp, Homo sapiens; identical to SEQ ID NO: 69

SEQ ID NO: 12457 - DNA, 95 bp, Homo sapiens; identical to SEQ ID NO: 68

SEQ ID NO: 12458 - DNA, 93 bp, Homo sapiens; identical to SEQ ID NO: 69

SEQ ID NO: 12459 - DNA, 85 bp, Homo sapiens
tccaccaagcatagtcatgaatatttttatttaaaggcaaataataaattgcctaaagagaaagagtgcagacaagcattgtgga

SEQ ID NO: 12460 - DNA, 117 bp, Homo sapiens
tgggctgagacgatggggctttcttttttttttttttttgagatggagtctcactctgtcacccaggctgcagtgcagtggcagaatcttggctcactgcaagctccgcctcccggg

SEQ ID NO: 12461 - DNA, 99 bp, Homo sapiens
tgtagctcatatattgctttcaatgtaggagaggcaccaattttgagaagagagaggagagtctgcagacagtggatatgggtcaaatagaaaaataca

SEQ ID NO: 12462 - DNA, 107 bp, Homo sapiens
ttcattgctttggtagatctgtgtctgcttttgttgagaggacttgtccaagaaggatgaacagtcagtgtcagtgtcagaagacaccaggaatgctgtgcagtggg

SEQ ID NO: 12463 - DNA, 84 bp, Homo sapiens
ttctaattcacatagttctttgctggcgtataacatttgagtcatttgagtgtgatgttagctgtgggcttgttacttatggaa

SEQ ID NO: 12464 - DNA, 58 bp, Homo sapiens
tgagactgagtctcactctgccacccaggctggagtacagtggtgtgatctcggctca

SEQ ID NO: 12465 - DNA, 117 bp, Homo sapiens
tatacgcacagacacctacatatatagtgtatgtatatatagtgtgtatatatgtatatatatgcatacacacatatatgtatatatacacacatatgtaggtatatatagtgtatg

SEQ ID NO: 12466 - DNA, 76 bp, Homo sapiens
cacatatatgtacatacacacacatatatatacacacacacacgggtatatatagtgtatgtatatatatgtgtgt

SEQ ID NO: 12467 - DNA, 109 bp, Homo sapiens
agtgcccttataaggagagacaccaggaagttttctctctctcactctctctttgccatgggaggacacagtgagaaggaggccacctgcaagcgaggatgagggctct

SEQ ID NO: 12468 - DNA, 97 bp, Homo sapiens
aaaagaaggaggttggaaagatctgagaagtgagtaagcagttgatgactagcaaatgtggactatattttttagttttttgttttttgtttttttt

SEQ ID NO: 12469 - DNA, 112 bp, Homo sapiens
tgagctttatgagagctgagacagatgatcctactaacaattttatatttaatataggtcctccttttttaaaatagctttataatggatgcatgctcattgcttaggttca

SEQ ID NO: 12470 - DNA, 84 bp, Homo sapiens
gtgtgtgtgtgtatatatatatatgtgcatgtgagtatatgtgaagacatatatatgtatgtgtgtgtatatatatacatatat

SEQ ID NO: 12471 - DNA, 116 bp, Homo sapiens
aacatgtctattttctacagaatagactagcagttttgaagttatgaagagatatttcatggttttctagctgaatgatttccttagtgttatgctgcagataaataactcatgtt

SEQ ID NO: 12472 - DNA, 81 bp, Homo sapiens
aaaatgaaattgttcattttttataacatcgtgtaaccttttagggttaacagagttaatagaagctgaacattttctttt

SEQ ID NO: 12473 - DNA, 89 bp, Homo sapiens
ttgtacactggtatggctatacttattattaaaataaaaatattttaatatttgataaataggtactgctcagggacttgtgagtacaa

SEQ ID NO: 12474 - DNA, 60 bp, Homo sapiens
gtttgaaactatatatcagagatataagaatttatatctttatgatatatagtttcaaac

SEQ ID NO: 12475 - DNA, 65 bp, Homo sapiens
tatatacacacacacacacatacacatacacacacagtgtgtgcgtgtgtgtatgtgtgtatatg

SEQ ID NO: 12476 - DNA, 95 bp, Homo sapiens; identical to SEQ ID NO: 68

SEQ ID NO: 12477 - DNA, 93 bp, Homo sapiens; identical to SEQ ID NO: 69

SEQ ID NO: 12478 - DNA, 68 bp, Homo sapiens
gggagcatatacaatgtatatatttactgtaaagaataaatagtaaaacagacacttatgtgctcacc

SEQ ID NO: 12479 - DNA, 113 bp, Homo sapiens
tattttatttagccttcccatgttttattcaggaattttgatcatttttattaaacttagaattgatatgaaagataccatgagtattgggaattaagggaaaaaatcaaata

SEQ ID NO: 12480 - DNA, 90 bp, Homo sapiens
cctctcagaggatatctttatttatataagaactaaagctttaaaggaaaggcagaaagttttttatgagatttcaagacatcagggagg

SEQ ID NO: 12481 - DNA, 84 bp, Homo sapiens
gccacaaattttttcacccctttaggtctgtattataatattttatttatctaaatctaggggggttggcaagggttatttggc

SEQ ID NO: 12482 - DNA, 58 bp, Homo sapiens
tgagacaaagtctctctctgtcgctcaggctggagtgcagtggcacgatcttgtctta

SEQ ID NO: 12483 - DNA, 104 bp, Homo sapiens
gtgatgtttgtacttataatgacagatatagatttgaatttaggaagttggatactgtggaaagtaaattactatgtaaatagtcattctgattatattctcac

SEQ ID NO: 12484 - DNA, 111 bp, Homo sapiens
tttgaatgttggcctgttcttgctaggttggggaagttctcctggataacttgaaaagtgtttttcatcttggttccattctccccgtcactttcaggtacaccaatcaaa

SEQ ID NO: 12485 - DNA, 95 bp, Homo sapiens; identical to SEQ ID NO: 68

SEQ ID NO: 12486 - DNA, 93 bp, Homo sapiens; identical to SEQ ID NO: 69

SEQ ID NO: 12487 - DNA, 73 bp, Homo sapiens
tgtgatatgtacatatatatgtatatatagtgtgtatatactatatatacatgtatgcattaacatacaaaca

SEQ ID NO: 12488 - DNA, 100 bp, Homo sapiens
gtcttaagctgtagtgaatctagtgtgctttctgtgtctgtctgtattgttctgtcataaagaaagaggcattccttaggataggacactggcttaggac

SEQ ID NO: 12489 - DNA, 66 bp, Homo sapiens
gaatatatatatatatatgcacacacacatatatatacatgtgtgtgcatatatatgtatatgggc

SEQ ID NO: 12490 - DNA, 99 bp, Homo sapiens
tttaggtgtactcatttctttgggcaatgatagagagacaattaattttaatttaattatttgtttttttttctggtttaattatcagtacaatttgga

SEQ ID NO: 12491 - DNA, 108 bp, Homo sapiens
atttattttagaaatctagtaactctagtatcacctagaaatccatacaatcatataaatttttaaatgatgaaattattattctgggttactgatgtttgaataaat

SEQ ID NO: 12492 - DNA, 98 bp, Homo sapiens
aagagctgttgcttcagattcaagagagatgaaagaaagctaaatactttctcctctttctagatttatttatttaagcattccagacctttgctctt

SEQ ID NO: 12493 - DNA, 116 bp, Homo sapiens
ctttttcaaggtcggaaaactaaaagaagtcaaaaggagccaaatcaaggctacatagtggatgtctaatgatttctcaaagatacttttacaaaatttcccttatttgatgagag

SEQ ID NO: 12494 - DNA, 99 bp, Homo sapiens
tagcctataatttgtgcaataacatcaaggttgttttgttcttacactaggggcagtaaataaagcagaaaccaagaggcattcataggactggggcta

SEQ ID NO: 12495 - DNA, 87 bp, Homo sapiens
ctcattttttcttcaagtaagaaaaaaatattctatatattttccaatgtgtttgaatatatctttcttttgccgggggaaggggag

SEQ ID NO: 12496 - DNA, 117 bp, Homo sapiens
atgtttaagcattaccttttctttgcaacctcaccagcttctgttatttttttgactatttaataatagccatctgactggcgggagatggtatctcagtgtggttttgatttgcat

SEQ ID NO: 12497 - DNA, 97 bp, Homo sapiens
ttcttatgtgttcacccaaatctcactttgaagagtagtttccataatccccacatgtcatggaaggcaccaggtgaagataactgaatcatgggaa

SEQ ID NO: 12498 - DNA, 78 bp, Homo sapiens
gagactgagtctcactctgtcacccaggctggagtgcagtggtgcgattttggctcactgtaatctctgcctcccggg

SEQ ID NO: 12499 - DNA, 59 bp, Homo sapiens
tgagacagagactcactctgtcaccccaggctggagtgcagtggcgtgatctcggctca

SEQ ID NO: 12500 - DNA, 88 bp, Homo sapiens
atacatatgtaacaatgtgcaaatgtatgcatatgtaacaaaccagttacatatgtatacatatgtaacaaaccagttacatatgtat

SEQ ID NO: 12501 - DNA, 128 bp, Homo sapiens
tatatgttatgtataatatacattgtatatgttatgtataatatataatatacaaatatatacattatatatgttatatataatatataatatacaaatatataatatattatatataatatattata

SEQ ID NO: 12502 - DNA, 78 bp, Homo sapiens
gtgtcagcactgtcccgagtgtgcacacttcctgctgggttgcaacagtgccctggcttggtgacagctttgctgcac

SEQ ID NO: 12503 - DNA, 113 bp, Homo sapiens
cggccaggcatgttggatgctgtggtcgggcaggcagctccaaacgcaggcacagtcgctggctccgtgcaaggctgcggctagaccatgagtaccacaagcagcttctgctg

SEQ ID NO: 12504 - DNA, 70 bp, Homo sapiens
ggtacctgtgagcataatagaatgacttctctcttgattaggttatgttatgttatgttatcaaggtgct

SEQ ID NO: 12505 - DNA, 85 bp, Homo sapiens
aagatattggacatgctggcaaaatctcatctagttttaatgactacagagagattcagctttaaaagtatgactatgaagtctt

SEQ ID NO: 12506 - DNA, 109 bp, Homo sapiens
ctccgttctcctggataatatttctggtcatgacagttttgaaatgtagtctatttttttaaatactttgcatggaaaatggtcatacagatagctagtttacagagag

SEQ ID NO: 12507 - DNA, 128 bp, Homo sapiens
ggattctgggtctgaactgtgtgatatgttgtgtctaaattgggtatatatatatatgtatgtatatatgtattaatttttataataatcaaaaattcagctactacattcaactatcatcacatttt

SEQ ID NO: 12508 - DNA, 95 bp, Homo sapiens; identical to SEQ ID NO: 68

SEQ ID NO: 12509 - DNA, 93 bp, Homo sapiens; identical to SEQ ID NO: 69

SEQ ID NO: 12510 - DNA, 115 bp, Homo sapiens
aaaaagtttcattagtattgtttctgttgtcttcaatgcttcattattttattgattttgtttattttctgtgtaaagtgagagagtatagtgggagtaaactggtcaacttttt

SEQ ID NO: 12511 - DNA, 86 bp, Homo sapiens
catatataaagagatacataagatatatatacaataagatataataagactatatatatatatatcttagtagctctgcatctatg

SEQ ID NO: 12512 - DNA, 86 bp, Homo sapiens
catagatgcagagctactaagatatatatatatatagtcttattatatcttattgtatatatatcttatgtatctctttatatatg

SEQ ID NO: 12513 - DNA, 82 bp, Homo sapiens
gtaatgagtatgtatagtatgtatgcgtgtgtgtttatataaatacttatatattgatatagactatatatgtgtttattac

SEQ ID NO: 12514 - DNA, 92 bp, Homo sapiens
aaagccaaagcttcacaaggtgttcacagaagacagagattgcagtttgaatcatgtcaaattagaagggctttgaaaacactttggacttt

SEQ ID NO: 12515 - DNA, 119 bp, Homo sapiens
tatatatatatgtatatatgtgtatatatgtacgtatgtgtatatatgtatatgtgtatatatgtgtatatatgtgtgtatatatgtatatatatgtgtatatatatgtatatatatat

SEQ ID NO: 12516 - DNA, 108 bp, Homo sapiens
ggtggttaatttttgctgtgaacttgacttttcatcaaatattctagttgtgttatgaggatgtttctagatgagattaacatttgaattggtagaagattgtcctcc

SEQ ID NO: 12517 - DNA, 82 bp, Homo sapiens
tgtgtatatatgtatatacgtacatatatatgcatatagatatatatgtatatctacatgtatgtgtatacgtatatctaca

SEQ ID NO: 12518 - DNA, 128 bp, Homo sapiens
tgtagatctacatatgtatatctacatatatgtatatctacatatatatgtatatatgtatatctacacatatgtatatatgtatatctacatatttatgtatatatatacgtgtatatcatatacat

SEQ ID NO: 12519 - DNA, 71 bp, Homo sapiens
ttgtttttgagacagagtctcactctgtggcccaggctggagagcagtcgtgtgatcttggctcactgcaa

SEQ ID NO: 12520 - DNA, 91 bp, Homo sapiens
accagcagtatatgagggctcctgattgttatttcaatgtatatttgtatgaagactaacacaatcaggcatcttttcatacgctcacggt

SEQ ID NO: 12521 - DNA, 100 bp, Homo sapiens
gacatcagcttgagcattttatgtaatactaacctataatataaaattattttaatttaaaataatttttggtattatgtaatatggtaattaatctgtc

SEQ ID NO: 12522 - DNA, 58 bp, Homo sapiens; identical to SEQ ID NO: 3380

SEQ ID NO: 12523 - DNA, 106 bp, Homo sapiens
taatacttggtacactgtttttcttacttgctagactatatattttttcaatatgatattggagagaattttataaatagtcttttaagctgtttatcaagtatta

SEQ ID NO: 12524 - DNA, 86 bp, Homo sapiens
aacacatttaatcagggtttcagaaatgttgagaaatattttctaggaaatttgtttttctcattatatagaagcctcagtgtgtt

SEQ ID NO: 12525 - DNA, 102 bp, Homo sapiens
acacatatgtatgcacagctatatgtaaaacatatataattgtgtatatgcatatatatatatatatatatgagtacttgtgtgtctgtgtgtattctgtgt

SEQ ID NO: 12526 - DNA, 64 bp, Homo sapiens
aggctccttgtgtaggcttttatttatccagaacataagtgaagtctgctcattggtattgcct

SEQ ID NO: 12527 - DNA, 113 bp, Homo sapiens
gtatttgaatatatatacagaagtgggattgctggatcatatggtaactctatttttacttttttaagagatctccatattgtttcccataatggttatactaatttaaattc

SEQ ID NO: 12528 - DNA, 79 bp, Homo sapiens
ttttcctatataagtgtctctagagagagagcacaagctcttcggtgtctcttctgataagtacactaagatggggaaa

SEQ ID NO: 12529 - DNA, 108 bp, Homo sapiens
tttttcttggacttctcagccttagaactgtgaaaaataaatgttttttgtttaaaccacacaaactagtattttgtcacagtagcctgaaaggacttacatgaaaaa

SEQ ID NO: 12530 - DNA, 95 bp, Homo sapiens; identical to SEQ ID NO: 68

SEQ ID NO: 12531 - DNA, 93 bp, Homo sapiens; identical to SEQ ID NO: 69

SEQ ID NO: 12532 - DNA, 116 bp, Homo sapiens
ccatttttggatataagaagtttctaattaagggccattgtcattttctagttgtcactatccaaggcgaccaccatttcaattttcccggtaataaagaggtttcctgaatatgg

SEQ ID NO: 12533 - DNA, 84 bp, Homo sapiens
atatgtatatatacacacacatatatatgtatatatacacacatatgtatagtatatgtatacaatttatgtttatgtatatat

SEQ ID NO: 12534 - DNA, 110 bp, Homo sapiens
atatatacataaacataaattgtatacatatactatacatatgtgtgtatatatacatatatatgtgtgtgtatatatacatatgtgtgtgtatatatatatgatatatg

SEQ ID NO: 12535 - DNA, 67 bp, Homo sapiens
tagatctatgatatagatatagatatagatctatatatctagatatctatatatatctatagatcta

SEQ ID NO: 12536 - DNA, 180 bp, Homo sapiens
ctatatagatagatagatagatagatagatgggatctatatctatagatatctatagatatatagatatatgtctatatatagatatctatacatatatagatatataaatatatagatatatagatctatagatatagatatagatgtagagatagatatagacagatatagatctata

SEQ ID NO: 12537 - DNA, 62 bp, Homo sapiens
tatatgtatagatatctatatatagacatatatctatatatctatagatatctatagatata

SEQ ID NO: 12538 - DNA, 71 bp, Homo sapiens
catgtgtatatatatataatacctatgtatatgtgtgtgtatatatatatgtatatatacatgtatacgca

SEQ ID NO: 12539 - DNA, 75 bp, Homo sapiens
gagtacgtatgtgcatgtatgtgcatatgtatgtatgtatgtatgtatgtatgtatgtatgtatgcatgtgtctt

SEQ ID NO: 12540 - DNA, 106 bp, Homo sapiens
caagatcttgttgtggtaaaaatatttataatctgcttaatagctctttaccaaaggtttttttttgttaagtttctataataaatgtccatatctactgattttg

SEQ ID NO: 12541 - DNA, 67 bp, Homo sapiens
gagacagggtctccctctgtcactcaggctggagtacagtggtgggttcttaactccctgtaacctc

SEQ ID NO: 12542 - DNA, 210 bp, Homo sapiens
cagctgagtagtattccatagtgtgtgtgtgtgtgtgtatatgtttgtgtatatgtatatgtgtgtgtatatatatgtatatacattatttcattcctttttatggctgagtagtattctatggtgtgtgtgtgtatatatatatgtgtgtgcatatatatatataggaatttttatatcatatatatacacatatgtatatatacacac

SEQ ID NO: 12543 - DNA, 96 bp, Homo sapiens
agtgaatttcttagtcttcagctctaatttgattgcactgtgtagactgttttttgttattttagttatttcaaatttgctgaggagggctttact

SEQ ID NO: 12544 - DNA, 105 bp, Homo sapiens
caaacattcatatacaggttttcgtatgaacataagtttttattttttttctgggaaaaatgcccaagagtgcaattgctgggtcatatggtaattgaatgtttg

SEQ ID NO: 12545 - DNA, 82 bp, Homo sapiens
cctgattttattgaattatttatccatgttcccttgtgccttgctgcacttccttaaaatgtgtttttaattcaatgtcagg

SEQ ID NO: 12546 - DNA, 88 bp, Homo sapiens
tgtatatgtatatatacacgtatatatgtatatgtatatatacacgtatatatgtatatgtatatatacacgtatatgtatatgtaca

SEQ ID NO: 12547 - DNA, 92 bp, Homo sapiens
ccagcttatccactgagagcatggtctataaaatatgtcacacagtgatcgtaggttttatagtagtgatattatccctgggagcaatctgg

SEQ ID NO: 12548 - DNA, 75 bp, Homo sapiens
gggatattctagctacagttcggtttggcactgacaacagaactaatctggcttgactgtagaaagagaggtccc

SEQ ID NO: 12549 - DNA, 97 bp, Homo sapiens
atttgtgtgcgcaccaaccaatccatagaacaaaaagttggaggaagagaacattcactctttttctctgactgactgcttgacctgaaacataaat

SEQ ID NO: 12550 - DNA, 100 bp, Homo sapiens
ccatcatgctatttcagattgttcagtgatttttctatgttgaatttgtagcttgaaactctactgaatttgtacatgagttctaatagctttttgatgg

SEQ ID NO: 12551 - DNA, 94 bp, Homo sapiens
gctctatctcagtagcatatatagtttgcaaaatagttttaggagactttatattattttatgttcactgttattgtatagccttgattagggt

SEQ ID NO: 12552 - DNA, 67 bp, Homo sapiens
acagttcactggcactttctctctgccatgtgaggacacagtgagaaggcagccgtctgtaggtgag

SEQ ID NO: 12553 - DNA, 128 bp, Homo sapiens
acgtatatattatatatgtatacatattacatacgtatatattatatatgtatacatattacatgtatatgttatatatatgtatacatgttacatatgtatatattatatatgatatatgtatacat

SEQ ID NO: 12554 - DNA, 85 bp, Homo sapiens
tcttctacttttagaggaactgtgaaaatcatttttatattaaagtgacaatattttccatatcagttcttcctaaagagagtga

SEQ ID NO: 12555 - DNA, 99 bp, Homo sapiens
tcttttttggtgaccattctcttggaatatatttttatatgtcatctctttcagcctatatatgtatttaaatccaagggaatatgttgcaggcaaaga

SEQ ID NO: 12556 - DNA, 91 bp, Homo sapiens
gaaatattcgtgaggtaaatttgatgtttcaatgtatgtatgaatgttgaaaatgatcaaataaaacttatgtacttcataaatgtatttc

SEQ ID NO: 12557 - DNA, 115 bp, Homo sapiens
tattgggataagttcttggagtgtgaaaaggggattacaatttttaaaatttatttatttttaatttttttagagacgtagttttttttaatgttgccaaagctagagtgcagta

SEQ ID NO: 12558 - DNA, 95 bp, Homo sapiens
gcccaaaggtgcaattgttggctcctatgatagttgcattttttgttttataagaaaatgcacctggtgtagtggctcacacctgtaatcccagc

SEQ ID NO: 12559 - DNA, 116 bp, Homo sapiens
atctatatgaattttaaggattggacatgtgccttgaatagtataaagatgacctatgtattaatctattttttatttaagaagacacgtatgtccatttcttatattgcttggat

SEQ ID NO: 12560 - DNA, 83 bp, Homo sapiens
gtcattgaatcatgggtaaattgaatcatgatttttttaaattgaactgaaaaaatcagtttttcccatgctgttctcatgat

SEQ ID NO: 12561 - DNA, 100 bp, Homo sapiens
gctatgtggctttttcctacttttttttttgtttattttgagtcacagtctcactctgttgctcaagcaggagtgaagtggcctgattatgcctcacagc

SEQ ID NO: 12562 - DNA, 110 bp, Homo sapiens
tgcaactcttcctattactcaaacagctagaggtcattttggggttattaattggcttaatctcaatatttttgttttatggagaatagggggcccaaaaagagaaagca

SEQ ID NO: 12563 - DNA, 86 bp, Homo sapiens
ggaggaaaatcttatttgtattttaaaatatgagacctgcctggcaagcaggtacttctctgtttaattattgattactttccttt

SEQ ID NO: 12564 - DNA, 85 bp, Homo sapiens
ggtgtgggtaaatgaggacaggttttggttagctaagcaacaggtagttggttctcttgtcaccctgacctggcctacccaggtc

SEQ ID NO: 12565 - DNA, 117 bp, Homo sapiens
gataaagcatagaaggacagatttaaatatgtatatgtgtatgtgtatgtgtgtgcacatatatataaatatatatgtttaattaaacaatttgcctcctgatatcaataaactgct

SEQ ID NO: 12566 - DNA, 100 bp, Homo sapiens
gaaaaactactggagaaatgtaaatgactgttttattgccaatacataaattttaaatgtattttaaaagtacagttgtttctgtctctgagagttcagc

SEQ ID NO: 12567 - DNA, 112 bp, Homo sapiens
tgctaaaatttctcaagttttttcttgactaaatataatgtctctaacatcattaggatgtgaagtcattatgttcttatgagtgagtgacaatttgataaatttctggaca

SEQ ID NO: 12568 - DNA, 74 bp, Homo sapiens
ggggttggcggagaggtaacacaagcactcccttaaccacccaagctggtgtctcactctgtcagatgcacccc

SEQ ID NO: 12569 - DNA, 106 bp, Homo sapiens
agccaattcaggtcatcaaagatgtcatgccttgctcagagtcacttaaagaattagtgacacttgagactgaggacagatgtcctaacgcctgtttacaatggtt

SEQ ID NO: 12570 - DNA, 84 bp, Homo sapiens
ggaggtcgagatgatggttagctaaaggcaataaaggaatgcatcatccgtctcttgttttcagagctggcttctccttactcc

SEQ ID NO: 12571 - DNA, 66 bp, Homo sapiens
ggggcggggtttatgaatttgtatttctgacaagcttgtaggagatgtactagtgtttttcgcctc

SEQ ID NO: 12572 - DNA, 77 bp, Homo sapiens
atagtgggagaggttatgagtgtgtgaaggcagtgagtacacgggaaatcttagcactttctgcttatttttgctat

SEQ ID NO: 12573 - DNA, 75 bp, Homo sapiens
gaactttgtctgaataattaaataaagtatatatatatgtaaagttatatatatatgtatttgagacagggtctc

SEQ ID NO: 12574 - DNA, 116 bp, Homo sapiens
gtgactacaagggagaaagagtccggccctctctggatgtggcagcagctttgtttgggctggcatttccctgggtcgcctggctcatgtgtgactgccagcctgttcagcaaggt

SEQ ID NO: 12575 - DNA, 118 bp, Homo sapiens
ctttttgcagtaggtggaggaaatgcagctaattcttttaatagctatgtcaatatatttatatgtaagcttaacaagagagctagggcataggctattcaaaatactgtttataaag

SEQ ID NO: 12576 - DNA, 58 bp, Homo sapiens
tgagacagggtctcactctgccactcaggctggagtgtagtggtgtgattttggctca

SEQ ID NO: 12577 - DNA, 192 bp, Homo sapiens
gcaaattatatatatatatatgtgtatatatacacatatacatatgtgtgtgtatatatgtatatatgcgtatatatgtatataaatgtatatatgtgtatatatgtatatatatgtgtgtgtatatatgtatatatatgtgtgtgtatatatatgtgtatatatatgtgtgtatatatatatatgtatatg

SEQ ID NO: 12578 - DNA, 155 bp, Homo sapiens
acatgtatatgtatatatatatatatctgtgtatatatatatatctgtatatatatatctgtatatatatatatctgtgtatatatatatctgtatatatatacataagtgtgtatatacatatatatgtatactgctctcaaaagaaatgtata

SEQ ID NO: 12579 - DNA, 97 bp, Homo sapiens
atttttgtcttgaaaacatacatataatttatatatttgtctacatgtgtgtatgtgtattaatatatgtgtgtttgtgtgcatttctaccaaaaat

SEQ ID NO: 12580 - DNA, 81 bp, Homo sapiens
gtgactgtaaaaggtaattttatttattttagtatctacattcttcctaggtactaaaaagatttgacatgtttacagcat

SEQ ID NO: 12581 - DNA, 93 bp, Homo sapiens
gttcttctgccttctatttcatgtttctatatattattgataaagccagtgctttgtaggatataaactatggtttaggctaggcacggtggc

SEQ ID NO: 12582 - DNA, 126 bp, Homo sapiens
gcagaaaaagagagagatatggtgagttatgtatatatacatatatgtatgtatatatatgtgtatgtgtatatgtgtcaaattatatataatcatatatgtatatatatatgtatgtgtgtgtat

SEQ ID NO: 12583 - DNA, 168 bp, Homo sapiens
tatatatgtatatatgtgtatatatactatatatgtatatatgtgtatatatactatatatgtatatatgtgtatatatactatatatgtatatatgtgtatatatgtgtatatatactatatgtgtgtatatgtgtatatttatactatatatgtgtatatatatat

SEQ ID NO: 12584 - DNA, 356 bp, Homo sapiens
atatatgtatatatgtatatacgtgtatatatactatatatgtatatatgtatatatgtgtatatatactatatatgtatatatgtgtatatgtgtgtatatatactatatatgtatatatgtgtatatatactatatatgtatatatgtgtatatatactatatatgtatatatgtgtatatatactatatatgtatatatgtgtatatatacatatatgtatatatgtgtatatatactatatatgtatatatgtgtatatatactatatatgtatatatgtgtatatatactatatatgtatatatgtgtatatatactatatatgtatatatgtgtatatatactatatatg

SEQ ID NO: 12585 - DNA, 177 bp, Homo sapiens
tatatatgtatatatgtgtatatatatactatatatgtatatatgtatatatgtgtatatatatactatatatgtatatatgtatatatgtgtatatactatatatgtatatatgtatatacgtgtatatatacatatatgtatatacgtgtatatatacatatatgtatatacgtg

SEQ ID NO: 12586 - DNA, 70 bp, Homo sapiens
aaggagagaaagaaagattcgaaagaaatggagtatatttcttttttcttttttttttcttttttttttt

SEQ ID NO: 12587 - DNA, 111 bp, Homo sapiens
tcctccaaataaaatgtgtgtatgttgctttttccttcatatttttattattatatgtttgcaaagaaagcatggagcaaaaatatgaactcctgcacccacttatgagga

SEQ ID NO: 12588 - DNA, 95 bp, Homo sapiens; identical to SEQ ID NO: 580

SEQ ID NO: 12589 - DNA, 93 bp, Homo sapiens; identical to SEQ ID NO: 69

SEQ ID NO: 12590 - DNA, 81 bp, Homo sapiens
agatttcgttttctttacatgtatgtattttgcttttctagcaaatttgacctttacaaccatgtaagataagtaaaatct

SEQ ID NO: 12591 - DNA, 77 bp, Homo sapiens
cagaagccagcaggcctccttgagctgcagtgggctccacccaattcgagcttcaaggttgctttgtttacctactg

SEQ ID NO: 12592 - DNA, 87 bp, Homo sapiens
gtggtctcttttttggttccatatgaaatttaaagtagttttttccaattctgtgaagaaagtcattggtagcttggtggagatggc

SEQ ID NO: 12593 - DNA, 116 bp, Homo sapiens
catggtaataagtacatttgctgtacctatatatttgcttacactatcttttttttttattattatacgttaagttttagggtacatgtgcacaatgtgcaggttagttacacatg

SEQ ID NO: 12594 - DNA, 58 bp, Homo sapiens
tgagacagagtctcactctgtctcccaggctggagtgcagtggtgtgatcttggctca

SEQ ID NO: 12595 - DNA, 116 bp, Homo sapiens
ttcttgagtgtattcatggatgaacaatgtcatctgcaatttaatttaataattctcattatattattattttagaggtgttgcagcacttttacatggtttatctcacttgagaa

SEQ ID NO: 12596 - DNA, 116 bp, Homo sapiens
tatatatacatatctgtatacatgctctctatatttatacaaatatttatatatttatttaaaagtctatatatttaggtatgcatatttagcatatatatctatgtgtatgtata

SEQ ID NO: 12597 - DNA, 117 bp, Homo sapiens
cagagtcaatttcagatgagctctttaagataccagaacaattcaatattggagcattttttttttttttttgagtggagttttgctctttttgcccaggctggagtgcaacctctg

SEQ ID NO: 12598 - DNA, 97 bp, Homo sapiens
tgctgttactattcaggctcttttttggtcaaattagttttagaattttttttctaattctgtggaaaacattcttgatagcttgataggaatagca

SEQ ID NO: 12599 - DNA, 64 bp, Homo sapiens
tgcttcctgagtctcactctgtctcccaggctggagtgcagcagagtgatcttggctcactgca

SEQ ID NO: 12600 - DNA, 70 bp, Homo sapiens
tgcaaatatgtatatatatatgtgtatgaatttatatattcatttgcatatatatgcacacatatatgta

SEQ ID NO: 12601 - DNA, 71 bp, Homo sapiens
gtgtgtgtgggtgcatgtatatatatacatataatatatatatatgtgtgtgtgtgtgtaactacatatat

SEQ ID NO: 12602 - DNA, 115 bp, Homo sapiens
tttggaagcagaatgtagttaagaaatcccaggagacatatttatattttttcaagaaagtgtcccaaacatctccttctgtattttaggattttttgagacatactcagttgaa

SEQ ID NO: 12603 - DNA, 101 bp, Homo sapiens
tagtagcagaaataacactatatgtgtatatatatatgtacatatatagacttctgttttctctatatatatgtacacatatacatatatgtcagcaactg

SEQ ID NO: 12604 - DNA, 92 bp, Homo sapiens
tctgccctcctgataccaaacgtcagtactgagtgtccagtcagagccctgacctggtccctcctgaggtctccctcccagtgaatggcagg

SEQ ID NO: 12605 - DNA, 93 bp, Homo sapiens
ggtgataaagctagttaaggaaattcctttaagtgaatatcgatattcttaaagtgaagtatcaaaattttttttaattactcagttatcacc

SEQ ID NO: 12606 - DNA, 110 bp, Homo sapiens
cttgaggaaatgttttgttgtacaccgaaacaatgtttttatttttaacagtgatcttttaaaatgtgaatatatactgttttgaaatttcccaataaaacaatttcaag

SEQ ID NO: 12607 - DNA, 100 bp, Homo sapiens
gaaaaaacattaagagcaatttttaagtatctaaatacaaaatgattataattattttgaatttgggttttttttgttaaaatttctcaaatgcattttc

SEQ ID NO: 12608 - DNA, 112 bp, Homo sapiens
aggccagaagggagggggtacagtgaaagcccatagagctagagagaagagacagtggtttctgcaggagctgggctctgatttggctttgttttctctcccaccatggctt

SEQ ID NO: 12609 - DNA, 108 bp, Homo sapiens
ccatgaaaagtagtttttagttctcacagttctctcaaacccagtctgaagttatcctggttagcgtgaaggggtagggattgggagaaagtactagcatttctatgg

SEQ ID NO: 12610 - DNA, 116 bp, Homo sapiens
aaggaaaatatgtaaaagcttgcctaaatcattagatatggaatgaaaatatttattctaaaaatgacatattttttcattctgaattctatatctttgaagctttattagtcttt

SEQ ID NO: 12611 - DNA, 95 bp, Homo sapiens; identical to SEQ ID NO: 580

SEQ ID NO: 12612 - DNA, 93 bp, Homo sapiens; identical to SEQ ID NO: 69

SEQ ID NO: 12613 - DNA, 99 bp, Homo sapiens
gtgcctgtagtcccaagtacttaggaggctgaggtggaaggatcacttgagcctgggagatcaaggctgcagtgagcgatcatcatgccttagcacttc

SEQ ID NO: 12614 - DNA, 95 bp, Homo sapiens; identical to SEQ ID NO: 68

SEQ ID NO: 12615 - DNA, 93 bp, Homo sapiens; identical to SEQ ID NO: 69

SEQ ID NO: 12616 - DNA, 94 bp, Homo sapiens
cactttttggatatttaaataatgtttccatatttgtatacaattattgtgtgtacatatgtttttaattttattgggtatatatctaggagtg

SEQ ID NO: 12617 - DNA, 81 bp, Homo sapiens
gaggctgggcatggtggctcacgcctgtagtctcagcactttgggaggctgaggtaggtggatcacttgagcccagatttc

SEQ ID NO: 12618 - DNA, 68 bp, Homo sapiens
gaataagagtttctctctgtctctgtcaggaggggagagggacagcaagtaaagagactccaagattc

SEQ ID NO: 12619 - DNA, 117 bp, Homo sapiens
tatgtatatgtgtgtgtgtatatatatatatagtgtttatactacatatatatagtgtttatactacatatatatagtgtttatactatatatatatagtgtttatactatatatat

SEQ ID NO: 12620 - DNA, 101 bp, Homo sapiens
acactatttcaatggaaattcctgaaactttggccaggaagatgttggtatcactagtcattttctaaaaatggctcagttgtttcctcttttactggtgt

SEQ ID NO: 12621 - DNA, 87 bp, Homo sapiens
tatatatgtatatctcattatatatgtgtaagtatatttgtatacaaactatatatgtatatctcattatgtataagtacatatgta

SEQ ID NO: 12622 - DNA, 95 bp, Homo sapiens; identical to SEQ ID NO: 580

SEQ ID NO: 12623 - DNA, 93 bp, Homo sapiens; identical to SEQ ID NO: 69

SEQ ID NO: 12624 - DNA, 108 bp, Homo sapiens
ctggtgaggggaaggttgtctgcatttgcttaagagttatattggaaataatttaattttcattattttaaaatgttctttccaagcaaggacaaagtaaattgtcag

SEQ ID NO: 12625 - DNA, 109 bp, Homo sapiens
ccttattatgtttccattctagctcagaaatttagatactatttgtaaagccaaaaaaggcacaaatatttctaaaccttcatatagaatcttaatactttaattctgg

SEQ ID NO: 12626 - DNA, 101 bp, Homo sapiens
ccatcaacgccctggcagatgccatcaatgggtttcagggtagtatgatgctggtcagccatgacttcagactcattcagcaggttgcacaggaaatttgg

SEQ ID NO: 12627 - DNA, 111 bp, Homo sapiens
gttagatattccatttgatttcaggcaactaatgtgctgactctttttcattttttgatagaaatcaaaatcactacatggctgctgaaagtgtttctgaatattgtctac

SEQ ID NO: 12628 - DNA, 95 bp, Homo sapiens; identical to SEQ ID NO: 68

SEQ ID NO: 12629 - DNA, 93 bp, Homo sapiens; identical to SEQ ID NO: 69

SEQ ID NO: 12630 - DNA, 74 bp, Homo sapiens
tgacagagtgtagagactgatgccaccatcaaggacataaaggacacggggtggtgattcctaccacatctgca

SEQ ID NO: 12631 - DNA, 70 bp, Homo sapiens
aagaccattgagactgaagtcagacaggaatagtttaaattatcctgttattctctttctctttgatctt

SEQ ID NO: 12632 - DNA, 117 bp, Homo sapiens
atgtcagtattatggtgtgtacacagtatcctcagtttataatcctggaaactgacagatcaatgtcaccacacaggtaagctgttatgtgaggactgggaccacgacatctgacat

SEQ ID NO: 12633 - DNA, 113 bp, Homo sapiens
gtggataaagaaactgtataaatatatatactcacacacacacacatatatatatgtatgtgtatatatatatgtgtgtgtgtgtgtgtgtatatatgtgcgtgtatatacac

SEQ ID NO: 12634 - DNA, 97 bp, Homo sapiens
tctatgcaggctcttttttggttccatatagattttagaatttctttttctaattctgtgaagaatgatggtggtattctgatggggattgcattga

SEQ ID NO: 12635 - DNA, 92 bp, Homo sapiens
aatgtggtaaggagggtaattcatgtaaatattattcattataagtatataacagtttaatttttcacattagttacctgaagtaacacatt

SEQ ID NO: 12636 - DNA, 85 bp, Homo sapiens
agtgaatcaaatggggctgttcactgcgaggaaagatcaatttttttttttagcagattcccacagatagccaaagaaactcact

SEQ ID NO: 12637 - DNA, 113 bp, Homo sapiens
acaacggatatatatacgtatatatatgtgtatatatatgtgtatatatgtatatatatgtgtatatatatgtatatatatgtgtgtatatatatatatgtgctgtatacaca

SEQ ID NO: 12638 - DNA, 88 bp, Homo sapiens
agatgcagatatatgtgtagatgtatacatagatatattcacacctagacgtatgtgtgtatatatatatatataacagatcacatct

SEQ ID NO: 12639 - DNA, 115 bp, Homo sapiens
ttcaaaggagaaagcaaaatgacttgactcttgtggttatacgttgaacagcatgtgcatgtgtaagagttcagtgttttaactccatgttatttttttaaccttttgttttgaa

SEQ ID NO: 12640 - DNA, 93 bp, Homo sapiens; identical to SEQ ID NO: 69

SEQ ID NO: 12641 - DNA, 95 bp, Homo sapiens; identical to SEQ ID NO: 580

SEQ ID NO: 12642 - DNA, 93 bp, Homo sapiens; identical to SEQ ID NO: 69

SEQ ID NO: 12643 - DNA, 102 bp, Homo sapiens
tagagtctgtttcaatttttgccttgctgagttgctgatatgaaatatatatttattatatgaagcatacctatggcagttaaatttagatagtgttatctg

SEQ ID NO: 12644 - DNA, 115 bp, Homo sapiens
tccaatttcttacacattgtatttatatacattgggaagcttttaagttttttttttaacaggaatttttgagtttgtaatatggtaatgtaggtgattataagaagcacgtgga

SEQ ID NO: 12645 - DNA, 158 bp, Homo sapiens
catacatacatatgtgtgtttatgcatacatacgtatgtgtgtatatgcatatatacgtatgtgtgtgtatacatatatacgtatgtgtgtgtatatatacatatatacgtgtgtgtgtacatatatatgtgtgtgtgtgtatatacatgtatatgtg

SEQ ID NO: 12646 - DNA, 65 bp, Homo sapiens
ggctagtgtttagtggaatcttctgtggcacatagcacacagcgagaagccagaataggatggcc

SEQ ID NO: 12647 - DNA, 73 bp, Homo sapiens
gggtacaggtggttttggattacaaggataattttttttttttttttgagacaagagtctcactctgtcaccc

SEQ ID NO: 12648 - DNA, 113 bp, Homo sapiens
tacatatatgtatatgtatatatatttattctctgcagtatgtaatacatatatgtatatattatatatatgtacacacagtatacatatatgtgtgcatatgtatatatgta

SEQ ID NO: 12649 - DNA, 108 bp, Homo sapiens
actagattttaacagagattttgccttcaaacatatttggacacaaatgtataattttttctaactcccaaaaggtttggtaaggtagagtttttcttttcatctagt

SEQ ID NO: 12650 - DNA, 80 bp, Homo sapiens
aagcttttaccaatgggcctgaaaacatttcttcttcctttgctggagatgggatctttgtttttatatctgttaggctt

SEQ ID NO: 12651 - DNA, 95 bp, Homo sapiens; identical to SEQ ID NO: 68

SEQ ID NO: 12652 - DNA, 93 bp, Homo sapiens; identical to SEQ ID NO: 69

SEQ ID NO: 12653 - DNA, 85 bp, Homo sapiens
agttttagggtacatgtgcacaacgtgcaggtttgttacatatgtatttatatatgtgccatgttggtgtgctgcaccattaact

SEQ ID NO: 12654 - DNA, 95 bp, Homo sapiens; identical to SEQ ID NO: 580

SEQ ID NO: 12655 - DNA, 93 bp, Homo sapiens; identical to SEQ ID NO: 69

SEQ ID NO: 12656 - DNA, 116 bp, Homo sapiens
agctttttttgtcaggctcatggtgtagactgcagcctcctgggttttttttttttttttttttttttaagaatctgtggattatttcagttttccagttaagtttttgcatggct

SEQ ID NO: 12657 - DNA, 114 bp, Homo sapiens
ctgcagggtgtgttggagaaatggggggatggagtccgcaggctgagcaccgagggctgagtgctgagtctctgtgtgacttcatgagaaatggcttctggctaagcaagggag

SEQ ID NO: 12658 - DNA, 76 bp, Homo sapiens
tatatatatatacacacacacatatatacacacacacatatgtgtatatgtatatgtgtgtgtgtatatatatgta

SEQ ID NO: 12659 - DNA, 105 bp, Homo sapiens
tatgtgtgtgtgtatgatgtgtgtatttatgtgtttgtggtatgggtgtgtgtgtatatatatactatatatatgtatatatacacacacatatacatacacata

SEQ ID NO: 12660 - DNA, 114 bp, Homo sapiens
ttccagtgttgctgtatgatgcttgaagacatgtaaggaaggggatttgcacaaacattttatttttgttaaattctgtttgacccacaatttggagtattataaaatttggaa

SEQ ID NO: 12661 - DNA, 98 bp, Homo sapiens
gtttttacatttgttttcgtgcctcagacatttgtgtttactgatacagacacacagacacatacacacaaagtctgattaaatgaacaaaaaagagc

SEQ ID NO: 12662 - DNA, 112 bp, Homo sapiens
ggatatgttttggagttttgcatatatatatatatatatatatatatatatatatatatatatatatatatatgtatgttttagaaagatgtgcaacactttggatatggac

SEQ ID NO: 12663 - DNA, 82 bp, Homo sapiens
tctatgtgtgtgtatatatatgtacatatatatacacatatttatgtgtgtgtgtgtgtatatatatatatagactgagaga

SEQ ID NO: 12664 - DNA, 121 bp, Homo sapiens
tatatatatacacacacacacacataaatatgtgtatatatatgtacatatatatacacacacatagatatgtgtatatatacacacacgtatgtgtgcatatgtgtatatatgtatatat

SEQ ID NO: 12665 - DNA, 107 bp, Homo sapiens
gaaacgaaactgttagaagtagtagaaagtgcattagatagaatgatgcttgtttggaagtgtttttctaattgtaatgcaatctactattctaatttattattatc

SEQ ID NO: 12666 - DNA, 95 bp, Homo sapiens; identical to SEQ ID NO: 68

SEQ ID NO: 12667 - DNA, 93 bp, Homo sapiens; identical to SEQ ID NO: 69

SEQ ID NO: 12668 - DNA, 82 bp, Homo sapiens
cttgtgaggattccttcttttttccctctggaggatgcagcatgaaagacgccatcttggaagaagagaatgagctcaccag

SEQ ID NO: 12669 - DNA, 97 bp, Homo sapiens
tctacttgcctctcctgtcttctgtgcacatgtgagggtgtgcatacacgacgcacacacacacatacacagacaagaacagacataaagccaaaga

SEQ ID NO: 12670 - DNA, 93 bp, Homo sapiens
ccaaaggctttaagacagggctgtgcccagggcagagactgagcacacagtgtgtgcttaaaggctctgtcagacctgctgctggaagcttgg

SEQ ID NO: 12671 - DNA, 86 bp, Homo sapiens
tctggaataattctacttgatcatgatattatttttaacacacttaagatcggactgaatatcattttatttagaattaattcaga

SEQ ID NO: 12672 - DNA, 70 bp, Homo sapiens
agggcttaatgatgttgttgttgatgatgatggtgatggtaatgaccatcatcatcatatccagtcctca

SEQ ID NO: 12673 - DNA, 85 bp, Homo sapiens
ggcggagtggctgggcttttggagtttgtctcagaactgcctatcactgcaccctgggcaagtctctctgagtctcagttttgtc

SEQ ID NO: 12674 - DNA, 93 bp, Homo sapiens
catttcctaaaggccttgatgaccctttctctgtgagtcactcccaccaaggaaaaaagatgtgacagcagcagcaggcgggggctgggaatg

SEQ ID NO: 12675 - DNA, 58 bp, Homo sapiens; identical to SEQ ID NO: 2051

SEQ ID NO: 12676 - DNA, 93 bp, Homo sapiens
tcacgcctcctgtatagcctgtgcaactgcgagtcaattataaattttctttataaattacccagtctcaggttgttctttttagcggtgtga

SEQ ID NO: 12677 - DNA, 107 bp, Homo sapiens
cgtctctgtctcacccttctagtctgcgcttgcccttctcactccccagctctctctgttactgtcagtggagggtctgtgcactttgtcgttttgatcctatgacg

SEQ ID NO: 12678 - DNA, 75 bp, Homo sapiens
gcctatctatctgtgtgtctatctgtctgaggggagttattagggggattggctcacatcataatggaggttggg

SEQ ID NO: 12679 - DNA, 120 bp, Homo sapiens
ggaaatacggaaccagaaattttaggtgtcttctagtccaactctatttgtttttcagatgtggaaattgatgattggagaggggctgtggctttcagattacttttagactgtctctcc

SEQ ID NO: 12680 - DNA, 103 bp, Homo sapiens
gcaatgggggcttttcaggagaggaggaagatgacgtttgttttttgttttatttatttatttttagagacaaagtctcgctctgtcacccaggccgtagtgc

SEQ ID NO: 12681 - DNA, 88 bp, Homo sapiens
ggcctagggtttaagtaagagtggcatctacagtaacttctttattttttatttatttgagacacagtcttgctctgtctcccaggct

SEQ ID NO: 12682 - DNA, 75 bp, Homo sapiens
cagagaaaggagttgaccgagggttcgttctgtttttattttaagagacagggtctcactctgtcacccgggctg

SEQ ID NO: 12683 - DNA, 95 bp, Homo sapiens; identical to SEQ ID NO: 68

SEQ ID NO: 12684 - DNA, 93 bp, Homo sapiens; identical to SEQ ID NO: 69

SEQ ID NO: 12685 - DNA, 82 bp, Homo sapiens
cttgtgaggattcattcttttttccctctggaggatgcagcatgaaagacgccatcttggaagaagagaatgagctcatcag

SEQ ID NO: 12686 - DNA, 58 bp, Homo sapiens; identical to SEQ ID NO: 1868

SEQ ID NO: 12687 - DNA, 72 bp, Homo sapiens
ctgggtgcagtggctcacatctgtaatctcagcactttgggaggctgaggtagaaggatccgttgagctcag

SEQ ID NO: 12688 - DNA, 75 bp, Homo sapiens
atttcttattaagattcctcttcatgtttatattttatgaagatgaaatgtgaggagtgaatttgtaaaagagat

SEQ ID NO: 12689 - DNA, 87 bp, Homo sapiens
gtggagttgttaaaatacatatacacatacatatacatatatgtatgtgtatatgtatgtatgtatgtatttgagcaaaggctttac

SEQ ID NO: 12690 - DNA, 72 bp, Homo sapiens
ttgctcaaatacatacatacatacatatacacatacatatatgtatatgtatgtgtatatgtattttaacaa

SEQ ID NO: 12691 - DNA, 75 bp, Homo sapiens
gagtctcactctgtcacctaggctggagtacaatggctcactgcaacctctgcctcttgggttcaagtgattctc

SEQ ID NO: 12692 - DNA, 75 bp, Homo sapiens
gagcttcttggatgtatggtttggtgtctaacaataatttggggacattttcagtcattattattccaaaagttc

SEQ ID NO: 12693 - DNA, 97 bp, Homo sapiens
tacatatatgtaatattgttatgtgctttaagtttattgatatataatagtttcaatatttgggagatacatgaaatatttaataaacgtctatgta

SEQ ID NO: 12694 - DNA, 101 bp, Homo sapiens
atatgtatattctatgtaaatatagaataaatttattctataggtctattctatattttatatattctattgttattactgtgtttatgtattatacatat

SEQ ID NO: 12695 - DNA, 114 bp, Homo sapiens
gccatttggaaatctagttgcccaaattataatttttttatttttatctttttatttgtgtaagtatatgggatacaagtataattttgttatatgcacagattatgtagtggt

SEQ ID NO: 12696 - DNA, 114 bp, Homo sapiens
ggactaatacaacacacacatacacgtatacaattgtgtgtatatatgtatatggtgtatatgtatatatgtttgcacagatatatatgtatgtgtgtatgtgtatgtattgcc

SEQ ID NO: 12697 - DNA, 110 bp, Homo sapiens
gtggctgctttttcgctctgcagattgtgtttttgttgttttttttttaattttattactattatactttaagttttagggtacatgtgcacaatgtgcaggttagttac

SEQ ID NO: 12698 - DNA, 96 bp, Homo sapiens
tgctacatgtagacataattattggtgaatatttcattaaatcattggatttgaccagagattttgatgatggacaatttatgttttttgtatgta

SEQ ID NO: 12699 - DNA, 109 bp, Homo sapiens
tatatatgtatatgtattatatgtgttatatatatgtgtgttatatatgttatatatatataacacatacatatttgtatatatatgtctcaaaaaatgtatatatata

SEQ ID NO: 12700 - DNA, 84 bp, Homo sapiens
tttgttttgtttttgttttttagatggagtctcgctctgtagcccaggctggagtgaagtggcgcgatcttggctcactgcaag

SEQ ID NO: 12701 - DNA, 92 bp, Homo sapiens
gccaaaatgtattcatatatatgtatgcatatatatgtgtatatataatatatgcatatgtatacatatatatatgtataatgcataatagc

SEQ ID NO: 12702 - DNA, 105 bp, Homo sapiens
tttggtccagtgaaacagacgtctgatttctggcttccagaactgtatgaaaataagattgtattttcttaagctgccaaatttgtcgtcagtttcaagttcaag

SEQ ID NO: 12703 - DNA, 58 bp, Homo sapiens
tgagactgagtctcactctgtcgcccaggctggagtacagggtcacgatctcagctca

SEQ ID NO: 12704 - DNA, 108 bp, Homo sapiens
tatgtatataacacatatgtatgtatatatgtgtatatacatatatatgtatatagcacgtatgtatgtatatatgtgtatatacatatatatgtatatttatacata

SEQ ID NO: 12705 - DNA, 107 bp, Homo sapiens
tgctgggattacaggcgtgagccactgcgcctggcctaaacctctttttctttataaattaccccagtcctggctgggcgcggtggctcacacccataatcccagca

SEQ ID NO: 12706 - DNA, 117 bp, Homo sapiens
gattataaaccttcaatatctaagcttctgttaaattctttatttatatattatttacataaatatagccagaggaatgaacagatgttaaaagtacatttgatttggtgatgagtt

SEQ ID NO: 12707 - DNA, 98 bp, Homo sapiens
gcaagatttgatgtacccatatatgtaattttatatcaatttcttggatataaaatgaatccaagaaatgaatgaaaatgtgggtgaaaaatacaagc

SEQ ID NO: 12708 - DNA, 108 bp, Homo sapiens
ctgtctgtctatatatttatctctgtgtgtatatatatatatatatatatatatatatatatatatatatatatatatataaagtttaatgtattgaataagagatag

SEQ ID NO: 12709 - DNA, 62 bp, Homo sapiens
accaccttgggcgcatatcaggacctcctcaggttctgcatgtgcaagtccttaaccttggt

SEQ ID NO: 12710 - DNA, 116 bp, Homo sapiens
tagagaaagagtaatgcacacagatctgactgtgcgtggaggagacaggagtttttattattatttaaatcagtctccccattcattcagggatcggagtgttgaaggataatttg

SEQ ID NO: 12711 - DNA, 70 bp, Homo sapiens
tcatataggcatacatatatccatatatgtatatttataaacagctatgtgtatatatgtatatgtatga

SEQ ID NO: 12712 - DNA, 61 bp, Homo sapiens
agttccacatgtgtttatatatgtatacatttgtatgtatatgtatacatgtatatgagct

SEQ ID NO: 12713 - DNA, 116 bp, Homo sapiens
ataatatatcagactgattttagatttcattatggaattacatttattttttgcatatatttatagaaaatattatgtatttccatagataactggatatcttttgaaaatattat

SEQ ID NO: 12714 - DNA, 114 bp, Homo sapiens
caggaaaaggctaagtgagaatactagaagtccactctcataagacagtaatgaagctccacaatactgagagaagagagagaccctctcatattgctttatactcagtacctg

SEQ ID NO: 12715 - DNA, 128 bp, Homo sapiens
ctgacagtgctgtggcaggagaagaatggatggctcgttccttccaggtggcctcctttgacacttgagagggagctctttattactgatagcctgggatggaagtgtcagctcctcacatggtcttc

SEQ ID NO: 12716 - DNA, 93 bp, Homo sapiens
tatattggatttacatacatgtgtgtacatctgcatgtatatatccctaataatatatatgtgtatatatgtgtttgtatgtatataaatata

SEQ ID NO: 12717 - DNA, 115 bp, Homo sapiens
gcttctacctggctgcttctttcagaaattatattactgtcaatttgagagcccagttctgcaacagcatctcctactgttagtattagtctacagagaacatctgccactgagc

SEQ ID NO: 12718 - DNA, 84 bp, Homo sapiens
ctcctgtctcaccccgagtagctgggattacaggtgcgtagaaccacgcctgactaatttttctatttttagtagagacagggg

SEQ ID NO: 12719 - DNA, 58 bp, Homo sapiens
tgagacagagtctcactctgtcatccaggctggagtgcagtagtgtgatctcggctca

SEQ ID NO: 12720 - DNA, 125 bp, Homo sapiens
ttcttcatatgaaattgctgaagtctttaaactgtgtgtggaaaaaattgagtggattacttctgaacttataattaaggatatgacagttgatttgtgctgcttcttagaagaaggactcacag

SEQ ID NO: 12721 - DNA, 66 bp, Homo sapiens
ttgagcctatatgtgtctctgtctctgagatgggtctcctgaatacagcacactgatgggtcttga

SEQ ID NO: 12722 - DNA, 118 bp, Homo sapiens
ttctgtcaaattaacgtgttctccaattgcctattatatatttgtacagttaaatagtaaatagttgtttatatgcacaaaatgtaatagacaaaatggcggttacctttgatgaggg

SEQ ID NO: 12723 - DNA, 109 bp, Homo sapiens
gaaatatctattcagggttttatcaattttttaatcagagtattattattattttctattaaatttcttatatattctagttattgattccttgtcagatggatagttt

SEQ ID NO: 12724 - DNA, 115 bp, Homo sapiens
tagagccagtaatgaggatatatgaatgagggtaatgaggttgctgaatcatatgatagttctattttttatattttgaggaacctctacactgttctctttagtgactgtacta

SEQ ID NO: 12725 - DNA, 115 bp, Homo sapiens
agtactgttagtcacactatgctattattgtgctactatactattactgcttttaatatgattatattaaatagtacatgataagcatttagcacagagtctgtctcatagaact

SEQ ID NO: 12726 - DNA, 118 bp, Homo sapiens
tgtatagtttctccctagttttgtgtattcatttgtgtaaatcacaactttttttttattatactttaagttctgggatacatgtgcagaatgtgcaggtttgtgacataggtataca

SEQ ID NO: 12727 - DNA, 163 bp, Homo sapiens
acaaaaaatgtgtgtgtatggatatatatatatatgtgtatatatatgtgtatatgtatgtgtatacatgtgtatatatatgtatatacatgtatgtgtatatatgtgtatatatgtatatatatgtgtatatatatatacatatatgtgtatatatgtgtat

SEQ ID NO: 12728 - DNA, 105 bp, Homo sapiens
tgactagaattccaaggtaaaagctattgaatctttgtttatgtgtatgtccacatgtttagatgtgtttatgtacatatattatgatatatgttttgtctagca

SEQ ID NO: 12729 - DNA, 109 bp, Homo sapiens
gacaaaaatcttaggtgttcattataatctgtgatgattatttttatttctgtgcagtcagaaataccctctttgtcatttctgattttgtttatttgttttttttctc

SEQ ID NO: 12730 - DNA, 110 bp, Homo sapiens
gttagcattacccttgtgtttttttgcttatgtttactgcttatttaattattttattcaggtgacatttttaaattttgcatatagcctaagctagaacaaattctaac

SEQ ID NO: 12731 - DNA, 63 bp, Homo sapiens
ggcagtgttgaggcggcaggagccagtccgaggggacaggcttctcaggctcagtcactcacc

SEQ ID NO: 12732 - DNA, 90 bp, Homo sapiens
ggctggtctcaaactcttggcctcaagtgatctgtctgtctcagcctctcaaagttctgcaattataggtgtgagccactgtgcccggcc

SEQ ID NO: 12733 - DNA, 75 bp, Homo sapiens
acactacctcaaccaggtcatcaagttcagcatgtacttaaatcatgttgatagtgtgcacacttgatatggtgt

SEQ ID NO: 12734 - DNA, 93 bp, Homo sapiens
catatacagcagaatttaaatatactctgaggagaaagaaaaaaattatttctcagtaggtgttctttctgttagatagttagcttgtatatg

SEQ ID NO: 12735 - DNA, 79 bp, Homo sapiens
ctaggccatgaagaggctcaggaagaagtttgacaaagaaaactgagtatttctgagcactttagacatgagcatatag

SEQ ID NO: 12736 - DNA, 112 bp, Homo sapiens
ggagtagagtagggttttcactttttgaaaaaaagttaaaaaaaagtaacaaaagttaaagttttgttttttttttttttttttttgagacagagtctggctctgtcattct

SEQ ID NO: 12737 - DNA, 120 bp, Homo sapiens
atagggattgcattgaatttgtagatcattttggatagtatggacttttttattatattaattatttgttgcttcattttctttcatcagaattttatagttttcagtatgcaactctgt

SEQ ID NO: 12738 - DNA, 108 bp, Homo sapiens
gatacacacatctgtgtgtgtatatatacacatatacgtatacttgtgtatattgtttaaatattatgtatatacatgtgtgtatatatatatatatatgtatgtatt

SEQ ID NO: 12739 - DNA, 114 bp, Homo sapiens
gtctaaaacagtgtactcatgggatatgcacaggtttttttttttgttttgttttgtttttttttttaaattgagtcttgctctgtcacccagtctagagtgcagtggtgtgat

SEQ ID NO: 12740 - DNA, 69 bp, Homo sapiens
agaagtgtatatatatatgtgtgtgtgtgtatatatgtgtgtgtgtgtatatatatgtataaaactttt

SEQ ID NO: 12741 - DNA, 79 bp, Homo sapiens
ttgccactggctaaggtggaaaagaagctaggagaagtctccgtctctgactttctcatctcatatatgcctgtgccaa

SEQ ID NO: 12742 - DNA, 117 bp, Homo sapiens
ggtgtgcgttgttagagaggaaagtataatgtgtggcaggtaaacatgaaaccaaaggtctctggctcctggtttttattctaattctgttcacaaatttggttgaatttgtacatc

SEQ ID NO: 12743 - DNA, 116 bp, Homo sapiens
gtgcatatatatgtatatgtgtatgtatatgtatatgtgtatatatgtatatgtgtatatatacacacatatatacacatatatatatatatatatatatataacctgttttgtat

SEQ ID NO: 12744 - DNA, 110 bp, Homo sapiens
acagcttggtgagacgtgagtgagctctagctgagtgaatgtgggtggcagtatgtatgccacttccacacctggcccagaaaaaccttatccacttgaacctacactgt

SEQ ID NO: 12745 - DNA, 102 bp, Homo sapiens
tccatgcaggctgcctttatttttattttctattaattttatgtcatataggcagatattaagtaatataggaggcaaataaatcacccagtcttgcatgga

SEQ ID NO: 12746 - DNA, 61 bp, Homo sapiens
ttgagactgagtctcactctcgctctgtcacccaggatggagtgcagtggcactatctcgg

SEQ ID NO: 12747 - DNA, 84 bp, Homo sapiens
ggaaaagataagattaagagtgatatttatatacaacttcttaatttgcttttaagagaatttgtacttgatttttgcttttcc

SEQ ID NO: 12748 - DNA, 115 bp, Homo sapiens
tgtatagccattgctttttctccaccaccttgcctgcatctattaatgtttgattttttaataatagccattctgactggtgtgagatggtaactcattgtggttttgatttgca

SEQ ID NO: 12749 - DNA, 58 bp, Homo sapiens; identical to SEQ ID NO: 315

SEQ ID NO: 12750 - DNA, 87 bp, Homo sapiens
gtgctttgatctcattttgtagaactgtggtgtgaagactcctttgaaaattggacttccacagtagagcttaacgggtaaaagcat

SEQ ID NO: 12751 - DNA, 76 bp, Homo sapiens
atatatatatatatattatatatatgtatatataccatatgtatatatacatatgtatgtgtgtatgtgtgtatat

SEQ ID NO: 12752 - DNA, 66 bp, Homo sapiens
ttatagagtcttggctgagaacaagaatataaatagtgttcttggtctctctcagtggctctgtag

SEQ ID NO: 12753 - DNA, 106 bp, Homo sapiens
cctaactcacagtggtttagagctatataaatatgaggtttctttcttttctttttttttttttgagacagagtctcactctatcacccaagctggaggacaatgg

SEQ ID NO: 12754 - DNA, 112 bp, Homo sapiens
cccactgcaccttattcatgggtttgaggaactgtattacgctctagcattcttgaggatagagtagagagtgagcagcatgtaaagccaaaacgcagaatcagagtttggg

SEQ ID NO: 12755 - DNA, 76 bp, Homo sapiens
tagcttcagttgagacttaggtaaaataacaaggcttcggatttgaaatcttgtgtttttctacttctctaggctg

SEQ ID NO: 12756 - DNA, 58 bp, Homo sapiens; identical to SEQ ID NO: 315

SEQ ID NO: 12757 - DNA, 111 bp, Homo sapiens
gctcccactgatctttcccagagctcagctcctgctgcagtcaggtatttgtcaacagacagactctgagtgtgtcctctgtgccaagccctgaggaaagaaggcgggtgc

SEQ ID NO: 12758 - DNA, 114 bp, Homo sapiens
tctgctcttttccattggcctatgtccctgttttcataccagtaccatggtttttttgtttataaagacacatgcactcgtatgttcactgccatgctattcaaaatagcaaga

SEQ ID NO: 12759 - DNA, 95 bp, Homo sapiens; identical to SEQ ID NO: 68

SEQ ID NO: 12760 - DNA, 93 bp, Homo sapiens; identical to SEQ ID NO: 69

SEQ ID NO: 12761 - DNA, 102 bp, Homo sapiens
gtacttggttgttcaatttgcttaaaaggagaaatgaataaatgtgtgattatatatcaatttatgagctatgtctaatgattaagctggatgatcagggac

SEQ ID NO: 12762 - DNA, 118 bp, Homo sapiens
cctggaagattgaagggtggatcttttttttttttctctgagacagagtctcactcagtcgctcaggctggagtgcagtggcacgatctcggctcactgcaagctccacctcccgggc

SEQ ID NO: 12763 - DNA, 114 bp, Homo sapiens
gctagcagattatatgcatatgtggtacatatatctatatatgaatatatacatatggatatgtttgtttatatgtctgtacagattgtataatatgcatatatatgcctcagc

SEQ ID NO: 12764 - DNA, 86 bp, Homo sapiens
gggatatcatgatgttaccattatctattgccctcatataagtctcatgtagaaggtactttagtagatgtggtaaatatcatacc

SEQ ID NO: 12765 - DNA, 119 bp, Homo sapiens
tattccaggtcagagaagaggctaatgacaaatggacttgtggaatctttcattatatataggtattgaacactctggtgcataagcaggttcttttatgactttctagaatgttggag

SEQ ID NO: 12766 - DNA, 95 bp, Homo sapiens; identical to SEQ ID NO: 68

SEQ ID NO: 12767 - DNA, 93 bp, Homo sapiens; identical to SEQ ID NO: 69

SEQ ID NO: 12768 - DNA, 112 bp, Homo sapiens
ggattgacttggcaatgcgggctcttttttggttccatatgaaatttaaagtagtttcttccaattctgtgaagaaagtcattggtagcttgatggggatggcactgaatct

SEQ ID NO: 12769 - DNA, 67 bp, Homo sapiens
gatgggaggcaggactagattgcagctctgactcagacagacagagcagtgtgtggaggctcgcatc

SEQ ID NO: 12770 - DNA, 83 bp, Homo sapiens
aagggccagtctcactccctctgtgcccccaccaacagcaccaagtctgtttccaggcagtgagtaagcggggctgagaactt

SEQ ID NO: 12771 - DNA, 111 bp, Homo sapiens
ggtagagaaagaccatcaagtaggggcaggttagtggtgtctgagctcagactctctttgtgtgggacttgctgcagctgctgtgggtgatgggggtgtggttctcaggcc

SEQ ID NO: 12772 - DNA, 59 bp, Homo sapiens
ttgagatggagtctcactcattctgtcatccaggttggagtgcagaggcacgatcttga

SEQ ID NO: 12773 - DNA, 58 bp, Homo sapiens; identical to SEQ ID NO: 637

SEQ ID NO: 12774 - DNA, 65 bp, Homo sapiens
ggttgtttctttggagtgtgtgcccaaacaaaaaaagtttgttttactactttaaagagacagcc

SEQ ID NO: 12775 - DNA, 170 bp, Homo sapiens
acgtatatacgcatatgtacatatacatatattaccatacatatatgtatatatacatatagtacatatattatacgtatatgtataatttattatattattatattaatgaattaattaattcattcattaatatattaatatattattatattatacatatacgtata

SEQ ID NO: 12776 - DNA, 58 bp, Homo sapiens; identical to SEQ ID NO: 1101

SEQ ID NO: 12777 - DNA, 56 bp, Homo sapiens; identical to SEQ ID NO: 1102

SEQ ID NO: 12778 - DNA, 73 bp, Homo sapiens
ctgtctgtgtgtctgtctcattctgtcacccacccgagctggagtgctgtagagtgatcatggctcactgtag

SEQ ID NO: 12779 - DNA, 75 bp, Homo sapiens
gggctgggcacggtgactcatgcctataatcccaacactttgggaggctgaggtaggaggatcatttcagcccag

SEQ ID NO: 12780 - DNA, 104 bp, Homo sapiens
cagagtagtggttgctgaagattggggtggctgtggcaatttcttaagacaacaacgaagtctgtcacactgattgactcttcatttcacaaaagatttctctg

SEQ ID NO: 12781 - DNA, 113 bp, Homo sapiens
ccaggataaagaattcaggaaaagaaacatatttggtgaggtagaagggagattagtactgtttttagaattcacttaccttcatcagcattcatctaggagcaattatcagg

SEQ ID NO: 12782 - DNA, 123 bp, Homo sapiens
gacagagagaggaagtgccaggctttttttttttttttttttttgagatggaatctctctctgtcacccaggctggagtgcagtggcgcaatctcagctcactgcaacctccacctcccaggt

SEQ ID NO: 12783 - DNA, 112 bp, Homo sapiens
catctcatcctgtcaaccaggctggagtgcagtggtgctcacagtgagaggtgacagcgaggtgacagcatgctggcagccctcgcagcccttgcttgctctcggtgcctcc

SEQ ID NO: 12784 - DNA, 97 bp, Homo sapiens
tgggagggacctgagtgatctgtaactatttatatttataaggcataaaaggtagtaagcatagtgtaagtggaaggagacctggattttgctccca

SEQ ID NO: 12785 - DNA, 102 bp, Homo sapiens
ttgccttgaggaaacatttaactaatctaccatcagaagtcatattcttttttttatttcagaatatttgatgtctgtagtggcaggatttacttaaagcag

SEQ ID NO: 12786 - DNA, 127 bp, Homo sapiens
atatatatacctatgtatatatacgtatatatacataggtatatatgtgtatatatacacatgtatatatgtatatatacgtatatatatacataggtatatatgtatatatatgtatatatataca

SEQ ID NO: 12787 - DNA, 153 bp, Homo sapiens
gtgtgtgtgtgtgtgtgtgtgtgtgtagtgtatatatatacatatatatacatatatacctatgtatatatatacgtatatatacatatatacatgtgtatatatacacatatatacctatgtatatatacgtatatatacataggtatatat

SEQ ID NO: 12788 - DNA, 58 bp, Homo sapiens
tgagatggagtctcactctgtcacccaggctggagtgcagtggcgggatctcagttca

SEQ ID NO: 12789 - DNA, 104 bp, Homo sapiens
ctagatgttgagcaacttgaaattccagaacaagagtacagctgtgtaataaagatgcattctagtgaatttgttcatatatgccaagatctcagtcatattgg

SEQ ID NO: 12790 - DNA, 112 bp, Homo sapiens
tgaatctctcaggctcttagagtcacacttgcttaaaaatatatatatattaacacaaagtacaaatgttggaaggttcacagttgtgacccctaggagcttggcaggccca

SEQ ID NO: 12791 - DNA, 83 bp, Homo sapiens
gtcttgatttcagtgctgaattacattggtgttgattcatatcaatttctatttcactgttgtaaagtactgccaatcaaaac

SEQ ID NO: 12792 - DNA, 81 bp, Homo sapiens
tatatatgtgtatgtgtatatatgtgtatatgtgtatatatattatatacgtatatatatgtgtacatgtgtgtatgtgtg

SEQ ID NO: 12793 - DNA, 139 bp, Homo sapiens
tgtatacatgtatgtgtgtacacgtatatatgtgtatgtgtatatgtatatatgtatatacatatatatgtatatgtatatgtatgtacccatgtgtgtacatgtgtgtatatatgtgtatatgtgtgtgtatatgtgt

SEQ ID NO: 12794 - DNA, 123 bp, Homo sapiens
atgtatacatacaagtgtatatatacacatacatgtatatatatgcatgtgtgtgtatatgtatgtgtatgtatatatatacacacacacacacatatatatatatatttggtatttaagcat

SEQ ID NO: 12795 - DNA, 109 bp, Homo sapiens
ggacatgttttaaacattgtttttttacctccccaaatatatattgattttacattaaaatacactgatcatttgggaacctcaagaaacagttcagaaaatgttttcc

SEQ ID NO: 12796 - DNA, 109 bp, Homo sapiens
ggaatttgtactatagggcagatagtttacatagttaagggattgtatttatatataaatatgtattccagcgtagaaattattggctaggtctgtaatcaagtattcc

SEQ ID NO: 12797 - DNA, 95 bp, Homo sapiens; identical to SEQ ID NO: 68

SEQ ID NO: 12798 - DNA, 93 bp, Homo sapiens; identical to SEQ ID NO: 69

SEQ ID NO: 12799 - DNA, 137 bp, Homo sapiens
cagtttctcaagtcagtggtaggtgcagcatcttggaagcccactcaaaggaggtgaaggactgacagaacacacggtgctggaagcatctgcctttctctcttgatgcctctggtcgcaggttttcacaaatgcat

SEQ ID NO: 12800 - DNA, 95 bp, Homo sapiens; identical to SEQ ID NO: 68

SEQ ID NO: 12801 - DNA, 93 bp, Homo sapiens; identical to SEQ ID NO: 69

SEQ ID NO: 12802 - DNA, 81 bp, Homo sapiens
gtggggttggaatggcagaggtctcttgaagctcatctcattctccagcggtaggtactttgtttatttattttcccccac

SEQ ID NO: 12803 - DNA, 119 bp, Homo sapiens
acatatatatatgtgtgtatatatatgaacatatatatatgtgtgtatatatatgaacatatatatatgtgtgtatatatatgaacatatatatatatgtgtgtatatatatattcaga

SEQ ID NO: 12804 - DNA, 102 bp, Homo sapiens
acatatatatatgtgtgtatatatatgaacatatatatatgtgtgtatatatatgaacatatatatatgtgtgtatatatatgaacatatatatatgtgtgt

SEQ ID NO: 12805 - DNA, 102 bp, Homo sapiens; identical to SEQ ID NO: 12804

SEQ ID NO: 12806 - DNA, 102 bp, Homo sapiens; identical to SEQ ID NO: 12804

SEQ ID NO: 12807 - DNA, 102 bp, Homo sapiens; identical to SEQ ID NO: 12804

SEQ ID NO: 12808 - DNA, 102 bp, Homo sapiens; identical to SEQ ID NO: 12804

SEQ ID NO: 12809 - DNA, 88 bp, Homo sapiens
atatatatatatatgaatatatatatgaacatatatatgtgtgtatatatatgaacatatatatgtgtgtatatatatgaacatatat

SEQ ID NO: 12810 - DNA, 113 bp, Homo sapiens
ggctctgtgatttcctgtcaaatagagatgatgaaagtgactctgtcagtttctgaaataggtcttaagaaactggcactgtctgcctcctgtctctggggatacttactgtt

SEQ ID NO: 12811 - DNA, 122 bp, Homo sapiens
tggttgcaaagattcatgggagaagcatggtttccagggtgggatcacacaatcactcactgcttctcttggctggggtgtgggttcctttggctctgtgctgctcctgcgtgggccattgc

SEQ ID NO: 12812 - DNA, 105 bp, Homo sapiens
gtatgaggcttagtttagctggatatgaaattctgggttggaaattattttctttaaaatgttgaatattgcaccccaatctcttctggcttgtagggttcccac

SEQ ID NO: 12813 - DNA, 116 bp, Homo sapiens
tgcttaggattgtcttggctatacgggctcttttttggttccatatgaaatttaaagtagttttttctaattttgtgaagaaagtcaatggtagcttgatgggggtagcactgagt

SEQ ID NO: 12814 - DNA, 115 bp, Homo sapiens
acatttcaactgtttagtttttaaaaatggggtataacatattttaaggtaaatatatgaatatctttgtatgtcactagttgcatttttctataacattaaagagttgagtagt

SEQ ID NO: 12815 - DNA, 73 bp, Homo sapiens
gttttgaacacagacactcagagactgtaggcaacctgatttttctgctcttgagtctcttcctgtgtaaagc

SEQ ID NO: 12816 - DNA, 115 bp, Homo sapiens
ggcatcattggcttctgtcttttctgctatttatgtggtgtgggtagtccctgatgtgactcacacagtgtctagtatacatgaagtgcacagcggaaactagaaaatagttgct

SEQ ID NO: 12817 - DNA, 58 bp, Homo sapiens; identical to SEQ ID NO: 1281

SEQ ID NO: 12818 - DNA, 71 bp, Homo sapiens
ttgtttttgagatgaagtctcactctgtcactcaggctggagtgcagtggtgtgatctcagctcactgcag

SEQ ID NO: 12819 - DNA, 108 bp, Homo sapiens
ttctaggcatttgacatatatctgtaaacaaaaaaagagaatgatcccacctgtgtagagactcattctcctagaaatgtttagaagctatgtgatagaaaaaaagga

SEQ ID NO: 12820 - DNA, 95 bp, Homo sapiens; identical to SEQ ID NO: 68

SEQ ID NO: 12821 - DNA, 93 bp, Homo sapiens; identical to SEQ ID NO: 69

SEQ ID NO: 12822 - DNA, 95 bp, Homo sapiens; identical to SEQ ID NO: 68

SEQ ID NO: 12823 - DNA, 93 bp, Homo sapiens; identical to SEQ ID NO: 69

SEQ ID NO: 12824 - DNA, 83 bp, Homo sapiens
cctgcctgtagccccagctactccgaaggctgaggtaggaggatcacttgagcctataagtttgaggttacaatgaggtatgg

SEQ ID NO: 12825 - DNA, 106 bp, Homo sapiens
ttctacttcccagagttagtcattctcaaaaatgtatatatatacacatacatatacatgtgtatatatatacatttttgagaatgactaactctgggaagtagaa

SEQ ID NO: 12826 - DNA, 146 bp, Homo sapiens
atatatatatgtatatatgtatatatatgtatatatgtgtatatatgtatatatgtatatatgtgtatatgtatatatgtatatatgtgtatatgtatatatgtatatatgtgtatatgtatatatgtatatatgtgtatatgtat

SEQ ID NO: 12827 - DNA, 108 bp, Homo sapiens
gaggtattgtgtgaattaccgaaatgtgacacagagacttgagtgagcacaacctgttggaaaaatggtgctgatagacttgcttgacacaaggtttctacaaacctt

SEQ ID NO: 12828 - DNA, 120 bp, Homo sapiens
tacatatatatgtgtatatatatgtatacacattgtatatatatgtatacacatatatgtgtatatatatgtatacacatatatgtgtatatatatgtgtatacatgtatacacacatat

SEQ ID NO: 12829 - DNA, 88 bp, Homo sapiens
tgtaatcacatacatgtatgtatatgtctgtaatcacatatatgtatgtgattatatatgtatgtgatatatacttaaataagagtac

SEQ ID NO: 12830 - DNA, 103 bp, Homo sapiens
atgttgattttgtatactgcaactttactgaatttatttattagatctaagagggttttattggtggagtctataggtttttccagatataggatcatatcat

SEQ ID NO: 12831 - DNA, 66 bp, Homo sapiens
gccttcctcaggggtctcagggcatctgaggtcttttcagggtccctgggtccctctgtggagagt

SEQ ID NO: 12832 - DNA, 102 bp, Homo sapiens
gagacaaggttttagcctgcagctggagcagctttattgtcagtagatacacagtttctataaggttgctttaaaaaatagtgaacattgcctgtaggtctc

SEQ ID NO: 12833 - DNA, 108 bp, Homo sapiens
tctgaggatgtacatatatatatataatgtgtgcatgtgtgtacataaaatatatgagttacatatatatatataatgtgcgtatgtgtgtacataaaatatatgaga

SEQ ID NO: 12834 - DNA, 110 bp, Homo sapiens
tgatgttcttggcaaagctagaagggaggagttaatcataaggcctggcatgtgctgagcactcactgtgtgtcacactttcttctgaatgctgtactgcatatgcatca

SEQ ID NO: 12835 - DNA, 95 bp, Homo sapiens; identical to SEQ ID NO: 68

SEQ ID NO: 12836 - DNA, 93 bp, Homo sapiens; identical to SEQ ID NO: 69

SEQ ID NO: 12837 - DNA, 102 bp, Homo sapiens
tggaacttatctttgtgtgtatatatatgtgtgtgtatatatatacacatatatgtatatgtatatatgtatactcttgtctttattaattataatgtttta

SEQ ID NO: 12838 - DNA, 68 bp, Homo sapiens
gggcacttaccatgaatagggcttacaggactggaagttgccctgggtgagtcagtgagtgagtggcc

SEQ ID NO: 12839 - DNA, 125 bp, Homo sapiens
ttgcatgtatatatgcatatatatgcatatgcttatcatttatatatgtgaatgtacatgtatatatgtatatacatgtaaatgtgtatatatgtatatacatgtatatgtgtgtatatgtaaat

SEQ ID NO: 12840 - DNA, 81 bp, Homo sapiens
tctttagctatatggtgaatcagcagaccatgctctgtgggacagtgtctgtcagagtttgttttgtgttgctatgaaaga

SEQ ID NO: 12841 - DNA, 109 bp, Homo sapiens
tgtcacgtacctaactcttgccaaccatgtgacaggtttagacttcctttttttttttttttttttgagaccgagtctcactctgtcaccaggctggagtgcagtggca

SEQ ID NO: 12842 - DNA, 95 bp, Homo sapiens
atatatatatgtatgtatatgtaaatatatatgaaatgtatatatatttcatagggcacattcacatatatatacacacacatatatatatatat

SEQ ID NO: 12843 - DNA, 86 bp, Homo sapiens
atatacatattggcagtgtgccttcatgaattattcatatatttatgaatattttcattaagagggtatatcagaaatagctttat

SEQ ID NO: 12844 - DNA, 127 bp, Homo sapiens
tcagggcaacaaatcagcacaggtaaggattctctaactttgccaggataataaaaaatggttgacagaagaaagactgcctgtaagatttccctgattattgtttaggaggaaacattgcctttgc

SEQ ID NO: 12845 - DNA, 71 bp, Homo sapiens
tatacttatatatatttatagatatcaatatatagatctatatattgatatctataaatatatatgttata

SEQ ID NO: 12846 - DNA, 103 bp, Homo sapiens
tctagaggaaatttcttgttttgtgtgatctatatatgtatatatgcacacacaaatgtatacataaacacacacatatgcattgctggtttatgctctgtga

SEQ ID NO: 12847 - DNA, 105 bp, Homo sapiens
aacacatggtttaaacttttaaaatattagtatacatttattggtttaaaccaataaatgttttttaaaatattagtatgcatttattggtttaaatcaagtgtt

SEQ ID NO: 12848 - DNA, 116 bp, Homo sapiens
tttatgcctaacaaatgagactggctcacatcaggtcttcagtaatgacagattgagtaaattaattaattaacacgttagaagtccttctagacctagatcaagtaggttctgaa

SEQ ID NO: 12849 - DNA, 114 bp, Homo sapiens
taggagccaagcatgttgaagccagaggatgggcacacagaaagagtcagaagaatctgaggagaattgctggagtactgatagcttctgcttcaaatgttgctatattacctg

SEQ ID NO: 12850 - DNA, 72 bp, Homo sapiens
agggagaggatcagcaacaaacatggcatcagtggagaatcctatgagctagttttttctttttctttttct

SEQ ID NO: 12851 - DNA, 93 bp, Homo sapiens
catttaaatctccttaaatatttgaaatatatttataaatttaatttctttgatttttaagtacttctaatgttgacagggtaggtttaaatg

SEQ ID NO: 12852 - DNA, 65 bp, Homo sapiens
gtctattggtttggagcagaagataactttatatttttagttcattgatctctggatcaatagat

SEQ ID NO: 12853 - DNA, 112 bp, Homo sapiens
agcaggagtggcaagcacgtcctgttcttgtactgtgatactgcatgagtaactgagtgctgccaccattgttaatcttaacaggcaaggctcatatttaggtggttcaaag

SEQ ID NO: 12854 - DNA, 67 bp, Homo sapiens
catccgtgtgaagagacaagcaaacaggctttgtgtgagcaacaaggttgtttatttcacctgggtg

SEQ ID NO: 12855 - DNA, 96 bp, Homo sapiens
ttcagttttataagagggataataaaactccttatctgggttattgagaaatttttttttttgacatggagtttcactcttgttgcccaggctgga

SEQ ID NO: 12856 - DNA, 58 bp, Homo sapiens; identical to SEQ ID NO: 637

SEQ ID NO: 12857 - DNA, 108 bp, Homo sapiens
ctgagttggttctattgttaagtagcatatttactccttttgacttggaaatttttttcttttaaaagtggccatgggctttatttaataacttttaccagagagcag

SEQ ID NO: 12858 - DNA, 77 bp, Homo sapiens
gtttctggttgatttaggggtagaaataagtaaagccaattttacattatttttaagtcacttaagggaatcagaac

SEQ ID NO: 12859 - DNA, 118 bp, Homo sapiens
ccaaagagcgtaaaccctaacatgggctagaaaatattcattttcaactgttgtgatttttaactattgtaattgaattttgaagacaatgttaatccttgagtttaccaatcttggg

SEQ ID NO: 12860 - DNA, 83 bp, Homo sapiens
gttgcttctcaaggatgagcaaagaagatagtttctttagaatctaaaaaatctactttctttgctcatccttgagaagcaac

SEQ ID NO: 12861 - DNA, 116 bp, Homo sapiens
tctccagggccggtccctgatgccttatttaactcatttggtgagttcttttttttttttttttttggatggtgttgatgctggtagatgttctttagtgactggccattaaggga

SEQ ID NO: 12862 - DNA, 84 bp, Homo sapiens
ccaaatggctgggattacagatatcagccagctaatttttttttttttttttgaggcggagtctggctctgtcacccaggctgg

SEQ ID NO: 12863 - DNA, 78 bp, Homo sapiens
gaatgatggagtgttctcttgaccaggactattttttttttttttttttttttgagagggagtctcactctgtcactc

SEQ ID NO: 12864 - DNA, 282 bp, Homo sapiens
tatatatatgtatatatgtatacacatatgtatatgtgtgtatatatgtatatatgtatacacatatgtatatatgtgtatatatatgtgtctatgtatacacatatgtatatatgtgtatatatatgtgtctatgtatacacatatgtatatatgtgtatatatatgtgtctatatatacacatatgtatatatgtgtatatatgtgtctatatatacacatatgtatatatgtgtatatatgtgtctatatatacacatatgtatatatgtgtatatata

SEQ ID NO: 12865 - DNA, 70 bp, Homo sapiens
atatatgtgtatatatatgtatatatgtatacacatatgtatatatatgtatatatgtatacacatatgt

SEQ ID NO: 12866 - DNA, 96 bp, Homo sapiens
ctgagcagctgtgactacaggtactgtgactatgggtacgggccaccacgcccagctaattttgttgtagatatagggtttcgctatgttgcctag

SEQ ID NO: 12867 - DNA, 88 bp, Homo sapiens
ggcagactgtgtcagaggaatgatctgtgactcaagggcttctgttcagattcttttgtcccacatggtgcttccttaatgtagtgct

SEQ ID NO: 12868 - DNA, 100 bp, Homo sapiens
ttcatgcaattggcaaatggcatacagtcctatttttaaaaaatattttattttttagtttcaatagttctggggaagatgtggtctttagttacatgga

SEQ ID NO: 12869 - DNA, 86 bp, Homo sapiens
gctgttcattgtagataaagatgttaatttcctggggagcttccatgactttcaggacaaagttcaatttttatatatggtttagc

SEQ ID NO: 12870 - DNA, 104 bp, Homo sapiens
gggggaataagttctagtgttctatagcaccgtgagtgattatagttaataacaatttattgtatattttcaaatagctagaagccaagattttgaatgctccc

SEQ ID NO: 12871 - DNA, 58 bp, Homo sapiens
tgagacagagtctcgctctgtcacccaggctggagtgcagtggtgtgatctctgctca

SEQ ID NO: 12872 - DNA, 61 bp, Homo sapiens
gctcatcagaattcattttgcggcaaggtggccatagtagagtgatcactgccaggtgagc

SEQ ID NO: 12873 - DNA, 95 bp, Homo sapiens; identical to SEQ ID NO: 68

SEQ ID NO: 12874 - DNA, 93 bp, Homo sapiens; identical to SEQ ID NO: 69

SEQ ID NO: 12875 - DNA, 115 bp, Homo sapiens
taagttgaagttttttctcaaataaacttggtagtccattatctcaagtttctgtcacacagattctctaattttttaatggattctgatttattttagtagaaaatgtaagtta

SEQ ID NO: 12876 - DNA, 107 bp, Homo sapiens
ccttgataggtttggtgttctgcatgagtggtaaaactgattttttttaaaatgcgatttaaaagaaaaaaaaaagatttgtccctttggtgaaatactcttagagg

SEQ ID NO: 12877 - DNA, 96 bp, Homo sapiens
agatgatatctcattgtggttttgatttgaatttctctactgattagtgatgatgagaattttttcatatatttgttggccacatgtatgtcttct

SEQ ID NO: 12878 - DNA, 95 bp, Homo sapiens; identical to SEQ ID NO: 68

SEQ ID NO: 12879 - DNA, 93 bp, Homo sapiens; identical to SEQ ID NO: 69

SEQ ID NO: 12880 - DNA, 95 bp, Homo sapiens; identical to SEQ ID NO: 68

SEQ ID NO: 12881 - DNA, 93 bp, Homo sapiens; identical to SEQ ID NO: 69

SEQ ID NO: 12882 - DNA, 103 bp, Homo sapiens
ctatacattgaaagtgggtatataactttttagagttatagatttattatcattatttgatctaggacctaagataatatctatttcacagcctcaattgtag

SEQ ID NO: 12883 - DNA, 92 bp, Homo sapiens
gtggcaattgtgaatggaattacattcctgattttgttcttggcttggccattgttaatgtataggaatgctagtgatttttatatgctcat

SEQ ID NO: 12884 - DNA, 87 bp, Homo sapiens
tatatatatgtgtatatatatgtatacatatataaatactatatatgtgtatctatgtatatatgtatacatatgtatacatatata

SEQ ID NO: 12885 - DNA, 190 bp, Homo sapiens
tatatatgtgtatatatacatgtatgtgtgtttatatatgtgtatatatacatatatgtgtgtttatatatgtgtatatatacatatatgtgtgtttatatatgtgtatatatacatatatgtgtgtttatatatgtgtatatacatatatgtgtttatatacatataatacacatatgtatttatatat

SEQ ID NO: 12886 - DNA, 69 bp, Homo sapiens
ttgtttgagacagagtctcgctctgtcacccaggctggagtgcaatggcgtgatcttggctcactgcaa

SEQ ID NO: 12887 - DNA, 98 bp, Homo sapiens
tactaaatatttagactgcacttttagttctctctccaatatatgtatatatatcagagaaagagaattatataatcgtgtgtttgtgtgtgtgtgta

SEQ ID NO: 12888 - DNA, 103 bp, Homo sapiens
ggagtgtaattggtagatcatagggtagttgcatgtttagtttttaaagaaactgctaaactactaaactgctttccagagtggctgtaccattttacatccc

SEQ ID NO: 12889 - DNA, 109 bp, Homo sapiens
ggactgctgaacttagagaatgaattatttgggaaaggggaagaaggtgataattcttttctctctcacactgtcatccatcgccataatcctgttttcattgcacttc

SEQ ID NO: 12890 - DNA, 120 bp, Homo sapiens
aattccagacatcatatagtgctgagagacactgaatttgtaataatccagggtggaaagacatcactgaacattgtgagcattcagttgtgatttcagaaagaccacacgatgggagtt

SEQ ID NO: 12891 - DNA, 90 bp, Homo sapiens
atttaaagaaacataactatagcagaaatcatcactttatgtatatttttacattcttgatgatttcttcagtggatttatggtgtgaat

SEQ ID NO: 12892 - DNA, 109 bp, Homo sapiens
gagggttgtgtgtaacacggtgctactgaagctttttgccacttcaggatttatatttgtattttcatcagtggcataaatatgtcagtcacagttggtagcagctgtc

SEQ ID NO: 12893 - DNA, 76 bp, Homo sapiens
ccacatgcaccactagaggggtctgaggacaggcctgccctggctctacactcccactcagtgcctgagcaaatgg

SEQ ID NO: 12894 - DNA, 112 bp, Homo sapiens
ctggggttggactgcacagtttgagctgacccaattggctacttgtacatatttttttaaatatagaaggggagggggacagaggtggagcgtgtgagatgtgcagtttcag

SEQ ID NO: 12895 - DNA, 67 bp, Homo sapiens
gcctgacatgagagccagcagacagcccaggccagggtaggcagtgcctgcttctgctctgtcaggt

SEQ ID NO: 12896 - DNA, 126 bp, Homo sapiens
atatatatttgtatatgtatgtatatatgtatatatacagtatatgtatgtatgtatatatacagtatatgtatatatatacgtatatgtatatatgtatatatacagtatatgtatatatataca

SEQ ID NO: 12897 - DNA, 71 bp, Homo sapiens
gtgtactttatttcatgctaagatgtcattttggccttaataaggcttttggcatgtaatgaagcatgcac

SEQ ID NO: 12898 - DNA, 75 bp, Homo sapiens
ctgaggcagggaggatcacttgagtccaggacttcgagaccagcctgggtaacacagtgagactctgtctcttag

SEQ ID NO: 12899 - DNA, 107 bp, Homo sapiens
tggtatatacctggaaatggaattgatggatcatatggtaattctatgtttaatttttggaggaaccatcatcatatggttttttttttttcacagcaggtacatca

SEQ ID NO: 12900 - DNA, 110 bp, Homo sapiens
gacacaaggaaataggtgggtgctatagttgtaacatataaagtatcgtttttatagtacttctcattttgtacttatttttgtactcatcctgtttaaacacttctgtt

SEQ ID NO: 12901 - DNA, 103 bp, Homo sapiens
tctgtgaattagttgtgcatatgttttgcccatgtttcttttttttttcttttcagcttttattttaggttcaaggggtacatgtgcaggtttgttacatgga

SEQ ID NO: 12902 - DNA, 117 bp, Homo sapiens
agatgcttcatgttgatgattgtggaataaaacctgtgtatttgttggatttagagctctaagtttttttaatatatttttcaggctctactgtctttaatgtcctcagaggagttt

SEQ ID NO: 12903 - DNA, 116 bp, Homo sapiens
cttcatcctgatttgtctccaatttcacagaaaaaattcaatttgaaaatgtatctattttcaaaaaacattttcagatggtcttggatgggaagcttttaagtacatggtagaag

SEQ ID NO: 12904 - DNA, 78 bp, Homo sapiens
cttggggttagtttagattctgtttttaggggcaattagtagctaaatctcagaacaaagtcagaagaatatcctaag

SEQ ID NO: 12905 - DNA, 120 bp, Homo sapiens
atatacttataagtatataagtgtatatatacttataagtatataagtgtatatatatacttttaagtatatgtgtatatatacttataagtatatataagtgtatacatatatatgtat

SEQ ID NO: 12906 - DNA, 68 bp, Homo sapiens
tgagccgagatggtgccactgcactccagcctgggtgacagagcaagacagagacactgtctctctta

SEQ ID NO: 12907 - DNA, 95 bp, Homo sapiens; identical to SEQ ID NO: 68

SEQ ID NO: 12908 - DNA, 93 bp, Homo sapiens; identical to SEQ ID NO: 69

SEQ ID NO: 12909 - DNA, 117 bp, Homo sapiens
gtgtctctctgtgtgtatttgggtctccgctcaccactttgggctctcagactctctgtttattttacagatgaggaaaccgaagctctaaaaggggagtagaatgcacgtagccac

SEQ ID NO: 12910 - DNA, 60 bp, Homo sapiens
gtgagacggagtctcgctctgtctcccaggatggagtgcagtggcgcgatctcggctcac

SEQ ID NO: 12911 - DNA, 84 bp, Homo sapiens
tgtgagttaaaacttaatagtgagaaaactcttagtgagaaactggcagatttttttttattatactttaagttttagggtaca

SEQ ID NO: 12912 - DNA, 97 bp, Homo sapiens; identical to SEQ ID NO: 1307

SEQ ID NO: 12913 - DNA, 88 bp, Homo sapiens; identical to SEQ ID NO: 1308

SEQ ID NO: 12914 - DNA, 81 bp, Homo sapiens; identical to SEQ ID NO: 1309

SEQ ID NO: 12915 - DNA, 77 bp, Homo sapiens; identical to SEQ ID NO: 1310

SEQ ID NO: 12916 - DNA, 86 bp, Homo sapiens
tttgtcatgccactatcttggtggccagcattctatagagaaggaatagtcagtgtgggtcctgaggttgtagcatgtttagcaaa

SEQ ID NO: 12917 - DNA, 79 bp, Homo sapiens
cctaggctttgaggattgtgtgacaattgttattctatattttgaaattagttgaatatactttcctttaaagtatagg

SEQ ID NO: 12918 - DNA, 95 bp, Homo sapiens; identical to SEQ ID NO: 68

SEQ ID NO: 12919 - DNA, 93 bp, Homo sapiens; identical to SEQ ID NO: 69

SEQ ID NO: 12920 - DNA, 68 bp, Homo sapiens
gtgtgcttgtgtgtgcgtgtgaagtgcttgttaaagtactgtgcttattatattatatataagcatat

SEQ ID NO: 12921 - DNA, 97 bp, Homo sapiens
acacttgaggaattgtagacagttttgacatggcattactctctctctgggtgtgagtaagcctgggcacaagctgtatgtatagtgttagcagggt

SEQ ID NO: 12922 - DNA, 84 bp, Homo sapiens
ctcagagcttttttttattatagattcaggggttacatgtgcagatgtgtgacatggatatattttgtaatgctggggtttggg

SEQ ID NO: 12923 - DNA, 104 bp, Homo sapiens
gtagatagacagtcatcctcctggcctctggttgaagcttgtatgggttgttccaatcaaagtttagttctcagaggctttcttaggtttgatttttttcccac

SEQ ID NO: 12924 - DNA, 62 bp, Homo sapiens
atgtgtgtatatatatatgtgtgtgtgtatacatacacacacacatatatatacacacacat

SEQ ID NO: 12925 - DNA, 71 bp, Homo sapiens
gtgtgtgtgcatgtatgttttttattttttgcaataatgtaatgtaagagtgctttgaagtgcacacatat

SEQ ID NO: 12926 - DNA, 100 bp, Homo sapiens
agatataagagaaacgtcatttagagcaggatttaaggaagcttgaagataatttcttcatctgtttctctgtagttctgtgagttgtttctctctctct

SEQ ID NO: 12927 - DNA, 95 bp, Homo sapiens; identical to SEQ ID NO: 68

SEQ ID NO: 12928 - DNA, 93 bp, Homo sapiens; identical to SEQ ID NO: 69

SEQ ID NO: 12929 - DNA, 168 bp, Homo sapiens
ccttttaatagctgagtagtatttaaaggtgtgtatatgtatatgtgtgtgtgtgtatatatatatatacacttatatatctaatggctgagtagtattcaatggtgtgtatatgtgtatatatacttacatatctaaatgtgatttatgtatatatatttacatatc

SEQ ID NO: 12930 - DNA, 104 bp, Homo sapiens
gtacttcaagtttttttgtgattctatacaaattttaggattgagtttttttatttctgtgaagaatctcaatggtgatttgatagggatttcattgaatgtat

SEQ ID NO: 12931 - DNA, 87 bp, Homo sapiens
gactgccgtcacagctaatctgagcagtgctggagctcacacccatttctgtttgagtccagtactgtatttgttgttcactgtatc

SEQ ID NO: 12932 - DNA, 93 bp, Homo sapiens
gtaaacacatctgagcctgtttatttctcttttgaaagttctaaaattattattttcatttatttaagctatagaccagttcagattgtttat

SEQ ID NO: 12933 - DNA, 116 bp, Homo sapiens
tgggtaaatgttagattgtttcaaatgctttttctgcatctactgatatgattatgtttttttcttcagccttttgtgtgatgaattgtattagttacttttcaaatgttgaccca

SEQ ID NO: 12934 - DNA, 86 bp, Homo sapiens
taagttttagggtacatgtgcacaatgtgcaggtttgttacatatgtatacatgtatcatgttggtgtgctgcacccattaacttg

SEQ ID NO: 12935 - DNA, 82 bp, Homo sapiens; identical to SEQ ID NO: 7035

SEQ ID NO: 12936 - DNA, 93 bp, Homo sapiens
gatgctgtctcttttttggttccatatgaaatttaaagtagttttttccaattctgtgaagaaagtcattggtagcttgatgaggatggcatt

SEQ ID NO: 12937 - DNA, 118 bp, Homo sapiens
gtgggagtaatgcttcctagctatgcctagtcagcgatcttgttctcccttctatttttttttaaatgagtatttaagacatttcatagttggccaaaataacaagcttacattctat

SEQ ID NO: 12938 - DNA, 115 bp, Homo sapiens
ttgatctccagtgttggaggtgggtcttaatgggaggtgtctgggtcattggtgctgtcctcacagtaatgagtgagttctcattctattagttccttcgtgaacaggtggttaa

SEQ ID NO: 12939 - DNA, 120 bp, Homo sapiens
ctttattcttttggcttaggattatcttggcaatgggggctctttctttggttccatatgaaatttaaagtagttttttccaattctgtgaagaaagtcattggcagcttgatggggatg

SEQ ID NO: 12940 - DNA, 99 bp, Homo sapiens
gcatttatttgtatattattacattttcactgacaaaaattgtatatatttatggtatgcaacaagatgttttgaaattagtatacatggtagaatggc

SEQ ID NO: 12941 - DNA, 71 bp, Homo sapiens
gccatgagcactgcatctgcaggaagacacacatcagaccctgtcactctcaggtgttgatgcacatgtgc

SEQ ID NO: 12942 - DNA, 110 bp, Homo sapiens
tgatggaagaatgtgggagctttcggtgtctgcggtgggttagtgagggaggttgtttatttttaatctttttcctcgtgcagctcgttggaatgactttctttatttta

SEQ ID NO: 12943 - DNA, 90 bp, Homo sapiens
ggaatctggcaacccagctcttctcttcctactttagaaaggttgcatataagagggagaaggaagttttgtatagttgtagatgaatcc

SEQ ID NO: 12944 - DNA, 85 bp, Homo sapiens
tcctgcctcagcctcctgagtagctgggattacaggtatgtgccaccatgcccgtctaattttcatatttttagtagaggcaggg

SEQ ID NO: 12945 - DNA, 84 bp, Homo sapiens
gtgaatatatatatacatatatatgtgtgtgtgtatatatacatatatatatatgtgtgtgtatatatatacacacatatatgt

SEQ ID NO: 12946 - DNA, 89 bp, Homo sapiens
tagtcagcagatgtcacccagtctctctcattgggcactccagtaaataaaggaagcatggtggaagagatggaggccatgcatgggta

SEQ ID NO: 12947 - DNA, 78 bp, Homo sapiens
gaaatgaaaatgaaagaaggtagtgagcactcagaatggaagtttccttctctttcttccttttttcttttatatttt

SEQ ID NO: 12948 - DNA, 90 bp, Homo sapiens
gcagacggccctctgttcactctcagtgtgttttttcatggcaggtatgagagagagagagagagagagcacaagagcgctttggtgtgt

SEQ ID NO: 12949 - DNA, 128 bp, Homo sapiens
ttgttcttttggcttaggattgacttggcgatgcgggctcttttttggttccatatgaaatttaaagtagttttttccaattctgtgaagaaagtcattggtagcttgatggggatggcattgaatct

SEQ ID NO: 12950 - DNA, 95 bp, Homo sapiens
cgatgcgggctcttttttggttccatatgaaatttaaagtagttttttccaattctgtgaagaaagtcattggtagcttgatggggatggcattg

SEQ ID NO: 12951 - DNA, 93 bp, Homo sapiens
gatgcgggctcttttttggttccatatgaaatttaaagtagttttttccaattctgtgaagaaagtcattggtagcttgatggggatggcatt

SEQ ID NO: 12952 - DNA, 117 bp, Homo sapiens
caatgctggggtatctatttctctctgtagctctagtgtggctttttttttttttttataattttaagctattttacaagttgctacaagttttgaatacataggtcttctatattg

SEQ ID NO: 12953 - DNA, 95 bp, Homo sapiens; identical to SEQ ID NO: 68

SEQ ID NO: 12954 - DNA, 93 bp, Homo sapiens; identical to SEQ ID NO: 69

SEQ ID NO: 12955 - DNA, 90 bp, Homo sapiens
tctctttagtgatatttgctttatatatctgggtactccatcattgggtacatatatatttgtaattattatagcatgtcactgaattga

SEQ ID NO: 12956 - DNA, 95 bp, Homo sapiens; identical to SEQ ID NO: 68

SEQ ID NO: 12957 - DNA, 93 bp, Homo sapiens; identical to SEQ ID NO: 69

SEQ ID NO: 12958 - DNA, 93 bp, Homo sapiens
ttgatattatatatatatatatatatatgtctatatatatatatatatatatgtctatatatatatatatatatgtctatatatatatgtcaa

SEQ ID NO: 12959 - DNA, 68 bp, Homo sapiens
ttgtttgagatgagtctcgctctgtcaccctggctggactacaggggcgccatctcagctcactgcaa

SEQ ID NO: 12960 - DNA, 71 bp, Homo sapiens
gtgggaatgtgtgaaggaaggtgatagaatttggtttggaaagcctgtctcccacctggcttcaaccccat

SEQ ID NO: 12961 - DNA, 91 bp, Homo sapiens
tcagatatgtggcagcaaagttataatttttctgaaaaattatattttttagcaagaatatttgcatgcaaagcatcttatttttttctga

SEQ ID NO: 12962 - DNA, 87 bp, Homo sapiens
tgatcactgaaggggaaatagataatgaatagtttctacattgtattaacattgtttgtttatatctatgtttcttccactagatca

SEQ ID NO: 12963 - DNA, 69 bp, Homo sapiens
agaagagtttaatttctgtgctgttgtgacatagtgaaggtcacagacaacacagagtgcagcttctct

SEQ ID NO: 12964 - DNA, 70 bp, Homo sapiens
tatgtgtgtacacatgtgaacatagttgcatgcacacacaggcacacactcacttatgtgtgcacacatg

SEQ ID NO: 12965 - DNA, 95 bp, Homo sapiens; identical to SEQ ID NO: 68

SEQ ID NO: 12966 - DNA, 93 bp, Homo sapiens; identical to SEQ ID NO: 69

SEQ ID NO: 12967 - DNA, 95 bp, Homo sapiens; identical to SEQ ID NO: 68

SEQ ID NO: 12968 - DNA, 93 bp, Homo sapiens; identical to SEQ ID NO: 69

SEQ ID NO: 12969 - DNA, 122 bp, Homo sapiens
ttagtgatgtagagcatttttcatgtgtttcttggccacttatatttctttttttgagaaatgttggttcgtggcctttgcgcactttttaatgtttttcttgttgagttgtttgagttgtc

SEQ ID NO: 12970 - DNA, 95 bp, Homo sapiens; identical to SEQ ID NO: 68

SEQ ID NO: 12971 - DNA, 93 bp, Homo sapiens; identical to SEQ ID NO: 69

SEQ ID NO: 12972 - DNA, 92 bp, Homo sapiens
tctctatatgtctctctatgtacatttctatgcaaatataaaattataccttgtatattttgtaactatttttaatggagaatatgtagtga

SEQ ID NO: 12973 - DNA, 127 bp, Homo sapiens
agttatacagaactgtgtctgtgcatatgcagatatatatgtgtatatatatgtgtgtatatatatatatctccagtatgtagatatagatatacatgtatgtacttgtatgtgttcgtgtgtgtac

SEQ ID NO: 12974 - DNA, 75 bp, Homo sapiens
gattgagtattagtgttatgttatctgctaggagctatgctagccagatgctgtcacacacactgttactgaatc

SEQ ID NO: 12975 - DNA, 83 bp, Homo sapiens
tatacatatatgtatgtatatgtacatgtatatatgtacatgggtgtacgtatacatgtatgtatatgaggtgtatatgtata

SEQ ID NO: 12976 - DNA, 87 bp, Homo sapiens
atatggtgtgtgtgtgtgtgtgtgtgtgtatatatgtgtgtgtatgtgtgtacatatatatatatgctatatatatgtgtgtgcata

SEQ ID NO: 12977 - DNA, 74 bp, Homo sapiens
cagaaggtgaaatttcaagtgctgggtaagtatttttcaatatttactccactaatatttcctgaggctctctg

SEQ ID NO: 12978 - DNA, 88 bp, Homo sapiens
tgtgcagttcagactggtgcagtttaatgtatagaagttattacttcaatttaatgagttttaaaacagtgctgatcagggaaataca

SEQ ID NO: 12979 - DNA, 115 bp, Homo sapiens
gtgtgtgcgtgtgtgagtgtgtgtatgtaagacagacagagagagagagagagagatcttcctactcagaaaacgttctatctattctcccccagcacataataacagagccagc

SEQ ID NO: 12980 - DNA, 56 bp, Homo sapiens
tgagacagagtctcactctgtcgcccaggctggagtgcagtggcgggctcagctca

SEQ ID NO: 12981 - DNA, 99 bp, Homo sapiens
ctgactacttttggaagacaattctctgtgggtctcttgtgtttcttcatgttttacaagcagagacactgactgtctttgttccagaccaatggtcag

SEQ ID NO: 12982 - DNA, 74 bp, Homo sapiens
tgttctcccacagaggagtgagggattcaggtctcttgggcttgtgtgtctctctgtcattgccatgggctgca

SEQ ID NO: 12983 - DNA, 105 bp, Homo sapiens
acaagatagggaacttttatgctttggactcagacactctgccacttactgaatatgtgaccttgggcaagttgctgtctccttcagcctcagtttttgttttgt

SEQ ID NO: 12984 - DNA, 105 bp, Homo sapiens
tgtgtggaaagtcaaggtgggggagtgggggatagctagtttctgaatctattaatcacagaagaaatagaggtcatttaagtcacttgctaactttaaaatata

SEQ ID NO: 12985 - DNA, 99 bp, Homo sapiens
tatatagagtatatatatgtacgtgtataaatgtgtatttatatctttgtgtatatacacagatatatatatatatgtatgtgtatacatatacatata

SEQ ID NO: 12986 - DNA, 93 bp, Homo sapiens
catgatttggacatgtctctccacccaaatctcatgtcaaattgtaattctcaatattggatgtggggcctggtgagaggtgattggatcatg

SEQ ID NO: 12987 - DNA, 96 bp, Homo sapiens
gaattcatctgggtctgatactttctgtttggaaatgttcttaattattgattgaatttctttaatagatgcaggcctattcagattatctaattc

SEQ ID NO: 12988 - DNA, 95 bp, Homo sapiens; identical to SEQ ID NO: 68

SEQ ID NO: 12989 - DNA, 93 bp, Homo sapiens; identical to SEQ ID NO: 69

SEQ ID NO: 12990 - DNA, 113 bp, Homo sapiens
ggttggcagcagaagggcacaaggacgtataaagggagaaatgtatacagatgtatatatatttacattttgacaatagccattgatgtatgtgcaattcttttggctgtgct

SEQ ID NO: 12991 - DNA, 93 bp, Homo sapiens
gaactcagtactctgtctcacggtcaccccaactgcaagagagattgggacactatgtctctctctgtgcctgagaaaagaggagatgagttt

SEQ ID NO: 12992 - DNA, 98 bp, Homo sapiens
gctattatgatttagtgtatggtttgcctgtgtatatttttaatagttaaatcaggtcattgggaactctaaatgcactgtccttataatcataatgt

SEQ ID NO: 12993 - DNA, 103 bp, Homo sapiens
tcttttgtaactttgttggtgtatgatgtacatgaggcattttttactttatatatggtagctattgttatgagttatgcatttaagcaaaacacatgaaaga

SEQ ID NO: 12994 - DNA, 114 bp, Homo sapiens
tatacacacacacatatgctaaattgagagtcagagttattttacaatttatttatcaggtggttagtaaatatgttaaaaataaaacaattcaaatttgtgtgcatgtgtata

SEQ ID NO: 12995 - DNA, 58 bp, Homo sapiens
tgagtcagtatctcactgtctctcccaagctggagtgcagtgatgtgatctctgctca

SEQ ID NO: 12996 - DNA, 72 bp, Homo sapiens
gggaaccctagtacactgttgatgggaatgtagattggaacaaccattaagaaaaacagtatgaaggttcct

SEQ ID NO: 12997 - DNA, 76 bp, Homo sapiens
ctactgggcagatggaaccaggataagaatgtatatatgtatgcacgtatgtgtcttgatctcatggcacctctgg

SEQ ID NO: 12998 - DNA, 81 bp, Homo sapiens
gtgtgtgtgtgtatctgtgtgtatgcagatgtatatatatatagtgtgtgtatatatgtatatatacatacatatatacac

SEQ ID NO: 12999 - DNA, 95 bp, Homo sapiens; identical to SEQ ID NO: 68

SEQ ID NO: 13000 - DNA, 93 bp, Homo sapiens; identical to SEQ ID NO: 69

SEQ ID NO: 13001 - DNA, 120 bp, Homo sapiens
ggaatggttcaaaatttagaagagatggagagtggttgcatattcttatatatatttcattgtgtaaaatgtatataagaatcaatgaattacacacttgtctgtaaacttgaagtctga

SEQ ID NO: 13002 - DNA, 101 bp, Homo sapiens
gtgtgtgtgtgtgtgtgtgtgtgtgtgtgcgcgcgcgtgcgtgtatgtgtgtgtatatatatatgtatattcatatgtacatatatatatatgtgctttac

SEQ ID NO: 13003 - DNA, 95 bp, Homo sapiens; identical to SEQ ID NO: 68

SEQ ID NO: 13004 - DNA, 93 bp, Homo sapiens; identical to SEQ ID NO: 69

SEQ ID NO: 13005 - DNA, 80 bp, Homo sapiens
tacatgcacatatgtatatatgtatatgtgtatatatatcacacatttgtatatatgtgtaaatatgtagatatgtgtgc

SEQ ID NO: 13006 - DNA, 73 bp, Homo sapiens
cactgaggcacctcaaactcagcaagtgagaagaggaacttgtcactctctctctgagattgttcctcctgtg

SEQ ID NO: 13007 - DNA, 130 bp, Homo sapiens
gtgtatatatacacacatatgtatgtatatatgtgtatatatacacacatatgtatgtatatatatgtgtatatatacacacatatgtatgtatatatgtatatgtgtgtatatatacacacaaatagca

SEQ ID NO: 13008 - DNA, 72 bp, Homo sapiens
atgtgtgtatgtgtatatatgtgtatatatacacacatatgtatgtgtatatatgtgtatatatacacacat

SEQ ID NO: 13009 - DNA, 180 bp, Homo sapiens
gtgtgtatatatatgtgtatatatacgtatatataaaaatacatatatatgtatatacatatatgtatatatgtgtgtatatatatgtatatatgtgtatatatatgtgtatgtgtatatatgtgtatatatacacacatatgtatgcgtatatatgtgtatatatacacacatatgtat

SEQ ID NO: 13010 - DNA, 95 bp, Homo sapiens; identical to SEQ ID NO: 68

SEQ ID NO: 13011 - DNA, 93 bp, Homo sapiens; identical to SEQ ID NO: 69

SEQ ID NO: 13012 - DNA, 113 bp, Homo sapiens
tgttatatattcagtatacttattgaatgttatatattcagtataattattgaatgtcatatattcaatataattattgaatgttatatattcaatatatgaggaaaacagca

SEQ ID NO: 13013 - DNA, 91 bp, Homo sapiens
tttgttcagtgacaaatttgaaatgagatttatattcacaagtactatgttcagtatttttttttcattaagtttgtctaatatgaacaga

SEQ ID NO: 13014 - DNA, 114 bp, Homo sapiens
atattgtcttctagtatgcatttgaattataattaggtatagtataactatgtatatttttgaaaatcaaattatatattttatatatactggatcttgtattgaggtcaatat

SEQ ID NO: 13015 - DNA, 111 bp, Homo sapiens
ttttgtattttttcccttatctttacacacatacacacacagttttattattatgttaaactgtgtggtcatgaagcaggttagagcaaggtacacagaaacctggcaaag

SEQ ID NO: 13016 - DNA, 99 bp, Homo sapiens
agcatcagattttgcaggtgtttataggttgcttttcatagggaaaaaatgtcattttttttctcttaatagagtttcagttcagaatttgttcttgct

SEQ ID NO: 13017 - DNA, 168 bp, Homo sapiens
gtatatatatatacatatatatatatacatatatatatatacaatatatgtatatacatatatatatacacatatatatatacacatatatatgactgtgtatatatatataaaactgtgtgtatatatatgtgtgtatatatatacacacacacacatacacactca

SEQ ID NO: 13018 - DNA, 95 bp, Homo sapiens
ggtgactttagaaaaagatgggctcttctaactatgatgatgatgatgatgattattattattattattgagacaggctgtctcactctgtcacc

SEQ ID NO: 13019 - DNA, 63 bp, Homo sapiens
tgtgtctgtgcctgtctgtgaggggcacatgtgtgaatcaggtcagagatggccacagacaca

SEQ ID NO: 13020 - DNA, 85 bp, Homo sapiens
ccaggaaactgaggaattgaggagctgttttactttttttttttttttttttttctgagacagtctcactctgttgccaggctgg

SEQ ID NO: 13021 - DNA, 84 bp, Homo sapiens
gtgtgtatatatttgtgtgtatatatgtacatatatatacatgtgtatatatatgtacatatatgtacatgtgtatatatatat

SEQ ID NO: 13022 - DNA, 120 bp, Homo sapiens
gcgtttgtcaatttctatggtgtaaatactccccatgtggtggattctaccactatgagtcactgactgtgaagctgggaacacaccactgggctttccaccagagagataccgtagacg

SEQ ID NO: 13023 - DNA, 79 bp, Homo sapiens
ctatgtctctctcttatcagatttcatatatatatatatatatatatatatatagagagagagagagagagagagagag

SEQ ID NO: 13024 - DNA, 92 bp, Homo sapiens
tcatttcatttttatttatttatttcaattgtggtgagatatacacagagccaccctcatacaaagagagatgatgatgatgatgatgatga

SEQ ID NO: 13025 - DNA, 78 bp, Homo sapiens
gtgtgtatatatatagagagagtttatatatagttttatactatatatacagttatatatgtgtatatatatatacac

SEQ ID NO: 13026 - DNA, 82 bp, Homo sapiens
gggtcactctgtcactcaggctggagtgtagtggcacaatctcagctcactgcaacctccaccccccgagttcaagtgattc

SEQ ID NO: 13027 - DNA, 72 bp, Homo sapiens
ttgttttttgagacagagtctcactctgtcgcccaggctggagtgcggtggtgtgattttggcttactgcag

SEQ ID NO: 13028 - DNA, 112 bp, Homo sapiens
gactagagactcacaatatgtttagggcccatggacagatttttatttctttagaaatccggaggaaaaaataaagttttaggtcaaagaacatgttttaatgggtaatgtt

SEQ ID NO: 13029 - DNA, 105 bp, Homo sapiens
actccaacagctttattcccattttactgatgagagaacagacacaggttatagaaaacccagagccatttgtattgttggtaggatttttgcagctgtgttagt

SEQ ID NO: 13030 - DNA, 160 bp, Homo sapiens
gacagactgtgagtgaggagagcagggaaggtggtggtaaagcaaaagctataaaatacctttttttttttttcttttctgtgagcctgtgtctcactctgtcgccaggctggagtgcagtggctcgatctcggctcactgcaacctctgactccctggt

SEQ ID NO: 13031 - DNA, 77 bp, Homo sapiens
agtgcttatgttgtcaactgctccatctcagaaaaaaagttttctcttgacagtggagtgtgagcacacagagcact

SEQ ID NO: 13032 - DNA, 119 bp, Homo sapiens
cctgattacttcttacattgattagtgaattagccaaagatgccccaaagatggctgaacagagacagctaacgtgaagttttggagttttactgacagatcgtcaggcgggcctcagg

SEQ ID NO: 13033 - DNA, 128 bp, Homo sapiens
cctttatgaggctgttaagctccttgaggacagaacctggttttgcacaacccattgtacagagcagagtgtgcacattgtaggggttaagtaagtcttgtttaaaggttgtttgtattatttgctta

SEQ ID NO: 13034 - DNA, 116 bp, Homo sapiens
tatatatatatgtgtgtgtgtgtgtgtatatacatatgtatatatatacatatacacatatgtgtgtgtatatatgtatatatgtatgtatatacacacacacatatatatgtgta

SEQ ID NO: 13035 - DNA, 58 bp, Homo sapiens
tgagacagagtctcgctctgtcacctaggctggagtgcagagtcacgatctctgctca

SEQ ID NO: 13036 - DNA, 74 bp, Homo sapiens
ttgttttgtttgagacacagtctcactctgtcacccaggctggagttcagtggtgtgatctcagatcactgcaa

SEQ ID NO: 13037 - DNA, 70 bp, Homo sapiens
ttgttttgagaccaagtctcgctctgtcacccaggctggagtgcaatggtgcgactttggctcactgcaa

SEQ ID NO: 13038 - DNA, 119 bp, Homo sapiens
ggattaatgtaatttcattggaaataacctgatcattttgccaggatgattaaatggtcctttctctgtaaggttatgaggttatgtctctattttgattgttctgtgtcattttttcc

SEQ ID NO: 13039 - DNA, 83 bp, Homo sapiens
cctcatcacctcttaggagagcacactctgtctgtgaattcctttgtaatgctagctgctctctatgagtgtggtgaatgggg

SEQ ID NO: 13040 - DNA, 87 bp, Homo sapiens
tcccgacatccattagatggtatcagtggtgagtgtgctgacatcgtccagcaacagcgcatgcttatccttcttggcactgcgggg

SEQ ID NO: 13041 - DNA, 72 bp, Homo sapiens
aggccttattccctgggatatctctgtctctgtgtcagcacagagacccatattctctgtggagactggtct

SEQ ID NO: 13042 - DNA, 95 bp, Homo sapiens; identical to SEQ ID NO: 68

SEQ ID NO: 13043 - DNA, 93 bp, Homo sapiens; identical to SEQ ID NO: 69

SEQ ID NO: 13044 - DNA, 71 bp, Homo sapiens
aatagtattccgttgtatttgtaatacacacacacacacacacacacacacacacacaacggaatactatt

SEQ ID NO: 13045 - DNA, 120 bp, Homo sapiens
attacaggtgtgagccactgcgcccggcctaaatgtttaaaaatcctgtaaacagaaatattttatttttctaacgttgctattatttggtgttggtcaaaaagtggattttagagtgat

SEQ ID NO: 13046 - DNA, 95 bp, Homo sapiens; identical to SEQ ID NO: 68

SEQ ID NO: 13047 - DNA, 93 bp, Homo sapiens; identical to SEQ ID NO: 69

SEQ ID NO: 13048 - DNA, 112 bp, Homo sapiens
gcattatctaacaaagttgatgatgcatatattctttttttaaattttaattttaatttaaattttgagttctggggtacatgtgcaggatgtgcaggtttgttacataggc

SEQ ID NO: 13049 - DNA, 57 bp, Homo sapiens
tgagacactcacactttgggtttagataacgtttcttctctcggtgtctgtgtttca

SEQ ID NO: 13050 - DNA, 58 bp, Homo sapiens; identical to SEQ ID NO: 7309

SEQ ID NO: 13051 - DNA, 56 bp, Homo sapiens; identical to SEQ ID NO: 688

SEQ ID NO: 13052 - DNA, 58 bp, Homo sapiens
tgagactgagtctcactctgtcacccaggctggggtgcagtggtgcgatcttggctca

SEQ ID NO: 13053 - DNA, 107 bp, Homo sapiens
gatgttaaaagagaattcagaatggaagcaagtttgtaagtgttgaaatgagtgattcattttaatttcttttttcttgtttgtatttgaaaatcccgcataatgtt

SEQ ID NO: 13054 - DNA, 119 bp, Homo sapiens
aggttgtgttccctaaataggatgtttggttccaactgcttagaagggttttaagtgagtctgaagagagagggcactacaagcacgactgtagagtggaataagaacagacaggcctg

SEQ ID NO: 13055 - DNA, 107 bp, Homo sapiens
tctcaggctaaagttgctgtttgcctcccagaactttttgctcttgatctttgaatatttttcatttcaggaacaaaagatgatcaggaaatcactattgcctgtga

SEQ ID NO: 13056 - DNA, 68 bp, Homo sapiens
gagtcacttagtagccctgttggtgatcagactgtctttgtgtcacagtgcttgtgttcaagtgactc

SEQ ID NO: 13057 - DNA, 120 bp, Homo sapiens
gagataacaatgtctagtctgaaaggtagtggggtagaggatttcttaagctttttttttttttttttggagatggagtctcgctctgtcacccaggctgaagtacagtggcacgatctt

SEQ ID NO: 13058 - DNA, 193 bp, Homo sapiens
ctaatatgtcttggtgagtatatatgtatatattgtattagtatatatatagtattgtattgtattagtatatatatatatatatatactaattgtattgtgttagtgtatatatatatggtattgtattgtattagtacattgtattagtatatatacatatatactgtatatatatactaatacaatacta

SEQ ID NO: 13059 - DNA, 109 bp, Homo sapiens
tcaactgggtatggtggtgtgtgcctgtattcccagatacttgagaggctgaggtacgaggatcatttgagcctgggaagttgaggctgcagtgagcagtgactgagcc

SEQ ID NO: 13060 - DNA, 100 bp, Homo sapiens
atatatatatatatatatatatacacgtgtatatatgtgtgtgtatatatatgtgtgtgtgtgtatatatatacatatatatatagatgtatatatatat

SEQ ID NO: 13061 - DNA, 95 bp, Homo sapiens
atatatatatatatatgtgtgtgtgtgtgtatatatatgtatatatgtgtatatatgtgtatatatgtgtgtatatatgcatatatatgtgtata

SEQ ID NO: 13062 - DNA, 62 bp, Homo sapiens
agatggagtctcactctctgtcactcaggctggcgtgcagtggcacgatcttggctccatct

SEQ ID NO: 13063 - DNA, 80 bp, Homo sapiens
tgagatcgagtctctctctgtcacccaggctggagtgcaggggcatgatcttggctcactgcaacctctgtctcctgggt

SEQ ID NO: 13064 - DNA, 117 bp, Homo sapiens
gtgccttaaacaatagacatttatttagcacaattcaggaggctggggttctgagatcaaagtgaatgctttcctcttggtttacagatggtcatgttctcattgtcatgaggacac

SEQ ID NO: 13065 - DNA, 107 bp, Homo sapiens
tatatataaaaaatatctttatattctatacaaggagatacatatatatcttgtatagaatatatatatatccttgtatagaatatatagatatagatataggtata

SEQ ID NO: 13066 - DNA, 63 bp, Homo sapiens
acattgtatgtatgcatgtatgtatgtatgtatgcatgcatgcatgcatgtatgtatgtatgt

SEQ ID NO: 13067 - DNA, 58 bp, Homo sapiens; identical to SEQ ID NO: 315

SEQ ID NO: 13068 - DNA, 118 bp, Homo sapiens
aattgtaatggagagcaatttgaaaaatattttgcaaaatgcaaaaggtgtgtatgtttatatacatataactccctttgactcagcaattccatttctaagaatttttctgacaatt

SEQ ID NO: 13069 - DNA, 110 bp, Homo sapiens
aaccatccacactcccatgaaggtctagatgtagggttaagcagaatcaacagtgaagtgtctgtgcactctacccatggtagttattcctttggccgagactgctggtt

SEQ ID NO: 13070 - DNA, 89 bp, Homo sapiens
ataaaagcctgaggctagcagtattggacagttgggcagacacaaatgttctgtttttgtacatgtaagactttttggcctgggtgtgt

SEQ ID NO: 13071 - DNA, 82 bp, Homo sapiens
gtcctaatgcactcaaagtttccatagagcattccctgctggctccagatatcaatgctttgtttttgttttaaagaaggac

SEQ ID NO: 13072 - DNA, 81 bp, Homo sapiens
cagagccagtgtgtgtgtgcgtgtgtgtgtctgtaatataaaatggatgtgaatatatatatacaaatagatatggttttg

SEQ ID NO: 13073 - DNA, 78 bp, Homo sapiens
gcaggtgtggctctgactctggctcaaagctctctctgaaagaaagagaagctgcttcagaagcagagaaaggcctgc

SEQ ID NO: 13074 - DNA, 84 bp, Homo sapiens
gcagggttttgaatagaagagtattgtggggttttttttgtttgttttttttgagacagagtctcacttactctgttgccctgt

SEQ ID NO: 13075 - DNA, 66 bp, Homo sapiens
tgtatgtatgtgtgcatgtgcatgtatgtgtatatacatatatatgtattatgtactcatatatca

SEQ ID NO: 13076 - DNA, 94 bp, Homo sapiens
gtgagattctggaatagagaggacctagcattagcgcttaatatatattctttaaaacaaatgctgtggttctttagtgatcctttgatgtcat

SEQ ID NO: 13077 - DNA, 95 bp, Homo sapiens; identical to SEQ ID NO: 580

SEQ ID NO: 13078 - DNA, 93 bp, Homo sapiens; identical to SEQ ID NO: 69

SEQ ID NO: 13079 - DNA, 74 bp, Homo sapiens
tatattcatgtgtgtatgtgtctctgtgtgtgtaaagaaagagcatatatactgtatatctacatgtgtatata

SEQ ID NO: 13080 - DNA, 91 bp, Homo sapiens
ttgctgggttgaatggtaatgttgttttaagttctttgagaaatctccaaactgcttttcacagtggctgaactaatttcaatcccaccaa

SEQ ID NO: 13081 - DNA, 95 bp, Homo sapiens; identical to SEQ ID NO: 68

SEQ ID NO: 13082 - DNA, 93 bp, Homo sapiens; identical to SEQ ID NO: 69

SEQ ID NO: 13083 - DNA, 101 bp, Homo sapiens
ggtagcagtcttaacttccatttcaatgcatctattgttgtatctctccttttttttttttttttttttttttttttttgagatggagtctcactgtcgcc

SEQ ID NO: 13084 - DNA, 76 bp, Homo sapiens
tctactgattttcatgtgctgattttgtctcctgagactttactgaggttactgatcagtctgggagtcttctaga

SEQ ID NO: 13085 - DNA, 95 bp, Homo sapiens; identical to SEQ ID NO: 68

SEQ ID NO: 13086 - DNA, 93 bp, Homo sapiens; identical to SEQ ID NO: 69

SEQ ID NO: 13087 - DNA, 97 bp, Homo sapiens
ggattcctaggtattttattctctttgtagcaattgtgaatgggagctcactgatgatttagctctctgtctgtctgttaatggtgtacaggaatgc

SEQ ID NO: 13088 - DNA, 110 bp, Homo sapiens
gtgggttatgcaacatatacatatttattgttgtgtgtattgtgaattttacattttaaaatatatttattcaggtatcatatatatatatagtaacttgcatagatcat

SEQ ID NO: 13089 - DNA, 89 bp, Homo sapiens
tgttagctatttgtatgaaacatatctattgaaaataaaaatttgaaaattttctatttttcaatagatttttatacaaatagccaaca

SEQ ID NO: 13090 - DNA, 105 bp, Homo sapiens
tgcaatgattaccccagggctgagagagtaatagaagcttagactatttgatgaatgattttttttcttttattattatactttaagttttagggtacatgtgca

SEQ ID NO: 13091 - DNA, 95 bp, Homo sapiens; identical to SEQ ID NO: 68

SEQ ID NO: 13092 - DNA, 93 bp, Homo sapiens; identical to SEQ ID NO: 69

SEQ ID NO: 13093 - DNA, 77 bp, Homo sapiens
gttaggagcatatacatatacacacatatatatgtatgtatatatgtatatatgtgtgtatgtctatatctacacac

SEQ ID NO: 13094 - DNA, 175 bp, Homo sapiens
catatacacatatatatgtttatatgtgtggtataagtgtgtatattatataagtgtgtgtgtatattatatatttatacaacatgcacactaatgtgtatatatatatgtgtatgtgtatatatgtacaccatatatatattccaccttctatatgcatatgtatatgtgtatg

SEQ ID NO: 13095 - DNA, 115 bp, Homo sapiens
ttattttaatttaatgtctctcctctagaacttctcttttctaaaataaattatatttaatattttagaaaatttattttagttttgggggtacatgtgcatgttggttctatag

SEQ ID NO: 13096 - DNA, 116 bp, Homo sapiens
ggcagtgcaggctggtggatatgcctagcaaacaactataaatgtgattgattcttcttttcatttttttttattatactttaagttctagggtacatgtgcacaatgtgcaggtt

SEQ ID NO: 13097 - DNA, 58 bp, Homo sapiens
ctgagtgtctgagtacagcagcatgtggtagtatctactgctgcactcaaacacccag

SEQ ID NO: 13098 - DNA, 83 bp, Homo sapiens
tttgtggattagtaggcaaatatatgtatatgattgtatataaatacatttgtatacatatatatgtatatgagatacataga

SEQ ID NO: 13099 - DNA, 95 bp, Homo sapiens; identical to SEQ ID NO: 68

SEQ ID NO: 13100 - DNA, 93 bp, Homo sapiens; identical to SEQ ID NO: 69

SEQ ID NO: 13101 - DNA, 116 bp, Homo sapiens
ggcctttggcacatttaaaaaatcaggctgtgtgctttcttattgttgagtatttttttttttttttttttttttatactctaagttttagggtacatgtgcacattgtgcaggtt

SEQ ID NO: 13102 - DNA, 93 bp, Homo sapiens
gtatttatgtgtgtatatatatatattatagtagatatatatctcctttcatccatatttacatgatccatatctatatatgtatatgtgtat

SEQ ID NO: 13103 - DNA, 70 bp, Homo sapiens
ttgttttgagatggagtctcactctgtcacccaggctggaatgcagtggtgcgatctcagctcactgcaa

SEQ ID NO: 13104 - DNA, 108 bp, Homo sapiens
attgtttgtttatgtgttgtaatacatatgtaactatatacatttatatattgtataagtacaccatatacatgtatatacagtatatatgtgtatatatagtataat

SEQ ID NO: 13105 - DNA, 58 bp, Homo sapiens
gtgatggagtctcactctgtcacccaggctggagtgcaatgtcgagatctcagctcac

SEQ ID NO: 13106 - DNA, 95 bp, Homo sapiens; identical to SEQ ID NO: 68

SEQ ID NO: 13107 - DNA, 93 bp, Homo sapiens; identical to SEQ ID NO: 69

SEQ ID NO: 13108 - DNA, 58 bp, Homo sapiens; identical to SEQ ID NO: 10482

SEQ ID NO: 13109 - DNA, 96 bp, Homo sapiens
cttataagaaaatagatgcagttctccaagtgttatgttgatgaatttatgaattaatttttcaatttaacccatggggaaaatttcacttgtgag

SEQ ID NO: 13110 - DNA, 103 bp, Homo sapiens
gatgtaaaggaagcacatggaggagacttcaaagcaagtggtatgtttttctatttaaatctatggcttggtctttgggtattcatcatgttccatgtatatc

SEQ ID NO: 13111 - DNA, 80 bp, Homo sapiens
tgttgactgtcagtttgtcatagacagcttttattaccttaaggtatggcctttctatactgattttgctgagggtttca

SEQ ID NO: 13112 - DNA, 58 bp, Homo sapiens
tgagccagagtctcgctctgtcacccaggctggagtgcagtggcgcagtctcagctca

SEQ ID NO: 13113 - DNA, 78 bp, Homo sapiens
ggtgtgagcacagtgcctgaccctccctctagaattttttttttttttttttttagatggagtttggctctgtcaccc

SEQ ID NO: 13114 - DNA, 94 bp, Homo sapiens
aagactgggctccccaccacttaaacgtggatgtacttgctttgaaactaaagaagtaagtgcttccatgttttggtgatggtaagtcttcctt

SEQ ID NO: 13115 - DNA, 102 bp, Homo sapiens
gggtaacagagcaagactccgtctcaaaaaaaaaaatgccctggaaaactttattttatttattctattttatttttgagacagagtcttgctctgtcaccc

SEQ ID NO: 13116 - DNA, 116 bp, Homo sapiens
acagaaaacatgtgttcctgttctctccacgtctatagagacacaaacagcttcccccagcactgcaaggaggaatgcacgtttctttgactgtttgaataagccctgttttctgt

SEQ ID NO: 13117 - DNA, 61 bp, Homo sapiens
tatgatgtggtgtgtgtgtgtgtaaaatacatatttgcatatatacatatatatatgcata

SEQ ID NO: 13118 - DNA, 105 bp, Homo sapiens
ggcatgaaaaatgggacaaataaatggaactagtttaggtcttggcaacagagatctcagaatgcatgttgtttttaaatgtcagaaacattcatcacgatagcc

SEQ ID NO: 13119 - DNA, 58 bp, Homo sapiens
tgagtcagagtctcgcactgtctcccaagctggagttcaatggcgccatctcggctca

SEQ ID NO: 13120 - DNA, 140 bp, Homo sapiens
atgtaatatggtttaaaagatatatatgtactatatatcaatatgtgtatagatcatataatttttataaatatatctttatatatccttttatatatctttatatatccttttatatatatttatatatatctatatat

SEQ ID NO: 13121 - DNA, 63 bp, Homo sapiens
cctctctctttttctctgtgaaatttataaatttaaattgctaaggagatctgagggtggagg

SEQ ID NO: 13122 - DNA, 105 bp, Homo sapiens
atcatggcgaaaagggaagcaaacacatccttcttcacatggcagcaggagagagaagaatgagtgccctgtgaaagggggatgccccttataaagccatcagat

SEQ ID NO: 13123 - DNA, 116 bp, Homo sapiens
ggtagattgatttctcctggctgcacaatcccagtgcatctattctctattctagtgttctttttttatttagtagaagtctaaattgcatgtgtccagtcaagaatcagagctcc

SEQ ID NO: 13124 - DNA, 112 bp, Homo sapiens
gggattacagatgtgagccagcacactgggcttcaaatagatattctttaaatatttgtttaaaatgtatttgatgtgccagagagaaatgcttataaaaatgtttactccc

SEQ ID NO: 13125 - DNA, 116 bp, Homo sapiens
gatggatctataggtctttatgtagatggatggatagatgtatcaaaagacatatacttgtaaaaatatatatttttatatttgaatatttttccattatatctttgactgccatt

SEQ ID NO: 13126 - DNA, 83 bp, Homo sapiens
tgagacagagtctcactctgtcacccaggctggagtgcagtggtgcgattcaggcttgagtgcagtggcgcgatctctgctca

SEQ ID NO: 13127 - DNA, 91 bp, Homo sapiens
gtaagatagaccacgacagatgtctctcttcttttttgatttttttttttttttaagacagggtatcactctgttgctcagtctggagtac

SEQ ID NO: 13128 - DNA, 58 bp, Homo sapiens; identical to SEQ ID NO: 637

SEQ ID NO: 13129 - DNA, 117 bp, Homo sapiens
atatatgaatatgtatgcatgaatatatgtatgtatgaatatatgaatatgtatgtatgaatatatgtatagatatattccctattcccaaatattttgtgcatgtatgttttgtat

SEQ ID NO: 13130 - DNA, 80 bp, Homo sapiens
acagctaaagaaaataggggagcatgttttgataaatgtgaatttgttcatttaaacagtactcactgagttctagctgt

SEQ ID NO: 13131 - DNA, 119 bp, Homo sapiens
gtgggcatacttgtcttgttatagatcttagaggaaaggctttcaattgttccgcattcagtctgatgttagctgtggatttgccatgtttggactttattaatttaaggtatgtttcc

SEQ ID NO: 13132 - DNA, 116 bp, Homo sapiens
taataatataaattttgggtagctatgcaaagtattgtaatccagtctttctatatattagtataagaaaacggcaagctacttccacatagaatattgatccaaaagtataatta

SEQ ID NO: 13133 - DNA, 66 bp, Homo sapiens
tcggtggcaggtgattagatggtgcccaccagattaagggtgggtcggtctttcccagcccactga

SEQ ID NO: 13134 - DNA, 102 bp, Homo sapiens
agggatcactgtcctgtgctgcttcatgttcaatatctgaaaaccagtgttttacatactttgtttttctaattgttgcttaaaaggataaatcttgtccct

SEQ ID NO: 13135 - DNA, 95 bp, Homo sapiens
gctgcagattcttttagccgtattacatatattatatatatgtaatatatatgattatatacatataatataccaagtattcaaatagtctgtgc

SEQ ID NO: 13136 - DNA, 95 bp, Homo sapiens
tgggtggattttctagctatcagagtctctaactctctactcaacgataaccagggtgaaagtgtctgttagaacataggtctcttgtccagcta

SEQ ID NO: 13137 - DNA, 91 bp, Homo sapiens
cagagtgccaagtcacaggatgggagggcatctgttactcagtgtctccctctatccagatggcactgctgggatgtgtttattcccatct

SEQ ID NO: 13138 - DNA, 105 bp, Homo sapiens
tttgtatttatttgccttgttaattacagtaatcagaaaggagagaaaactttttttttttatattatcaatgattactgttctgggctaggttcttgggttaaa

SEQ ID NO: 13139 - DNA, 106 bp, Homo sapiens
gttactgtgaacacatttttttttcactgtataaattgtatgtctttttttactattaagtatttatgtgtaaataagtgtaagaaaatgattgcttatcagtagc

SEQ ID NO: 13140 - DNA, 77 bp, Homo sapiens
cacacacatatgtacacgcacacatatatatgtctatgtatatatatgtgtgtgtatatatatgtgtgtgtatatat

SEQ ID NO: 13141 - DNA, 117 bp, Homo sapiens
gttttgtagttctccttgtagatatcttttacctccttggctagatgtattccaagtattttattttttatacagtcaacctacagaatgagagagaatatttacaaactacatagc

SEQ ID NO: 13142 - DNA, 58 bp, Homo sapiens
tgagactgagtctcactctgtcacccaggctggagtgcagtggtgcgatctcagctca

SEQ ID NO: 13143 - DNA, 66 bp, Homo sapiens
tgtgtgtgtatatatatatatatatatatataaaagtgtgtgtgtgtgtatatatatacacacaca

SEQ ID NO: 13144 - DNA, 92 bp, Homo sapiens
ttaaatagagtgttcagtcaaggttttcttgagcaggtgaccctagagacatgactgaagtaagggagctgagcacgtgaacctctaagtga

SEQ ID NO: 13145 - DNA, 88 bp, Homo sapiens
cctggtgaaaaatatttcttttttcttgtatttccttagtagtttatttctacatagtagcataagaaaagaaatctttctctttagg

SEQ ID NO: 13146 - DNA, 108 bp, Homo sapiens
ataatatagatattatatatatctaatatctctgtgtgtgtgtgtatatatatatatatatatatatatatatatatatatatatatggatatatatggctatgttat

SEQ ID NO: 13147 - DNA, 107 bp, Homo sapiens
agtcatgtttctgaattccaaaagatttagctctgtctcaatctctgaaacttcacaaaagcctgtccccagtgattgtggaagtgcatttctgcaggactatgact

SEQ ID NO: 13148 - DNA, 96 bp, Homo sapiens
gtgacacgtgctttgctggcccaggaaagagagtgactctctgtcagagtttgtggaggtatacttattttctattgcttcatagtagattatcac

SEQ ID NO: 13149 - DNA, 81 bp, Homo sapiens
ttcggatttgaccaacaagttttttttttctttcagtgtagaatgtgtccacactggaaacttctgttagttagctctgag

SEQ ID NO: 13150 - DNA, 98 bp, Homo sapiens
caggaagttgtatctttacacttgtgttactgatatgtataaatcattttgttgtttattcatttgatagcaaactaagtgaaagcaactttaacctg

SEQ ID NO: 13151 - DNA, 104 bp, Homo sapiens
acttttaaggcaaagaatattaatgtattgaaaagaatacgagtttatttttattttttatttttttattttattttcattattagtattttttgaaatggagt

SEQ ID NO: 13152 - DNA, 95 bp, Homo sapiens; identical to SEQ ID NO: 68

SEQ ID NO: 13153 - DNA, 93 bp, Homo sapiens; identical to SEQ ID NO: 69

SEQ ID NO: 13154 - DNA, 120 bp, Homo sapiens
acaatatttcaggttaaaaattatggaaaagggtacatatacacatacatatgtatgtataaattatatatgtatgtatacacatgcccttttctataatttgtaacctgaaatatatgt

SEQ ID NO: 13155 - DNA, 100 bp, Homo sapiens
gaacaaagctaataggtagttgtatgtatatatcctatttgtttatggatttttcattatataatatagttatatatataattgcctatttgaaacattc

SEQ ID NO: 13156 - DNA, 107 bp, Homo sapiens
ctggcacacactatgacacccggctaattttttaaatttttgtttagtagagacgggtttcactatgttgaccagactggtcatgaactcctgacctcgtgatctgc

SEQ ID NO: 13157 - DNA, 73 bp, Homo sapiens
gcataatgtaggcatatatttgtgtatatatatatatatatatatatatatatatatatgtgtgcatgtatgt

SEQ ID NO: 13158 - DNA, 65 bp, Homo sapiens
atatatgcatgtatgtatgtgtgtgtatatacgtacatacatacacctatatacattgtgtgtat

SEQ ID NO: 13159 - DNA, 69 bp, Homo sapiens
tgtagtgtatgtgtgtgtgtgcatatatatatatatgtatatatatgtatacatatgtatacatatata

SEQ ID NO: 13160 - DNA, 112 bp, Homo sapiens
tgattttttttgctttaactaatagtgcatctttcacccaaagtgtgtgtgtgtgtgtgtgtgcgtgtgtgtgtgcgtgcacacgtgagtgtgcacagtctgcagaatgtca

SEQ ID NO: 13161 - DNA, 109 bp, Homo sapiens
ggctttgtgttagatgattgtcctcaattttaggctagtgtaattgttgttgttaagggatcaacaggttcatatgcctgcttgcagtaacatcctcaaacaccaagac

SEQ ID NO: 13162 - DNA, 118 bp, Homo sapiens
gataaagtctgagaatgacttgagttcagatttactatatatatatatatatatatatatatatatatatatatatatatatatatatctatggtcataatcatttttatagcttgtc

SEQ ID NO: 13163 - DNA, 118 bp, Homo sapiens
tctgagtatatttcttcttatgtataattaacatttgttcatccgttcttttttttttttacttttttatgaaagaagagaatttattgctgtaactggatacagggagaaggctgga

SEQ ID NO: 13164 - DNA, 102 bp, Homo sapiens
aggatgatggcatccagctccatccatattgctgcaaatgatatgatctcattctttttttatagttgcatagtatttcatagtgtatgtgtgccacgtttt

SEQ ID NO: 13165 - DNA, 116 bp, Homo sapiens
tgacatggtcattcacagagcataaatttcagatgtttataataaagtgcagtttatcaattttttttcatagattgtgcttctggtgttgtagctagaaatttatcaccatgcca

SEQ ID NO: 13166 - DNA, 102 bp, Homo sapiens
tctaaaatataggttggtaccagatgaccatacactttgtttaccattatttttgacagtagagagagagtaatcatttttctggctcctgttgtttctaga

SEQ ID NO: 13167 - DNA, 129 bp, Homo sapiens
tgtccctcatctcctatttccatttctaaaatatgtccctcatctctttttctatatatctatatagaaagataggtagatagatagatagatagatagatagatgatagatagatagatgatagatag

SEQ ID NO: 13168 - DNA, 138 bp, Homo sapiens
tatatacatataaatctgtaagctgatatatataagctgataaatatatatacatatatatttgtatatatatgtatatatatacacaggcatacatatgacagtgtgtatgtgtgtatatatatatatgtaaacaaa

SEQ ID NO: 13169 - DNA, 84 bp, Homo sapiens
tgtgtactcatatgtatatatgtgtatatgtatacatgtgtactcatatgtatatatgtgtatatatgtacatatatgtatata

SEQ ID NO: 13170 - DNA, 129 bp, Homo sapiens
atatatatttgttatatatataagtgtgtgtgttatatatgtgttatatacataagttatatatatgttatatatataagtgttatatatgtgtgtatatacatatatgtacatatatacacatatata

SEQ ID NO: 13171 - DNA, 88 bp, Homo sapiens
gtgtgtgtgtttgtgtatctgtctgtctgcctgtctcaaggttaccaaggtttgagaagtgtagcttaagagaaacaaggaaaataac

SEQ ID NO: 13172 - DNA, 107 bp, Homo sapiens
ctagtttttaaattttttgtaaagctggggactcactctgtcggtcaggctggtttaaaacacctgggctcaagtgatcctcccacctcagctttccaaagtgctgg

SEQ ID NO: 13173 - DNA, 111 bp, Homo sapiens
tctatggttgcctggggtggggagacagtaacattaactaggaagtggcagagaggaatttttttcttttttttttttttgagacagtctcgctctgtcgcccaggctgga

SEQ ID NO: 13174 - DNA, 86 bp, Homo sapiens
tatgaatatatatatgaatatatgtgtgtaaacatatgcacatatgcacacacatatagtcataaatatacacacgcatattcata

SEQ ID NO: 13175 - DNA, 67 bp, Homo sapiens
ttggtttttcatatatgtgtgtgtgtgtatgaatatatgtgtatatatgtatgtgtgtatatatcaa

SEQ ID NO: 13176 - DNA, 85 bp, Homo sapiens
gtgaatgtgtataagtgtgtatctctgtgtaagtgtatatctctggatataaaatttcacagagttatagaaatatattgtttac

SEQ ID NO: 13177 - DNA, 91 bp, Homo sapiens
tatattacttatacatattatatatgtatttgtgagtatatatgcaattatacatatattttgtaattatatatgtgtatgtataaatata

SEQ ID NO: 13178 - DNA, 108 bp, Homo sapiens
ttatacaatgctgaactgcatttgataatattttgttaagacatttgtgtctatgtttatgtgagatattattctgtagttttcttttttagcattatctttgtgtga

SEQ ID NO: 13179 - DNA, 95 bp, Homo sapiens
tgtgtatatatatatttgtttatatatatgtgtatgtccacaataaaatatatatcttattgtttatacacatatatgcatatataaataacata

SEQ ID NO: 13180 - DNA, 111 bp, Homo sapiens
cagtcagtcactccgtgtctttctaatggtgagtttagtccatttatattcaatgttattatttataagtgagaacttactcctgccattttggtatttgtgttctggctg

SEQ ID NO: 13181 - DNA, 171 bp, Homo sapiens
atgagtgtgtgtatatatatgtgtgtgtgtgtatatatgtgagtatatatataaatttatttatttatatatactcatatatatttatttatatatatgcacacatatatacttatgtatatatacttatgtgtatatatataaacacacacacacacaagtatatataaa

SEQ ID NO: 13182 - DNA, 118 bp, Homo sapiens
gggtcaatatgaatgaaatctaggatattatacaaatggtcataggagcttgggaaaatacttgtttttttctataaactgtgaatatctgagaatatgaagtcaacaaatttgacct

SEQ ID NO: 13183 - DNA, 112 bp, Homo sapiens
agcaatatatatcaactatatatatgtgtatatgtatatgtatatatgtatatgtgtatatatatatacgtgtgtgtgtgtatatatatatgtaagtatatatatcagcttg

SEQ ID NO: 13184 - DNA, 119 bp, Homo sapiens
tggatttaaatctttgctctaacccttactagggaggtgaatttggccatattacttaacctctctgtgcctcagtgttttgtctcttgaaaaggggtgggggaggggagattatcaca

SEQ ID NO: 13185 - DNA, 73 bp, Homo sapiens
ctcctttctatagaatgcatcaatctatgaatgtcacttttgcggcagtcatgatttgtattcttcctggcag

SEQ ID NO: 13186 - DNA, 116 bp, Homo sapiens
cttttaaagcaagtacttgacatccactaatctattatgttttattatttttattatactctgtgaaatagaacatttatagatctgtaatagatgtaaatgtgttttgcatgaag

SEQ ID NO: 13187 - DNA, 114 bp, Homo sapiens
gcattctcaggaaaactgatggtttaaaagtgtggcacctccctgctcactctctctctctcctgcggccatgtaagaggtgcctgcttccccttcaccttctgttatgattgt

SEQ ID NO: 13188 - DNA, 117 bp, Homo sapiens
ttgttgcttataaacttcaggttatgttgtattctttgaaatgaagctccttaattatagtataattattttttattcattcaaatgtgttaaagcataatgtctttattacaacaa

SEQ ID NO: 13189 - DNA, 95 bp, Homo sapiens
agttgcagacacatttgttcgggattctgggggctggagtatgtaaagcttctgggtctctctgtgtgcctgagtagctgctctgccaagacccc

SEQ ID NO: 13190 - DNA, 104 bp, Homo sapiens
caaaattggtgactctactcctctcctgtttcaagctacttctccattgaatatttatttttccttgtgtagcaatataagcggagtccttcactgtctttttg

SEQ ID NO: 13191 - DNA, 58 bp, Homo sapiens
tgagttagagtctctctctgtcacccaggctggagtgcagtggcgcgatctcagctca

SEQ ID NO: 13192 - DNA, 84 bp, Homo sapiens
catgatgggggaaaggagagaggactatttcttttttttttttttttttttttgagacgtagtctcgctctgtcgcccaggatg

SEQ ID NO: 13193 - DNA, 154 bp, Homo sapiens
gtatatagacacatattatatatgtgtatataatacatatataaaagtgtataatattcatatatgtatatacatattttatatgtgtatatatacacacaatatgtattgtatatatgtgtatatacacacaatatatagtatatacatatgt

SEQ ID NO: 13194 - DNA, 112 bp, Homo sapiens
tgggtacttattttcctgttacacagttacttgagttatttatatcttttaaagaatgtaatagatggatgatttgcagatgtgttctcccatgttacaggttgtgtattca

SEQ ID NO: 13195 - DNA, 95 bp, Homo sapiens; identical to SEQ ID NO: 68

SEQ ID NO: 13196 - DNA, 93 bp, Homo sapiens; identical to SEQ ID NO: 69

SEQ ID NO: 13197 - DNA, 170 bp, Homo sapiens
gtaaatgtacatgtatatgtgtgtgtgtgtatatatatatacacatatatatatacacatatatttatatatatatatatacatatatacacacacacacacacacacagacagacagagagagagagagagagagagagaaagtctcactcactctgtcacctaggctg

SEQ ID NO: 13198 - DNA, 111 bp, Homo sapiens
tttatttcagtgcatttgtttgctataaatgtagttcacatgtatttactaggtaaggatatgttagaatttattttttatagtttgcaatagcatttattatgaaataga

SEQ ID NO: 13199 - DNA, 64 bp, Homo sapiens
gtgtgtctctgtgtgtgtatatatatatatttatatatatatatatatatacacacacacacac

SEQ ID NO: 13200 - DNA, 96 bp, Homo sapiens
attcactcttgattggcatctagtttgattgtttatcttactattttgaatagtgctgggataaacatacaagtgtatgcatctttttagtagaat

SEQ ID NO: 13201 - DNA, 124 bp, Homo sapiens
agcaatatataattcttccattttttttccatttcaaatgattttggtgagaaatgttttcaatatgaatatatttctgaagtgaaattgtttgaaactgtcaaatatatattgttatagaatt

SEQ ID NO: 13202 - DNA, 96 bp, Homo sapiens
agcatttttgttttttttttgagatggagtctctctctgtcacctaggctggagggcagtggcacgatctcatctaacagcatatttttaaatgtt

SEQ ID NO: 13203 - DNA, 86 bp, Homo sapiens
ttgttcatttcccttagtttctcccaaacaaacagagtctctttctctgtgctgagctgcctggaactgggattatgatgatgcaa

SEQ ID NO: 13204 - DNA, 95 bp, Homo sapiens; identical to SEQ ID NO: 68

SEQ ID NO: 13205 - DNA, 93 bp, Homo sapiens; identical to SEQ ID NO: 69

SEQ ID NO: 13206 - DNA, 95 bp, Homo sapiens; identical to SEQ ID NO: 68

SEQ ID NO: 13207 - DNA, 93 bp, Homo sapiens; identical to SEQ ID NO: 69

SEQ ID NO: 13208 - DNA, 85 bp, Homo sapiens
acctgccactgcactgtctctgggtctctcttaggccgcccacttcagagaggctgagctgagccgtggaggtcaccagagccag

SEQ ID NO: 13209 - DNA, 101 bp, Homo sapiens
tataagaacatatatgtatattttcagtatatatatatatgtgtgtgtgtgtgtgtatatatatatatatatataaattataaacaggtatgtgactagtg

SEQ ID NO: 13210 - DNA, 76 bp, Homo sapiens
gagggacacaggctctctctgggtgaggactggctgcagctctcaagtttccatcattcagtagccattgcacctc

SEQ ID NO: 13211 - DNA, 99 bp, Homo sapiens; identical to SEQ ID NO: 3220

SEQ ID NO: 13212 - DNA, 111 bp, Homo sapiens
cagctccctcatgaccctggagggaattctgcccactcacagactctttcttattctgggcctctgctgttatctgggtattactccctgtcacagtcagtttggggactg

SEQ ID NO: 13213 - DNA, 59 bp, Homo sapiens; identical to SEQ ID NO: 2593

SEQ ID NO: 13214 - DNA, 78 bp, Homo sapiens
ggctgaagcgatcctcctacctcagcagggagtccctcagctactcaggaggctgaggtaggaggaagttacatggcc

SEQ ID NO: 13215 - DNA, 68 bp, Homo sapiens; identical to SEQ ID NO: 2134

SEQ ID NO: 13216 - DNA, 58 bp, Homo sapiens; identical to SEQ ID NO: 2135

SEQ ID NO: 13217 - DNA, 56 bp, Homo sapiens; identical to SEQ ID NO: 2136

SEQ ID NO: 13218 - DNA, 98 bp, Homo sapiens
cacttaggagggaaagttactgggaatgtcataaagggttaatttgtattttattttattttattttttgagacagtctcattctgtcacctaggctg

SEQ ID NO: 13219 - DNA, 86 bp, Homo sapiens; identical to SEQ ID NO: 2169

SEQ ID NO: 13220 - DNA, 86 bp, Homo sapiens; identical to SEQ ID NO: 2671

SEQ ID NO: 13221 - DNA, 58 bp, Homo sapiens; identical to SEQ ID NO: 6359

SEQ ID NO: 13222 - DNA, 119 bp, Homo sapiens
gcttattgggtaatgtaagataacacctcaaaatgaaactcagaattttattttattttattttttgagatggagtctcacctaggctggagttcagtgtggtaatcttggctcactgc

SEQ ID NO: 13223 - DNA, 101 bp, Homo sapiens
ctgatatgggaggcaggtgttcagaacaatatttatttttacagtcgcagtgagatttcaggcctcagaaatgtattctgtaatcgtttgctttcacacag

SEQ ID NO: 13224 - DNA, 82 bp, Homo sapiens
gagctcttagtttttttgagatggagtctcactctgtcacccaggctggagtgcgatctcgactcactgcaacctccacctc

SEQ ID NO: 13225 - DNA, 80 bp, Homo sapiens
catttgggggtctggaaatctgagatcaaggtgtcagcagactggttccttctgaagcctctctccttgacttgcagatg

SEQ ID NO: 13226 - DNA, 83 bp, Homo sapiens
tcacctggaatatgagcactatgtggactggctcactctctcataataggagcgccacacacacaagttgctgccatacgtgg

SEQ ID NO: 13227 - DNA, 59 bp, Homo sapiens
gtctgtctccctgtgactgagaccaccgctagtgattctccaagtacagaggggcatac

SEQ ID NO: 13228 - DNA, 95 bp, Homo sapiens; identical to SEQ ID NO: 68

SEQ ID NO: 13229 - DNA, 93 bp, Homo sapiens; identical to SEQ ID NO: 69

SEQ ID NO: 13230 - DNA, 77 bp, Homo sapiens
gggaggccaggtgaaaggatcacatgaggccaagagtttgagaccagcctgggcaacagtgagactctgtctctccc

SEQ ID NO: 13231 - DNA, 86 bp, Homo sapiens
ttgttttgagacagggtctcactctgtcacccaggctggagtgcagaggcctgatcatgactcattgcagtctcagcctccctggg

SEQ ID NO: 13232 - DNA, 98 bp, Homo sapiens; identical to SEQ ID NO: 13218

SEQ ID NO: 13233 - DNA, 68 bp, Homo sapiens; identical to SEQ ID NO: 2134

SEQ ID NO: 13234 - DNA, 58 bp, Homo sapiens; identical to SEQ ID NO: 2135

SEQ ID NO: 13235 - DNA, 56 bp, Homo sapiens; identical to SEQ ID NO: 2136

SEQ ID NO: 13236 - DNA, 96 bp, Homo sapiens
ggagggttgcttgagcccaggagttcgaggctgtagtgaggtatgatgacaccactgcaccactgcacttcagcctgggtgacaaagtgagactct

SEQ ID NO: 13237 - DNA, 90 bp, Homo sapiens
gcagctccacgcctgtgtccctccctgtgtctggcgctgccgctcttcagctgtgcccaggaggagaggcccggggcggggtggggctgc

SEQ ID NO: 13238 - DNA, 78 bp, Homo sapiens
aagtcacagcatgcatctatgaaacattaggacaattatatgtttttaaaaatctgtgtaggtatatgcttgtgattt

SEQ ID NO: 13239 - DNA, 101 bp, Homo sapiens
atgctcaaagggaaagatgtgtgagaaatgatttaattttatttgtggttggttcatcagtgattttgatgttatgataacatgttttcctctgcaagtat

SEQ ID NO: 13240 - DNA, 121 bp, Homo sapiens
atatatatatggggtatatatacatatatatctgatatatatatatctgaatatatatatagcatcatatatatatgaaatatatatatatagcatcatatatatatgaaatatatatata

SEQ ID NO: 13241 - DNA, 94 bp, Homo sapiens
cacattctcagattctcattatatatttagatttaaatttatatttatttttatatataaatatagatagatatagttagatagctggattgtg

SEQ ID NO: 13242 - DNA, 120 bp, Homo sapiens
atatatagccttgtatataagatatatatcttataagctggatgtatatatatacatatatgtatatgtatacgtgtgtatgggtatatatatacttagaaagtatataagtgtatatat

SEQ ID NO: 13243 - DNA, 71 bp, Homo sapiens
ttggagagtctgacagtttcactcacatgtccaacatcctggaagttgtggcttgaagatgtgacttacaa

SEQ ID NO: 13244 - DNA, 58 bp, Homo sapiens
tgagacaaggtctcactctgtcacccaagctggagtgcagtgtggcaatcatggctca

SEQ ID NO: 13245 - DNA, 109 bp, Homo sapiens
taattaaaatgaaaaactagtaagtatgaaaggcacactctctgtctcttcttgattttaatgagagacatttgctttattatagttattaatgactttattttagtta

SEQ ID NO: 13246 - DNA, 89 bp, Homo sapiens
ctgtccaagactgggtgatttataaaggaaagaggtttaactgatgtattagtccattttccttttttttttttttttttttgagacag

SEQ ID NO: 13247 - DNA, 95 bp, Homo sapiens; identical to SEQ ID NO: 68

SEQ ID NO: 13248 - DNA, 93 bp, Homo sapiens; identical to SEQ ID NO: 69

SEQ ID NO: 13249 - DNA, 87 bp, Homo sapiens
gtactatatatatgtaataactatatatgtatgtactatatagtatataggtactatatatgtgttcattaatactatatatagtac

SEQ ID NO: 13250 - DNA, 179 bp, Homo sapiens
atacatatatagttattacatatatatagtacctatatatacatatgtgtatatatatgcatatatgtactatatatgtatatttaatataaacatttgtatatatagattacatatatgtatagtatgtatagtatatatgtatgtactatatatatagtacatatatatgtatatat

SEQ ID NO: 13251 - DNA, 88 bp, Homo sapiens; identical to SEQ ID NO: 1308

SEQ ID NO: 13252 - DNA, 81 bp, Homo sapiens; identical to SEQ ID NO: 1309

SEQ ID NO: 13253 - DNA, 77 bp, Homo sapiens; identical to SEQ ID NO: 1310

SEQ ID NO: 13254 - DNA, 94 bp, Homo sapiens
ctgtctttgatttttcatcttatttttactgctttcaatattttctatttatttttggccttgagtagtttgattatgatgtgtcaaagcccag

SEQ ID NO: 13255 - DNA, 111 bp, Homo sapiens
atatttttatatttccttggactaatcagttaatgtgaaaaatctgactttttttgtttagaaaaagatgtctactttttccattggtgggacaaggggtgactgagatat

SEQ ID NO: 13256 - DNA, 102 bp, Homo sapiens
tgaattacttctcctagttttccttcatctgaaaatgtttatatttcaatttcattcctgaaggatattttactgaatatggaattctgggttgagagttca

SEQ ID NO: 13257 - DNA, 66 bp, Homo sapiens
gtgagctgagatcgcaccactgcacaccagcctgggtgacacagtgggactctgtctcaaaaaaac

SEQ ID NO: 13258 - DNA, 85 bp, Homo sapiens
acacaattcctgagcaacgaaatgaaatcatattgcttactggatttgcaatgaaatgaaatcatattgcttgccagatttgtgt

SEQ ID NO: 13259 - DNA, 80 bp, Homo sapiens
atattcctagccctggttcatttctgggatttcctttcaagcagagaggcaacttcagggaccaggcaacttggctatat

SEQ ID NO: 13260 - DNA, 68 bp, Homo sapiens
ttgctctctttctctctcactgtggaccttactcctatggtttactcagaggagagagtgataagaga

SEQ ID NO: 13261 - DNA, 83 bp, Homo sapiens
gtcttctgggactgaatggagaaatgtatttattattcatatgaatattcatgagttctctgaccagcacaatttaagggggc

SEQ ID NO: 13262 - DNA, 104 bp, Homo sapiens
gtggacacttcatttaattttagattctgggtgcatgtgctggtttgttatttgggtatactgcataatgctaaggtttatacttctagtgaacccatcaccca

SEQ ID NO: 13263 - DNA, 95 bp, Homo sapiens; identical to SEQ ID NO: 68

SEQ ID NO: 13264 - DNA, 93 bp, Homo sapiens; identical to SEQ ID NO: 69

SEQ ID NO: 13265 - DNA, 95 bp, Homo sapiens; identical to SEQ ID NO: 68

SEQ ID NO: 13266 - DNA, 93 bp, Homo sapiens; identical to SEQ ID NO: 69

SEQ ID NO: 13267 - DNA, 113 bp, Homo sapiens
gcagttttccttgtagaggtctttctcctccttggtttggtatattccttttttttttttttttttggagctgttgtaaaggaggttgagtttttatttgattctctgcttgg

SEQ ID NO: 13268 - DNA, 116 bp, Homo sapiens
caagctgaactgtctgagaacctttcttacattttcacagtggtttttatatatatttttaatggtgtcagccaggcaaatggaaaaagtagggtgagctcacatatctctgtttg

SEQ ID NO: 13269 - DNA, 117 bp, Homo sapiens
ggattattacctgttagtcgtgggaggaattttagtatttatgtttttattttttgttgatagtgcctaaaattaaaaacatccttcaattccttcattttatgattgattttatcc

SEQ ID NO: 13270 - DNA, 103 bp, Homo sapiens
cagttacatcttgagagggtgatggatccaggaatttattcatttttttctagattttctagtttatgtgcatagaggtattcataatatttttcaatgattg

SEQ ID NO: 13271 - DNA, 114 bp, Homo sapiens
ctgactttttagtgattgccattctaactggtgtgagatggtatctcattgtggttgtgatttgcatttctctgatggccagtgatgatgagcattttttcatgtgtctgttgg

SEQ ID NO: 13272 - DNA, 107 bp, Homo sapiens
atataaaaaatatataaaaatatatatatggttgtgtgtatatatgtatttgtatatgtgtgtatatatgtgtgtatacatgtatatgtttatgtatgtgtgtatat

SEQ ID NO: 13273 - DNA, 132 bp, Homo sapiens
tggaaaggaaggaacgaggagaaatttctaccttcatctctcaactaggcatttcagatagagatctgagagaggtgaccctggtaagaattcttacctctctccagcacttgtcatttttcccaggatctc

SEQ ID NO: 13274 - DNA, 118 bp, Homo sapiens
ctgctttagctgtgtcccagagattctggtatgttgtgactttgttctccttggtttcaaagaatttatttatttctgccttaatttcgttatttacccagtaatcattcaggagcag

SEQ ID NO: 13275 - DNA, 95 bp, Homo sapiens
ctcttgaatctgaaccaggcttgtgagttgctttgtgagaccaataaaacgagacagaagtgacagtgctcagcctccataccaggcctcaagag

SEQ ID NO: 13276 - DNA, 67 bp, Homo sapiens
ggagacagtcttactctgtcacccaggctggagtagtgcactggtgtgatcatagctcactgtaccc

SEQ ID NO: 13277 - DNA, 117 bp, Homo sapiens
tttgtttgttgtagattctggatattagttttttgtcaaatgtatagattgtgaagattttctctcactctgtgagttgtctgtttactctgctgccagttcctttggccatgcaaa

SEQ ID NO: 13278 - DNA, 115 bp, Homo sapiens
ctaacttgcttttgattttacaggctcatcagtagaagggacttgcatcgtctcagatgagactctggactgtggacttttgagttaattctgaaatgagttgagactttggggg

SEQ ID NO: 13279 - DNA, 76 bp, Homo sapiens
cagatatatatatatatacatatgtatacatatatatatgtgtgtatatatatatatatgtatatatatatatagc

SEQ ID NO: 13280 - DNA, 105 bp, Homo sapiens
ttgcagtatggaaaatgaagtcagaaagcgtagaaatttaggtgaaagaagaaagaaactattatttgatttttatgacagcttgcttcagaattctctaagcaa

SEQ ID NO: 13281 - DNA, 72 bp, Homo sapiens
gggtgtagtggcacacacctgaagtcccagctagctacttgggaggctgaggtaggaggatcatttgaaccc

SEQ ID NO: 13282 - DNA, 86 bp, Homo sapiens
tgtggatatatgtatacccacagtatatatctgtatatattagtatatacacagtatatatatatgaatatatgtatatatacaca

SEQ ID NO: 13283 - DNA, 86 bp, Homo sapiens
gctgggactactacagatgtgtgccaccacatctagctaattttttgtatttttagtagagatggggtttcaccatgtaagccagc

SEQ ID NO: 13284 - DNA, 116 bp, Homo sapiens
tttgcatgtagatgtgcagttgttccagtaccatttgttgaaaagactcactgattttttttttcttttttaaaattttactttaagttctgggatacaagttcagaacatgtaga

SEQ ID NO: 13285 - DNA, 71 bp, Homo sapiens
ttgttttaagatgggagtctcactctgtcacccaggctggagtgcagtggtgtgatctcggctcactgcaa

SEQ ID NO: 13286 - DNA, 60 bp, Homo sapiens
atgtgcatatatgtatacatatgtgtatatatgtatacatgtgtgtacatatctgtatat

SEQ ID NO: 13287 - DNA, 109 bp, Homo sapiens
atggatctgtatcaatttttcctggcatacactatggcctttctatttttttgttttttaagatggagtcttgctgtgtcacccaggctggagtgcagtggcgtgatct

SEQ ID NO: 13288 - DNA, 81 bp, Homo sapiens
aagctttgataactttcagtctctctgtctttccctgcacttggttggatatttgggtggatcagactgtgttaggtgctt

SEQ ID NO: 13289 - DNA, 100 bp, Homo sapiens
gctaagtcaagtagtatagtatgactacatttattttctttgataattgattgtttttcttggagtaaatatttgtcacatcgtgtccttgtttcttagc

SEQ ID NO: 13290 - DNA, 103 bp, Homo sapiens
aaagccatgttgttagagaggcataaaagtttgtggccatttcgtttttttggttaattatttattttaccagtatgaaaatttttgtgccttctaaggcttt

SEQ ID NO: 13291 - DNA, 98 bp, Homo sapiens
ggccttgagatggtttccctaacatttccattagtacatgggatgacaactgattctgtacttcccttcactgaaatgagagaatagattgacaggtc

SEQ ID NO: 13292 - DNA, 86 bp, Homo sapiens
gattctctggattaccagacagaggctcttattatcttcccttactttctcccaagcagagtctctctctgtgtgtgctgagcttc

SEQ ID NO: 13293 - DNA, 93 bp, Homo sapiens
taattctcacaatatttcaaactttttcattagtattatatgtctgttataatgctctgtgatcagaaatctttgatgttgctgcgggaattg

SEQ ID NO: 13294 - DNA, 95 bp, Homo sapiens; identical to SEQ ID NO: 68

SEQ ID NO: 13295 - DNA, 93 bp, Homo sapiens; identical to SEQ ID NO: 69

SEQ ID NO: 13296 - DNA, 107 bp, Homo sapiens
tacatatatatctatatcatatgtatatatataaatatatgtatatatacatatgtatatatatacatatgtgtccatgtatatgtatatatctgtatacatagata

SEQ ID NO: 13297 - DNA, 58 bp, Homo sapiens
tgagacagagtctcactctgtcacccaggctggagtgcagtggtgcgatctctgctca

SEQ ID NO: 13298 - DNA, 95 bp, Homo sapiens; identical to SEQ ID NO: 68

SEQ ID NO: 13299 - DNA, 93 bp, Homo sapiens; identical to SEQ ID NO: 69

SEQ ID NO: 13300 - DNA, 68 bp, Homo sapiens
gccctgcagtctctctctctctgcctcgtaatcctgattaggtagggagccagaggtatatcgccagc

SEQ ID NO: 13301 - DNA, 111 bp, Homo sapiens
gggataagattctttatattaattttaagcggatggaaaaaataggtgcactgtattatattttttctttctgtgtttttattggaaatgtgtaggtttcttttacttctc

SEQ ID NO: 13302 - DNA, 116 bp, Homo sapiens
tatatacatatgtgtatgtgcatatacacacatgtgtgtatacatacatatgtgtatatatacatatgtttatatatacatatgtgtatatatacacatatgtatatataaatata

SEQ ID NO: 13303 - DNA, 95 bp, Homo sapiens; identical to SEQ ID NO: 68

SEQ ID NO: 13304 - DNA, 93 bp, Homo sapiens; identical to SEQ ID NO: 69

SEQ ID NO: 13305 - DNA, 95 bp, Homo sapiens; identical to SEQ ID NO: 68

SEQ ID NO: 13306 - DNA, 93 bp, Homo sapiens; identical to SEQ ID NO: 69

SEQ ID NO: 13307 - DNA, 58 bp, Homo sapiens
tgagacagggtctcactctgtcacccaggctggagtgcagtggtgtgatcttagctta

SEQ ID NO: 13308 - DNA, 84 bp, Homo sapiens
ttgttattactgtttttatgaggggaatggtgttaggaatgaggggttctctttctataacactccttgagggaatagggacag

SEQ ID NO: 13309 - DNA, 76 bp, Homo sapiens
gcagccccttccaagttttggctttggggatagagaattgggagagatcagagaagagagactggtgagaggttgt

SEQ ID NO: 13310 - DNA, 96 bp, Homo sapiens
catactaagttttgttgttgttgttgttttttctgagacagagtctcactctgtcgcccaggctggagtgcagtggcatgatcgtggcttactgtg

SEQ ID NO: 13311 - DNA, 115 bp, Homo sapiens
gtcttcatccttatcgtcttaaggctgagtagtgtttgtgtgtgtaggttttgataattttaactttttataatagatttgtgtatatttcatgttagtaaatggtaaaatagac

SEQ ID NO: 13312 - DNA, 88 bp, Homo sapiens
gtggtgcttacaagatcagactcattgactcactcacttctccctgctccgtcactacactcccagtgagtatttcttgagctaccac

SEQ ID NO: 13313 - DNA, 114 bp, Homo sapiens
gcagatctgggactgttcagggtgggccactgtttgatattcatgtttttcaatataagcatcttttttttaaatggctgtgtctgaaaattggaatttggaataaatatctgc

SEQ ID NO: 13314 - DNA, 90 bp, Homo sapiens
tatatatcttttggatatatatatatctctccaaagtatctatatctaaaagatatatagatatatatatacaaaagatgtatatatatt

SEQ ID NO: 13315 - DNA, 58 bp, Homo sapiens
tgagacagagtctcactctgtcacccaggctggagtgcagtggcatgattttgactca

SEQ ID NO: 13316 - DNA, 117 bp, Homo sapiens
acatctagttcaaaaatcacaatgttttggagggaagcatattttgatgaattttatattattttatttagaatccctttgctgtattctcattgttgtgatctgagtacctgatgt

SEQ ID NO: 13317 - DNA, 92 bp, Homo sapiens
ataggaatccatactgtgttagcattagtaatgacattttatttttatatctgaggtgaatgtgctgttagctcattggcatgggctcctat

SEQ ID NO: 13318 - DNA, 72 bp, Homo sapiens
cctggtgtagtgggcatgcctatagtcttagctactagggaggctgaggtaggaggatcacttgagcccagg

SEQ ID NO: 13319 - DNA, 101 bp, Homo sapiens
gcttagcttccacttatgagtgagaacaatgtttgtttttctattcctgagttacttcacttagaataatagtgttcagtctcatccaggttgctgcaagt

SEQ ID NO: 13320 - DNA, 94 bp, Homo sapiens
tctattttgagacagggtctcactctgtcactgagactgaagcaagtggtgcgatctaagctcactgcagccttgacctcctgtgctcaggtga

SEQ ID NO: 13321 - DNA, 108 bp, Homo sapiens
tgaaagaggaaggagttttatatctttaattcacctgtgattttcttgtaatctccaaagaaactttactgagaaaaacacttgtgaaactgatttagcttttaactc

SEQ ID NO: 13322 - DNA, 115 bp, Homo sapiens
cttattttcatggtgcaaatacttccagcataagagtttaagctatcaatgttacatcattaagctagaatagggaagaaatggacagtatgctattgcacagtatttccataag

SEQ ID NO: 13323 - DNA, 76 bp, Homo sapiens
tgtgacaaccctggatcaagcaagtctgttggtaccattgtccaacagcatgtgctcactttctgtctctgtcaca

SEQ ID NO: 13324 - DNA, 95 bp, Homo sapiens; identical to SEQ ID NO: 68

SEQ ID NO: 13325 - DNA, 93 bp, Homo sapiens; identical to SEQ ID NO: 69

SEQ ID NO: 13326 - DNA, 81 bp, Homo sapiens
aacttggtgctgtttacatgataatgagttgagttcttgttgtagtgagactggattatttatcataggaatggactagtt

SEQ ID NO: 13327 - DNA, 95 bp, Homo sapiens
tgaccagatgtcttataaaaatgctatccattatattatggataaatgctatccattatattaatgttattattattcttattttcatttggtca

SEQ ID NO: 13328 - DNA, 95 bp, Homo sapiens; identical to SEQ ID NO: 68

SEQ ID NO: 13329 - DNA, 93 bp, Homo sapiens; identical to SEQ ID NO: 69

SEQ ID NO: 13330 - DNA, 108 bp, Homo sapiens
tgctattgtgaatagtgtgctgcagtgaatatatgcatgaatgtatctttgtaacagaaagatacacatgcatgtatcttttatggctgcatagtattccgtgatgta

SEQ ID NO: 13331 - DNA, 123 bp, Homo sapiens
gtatatatatatgtgtgtgtatatatatatatacacgtaggtatatatacgtgtatatatgtatgtatatatacgtatatatatgtatgtatgtatacgtgtatatatatgtatgtatgtata

SEQ ID NO: 13332 - DNA, 57 bp, Homo sapiens
gcagtggctctgtgtcgctctgaggtggatttcccagaagcaactgatagcccctgt

SEQ ID NO: 13333 - DNA, 111 bp, Homo sapiens
agatttctggcaattctatccccactcatcagcacgacaacagggctgaataagtctgaaacactgtcagtgatagatgagtgggcttatattttggtgactttgctttct

SEQ ID NO: 13334 - DNA, 73 bp, Homo sapiens
gcaaaagagactgtgtacactgagagcccatgctgtgatggacatggtgctactcactcatggtgtcatgtgc

SEQ ID NO: 13335 - DNA, 116 bp, Homo sapiens
tacacattgtttggcatatattaaatggtatagctattttctacaaaagacagaacacagtatggaatttgttgtagattttggcacttttttatttgtgcaagttaattttggta

SEQ ID NO: 13336 - DNA, 105 bp, Homo sapiens
aagatttttctttgttataaaatctgtcaatgtatgttataaagtctataataagatagattttttagtttttaatacagacactttatgtaatataaaagtctt

SEQ ID NO: 13337 - DNA, 82 bp, Homo sapiens
gcttcaagaacatgtgcagttttccagcttcatttgctgacagaaatgagagagctgggagtcaactgaatcagtgtgaagc

SEQ ID NO: 13338 - DNA, 95 bp, Homo sapiens; identical to SEQ ID NO: 12950

SEQ ID NO: 13339 - DNA, 93 bp, Homo sapiens; identical to SEQ ID NO: 12951

SEQ ID NO: 13340 - DNA, 99 bp, Homo sapiens
agttattcacagattcacaaagctggggaaattgcagagaagtgatttacttgatgctttttaaatccacttatcttttcttcagtttgcttcttagct

SEQ ID NO: 13341 - DNA, 62 bp, Homo sapiens
gcattttagtcttgttgctgttgttgagacaaagtctcactctgtcacctaggctggagtgt

SEQ ID NO: 13342 - DNA, 112 bp, Homo sapiens
tagagcctgcatataacttatgtattcaacctgaagtgttagtcccattctttttttttttttttaattatactttaagttctagggtacatgtgcacaacgtgcaggtctg

SEQ ID NO: 13343 - DNA, 98 bp, Homo sapiens
gagtttactttgggctagcacgtttctccacttctgtcccaatgttctcattagagaacattgaaagcactaagaattagtgcatgcccagtaagtcc

SEQ ID NO: 13344 - DNA, 103 bp, Homo sapiens
atgtgaatgctcttatgatttatgtgtgtatatgtatttccataaatatgttttactgtttatatatacttatgtatgcatataaattatgaattatatatat

SEQ ID NO: 13345 - DNA, 90 bp, Homo sapiens
gatatatatctatatatgatatacagatatatatgatggaatacatatatgatggaaaatatatattttatatatatatatatatatatc

SEQ ID NO: 13346 - DNA, 108 bp, Homo sapiens
tatgcgtgtgcgtgcgtgcgtgtgtgtatatgtacatatatatatatatgtctatgtgggtgtgtatatctatatatatatacacacatatatgtccgtgtgtgtgta

SEQ ID NO: 13347 - DNA, 122 bp, Homo sapiens
gtgtatatatataacatatatgtgtgtatgtacatgtataatacgtacacatatattttatatatttgtgtgatgtatatagtgtatataatacatatataatatatacattatacacatat

SEQ ID NO: 13348 - DNA, 93 bp, Homo sapiens
gtgtttttcactagttgtgtgatgttagggaagccacttgagttcactcagtatcagtgtattagtctgttttcatgcggctaataaagacat

SEQ ID NO: 13349 - DNA, 96 bp, Homo sapiens
ttgtcacctgcaatgagccaacatgttttaatatttctctatgaattttataaatttcttctccaaatatggaaacatgttcattgctttgtgtaa

SEQ ID NO: 13350 - DNA, 111 bp, Homo sapiens
tcggactgttcaactcacctggcagccactcccagagcccctggaactctggcccaaggctctctgactgactccttcccagatcttcttggcttagcggctgaagactga

SEQ ID NO: 13351 - DNA, 81 bp, Homo sapiens; identical to SEQ ID NO: 7982

SEQ ID NO: 13352 - DNA, 126 bp, Homo sapiens
tctcttcagtctcttgccagatctaaaatggaatgggtttgagtgtgagtgacatgagtgagaagtgactaatctctgccacccatcattttcagggttgcaaaattaactcactttctctttgtt

SEQ ID NO: 13353 - DNA, 97 bp, Homo sapiens
gttctcttataagaagagaccagagagcttgatccctctctctctgccctgtgagaacacagtgagatgggggccacctgcaagtctggaagagagc

SEQ ID NO: 13354 - DNA, 112 bp, Homo sapiens
atatactgatcatgacgctaatatatatgcatgcaaatatatatatatatctgacacataaaaggttgattatgtttatatagtaccattatgcattgtgtctttagtgtat

SEQ ID NO: 13355 - DNA, 64 bp, Homo sapiens
tgagacaaggtctcactctgtcacccaggctggagtgcagtgatgtgattatggctatggctca

SEQ ID NO: 13356 - DNA, 100 bp, Homo sapiens
tatcatgtctttgcatctcagctaaaatatatgtatatgtgatatacatgtacaaatatgagtatatatatatatagagagagagagagagacataggtg

SEQ ID NO: 13357 - DNA, 94 bp, Homo sapiens
atggatccatatatgatttcaatagatgtttgaatataatactgagataataatgaaggaagatatttattgtcatgaaatatggtatatccat

SEQ ID NO: 13358 - DNA, 107 bp, Homo sapiens
ttatgtgtctgaataatttgacagttttctgagatgtgaattgctagtatttttctctggttgttgtttgtatttgatgttgcttatagttattttgtgatacataa

SEQ ID NO: 13359 - DNA, 62 bp, Homo sapiens
tatgtctatatgtatatatacatatatgggtatacatgtatgtatgtatatatgtatacatg

SEQ ID NO: 13360 - DNA, 59 bp, Homo sapiens
tgagactgagtctcgctctgtcgcacaggctggagtgcagtggcagcgatcttggctca

SEQ ID NO: 13361 - DNA, 95 bp, Homo sapiens
ccactgaatggaaaaggaagtcagagagcagagagaggaataatttcagccccccattctctttttaactctctgtattagtagatcctaagagg

SEQ ID NO: 13362 - DNA, 84 bp, Homo sapiens
tatatatacgtatatatacgtgtatacgtatatatacgtatatatatgtatatatacgtgtatacgtatatatacgtatatgta

SEQ ID NO: 13363 - DNA, 64 bp, Homo sapiens
tgtatatatatacaagtatgtatatatatacaagtatgtatacatacaggtgtatatatataca

SEQ ID NO: 13364 - DNA, 108 bp, Homo sapiens
tgtatatatatatacttgtagatatatatacttgtagatatatatatacttgtgtgtatatatacaagtatatcttgtatatacttgtatatatgtatatatacacaa

SEQ ID NO: 13365 - DNA, 90 bp, Homo sapiens
cagatgtgaaaactaagtagtgataatatttaagatggtccatgtagtgaacatgacattttatagttttttaacttcattcacatactg

SEQ ID NO: 13366 - DNA, 117 bp, Homo sapiens
aagtgtaagccactgcgccaggcctgttaagacttttgattaaataaatattatttcataataattatgtgataagattttgatcaaatgttttgaaccttaatttttggcaaactt

SEQ ID NO: 13367 - DNA, 86 bp, Homo sapiens
tgctatagatcctatgggtctgtgtggtaatttacacatagcagccagctaaaacctccacacagtatctctctctgtcatagaca

SEQ ID NO: 13368 - DNA, 68 bp, Homo sapiens
gtggagctgtgagaagacagccaccattctccagacctccgaatggtagatctactgacagcttgcac

SEQ ID NO: 13369 - DNA, 109 bp, Homo sapiens
ttgttatttgtgtttttgcatgtgtatgtgtttcccctgaaaactttttgactatttttttaacctttccgaatgccatgggaaatatataacagcgaaaacaatacaa

SEQ ID NO: 13370 - DNA, 118 bp, Homo sapiens
cctcggaatatttgctgaagagctgtgtgaccctgagaaatcagttgacctctctgtgcctgtgtcatcgtgtattcagtgaaaacatcagctccacttcagctcatgtgttctatgg

SEQ ID NO: 13371 - DNA, 127 bp, Homo sapiens
atatatatatatatatatatatatatgtacatatatacgtgtatatatgtatatatgtgtgtatatatgtatataagcatatatgtatatatgtatgtatatatatgtgtgtatatatatatattca

SEQ ID NO: 13372 - DNA, 119 bp, Homo sapiens
tgtctataactgtgagggaagaaaatatttttaagatacattggtctagcaataatttatttattatttttgtttagagacagagtctctttggttgtttaatctgaagtgcagtgaca

SEQ ID NO: 13373 - DNA, 96 bp, Homo sapiens
tctctttatagatgaagtgtgtttcttgtaggcaacagatcattgggtcttgtttttataatttattcagccacgctttgtcttttgattggagag

SEQ ID NO: 13374 - DNA, 86 bp, Homo sapiens
cagagacttagactaggagttatgacatcacttcccctggttcttatgcctttggattgaaatgaattatgaccctggcttttctg

SEQ ID NO: 13375 - DNA, 95 bp, Homo sapiens; identical to SEQ ID NO: 68

SEQ ID NO: 13376 - DNA, 93 bp, Homo sapiens; identical to SEQ ID NO: 69

SEQ ID NO: 13377 - DNA, 107 bp, Homo sapiens
ctaaaactaaatgggaataataatatggactgcataaaggtatttttgccaggattcaattatattaatttatgcagtagcattatttgaaactaatatagttatgg

SEQ ID NO: 13378 - DNA, 72 bp, Homo sapiens
gtgtatatatgtatatatgtgtgtatatatagacatatatgtatatacatttggatatatacatgtatatat

SEQ ID NO: 13379 - DNA, 98 bp, Homo sapiens
taaattcctctgggaaaagtgagacccatatacacattttttttttgtaaaggccatatgtttatactaagtctcacctaattccccaaggtcattta

SEQ ID NO: 13380 - DNA, 107 bp, Homo sapiens
gatgatggaggctgatctacggtaatgttagtggaaatgaaatgaaatgaaacgaaatgaatgtggtggcatttgctctgactgggaccatggagtggtaacgggtt

SEQ ID NO: 13381 - DNA, 71 bp, Homo sapiens
gcagaaaccacactcatcatggttggtaatgattgcatcagtatgaagtgtgtgtgtgtgtgtgtgtgtgt

SEQ ID NO: 13382 - DNA, 95 bp, Homo sapiens
tgtatatgcacacatacgtatatgtatatatgtatatgtatatatgtatatgtatatgtacatatatgtatatgtatatgtgtatatatagccat

SEQ ID NO: 13383 - DNA, 58 bp, Homo sapiens
tgggacagagtctcactctgtcacccaggctggagtgcagtagtgtgatcttggctca

SEQ ID NO: 13384 - DNA, 72 bp, Homo sapiens
agaatatatacatatattatagaaatatatatattactctatatatatgtatttctgtgtatatgtatttct

SEQ ID NO: 13385 - DNA, 99 bp, Homo sapiens
gcaaacaacacagattaaaagcacaatcatcattgaaatcacagagcctccaagtgtttttatctattttaatgggttactagctgctaatctgtctgc

SEQ ID NO: 13386 - DNA, 95 bp, Homo sapiens
tctttggtaatcatctgtttattgttctgtttggtaatcatctgaaatgaactttatgcagcagatataaatacagttacagatgtcattggaga

SEQ ID NO: 13387 - DNA, 69 bp, Homo sapiens
gtctctctgtctgtctgtctgtctgtcaattataggaattggctcacacaattacagaggctgagaggc

SEQ ID NO: 13388 - DNA, 116 bp, Homo sapiens
tatcttggagaaggttccatgtgctgttgaacggaatgtgtattttgcggttgttggatgaaatgttctgtatatatctgttaagtccatttgttccaaggtatagtttaaatcca

SEQ ID NO: 13389 - DNA, 99 bp, Homo sapiens
gaaaactgttgctttcatttctcaaatcttcagaatatgtagaaatatattttcttattgttttggagaagctaggaaaatgtgagttttatatatttc

SEQ ID NO: 13390 - DNA, 91 bp, Homo sapiens
atgcaggctcttttttgcttccatatgaaatttaaagtagttttttccaattctgtgaagaaagtcaatggtagcttgatggggatagcat

SEQ ID NO: 13391 - DNA, 95 bp, Homo sapiens; identical to SEQ ID NO: 580

SEQ ID NO: 13392 - DNA, 93 bp, Homo sapiens; identical to SEQ ID NO: 69

SEQ ID NO: 13393 - DNA, 81 bp, Homo sapiens
tgtacatttgtacatgtaatatacaaattcaaatgtacatagtttaatgtatatttgtacatgtaatgtacagttaatgta

SEQ ID NO: 13394 - DNA, 93 bp, Homo sapiens; identical to SEQ ID NO: 69

SEQ ID NO: 13395 - DNA, 109 bp, Homo sapiens
catttatcagagtatggtagttttcctcatacagatattgtatatactttgttaaatttataactaagtatattttattttggggagtgctaaggtacatggtattgtg

SEQ ID NO: 13396 - DNA, 95 bp, Homo sapiens; identical to SEQ ID NO: 68

SEQ ID NO: 13397 - DNA, 93 bp, Homo sapiens; identical to SEQ ID NO: 69

SEQ ID NO: 13398 - DNA, 90 bp, Homo sapiens
agttacttaatctccctgccttccatttccttgtacacatgagacaattcccccctcagaggattgttgtaaggatgagatgaagtaatt

SEQ ID NO: 13399 - DNA, 98 bp, Homo sapiens
ggtataaaagtagtagcagtgattatttattatttttcattcactgtagtatagtagaggggagtgtagtgtggtagttagatgttgagctgtgtacc

SEQ ID NO: 13400 - DNA, 58 bp, Homo sapiens; identical to SEQ ID NO: 637

SEQ ID NO: 13401 - DNA, 81 bp, Homo sapiens
atacatatatatacacacatacgtgtgtgtgtatatatatataaaacgtatacatatacgtatatgtgtatatttatgtat

SEQ ID NO: 13402 - DNA, 58 bp, Homo sapiens; identical to SEQ ID NO: 1673

SEQ ID NO: 13403 - DNA, 116 bp, Homo sapiens
gctgtttgctgttggtaagagtatgaggtagtatttctttctttctttctttttttttttttttttttttttttttttgagacggaatcttctcactctgtcgcccaggctggagt

SEQ ID NO: 13404 - DNA, 73 bp, Homo sapiens
gttgttgttgagacggagcctcactctgtcgctcaggctggagtacagtggcgcagtctcggctcactgcaac

SEQ ID NO: 13405 - DNA, 116 bp, Homo sapiens
aggagtggaattgctgaattgagcagtaggtttctatttagccttagtagaaaatgccagtttttcacagtggctgtacctatttttatccccattagcagtatattaaagttcct

SEQ ID NO: 13406 - DNA, 98 bp, Homo sapiens
tgtgtatgtacatgtatgtatatgtgtatatatgtatatatgtgtaaatatatgcacatacatacataggcacatacataaacatacacacatacaca

SEQ ID NO: 13407 - DNA, 95 bp, Homo sapiens; identical to SEQ ID NO: 68

SEQ ID NO: 13408 - DNA, 93 bp, Homo sapiens; identical to SEQ ID NO: 69

SEQ ID NO: 13409 - DNA, 79 bp, Homo sapiens
gtgtacaggtatatccatatatatgtatacacacatacacactacacatgtatatatatatatggatatacctgtacac

SEQ ID NO: 13410 - DNA, 83 bp, Homo sapiens
agtagctgggactacatgcatgtgccaccatgatttttacattttctgtggagacagggtctctgtgtgtttctcagattgct

SEQ ID NO: 13411 - DNA, 77 bp, Homo sapiens
ggtatctcattgtgattttgatgttcatttacaaataattagtggtgttgggcatcttctcacatttattagatacc

SEQ ID NO: 13412 - DNA, 115 bp, Homo sapiens
gggcaactaggaagccaccacagaaacagctaaagtattgagcactctttccacctcactctcactcacaacctagttctgctgttctcttcctcttggctggctccctcagcct

SEQ ID NO: 13413 - DNA, 59 bp, Homo sapiens
ttgagatggagtctcactcactccgtcacccaagctggagtgcagtggcaccatcttgg

SEQ ID NO: 13414 - DNA, 117 bp, Homo sapiens
tacttatttacacacatactaaagtttatattatggtgtatatatatatgcttcttttatggtatatataaatttatattgtggtacgtctgtggtgtgtgtgtgtatatatatgta

SEQ ID NO: 13415 - DNA, 58 bp, Homo sapiens; identical to SEQ ID NO: 315

SEQ ID NO: 13416 - DNA, 81 bp, Homo sapiens
gttaagaagctgggctgctggccataactcctacagaaactaacgtatacttctgtgcctctgacagcccggcccagtgat

SEQ ID NO: 13417 - DNA, 70 bp, Homo sapiens
tgcaggagtttctgcacaggccactgcttgggatgttcttgagccagaggttgtagtttcagctcctgta

SEQ ID NO: 13418 - DNA, 95 bp, Homo sapiens; identical to SEQ ID NO: 68

SEQ ID NO: 13419 - DNA, 93 bp, Homo sapiens; identical to SEQ ID NO: 69

SEQ ID NO: 13420 - DNA, 78 bp, Homo sapiens
tatatatatatatatgtgtgtgtgtatatacatatatatatatgtgtgtgtatatatatatatgtgtgtgtgtgtgtg

SEQ ID NO: 13421 - DNA, 71 bp, Homo sapiens
ttgttttttgagacagatctcactctgtcacccaggttggagtgccctggtgcgatctgagctcactgcaa

SEQ ID NO: 13422 - DNA, 70 bp, Homo sapiens
ttagaagaatgtgtgtatgtatgtgtgtgtacatatatgtgcatatctatacatatatgtaaaatactag

SEQ ID NO: 13423 - DNA, 110 bp, Homo sapiens
gtgtctgttcttgtcctttgcccactttataatggggttgtttgtttttttcttataaatttgtttaactatattgtagattctggatattagacttttatagcatgcac

SEQ ID NO: 13424 - DNA, 60 bp, Homo sapiens
gtgtgtatatttatgtgtatatgtgtatgagtatatatatatatgtacatatgatcatat

SEQ ID NO: 13425 - DNA, 85 bp, Homo sapiens
caagtatgatgacatgtgacagtgtttgatctagagaatgacagtctcattgtgtctctggctctatctatatgtgattttcttg

SEQ ID NO: 13426 - DNA, 115 bp, Homo sapiens
gatttatagttctattctctgatgtggggatgagagagttttaggaaaaattagttgttttttcttaaaacataatcagtcaccaacatcaatcgagtgtttgatagttattttc

SEQ ID NO: 13427 - DNA, 95 bp, Homo sapiens; identical to SEQ ID NO: 68

SEQ ID NO: 13428 - DNA, 93 bp, Homo sapiens; identical to SEQ ID NO: 69

SEQ ID NO: 13429 - DNA, 112 bp, Homo sapiens
tgtatgtatagatatacatatgatgtatatgtatatatacacatatatacatgtatatatacttatatatatctgatatatacactgatatatgtattatatatccatatac

SEQ ID NO: 13430 - DNA, 58 bp, Homo sapiens
tatatgtacataaatatatgtatatactaatatgtatatatgcatatgtgtacatata

SEQ ID NO: 13431 - DNA, 100 bp, Homo sapiens
atacaattgtcttgtatgtatatatgtgtatacatatatactgatatatactgatatacctatatatgtatatatactatatatactgatccacatgtat

SEQ ID NO: 13432 - DNA, 89 bp, Homo sapiens
ctgaatttaataatattggctcagtctctctttctctttacacatggtaacaagttcaggaagtactgtcactaatattgttttttcag

SEQ ID NO: 13433 - DNA, 115 bp, Homo sapiens
attctgacatagggacaatgtttattcatctttttaaacatttcgttaattgacaaagtaattttataaatttactatgtagaacatgttttgaagtgtgtatacattgtggaat

SEQ ID NO: 13434 - DNA, 106 bp, Homo sapiens
tgaccctgacacagtaaaatcctaaaaacattttagaatcattttgtctctcataatttatatagataaaagccttgtgttttttctttgcctgttaagtgggtta

SEQ ID NO: 13435 - DNA, 106 bp, Homo sapiens
ttgaactttaagtgatgcctgggagccatgtgtttaaggtctctgtctgtctcaccccctgcagtagattcctacatcagtggtcccagtgaagcttgtcttttgg

SEQ ID NO: 13436 - DNA, 78 bp, Homo sapiens
caaagggcaggaggatttttaaaggctgggctgagagggagctcacaggctgcctgtgtttgcttgctaattggcttt

SEQ ID NO: 13437 - DNA, 75 bp, Homo sapiens
atagatgttgcctcctcacgatgtcctcacatgttaaaagagtttcatgtgaggacacagtgtggtgtcttctat

SEQ ID NO: 13438 - DNA, 87 bp, Homo sapiens
ccaggctgggcaacatagcaagacccccatttctacaaacaatttttgtgttttagagacaaggtctcactctgtcactcaggctgg

SEQ ID NO: 13439 - DNA, 83 bp, Homo sapiens
ttcacatgatcaagagactatatatacatatatatatacagttatgtgtatatatatgtatatatatagtcatgacactggaa

SEQ ID NO: 13440 - DNA, 104 bp, Homo sapiens
gaagacagagacttttggatttcttttggaagtagacattaaaataattaagatctatatattttaaagtatctttctttcaaatatccttgaagttggtcttt

SEQ ID NO: 13441 - DNA, 118 bp, Homo sapiens
aaacacgtgagccagtatcatgtgtgtatatgtatatgtgtgtatatacatatttcatacacacacacacacacacacacacacacacacacacacacatcttttattggctctgttt

SEQ ID NO: 13442 - DNA, 82 bp, Homo sapiens
ggttggttgtttttgagactgagtcttactctgtcacccagactggagtgcagtggcatgagctcagctcactgcaacctcc

SEQ ID NO: 13443 - DNA, 95 bp, Homo sapiens; identical to SEQ ID NO: 68

SEQ ID NO: 13444 - DNA, 93 bp, Homo sapiens; identical to SEQ ID NO: 69

SEQ ID NO: 13445 - DNA, 117 bp, Homo sapiens
aagttattatattgagggtagaaatttagggttaaaaaacatgttaaatatatttgaaacattttcaattttatatctctgtgaatacctaagtcctatgtttttgtgtgtcagctt

SEQ ID NO: 13446 - DNA, 114 bp, Homo sapiens
gttcagatgtgtctggagtttcttccttctggtgggtttgtggtctcgctgacttcaggagttcagctgcagaccttcagggtgttacagctcttaaagtcggcgggtctggat

SEQ ID NO: 13447 - DNA, 107 bp, Homo sapiens
tgtttatatatatacatgtgtatgtatatatatatatatacacacacacacacacacacacacatatacatatacatatatatacacacacgtatatatatctcaca

SEQ ID NO: 13448 - DNA, 106 bp, Homo sapiens
tctgagtttttttcctcgaaagtgctaaatgggggctttattattttatatatgtaggtcatagaaagtttttgttaaggcatcttttaagcaaagatctaaagga

SEQ ID NO: 13449 - DNA, 108 bp, Homo sapiens
acaaagaaacgaggaaagtgttttatatggctgtgagtgtctgtgtgtcatggaggtaacagtagtggcactcttgctatgtgcatttcatttgatttacatatttgt

SEQ ID NO: 13450 - DNA, 56 bp, Homo sapiens
gcgtgcctgactgtgtcagtggctggaccccatgctcactcacacacactcgcagc

SEQ ID NO: 13451 - DNA, 70 bp, Homo sapiens
tttttttgagacagagtctcgctctgtcacataggctagaatgcagcagagtgatctcagctcactggaa

SEQ ID NO: 13452 - DNA, 98 bp, Homo sapiens
cttcagtagatgatgtagtatgcttcaggtacggttattctgtatactgttttttaaaaattttatacagacttaatttactcctaggcctattgaag

SEQ ID NO: 13453 - DNA, 81 bp, Homo sapiens
gtacatatacagtatgtaatttgtgtatatatatatatatatatatatatactataaatgcacacatatataagtatgtat

SEQ ID NO: 13454 - DNA, 76 bp, Homo sapiens
gatacttagtactatgtctggcatattataagtaaaagtatctatttattataattcagacaaaatatgaagtatc

SEQ ID NO: 13455 - DNA, 85 bp, Homo sapiens
tctctcatttccacaaggttcaggaaggagcaaaatcaaatcaatcagatttaactccctgacactctgagacagaaatgacagg

SEQ ID NO: 13456 - DNA, 93 bp, Homo sapiens
tttaatgatttaattaaatatataaacacattttatatatacatatttatgtgtgtgtctgtgtgtccatataaataggattgggttgtagag

SEQ ID NO: 13457 - DNA, 84 bp, Homo sapiens
gacttattgatggagctagtacgatcaaaactataggttttcgtttttgtttttgtttgtttgctagcttgcgtccttttggtt

SEQ ID NO: 13458 - DNA, 112 bp, Homo sapiens
tctgattagtacttatagtttctgaagtaaaagtcagggattatgttgaaagtatttattttttcaattatgtctttgtcttggggttctgaatcttttttgctgtaataga

SEQ ID NO: 13459 - DNA, 96 bp, Homo sapiens
tgcatgcctggtacaaaactcacttgatcgtggtgtattatttttttgatatgctgtttgattcagttagttagtattttgttaaggatttttgca

SEQ ID NO: 13460 - DNA, 113 bp, Homo sapiens
gagtgctgacttcctgggatcccactttcttctcctaggtatttgtgccagcttcttggatcttttgtatttttacctggctagggaaatcagggtccctggtggtgagtctc

SEQ ID NO: 13461 - DNA, 101 bp, Homo sapiens
atactctttccaatgcaacggtcctatattatatttacacaacttattgtgtgtgtgtgtgagagagagagagaagtgtgtgtgcatgagagagaaagtgt

SEQ ID NO: 13462 - DNA, 78 bp, Homo sapiens
cagagagagagagagagagagaaagatctgtgtatcaatttttaatttgatttctatcttttagtgaatttttctctg

SEQ ID NO: 13463 - DNA, 89 bp, Homo sapiens
aaatatgagtctatctaggaagattttatgaattttaagatgcactttaagtgatcaataattgtttttctcttagaagaagcatattt

SEQ ID NO: 13464 - DNA, 128 bp, Homo sapiens
aatatatcttctgctggggcagtttcatagaagggtgaggatgacatgagtatcttatttctttttaaatttattgacactgcattaattgacaggacattatatttggatcatgctcctcttctgga

SEQ ID NO: 13465 - DNA, 94 bp, Homo sapiens
actaaaactttaggaactgacttcactctctgtcactactgtaaattattatttggttttagtgtggagcttataagtctttcttggtcatagt

SEQ ID NO: 13466 - DNA, 90 bp, Homo sapiens
tgattatacaaacataaacacatatataaatttatatatgtgtgtgcacatgcgtgaatatatatgtgtgtaaatatgtgtgtatgatta

SEQ ID NO: 13467 - DNA, 75 bp, Homo sapiens
cctctgaagactagagattatggtgttggcggcaattacaaagctggattcatacatatctctgaggacgtgagg

SEQ ID NO: 13468 - DNA, 109 bp, Homo sapiens
acaagatagcttgtcttgtatacttcagccacatctatatttgattatctcatacttgcataatgtatacatgaatggagtagcactggtgttaggaggggtgttttgt

SEQ ID NO: 13469 - DNA, 80 bp, Homo sapiens
catagtatttttcttcagagatctgtgttaaaacaattgatagtctctgtctcacagatttatgacaattgaatacaatg

SEQ ID NO: 13470 - DNA, 103 bp, Homo sapiens
tgcatataagaatatatgtatatttgttacatgcatataagaatatacatatagatatatatatatataagtgtgcatgtgtatgtatatatgtctgtgtgca

SEQ ID NO: 13471 - DNA, 58 bp, Homo sapiens; identical to SEQ ID NO: 852

SEQ ID NO: 13472 - DNA, 94 bp, Homo sapiens
ccaattaatgagattttaatagtaattttacagagatggagaattaaccattattctctatttctgtctgttaaaaccccctctcatgacttgg

SEQ ID NO: 13473 - DNA, 101 bp, Homo sapiens
gctattttatctacagtgacattctgttgtttagtatggccatctttattaattattttagatagatcttctgggtaacttgctgtagcctctacattagc

SEQ ID NO: 13474 - DNA, 89 bp, Homo sapiens
tatacctatatctacatatctctgtatttatatgtgtatctgtgtacacatatatatgtgtatatataaggtatgtatgtttacgtgtg

SEQ ID NO: 13475 - DNA, 117 bp, Homo sapiens
tttatcatgtaaatacattgtataaaaattaccagctacataaagttgtgataaatttacatttttattaataatattagtagcaatagtagttgagatacttcataatatggtgga

SEQ ID NO: 13476 - DNA, 69 bp, Homo sapiens
atgtatgtatgtatgtatgtatgtgtgtatatatatatacacacacatatatatattatatatatacgt

SEQ ID NO: 13477 - DNA, 92 bp, Homo sapiens
gagttactttttgtgtatagtgtgagataagaatctaatttatttttgcttttactttatttcactattctcttgctgtcattgagtagctt

SEQ ID NO: 13478 - DNA, 83 bp, Homo sapiens
catgtatatatgtgtttatatacatgtgtatatatgtgtatgtgtgtatgtatatgtatatgtgtatgtatatatgtgtgtgc

SEQ ID NO: 13479 - DNA, 62 bp, Homo sapiens
attctcagccatgtggaactgtaagttcatgtggaactgtaagtccatgtggaactgtaagt

SEQ ID NO: 13480 - DNA, 85 bp, Homo sapiens
agtagctgtcttgacattttctagttcttttccagcctttttagtcattgtcagcaggaaagggacagaatcaggataaaatact

SEQ ID NO: 13481 - DNA, 83 bp, Homo sapiens
tgataccagaggcaaactttataaaaggaatgaaaagttctataaatactttttttttttgagacggagtttcactcttgtca

SEQ ID NO: 13482 - DNA, 107 bp, Homo sapiens
gcttagtattgtcttggctatatgtgctcttttttggttccatatgaaattaaaagtagttttttcttattctgtgaagatattcaatggtactagcaaaactaagc

SEQ ID NO: 13483 - DNA, 66 bp, Homo sapiens
ggcttcaactgaaagtcagtagctgcactaacccctaacaagagtgtcagtctgtcatttgaagct

SEQ ID NO: 13484 - DNA, 82 bp, Homo sapiens
gggagagggaggccagaagtctgactggtaagaactttttttttttttttttttttttgagacagactctccctctgtcccc

SEQ ID NO: 13485 - DNA, 71 bp, Homo sapiens
tgtgcatatatatatataaaatatacatatttatgtgtgtaaatatgtgtgcgtgtatatgtgtgtgtgta

SEQ ID NO: 13486 - DNA, 92 bp, Homo sapiens
ggcagctgggaaggagatgtagcaggaaggtttctggctggactcttttccaaagttgcactgtcaagctgtctctctgaaatcaagctgct

SEQ ID NO: 13487 - DNA, 88 bp, Homo sapiens
gccagcccgtgtgcctgtacttgagtcaagagcctcagcacatcaccggctgaagttaatttaagtgcagagcttttccaagctgtgc

SEQ ID NO: 13488 - DNA, 121 bp, Homo sapiens
atgtatatatatatatatatatgtgtgtatatatatatgtgtgtgtatatatatatatacgtgtatatatatatgtgtgtgtatatatatatatacacgtatatatatatatatatagatg

SEQ ID NO: 13489 - DNA, 116 bp, Homo sapiens
tatataacatatataatatatatacaaatatatataatatatatatatttgggtatatgtaatatatattatatatatttgtatatatattacacgtatatattgtatatgtatat

SEQ ID NO: 13490 - DNA, 114 bp, Homo sapiens
ttgtgtgtgtatgtaagcatgtgtgtataaatgtgaattatattatgtatttctatatattagctatatattaactgcatatattagcactgcaacatgaaatatacatagcag

SEQ ID NO: 13491 - DNA, 165 bp, Homo sapiens
gaagctgatgagacattatgagtagagaattcactgattatttatattttgttaggaatgggttcgcattactcatcacttccttttgcactaatcatagcatatggaatgtatttagtgcaagtaaaattgtaaattatattcatcatgatctagtcaagagga

SEQ ID NO: 13492 - DNA, 101 bp, Homo sapiens
aagtttctagggatggtattaatctctaccacctttccaagaatgtagtattaattttttatttacttttttggccaaggtagaatactttctagggcctt

SEQ ID NO: 13493 - DNA, 74 bp, Homo sapiens
gtaatagcctgtgatgatattttgtatttctgtggggtcaatggaaatgtcacttttgtcatttctggttttgc

SEQ ID NO: 13494 - DNA, 98 bp, Homo sapiens
ctcgaacatcagaccccaagttcttcagtctgggactctgactggctctcctggctcctcagcttcaagacagcctattgtgggaccttgtgattgtg

SEQ ID NO: 13495 - DNA, 95 bp, Homo sapiens; identical to SEQ ID NO: 68

SEQ ID NO: 13496 - DNA, 93 bp, Homo sapiens; identical to SEQ ID NO: 69

SEQ ID NO: 13497 - DNA, 115 bp, Homo sapiens
actagaatgatcaatgtgctaatttattaatatcggaactatctatataaatttatgtttaacttgatatagatacaaaaggatatgtatagaattatgtacagatattttgtgt

SEQ ID NO: 13498 - DNA, 171 bp, Homo sapiens
atatacatatatatacatatatatgtatatgtcatatacatatacatatatatacatatatatgtatatgtcatatacatatacatatatatacatatatatgtatatgtcatatacatatatatgcatatatatacatatatatgtatatgtcatatacatatatgacat

SEQ ID NO: 13499 - DNA, 142 bp, Homo sapiens
atatatgtatatgacatatacatatatatgtatatatatgcatatatatgtatatgacatatacatatatatgtatatatatgtatatgtatatgacatatacatatatatgtatatatatgtatatgtatatgacatatac

SEQ ID NO: 13500 - DNA, 111 bp, Homo sapiens
aatgatcaggtcctaaactctcctacccacattggatttttttagttttacattgaattttatcaaagtacatggctaaactgaaaggttgcctgggagagtccatgcatt

SEQ ID NO: 13501 - DNA, 89 bp, Homo sapiens
tacagggtgtgtttgtgtgtgtgtgtgtgtgtctgtatgtatacagtatatatatatgtgtgtgtatatatatgcaagttcagtatgtg

SEQ ID NO: 13502 - DNA, 112 bp, Homo sapiens
taggatcacttcttgttatttatgtcagtgagtatcagtttatttatttgtaaacagatgattgaaagacatatactccctgcctcaaaagatactgctttttgtgatactg

SEQ ID NO: 13503 - DNA, 72 bp, Homo sapiens
gtatatgtttatacgtatatatgtatatgtatatacgtatatgtatatacatgtatatgtatatatatatat

SEQ ID NO: 13504 - DNA, 96 bp, Homo sapiens
ttcaatgtatgctgcccacaagacaccctctttacttgtatggacacacacagactgaatgtaaagggatgaaacaaggcattccatgcaaatgga

SEQ ID NO: 13505 - DNA, 113 bp, Homo sapiens
atgatactgaggtggaaaaagaagaaattggggaagagaaatctgtttgtatatagacagtacagagagaacaccacacattttaacagtttctgacactatcacagtattat

SEQ ID NO: 13506 - DNA, 95 bp, Homo sapiens; identical to SEQ ID NO: 68

SEQ ID NO: 13507 - DNA, 93 bp, Homo sapiens; identical to SEQ ID NO: 69

SEQ ID NO: 13508 - DNA, 109 bp, Homo sapiens
catttggcatactcactaccacatatatgtattttttgatgaaagagtagaactttattcattatttattctaagaaacatttatgaaatacctagtatgtttcaggtg

SEQ ID NO: 13509 - DNA, 58 bp, Homo sapiens
tgaggcggagtctcgctctgtcacccaggctggagtgcagtggcgcgatcgcggctca

SEQ ID NO: 13510 - DNA, 83 bp, Homo sapiens
agcagtctttttgatatcaggccactctcacagtcactcataaaaagtgaaagccgtggagatggggctcatgaagagatgct

SEQ ID NO: 13511 - DNA, 98 bp, Homo sapiens
tggggcaggaagcagggataggaatggagtgggtggtggctggaaagtcacagactctcactgttattaccgacattagataatttgctatgcactta

SEQ ID NO: 13512 - DNA, 62 bp, Homo sapiens
gtcttccagctggagtgtgcagtggcaccatcacagctcactgcaatcttgactgcctgggc

SEQ ID NO: 13513 - DNA, 109 bp, Homo sapiens
gtagtttcatagcttgaggtcttggatttaagtctgtaatccattttcatttaatttttataaataatgggagataggggtcaagttttattcttctacatatggctac

SEQ ID NO: 13514 - DNA, 122 bp, Homo sapiens
ttttgttctttttgcttaggattttcttggctataccggctcttttttggttccatatgaaatttaaagtagttttttccagttctgtgaagaaagtcagtggtagcttgatgagaatagca

SEQ ID NO: 13515 - DNA, 110 bp, Homo sapiens
tgctgggcctacatctggttctactttagagttctgtgggaatttttatctttttagatcaatgaaaaaccatcaggaaaatccctatactagaccagaatgtgccttca

SEQ ID NO: 13516 - DNA, 107 bp, Homo sapiens
gggaggaatagtagtactaagcaatatgagaacatgagatctgtggttagatgtctttcattaattttataaagttcacagccattactgcttcaagtatttcttgc

SEQ ID NO: 13517 - DNA, 109 bp, Homo sapiens
tcttactgtctagctttgtgacatgattgttttggtggtgtgctttaattctttctttttttatttgtgtatctactggaacttttttctctgtggttactgtgaggct

SEQ ID NO: 13518 - DNA, 114 bp, Homo sapiens
tggttacattaaatatgttttaaaggtctcttttctctgaactgggtctaaatatgtttttcattcttaaatagttacaggaatagatgagcttttcctctgttttctttacca

SEQ ID NO: 13519 - DNA, 63 bp, Homo sapiens
ggttttgagatgataatgactctatctgtgaagtatctagtcatttagttcatttcaaatacc

SEQ ID NO: 13520 - DNA, 189 bp, Homo sapiens
actaactcattccaacatatgtatattcatatatatatgaatatatgtatgtatatatatatgtgtatatatatgaatatatgttggaatgtgttagtgcatatatatacacatatatatgaatatatgtgtatatatatgaatatatgtatataatgaatatatgtgtatatatatgaatatatatat

SEQ ID NO: 13521 - DNA, 72 bp, Homo sapiens
tacataacaaatatatatgtgtacatatatatacaaaaatggaaatatatgtgtgcataaaatatgtgtgta

SEQ ID NO: 13522 - DNA, 103 bp, Homo sapiens
ggatatccttgtatttttcctgatcccatgagtaaaagctttcagttttttacctttgagtgtgatgttagctgtgggttggttgtagatgccctgtatgtcc

SEQ ID NO: 13523 - DNA, 103 bp, Homo sapiens
tccagctgtgaagtgatgagccacttgacattattccacagctcactgattttttttttttttttttattgagatggagtttcactctgtcactcaggctgga

SEQ ID NO: 13524 - DNA, 115 bp, Homo sapiens
ctctcatcctttcttaaggctagaaaaggatgtggctgtggtatcattcagtaacagggtcagagaagagtgagacatcagacagttgggaactattagcggaaaaagatgagag

SEQ ID NO: 13525 - DNA, 101 bp, Homo sapiens
tggaagttctgtttgttctacatatttgccaacacttgatgtaaatctttttaattttagtcattctggtggatatttagtggtagctcattatgctttta

SEQ ID NO: 13526 - DNA, 112 bp, Homo sapiens
ggattttgcagaacacattggagggaagcaaaactatctgtagaagacaattgattaagatgtggtgttttaaagactgtgctttgaccctgtgcataagcagactaagtcc

SEQ ID NO: 13527 - DNA, 95 bp, Homo sapiens; identical to SEQ ID NO: 68

SEQ ID NO: 13528 - DNA, 93 bp, Homo sapiens; identical to SEQ ID NO: 69

SEQ ID NO: 13529 - DNA, 95 bp, Homo sapiens; identical to SEQ ID NO: 68

SEQ ID NO: 13530 - DNA, 93 bp, Homo sapiens; identical to SEQ ID NO: 69

SEQ ID NO: 13531 - DNA, 118 bp, Homo sapiens
ctttatatgtttatacatagatggaattgagaaccaattttaaatatataatagaagtattctatatatatatatatatgcttttcaatagttaatattttaagtgtaagagttaaag

SEQ ID NO: 13532 - DNA, 78 bp, Homo sapiens
tatatatatataagtgtatatatatatatatgtgtgtgtatacacacacacacacacatatacatatgtatatatgta

SEQ ID NO: 13533 - DNA, 94 bp, Homo sapiens
agcaagcatatatatatgtgtatgcatatatatatgtgtatatatatatacacacacaatatatgtatatatatacacacacatatgcctagtt

SEQ ID NO: 13534 - DNA, 95 bp, Homo sapiens; identical to SEQ ID NO: 68

SEQ ID NO: 13535 - DNA, 93 bp, Homo sapiens; identical to SEQ ID NO: 69

SEQ ID NO: 13536 - DNA, 116 bp, Homo sapiens
ggaagttccttgatattttcagtttactgaaagtttttaacagagattggtgttgattttttaaaaattatttttctttgttaaaaacaaccttgtgttactgagataagacttcc

SEQ ID NO: 13537 - DNA, 83 bp, Homo sapiens
gatactttctcttattttagcaaacattttgcaaatttgtatttgtatttgtaaaatatttgctaaaatatagtattggtatt

SEQ ID NO: 13538 - DNA, 108 bp, Homo sapiens
ggatttagtgaactgtgtatgcttagtattggagtggtatataattaattttcatattgttttatttctgttaagctttgtcaatattaagtgaatatccactgagct

SEQ ID NO: 13539 - DNA, 111 bp, Homo sapiens
caagaaagttgtgtgtaaccttagcaagcactgttttggtagattgatttgagaaagatcagactgagctgaagaagaagtgaaagaaaaagtggagacagcaattttagg

SEQ ID NO: 13540 - DNA, 118 bp, Homo sapiens
cagccaaaatgaaattacgtataaaaccaaggatttagagaatatctacaacatgcctaggtctgtctgtgtctgtgttacatgtttggaattccgtggtggtcatagttctactggc

SEQ ID NO: 13541 - DNA, 110 bp, Homo sapiens
tatggttattaatattgtgtcatttattgatgtgtctgatgtattttgttttttcttttaaaaaagtacatttttggcaagttttagagctccagtattttctggctgta

SEQ ID NO: 13542 - DNA, 81 bp, Homo sapiens
tatatatatatatatatatagtgtgcgtgtatatatagtgtgtatatatgtatatatacacacatgtacacatacacacac

SEQ ID NO: 13543 - DNA, 166 bp, Homo sapiens
gtttgtgtattatgtgtgtatattttataaatttataatacagaatgtataatatgtcacatatgtttacatagatttgtatatgtacatgtgtattttatgtacatgtacatatgatatatatatgtattttatgtacatgcacatatgatatgtacatacatac

SEQ ID NO: 13544 - DNA, 74 bp, Homo sapiens
tgtaattccatatatattttaatattttttatatttctgtgaaggatattattggtattttgatggagattgca

SEQ ID NO: 13545 - DNA, 72 bp, Homo sapiens
ggcacatgactgtatatgtatttatgtttgtatttgtgtgcatgcatgtgtgtatatatgtttatatgtgtc

SEQ ID NO: 13546 - DNA, 95 bp, Homo sapiens; identical to SEQ ID NO: 68

SEQ ID NO: 13547 - DNA, 93 bp, Homo sapiens; identical to SEQ ID NO: 69

SEQ ID NO: 13548 - DNA, 111 bp, Homo sapiens
agtgtgagccaatgtgctcagcttccatttggacatattttctaatagccatatcatttatataagtttatatatcagatggaatcttcctattttcatattggtaccact

SEQ ID NO: 13549 - DNA, 76 bp, Homo sapiens
atatgtatatgtgtatatatatatgtggatgtgtatatatatacacacacacacgtatatgtatacatatatatat

SEQ ID NO: 13550 - DNA, 111 bp, Homo sapiens
tatatatttatgtatatacacacacctattttatatatttatatatgagattttttacatttatatatatttatatgtgtgtgtgtgtgcatctgtgtgtgtattgtatga

SEQ ID NO: 13551 - DNA, 102 bp, Homo sapiens
gtgaataagtgtatgtaatgtgtatatatatgtatgtatatgcatgtatatgtgtgtatatatgtatatatgtatacacatacatatataatttttttttgc

SEQ ID NO: 13552 - DNA, 78 bp, Homo sapiens
tatacataaacacacacatatatatgtatgtatatatatatatatacatacatgtgtgcctgtgtgtgtgtatgtgta

SEQ ID NO: 13553 - DNA, 118 bp, Homo sapiens
tgcagtcatgtttttatgtcagttactgcttctggggagccacacataagataactttattttttaaattacgggttgacttcacacagaatttgttaagatatgggaaaaaaatgca

SEQ ID NO: 13554 - DNA, 106 bp, Homo sapiens
ctagactctatagatatgaagtttcctgataatgttagctagtaacatgtattgattaaaaagagtaatgacgatttttatcaggtaaagtctatttattaactag

SEQ ID NO: 13555 - DNA, 74 bp, Homo sapiens
tatatacatatatatgcacacatatacatatatatctaagaatatatgtatatgtgtatatgtgtgtgtatata

SEQ ID NO: 13556 - DNA, 112 bp, Homo sapiens
ggatatgtatatacacacacatatatatacacacacatatacatatatatgtgtatatataatatagatacacacatatacatatgtatgtgtatatataatatagatacac

SEQ ID NO: 13557 - DNA, 118 bp, Homo sapiens
ctggatctcttccttcagcttcttcaagccctgggtcaggtatatgtgcaactccatgtgaagagtacctgtttccccattaagtttggaggcagtgggagacagacaaatgcttcag

SEQ ID NO: 13558 - DNA, 78 bp, Homo sapiens
catatacacatatataaaatgtatatatatgtaatgtgtatatatgcatatatatacatacatatgtgtgtgtgtgtg

SEQ ID NO: 13559 - DNA, 64 bp, Homo sapiens
acacatatgtatgtatatatatgcatatatacacattacatatatatacattttatatatgtgt

SEQ ID NO: 13560 - DNA, 91 bp, Homo sapiens
gcatttgtgagatatatatatgtgtgtatatatatatgtatatgtatatatatgtatatgtatatatgtgtgtgtgtgtgtgtgtgtgtat

SEQ ID NO: 13561 - DNA, 70 bp, Homo sapiens
acgtacatgtatatatgtgtatatgtgtatagatgtatatgtatatatgtatatgtgtatagatgtatgt

SEQ ID NO: 13562 - DNA, 136 bp, Homo sapiens
tatatacatatatgtatgtgtatatacatatatgtgtatatacatatgtgtgtatatacatatatgtatatatgtgtatatacatatgtgtgtatatacatatatgtatatgtgtgtatatacatatatgtatatg

SEQ ID NO: 13563 - DNA, 129 bp, Homo sapiens
tgtaatacacacactccttatatacgtatataaggaatatatgtgtatacatatatacttatatatatgtgtgtatatatatacttatatatgtgtatatatatgtgtgtatatatataagtatataca

SEQ ID NO: 13564 - DNA, 73 bp, Homo sapiens
atgtatacatgtttgtgagtgtatgtgcatatacacacacctatcatatgtgtatatatatatatgtgtacat

SEQ ID NO: 13565 - DNA, 86 bp, Homo sapiens
tgagtgagagagaggggttaagatagatacataatggagatctctctctctgtatatatatatctctaaaccttccctccccgcca

SEQ ID NO: 13566 - DNA, 83 bp, Homo sapiens
attgcaatcatatctcaggctgctttgtgtccatctctactttttttttgctggacagattgcggatggagaggagagacgat

SEQ ID NO: 13567 - DNA, 108 bp, Homo sapiens
ctatatatagatatatcctatatatagatatatatatctgagatatatttctatatatatctatatatagtatatccatatatagtatatctatatatagatatatat

SEQ ID NO: 13568 - DNA, 89 bp, Homo sapiens
gttttatgtgtacaaccataaatcatgtaagaattgttcaaattggcagctccataatttatattttttttagttgtaacacatggaat

SEQ ID NO: 13569 - DNA, 123 bp, Homo sapiens
gtatgcatatatgcatatatacacacatatatgtatatatgtttatgtgtatgtgtttatatgtgtatacatatatatgtatacgtatatgtttatgtgtatacatatatgtatacacacatg

SEQ ID NO: 13570 - DNA, 88 bp, Homo sapiens
ttgggttaagggtttttaatgccttcagtaacaagttattttgtagatgtgaatgttgtcattaggtattaaattactttggctacaa

SEQ ID NO: 13571 - DNA, 58 bp, Homo sapiens
gagactgagtctctctctgtcacccaggctggagtgcagtggcgtgatctcagctctc

SEQ ID NO: 13572 - DNA, 92 bp, Homo sapiens
ttcacaatgccatgtctatgtgtaatacataacatattatatatctatattcatatagacatgtatgtacatgtgagacatatatatgtgag

SEQ ID NO: 13573 - DNA, 96 bp, Homo sapiens
cagggtggggaacatttgttttctagatgaaatgttgtctatagtaattctaattattaatgtaatttttttctagtaaaaatgtttacttttctg

SEQ ID NO: 13574 - DNA, 111 bp, Homo sapiens
ggtaatatgttcactatttggatgatgggttcagttgaagctggctaagtttttaaatttttagagatggaatcttcttacgttgcccaggctggtctcaagctccttgcc

SEQ ID NO: 13575 - DNA, 78 bp, Homo sapiens
ataaaatataatttgtcattttggaaattcttaaactgatattaattttttttctgaaaatgacaacttgtattttat

SEQ ID NO: 13576 - DNA, 58 bp, Homo sapiens
tgagacagtgtctcactctgtcatccaagctggagtggagtggtgtgatcttgtctca

SEQ ID NO: 13577 - DNA, 98 bp, Homo sapiens
gtgtgtttgttctcattggtttcaaagaagttatttatttatagatgctaattttcttctattgaaaccaatacctaatccttgatgttcacttacat

SEQ ID NO: 13578 - DNA, 93 bp, Homo sapiens
cacatgcatatgaaataatagttaactttaaccttcaagtctctatttattttacattttaaaaggaaaagagagggatagttggtgcatgtg

SEQ ID NO: 13579 - DNA, 93 bp, Homo sapiens
cctcattgatacaggattctctaaatctaggcttgtcatgagtctcacaaagactctgagtttgacattgcgagaatattggaactgtatggg

SEQ ID NO: 13580 - DNA, 115 bp, Homo sapiens
tgggtactagctcagtccacaaacttaggggtgaatgaaagtgaattttatttttctattgaactgtattttgttataagccctcattccatgagaattgcagaaactttaccta

SEQ ID NO: 13581 - DNA, 118 bp, Homo sapiens
ttgattccatgtctttgctattgtaaataatgccacaaggaacattcacatgcatgtttgtggtagaatgatgtatatttctctgggtaaatgcgtagtaatgggattgctgggtcaa

SEQ ID NO: 13582 - DNA, 89 bp, Homo sapiens
cggttgaatttctaaatattttattttagtgctgctttaaatgggaattttcttagcttcatttaaaatttatatttgatttttgactg

SEQ ID NO: 13583 - DNA, 105 bp, Homo sapiens
attatgattagagtatgtcacagtttctctgggtctctgtttccctgtgataaaagttgcaaacacatcttattcagaatattgtgagaaagtgcttagcatgat

SEQ ID NO: 13584 - DNA, 100 bp, Homo sapiens
taggtggattcaaagattatctgatcggaaattggttgaaaagttttatcctgcagatgaagcccccaagtagccagcttcagagctcttatcagactta

SEQ ID NO: 13585 - DNA, 76 bp, Homo sapiens
acctatatatatatatatatacctcaaaacctatatatatgtatatatgtgtgtgtatgtatatatatgtgtgtgt

SEQ ID NO: 13586 - DNA, 112 bp, Homo sapiens
gtggatgacataatttaattggttggttatgaacatgctgtatgctgggaagtgagtgattatttcattttctagtaaacatacgggtaaataaccccaaatagtgtttcac

SEQ ID NO: 13587 - DNA, 109 bp, Homo sapiens
tgcttgggatgttgatgacttctttacctgttaaaaagttatgctagtagtttgggctctttaatttttctttagaatggagttatattcatctgaatctgtgtcagca

SEQ ID NO: 13588 - DNA, 99 bp, Homo sapiens
gtgtactttttcacatatgctctaaaatgtataaatgtttcttttttgcaagaatgtagaaaagatattaaatagcatagattgtgaaaaagtagttac

SEQ ID NO: 13589 - DNA, 82 bp, Homo sapiens
gaggacagatgtctctgtgtgatatcgtgtcctgtatgacagtactaccaggatgctataacaggacagacaccttgttttc

SEQ ID NO: 13590 - DNA, 58 bp, Homo sapiens
tgagacagagtctcactctgtcacccaggttggagtgcagtggtgtgatctcggctca

SEQ ID NO: 13591 - DNA, 108 bp, Homo sapiens
agtatttctaatgacccaacactgtatactatactctttttatttttaaagacaaagataatacaggcagaaatgtaaggaagtgtcattgttattagatgaaatact

SEQ ID NO: 13592 - DNA, 113 bp, Homo sapiens
gatcttatactagagatatagttggaatagcaacttatatttattatataatataatttatttcaaatatgagttgctattccaactacaactctaatatagtatattagatc

SEQ ID NO: 13593 - DNA, 114 bp, Homo sapiens
agataaaaggggaaaattgtatagttttaagagtgcaatagttggtgactcatttcttcatatttattaatgcattcataaattaaaataggctggtcacagtggctcacatct

SEQ ID NO: 13594 - DNA, 95 bp, Homo sapiens; identical to SEQ ID NO: 68

SEQ ID NO: 13595 - DNA, 93 bp, Homo sapiens; identical to SEQ ID NO: 69

SEQ ID NO: 13596 - DNA, 127 bp, Homo sapiens
gtatatatatgtatatatatatgtatatatatgtatatacgtgtatatatgtatatatatgtatatatgtgtatatgtgtatatgtgtatatatgtgtatatatgcatatatatgtgtatgtatata

SEQ ID NO: 13597 - DNA, 95 bp, Homo sapiens; identical to SEQ ID NO: 68

SEQ ID NO: 13598 - DNA, 93 bp, Homo sapiens; identical to SEQ ID NO: 69

SEQ ID NO: 13599 - DNA, 91 bp, Homo sapiens
tttatatatgtatatgtgtgtatatatgtatatatagatgtgtgagtaatatatatgtatatatgtggaatgtgtttgtatgtatatatac

SEQ ID NO: 13600 - DNA, 67 bp, Homo sapiens
tatatatgtatgtatatatatgtgtgtatttatatatacacatatatttcaaaggcatatatatata

SEQ ID NO: 13601 - DNA, 85 bp, Homo sapiens
gcagtagaactactggataataaggtagtttgatttttaatttttttgagaatcctccatattgtttttcatagtagctgtactc

SEQ ID NO: 13602 - DNA, 115 bp, Homo sapiens
ttgtatcctcttctggggaaagagttagtgcatttttggttgtacgtaggatagttaaattatgttaggtggaagtatgaccttgctattgtctttatttgaagatgaggtatgg

SEQ ID NO: 13603 - DNA, 106 bp, Homo sapiens
caggctctaaaatatgttttctgtactgttgctcactaaataaggtaagtatcattttattttcctttttaatagcaacctacaggtgacatcttcagttttcctg

SEQ ID NO: 13604 - DNA, 98 bp, Homo sapiens
ttttcttccaagtgatcagtgggagggaaagagttcagctaatcatttatgtggcaaaaacttttgagattttgtacttctcctgtcatggataaaaa

SEQ ID NO: 13605 - DNA, 118 bp, Homo sapiens
ttatatataatatatattacatataggtacattgtatattagttataatacattacatataactatgttaatatatattgtaccatacatgtagttgtacataatattttatatataa

SEQ ID NO: 13606 - DNA, 115 bp, Homo sapiens
aaaggtggccagaggtaattgggaaagaacagtagtgctatttatgttagaagaagattgtttggaaatggtatgaatagaataactacaaacatcagtgctaaagttcactttt

SEQ ID NO: 13607 - DNA, 95 bp, Homo sapiens
ttgtcatgttgcagcctgggattctcaggggtttctctctctctttttttttttttgagatggggtctcactctgtcacccaggctggagtgcag

SEQ ID NO: 13608 - DNA, 78 bp, Homo sapiens
acatgagggccagcctagaactgtgaggttaagttgtttggataggaaggctacaggttgtgggcctggttcctgtgt

SEQ ID NO: 13609 - DNA, 117 bp, Homo sapiens
aatggaagtaatcaatattgaagaaattataggaaaatggttgaagaaaattttcttttttaatgaaagttttcattatactagattaaattgatgatgatgatgataactgacatt

SEQ ID NO: 13610 - DNA, 117 bp, Homo sapiens
agagggccagaatagaacaaaaagctagaggaaggtataattcactctctgcctgagtgtttgaactgggccactgatcttctcctcccctctgtgctcctgattctcaggcctttt

SEQ ID NO: 13611 - DNA, 88 bp, Homo sapiens
gttatagttgaagttgaggggaatctagaaagggtagcacaggaggaagattatgcatatcatttgtggccctgagaccagctgaagc

SEQ ID NO: 13612 - DNA, 94 bp, Homo sapiens
gcaggttgtttgtttgtttgttttgaaacagagtctcgctctgtcacccaggctggagtgcagtgacgctgtctcagctcactacaacctctgc

SEQ ID NO: 13613 - DNA, 117 bp, Homo sapiens
acgtgtatatgtatacacatatatgtaaacacatatattatgtatattatgtatatacatatatgtatatatacacatgtatattatgtgtatacatatatgtatatatacacatgt

SEQ ID NO: 13614 - DNA, 76 bp, Homo sapiens
tatatacatataggtatatatacatatatgtatatacatatatacctatatgtgtatatatgcgtatatgtatata

SEQ ID NO: 13615 - DNA, 82 bp, Homo sapiens
acgtgtgtgtgtgtgtgtacatatatatgtgtatatatgtacatatatgtgtatatatatgtgtgtgtatatatatatatgt

SEQ ID NO: 13616 - DNA, 85 bp, Homo sapiens
gggttcaaggggacccagcttcttaattacaagatgggttagaattctggccctgtcactctgagacaatgggcagtttgtgcct

SEQ ID NO: 13617 - DNA, 170 bp, Homo sapiens
aaatgcctatatgtatatatgtatttatatacatatatgtgtatttatacatgagtatatatgtatataggtatttatatacatatatgtgtgtatttacacatatgagtatatatgtatatatgtatttatatacatatatgtgtatttatgcatatgagcatatatat

SEQ ID NO: 13618 - DNA, 112 bp, Homo sapiens
gtatgataaggccagggaatcaagagaggatgctattattttgttttattatttattaattttttttttttttgagacggagtttccactcttgttgcccgggctggagtgc

SEQ ID NO: 13619 - DNA, 95 bp, Homo sapiens; identical to SEQ ID NO: 580

SEQ ID NO: 13620 - DNA, 93 bp, Homo sapiens; identical to SEQ ID NO: 69

SEQ ID NO: 13621 - DNA, 115 bp, Homo sapiens
tatatatatatatatatgtgtgtgtatgtgtgtgtgtgtgtgtgtgtgtatatatatatatatatatatacacacacacacacacactttttatatatatatatatatatatata

SEQ ID NO: 13622 - DNA, 107 bp, Homo sapiens
agagggaagggactgtgattaggatagatggatggaaaaattatattttttaaacctagctatggttataagggtatttggtttattttatatagtcttctatatct

SEQ ID NO: 13623 - DNA, 110 bp, Homo sapiens
tcacagtaaaaggtaatctctcgtggttcttgagtatttcttattgtgtttagtgcaataccataaaccttgaattacaccatgagacccattcaaagtgcctctagtga

SEQ ID NO: 13624 - DNA, 117 bp, Homo sapiens
gccccaccattttatttttttttttatcacagttacaaacccctgacatgtatttatgtatttgtttagcgtttgtttccaccccactagactgtgagctcagaggttaaggtaggc

SEQ ID NO: 13625 - DNA, 88 bp, Homo sapiens
cttcttccaatagaaggctattttgtctacattgaaaatctcttttttttttttgagatggagtttcgttctgtcacccaggctgaag

SEQ ID NO: 13626 - DNA, 116 bp, Homo sapiens
gttccttgtagatactggatattagtcttttgtcagatgtatagattgtgaagattttctctcactctgtgtcttgtctgttaaatctgctaattgtttcttttgctgtgcagaac

SEQ ID NO: 13627 - DNA, 95 bp, Homo sapiens; identical to SEQ ID NO: 68

SEQ ID NO: 13628 - DNA, 93 bp, Homo sapiens; identical to SEQ ID NO: 69

SEQ ID NO: 13629 - DNA, 117 bp, Homo sapiens
atggaggtgattttgagtttgctttgctcttttattgttgaaatttttattttgaaaaaaaatttcaagcctgaaagagttccaaaggagcaaaaggaatctgtacatattcttcat

SEQ ID NO: 13630 - DNA, 58 bp, Homo sapiens; identical to SEQ ID NO: 454

SEQ ID NO: 13631 - DNA, 118 bp, Homo sapiens
ctggacaggatgaagaagcttttgggagaaatatttctctagccatctatatatttatttgtgaacaagagatcctagagaaatacagcttacataagctacgttacccaaactacag

SEQ ID NO: 13632 - DNA, 71 bp, Homo sapiens
taggtatggctatgtagatgtttcaatagtatttacaggaatgaatctatatatctatatatctatatcta

SEQ ID NO: 13633 - DNA, 68 bp, Homo sapiens
agtgctatgcagctgacattttcatgttctgacttgatagaactggattattcagttgctgcttcact

SEQ ID NO: 13634 - DNA, 58 bp, Homo sapiens; identical to SEQ ID NO: 87

SEQ ID NO: 13635 - DNA, 56 bp, Homo sapiens; identical to SEQ ID NO: 88

SEQ ID NO: 13636 - DNA, 73 bp, Homo sapiens
tttcctttttgagacgaagtctcactctgtcacccaggctggagtgcagtggtgcaatctcggctcacggaaa

SEQ ID NO: 13637 - DNA, 114 bp, Homo sapiens
taagacaaacacgtttgcataaaattctgcatctgttgagagaacagtgtcagctgtctgaaaagatgttcctcaaatattgatagtagttattgctgggtagtgttactttta

SEQ ID NO: 13638 - DNA, 106 bp, Homo sapiens
gacctacttcagtgactgtgactgtgctgcctggtgacatgctgcctctctctgttacagtctgtccacgcgggttccacctccttgcaccctcctgtctcatgtt

SEQ ID NO: 13639 - DNA, 58 bp, Homo sapiens
tgagacagggtctctgtctgtcacccaggctggagtgcagtggcgtgatcccggctca

SEQ ID NO: 13640 - DNA, 104 bp, Homo sapiens
caataagttattttgtttggaagaggctttacctgtaatttttacttttatttctgatggaagagaattccaggtttttttgagatggagtttcactcttgttg

SEQ ID NO: 13641 - DNA, 78 bp, Homo sapiens
cggtgttttttttattttttgagacacagtctcgctgtcacccgggctggagtgcagtggcgtgatctcggctcactg

SEQ ID NO: 13642 - DNA, 58 bp, Homo sapiens
tgagacagagtctcgcactgtcaccctggctggagtacagtggcgcgatcttgcctca

SEQ ID NO: 13643 - DNA, 64 bp, Homo sapiens
gggagctgagatcgcgccactgcaccccagcctgggtgatgcagtgagactctttctctctctc

SEQ ID NO: 13644 - DNA, 112 bp, Homo sapiens
actctagcctgggtgacagtaagactccatgtcaataaaaaataaataaataataacagaaatcttttttttttttgagatgggagtctcactctgtcacccagactagagt

SEQ ID NO: 13645 - DNA, 88 bp, Homo sapiens
ccaaggcctgggaatatgatgacaacagtgcattcattcatttatgtatttattttgagacagagtctcactgtgtcacccaggctgg

SEQ ID NO: 13646 - DNA, 93 bp, Homo sapiens; identical to SEQ ID NO: 69

SEQ ID NO: 13647 - DNA, 97 bp, Homo sapiens
gccctgtacgtgtgatgtccccagctgtctctctgtttctccaagtgccaaccacttcacagattcaggcgtcctcaagtggagaaaaccattgggc

SEQ ID NO: 13648 - DNA, 58 bp, Homo sapiens; identical to SEQ ID NO: 9124

SEQ ID NO: 13649 - DNA, 95 bp, Homo sapiens; identical to SEQ ID NO: 68

SEQ ID NO: 13650 - DNA, 93 bp, Homo sapiens; identical to SEQ ID NO: 69

SEQ ID NO: 13651 - DNA, 116 bp, Homo sapiens
aaaactgatatgagcaatcatatacagggttttctgtggatataatttttatttttctgggataaatatccaggagtacaactgcttggtcatatggtagttgcatgtttagtttt

SEQ ID NO: 13652 - DNA, 74 bp, Homo sapiens
tagagtctggctcttttttagatttttatttatttatttatttatttatttatttgagatggagtctcgctctg

SEQ ID NO: 13653 - DNA, 95 bp, Homo sapiens; identical to SEQ ID NO: 580

SEQ ID NO: 13654 - DNA, 93 bp, Homo sapiens; identical to SEQ ID NO: 69

SEQ ID NO: 13655 - DNA, 118 bp, Homo sapiens
gattgtatatacagtgtgtgtgtatgtatatataaaataagtattaaatgtaaatatataaatatataatatatattaaatatataggcatatataaactatataggtatatatagtt

SEQ ID NO: 13656 - DNA, 91 bp, Homo sapiens
gcatggtctgtgtggcaggtgcatatgatgtgtgtgtagagtgtgtgtacacatgtgtggtatatggtatatgtatgtgtatggtctgtgt

SEQ ID NO: 13657 - DNA, 131 bp, Homo sapiens
agggaaatcctagcaggaattagagggcaggggaaagaaagaagtggtagtattccagcccctctgtctctctgtttggggatgtctctggcagtgtccacatttcccctgtggtcacaccaggcctccag

SEQ ID NO: 13658 - DNA, 110 bp, Homo sapiens
catttaacatctcatgtcaagtctggcaatggcaatgatgaccatatgcattctttttttttttttttttaaacagggtctcagtctgtcacccaggctggagtacagtg

SEQ ID NO: 13659 - DNA, 95 bp, Homo sapiens; identical to SEQ ID NO: 68

SEQ ID NO: 13660 - DNA, 93 bp, Homo sapiens; identical to SEQ ID NO: 69

SEQ ID NO: 13661 - DNA, 105 bp, Homo sapiens
tggtgccatgtgtgctctgtaagcatgtgcataagttttgataaattgtaactttttataatagatttgtgatattttatggtaatagtaacacagactagtatc

SEQ ID NO: 13662 - DNA, 110 bp, Homo sapiens
ctctgaagagcatagaagtcagggttacagtgataactaatatttttatttatttatttatttatttatgagaaatggtcttactctgtcacccaggctggtgtgtaggg

SEQ ID NO: 13663 - DNA, 95 bp, Homo sapiens; identical to SEQ ID NO: 68

SEQ ID NO: 13664 - DNA, 93 bp, Homo sapiens; identical to SEQ ID NO: 69

SEQ ID NO: 13665 - DNA, 95 bp, Homo sapiens; identical to SEQ ID NO: 68

SEQ ID NO: 13666 - DNA, 93 bp, Homo sapiens; identical to SEQ ID NO: 69

SEQ ID NO: 13667 - DNA, 103 bp, Homo sapiens
gttcatgtcagtgaagaaaagacatgttttgggagtgaaggatatttgtggatttgtatagatgtgatcatcagggctgtgttgttttgaagtaatataggac

SEQ ID NO: 13668 - DNA, 64 bp, Homo sapiens
tatatgtgtctacatacacatacgcgttttttgtgttttgtgtgtgtgtgtgtgtgtgtgtgtg

SEQ ID NO: 13669 - DNA, 93 bp, Homo sapiens
agtgactgggtaaaggtaaggggttgtgaagactgagattctttttttttttttttttttttttttaaacactcttgctctgtcacccaggct

SEQ ID NO: 13670 - DNA, 58 bp, Homo sapiens
tgagacggagtctcactctgtcaccctggctggagtgcagtggcgtgatcttggctca

SEQ ID NO: 13671 - DNA, 133 bp, Homo sapiens
gacacttcatatttaaatctgagggccacagtttgtagagaaggataaagtcagtaggcatttatttttgttttcattatatgccttcctcttcagtgtcctttaggtgaatgatggttggctccgtgtaaga

SEQ ID NO: 13672 - DNA, 88 bp, Homo sapiens
tgtatacaatacatatatattgtgtatatatacgtattgtatatatatgcatacaatacatatatatagtatatatgtattgtatata

SEQ ID NO: 13673 - DNA, 101 bp, Homo sapiens
acccacctgccaaaaatttccgagttctgtccccctctcagtacctcagaaggtgaccttatttgggagataggtgactcgggagataagggattatgggt

SEQ ID NO: 13674 - DNA, 83 bp, Homo sapiens
cctgcacacatacacacacactgatttgcatgaaagatactggaagaattcatatcaaatcagagtggtggttgctgtgttgg

SEQ ID NO: 13675 - DNA, 95 bp, Homo sapiens; identical to SEQ ID NO: 68

SEQ ID NO: 13676 - DNA, 93 bp, Homo sapiens; identical to SEQ ID NO: 69

SEQ ID NO: 13677 - DNA, 77 bp, Homo sapiens
tcttcatatgtattcatatatacgtgtgtgtgtgtgtgcgcgcgtgtgtgtagagagagagagagtagagagagaga

SEQ ID NO: 13678 - DNA, 94 bp, Homo sapiens
accagttattgataaagagttgtttcctcattgcttatttttgtcaactttgtcaaagatagatggcaataggtgtgcatcattatttctgagt

SEQ ID NO: 13679 - DNA, 111 bp, Homo sapiens
atgtgtgtgtgtgtgtatatatatacgtatatatgtatgtatatatatacgtatatatgtatgtatatatatacatacacatatatatgtgtatatatatgtgtgtatata

SEQ ID NO: 13680 - DNA, 56 bp, Homo sapiens
gagacagggtctcactctgtcacccaggctggagtacagtggtcagaccatagctc

SEQ ID NO: 13681 - DNA, 104 bp, Homo sapiens
tgtattatacatgatataaagataaacatgcatcttatatatatctctcatatataggtatgtatatgtatatatatgtatgtgtatatatatgtatgtctaca

SEQ ID NO: 13682 - DNA, 95 bp, Homo sapiens; identical to SEQ ID NO: 68

SEQ ID NO: 13683 - DNA, 93 bp, Homo sapiens; identical to SEQ ID NO: 69

SEQ ID NO: 13684 - DNA, 94 bp, Homo sapiens
gtcttgggagggtgtatgtggccaggaatttattcatttattctagattttctagtttatttgcatagaggtggttatagtattctctgatgat

SEQ ID NO: 13685 - DNA, 118 bp, Homo sapiens
gtatgtgtatatacatatatattcatatatgtgtgtatgcataaatatatatgtgtgtatacatatatattcatatgtgtgtatacatatatattcatatgtgtgtatacatatatat

SEQ ID NO: 13686 - DNA, 95 bp, Homo sapiens; identical to SEQ ID NO: 68

SEQ ID NO: 13687 - DNA, 93 bp, Homo sapiens; identical to SEQ ID NO: 69

SEQ ID NO: 13688 - DNA, 119 bp, Homo sapiens
gcctctgttcacatcttcatcaattaatcaatatataaccttgctttttgtatttttctattcaaaaacgctttatttttatatattgttgattgtttcgttagcattgaactgacagc

SEQ ID NO: 13689 - DNA, 103 bp, Homo sapiens
gaggtggagaaaggcgtatcagattctccaacgaaaaagaaactttataggttgaaaacttttaaatgcttccaatgaagatctgatcagcatgtttccctac

SEQ ID NO: 13690 - DNA, 103 bp, Homo sapiens
ctggttagaatgcaaaataatatgaaagacttttgatcctctagtaatatacaagtgtatatatattttttgagacagggtcttgctttgttgtctaaactgg

SEQ ID NO: 13691 - DNA, 62 bp, Homo sapiens
ttgatgtctttataagaagagagagggacaccagagctctctctctttctgtgagtgcacag

SEQ ID NO: 13692 - DNA, 88 bp, Homo sapiens
gtatagaattaatattagaatatacatgaagtataaaattaacactgttgacatttatatatgtatatatctgagattataaatgtgc

SEQ ID NO: 13693 - DNA, 58 bp, Homo sapiens
tgagacagactctcgctctgtcacccaggctggagtgcagtagtgcgatctcggctca

SEQ ID NO: 13694 - DNA, 102 bp, Homo sapiens
actctgacaagccgtgtcttaatgaaaggcagtgtggatagctgttgaggatgtggattttgcccagttttaaagcccaggcctgacacttcttatcttagt

SEQ ID NO: 13695 - DNA, 59 bp, Homo sapiens
tgtggtatttgaatgtgtgtgtgtatatatatatatatacacacacacagatacacaca

SEQ ID NO: 13696 - DNA, 61 bp, Homo sapiens
catacatacatatatacatgtgtgtatatatatatatagtacgtgtgtgtgtgtgtgtgtg

SEQ ID NO: 13697 - DNA, 145 bp, Homo sapiens
gcatattatatatatacacaaatgtgtttaaacatagtatatatacacatatgtgtatatatatcaatgtgtaatatatgtatacttgtatatatcatttatatatgctgtatctcacatattgcatataataaatatgcacgta

SEQ ID NO: 13698 - DNA, 95 bp, Homo sapiens; identical to SEQ ID NO: 68

SEQ ID NO: 13699 - DNA, 93 bp, Homo sapiens; identical to SEQ ID NO: 69

SEQ ID NO: 13700 - DNA, 95 bp, Homo sapiens; identical to SEQ ID NO: 68

SEQ ID NO: 13701 - DNA, 93 bp, Homo sapiens; identical to SEQ ID NO: 69

SEQ ID NO: 13702 - DNA, 70 bp, Homo sapiens
tgagacagggtctcattctgtcaccaaggccggagcttaatagtgtgatctcagtgatcttcctgtctca

SEQ ID NO: 13703 - DNA, 101 bp, Homo sapiens
tgttcatatatatgtatatgtgtgtatatatatatgtgtgtatgtatacatatatatgtgtatgtatacatatatgtgtatgtatacatatatatgtgtat

SEQ ID NO: 13704 - DNA, 85 bp, Homo sapiens
acacatatatgtatatatatatgtgtgtgtatacatacacatatatatatgtgtgtatacacacacacatatatataatgtgtgt

SEQ ID NO: 13705 - DNA, 79 bp, Homo sapiens
ttcagtgagtattcacatagataaaagatttattttctaactttgagggtgagagaatccttcttttatttatactgag

SEQ ID NO: 13706 - DNA, 105 bp, Homo sapiens
gggttgtttgaatttgaaatctatgaagagtaatgaataagtacttattttttctgtatttattttagtatttaattactctaatactctgcattctgatagtcc

SEQ ID NO: 13707 - DNA, 89 bp, Homo sapiens
tccaacactgactttgggctggtgacttactctctctgtcccacaactgtgaaagaagatgattatggggctaagctgacagggttgga

SEQ ID NO: 13708 - DNA, 68 bp, Homo sapiens
ctataacacagaaaaggtaactgagtgactcactgagggtcactgagctagtactatgtgacagatag

SEQ ID NO: 13709 - DNA, 107 bp, Homo sapiens
gatttcattgggtgagggttggggggctttatctgcataaaaatgtcaatctttgtttttatgtagttctgcccctcaccttgtccatctagcttccaaatagaatc

SEQ ID NO: 13710 - DNA, 77 bp, Homo sapiens
ctttgatattgattgaaattgcattgaatctattttcatttttaaagtagagatagtgcaatttttaaagttcagag

SEQ ID NO: 13711 - DNA, 110 bp, Homo sapiens
agctttgttctttttacttaggattgtcttggctatatgggctcattttcagttccatatgaaatttaaagtagttttttccaattctgtgaagaaagtgaatggtagct

SEQ ID NO: 13712 - DNA, 109 bp, Homo sapiens
acacgtttagaccacttttatgtattgtcttaccatatatatataaataaacatatatatgttttatatatatatggtaagacattatataatatatattatatatggt

SEQ ID NO: 13713 - DNA, 88 bp, Homo sapiens
aggcagaacttgttcaggagggcagatattgtaaaattttaaattttaatttaaaattttaagagatttgaatgggaaagttttgttt

SEQ ID NO: 13714 - DNA, 56 bp, Homo sapiens; identical to SEQ ID NO: 6618

SEQ ID NO: 13715 - DNA, 78 bp, Homo sapiens
gagcctattgagaggtgacagtgtgcaggcagtcctcagagccctcgcttgctctctgcacctcctctgcctgggctc

SEQ ID NO: 13716 - DNA, 82 bp, Homo sapiens
gtcatctgttgtgactcagcatcatcatctgctgaaaccgtaagatgacatatgctgaaacattcaagtcacaatctgtgac

SEQ ID NO: 13717 - DNA, 95 bp, Homo sapiens; identical to SEQ ID NO: 68

SEQ ID NO: 13718 - DNA, 93 bp, Homo sapiens; identical to SEQ ID NO: 69

SEQ ID NO: 13719 - DNA, 95 bp, Homo sapiens
gagagtatccccttgctgagaaagtgaagtgattagcagtgtatgtatagcactcagaacagtggcagcacataatcagtgtcagggaagcaatc

SEQ ID NO: 13720 - DNA, 76 bp, Homo sapiens
cctgatacttgttcttggttttcagcactccctagcccaaggaaatcagtgagaagagagagggcagggttacagg

SEQ ID NO: 13721 - DNA, 58 bp, Homo sapiens; identical to SEQ ID NO: 10913

SEQ ID NO: 13722 - DNA, 111 bp, Homo sapiens
gcccactgtcatctaaacatccgtacaagttggtgtccatcactgcatgttgcttgtatagatctaagttgctaaaaaatgatagtgggctccaaccgacttcagatgttt

SEQ ID NO: 13723 - DNA, 85 bp, Homo sapiens
cagagagctactgtgtgagtgaacagtgtcaggtcttgccaactgaacctgacaacctgatgcttccacttcaaaatactgtctg

SEQ ID NO: 13724 - DNA, 89 bp, Homo sapiens
ggagatttggggcactgcttgaattcaccgtaactttgtaaacctgactgcagaggctgcggccagagttgaagtagtgagcatgctcc

SEQ ID NO: 13725 - DNA, 95 bp, Homo sapiens; identical to SEQ ID NO: 68

SEQ ID NO: 13726 - DNA, 93 bp, Homo sapiens; identical to SEQ ID NO: 69

SEQ ID NO: 13727 - DNA, 70 bp, Homo sapiens
gtatatatggaatagggaataatgcatatatatatatatggaatatatatgcatatctatctatatatat

SEQ ID NO: 13728 - DNA, 90 bp, Homo sapiens
ctgtgttggggttggcttttggatggatccaaactcagatgctctgttagagcaactccatctcaagaccaaacacagtacctggcatgg

SEQ ID NO: 13729 - DNA, 95 bp, Homo sapiens; identical to SEQ ID NO: 68

SEQ ID NO: 13730 - DNA, 93 bp, Homo sapiens; identical to SEQ ID NO: 69

SEQ ID NO: 13731 - DNA, 127 bp, Homo sapiens
ttctcttgcctgatggctctggctaggacttccagtactatgttgagtatgagtggtgagagtggacatccttgtcttgctccagtgcttaaggagaatgctttcaacttttcctcatttggtatgg

SEQ ID NO: 13732 - DNA, 95 bp, Homo sapiens; identical to SEQ ID NO: 68

SEQ ID NO: 13733 - DNA, 93 bp, Homo sapiens; identical to SEQ ID NO: 69

SEQ ID NO: 13734 - DNA, 95 bp, Homo sapiens; identical to SEQ ID NO: 68

SEQ ID NO: 13735 - DNA, 93 bp, Homo sapiens; identical to SEQ ID NO: 69

SEQ ID NO: 13736 - DNA, 93 bp, Homo sapiens
gagcaaatgaagaggtagctgtaggatttccagtatgttactagtgtctgtgtgactcgctccaggcttcttgctttcatagctctatttctc

SEQ ID NO: 13737 - DNA, 106 bp, Homo sapiens
tccacataggcctattttagctaaaagtggcttagggagaaaaaaaataatttacttataaatttttaaatttcagaagtaacttatagcttcaggcatgtttgga

SEQ ID NO: 13738 - DNA, 110 bp, Homo sapiens
tccacatagtcaggcctattttagcgataagtggcttatggagaagaaaaataatttatttataaatttttaaatttcagaagtaacttatagcttcaggcatgtttgga

SEQ ID NO: 13739 - DNA, 112 bp, Homo sapiens
atccaagatcgttctagttattacttttcttttagaatagctctgacttgattaaatatattttataatgcttaaaagaaaatgtgatgccatttttggaatgttactgggt

SEQ ID NO: 13740 - DNA, 68 bp, Homo sapiens
gaacagtgatttactatatctctgtttatatatattttgaagaacagtgatttactatattactgttc

SEQ ID NO: 13741 - DNA, 73 bp, Homo sapiens
ttatgagctgtgtgtgtgtgtgtgtgtgcaagagcctgtgtggtatcttggtgtgcttgcatgctcggaataa

SEQ ID NO: 13742 - DNA, 104 bp, Homo sapiens
tcattctgcattgctgatggccatcttgtgtagatcatattgcttacaaagatttttttctttcttaatgtggatctagaggctatactgtaatgtctgtatga

SEQ ID NO: 13743 - DNA, 74 bp, Homo sapiens
tcaggaggttcactcttactgtctctttcttgtttcatcttagagatccacaagaaggtaggtgtcttcactga

SEQ ID NO: 13744 - DNA, 114 bp, Homo sapiens
ttgtaggatggtctgcatcactattgatcttagcgttgccagcatgtggatccagtcagcctctctgacacatggggagagggcagggaagcaaagtagtctgccatccaacag

SEQ ID NO: 13745 - DNA, 75 bp, Homo sapiens
ctctgggctctctctctccctccatgtctctgttcttgttccagttccagtttctgggagacagtgattccagag

SEQ ID NO: 13746 - DNA, 92 bp, Homo sapiens
tatatgtacacgtgtatatatgtatatatacacgtgtatatgtacacgtgtatatgtgtatatatacacgtgtatatgtacacgtgtatatg

SEQ ID NO: 13747 - DNA, 108 bp, Homo sapiens
tgtgtatatatatgtgtatatatacacatatacacgtgtacatatacacgtgtatatatacacatatacacgtgtacatatacacgtgtatatatacatatatacacg

SEQ ID NO: 13748 - DNA, 115 bp, Homo sapiens
aggctctgtgccaggctctatgccatcatttagaactaaattatatactgtttttatttatttttttttcacattttccctaggtatgtcatctagccagccagaaagcaagcct

SEQ ID NO: 13749 - DNA, 83 bp, Homo sapiens
gatgatcattacgcaatgttgctaatagataaaatggagataatctatatgtttattagcaatgaagtgatgaatgaacactc

SEQ ID NO: 13750 - DNA, 77 bp, Homo sapiens
agcaaaactctgctaatcagagaagtggaagatgtcataaactgtactttctttttttgttttggttttgttttgtt

SEQ ID NO: 13751 - DNA, 115 bp, Homo sapiens
tattttaattatgaggtatatacagggttgtagcttttggagagtcaggattatatatctttattttttagttctgcttctaaatagtattaggtgtacacagacatttgggata

SEQ ID NO: 13752 - DNA, 87 bp, Homo sapiens
agaggatctgcacatttctggaaattatttttaaattaataaaagagaatgaaatcacaggagtgtgtagcaggataacagtctttt

SEQ ID NO: 13753 - DNA, 95 bp, Homo sapiens; identical to SEQ ID NO: 68

SEQ ID NO: 13754 - DNA, 93 bp, Homo sapiens; identical to SEQ ID NO: 69

SEQ ID NO: 13755 - DNA, 103 bp, Homo sapiens
tggagtcaactataggctcagtgcaggttgttttatttttcattccctcatcagtgaacaatgaatgctagaaccaacccacagagtccttgtgacagttcca

SEQ ID NO: 13756 - DNA, 117 bp, Homo sapiens
acaacagaaatttgttatctcatggtggaggctggaaatcagagttcaaggtgtaagcagcattgatttcttctgagacctttctccttgacatgtagatggccgtcttcttcctgt

SEQ ID NO: 13757 - DNA, 117 bp, Homo sapiens
gaatgtgagatcttggaccaaataaaatctgtattttagtttaatagagttgtgccagcactaatttattagtttataattgtattatattttgtaccagtgctgatttcttagttt

SEQ ID NO: 13758 - DNA, 73 bp, Homo sapiens
gttttgctgtagaagactactgatttttgtttctgaaccaacattgatgtaagtagtagtactacagctagac

SEQ ID NO: 13759 - DNA, 72 bp, Homo sapiens
tgagaagttcacactgtgtccaggagggaagagcctggcctcttcagtgcctgtgtgtgtggcctggaatca

SEQ ID NO: 13760 - DNA, 66 bp, Homo sapiens
ctctacactctcattcactgattagagagctcacgactttctaatttctggcttgattggttagag

SEQ ID NO: 13761 - DNA, 69 bp, Homo sapiens
tgcccaaggagattaacatttgagtcagtggactgggaaaggcagacccactctcaatctgtgtgggca

SEQ ID NO: 13762 - DNA, 84 bp, Homo sapiens
ggcacagtttctctctctctgtttagaatctgagtgggaggatgagcctttccctctgctacaggagggatggaagccaatgcc

SEQ ID NO: 13763 - DNA, 85 bp, Homo sapiens
tcaagtccaaataagcttagttaagaaatgaagagatgtaagtagaggtcagaggtctggtttcttagtaagctcaaggatggga

SEQ ID NO: 13764 - DNA, 98 bp, Homo sapiens
gctgtggtggttacatgagcatatacacttgtcaaatctcatcaaattgtatatttataagtgatgaatttcactgtatgtcaattttacctcaaagc

SEQ ID NO: 13765 - DNA, 58 bp, Homo sapiens
ttgagacagtctgtctctgtcacccaggctggagtgcagagacacgatcttggctcag

SEQ ID NO: 13766 - DNA, 61 bp, Homo sapiens
ctggagtgcctcagttcacctctatgggcttctccatggggctggaaggtgagaattgcag

SEQ ID NO: 13767 - DNA, 75 bp, Homo sapiens
agctatagtgtgatataatcagagattctttttttttttttttttgagacagagtctcactctgtcgcacaggct

SEQ ID NO: 13768 - DNA, 76 bp, Homo sapiens
gagatgtcagcagtttggtttcttctgaggcctctctccatggcttgcagatggtcaccttctgcatggacacctt

SEQ ID NO: 13769 - DNA, 78 bp, Homo sapiens
atatatatatatatacgtatatatacatatgtacatatgtatatacatatatatacacacacatatatatatatatat

SEQ ID NO: 13770 - DNA, 90 bp, Homo sapiens
cccagctattcaggaggctgaggtaggaggatcacttgaacctgggaggtctaggctgcagtgagccatgccactgcactccagcgtggg

SEQ ID NO: 13771 - DNA, 61 bp, Homo sapiens
tgtatgaactacatctatgtagatatatatatatctacatagatgtatgtacactcatgca

SEQ ID NO: 13772 - DNA, 57 bp, Homo sapiens
tgagtgtacatacatctatgtagatatatatatatctacatagatgtagttcataca

SEQ ID NO: 13773 - DNA, 89 bp, Homo sapiens
ttttgtcttacacaacagtgtgtccactgtgccttgaacattgcctggaatatagtaggggcccagtgcatatttgtggaatgaaagaa

SEQ ID NO: 13774 - DNA, 107 bp, Homo sapiens
aagcaccataataccactcctctgtagatgaagttatatacacatcaatatatatatagttattctatgtgtgtgtgtgtatatggggagggtgtcaatgtgtgttt

SEQ ID NO: 13775 - DNA, 76 bp, Homo sapiens
acagaaagtcacaggggtcagaatcgtgcttattaagggtttgttaggatgagaaggcctgtgtgtgtctctctgt

SEQ ID NO: 13776 - DNA, 73 bp, Homo sapiens
tgaggctgacacctcgttcatgctgctcagtgactgtcactgttggcagcgggcagcggagaggcaagttcca

SEQ ID NO: 13777 - DNA, 73 bp, Homo sapiens
tgcacgtccgtgtgaagagaccaccaaacaggccttgtgtgagcaacatggttgtttatttcacctgggtgca

SEQ ID NO: 13778 - DNA, 94 bp, Homo sapiens
cttctttctctttccttctttctttcaatttttagttttccttgcctatctggtttttttggacagtgataaagaagtgttgaaagggaagaag

SEQ ID NO: 13779 - DNA, 127 bp, Homo sapiens
agtatatatgtggtatatatacaccacagtttcttatatactgtatatatatacactatatatactatatatatatttactgtatatatagaaactatatatatagaaactgtatatatataaaaag

SEQ ID NO: 13780 - DNA, 120 bp, Homo sapiens
tatatatgtacatatatatcacagtttctttttatatatatacagtttctatatatatagtttctatatatacagtaaatatatatatagtatatatagtgtatatatatacagtatata

SEQ ID NO: 13781 - DNA, 94 bp, Homo sapiens
tgtgagccatgcagtctgtgtcacagctacttcatctgccatttcagcaagaaagtagccatgggtagcacataagtgaatgggcgtgattgca

SEQ ID NO: 13782 - DNA, 105 bp, Homo sapiens
cccagcttggtgatgcgtgcctgtggtcccagctacttgggaggctgaggtagaaggatcatttgagcctgggaggtcaaggctacagtgagctgcactccagcc

SEQ ID NO: 13783 - DNA, 95 bp, Homo sapiens; identical to SEQ ID NO: 2114

SEQ ID NO: 13784 - DNA, 122 bp, Homo sapiens
gcttaactgataataaagggaccaatagagaaggaggaaagcagttaattgagttagaagcttgtttgctaaatagaggagtcttttaccagttgagtgggaaaagccctgtctcaggtttt

SEQ ID NO: 13785 - DNA, 80 bp, Homo sapiens
tttgacacatatatgtatgtgtatatgtatatgtgtatatatatacacatatacatatacacatacatatatgtgtcaaa

SEQ ID NO: 13786 - DNA, 80 bp, Homo sapiens; identical to SEQ ID NO: 13785

SEQ ID NO: 13787 - DNA, 95 bp, Homo sapiens; identical to SEQ ID NO: 68

SEQ ID NO: 13788 - DNA, 93 bp, Homo sapiens; identical to SEQ ID NO: 69

SEQ ID NO: 13789 - DNA, 79 bp, Homo sapiens
tgagatggagtctcgctctgtcacccagactggagtgcagtggtgtgatctcagctcactgcagcctctgtctcccggg

SEQ ID NO: 13790 - DNA, 89 bp, Homo sapiens
tcagcacgtgtgtgtctgtgtgcctgcgtgtgtcagcgcgcgcgcgcgtgtgtgtgtgcatgtgtgtgtatgtctgcacagatgtgtga

SEQ ID NO: 13791 - DNA, 65 bp, Homo sapiens
gagtttaggaaatggacttgtgcggggctggtccaaatgcctcaaagtcttctctgtcctcactc

SEQ ID NO: 13792 - DNA, 76 bp, Homo sapiens
ggcactgtgctgggccgagaataagatacgtgagctcccatctctcacagagtgtcagtcttttgcaaagtgtgct

SEQ ID NO: 13793 - DNA, 145 bp, Homo sapiens
tatatacacatatatatgtgtatatatacgtatatatacacatatatatgtgtatatatacatatatatacacatatatatgtatatatatacacatatatatgtgtgtgtatatatatatgtgtgtatgtatatatatatgtac

SEQ ID NO: 13794 - DNA, 93 bp, Homo sapiens
cagctatgcagtgctagctgttctcattttgaagttgtgatcactaacctcaagtgggcccttaatgctaattccaatcactgtatttccctg

SEQ ID NO: 13795 - DNA, 121 bp, Homo sapiens
tatatatatatatatatatatatgcacacacacatacaaatatatgtagtgtgtatcttcataaatatatatatatatattgtatgtgtgcatgtttgtgtgtatatatgtatgtgtgtat

SEQ ID NO: 13796 - DNA, 72 bp, Homo sapiens
atacacatgtgtatatgtatgtatatacacatgtgtatatacacatgtgtatatgtatgtatatatgtgtat

SEQ ID NO: 13797 - DNA, 108 bp, Homo sapiens
tcctctctgaggtaacagcttggatggaaatgtactcattgtcattttttataattagagagtgggactattttccatatatgactagtgttgctaaagtacttagga

SEQ ID NO: 13798 - DNA, 73 bp, Homo sapiens
tgatacatctataatatcttctcacagtaagcctgcctcttggtttttgtgactgaagattctgagatggtca

SEQ ID NO: 13799 - DNA, 67 bp, Homo sapiens
aagatcaaggtgtcaacagacctggtgtctggtaagggcccattcctggtttgtagacggctatctt

SEQ ID NO: 13800 - DNA, 95 bp, Homo sapiens; identical to SEQ ID NO: 68

SEQ ID NO: 13801 - DNA, 93 bp, Homo sapiens; identical to SEQ ID NO: 69

SEQ ID NO: 13802 - DNA, 69 bp, Homo sapiens
agctcatggagactgtgtgactgtcaacaaacttctaaatgggacaggtggcaggcagcctctatggct

SEQ ID NO: 13803 - DNA, 95 bp, Homo sapiens; identical to SEQ ID NO: 580

SEQ ID NO: 13804 - DNA, 93 bp, Homo sapiens; identical to SEQ ID NO: 69

SEQ ID NO: 13805 - DNA, 71 bp, Homo sapiens
tgaataatgttctgtgttatgtacatgtatttatatacatatacatacatgtatataccacattttgttta

SEQ ID NO: 13806 - DNA, 75 bp, Homo sapiens
tggataaacaaaatgtggtatatacatgtatgtatatgtatataaatacatgtacataacacagaacattattca

SEQ ID NO: 13807 - DNA, 109 bp, Homo sapiens
agcaatgtagaaatggcctaatacagtctgtaagcaaggttagttatcttcctctcacactgaggcactgactttgttgtgtttctttttggttccttactgcctagct

SEQ ID NO: 13808 - DNA, 116 bp, Homo sapiens
ctagaatattgtagtgttcatattggtgatcacttttgggatttcacacttattctttgttttttaatgtgtctgatctatggtggtgctaccaaatgatttgtattagcagctgg

SEQ ID NO: 13809 - DNA, 70 bp, Homo sapiens
tttgggaggcagaggtgggaggattgcttgagccagcttaggcaacatagtcacactctgtgtctacaga

SEQ ID NO: 13810 - DNA, 87 bp, Homo sapiens
gaagagagtgaacccactccctcaagccctttttttttacatttttatttatttatctatttattgagatggagtttcactcttgtc

SEQ ID NO: 13811 - DNA, 83 bp, Homo sapiens
gaagcagaatcaccaggaaatgtgtgcatgtgcatgcacgctcacgcgcacacacacactcacaccattttttattttgtttt

SEQ ID NO: 13812 - DNA, 96 bp, Homo sapiens
cagcctcaacagaaagtcattctgtcttgacaggtagaattttttttttttttttttttttttttgagatggagtctctctctgtcacccaggctg

SEQ ID NO: 13813 - DNA, 100 bp, Homo sapiens
gaagaggtccttcacgtcccttgtaagttggattcctaggtattttattctttttgaagcaattgtgaatgggaattcactcatgatttggctctctgtc

SEQ ID NO: 13814 - DNA, 92 bp, Homo sapiens
gtcttgaaaatctaggcataagtgtgcacctgtagtcccagttacttgggaggctgaggtaggaggatcgcttgagtctaggagttcgaggc

SEQ ID NO: 13815 - DNA, 99 bp, Homo sapiens
gaggcaggaggatcacttaaggccaagaattcaaggttgtagtgagctatgatggcatccccacactccagcctgggcaacagaatgacatcttgtctc

SEQ ID NO: 13816 - DNA, 126 bp, Homo sapiens
gcctagatgggcagtcaaggtagggtgacccaaacagagatgctccccatccccccagcagagtgtctgtttgtctaatatctcatggtcttaactaaaaattgttgataaataggtggctctgct

SEQ ID NO: 13817 - DNA, 114 bp, Homo sapiens
aggtaatttgtgtgtatatattgtagatactgtagagggtgtgtgaagacagtgtggtcccatgaggtttttctggcacacactgacagatacagtcattattcatgtgatcct

SEQ ID NO: 13818 - DNA, 108 bp, Homo sapiens
ctggtgaagtccatatgaagtctgtggtttagttaacagtactgtatcaacactaatttcattatttttaacaaaggtaccacagttctgtaagatgctaagagccgg

SEQ ID NO: 13819 - DNA, 105 bp, Homo sapiens
ctgctacaagcagcagagactgttcacaaattattattatttttattttttattttactttaagttctgggatacatgtgcagaatgtgctggtttgttatgtag

SEQ ID NO: 13820 - DNA, 95 bp, Homo sapiens; identical to SEQ ID NO: 68

SEQ ID NO: 13821 - DNA, 93 bp, Homo sapiens; identical to SEQ ID NO: 69

SEQ ID NO: 13822 - DNA, 109 bp, Homo sapiens
gtggaccgatggaacagtgtctgtgttcttgtgtctcagtcacacacagcatcagtaagaggtggattgagagggcagtaccaagggcaaggaaaatgattatttctac

SEQ ID NO: 13823 - DNA, 72 bp, Homo sapiens
cagtgtatactgcttctaggtttaatagtatccttcatcattaggttgaaccttgaactgcagtattttctg

SEQ ID NO: 13824 - DNA, 107 bp, Homo sapiens
accttctgaagcctacttctgtcaattcgtcacactcattctctgtccagatttttcccttgctggcgaggagttgtgatcctttggaggagaagaggtgttctggt

SEQ ID NO: 13825 - DNA, 79 bp, Homo sapiens
gctgaccttcctcatactgtgtgtcctagctgtgctaattttgttcttctgagaagcagagtggagggtatggtctagc

SEQ ID NO: 13826 - DNA, 83 bp, Homo sapiens
tctcccttccgtttaatcagtgtttgctatatatttatatatgcttatatacataagcaaacattgattaaacagagggaaga

SEQ ID NO: 13827 - DNA, 69 bp, Homo sapiens
ggcaaaatatatacatgtatatatagaaaacgtgtatatatatatgtttttctatatatgtgtatatcc

SEQ ID NO: 13828 - DNA, 69 bp, Homo sapiens
gtgtatataaatatacatagtttgtgcatatatatgtatatatgcatatatactggtatttgtatatgt

SEQ ID NO: 13829 - DNA, 117 bp, Homo sapiens
ctgctgtaacagatacccccagatctcagtggtttccaacagcagagagttatatctctctgatgctctgtctttattgtggattggctgggagttctgctctatattgtcagaagc

SEQ ID NO: 13830 - DNA, 109 bp, Homo sapiens
tgtgttacattttggtaattctcataatattttcaattttttcattattattatatctagtatagtgatctgagatcagtgatctttgacattactattgtaattcaca

SEQ ID NO: 13831 - DNA, 95 bp, Homo sapiens; identical to SEQ ID NO: 68

SEQ ID NO: 13832 - DNA, 93 bp, Homo sapiens; identical to SEQ ID NO: 69

SEQ ID NO: 13833 - DNA, 86 bp, Homo sapiens
caccatctatagttattttagtggttcctctaaatcttcataaatgcttcagaaaatttatactattttatcactgtgggtgtgtg

SEQ ID NO: 13834 - DNA, 83 bp, Homo sapiens
gctagtcctgtctctcattgtctcttttcattctttgcaacaatgaagtactgaatagattcaattgtctgagacagtttggt

SEQ ID NO: 13835 - DNA, 147 bp, Homo sapiens
tatatatatgcatatctatgtgtatatatgtgtgtgtatatatatgtgcatatatatgtgtgtgtatatatatacatatatgtacacatatatgtatatatatgtgtgtatatatatacacatacacacacatatatatatatatcc

SEQ ID NO: 13836 - DNA, 90 bp, Homo sapiens
gtggtgatgtatgcctatagttccagctgcttgggaggctgaggtaggaggatcacttgagcctgagcagttgaggctgcagtgagccat

SEQ ID NO: 13837 - DNA, 105 bp, Homo sapiens
acaaatatgtgtatgtatatcctgtgttaacaaatacatatatatgtatatatatcctgtgttaacacaggaaagcaaatataacatacattcagtatattctgt

SEQ ID NO: 13838 - DNA, 114 bp, Homo sapiens
taaaatgacaggtacacactgaaaatgtattaacttactgtagtttttttatttatttattttttattatactttaagttctagggtacatgtgcagaatgtgcaggtttgtta

SEQ ID NO: 13839 - DNA, 91 bp, Homo sapiens
gttaaagctacttatagatgctggatattagaactttgttggatgcaaagttttcaaaatttttctccaattctgtaggttgtctgtttac

SEQ ID NO: 13840 - DNA, 66 bp, Homo sapiens
agtatggagctctctgatgttgggggttattccaatctctgattctctcagtgaatgcccatagct

SEQ ID NO: 13841 - DNA, 116 bp, Homo sapiens
ctgaggcatcagggtttgggattctttgcttacttttagagagaacagagtgacttcaataagaagtaaggaaaagctattcaaaaagtgagattctacaaagctaggtgtgtgag

SEQ ID NO: 13842 - DNA, 89 bp, Homo sapiens
aagtgaagatattcttaactgtaaatattttgtgtgtgttgatatatatatatatatttcaccccaaatgttttcagagatattcactt

SEQ ID NO: 13843 - DNA, 148 bp, Homo sapiens
gtatatatatgtgtatatatatacacgtgtatatatatgtgtatatatatacacgtgtatatatatatgtgtatatatatacacgtgtatatatatatatatacacgtgtatatatatatatatacatgtgtatatatatatatgtat

SEQ ID NO: 13844 - DNA, 84 bp, Homo sapiens
aggtctcactcagtcactcaggttggagtgcagtggtgcaattacggctcactgcagcctcagtctcctgggttcgaaagatct

SEQ ID NO: 13845 - DNA, 128 bp, Homo sapiens
atatgtgtatatatgtatatatgtatatatatttatgtatataaatatattatatatattatatataatatataatatatataatatatatgtataatatatatatatttggacatatatgtatgtgt

SEQ ID NO: 13846 - DNA, 58 bp, Homo sapiens
tgagacagagtctcactctgtcacccaggccggagtgcagcagtgcgatctactctca

SEQ ID NO: 13847 - DNA, 66 bp, Homo sapiens
tcatatatatatatatacatacatatatacacatgtatatatatacttgtgtgtgtgtgtgtgtga

SEQ ID NO: 13848 - DNA, 74 bp, Homo sapiens
agatacagataagtatatatgtatatatatacagataagaatgtatgtatgtatgtatatatggataagtatgt

SEQ ID NO: 13849 - DNA, 109 bp, Homo sapiens
ctcctaacatcaatatgaacctgcattctgttgcatctgggatgtcatattatatatatatatgccatccagtcttgggggcagatgggcaaggtcagtgcagtgggag

SEQ ID NO: 13850 - DNA, 99 bp, Homo sapiens
ttcattcttttatatgactgagtagtattccatggtgtatatatatatatatatatatatatccatcccacatttttaatccagtcatctattgatgga

SEQ ID NO: 13851 - DNA, 95 bp, Homo sapiens; identical to SEQ ID NO: 580

SEQ ID NO: 13852 - DNA, 93 bp, Homo sapiens; identical to SEQ ID NO: 69

SEQ ID NO: 13853 - DNA, 109 bp, Homo sapiens
gaaagtgggatgcttcagaatgagctcatcaagcagcagtgttgtttcaagtagcctctatgttttaatattttgttttagtaggacttcagtagaaaatcctattatc

SEQ ID NO: 13854 - DNA, 149 bp, Homo sapiens
tatatatacatacacataggtatacttacatatatatagtatacatatatatatagtatacatatatatgtatatatagtatacatatgtgtatatatagtatacatatgtgtatatatagtatacatatatacatatataaagtatac

SEQ ID NO: 13855 - DNA, 117 bp, Homo sapiens
acatatgtatactatatatacacatatgtatactatatatacatatatatgtatactatatatatatgtatactatatatatgtaagtatacctatgtgtatgtatatatatgtatg

SEQ ID NO: 13856 - DNA, 64 bp, Homo sapiens
catatatatatgtgtgtgtgtgtacctgtgtgtatatatgtatatacatgtatgtgtatatgtg

SEQ ID NO: 13857 - DNA, 95 bp, Homo sapiens; identical to SEQ ID NO: 580

SEQ ID NO: 13858 - DNA, 93 bp, Homo sapiens; identical to SEQ ID NO: 69

SEQ ID NO: 13859 - DNA, 74 bp, Homo sapiens
ttggttgtggtggtggttacataaatctacacttgtgataaatttgctcatgtgacacacacacacacacacaa

SEQ ID NO: 13860 - DNA, 87 bp, Homo sapiens
tgagacagggtctcactctgtcacccagactggagtgcagaggcgcgatcaaggctcactacaatctctgcctcccagactcaaggg

SEQ ID NO: 13861 - DNA, 67 bp, Homo sapiens
tctcatatatgtgcatatatgtatacatttatatctcatatatgtgtgtgtatatatatatctgaga

SEQ ID NO: 13862 - DNA, 103 bp, Homo sapiens
tctaaaaaagtagtcctttcttctttccgacccaatctctctctttcacttaattttccatctccatgaaggagagcctgtgtccttaccaggacttctgaga

SEQ ID NO: 13863 - DNA, 71 bp, Homo sapiens
ccaccttatagggcagatgggactcttattcttttttttgagatggagtctcactctgtcacccagggtgg

SEQ ID NO: 13864 - DNA, 110 bp, Homo sapiens
tgcttaggattgtcttggctatacaggctcttttttggttccatatgaaatttaaagtagttttttctaattctgtgaagaaagtcaatggtagcttgatggggatagca

SEQ ID NO: 13865 - DNA, 95 bp, Homo sapiens; identical to SEQ ID NO: 68

SEQ ID NO: 13866 - DNA, 93 bp, Homo sapiens; identical to SEQ ID NO: 69

SEQ ID NO: 13867 - DNA, 82 bp, Homo sapiens
ttcagtctaagctccgtggcagccttggcactagtcacccacttgctcactgtgcctgtgactgtggagctaaaggcttgaa

SEQ ID NO: 13868 - DNA, 119 bp, Homo sapiens
gctttcattttacagacaagacagaaggaccacagcaaagcttggaacttagattttttttttactacaaaccccaggatttgttcagtcctacttaattcgttttttaaaggccatgc

SEQ ID NO: 13869 - DNA, 110 bp, Homo sapiens
ggctgtgtatatatatatacacacatatatacatatatatatacacgtatatatgtgtatatatgtgtatatatatacgtatatatgtgtgtgtatatatatatacacac

SEQ ID NO: 13870 - DNA, 115 bp, Homo sapiens
gattttgctctattacatcatacaattttttatttaatataaatattaaatctatagattaaggattttgtaactatatttaattaaaacctgtatgtgtagcctctggtaaatc

SEQ ID NO: 13871 - DNA, 77 bp, Homo sapiens
gtctcactcagtctgacttggatggcatctacatgatattctggacgttaaacttttgagctagaaggagttaagac

SEQ ID NO: 13872 - DNA, 113 bp, Homo sapiens
aatagaggttgagttgaaagagtggagatgatttcagaactgataggatcaaagtttatatttttaacacaggactgtttttaccaaggaatcttacacaacttaagcctgtt

SEQ ID NO: 13873 - DNA, 107 bp, Homo sapiens
agtaagattgtattttgtattagtcattcctgaagaagttttgattatgaataattttttaatttcattattgaaacttacaggtgttcctgctgtatatctttatt

SEQ ID NO: 13874 - DNA, 79 bp, Homo sapiens
gctgaccaaacagggaggaggtagaagagagaaatttctttttcttttttatgtcgttctttgatttgtttttaaaagc

SEQ ID NO: 13875 - DNA, 89 bp, Homo sapiens
gtttttctggcatctccaggtagaagaggaaagaggtaacgttacctactcagtttgtttctctctgtatttgaaggcgttaagaaaat

SEQ ID NO: 13876 - DNA, 83 bp, Homo sapiens
ttgggagtggtttatggcactcattttttatcattcagtatccatttattgattataatccatgtgccaggtactattctgga

SEQ ID NO: 13877 - DNA, 102 bp, Homo sapiens
gctgataccaactatatatatatacatatatatacacgtatatatatatatatgtgtatatatatacgtgtgtgtgtgtatatatatatatgcataccaagt

SEQ ID NO: 13878 - DNA, 58 bp, Homo sapiens; identical to SEQ ID NO: 2441

SEQ ID NO: 13879 - DNA, 117 bp, Homo sapiens
gaactgcttcattttgttgctactgagtccctgaaaccactttttaaaaaattttaattttaattttttaaaattatactttaagttctagggtacatgtgcacaacatgcaggttt

SEQ ID NO: 13880 - DNA, 87 bp, Homo sapiens
cattggtcagtctgttacaagcaaaacaaactttttttttattttgagatggagttttgctcttgttgcccaggctggagtgcagtg

SEQ ID NO: 13881 - DNA, 63 bp, Homo sapiens
gagtctcactcactgagtgctcaatgttgcccaggctggagtgcagtggtgtgatctcggctc

SEQ ID NO: 13882 - DNA, 65 bp, Homo sapiens
acacacgcacacactcacacacattacatatttatgtgtgagtgtgtatgtgtatatgtgtgtgt

SEQ ID NO: 13883 - DNA, 58 bp, Homo sapiens
gagtctcacagtctcactctgtcacttaggctgaagtgcagtggtgcgatctgggctc

SEQ ID NO: 13884 - DNA, 119 bp, Homo sapiens
catagtaagaccttgtctgtataagaaaaaaaaataccattttatatatatatatatatatatatatatatatatatatattttttttttttttttttttgagatggagtctcactctg

SEQ ID NO: 13885 - DNA, 97 bp, Homo sapiens
gcctaagtgtacagtgtttataaagtctacagtagtgtgcagtaatgtcctaggccttcacattcactcactacttactcattgactcacctagagc

SEQ ID NO: 13886 - DNA, 107 bp, Homo sapiens
ggacatggtgactcgtgcctatagtcctagctactcagcaggctgtggtagaaggatcacttgagcctaggagttcatggtttcagtgagctatgattgcactgttg

SEQ ID NO: 13887 - DNA, 88 bp, Homo sapiens
tactccatcctgggtgacagagtaagatcatgtctctcaaatgtaatttttttttcaacagtctcattttgtagcccagactggagtg

SEQ ID NO: 13888 - DNA, 122 bp, Homo sapiens
tgtatatatgtatgtgtatatgtatatacatacacgcatacatacgtatgtgtatatgtatgtatatatttaaagtgtgtgtatgtgtatacacatatgtgtatatgtatatatgtgcatac

SEQ ID NO: 13889 - DNA, 58 bp, Homo sapiens
tgagacagagtctcgctctgtcacccaggctggagtgcagtggggcgatctcggctca

SEQ ID NO: 13890 - DNA, 71 bp, Homo sapiens
ggtgcttctgaccctgtctctctggctatcggcgattagaccatggatcaacacctggccaagttagcacc

SEQ ID NO: 13891 - DNA, 84 bp, Homo sapiens
ttaagatgctccgtgttttttgttttttgtttttctgtagaagcaagagcagtctgtgatagaattatggcagcaagttcttaa

SEQ ID NO: 13892 - DNA, 78 bp, Homo sapiens
agtaaagtcactgtgtgtcactgtgtgttactgtatattacacatggtttcaaatttagcggcataccagtgaagact

SEQ ID NO: 13893 - DNA, 77 bp, Homo sapiens
agcaatatgtttatatttatcttgctttgcctaaaacttaagacttttagtcaaagcaagacaaatataaacatgct

SEQ ID NO: 13894 - DNA, 79 bp, Homo sapiens
gcagcaaggctttgttggagggagatttgagtggcacatctctttgtgtctcccacagtgtctgcctcagctttcatgc

SEQ ID NO: 13895 - DNA, 88 bp, Homo sapiens
agttagggtctctctctctctctggcccaggctagagttcagtggcatgatctcggctcactgcagccttgatctcctgggctcaggc

SEQ ID NO: 13896 - DNA, 100 bp, Homo sapiens
gtcaatgaattcatgttgtcagagtttctcttgtttttttttttttttttttttttagagataggttcctactctgtcaccaaggctggaatgcagtgac

SEQ ID NO: 13897 - DNA, 82 bp, Homo sapiens
atttcaggaaacttcaaagcacagaagacagtaaggagaccctttcctggcttgggttttttggaagggagaaaggtgaaat

SEQ ID NO: 13898 - DNA, 95 bp, Homo sapiens; identical to SEQ ID NO: 68

SEQ ID NO: 13899 - DNA, 93 bp, Homo sapiens; identical to SEQ ID NO: 69

SEQ ID NO: 13900 - DNA, 58 bp, Homo sapiens; identical to SEQ ID NO: 637

SEQ ID NO: 13901 - DNA, 80 bp, Homo sapiens
ccagtaggtgctctatgttagtaactcttaaatgtcgtggaagtccaaaagagaaccagagttgagacagatactgctgg

SEQ ID NO: 13902 - DNA, 58 bp, Homo sapiens; identical to SEQ ID NO: 884

SEQ ID NO: 13903 - DNA, 56 bp, Homo sapiens; identical to SEQ ID NO: 885

SEQ ID NO: 13904 - DNA, 107 bp, Homo sapiens
taattttttttttagaaactgcccaactgcttattaggttttaagcttcagtaattttcttgataatttttacttactaatacagttgggtaggagaatgaacatta

SEQ ID NO: 13905 - DNA, 107 bp, Homo sapiens
gatgttagctgcgggcttttcatataaggcctttaatatgttgtagttgtttctttatatttctagtttgttgagtgcttttatcatgaaagggtgtggaatttgtc

SEQ ID NO: 13906 - DNA, 96 bp, Homo sapiens
gtagtggtgtgtacttgtagtcccagctagtcgggaggctgaggtaggaggatcacttgagcccaggacatagaggctgcagtgtgctatgactac

SEQ ID NO: 13907 - DNA, 80 bp, Homo sapiens
gtgtatttctgtgtcagtatctctgtgtgtccacgtgtgtccacatgtgtctgcatgtgggatgccgagtacctgtgtgt

SEQ ID NO: 13908 - DNA, 84 bp, Homo sapiens
ctcatcctctcatagttcattgttggctgagccagagtccaatttcctttgcttcagtgagtggctgcacagtgtgaggagaag

SEQ ID NO: 13909 - DNA, 60 bp, Homo sapiens
agccaggggctgggtgcggattctggagtatgcccagtctcaggctctcagcccctcact

SEQ ID NO: 13910 - DNA, 69 bp, Homo sapiens
gaggaggaaattctttttattttctagaatctgagattcctgaggagaccgtggagggaaggcctcctc

SEQ ID NO: 13911 - DNA, 99 bp, Homo sapiens
ttctacttgaaaggcaatcctagcatagacaatgatttaccatcgatggcttctgtgtgagtcagtctttctaaaagaggaaagccttctttaaaagaa

SEQ ID NO: 13912 - DNA, 126 bp, Homo sapiens
gtctcagtcagagcttgaatcatcccgacgatcctcctcggtctcatttctctctgtgtctgtgacgctgcatccattctgacaggcccttctgtccctcagaatgttcctgctgtcagtccaggc

SEQ ID NO: 13913 - DNA, 73 bp, Homo sapiens
ggacagcttctcaggggtggggccagtttctgctgtgtgaccctgtttctctcactcctgcctgcaggctgcc

SEQ ID NO: 13914 - DNA, 66 bp, Homo sapiens
cagcccgtgagccagcgtgggtggcaggggcctgtctctgtgcctgtgctgtgctacctctagctg

SEQ ID NO: 13915 - DNA, 115 bp, Homo sapiens
attactgaagcctagaagcctaggaaatgcagatccttctgagattttttttttttttttttttttttttttgagacagagtctcgctctgtggcccaggctggagtgtagtgat

SEQ ID NO: 13916 - DNA, 114 bp, Homo sapiens
gtcatatatgtgagagtaactattgagtttcactaatttgattatttatttaccaagatttttttgtcaagttatttgaagcccaacctttagttatcttggtatattcatgat

SEQ ID NO: 13917 - DNA, 77 bp, Homo sapiens
gagattcacaatatttgtttatcatttataggtagcacagaaaaagctagtgactgagagcaattcatgtgagcctc

SEQ ID NO: 13918 - DNA, 78 bp, Homo sapiens
cagaacacagtgacaacatccctgtgggtgcgtaacacagtaaagagtgtccacatgagggaaagatgtcaaaggctg

SEQ ID NO: 13919 - DNA, 101 bp, Homo sapiens
gccaggtctgtatgaagcaggaggtgacattggactttttttttttttttttttttgtgacggagtcttgctctgtcacccaggctggagtgcagtggcac

SEQ ID NO: 13920 - DNA, 58 bp, Homo sapiens; identical to SEQ ID NO: 2381

SEQ ID NO: 13921 - DNA, 88 bp, Homo sapiens
atgtatatacatatatatacgtatatatatatatgtacacgtatatatatacacgtgtgtgtgtgtgtgtgtgtgtgtgtgtgtgtat

SEQ ID NO: 13922 - DNA, 135 bp, Homo sapiens
tcgctctcagtctcagcggcggcggcggcggcagcggcagcggcagcgcccggagctcagctcgctgtctccctcgctctgtgcggggctctcgcctcactccagagagaggggcgggaggagagcggcgcctgc

SEQ ID NO: 13923 - DNA, 66 bp, Homo sapiens
gtggactctcaggctctctcagtggacagctctcaggctctctcagtggacagcactagggaacac

SEQ ID NO: 13924 - DNA, 85 bp, Homo sapiens
acagtgggtgtataccttgtgatatcattcgtaatatactaggaatatattactcctaatatcacagtgggtgtacactctgtgt

SEQ ID NO: 13925 - DNA, 115 bp, Homo sapiens
ggcctctgagtcactgatgggctagtttcagtctttcctgcggctttctcagtgtttttgtctcttatttctggaggctcatattgtgagtgatccacaaattttgttgactgga

SEQ ID NO: 13926 - DNA, 125 bp, Homo sapiens
gtatctgcccaagtgttatgcctttggtttcttctgtccttcattccttctgtccctctgagtgtgcccccgaaacagtcgagtgaaggtgtaggaccggcccttgcagggaggcactctcttgg

SEQ ID NO: 13927 - DNA, 101 bp, Homo sapiens
tctgggtatatgccatttgtttggatgtatatatgcaaatatcttcttccagtctatgtcttgtttttgtactctattaatggcatcttttgatgaacaga

SEQ ID NO: 13928 - DNA, 155 bp, Homo sapiens
accataacacacacagtttaagcagtctccaaacaaacctaatcaatcaacaatattagagagagagagagagagagagagagagtgtgtgtgtgtgtgtgtgtgtgtgtgtgtgtgtgtttccctggggaaatactatgtgcacaccccacata

SEQ ID NO: 13929 - DNA, 103 bp, Homo sapiens
tttgattccttgagcctgtcacagtgcctgtcacatggttggcactcagtcttactgtgtctgactattatactgagcattatttcactccgctttcatcaaa

SEQ ID NO: 13930 - DNA, 128 bp, Homo sapiens
tctagatatatacattatagtcactattgtgtatacagtgtatatagatatacactatatctatgtatatagatatatgtgtatacactatatgtatatctatagatctatatttatatagtatatgt

SEQ ID NO: 13931 - DNA, 110 bp, Homo sapiens
ggggttggtttgctcttgattctctagttcttttagttgtgatattaggttgttaatttgagatctttttaactttttgatgtggctatttaatactatagatttccctc

SEQ ID NO: 13932 - DNA, 83 bp, Homo sapiens
gtcttgcagggtgcctgctactctcactccctctctacactaatgaaactgggtgcatagggcgagatggcttccctaaggtc

SEQ ID NO: 13933 - DNA, 58 bp, Homo sapiens
tgagatggagtctcactctgtcacccaggctggagtgcagaggtgtgattctggctca

SEQ ID NO: 13934 - DNA, 69 bp, Homo sapiens
agagtgacacatactctacaggaaaaggtttttttgtttgtttgtttttctgagagggagtctcgctct

SEQ ID NO: 13935 - DNA, 129 bp, Homo sapiens
gtactttagtagttatatatacatgtgtatatatatgtgtatatatgtatatatgtgtatatatgaatatatgtgtatatatgtgtatatgtatatgtgtgtatatatgtgtatatacatatacacaca

SEQ ID NO: 13936 - DNA, 73 bp, Homo sapiens
cctggggctgggttttgtgttgtctttataaatacactctctcacacacacaaagaacctagttctttttagg

SEQ ID NO: 13937 - DNA, 90 bp, Homo sapiens
caggcgtgcaccaccatgcccagctaattttttgtatttttagcagagttggaatttcaccatgttgtctaggctggtcttgaactcctg

SEQ ID NO: 13938 - DNA, 119 bp, Homo sapiens
acaccataagtgtgttaggggaagagctgggataaagggatggagatgctttgagctgctacagtagtttgcacattcttacctgtctgactctatttgccatcacatatagaatgtgg

SEQ ID NO: 13939 - DNA, 58 bp, Homo sapiens; identical to SEQ ID NO: 884

SEQ ID NO: 13940 - DNA, 56 bp, Homo sapiens; identical to SEQ ID NO: 885

SEQ ID NO: 13941 - DNA, 115 bp, Homo sapiens
gattgtcttggctatacgggctcttttttggttccatatgaaatttaaagtagtttttttctaattctatgaagaaagtcaatggtatcttgatgggaatagcattgaatctatc

SEQ ID NO: 13942 - DNA, 94 bp, Homo sapiens
tcttgtgtggtggaggcaagatgtcagtcaagacaaggggcctggtctaggcttctttcccctgaagtcttgtctctgcaatggccacttcaga

SEQ ID NO: 13943 - DNA, 74 bp, Homo sapiens
gtttgttttgagacagagtctcgctctgtcacccaggctggagtgcagtggcatgatctcggctcactgcgagc

SEQ ID NO: 13944 - DNA, 123 bp, Homo sapiens
agagaatctcatttcctttcccacctggctgtttgctgagccacagaagtttgtcagctcactccaggtactggagtggagctcatagagattttctggaagctgcctggctctggcaaaggg

SEQ ID NO: 13945 - DNA, 99 bp, Homo sapiens
tatatattttatatgtatatatatatatatgttttcaatatataattgtacatttatttgtatatatgaggtgtgtacatgtatgcatatattattata

SEQ ID NO: 13946 - DNA, 120 bp, Homo sapiens
ttgctaccaggaacgaattaggtatgagtgaatagtgggatgatttattttcttttaagagcctctctttcttttaacaaataacattcttgttcttctttcctctggccataatggcaa

SEQ ID NO: 13947 - DNA, 95 bp, Homo sapiens; identical to SEQ ID NO: 68

SEQ ID NO: 13948 - DNA, 93 bp, Homo sapiens; identical to SEQ ID NO: 69

SEQ ID NO: 13949 - DNA, 117 bp, Homo sapiens
aagggtacatgttcagcagaaggaattggcaggagcacacgctccctctctctctcactttgcatgcttgaccctgagaccttgtgttctcctgaagcctctgccacgcaatctctt

SEQ ID NO: 13950 - DNA, 111 bp, Homo sapiens
ccaggccagattgatttaggtaaaaacaacattcttcatttaaaaatatacagagtcctcttttttttttttttagcagtgagtaagttgaggcctcagtggttttggagg

SEQ ID NO: 13951 - DNA, 63 bp, Homo sapiens
ctgtctagacagatcacacagagcacctgctgtcgtacgttctatgtgaggtgactctggcag

SEQ ID NO: 13952 - DNA, 94 bp, Homo sapiens
gatcagtaagtctgggctggggcagagattctacatttctttctttttttttttttgagaggaagtctcactctgtcacccaggctggagggtc

SEQ ID NO: 13953 - DNA, 123 bp, Homo sapiens
gatggtctctaagtagtgtacttagacatgtattttgcaaagatcagtttgattgttgtgtgggaagtggtctaaatggtctcagaatgaatgctagtccacaggcagtgacagtcaagatga

SEQ ID NO: 13954 - DNA, 104 bp, Homo sapiens
gggaatatatgatatcaatatgtcttgacactggtgataataaatttaattatttggttaaggctgtgtctaccaggtttctccatagtaaatcacaacttttc

SEQ ID NO: 13955 - DNA, 92 bp, Homo sapiens
gaaggtagatatgtgtgtgtgtgtgtgtgtgtgtgcgcgcgcacatctgtgtatgtgtgtattcacactggtgtgcatacacacataggtat

SEQ ID NO: 13956 - DNA, 110 bp, Homo sapiens
tcctatttgtattccacagagaggaaggtgttcatttgaagcctggatacatatttttgtttcatattttaatatttacctgccattgttatttgtttataaagaaggga

SEQ ID NO: 13957 - DNA, 71 bp, Homo sapiens
ctgggtgtggtgacacatgcctgtagtccagctactcagggggctgaggtagcaggatcacttgagcccag

SEQ ID NO: 13958 - DNA, 123 bp, Homo sapiens
gccagtaaaatgtttgtctatttaagtttgtaaatgcctaagtccatccatttttttttttacatagaaaaataattgggtagggttgatcacaaaccacagattttaccagggtagaaagca

SEQ ID NO: 13959 - DNA, 58 bp, Homo sapiens
tgagatagagtctcactctgtcactcaggctggagtgcagtggtgcgatcttggctca

SEQ ID NO: 13960 - DNA, 117 bp, Homo sapiens
cgtgtgtgtgtatatatatatatatagatatataatatatctatatatatatatctagcctaaatatatatatatctgtatatgtatttatatatatatatataaaataagataccg

SEQ ID NO: 13961 - DNA, 68 bp, Homo sapiens
tgttttgagacggagtctcgctctgtctcccaggcgggagagcagtggcaggatctcggctgactgca

SEQ ID NO: 13962 - DNA, 117 bp, Homo sapiens
gttgtagcatgtatcagaacttcatcccttttaatggctgaataatgtatcatcatatagctagattacacattgtttatccattcatcagttgataggtatttgggttgtttcaac

SEQ ID NO: 13963 - DNA, 120 bp, Homo sapiens
gctcaagctgtcttatttgtgttttactgtctgctctttctggctgcttgtagttagaacagaagtgattttcttgaaatgcatgaggctagaaagggagctggaacttaaagtggcggt

SEQ ID NO: 13964 - DNA, 119 bp, Homo sapiens
tcctgaggctgggtgtggtggctcatgcctgggtgcgtgacacccagcactttgggtggctgaggtaggaggatcacttgagcccaggagttcaagaccagccttggcaagatatggag

SEQ ID NO: 13965 - DNA, 165 bp, Homo sapiens
tatatatgtatttgcaattaaattatatataattatatatatttgcaattaaattatatatataattgcaaatatatatggtctctatatatttgtatatatgtacacatacacatgtatatacatatatgtatatgtacatataggtataattgcaaatatata

SEQ ID NO: 13966 - DNA, 160 bp, Homo sapiens
tttatatggatatatatggatttatatggattttatgtggatatatatccatataagatatatattatatatatcaatataaaatatatatatgtatatatttatatagccatatatatttatatagccatatataaatttatatagccatataaatata

SEQ ID NO: 13967 - DNA, 116 bp, Homo sapiens
tggtatagtttccaagctggcctgtcagttacacctgtaaaagccatcccgtcactctatctgactgggacttctgggtagtgtagtatgtgataggacaagtgtatcttatgtca

SEQ ID NO: 13968 - DNA, 113 bp, Homo sapiens
tagattatctaaatagtggcatagacatcttgatggtattgcctcataattatttttatttctgtgagatgtatggcaatgtcctctctttcattcctgatttaaatgatttg

SEQ ID NO: 13969 - DNA, 115 bp, Homo sapiens
gtatgtttttcatctagactgttaaattaattagcatgtaatatgtttgcatttgtagctgtgtgtttacataattgccagggattgagttaatcatgtttgaggttcaaggtac

SEQ ID NO: 13970 - DNA, 102 bp, Homo sapiens
agatcctgattttaatttttttggataagtaacccaaagtaggattggtggatcatatggtaattctatttttatttatttattttttttgagacagagtct

SEQ ID NO: 13971 - DNA, 79 bp, Homo sapiens
atatatatgcattgctatataaatgtgtgtgtatttatatatatatatacacacacacagtgagtatgtgggtgtatat

SEQ ID NO: 13972 - DNA, 69 bp, Homo sapiens
ttttaccttcattatttgtttataaacctgaagatatcaggactgttactgtagatagttgaggtaaaa

SEQ ID NO: 13973 - DNA, 104 bp, Homo sapiens
tggaggagttggaagtgaaggcagaagaggcaggcacactcagtgtgacttcacggaaatacagcattgtttttgtctgagttttttgcctttttatttctcta

SEQ ID NO: 13974 - DNA, 106 bp, Homo sapiens
gaccctgtgaagttagcagattgctgaagtaaatgggcatgaggttgaaattgtatatatttgttttatttatttgcttaagcagaatctgtaatttattagggtc

SEQ ID NO: 13975 - DNA, 95 bp, Homo sapiens; identical to SEQ ID NO: 68

SEQ ID NO: 13976 - DNA, 93 bp, Homo sapiens; identical to SEQ ID NO: 69

SEQ ID NO: 13977 - DNA, 109 bp, Homo sapiens
atatatataaattgcttcatatatatagtgtgtgtgtatatatatatatatgaagaaatatatatatatatatatatatatatatatgaatgaaacaatttatttttat

SEQ ID NO: 13978 - DNA, 78 bp, Homo sapiens
tatgtgtatatgtatatatatatacacacatgcaaatatgtgtaaatatgtgtgtatatatgtgtgtgtgtgtatatg

SEQ ID NO: 13979 - DNA, 114 bp, Homo sapiens
caaaattagctgggcatggtggttcatgcctgcagtctcagctactcaagaggctgaggtaggaggatggcttgaggctgggaaacaggcagaggttgcagtgagcagtgtttg

SEQ ID NO: 13980 - DNA, 67 bp, Homo sapiens
gtggagagaacacagtctctggcactcaggaagggctcttgggtgtgggttattgctgagagtccat

SEQ ID NO: 13981 - DNA, 101 bp, Homo sapiens
gtgatctgtcagccacaagtttacagaactgccccttagaggtggagaaacttttttttttgtttttaagagacagagtctggctctgttgcccaggttgc

SEQ ID NO: 13982 - DNA, 85 bp, Homo sapiens
ccaggcatggtgccatgtgcctgtagtcccagctactcaggaggctgaggtaggaggatcacttgagcctgggaggtggaggttg

SEQ ID NO: 13983 - DNA, 124 bp, Homo sapiens
gaaatgcatttcatatatatatatatatatatgtttgcatttcatatatatatatatatgaatgaacgaatatatatttcatatatatatatgaacgaaatgcatttcatatatatatatatgt

SEQ ID NO: 13984 - DNA, 97 bp, Homo sapiens
tgcagtaagtggctctgatggtaggccaggataagggaataattatatatgattttcattctaattttgtgcctacaggggagccctgctcaatgca

SEQ ID NO: 13985 - DNA, 58 bp, Homo sapiens
tgagacggagtctcgctctgtcactcaggctggagtgcagtggcgcgatctcggctca

SEQ ID NO: 13986 - DNA, 112 bp, Homo sapiens
cttgctggattgaaatagtgtactattgtgttttaaaaatgcttataatttaaaaaaattataactttatctttttttttgagacggaatctcactctgtcacccaggctgg

SEQ ID NO: 13987 - DNA, 109 bp, Homo sapiens
gacttccaaacaaagccaaaagcttcaataagtaaagagactgagctctgagttcatggaggtcaaggcagctcgaatttatgcggtggagctctggagaaaaggtgtc

SEQ ID NO: 13988 - DNA, 64 bp, Homo sapiens
tgtgatatatacatctacatatgtatatatattttggatatatgtatgtatacgtgtatacaca

SEQ ID NO: 13989 - DNA, 113 bp, Homo sapiens
tttccccagtagcttaccaaatcttgctctttattcaactaatagatactgagtatgcaataaatatttctttttagattatggttcagtagagtgcctgggcctatgggaaa

SEQ ID NO: 13990 - DNA, 71 bp, Homo sapiens
acatatgatggaggacatgtgacatctgtttctgtgtccagcttacttaacagaatgacttccatccatgt

SEQ ID NO: 13991 - DNA, 173 bp, Homo sapiens
atatatacactataaagcatgtatttactatagtatatatactatttatatggtatatataaatatatagtatatattatacatatacactttatagtatatatatatcatagtgtatatactatttatatagtgtatataagtgtatatactatttaattatatatactata

SEQ ID NO: 13992 - DNA, 128 bp, Homo sapiens
gtatatatatgtattgtatacattatattgtattacatatataatgtatacaatacatatattgtatatgtatatgtatatgtatacaatatatgtattgtatacatgtatatatgtaatacaatata

SEQ ID NO: 13993 - DNA, 103 bp, Homo sapiens
tatatatatatgtgtgtgcgtatatctgtatatatatatgtatatactatatatattgtatatatgtatatatacacatatatgtacacacacatataatgta

SEQ ID NO: 13994 - DNA, 86 bp, Homo sapiens
gcatacatacagacacacacacacacatatatacatatatgtgcacatacataatgtatgtatgtgtgtggatgtatatggactgc

SEQ ID NO: 13995 - DNA, 97 bp, Homo sapiens
gcattagacaagtgacaaagtttttatatatttatctgggccacagaatagagtttctgtaatccgtgaagacagtgagtacctaaatgtttcttgc

SEQ ID NO: 13996 - DNA, 114 bp, Homo sapiens
gagctaagtgaataaagctagctagaccatttcacatggaggttcactgaagctgagttttcttttttttttttttttttttttgagatggagtctggctctgtcgcccaggtt

SEQ ID NO: 13997 - DNA, 75 bp, Homo sapiens
atatcatatatatatgtgagatatatatatgagatatatatatctccctatatatctatatatatcacctgatat

SEQ ID NO: 13998 - DNA, 107 bp, Homo sapiens
gagacattgtcatacttttttttcaataggctttctatagttctttgaatatatttataatggctgttttgaagtctttgtctactaagtttgatacctgggccctc

SEQ ID NO: 13999 - DNA, 97 bp, Homo sapiens
gtgtggaatgtcattgattttagctttagtaggtttgtttttatttttcttttgcctaacctttctgttatgctctctctctctgtgaatttcacac

SEQ ID NO: 14000 - DNA, 57 bp, Homo sapiens
tgagactgagtctcactctgtctccaggctggagtgcagtggtgcaatctcagctca

SEQ ID NO: 14001 - DNA, 89 bp, Homo sapiens
ccagcatgggcaacatagtgagaccccatatcaccaaatttttttttttttttttttgagatggagtctcgctctgtcacccagcctgg

SEQ ID NO: 14002 - DNA, 118 bp, Homo sapiens
tgcctcatgatattcctatcactgcattccttttactttattatttttcatttttcttccatttttattttaagttcccaggtacatgtgcaggatgtgcaggtttgttacataggta

SEQ ID NO: 14003 - DNA, 93 bp, Homo sapiens
agagcatatgatttcaagtgtattataaatattgagattttaatataaagctgtaaaatcttaatatttataatatacttgaaatcagactct

SEQ ID NO: 14004 - DNA, 77 bp, Homo sapiens
atgcctggatagatgtttattttaatatcactcttcaggaagttagagaaacatttatttctttttccttaaggcat

SEQ ID NO: 14005 - DNA, 89 bp, Homo sapiens
ttgccaacatagctttttaagagtctgcaaatagaaagaaaggtaatttttttctgtattttccagacttgtgacaaagagctaggtga

SEQ ID NO: 14006 - DNA, 93 bp, Homo sapiens
acagagcaagacctcatctcaaaaaagaaaagaaaagttaactccaaagatcttctctttttttttttttttcgagatggagtcttgctctgt

SEQ ID NO: 14007 - DNA, 104 bp, Homo sapiens
gcactcaatttccactggaggaggcagaagcagtgttttagatatatatttttttaagatatatatatttttggtcaaaatattttctatttctctgtgtgtgc

SEQ ID NO: 14008 - DNA, 116 bp, Homo sapiens
ataattttacaactaacatcaacacatttaagagggcttaaaaataacatatttataaatttaattagtagatttataagacatttttaagtgtgtggaaatgttttgttaattat

SEQ ID NO: 14009 - DNA, 61 bp, Homo sapiens
tcatgctttttttatattttatgatggttattgccatagagattatagaaagagctgttga

SEQ ID NO: 14010 - DNA, 60 bp, Homo sapiens
gagtcactgtctctcactttaaatcaaaagctagaaagagtgggccaggtgcggtggctc

SEQ ID NO: 14011 - DNA, 58 bp, Homo sapiens
tgagatggagtctcactctgtcacccaggctggagtgcagtggcgtgatctcccctca

SEQ ID NO: 14012 - DNA, 99 bp, Homo sapiens
cacatgaattgattgtgatggtgaaagtatgtaagagacacacattggtgatggattttatttttcatttttaatcatgataagaagtcagtgcatgtg

SEQ ID NO: 14013 - DNA, 111 bp, Homo sapiens
ttaaagatggaattttggcatgattttataaaacttgagccagattatcttattttatttggatccctggtttatctcaagagttggaattcagggccagcccatttgtga

SEQ ID NO: 14014 - DNA, 100 bp, Homo sapiens
ggaattgtgacagcgtgaggtgtatttatgtgatgcctggcacttttttttcttttgtttttcagagatgtggtctcactgtcacccaggctggagttct

SEQ ID NO: 14015 - DNA, 102 bp, Homo sapiens
gtagagtagctggaacaacagacaggccattgcgctccactaattattattattattttttaagagacagcatctctggctttgttgtccaggatggtctcc

SEQ ID NO: 14016 - DNA, 70 bp, Homo sapiens
ttgtttttgaggcagagtctcactctgtcacccaggctggggtgcagtggtgtgatctcagctcatgcaa

SEQ ID NO: 14017 - DNA, 71 bp, Homo sapiens
gttttttgagacagggtcactctctgtcacccagactggagtgcagtgggatgatcttggctcactgtaac

SEQ ID NO: 14018 - DNA, 58 bp, Homo sapiens; identical to SEQ ID NO: 1215

SEQ ID NO: 14019 - DNA, 115 bp, Homo sapiens
tctcctcacacactagagtttctctttttttaaacttgtatcagctgttgtctttttgaatttttctcaaaagttcagttttaactagagggagcaatggtgagggtaaggatga

SEQ ID NO: 14020 - DNA, 76 bp, Homo sapiens
tctttgtatagaactgatcttttttattttaaaatatctgatattaatttggaatgaagtaaggttctgtcaaaga

SEQ ID NO: 14021 - DNA, 89 bp, Homo sapiens
gagtaaagattattgtttttgtgagaacatacagagtaaaaattatatttttattacttcttgtatgtttcagggacagacgtttgctt

SEQ ID NO: 14022 - DNA, 83 bp, Homo sapiens
gacattctttgttccctgaggagaaaaaggtctctctttctctctgtgggagaaagaggaacatcattggataaaagaaagtc

SEQ ID NO: 14023 - DNA, 127 bp, Homo sapiens
tcaggagatgggggctaaggaggatttcccgtgcccagggttgcaaaggtctgtgacagaagtgtgagtccccaagggctctggctcacttatcctttccccatagtagggaccctcctctggctct

SEQ ID NO: 14024 - DNA, 89 bp, Homo sapiens
gggatatatatatacattatatatgtatatgcattatgaatgtatatagcatgcttatatacatagtgtatatatatattctaatagta

SEQ ID NO: 14025 - DNA, 103 bp, Homo sapiens
acatatatatatatgtgtgtgtatatatgtatatatgtgtatatatatgtatatatatgtgtgtatatatatatgtatatatatgttatagaatactacatac

SEQ ID NO: 14026 - DNA, 91 bp, Homo sapiens
tagtcttggggtttttttgttttatttatttttttctgagacagagtcttgctctgttgcccagactagagtatgcaacctcagctcactg

SEQ ID NO: 14027 - DNA, 111 bp, Homo sapiens
agttgtggttttcccctcatgaatccagtgatcatccttcctgtttttctagttgtgttcactagggagagggagtctggggcattgactgggttttgtaaaaatgattct

SEQ ID NO: 14028 - DNA, 113 bp, Homo sapiens
gatgtgtgtgtatgtgtgtgtgtctgtgtgtgtgttttatgagtttttttaaaaaatttttttattattattatactttaagttttagggtacatgtgcacattgtgcaggtt

SEQ ID NO: 14029 - DNA, 113 bp, Homo sapiens
tctcaccaaaataactcataacatggcatagttgtctggtagtttatttaattctatttgtaggttgaaacttatctgttaatacaactatacctgagtatttattaaggaga

SEQ ID NO: 14030 - DNA, 84 bp, Homo sapiens
gggtctcactctgtcactcaggctggagtgcagtggtgcaatctcagcttactgcaacctccaccttccaggctcaggggaccc

SEQ ID NO: 14031 - DNA, 104 bp, Homo sapiens
atagaactgtctctctgtctctctctgacacacatacacacacacacacacacacactaaactgtggcaaactgttggggaggcagaggtggtggtatatctgt

SEQ ID NO: 14032 - DNA, 102 bp, Homo sapiens
gccatttcagaaactcattcttttctttttatttgtataaatttaagtggtacacctgcaattttgttatgtggatatattgaggagtggtgaagtcttggc

SEQ ID NO: 14033 - DNA, 102 bp, Homo sapiens
atatatcctctttatatatatatatcctactgtgtgtatatatatatctaatatatataatgtaacatatgtaatataatatatatatcctagagtgtgtgt

SEQ ID NO: 14034 - DNA, 205 bp, Homo sapiens
catatatatatgtatctccttattgtagtgtgtgtgtgtgtgcgtgtgtatatatatggaatatatatatatctatggaatatatatatatatctatggaatatatatatctctatggaatatatatatatatggaatatatatatatctctatggaatatatatggaatatatatatatctctatggaatatatatatatatct

SEQ ID NO: 14035 - DNA, 107 bp, Homo sapiens
gagatatatatatattccatatatattccatagagatatatatatattccatatatatatatattccatagagatatatatattccatagatatatatatatattcc

SEQ ID NO: 14036 - DNA, 151 bp, Homo sapiens
tatctatggatagataagtatagatatatatatctatggatagatatgtatagatatatatctatctatggatagatatgtatagatatatatatctatggatagatatgtatagatatatatatctatggatagatatgtatagatatat

SEQ ID NO: 14037 - DNA, 72 bp, Homo sapiens
tctatccatagatatatatatctatacatatctatccatagatatatatatctatacatatctatccataga

SEQ ID NO: 14038 - DNA, 72 bp, Homo sapiens; identical to SEQ ID NO: 14037

SEQ ID NO: 14039 - DNA, 72 bp, Homo sapiens; identical to SEQ ID NO: 14037

SEQ ID NO: 14040 - DNA, 72 bp, Homo sapiens; identical to SEQ ID NO: 14037

SEQ ID NO: 14041 - DNA, 72 bp, Homo sapiens; identical to SEQ ID NO: 14037

SEQ ID NO: 14042 - DNA, 72 bp, Homo sapiens; identical to SEQ ID NO: 14037

SEQ ID NO: 14043 - DNA, 72 bp, Homo sapiens; identical to SEQ ID NO: 14037

SEQ ID NO: 14044 - DNA, 72 bp, Homo sapiens; identical to SEQ ID NO: 14037

SEQ ID NO: 14045 - DNA, 72 bp, Homo sapiens; identical to SEQ ID NO: 14037

SEQ ID NO: 14046 - DNA, 72 bp, Homo sapiens; identical to SEQ ID NO: 14037

SEQ ID NO: 14047 - DNA, 72 bp, Homo sapiens; identical to SEQ ID NO: 14037

SEQ ID NO: 14048 - DNA, 110 bp, Homo sapiens
agtgtggtggcatatgcctgttgtcccagttactcaggaggctgaggtggaaggatcacttgagcccaagagtctgaggttgcagtgagttatgatcacaccactgcact

SEQ ID NO: 14049 - DNA, 97 bp, Homo sapiens
gaaatccatgttaattataaagacacaaaaggaatggagaaagttatatttttcttttctttcctttttttttttttaacctttgaaacagggtctc

SEQ ID NO: 14050 - DNA, 59 bp, Homo sapiens
gtgtcctcataagaagaggaagaaacaccagagtgctctctctctctccatgagcacac

SEQ ID NO: 14051 - DNA, 75 bp, Homo sapiens
ttgttttgtttcattatattcaatgtttggctgagcccagtgaaacaattagaatgtaatgaagcatctagataa

SEQ ID NO: 14052 - DNA, 110 bp, Homo sapiens
ttcctaaaaaccaaattgtgtgtctatgtatgtatgtatatgtgtgtgtatatatgtgtatatgtatatgtgtgtatatacatataacgtgcctcccaactgtttaagag

SEQ ID NO: 14053 - DNA, 82 bp, Homo sapiens
tccagtttgtgtctgtgtgtttgcagagtcctttactttctctttttttgagacatggtctcactctctaactcaggctgga

SEQ ID NO: 14054 - DNA, 89 bp, Homo sapiens
gatctcttggcagaaactctacaagccagaagagagtgggggccaatattcaacattcttttttgtttgtttgtttgtttttttgagtc

SEQ ID NO: 14055 - DNA, 95 bp, Homo sapiens; identical to SEQ ID NO: 68

SEQ ID NO: 14056 - DNA, 93 bp, Homo sapiens; identical to SEQ ID NO: 69

SEQ ID NO: 14057 - DNA, 95 bp, Homo sapiens; identical to SEQ ID NO: 68

SEQ ID NO: 14058 - DNA, 93 bp, Homo sapiens; identical to SEQ ID NO: 69

SEQ ID NO: 14059 - DNA, 73 bp, Homo sapiens
tgtgtgtgtctgtctgtgtatatgtgtgtccctctgtgtgtacctggggatggatgacaggataggccaagca

SEQ ID NO: 14060 - DNA, 66 bp, Homo sapiens
gcaggggttacagactccagtgtctccagcggtcaggcaatgtcactgtagactgtgtccagatgt

SEQ ID NO: 14061 - DNA, 77 bp, Homo sapiens
gaaaatggaaccatttttcagaggctgttttctttctgtagatgagagttgagacagtgctgaattgaactgttttc

SEQ ID NO: 14062 - DNA, 108 bp, Homo sapiens
tatatataagtataattatataaaaacatattttaagtatatatttaaatggacatacatgtatatatccaattaaaatgtgtgtgtatatacatgtatatatatgta

SEQ ID NO: 14063 - DNA, 118 bp, Homo sapiens
aatattttctctttcttgtcttttcatcttctttattgttttttgacaaatgggaagtcttacaatttttcttattgtctaagacccagggtacatgtgcaggaagtgcaggtttgtt

SEQ ID NO: 14064 - DNA, 95 bp, Homo sapiens; identical to SEQ ID NO: 68

SEQ ID NO: 14065 - DNA, 93 bp, Homo sapiens; identical to SEQ ID NO: 69

SEQ ID NO: 14066 - DNA, 73 bp, Homo sapiens
tgagctatctgcaaacgttttttattatattttaagttctggagtacatgtgcagaatgtgcaggtttgctta

SEQ ID NO: 14067 - DNA, 102 bp, Homo sapiens
gggcctcttcactggctgtccgggaaactggattggagcccacagtggactctgcctgcctgtgaccctgacctcggggtgtggcaggaggtgtctaagctg

SEQ ID NO: 14068 - DNA, 77 bp, Homo sapiens
tttgttttgttttgagatggagtctcactctgtcacccaggctggagtgcagtggcgccatctcagctcactgcaaa

SEQ ID NO: 14069 - DNA, 76 bp, Homo sapiens
ttgagatggagtctcactctgtcacccaggctggagtgcaatgtccgcctcctgggttcaagcgattctgcctcag

SEQ ID NO: 14070 - DNA, 112 bp, Homo sapiens
agctttaaaatcacattttctttttgtttttttctctctctctctttttggagacagagtctcactctgtcacccaggctggagtgcagtggagtgcagagcaaacatggct

SEQ ID NO: 14071 - DNA, 68 bp, Homo sapiens
tgtccctaatttgagaatcacaggaaacatactagctgacagtttcactgtgttaatctctggggaga

SEQ ID NO: 14072 - DNA, 112 bp, Homo sapiens
tagctagacatggtggcatgtgcctgtggttccaactactcaggaggctgaggtggaaggatcacttcagcccaggagtttaaggctacagtgagctatgattgtgtctcta

SEQ ID NO: 14073 - DNA, 58 bp, Homo sapiens; identical to SEQ ID NO: 1409

SEQ ID NO: 14074 - DNA, 115 bp, Homo sapiens
gtgccaggatttcaattcaataagggggctgaagaaatggattacatcattgtctatatttgattttcttttgctgtcagtgagggtcccgtgcttcatcctgattttcctccac

SEQ ID NO: 14075 - DNA, 86 bp, Homo sapiens
ttttcctggcaagcagtgacacttctatggatttgctatgataatatggtgaatctcaggtgtagagttctagtgctcctggaaaa

SEQ ID NO: 14076 - DNA, 105 bp, Homo sapiens
gatatcatgcaaagtgggtggcttagttaatgtttctattttctttctatgggactcttagaatattatatgcaaacaatctgagctaaggttgcataagatgtc

SEQ ID NO: 14077 - DNA, 134 bp, Homo sapiens
ccagctttgttcttttggcttaggattgacttggcgatgcaggctcttttttggttccatatgaaatttaaagtagttttttccaattctgtgaagaaagtcattggtagcttgatggggatggcattgaatct

SEQ ID NO: 14078 - DNA, 114 bp, Homo sapiens
agcaagattaagagtttgaagatttgggctgtgtgattcatatgaaaagaagtatgatgacaattataaggctgataatgatatacaggcctggtccacgtacttgggatagct

SEQ ID NO: 14079 - DNA, 97 bp, Homo sapiens
gcaatgcggactcttttttggttccatatgaaatttaaagtagttttttccaattctgtgaagaaagtcattggtagcttgatggggatggcattgc

SEQ ID NO: 14080 - DNA, 68 bp, Homo sapiens
gccccttataaaactattagattttgtgagaactcagtcactgagtctgatgtttgagcacgggaagc

SEQ ID NO: 14081 - DNA, 112 bp, Homo sapiens
agtgtgataccaaagtaagcctttcttttgctcacaagtttgtgcatctgcatctgcttcaggtgctagtcttcctgtgagctgagattgctcttctgatgtgtccctcatt

SEQ ID NO: 14082 - DNA, 118 bp, Homo sapiens
aatatggattgcaagactgaagaataaaggagatatccaaggtagagatccaagaagcttgcctcactcagtctctgaaataggacttgggagactccatttttcttgttcccaaatt

SEQ ID NO: 14083 - DNA, 87 bp, Homo sapiens
agtgctattacccatctactttcacactctcacatatacatgtgtatatatatatgtgtgtgtgtaagtacatatatatttagtgtt

SEQ ID NO: 14084 - DNA, 78 bp, Homo sapiens
tgtatatatgtacatatatgtatgtatataagtatatgtatgtatacatatatacacacatatatgtgtatatatata

SEQ ID NO: 14085 - DNA, 74 bp, Homo sapiens
gtatatgtgtatgtatatatgtacatatataaaacttgtgtatatgtgtgtgatgtgtgtacatatatatgtat

SEQ ID NO: 14086 - DNA, 121 bp, Homo sapiens
atgtatatttacacacacgtaatggtgtgtgtgtgtatatatatatatatgtatatatacacacacatacatatacatgtaatggtatatatatacatatatacacacatttaatggtgta

SEQ ID NO: 14087 - DNA, 101 bp, Homo sapiens
tatatgtatatatataccattacatgtatatgtatgtgtgtgtatatatacatatatatatatatacacacacacaccattacgtgtgtgtaaatatacat

SEQ ID NO: 14088 - DNA, 98 bp, Homo sapiens
caataccatttgaaatgtatttattcattcattctatgtatatttgtgtatatgtacatttattgagtgactactaagtgctagtcactgtggagttg

SEQ ID NO: 14089 - DNA, 75 bp, Homo sapiens
gctggggacactgagcttgtaaactctggatgaacactttttgccagaagaaacagaaacagcttccccatccgc

SEQ ID NO: 14090 - DNA, 94 bp, Homo sapiens
tgtttcaatttggaaagtgcaatgagcagagcttcagaagagagtgtttgctttctgtgaagctctctctcattcacttggcttagacactgca

SEQ ID NO: 14091 - DNA, 103 bp, Homo sapiens
agctcattgccataactaaggtaaagtgtatttcttaccattatcttacagaaggttttaaagttttgcactttacatttaggtctatgagaaattttgagtt

SEQ ID NO: 14092 - DNA, 109 bp, Homo sapiens
tagaggaatatatataggtatgtatatacacctatataaatataggtgtatattcacatatatctatatttatatatgtgtgtatacatgagtgcatatttaactttta

SEQ ID NO: 14093 - DNA, 93 bp, Homo sapiens
atgtatgtgtatatagtatatgtatatgtatgtaagtatatatacactatatatagtatatgtatagtatatatagtatatatacgtatatac

SEQ ID NO: 14094 - DNA, 101 bp, Homo sapiens
gacattattacaagtactaagacatgctctgtgcctctgtgcctgctacttccagagtcccagttcatagaggtggtataatttcttatgcataaaatgtt

SEQ ID NO: 14095 - DNA, 98 bp, Homo sapiens; identical to SEQ ID NO: 1311

SEQ ID NO: 14096 - DNA, 92 bp, Homo sapiens
gctgttcttagtaagatttctcatttcatgttcaggattatggagaggttgatgtctttttatttctatgagacaatctactgtaggaaagc

SEQ ID NO: 14097 - DNA, 191 bp, Homo sapiens
tatacatatatgtgtatctatatacatatatgtatatagatacatatatatgtatatatacatatatgtaaatatatacatatatatgtaaatatatacatatatatgcaaatatatacatatatatgtaaatatatacatatatatgtaaatatatacatatatatgtaaatatatacatatattttttg

SEQ ID NO: 14098 - DNA, 106 bp, Homo sapiens
gatggttgatagccaaatgtgatattaagcagcatataaaaattgatttttaaattatcataaaaggccccatatactggtaattctcatttagctatcttttgtc

SEQ ID NO: 14099 - DNA, 84 bp, Homo sapiens
gtattcttgttggtatggtattcattttgtaattctgaaatcacttcatcagtactgaatgaaacctcaaattaataaagatat

SEQ ID NO: 14100 - DNA, 103 bp, Homo sapiens
tgcatgaagcacacattcctatctttgccacaaaacatacatctgatgggagaaggtcctgtctgatgtgagtgtgcagaagtgtgatggttaattttatgta

SEQ ID NO: 14101 - DNA, 93 bp, Homo sapiens
tatataagtttagattatatatatatacacacacacacgtgtatatatgtatatatgtgtgtgtgtatatatatgtgtatgtatatgtgtata

SEQ ID NO: 14102 - DNA, 111 bp, Homo sapiens
agagtgatcttgttttgtgtttaagttgaggaccgtaagtcactgtgtctgagtggctcgctgttgttatgtgggaacttgggaggtgcaaactctatatggctttcagct

SEQ ID NO: 14103 - DNA, 108 bp, Homo sapiens
ttggactcttcactgaatgatgtaccgtacactgtaccaaacgttgtaagaaatacgttttacacattttgttattgtgtgggcatatgtttgttttgatttgtttaa

SEQ ID NO: 14104 - DNA, 58 bp, Homo sapiens
tatgtgcttcatattgaatatatatatatgtgtgtgtgtgtgtgtgtgcaagcgtgtg

SEQ ID NO: 14105 - DNA, 108 bp, Homo sapiens
agcacttgactttgttattttttgatacactatgtttgtatatatttatgggacatatatgaaattttattacatgcatagaatgtgtgataatcaggttgaggtgtt

SEQ ID NO: 14106 - DNA, 71 bp, Homo sapiens
ggtccatttggtctctagtgcagattaagttcaatgtttccttactgactctctgtctggaagagtggtcc

SEQ ID NO: 14107 - DNA, 77 bp, Homo sapiens
atgtgtgcacatatgtgtgtgtatatgaaaatataataaatatacatatatatatatttccacatagtgacacacat

SEQ ID NO: 14108 - DNA, 61 bp, Homo sapiens
gagtgggcattcttgtcttcttccagttctcaaaggggatggtttgagcttttgcccattc

SEQ ID NO: 14109 - DNA, 62 bp, Homo sapiens
agatgggcggagtctcgctctctcgctcaggctggagtgcagtggcaggatctcggttcact

SEQ ID NO: 14110 - DNA, 73 bp, Homo sapiens
gtatatatatgtgtatatgtgtgtatgtgtatacatatatatatatatatatatatatatatatatatatgta

SEQ ID NO: 14111 - DNA, 116 bp, Homo sapiens
tgtttttagcatatgtagtaatcgcacctatctcaattctaatactagtatttttattttattttattttatttttttgagagggagtttcgtgcttgttgccaggctggagtgca

SEQ ID NO: 14112 - DNA, 95 bp, Homo sapiens; identical to SEQ ID NO: 68

SEQ ID NO: 14113 - DNA, 93 bp, Homo sapiens; identical to SEQ ID NO: 69

SEQ ID NO: 14114 - DNA, 85 bp, Homo sapiens
ggtgacttgtgtttttggtcttttaacaatatcttttgaggaatagatattttaaattttaatgttgtcaaagttataagtcact

SEQ ID NO: 14115 - DNA, 58 bp, Homo sapiens
tgagatggagtctcactctgtcacccagcctggagtgcaacggcgagatctcagctca

SEQ ID NO: 14116 - DNA, 114 bp, Homo sapiens
ttatgtattcagtattagggttgaatattgattatcttctttgtcatcatatatatatgtgtatatatatgattagatgaattctcatgtatgttccctcgaatggtcctataa

SEQ ID NO: 14117 - DNA, 108 bp, Homo sapiens
gctgatcactacttccatctatgtgtaaatatagtgttttagtaatttattattataaacacactagtgtatatgtatatttttcatgaaagtataggtgatgtcagc

SEQ ID NO: 14118 - DNA, 98 bp, Homo sapiens
gtgctggattttgtattgaaatatatatatgtacgtatatgcatacatatacgtatgtatatatgtatatatacatatgagattccaaaagatgatac

SEQ ID NO: 14119 - DNA, 78 bp, Homo sapiens
tgtaacccataaatatgtacagacattatgtacatatttatgtacataatgtatttgtaacattatttatttgtaaca

SEQ ID NO: 14120 - DNA, 115 bp, Homo sapiens
ttagaatatgctatttatgcttaaatttcaaaggagcttgcaaaggagattatttttaaataatcagctgattttaggtttcattcatgaattttgaggtggattttttttctag

SEQ ID NO: 14121 - DNA, 117 bp, Homo sapiens
ggaacatactctagatgtattatccttagtcatcctttgaagtttttatttttccttaataaagagcttgtcatggttattttgaatttatggataatacattgtccctacatgttt

SEQ ID NO: 14122 - DNA, 90 bp, Homo sapiens
cacctctccctcctggcaattacacacatatattgaatactgaatactgaatattgaatatatgtgtgtagttatcaagaggaagaagtg

SEQ ID NO: 14123 - DNA, 92 bp, Homo sapiens
atattttaagcagtgtatgcagttgaaaaatagaggcagcgatatgattatttgcattttttataaacaagtgtgtaaattgtggtgaatgt

SEQ ID NO: 14124 - DNA, 93 bp, Homo sapiens
tgctgtggaccctcctcttgccaacagtattcataggaaattgaaaccaaacctgtaaaaatgtctgttgtaaagataaagaggcacttagca

SEQ ID NO: 14125 - DNA, 127 bp, Homo sapiens
atatatatatatatatatatatatatatatatatatgtgtgtgtatatatatatatatatatatgtgtgtatatatatatgtgtgtatatctatatatatatgtgtgtatatatatatatgcaagta

SEQ ID NO: 14126 - DNA, 93 bp, Homo sapiens
ttgtaatagacattgtgaaggtatactgaaaatttttttttttttttaagacagagtctttcagtgtcgcccaggctggaatgtgcagtgcaa

SEQ ID NO: 14127 - DNA, 78 bp, Homo sapiens
gctatggcacgccacctcccacctggttaaaagcatgtattttgcttatattttttaatcaggattgagtgaccaagt

SEQ ID NO: 14128 - DNA, 105 bp, Homo sapiens
ggcttaagaaggtgtgtgtgtgtgagagagagagagagagagagagagaagcagttttctaattttctttctggttctattttcatattatatatattctttgtt

SEQ ID NO: 14129 - DNA, 74 bp, Homo sapiens
atatatacatacatacatatatatatatatatatatacacacatagatatactcatatgtgtgtgtgtatatat

SEQ ID NO: 14130 - DNA, 107 bp, Homo sapiens
caatggtactgtagtgtttaaaaaatataccttggaaaccaaagagttattaagttgttttgttttgttttccaggtatatttcatgaacaaatgaaaatatttttg

SEQ ID NO: 14131 - DNA, 85 bp, Homo sapiens
caatatatattcattgtatgtatattcatatacaatgaatacaatatacaatgtatattcatatacatacaatgaatatgtaatg

SEQ ID NO: 14132 - DNA, 58 bp, Homo sapiens; identical to SEQ ID NO: 1101

SEQ ID NO: 14133 - DNA, 56 bp, Homo sapiens; identical to SEQ ID NO: 1102

SEQ ID NO: 14134 - DNA, 86 bp, Homo sapiens
tagaatgtatatacgtgtgtatgaatttatgtgtgtacatatatatttacacatatatgtatatacacatatatatgtaaattcta

SEQ ID NO: 14135 - DNA, 119 bp, Homo sapiens
aggtttacaagataaaagagaagccaacgtcagcttactagtgttttttttttctttatttagcaagaaaagccaagcttgtgaggacctaggtgtctctctatttcagtcaacagcct

SEQ ID NO: 14136 - DNA, 83 bp, Homo sapiens
ctccatgtctgtctgtctgggctttatttatttatttatttatttttttgagatgaagtctcactctgtcactcaggctggag

SEQ ID NO: 14137 - DNA, 111 bp, Homo sapiens
tgctgaagtgggcagacactgtttagtgaggagcaggggaggcagagcgttgtgtggtatgtagtctgcctactcttccataccatggctgcagtatctgtttttgtggca

SEQ ID NO: 14138 - DNA, 100 bp, Homo sapiens
gtgctattgtactaaattttaagcttgatcctgtcatgaaaagttatacaatataattttttgatgtgatagattgtttaagacggatgagcagtttcac

SEQ ID NO: 14139 - DNA, 56 bp, Homo sapiens
acaactatgtatatctatatctatatataggcatatatagatatagatatagttgt

SEQ ID NO: 14140 - DNA, 87 bp, Homo sapiens
tatattgcatatatatatatatatagcatatatattgcatatctatagcatatatattgcatatctatagcatatatattgcatata

SEQ ID NO: 14141 - DNA, 78 bp, Homo sapiens
tgcaatatatatgctatagatatgcaatatatatgctatagatatgcaatatatatgctatatatatatatatatgca

SEQ ID NO: 14142 - DNA, 112 bp, Homo sapiens
ggattgtcttggatacacgggctctttttttggttccatatgaaatttaaagtagtttcttttaattctgtggaaaaggcaatggtagcttgattggaatatcattgaatct

SEQ ID NO: 14143 - DNA, 89 bp, Homo sapiens
tgggtctctatgtttgcaacttttctctttattattgccactgaagttacccagctgacaagtgagagagaagagacagcagaaaccca

SEQ ID NO: 14144 - DNA, 69 bp, Homo sapiens
gctgagtgtggtggcatgtgcctacagtctcagatacacaggaggctgaggtaggaggatcgcttgagc

SEQ ID NO: 14145 - DNA, 76 bp, Homo sapiens
atatatatacacatacatatgtatgtatatatatacacatacatatgtatgtatatatgtatacacacatatatat

SEQ ID NO: 14146 - DNA, 129 bp, Homo sapiens
tatatagatatagatctatatctatatagagagagatctatatagatatagatctctatatatatctctatagaagatctatatatagatatctatatttctatagatctatttgtagatatctatata

SEQ ID NO: 14147 - DNA, 91 bp, Homo sapiens
atatatatatgtatgtgtatatatatatatgtgtgtatatacatatatacatatacatatgtgtgtgtatatatatataaaatatatatat

SEQ ID NO: 14148 - DNA, 61 bp, Homo sapiens
gtatgtgtgtctgtgtatatgtgtattttatttatatatatggatatatacacacaggggc

SEQ ID NO: 14149 - DNA, 112 bp, Homo sapiens
agagtgttaaattttgtaaaatgccttttctgtatctattgagatgatagtacgttttttatctttattttgttaatgtggtatatgggcatacattattttattgtactct

SEQ ID NO: 14150 - DNA, 95 bp, Homo sapiens; identical to SEQ ID NO: 580

SEQ ID NO: 14151 - DNA, 93 bp, Homo sapiens; identical to SEQ ID NO: 69

SEQ ID NO: 14152 - DNA, 166 bp, Homo sapiens
atatatatatatatatatatgtatatatacatgtgtgtgtatatatgtatatatacatatgtgtgtatatatgtatatatacatatgtgtgtatatatgtatatatacatatatgtgtatatatgtatatatacatatatgtgtatatacatacatatacatatat

SEQ ID NO: 14153 - DNA, 101 bp, Homo sapiens
atatatactatatgtatatactatatatacatatatactatatgtatatataaatatatatactatatatatactatatatgtatatgcatatactatatg

SEQ ID NO: 14154 - DNA, 94 bp, Homo sapiens
gatgggcataagattatacctcaatgtgcttttaatttttatttttctaatgattagtgatattgaacatatttttatgtgtttgttgcccatt

SEQ ID NO: 14155 - DNA, 92 bp, Homo sapiens
gtgtatgtatgtatgtatgtatgtatgtgtgtgtgtgtgtgtatatatatcatatatatacacatatatatgatatatatacacatatatat

SEQ ID NO: 14156 - DNA, 85 bp, Homo sapiens
gggaataagacacattataatataaatgaaacagttgagaataaaacatcatttatatcaattgttttatatatatgcttgtctc

SEQ ID NO: 14157 - DNA, 113 bp, Homo sapiens
aatttactgtttcttccaaccagcacctgaagatagggctcctgtctcccactctctgtggaacgtaggagcttataacttcaatcaggccggttgtcaaacccagataggtt

SEQ ID NO: 14158 - DNA, 111 bp, Homo sapiens
agaaacaggtaagcagaggaagattagagagataccttggttctgaggcttatttctgttttttcttttctttcttttttttttttttttgagacagggtctctctctgtc

SEQ ID NO: 14159 - DNA, 116 bp, Homo sapiens
tttactgaagagaaaatggttaatgaggtaataatcccaccttcaatttttttttaaattatgttggaattaaagcttagattttcattaaaattctacattctcttataagtaaa

SEQ ID NO: 14160 - DNA, 68 bp, Homo sapiens
acatatatatgtgtgcatttatatatatacacatatatgtctatatataaatgtatgtatgtgtgtgt

SEQ ID NO: 14161 - DNA, 81 bp, Homo sapiens
agcacttcacttctttgtttataaatctattacttggatccattggtctaggtattaggaaagtaatctgggtgtaaggct

SEQ ID NO: 14162 - DNA, 102 bp, Homo sapiens
acactttatatgaatatatacattatatatgtatacatattttgtatatgtataaatatatttaatatatatgtatatgtgtatatgtatatacacacaaag

SEQ ID NO: 14163 - DNA, 111 bp, Homo sapiens
ggtttatcctctgcgggtttaaatgtactattttctttcctaggactgcttcaactctctgtatctcactgggaaacatctagtcaccattcaaaaccagtttcaactacc

SEQ ID NO: 14164 - DNA, 99 bp, Homo sapiens
gtattcctaggtatttttttctcttcgtagcaattgtgaatgggagttcactcatgatttggctctctctgtttgtctgttattgatgtataggaatgc

SEQ ID NO: 14165 - DNA, 101 bp, Homo sapiens
tatgggttcttttttggttccatatgaaatttaaagtagtttttttctaattctgtgaagaaagtcattggtagtttgatggggatagcattgaatctata

SEQ ID NO: 14166 - DNA, 72 bp, Homo sapiens
catacatatatgtgtatatatatgtgtgtgtatatatacacacacacatacacatatgtatatgtatgtatg

SEQ ID NO: 14167 - DNA, 91 bp, Homo sapiens
gtcagggagtgattcatgcattggaaagagcactctaggcagagagaacagtgagtgctcttgtaagtggacatgaaccagctaagaagac

SEQ ID NO: 14168 - DNA, 68 bp, Homo sapiens
tgtgtatatgtacatatatatgtatatgtgtatatgtacatatatatgtatgtatgtatatgtataca

SEQ ID NO: 14169 - DNA, 123 bp, Homo sapiens
gatagatctataaatatgtagatctataaatagatctatatatctatagatatgaatctatagatctatctctcaatatatatatctagataaatatatattgatatagagataggtatagat

SEQ ID NO: 14170 - DNA, 80 bp, Homo sapiens
atatctatctatacctatctctatatcaatatatatttatctagatatatatattgagagatagatctatagattcatat

SEQ ID NO: 14171 - DNA, 111 bp, Homo sapiens
gctgaattttgattccagctctatcaggttgtactcagtattgtgatcttaattagtcattttatttctttgtgctttagttttctggtttgtgtatggtcaaaataaggc

SEQ ID NO: 14172 - DNA, 98 bp, Homo sapiens
gcaaaaatgtttcccagctcttggcccatctgtctctgtcagtccatcctgtgggggcagggaatgcaggttgagctcagagggcaggatcccagagc

SEQ ID NO: 14173 - DNA, 118 bp, Homo sapiens
gcctacagagcacctgcacaaattttaataagatagttcatgaggtgagatttttatttatattttattttatttttatttatttatttgagacagagtctggctctgtcgcccaggc

SEQ ID NO: 14174 - DNA, 130 bp, Homo sapiens
ttatatatgtatatatgcatatatatactaatatataatttgtatatataaattatgcttgtatatataaattatacttgtatatatattatatatacaagcatatatagtttatatatatatatatata

SEQ ID NO: 14175 - DNA, 68 bp, Homo sapiens
agtatataagtattgtataagtatttatacatatttataagtatatgtacttatagatacttgtgtct

SEQ ID NO: 14176 - DNA, 95 bp, Homo sapiens
aggctctttgtttggttccatatgaattgtaaaatagttttctctagttctgtgaagaatgtcaattgtaatttaatgggaacagcattgaatct

SEQ ID NO: 14177 - DNA, 76 bp, Homo sapiens
ccacagcagcgaagccaaggcagttgtagggggaacgggggttccctgctgaagactgtgtgcactgttgcactgg

SEQ ID NO: 14178 - DNA, 74 bp, Homo sapiens
ctgggcatggtggcataaacctatagttccacctactcaggggaggctgaggttggaggatcacttgagcccag

SEQ ID NO: 14179 - DNA, 86 bp, Homo sapiens
tttttgggatgctcaaggcattttgttgttgactttctggagggccaaagaacaataccatctgcttattatgagtgttttgagaa

SEQ ID NO: 14180 - DNA, 105 bp, Homo sapiens
gatttgggacatgactgcatacatttgaaaggggagggcaatggtgaattattatttatagttcttctcatatcttttatacctctgtagtttctattacatatc

SEQ ID NO: 14181 - DNA, 114 bp, Homo sapiens
tagtattgtcttggctatttgggctcattttggttccatatgaaatttaaagtagttttttctaattgtgtgaaaaaagtcaatggtagcttgatggggatagcattgaatcta

SEQ ID NO: 14182 - DNA, 90 bp, Homo sapiens
acatatatatatatacacacacacacacacacacacatatatatgtgtgtatatatacatatatatgtgtgtgtatatgtacatatatgt

SEQ ID NO: 14183 - DNA, 115 bp, Homo sapiens
tctttgcggatgaatggtactttccacaagtgcatttgagtagaagcataacctattctcagttatatttatgtttaaaacatgtactggtttgtatattttgtactgaaaaaga

SEQ ID NO: 14184 - DNA, 95 bp, Homo sapiens; identical to SEQ ID NO: 68

SEQ ID NO: 14185 - DNA, 93 bp, Homo sapiens; identical to SEQ ID NO: 69

SEQ ID NO: 14186 - DNA, 112 bp, Homo sapiens
tgtataatctcttctgcacactctcagactagtgttatagagaacaaaatcttttttttttttgagttggagtagtctggctctgtcgcacaggctgaagtgcagtggtgca

SEQ ID NO: 14187 - DNA, 95 bp, Homo sapiens
gtcaggtggctctttacctgttgttgtagtagcttgaatagttatattctgtttatttgagactgggcaattcttttttaaatggccaatttgac

SEQ ID NO: 14188 - DNA, 118 bp, Homo sapiens
ccagctttgttcttttggcttaggattgtcttggctatgtgggctcttttttggttccatatgaaatttaaagtagttttttccaattctgtgaagaaagtcagtagtagcttgatgg

SEQ ID NO: 14189 - DNA, 58 bp, Homo sapiens
tgagacggagtctctctctgtcacccaggctggagtgcggtggtgtgatctcggctca

SEQ ID NO: 14190 - DNA, 114 bp, Homo sapiens
atcttctgatgaatagaagatttttattctgatgacgtataatttattattattttttctttaatggtttgtgacttctgcctttttccagaaaatctttgcttatcacaaggt

SEQ ID NO: 14191 - DNA, 142 bp, Homo sapiens
gtgtatatatatatatatacacgcacacacatatatatgtgtgtatatatgtgtgtatatatatctgtatgtatgtatatatgtatacatatatatctatatatgtgtatatagatatatgtatgtatatatgtatacatat

SEQ ID NO: 14192 - DNA, 76 bp, Homo sapiens
ctctttagtactagagtcctcagtaggtacctgtgtgagacaggtagaggtctctcactgtcactaatacttggag

SEQ ID NO: 14193 - DNA, 113 bp, Homo sapiens
accaacaagttccaggtctcggaggcagttttcaagtgctaattagttagtgtctatcaaggactcagaagtcactgaggacaacccctcaaggcaaatatttccaaatcggt

SEQ ID NO: 14194 - DNA, 110 bp, Homo sapiens
tagatattataataatctgcttgaatatgatgtattgaactctcattgattatatccgtatttctttgattattgtaagtttggaatttttagcagatttttggtttcta

SEQ ID NO: 14195 - DNA, 118 bp, Homo sapiens
tgtcttcttttgagaagtgttgttcatgtcctttgcccactttttaatgtttctttttcttgtaaatttgtttaagttccttgtagattctggatattagaccttcatcaaatggata

SEQ ID NO: 14196 - DNA, 89 bp, Homo sapiens
gaggtctggaaccaaacacacagtgtctctgaggtatgccagaatttgagatatctctaaatgaaatactgggcttcattcctgacttt

SEQ ID NO: 14197 - DNA, 60 bp, Homo sapiens
ctgacatgagagagacgagacaggcttagcctccaagcctgcatctttctcttgtgctgg

SEQ ID NO: 14198 - DNA, 77 bp, Homo sapiens
tacaattcctgctgagatcaatcagtcttgggagcatgcacgctccctctgtctctctgaccttaacataagctgta

SEQ ID NO: 14199 - DNA, 124 bp, Homo sapiens
aagtagtagggaagtaattgagagcagaatgtgtgtgtgtttgtatgtgtgtgtatatattttacataattatatatatactatatatattaattataagctgtggaatttgaacaaattattt

SEQ ID NO: 14200 - DNA, 74 bp, Homo sapiens
gttttgatcctgtctgtggttagctggttgttttgtagatgcaattgtgaagctgctttatagggtctgtgggc

SEQ ID NO: 14201 - DNA, 71 bp, Homo sapiens
tatgtacatattaaatatatatatataacatacacatattacatgagtatgtattatgtaatatgtacata

SEQ ID NO: 14202 - DNA, 84 bp, Homo sapiens
atgtatatatatatgcatatgtaggcatgtgtatatatgtatataatatacaacatgcatatatatgtatatataaacatacat

SEQ ID NO: 14203 - DNA, 97 bp, Homo sapiens
cttatgaagcttagtttggctggatatcaaattctgggttgaaaatttttttctttaagaatgttgaatattggtccccactcttctagcttgtagg

SEQ ID NO: 14204 - DNA, 67 bp, Homo sapiens
gctaagtgtagagaaggctttgagtgagtctgtctcactcaagatctgagcacctaatcactatagc

SEQ ID NO: 14205 - DNA, 80 bp, Homo sapiens
tatgtgtgtatatttgtatatgtgtgtgtatctatctctccatatatatatatacacacacacacatatatatacatatg

SEQ ID NO: 14206 - DNA, 70 bp, Homo sapiens
tgtatatatatgtgtgtgtgtgtatatatatatatggagagatagatacacacacatatacaaatataca

SEQ ID NO: 14207 - DNA, 58 bp, Homo sapiens
tgagacggtgtctcactctgtcgcccaggctggagtgcagtggtgtgatctcggctca

SEQ ID NO: 14208 - DNA, 97 bp, Homo sapiens; identical to SEQ ID NO: 1307

SEQ ID NO: 14209 - DNA, 88 bp, Homo sapiens; identical to SEQ ID NO: 1308

SEQ ID NO: 14210 - DNA, 81 bp, Homo sapiens; identical to SEQ ID NO: 1309

SEQ ID NO: 14211 - DNA, 77 bp, Homo sapiens; identical to SEQ ID NO: 1310

SEQ ID NO: 14212 - DNA, 95 bp, Homo sapiens; identical to SEQ ID NO: 68

SEQ ID NO: 14213 - DNA, 93 bp, Homo sapiens; identical to SEQ ID NO: 69

SEQ ID NO: 14214 - DNA, 89 bp, Homo sapiens
gtaagagagaaccattatatttcacttaccatattgaacaattacatgtgcatttgtagtggtgaaattttaaatgagttttcttttat

SEQ ID NO: 14215 - DNA, 78 bp, Homo sapiens
ggctctctgactgactccttcgcagatcttctcggcttagcggctgaagactgacactgcccgatcgcctcggaagcc

SEQ ID NO: 14216 - DNA, 95 bp, Homo sapiens; identical to SEQ ID NO: 68

SEQ ID NO: 14217 - DNA, 93 bp, Homo sapiens; identical to SEQ ID NO: 69

SEQ ID NO: 14218 - DNA, 113 bp, Homo sapiens
acagtggtagaatttgaactcaggtagccattctggtaccttttgtttatttgtttttgacccaaagaaacacaagacatcagtgggcttttctaagtaacttcccaaattgt

SEQ ID NO: 14219 - DNA, 97 bp, Homo sapiens
gacttcttcccaaatgtgtgatctgggccctggtgtcagatgtacacattttcttgaagtgagtcaacagagggcattttagggctcaggaaatcat

SEQ ID NO: 14220 - DNA, 108 bp, Homo sapiens
attataaactgatatagatagatacaatatatggcatactattttttctttatctagaaaaataattgtcatattaattttgaaatcatttgtgtattagttgttgat

SEQ ID NO: 14221 - DNA, 86 bp, Homo sapiens
ggatttgaagattcagtactgcacaatatctaaaaaatgattctagcttgttttctatagaaattgacagactgattctgaaattc

SEQ ID NO: 14222 - DNA, 105 bp, Homo sapiens
atctgaagatgctgacagctgagggtgattgtttcattgtttttgtatattgtgaacaagaagcccagtgttttatgctcccttgctgcctgtgcagctgcagat

SEQ ID NO: 14223 - DNA, 116 bp, Homo sapiens
gctcaaatgtaatctgtagtgatatttaagctatggtgaataatttaatttttctaaaagataagggaaatgggggttgttaaggcagaaatacattggaacagaattgctaatgc

SEQ ID NO: 14224 - DNA, 144 bp, Homo sapiens
tatatatatacatatacgtatatatatttgtgtatatatatatatacacaaaagtatatatatacaaaagtgtgtatatatatacttttgtgtatatatatattacaaaagtgtatatatatatacttttgtgtatatatattt

SEQ ID NO: 14225 - DNA, 136 bp, Homo sapiens
tatatatactatatgtgtgtatatatacatatatactatatacgtatatatgtgtatatatatacgtatatagtatatatgtatatatatacgtatatagtatatatgtatatatatacaaaactatatatgtata

SEQ ID NO: 14226 - DNA, 110 bp, Homo sapiens
gttttagaggagggggtcttctgtcaacaatatttagatcagttgtagttaaaacttttttttttcctatctggaatgtgattttaatagaagattctatttgaataaac

SEQ ID NO: 14227 - DNA, 95 bp, Homo sapiens; identical to SEQ ID NO: 68

SEQ ID NO: 14228 - DNA, 93 bp, Homo sapiens; identical to SEQ ID NO: 69

SEQ ID NO: 14229 - DNA, 83 bp, Homo sapiens
aaactatatatacacacacacacacacacacatatatatgtatacatatatgtatgtatgtatatatgagtatatatatgttt

SEQ ID NO: 14230 - DNA, 106 bp, Homo sapiens
aaattatttcaggtagatagagaggataaggggtccttggtaaggttttattttcttttaaagcagctccagaaacatttcttttctagcagaaaaatgatttgaa

SEQ ID NO: 14231 - DNA, 117 bp, Homo sapiens
gtccagctatgtcggcaggacagagaaaggcctgtgcttgctgcacaacagtgagaagtcactgtagagaggaggtacaggaagtgggctctccttgctttggggttggagttggat

SEQ ID NO: 14232 - DNA, 63 bp, Homo sapiens
tatatatatcatatatatgatatcatatatatgaatatatgatatcatatatatgaatatatg

SEQ ID NO: 14233 - DNA, 119 bp, Homo sapiens
tgcttagaattgtcttggctatgagggctcttttttggttccatatgaaatttaaagtagttttttctaattctgtgaagaaagtcattggtagctggatggggatagcattgaatcta

SEQ ID NO: 14234 - DNA, 112 bp, Homo sapiens
ttataatgccagatatgcaatggtatggcaatattttaaaaaaccaaattggaaattatctgaatttttaagattgaggcatagttgactaaattgtgatttggcagaataa

SEQ ID NO: 14235 - DNA, 104 bp, Homo sapiens
atgtgtatatatgtatatatgtatataagtgtgtgtatttatatgcatatatgtatatatgtgtatataatgtatatacatatatgtgtatataatgcacatac

SEQ ID NO: 14236 - DNA, 95 bp, Homo sapiens; identical to SEQ ID NO: 68

SEQ ID NO: 14237 - DNA, 93 bp, Homo sapiens; identical to SEQ ID NO: 69

SEQ ID NO: 14238 - DNA, 113 bp, Homo sapiens
gtacaactatactgaaagagtttggcagggtttttatttatttatttatttatttatttatttatttatttattttgagctggagcctcactctgttgcccaggctggagtac

SEQ ID NO: 14239 - DNA, 85 bp, Homo sapiens
ctgccaagctctttattatttttcaaactgtgatggtgaatcttccttttttttttttaaaccatgaaatgagagggctgggcgg

SEQ ID NO: 14240 - DNA, 95 bp, Homo sapiens
ctctctatgtatgtgtatatatatgtatgtgtatgtatgtgtatgtgtgtgtatatatatgtatgtgtatatatatgggtgtatgtgtgtataca

SEQ ID NO: 14241 - DNA, 86 bp, Homo sapiens
tgggtgtatgtgtgtgtgtatatatatgtgtgtgtgtgtatatatatatatatatttgtgtatacacacatacgtccatgcaccca

SEQ ID NO: 14242 - DNA, 237 bp, Homo sapiens
tatacatacgtgtgtgtatatatacatatatgtatatatatgtgtatatatacatatatgtatatatgtgtatatatacatatatgtatatgtgtgtatatacatatgtgtgtatatacatatatgtataggtgtgtatatatacatatatgtatgtgtatatatacatatatgtatatatgtgtgtatatattcatatgtgtatatgtgtgtatatatacatatatgtgtatatgt

SEQ ID NO: 14243 - DNA, 185 bp, Homo sapiens
tatgttttgcttttaaaatttcatatatatatacatatactacaaatatgtatatatatgtgtatatatgtatacatgtgtgtgtatatatatgtgtgtatatatatacatgtatgtgtgtatatatatatacatatatgtgtgtatatatatatacatacatgtgtgtatatatatatgtatgt

SEQ ID NO: 14244 - DNA, 99 bp, Homo sapiens
gaaacatgttgttcatccctgaatttttctgttgtctgtagagctgtctgtctctcagcggctcttaaggtttggtttaagagtaatacaacatctttc

SEQ ID NO: 14245 - DNA, 73 bp, Homo sapiens
tgagacaagatagtgtgtgtatgtctgtgtgtgtatacatcatacatacacgcagacacattgttctttttca

SEQ ID NO: 14246 - DNA, 77 bp, Homo sapiens
agtgatgagagtgctgactgcctgattgccagccttttctaggctttgccaactcactgtcattcactttttctact

SEQ ID NO: 14247 - DNA, 119 bp, Homo sapiens
ctttagcttttctggatcttttttgattaatacaagtgtcaggctaattttttctatttttgtgaaaactgacattggtgttttgatagggattgaattgaatctgtagattgctttgg

SEQ ID NO: 14248 - DNA, 102 bp, Homo sapiens
tatgggctcttttttggttccactatgaattttaaaatagtttttttctaaatctgtgtagaaagtcactggtagtttaatgggaatagcactgaatctata

SEQ ID NO: 14249 - DNA, 122 bp, Homo sapiens
aaagaaaaaaagaagaactgtgtgaaggtatatatctttatctttctcaagatacatgatgtatgttgtaaagattttacaagataactgtgcattttattaatattctgcgtactttttct

SEQ ID NO: 14250 - DNA, 114 bp, Homo sapiens
ggaagtggcttcaagaggtaattatttagctcacgaggggagtgagacatgactgctgtcacaccctgtcacactccaatgcctctctgggcctgataattaaagggcactcac

SEQ ID NO: 14251 - DNA, 58 bp, Homo sapiens
gctgcttcctggttcatagagagctgtcttctctgtgtccttacttggtggaaggggc

SEQ ID NO: 14252 - DNA, 95 bp, Homo sapiens; identical to SEQ ID NO: 68

SEQ ID NO: 14253 - DNA, 93 bp, Homo sapiens; identical to SEQ ID NO: 69

SEQ ID NO: 14254 - DNA, 86 bp, Homo sapiens
acacacacacacatacacatatatagatgtatatatgtatatatactatatatacacacatataatatgtgcatgtgcaggtgtgt

SEQ ID NO: 14255 - DNA, 69 bp, Homo sapiens
cccgcagtttgagtctgtgtgtgtgtccagggatttaaaggaaaacatgtggagaccaaattagtgtgg

SEQ ID NO: 14256 - DNA, 58 bp, Homo sapiens
tgagactgtgtcgcacactgtcacccaggctggagtgcactggtgtgatctcagctca

SEQ ID NO: 14257 - DNA, 69 bp, Homo sapiens
ctgaggattctcagacattctgtctcactagcaaagaacattctgatgagtgagtgatgtctgccacag

SEQ ID NO: 14258 - DNA, 95 bp, Homo sapiens; identical to SEQ ID NO: 68

SEQ ID NO: 14259 - DNA, 93 bp, Homo sapiens; identical to SEQ ID NO: 69

SEQ ID NO: 14260 - DNA, 73 bp, Homo sapiens
ggcttgtggacggatcgctccagtctctgcctctgtctgcacaaggctttatccctgtgtgtctgtctgtgtc

SEQ ID NO: 14261 - DNA, 117 bp, Homo sapiens
ggattgtcttgtctatgcgggctctttttttggttccatatgaaatttaaagtagttttttctaattctgtgaagaaagtcagtggtagcttgatggggatagcattgaatctataa

SEQ ID NO: 14262 - DNA, 89 bp, Homo sapiens
gcagagattaatgtcagtctcagtgacttaatggctgaagtgtggtgattcctatcatattcctacttaattaatgagactgtccttgc

SEQ ID NO: 14263 - DNA, 78 bp, Homo sapiens
agtctcactctgtcacccaggctggagtccagtggctagagaattccactcccactttcctgatgatctagtgaggct

SEQ ID NO: 14264 - DNA, 57 bp, Homo sapiens
agaccaactgaattcacacaggcgatccaataggaagacagtgtgcacagttggtct

SEQ ID NO: 14265 - DNA, 69 bp, Homo sapiens
ttatggatcagcttgagcttgttgcttctaacaaatggaagagagcaacatgctggagtgatcacatgg

SEQ ID NO: 14266 - DNA, 81 bp, Homo sapiens
gtggtagcttggcgttctttgatttagtttcttcttctttttttttttttttttttgagacggagtctcgctctgttgccc

SEQ ID NO: 14267 - DNA, 86 bp, Homo sapiens
tttgaatagatttggtttcagcctctgtcagtcagtttaatcaacatggctgatggagtggggtattcatgtgaaaatttatcaga

SEQ ID NO: 14268 - DNA, 106 bp, Homo sapiens
tggatgatgggagcatggaaggcctactaaataccttgactattagcacttggttgaatagtttttgcaatcaaaggtgtactgttgtcagactgtaaatcatcca

SEQ ID NO: 14269 - DNA, 85 bp, Homo sapiens
atacatatacatatgcatatgtgtatatatatgtacatatatacgcacatatatatacacgtgtatatatatatgtatatatata

SEQ ID NO: 14270 - DNA, 72 bp, Homo sapiens
atacatatatatatacacgtgtatatatatgtgcgtatatatgtacatatatatacacatatgcatatgtat

SEQ ID NO: 14271 - DNA, 69 bp, Homo sapiens
gaaatagactaggaaatacatatacatgcatatatgtatgtgtgcatgtgtattgtattagttcatttt

SEQ ID NO: 14272 - DNA, 104 bp, Homo sapiens
agtgatgttgtagccatgataacattctagtgcaattactatatttttaaataaattaaatatagcctaagtgtacagtaatgtcctaggccttcccattcact

SEQ ID NO: 14273 - DNA, 119 bp, Homo sapiens
tgtaaagattcaaatcaaaactttgcatttgttgtgattttataaagggaaattatcaatatatttttccaatggaatttttaaaaatagtaacattttcaagatttgattaatttata

SEQ ID NO: 14274 - DNA, 115 bp, Homo sapiens
tctgtgtgtgtctttataggtgaagtctgtttcttgtaggcaactgttcattgagtcttcttttttttttttgattatgcttcaagttctagggtacatgtgcacaacgtgcagg

SEQ ID NO: 14275 - DNA, 74 bp, Homo sapiens
ctttctcagtctctctgtctctctcgcatttaagaataatcaatgtggaagttatttgggagattgatttgaag

SEQ ID NO: 14276 - DNA, 107 bp, Homo sapiens
tggaaatgggtgagctttctagccagaaaaccagagggaatcttgacaggcacacagtcaatgagtcactctttctaaaagtggggaaaagttcatctcaaaattca

SEQ ID NO: 14277 - DNA, 88 bp, Homo sapiens
cctctattgtgtgtctcagtcactgatatggttgggatctgtgtccccaccaaatctcatgttcaattgtaatccccacagttgcagg

SEQ ID NO: 14278 - DNA, 58 bp, Homo sapiens; identical to SEQ ID NO: 2263

SEQ ID NO: 14279 - DNA, 121 bp, Homo sapiens
tacctatctatctatctgtttatctatctatctatctatctatctatctatctatctatctatcatctatctgcaaggagaaagagagactgaagagaatgcagggtgatagaaaggtaga

SEQ ID NO: 14280 - DNA, 90 bp, Homo sapiens
gagcaggtgggtgatctataaatgtttctttatctgaagcttgaagatttctgctatcacataaggataatatattgttatgctatgctc

SEQ ID NO: 14281 - DNA, 84 bp, Homo sapiens
gtcgcagtgttcagtggggtggtgctcagtcctcattgagaaagtgagaaggtgagcaaagactcatgttagacaagtggtggc

SEQ ID NO: 14282 - DNA, 98 bp, Homo sapiens
tcagcaatttagactaacccttcttattcctgtgaaacaatcagtgatctctggctgcagctcagaagaaaagatggatgggtagtgtaaaaatctgg

SEQ ID NO: 14283 - DNA, 97 bp, Homo sapiens
caggaatgaacaagaacagcttagaggttagaagcaagatagagtctgttaggtctgatctctttcactgtcacaatttcttcagttataatttttg

SEQ ID NO: 14284 - DNA, 85 bp, Homo sapiens
ctttaaaagatgtcagactgtcagtctctcctggacccagggaaaggaataggaaggggagggaggcatggctgcattaagggag

SEQ ID NO: 14285 - DNA, 113 bp, Homo sapiens
gcctgagctggtggcatgctggcacatggctgcagggccagatgcaagctcagtgatgagggtgaggactggtaggcgagaatggttgtgtgcttatatgcagctgttggggc

SEQ ID NO: 14286 - DNA, 90 bp, Homo sapiens
agatttagttccagagtagtgtttaagttcaggtgtttactacaagttatccccagaataggaagcactaacaagctggtgtttaagttt

SEQ ID NO: 14287 - DNA, 95 bp, Homo sapiens; identical to SEQ ID NO: 68

SEQ ID NO: 14288 - DNA, 93 bp, Homo sapiens; identical to SEQ ID NO: 69

SEQ ID NO: 14289 - DNA, 97 bp, Homo sapiens
atagtttcatgtcattatggtcagagaaggtgcttgatataatttcaatttttttgaatgttttaagacttgttttgtgacctaatatattgtctat

SEQ ID NO: 14290 - DNA, 112 bp, Homo sapiens
ctggtgtttacctactcatccgttggtggaaatttgggctgcttattaattattaattatttttaattattgaataccagatctggtttctaaatggaatgaagactaccag

SEQ ID NO: 14291 - DNA, 118 bp, Homo sapiens
gtgcccaagctgtcttatctgtgttttactgtctgctctttctggctgcttatagttagaagagaagtgatttccttgaaatgcatgaggctagaaagggagctggaacttaaagtag

SEQ ID NO: 14292 - DNA, 119 bp, Homo sapiens
gatatatatataggatatatatccaatatatatatatctggatatacatagagatatatatatatctatgtatatccagatatatatatatctctctatatatatcctatatatatctc

SEQ ID NO: 14293 - DNA, 107 bp, Homo sapiens
tatataggatatatatagagagatatatatatatctggatatacatagatatatatatatctctatgtatatccagatatatatatattggatatatatcctatata

SEQ ID NO: 14294 - DNA, 79 bp, Homo sapiens
ctggaatgaatggtttagtggatattaattaattaataaacatggattattattatcacattgaatccatgtgttccag

SEQ ID NO: 14295 - DNA, 95 bp, Homo sapiens; identical to SEQ ID NO: 68

SEQ ID NO: 14296 - DNA, 93 bp, Homo sapiens; identical to SEQ ID NO: 69

SEQ ID NO: 14297 - DNA, 158 bp, Homo sapiens
tatatatacacacacacacacacacacgtacgtatatatgtatatatatatacttatgtatgtgtatatatgtacatatatgtatgtctatgtatatatgtgtatacatacatatgtacacatatgtgtgcatatgtacatatacacacatgtatata

SEQ ID NO: 14298 - DNA, 116 bp, Homo sapiens
gcagcagaaaaacatctcgaaccgaacacaagaaattaccagccatctctttctctgtgactattaccagcacccaagaggcctctaatttcctttttcagaggtatgtctgtttc

SEQ ID NO: 14299 - DNA, 112 bp, Homo sapiens
tggtaatttcttgtgttcggttcgagatgtttttctgctgctttcttattatattcacttgagattttgttgttatgataaaacagtactgaactcctagttagggttgcta

SEQ ID NO: 14300 - DNA, 118 bp, Homo sapiens
tgtgtgtgtgtgtgtgtgtgtaattcaagactatatatataaactagatatatgtaactgtatatatgtatatataacttatatatagtcttaaaatatacacacatatatacatata

SEQ ID NO: 14301 - DNA, 78 bp, Homo sapiens
tctctgagcctatctagggaaggaaaaaaatgtgtcagtctcttctctgaccatgttcttcactgtcactctcactga

SEQ ID NO: 14302 - DNA, 107 bp, Homo sapiens
aggcagtgatcagttcaaaggctatggtcctgatgactttttatttttatttttatttttggaaatagagagagagggtctcaccatgttgtccaggctgaactcct

SEQ ID NO: 14303 - DNA, 95 bp, Homo sapiens; identical to SEQ ID NO: 68

SEQ ID NO: 14304 - DNA, 93 bp, Homo sapiens; identical to SEQ ID NO: 69

SEQ ID NO: 14305 - DNA, 75 bp, Homo sapiens
tctctaatataaatttcagtatctgcttgtggatgtcaccatccacaaaagagcttactagaatttttattgaga

SEQ ID NO: 14306 - DNA, 99 bp, Homo sapiens
gctttgagaaaacagcaaatacctccttgctagtatttccaagaaaaattttataaatatttctcaggaatattagggaagaaattgtttaattgaagt

SEQ ID NO: 14307 - DNA, 72 bp, Homo sapiens
atatatatatgtgtgtgtgtatatatatatatggcatacatatttgcatgtatacataaatagtatatgtat

SEQ ID NO: 14308 - DNA, 66 bp, Homo sapiens
gtatatatacatgtatatatgtgtatatgtacatgtatatatgtgtatatgtacatgtatatgtat

SEQ ID NO: 14309 - DNA, 60 bp, Homo sapiens
gcttctacagtctttgttgatctgttaataacagatcaataacagttgtgcccagagagc

SEQ ID NO: 14310 - DNA, 78 bp, Homo sapiens
agttgcagtcacctttgttggaaatcccaggactgaagtgtgtaaagctcctgggtctctgtgtgtgtctaagcagct

SEQ ID NO: 14311 - DNA, 111 bp, Homo sapiens
gtgccagtggctcacatctgtaatcccagcattttaggaggctgaggtgggagggttacttgatgtcagaagtttgagaccagcctgggaaacatcgtgagaccccatctc

SEQ ID NO: 14312 - DNA, 110 bp, Homo sapiens
ttgaatggggtatacttttttgtttatttgcatgtcttgtgatttttttgttaaaaattgaatgaatttaattatgtggtaactatagaaatcagtagctttcccttcag

SEQ ID NO: 14313 - DNA, 88 bp, Homo sapiens
cttagcatgtggaaaatgtctatatatatttgtcacctgaatgaatgcatgtgtgaataaagattagtctagtttttcctctgctgag

SEQ ID NO: 14314 - DNA, 101 bp, Homo sapiens
ctttgtctccgtgaaggagtcaaggtggtctctcatcagcaaaatagcctcagattgacttgttctcattttgatctcctgaatatttatggaaactaaag

SEQ ID NO: 14315 - DNA, 87 bp, Homo sapiens
ggcctcagggatatcatttattttctataaggatatattattacctgtccatagaagtattttgaagactgtgttttccctgatgtc

SEQ ID NO: 14316 - DNA, 150 bp, Homo sapiens
ctcacatgtaagagagaaataatgtgtatatatgtgtgtgtgtatatgtgcatttgtatatgtgtatatatgtgcatgtacatgtgagtatatgtgtatatgtgtgtgctttacataaatgtgtgtgtgtgtatgtatatgtatatgtat

SEQ ID NO: 14317 - DNA, 77 bp, Homo sapiens
tcactctttctctgactccaagcagcccagtgaggagagactccttctgattaagggaaaaagagagaaaagagtga

SEQ ID NO: 14318 - DNA, 111 bp, Homo sapiens
ctttgtcatattttgtactgtcagtaggaaagattctttcattatttttatgagggacttcccttagcatagttatataaatcttctttttctctgccatactttacaggg

SEQ ID NO: 14319 - DNA, 122 bp, Homo sapiens
gtgctactgatttgtgtacattgattttgtatcctgagactttactgaatttgtttatctgatataggagcttttgggatgagtctttagggttttctaggtataagttcatatcatcagtg

SEQ ID NO: 14320 - DNA, 132 bp, Homo sapiens
atatgtatatgtatatatacacatatgtatatatacacatatacatgtatatatacacatatatgtatatatgtatatatacgtatatatgtatatatgtatatatacgtatatatgtatatatgtatatat

SEQ ID NO: 14321 - DNA, 122 bp, Homo sapiens
gtatgtatgtatgtgtatatatgtgtatatatgtatttatatatacgtatatatgtatatatccatatatacatatatgtgtatgtatacgtatatccatatatacatatatgtgtatgtat

SEQ ID NO: 14322 - DNA, 72 bp, Homo sapiens
tacatacgtgtgtatatacatatgtatgcatacatacgtatgtatatatgtatgtatatgcatatgtatgta

SEQ ID NO: 14323 - DNA, 145 bp, Homo sapiens
ggcagaatttttgctcgttaaagggccctcacatgtaggtaatgttctaaatttgagctcagatctgtctgcctcacaccaagtgtagtttgctgattgctgacagagctccactttcctgtgtttgaggcttcttttctaactc

SEQ ID NO: 14324 - DNA, 77 bp, Homo sapiens
ctggctgctgcagccaggcaggcagctccaggtgctgacacaggcactggctctctgtgaggctgtggccagaccag

SEQ ID NO: 14325 - DNA, 75 bp, Homo sapiens
gatgtcagatagttaccttagtgctcctgagtatggtaaatttggagccacagagtcagtatctgtctgtcagtc

SEQ ID NO: 14326 - DNA, 72 bp, Homo sapiens
aggcaatagagatatgtgtggaatgatggctggagttccctacattagatgattatacatttcctattggct

SEQ ID NO: 14327 - DNA, 76 bp, Homo sapiens
tatgtatatatatttgtgtgcatatatatgcagatatgtatatgtatgtgtaaacatgtatatatgtatgtacata

SEQ ID NO: 14328 - DNA, 111 bp, Homo sapiens
cataggggagacatcgtttcaagggcttgcacgagcttttattattaatatttaatataggaatgtggtagagaatgtctgtgagtctcagagctgggaaagttctctatg

SEQ ID NO: 14329 - DNA, 116 bp, Homo sapiens
aaatcagacccaaactgtatgacctatgcattgatatacgatatacaacatatatttatatataattgtgtattaatatttaaatattttgtatacacacatatataggtctattt

SEQ ID NO: 14330 - DNA, 75 bp, Homo sapiens
aagtatacattactgcctttttccatgaggtaatagtatatatttgcttattttaaaaggcaatgatatatattt

SEQ ID NO: 14331 - DNA, 116 bp, Homo sapiens
acgtgcattaaggcattatatatatacatgtgtatgtgtgtgagtgtgtgtgtgtgtatgtgtgtgtgtgtgtgtgtctatatatatatataatctccaatactttgaacaagctc

SEQ ID NO: 14332 - DNA, 117 bp, Homo sapiens
atatatgtttacttagtatgtgtgtatatatatatacacatgtgtatatatatgtgtgtatatatatgtacacatatatacacatgtgtatatatatacacacacatatatgtgtgt

SEQ ID NO: 14333 - DNA, 123 bp, Homo sapiens
cacatatgcacatcacatgtatgtttgtatatataagtatgcacgtaggcaaagatcaaactatatatatatgtatgtatatgtatgcatgtttgtatatatgtgtgtacatatccatatgta

SEQ ID NO: 14334 - DNA, 118 bp, Homo sapiens
tgtttatattcagaagtggaattgttaggttatatagcaattgcattctatttttaatttattttaggtactgccatactgttttgcctagtgattgcaccattttacattcccagca

SEQ ID NO: 14335 - DNA, 58 bp, Homo sapiens
tgaaatggagtctcactctgtcacccaggctggagtgcagtggtgcgattttggctca

SEQ ID NO: 14336 - DNA, 69 bp, Homo sapiens
atacatatttatatatacttatatatataagtattaagtatatatgttgaagtacatataagtatgtat

SEQ ID NO: 14337 - DNA, 56 bp, Homo sapiens
gagactgagtctcgcactgtctcccaggctggtgtgcagtggcgtgatctcagctc

SEQ ID NO: 14338 - DNA, 114 bp, Homo sapiens
aggaaagataataaaattattattatgtatgggtatatttgatatttaaaaaatagtgtatttgatgttctcttaaatgttacatatataacattttgatgtttattagttctt

SEQ ID NO: 14339 - DNA, 99 bp, Homo sapiens
gttgggacttcataatatagttgggcaaaagtgcagaaagtgagaccatggataatggaagacttctgtatttgctacaaatttgtatgcaattctgac

SEQ ID NO: 14340 - DNA, 83 bp, Homo sapiens
gtgtcaaaagctgaaacagcaacagaagtagagtctgggcagagacatgtccttttgtcatatcttgtttttttttttgagac

SEQ ID NO: 14341 - DNA, 109 bp, Homo sapiens
ttcatttaaaaagtgagtgggtggaatttttggcatctgcctacatttgactatttgttgttaacttatgatatatgccaggttttggcctctcagttcataaaatgag

SEQ ID NO: 14342 - DNA, 65 bp, Homo sapiens
tgttttgagggggaaattgtgctcatctggagggtccacatgagcatttttttttttttgagaca

SEQ ID NO: 14343 - DNA, 62 bp, Homo sapiens
tatgtgtgcattatatatgtgcatatttatgtttatatatgtgcatatatagtgtatatata

SEQ ID NO: 14344 - DNA, 119 bp, Homo sapiens
aaaaactatggttgtcaggaggattttgtgagataattatatatgaaagaacctactaggatgtattctttagtaaacattcagtatttggctctctatttggcaactgagtggtggtt

SEQ ID NO: 14345 - DNA, 77 bp, Homo sapiens
tacactgaatgaccttgatgaagcagtaagtcttccttgatgaagatttattaattttattaaatcccttgagtgta

SEQ ID NO: 14346 - DNA, 81 bp, Homo sapiens
actgaactatgtcttttgggtagctattttcaaattttctttttttgaaaaggaaaacatactcagacagatgtatccagt

SEQ ID NO: 14347 - DNA, 104 bp, Homo sapiens
tactacagttttgcaaaatattgtcattggagaaaatggggtaaagacacagtgtctctctgtaatgcttcttacaactgtatgacaatatgcaattaagagta

SEQ ID NO: 14348 - DNA, 71 bp, Homo sapiens
gttttttgagacagaatctcactctgtcacccaggctggagtgcagtggcatgatcttggctcattgaaac

SEQ ID NO: 14349 - DNA, 103 bp, Homo sapiens
ttagccaggtatggtggtggcatgcacctgtggtcccagctactcaggaggcagaggtggaaggatcacttgagtccacaccactatactccagcctgggtga

SEQ ID NO: 14350 - DNA, 71 bp, Homo sapiens
ggccattatatcagtctctgtgctgatgctgaatttgtctgacagactcacacaggggcctccaaatagcc

SEQ ID NO: 14351 - DNA, 113 bp, Homo sapiens
catgcctttgacatagtttatgaagagagtagagagacagggaatcatacaattttttttgttgtttttgagacagagtctcattctgttgcccaggctggagtgcggtggca

SEQ ID NO: 14352 - DNA, 107 bp, Homo sapiens
gcttttaaaaactcatgcaatcatttggaatccttggccaactataatatatatatatatatatatataactgcctagagttgcctaatatgaaaatgtggttaagc

SEQ ID NO: 14353 - DNA, 80 bp, Homo sapiens
gagtctcgctctgtcactcaggctggactgcagtggcatgatctcggctcactgcaatctcctgggttcaagtgagtctc

SEQ ID NO: 14354 - DNA, 127 bp, Homo sapiens
catgttgttacttaggcattttatcttggctcaaattgttgaagaatggcttgtttcacagtttttgtatttgtgtctaatgcacgttttaacatgatagatgcaatgcattgtgtagctacttttc

SEQ ID NO: 14355 - DNA, 95 bp, Homo sapiens; identical to SEQ ID NO: 68

SEQ ID NO: 14356 - DNA, 93 bp, Homo sapiens; identical to SEQ ID NO: 69

SEQ ID NO: 14357 - DNA, 95 bp, Homo sapiens; identical to SEQ ID NO: 68

SEQ ID NO: 14358 - DNA, 93 bp, Homo sapiens; identical to SEQ ID NO: 69

SEQ ID NO: 14359 - DNA, 79 bp, Homo sapiens
gatgaaacagaagacagtctgtactctcaattcctgtatagtcagccttctgagagaaacagatgacttcccggtcatt

SEQ ID NO: 14360 - DNA, 95 bp, Homo sapiens
tttcacaaatgtgggcctgggttttcatttgactctcacagtaactcagagtgtcagagagtacaagttgtcatgcccatttcacatacatggaa

SEQ ID NO: 14361 - DNA, 188 bp, Homo sapiens
ggttatgattcatttttgctcattaaaaatttattatattgtttttccataaggaaaattaatatgactatattaatatatttgcaaatagttattgtaatcacttatgtgttagtaatttattatataaataaaattattatattatataatatataaataaattactaatacataactgatgataa

SEQ ID NO: 14362 - DNA, 74 bp, Homo sapiens
tgtacagatgctccacatgtgtttttatttaatttattttttaatgtggaaaagttcactttgagctctgtgca

SEQ ID NO: 14363 - DNA, 90 bp, Homo sapiens
ggtgttctcctggcacatgacactggtatcggtgtgtgagatcagggaaagtgcctgtggacagtgatgattctcagcacaccttgctgg

SEQ ID NO: 14364 - DNA, 189 bp, Homo sapiens
gtatgtgtacatatatattcattatatacgtatgtgtacatatatattcattatatacgtatgtgtacatatattcattatatacgtatgtgtacatatatattcattatatacgtatgtgtacatatatatcattatatacgtatgtgtacatatatattcattatatacgtatgtgtacatatatat

SEQ ID NO: 14365 - DNA, 90 bp, Homo sapiens
ctcagagggatgttgtgaggaacagatacaattgcgggcatacagatgttctatagaagtattttttgttattattttacagaccatgag

SEQ ID NO: 14366 - DNA, 114 bp, Homo sapiens
tatatatatatatgcatatatgtgtgtgtgtgtgtgtgtacatacatatgtggatctctgtctctctcaatatatatacacacatacatacatatatatggttatatatatata

SEQ ID NO: 14367 - DNA, 169 bp, Homo sapiens
aaaaatatagagatgatcaaagaaactgtgtgtgccactactgcataaaagtgcagtatgaatgtatatattttaggatgggctttgtgtgtttaaaaattttatttctaattcacgttagaatattttttacattttctcagctgaacctaatttgttttaatccata

SEQ ID NO: 14368 - DNA, 168 bp, Homo sapiens
atgcatgctttttagataatgatgataagtggagaaggaggaattttttcataatttttttgaagacattctaggtctaatccaactataaaattatgtgtgtatatgcatgtgtgcatatatatatatatatatatatatgcacatattttaacatctgactgtata

SEQ ID NO: 14369 - DNA, 120 bp, Homo sapiens
tgtactgttataggttgcttcagttgttttttgtctgtatttgattttttattatttcattcattcatatgacagataataaaatgggatttgaaaagactgaaaatcagttacgatagt

SEQ ID NO: 14370 - DNA, 88 bp, Homo sapiens
gtagttattcaacagacctcatgctgtggtatttttttgtatttaattgtacgttggtgcgaaagtgattgcggttttttgacattac

SEQ ID NO: 14371 - DNA, 101 bp, Homo sapiens
gtgtctgtgtgtttgctccaagatttgtagtatatatatttaacttactataagctactgtcaaatattatactactcatttttcagtatatatatttaac

SEQ ID NO: 14372 - DNA, 87 bp, Homo sapiens
ggagtctagctctgtcaccaggcttgagtgcagtgatgtgatctcagctcaccacaacctccgaccccctggttcaagtgattctcc

SEQ ID NO: 14373 - DNA, 70 bp, Homo sapiens
atacacgtacacatacatacaggcacatacatatatctatatatgtgtttgtatgtgaatttatatgtat

SEQ ID NO: 14374 - DNA, 76 bp, Homo sapiens
gtgttccttgagtcaatgagttaaataatgggatatgctgtgggcatgtcacagtctgactcagtgactcatgtgc

SEQ ID NO: 14375 - DNA, 109 bp, Homo sapiens
ctgggccgtctcactttctcagtaccacattactttttattcatatattttactgtaggcccagtggagagtaagatggaaacactgaaaagtcactgaaaagtactag

SEQ ID NO: 14376 - DNA, 96 bp, Homo sapiens
gctgtgtctctttcccttgagtagttttttccatgagttttttttttttttcttgagatgggatctctcactctgtcacccaggttggagtgcagt

SEQ ID NO: 14377 - DNA, 81 bp, Homo sapiens
catcttcttggaagtaaggatatttatttttatagcaaggaaacagacttgtagctaattgtccatttccaatgaaagatg

SEQ ID NO: 14378 - DNA, 58 bp, Homo sapiens; identical to SEQ ID NO: 9124

SEQ ID NO: 14379 - DNA, 97 bp, Homo sapiens
tatagacatatatatgtatatttttacatacatagctatgcatatatatatttgtgtgtgtgtgtgtatatatatatgtatatatatatatatgcct

SEQ ID NO: 14380 - DNA, 95 bp, Homo sapiens; identical to SEQ ID NO: 68

SEQ ID NO: 14381 - DNA, 93 bp, Homo sapiens; identical to SEQ ID NO: 69

SEQ ID NO: 14382 - DNA, 106 bp, Homo sapiens
atcaatgctgattaccatggctacatggctgctgaagtgaaatgactttttttttttgtctgcagatccactggcatgataaaggcatggtagttggccagatggt

SEQ ID NO: 14383 - DNA, 120 bp, Homo sapiens
ccactatgccactatcactgatttgatctttctggatttttgtttctttttttttttttttttcattatgagactggattagattttatctaaaatctggtagttccaaaattctagtgg

SEQ ID NO: 14384 - DNA, 118 bp, Homo sapiens
ccctattgcaatagtcttgcctccctctgcaattgtctttgcctgtcaactctggctggtgtcttttttttttttaagcacatgacagggaatttgtagagataggtaatgttagggt

SEQ ID NO: 14385 - DNA, 83 bp, Homo sapiens
agttgagacagactctcactctgttgcccaggctggagtgcagtggcgcgatctcagctcactgcaatctctgtctcctgggt

SEQ ID NO: 14386 - DNA, 74 bp, Homo sapiens
gtctgaatagatgacttgtctttgatatatatatatattttttttttaagacaggctctcactctgtctcaggc

SEQ ID NO: 14387 - DNA, 93 bp, Homo sapiens; identical to SEQ ID NO: 69

SEQ ID NO: 14388 - DNA, 76 bp, Homo sapiens
tcagactggccaatgagactttcattttttttatttcttattttgagatggagtctcactctgtcacccaggctgg

SEQ ID NO: 14389 - DNA, 91 bp, Homo sapiens
ccattcagcaaagaattccagttatttcaagtgaaggagatgagcagaataaacatttaatttatttgtattgactggtcaagtctgaagg

SEQ ID NO: 14390 - DNA, 80 bp, Homo sapiens
atggtccaagatcgtgcttggtatgattttgatttttttattttattgatacttgcttcattactgagcatgtggtccat

SEQ ID NO: 14391 - DNA, 127 bp, Homo sapiens
actgtgtgtctgtgtgtgcatgtgtataaataaatatatatacaaaaatataagtgtatgtatgtgtatataagtatacataataaatataagtgtatgtatgtatatatgtatagatgtgtgtata

SEQ ID NO: 14392 - DNA, 110 bp, Homo sapiens
tatgggctcctttttagttccatgtgaattttagttccatgtgaatagtttttttctaattctgtgaataatgtcaatggtagtttaaggggaatagaattgaatctata

SEQ ID NO: 14393 - DNA, 95 bp, Homo sapiens; identical to SEQ ID NO: 68

SEQ ID NO: 14394 - DNA, 93 bp, Homo sapiens; identical to SEQ ID NO: 69

SEQ ID NO: 14395 - DNA, 56 bp, Homo sapiens
ttatatagaaatatctgtgtgtatatatatatatgcacacatatgtgtttgtataa

SEQ ID NO: 14396 - DNA, 71 bp, Homo sapiens
tccttcaccagctgagtgatcacactgtggtaaaaccataccgtgaaatgccactcagcaatagaaaagga

SEQ ID NO: 14397 - DNA, 80 bp, Homo sapiens
atatatataaccatgtgaggtgatggatatgttaattagctcgatcatggtaatcatttcatatgtatcaatatatgtat

SEQ ID NO: 14398 - DNA, 119 bp, Homo sapiens
acagtatgtgctcactttgtttctcactgtcacattttggtagttctcatagtatttgaaactttttcattattgtcatatctgttacatggtctgtgatcagtgatgatctttgctgt

SEQ ID NO: 14399 - DNA, 95 bp, Homo sapiens; identical to SEQ ID NO: 68

SEQ ID NO: 14400 - DNA, 93 bp, Homo sapiens; identical to SEQ ID NO: 69

SEQ ID NO: 14401 - DNA, 92 bp, Homo sapiens
gacaggtgagctctggggccacgccagctacagaaaggagccgagtgccgggctccctgagtccctgcgtgggtcaggagcggctgggggtc

SEQ ID NO: 14402 - DNA, 65 bp, Homo sapiens
tgtccttcagtgcctcaagagactgtggactatttcaccaacagtgcttcaggttattaaggata

SEQ ID NO: 14403 - DNA, 105 bp, Homo sapiens
tgtcaagccgccagggtaaattcatggtctgatgtaaatttttatttatctcaggattggtaaataagctgcccaagaaagtgagtaggtctgtggttcataaca

SEQ ID NO: 14404 - DNA, 98 bp, Homo sapiens
tatatatataaaggtcatatatatatgaggttactgggagtccttctaaggctctccatatatttttatatatataattatacatttttatatatata

SEQ ID NO: 14405 - DNA, 56 bp, Homo sapiens
tatatgtgtacatgtatgtgtgttcatatatacatatatatacatgtgcacatgta

SEQ ID NO: 14406 - DNA, 81 bp, Homo sapiens
gagcaggagcaagagagagtagggggaggtgctgcacactttcaacaaccacatctcaccgtaactcactcactcactttc

SEQ ID NO: 14407 - DNA, 56 bp, Homo sapiens
gagacagagtctcactctgtcacccaggctggagtgcagtggcgtgatctctgctc

SEQ ID NO: 14408 - DNA, 105 bp, Homo sapiens
gactcaggctctctcagctcttgttagtctaaacttataaacagttgttttttttttaaattcttggtaagggaaaagtgcacaggtgagagaatgctgatagtt

SEQ ID NO: 14409 - DNA, 106 bp, Homo sapiens
ctgcttatggtgattgtcttgacaatactaaaaaggagagctcttgaattatgaaaattaattggtatctgattgtaatggtccagataaggattactaaaagtag

SEQ ID NO: 14410 - DNA, 110 bp, Homo sapiens
atgttgctaaatctcttaagtgtgctttaacatttagttatttatttatgaattcataaaatacctattgaatgcctgcaggctgctaggatttgtgtcagatgcaatgt

SEQ ID NO: 14411 - DNA, 105 bp, Homo sapiens
tggaattgcaggtgtgagccactgcgcccgacctccatggtagtttttatatacattataagtctgccatgtgtcctgcagaactcaaagttgtgtaatgtgtca

SEQ ID NO: 14412 - DNA, 117 bp, Homo sapiens
aattaatgctaaggagatgattatatttaggttttcaaacctctacattaaataataatttattttaaagttgaaatatagagggagatcatgaggaaagatccttagggattaatt

SEQ ID NO: 14413 - DNA, 93 bp, Homo sapiens
gcagaaaatttgatattttttctctagatcaatattgatagaattctttatttattattattattattattttgagacagagtgtcactctgt

SEQ ID NO: 14414 - DNA, 109 bp, Homo sapiens
tgaaattgcttcagctggagggggaggagcttgtaacatggaggtaggtgcaataacaatggctgcctgcctctttgtctgcacttctgtgatcagaagcagtagatca

SEQ ID NO: 14415 - DNA, 56 bp, Homo sapiens; identical to SEQ ID NO: 88

SEQ ID NO: 14416 - DNA, 68 bp, Homo sapiens
catgttacccatgtcttgcatttggatgggtcctgtctctttctgtgactaagacatggagtagcgtg

SEQ ID NO: 14417 - DNA, 77 bp, Homo sapiens
gcgggcacgttacccatgtcttgcatttggatgggtcctgtctctttctgtgactaagacatggagtagcgtgatgt

SEQ ID NO: 14418 - DNA, 71 bp, Homo sapiens
agatgtgcccagtttatatatatgtatatgtacatatgaggcatatatgtgtatgtagatactgtatatgt

SEQ ID NO: 14419 - DNA, 58 bp, Homo sapiens; identical to SEQ ID NO: 1409

SEQ ID NO: 14420 - DNA, 79 bp, Homo sapiens
aggaaaagctatcagagtttacggatgttttcctgtgaagagtgagaggagtcaaagataactctgagaatttttacct

SEQ ID NO: 14421 - DNA, 95 bp, Homo sapiens; identical to SEQ ID NO: 68

SEQ ID NO: 14422 - DNA, 93 bp, Homo sapiens; identical to SEQ ID NO: 69

SEQ ID NO: 14423 - DNA, 80 bp, Homo sapiens
gaactggaagcattgattctgactgtgggtgtagtttatgtccataaatcttttaactcactaggacccaatgtgagttc

SEQ ID NO: 14424 - DNA, 95 bp, Homo sapiens; identical to SEQ ID NO: 68

SEQ ID NO: 14425 - DNA, 93 bp, Homo sapiens; identical to SEQ ID NO: 69

SEQ ID NO: 14426 - DNA, 118 bp, Homo sapiens
tgtatgttctcattcaccctcaccgtgaggtctctttttttttctttttcttttttttttttttttttttttcggagagggagtccacctctgttggccaggctggagtgcaggtgca

SEQ ID NO: 14427 - DNA, 76 bp, Homo sapiens
agagtatatagtatatacatatatatatctatatagagtatatacatataatctacatgtatatactatatactct

SEQ ID NO: 14428 - DNA, 78 bp, Homo sapiens
cactcagtttatatatatgtgtgtgtgtgtgtacatatgtgtttgtatatatagataaatagtatatttgagacagtg

SEQ ID NO: 14429 - DNA, 58 bp, Homo sapiens
cgggcgcctgtagtcccagctactcgggaggctgaggtaggagaatgacatgaacccg

SEQ ID NO: 14430 - DNA, 91 bp, Homo sapiens
gcggggcacggtggctcacacctgtcatctcagcactttggaaagccaaggcgggtggatcacgaggttaggagttcaagaccagcctggc

SEQ ID NO: 14431 - DNA, 95 bp, Homo sapiens
agcttagtttggctggatatgagattctgggttgaaaatttttttctttaagaatgttgagtattggcccccactctcttcttagactttctgct

SEQ ID NO: 14432 - DNA, 116 bp, Homo sapiens
tgatctttagtgataatatgtagagtgtctgcattaccttctacagttattatttcttttataattagtaatgctacttctgagacaattcttaacatcctactctctggaggcca

SEQ ID NO: 14433 - DNA, 75 bp, Homo sapiens
ggcaaagagttttgaatttcttgttagagcttctccttggatacctagttctaggaattcatgacatcaaatgtc

SEQ ID NO: 14434 - DNA, 104 bp, Homo sapiens
gttatgaatatgtatatatacacacatatatgtttatgtatgtatgtatgtacatatatatgcatatatatacatatatttctatatatagcagcctatataat

SEQ ID NO: 14435 - DNA, 118 bp, Homo sapiens
ggcgtgtaggaggaaaaccatgtagtgtttaccgtaacaactccttttgtttttgagagaatgtctcactctgtcaccctgctggagtgcagtgctgtgatcatggctcactgcagcc

SEQ ID NO: 14436 - DNA, 98 bp, Homo sapiens
gcatttgtttgtttgtttgtttacttatttctttactgacacagggtctcaccctgtcactcaggctggagtgcagttgcacaatcatagctaattgc

SEQ ID NO: 14437 - DNA, 88 bp, Homo sapiens
atgtccatgtatatgtatatatgtatgtaaatgtgtgtatatatgtaatgtatatgtatatatgtatgtatatataatatatggatat

SEQ ID NO: 14438 - DNA, 167 bp, Homo sapiens
tatatatgtgtgtatatatacgtatatatgtgtatatatactatatatgtatatgtgtataatatacgtatatatgtgtgtatatatgtatatatgtgtatatatatacacgtatacatatgtatatatatgtgtgtgtgtatatatatgtgtgtgtgtgtgtgtat

SEQ ID NO: 14439 - DNA, 59 bp, Homo sapiens
tgagacagggtctcactctgtcacccaggctggagtgcagtggtgtgatcatgggctca

SEQ ID NO: 14440 - DNA, 109 bp, Homo sapiens
gtgtatatatgtaaaatgtgatatatatgctattaaatttgtatatatatgctattaaatgtgtatattatatatgtgtgtgtatatatgtgctattaaatgtgtatat

SEQ ID NO: 14441 - DNA, 93 bp, Homo sapiens
tgctactttctatggaaagaaaagtagtaagtttaatggtgaaattccctaggaaaaccacacaacttaacatcttattcttgccaagtagca

SEQ ID NO: 14442 - DNA, 117 bp, Homo sapiens
gttttactttgtgcttgagaatggcattgcaattctggccagtgactatagagtagtcattttctagttaattggttttaagaaagtttaatcattactggaagcacttaaacagac

SEQ ID NO: 14443 - DNA, 105 bp, Homo sapiens
ccaggagctgggactacaggcacacactgacatatctgtccaactttttattttttgtaaagacggcgtctcactatgttgcccaggctggtctcaaactcctgg

SEQ ID NO: 14444 - DNA, 107 bp, Homo sapiens
tttggtgataccctcttgttcctctttcttcaacaccctagatttgagatattcttgttttagagtatgggggtcagagttgtgggggacaatagacatctattgaa

SEQ ID NO: 14445 - DNA, 86 bp, Homo sapiens
gaatttgttccttcagatgttcagatgtgtccagagtttcttccgtcttgtgggttcatggtctcgctgacttcaggagcaaagcc

SEQ ID NO: 14446 - DNA, 156 bp, Homo sapiens
ctgatggtgatattttatatatatatgcgtatatatatatatgtgtgtgtgtgtgtgtatatgtatatatgtatatgtgtgtgtgtatatatatatatatagtgtggtacagatagtgatatatatatctatcacactatatatcacactatgtat

SEQ ID NO: 14447 - DNA, 110 bp, Homo sapiens
tgtatatgtttatacacgcatgtatatgtatatgtacacatattcatgtatatgaatatatgtacacatatacatgtatatgaatatatgtacacatatacatgcatgta

SEQ ID NO: 14448 - DNA, 95 bp, Homo sapiens; identical to SEQ ID NO: 68

SEQ ID NO: 14449 - DNA, 93 bp, Homo sapiens; identical to SEQ ID NO: 69

SEQ ID NO: 14450 - DNA, 154 bp, Homo sapiens
atatatgtatacgtatatgtatatatgtatactatatatatgtgtgtgtgtgtatatgtgtatatatatgtgtgtatatatatgtgtatatatgtgtgtgtgtgtgtgtgtgtgtatatatatatatatatatatatatatatatatatatata

SEQ ID NO: 14451 - DNA, 154 bp, Homo sapiens
atatatatttgtttgaaaatatatatatactatatatacacgtatatatatgtgtgtgtatatatatacgtatatatatatattttttcaaacaagtcccagagttgtttgtatatatacatgtatacatatatgtatatatatacgtgtatgt

SEQ ID NO: 14452 - DNA, 101 bp, Homo sapiens
atggatttttaaaatgtggtatgtgtgtgtgtgtgtgtatagtgtgtatatatatatatatatatatacacacacacacagaaatatgtgtatatatgtat

SEQ ID NO: 14453 - DNA, 97 bp, Homo sapiens
atggcatataaaaatatgtatgtttatatgtatatgtgtatatatatgtttacacattaatatatgtatatatacacatacattcttttaatttcat

SEQ ID NO: 14454 - DNA, 96 bp, Homo sapiens
gtgtatatatgtatacacatacacaaacacacattaacatgtttatatgtatatatatgcagtaacacgtgtttgtgtgtgagtgcatgtatatac

SEQ ID NO: 14455 - DNA, 58 bp, Homo sapiens
tgagacagagtctcgctctgtcacccaggctggagtgcagtagcgcgatctcggctca

SEQ ID NO: 14456 - DNA, 98 bp, Homo sapiens
actgcagggtactgtgtgtatattgtgattttagaaaaacaatcttaaatactgagttcatcgaggttgcaacatacaagccatgatgcctttgaagt

SEQ ID NO: 14457 - DNA, 75 bp, Homo sapiens
agcataggtattatgagtatgtaggcagatgccaaactgtactgtttgttaaatattcatgttagcatctctgct

SEQ ID NO: 14458 - DNA, 104 bp, Homo sapiens
agattctgttgtgtatgtgtgtatatatatgtgtgtgtgtatatatatatatacacacacacatatataaatgtatcacacatatatcattatttaaaagagag

SEQ ID NO: 14459 - DNA, 92 bp, Homo sapiens
cgataagagatttacaaatgctggacaaatgggcctagaggttttatataacctgtgagtgtctctctgtttcatgttagtctttattattg

SEQ ID NO: 14460 - DNA, 106 bp, Homo sapiens
gagtatctcctacaagtggaattactgggttatatggtgattttatgtttaattttttgaggaattgccacatggttttccatagtagctgcactatttggtattc

SEQ ID NO: 14461 - DNA, 63 bp, Homo sapiens
gcagaaatctctcttctctctcggtgactctgttgttattggagagaaaatggaaagtactgt

SEQ ID NO: 14462 - DNA, 118 bp, Homo sapiens
ttgctcagcgttcttggagtgttatatggaatgtgtaaatacagtttttttctatttgatgtaaaaactacaaaatgtatctcttctttcataaacattctaaactctttgaagacag

SEQ ID NO: 14463 - DNA, 118 bp, Homo sapiens
ttgacctaactctcaaattttcaggaacactgtgtgatcttttataagattttatcactatttgttcttcataaatatttatgcatatttcctgataaccatgaggctcataggttga

SEQ ID NO: 14464 - DNA, 56 bp, Homo sapiens
acagagtcactctctctgtgctgagctgcctggagctgatggtgaggtggcactgt

SEQ ID NO: 14465 - DNA, 91 bp, Homo sapiens
gtatatatttgtcaacatccacatgtgtatatatatttatataaatatatatacatgcatatgtgtttacataaatatatattcttcagtg

SEQ ID NO: 14466 - DNA, 79 bp, Homo sapiens
agtcctcaagggacagaggacagtctgaggagagacaaacctggatgtccccagaggctaattttttctcctcttgtct

SEQ ID NO: 14467 - DNA, 97 bp, Homo sapiens
ggaaaatctaatgccccagctgatctgacaggagacagagcccaggccgtaatgctagcttgcctgaagctcacctcctgctgtgtggccaggttcc

SEQ ID NO: 14468 - DNA, 101 bp, Homo sapiens
ggaatatgtcttttcatggcagaaagaagaaagcaagagagctgtcaggcacactcaatggctcttagggcttcaactttgaatgaaaatagtcattttgc

SEQ ID NO: 14469 - DNA, 62 bp, Homo sapiens
tgaggcggagtctcgctctgtctgtcgcccaggctggagtgcagcggtgcgatctcggctca

SEQ ID NO: 14470 - DNA, 85 bp, Homo sapiens
gtatatataatacatacatatgtatgtatatatactgtgtatatacatactaaatatgtgtgtgtatatatatgtaaatatatat

SEQ ID NO: 14471 - DNA, 116 bp, Homo sapiens
tttctgtttctgtttgtttgtttgttttgtgagactgggtctctctctgtcaccctgtctggagtgcaatggcatgatctcggctctctgcaaactttgcctcatgggttcaagga

SEQ ID NO: 14472 - DNA, 161 bp, Homo sapiens
tatatatacacacatatatacgtatatacacatatatgtatatacgtatatgtgtgtatatgtatatatgtgtgtatatatgtgcatatatatgtatatgtgtatatatgtatatatgtgtatatatgtctatatacgtatatatacacacatatacgtat

SEQ ID NO: 14473 - DNA, 141 bp, Homo sapiens
atatacacgtatatacgtatatatctatatatacgtatatatgtatacgtatatatacacgtatatatgtatatatctatatatacgtatgtgtatatatacgtatatatgtgtatatatgtgtgcgtatatatgtatata

SEQ ID NO: 14474 - DNA, 111 bp, Homo sapiens
ttaacaaatgcttgtgatttgtcatgtatcatggttaatttttctatgtcattaattcataaaatagacccggtaacccaattagatgtatactgttacggcatttattga

SEQ ID NO: 14475 - DNA, 71 bp, Homo sapiens
ctgggtacagaagtaactctctagctctctgtaaaatagactgacagtaagtttctcttcttcagacctag

SEQ ID NO: 14476 - DNA, 118 bp, Homo sapiens
atagggaattgttggggtggagaggtaaggtccagatcatggagaacattatggtatcaaatattttttatgttcaagtctagagagtttgatttcttctttctataggtctatgatt

SEQ ID NO: 14477 - DNA, 60 bp, Homo sapiens
atgaatatatatatatgtgtgtctgtacgtatacacacacacatatatatgtgtgtacat

SEQ ID NO: 14478 - DNA, 84 bp, Homo sapiens
tctgaatgccctagactaccacactgtgaaacttgaggccaatgtaggctgggggcagtgagaaagaggagaggaggcaaggga

SEQ ID NO: 14479 - DNA, 116 bp, Homo sapiens
gtgattttcatttgaatttttctgatgatgtgtgatattgaacattttttaatatacttgttggtcatttgaaaaatgtctattaatgtccttagcctgccttttaatgagattat

SEQ ID NO: 14480 - DNA, 107 bp, Homo sapiens
ggttttgatttgcatttctctgaagattagtgatgttgaacatatttttatgtttattggtcacttgtatgtcttcttattaaaagtgtctgttcatgttgttggcc

SEQ ID NO: 14481 - DNA, 76 bp, Homo sapiens
tatatatatgtatatttcaagtatgtatatatgtatattatatatgtttatatatgtgtgtgtgtatgtatgtgtg

SEQ ID NO: 14482 - DNA, 115 bp, Homo sapiens
cttctggctttaatttacaaactcattgaatggacttttaatatttgtattatatataacacaagtgctgatgcatcattattttttcaagtccttttaatgaaaagaccaaaag

SEQ ID NO: 14483 - DNA, 82 bp, Homo sapiens
cagccactcccagagcccctggaactctggcccaaggctctctgactgactccttcccagatcttctcggcttcagcggctg

SEQ ID NO: 14484 - DNA, 113 bp, Homo sapiens
ttgtacacttgaaaatagtaaagatggtaagagtaaatgtgtatatatatatatatatatatatatatatatatatattttttttttttttttttttttcttttttgtgacgg

SEQ ID NO: 14485 - DNA, 207 bp, Homo sapiens
tgtatatatctatatatgtgagtgtatatatatgtacacacatatatatgtgtatatatatgtacacacatatatatgtgtatatatatgtacacacatatatgtgtgtatatatatgtacacacatatatatgtgtatatatatgtacacacatatgtgtatatatatgtacacacatatatgtgtatatatgtacacacatatat

SEQ ID NO: 14486 - DNA, 118 bp, Homo sapiens
atatatacacagatatatatgtgtgtacatatatgtacacacatatatgtgtgtatacatatatatacatatatatgtgtgtacatatatgtacacacatatatgtgtgtacatatat

SEQ ID NO: 14487 - DNA, 97 bp, Homo sapiens; identical to SEQ ID NO: 1307

SEQ ID NO: 14488 - DNA, 88 bp, Homo sapiens; identical to SEQ ID NO: 1308

SEQ ID NO: 14489 - DNA, 81 bp, Homo sapiens; identical to SEQ ID NO: 1309

SEQ ID NO: 14490 - DNA, 77 bp, Homo sapiens; identical to SEQ ID NO: 1310

SEQ ID NO: 14491 - DNA, 113 bp, Homo sapiens
ttcttcatctattaagttcttggatatttttcttcatatttttataattattctgtacaggttttcttgtctatatttgttagatttatgcctaagaattttattttggggga

SEQ ID NO: 14492 - DNA, 96 bp, Homo sapiens
agctgtgtaatttgtgtatattatttattttatcatctctgtgctgcagccagttcgactattaaatgggaataatattatctagtttatgcagtt

SEQ ID NO: 14493 - DNA, 94 bp, Homo sapiens
tatatgattaataccttgtcagtttattttttttccataacacacatggtggtggagagttgagtaggcccagacatctggtaaaaattctgtg

SEQ ID NO: 14494 - DNA, 112 bp, Homo sapiens
tgaaccctgtttttttaaacattgagttggggatttcatttttattttttttggatcctcatcaggactggaagaagtctgcctgagtcactgaaaatgatcacagtgagca

SEQ ID NO: 14495 - DNA, 58 bp, Homo sapiens
tgagccggagtctcgctctgtcactgaggctggagtgcagtggcgcgatctcatctca

SEQ ID NO: 14496 - DNA, 95 bp, Homo sapiens; identical to SEQ ID NO: 68

SEQ ID NO: 14497 - DNA, 93 bp, Homo sapiens; identical to SEQ ID NO: 69

SEQ ID NO: 14498 - DNA, 78 bp, Homo sapiens
gaattctccagaatagctgtgtataattaattaaatttttgattgagttaattggcatagctattgtttcaattgttc

SEQ ID NO: 14499 - DNA, 91 bp, Homo sapiens
gatgctgtaatgatttcaggtgctgatttttacttttttttctttcttttgaggcaaggtctcacttggttgcccagctcactgcagcctc

SEQ ID NO: 14500 - DNA, 95 bp, Homo sapiens; identical to SEQ ID NO: 580

SEQ ID NO: 14501 - DNA, 93 bp, Homo sapiens; identical to SEQ ID NO: 69

SEQ ID NO: 14502 - DNA, 111 bp, Homo sapiens
aggactagtagagttaaaaatctgaaaatgagtgcatatatatatatatatatatatatatatatatatataccccatttgatattctgtatttcctcagtatttcttaat

SEQ ID NO: 14503 - DNA, 106 bp, Homo sapiens
tgacattgcatgtgtgtagacatgatatttatttaaatgcgtatacatagatatatgtatatatctttgcatatgtgtgatagcagaaaaacgtgttaatagacat

SEQ ID NO: 14504 - DNA, 89 bp, Homo sapiens
ctgaagctgctctgaaaatatctttatttttggtataattctgaaatattttagtagagaagatattttatgtgagtattttccttcag

SEQ ID NO: 14505 - DNA, 95 bp, Homo sapiens; identical to SEQ ID NO: 68

SEQ ID NO: 14506 - DNA, 93 bp, Homo sapiens; identical to SEQ ID NO: 69

SEQ ID NO: 14507 - DNA, 96 bp, Homo sapiens
agaatctaatgcctgatgatctgtcactgtctctcatcacccccagatgggactgtctagttgcaagaaaacaagctcaggtttcccactgattct

SEQ ID NO: 14508 - DNA, 114 bp, Homo sapiens
catcaaaggatatatatctgtatttcttatatatttatgtataaatgtatttgtacatttataaatttattttcatatttatatttataaataagatatatatctatatgcatg

SEQ ID NO: 14509 - DNA, 98 bp, Homo sapiens
tatatgcatatatatacacacgtatatatatatacacatgtgtatatatgtatatacatacgtgtgtgcatatatatgtgtatatatatacgtatata

SEQ ID NO: 14510 - DNA, 81 bp, Homo sapiens
tatacatatatgtatgtatatatgtatatatgtatatgtatatgcatatacatatatacatatatattttacatatgtata

SEQ ID NO: 14511 - DNA, 96 bp, Homo sapiens
atatgtgacatgcctgataccatttcgtgaggttgcaggttgaaattaaccatgaacattagtgatgtatactggataataaggtatgtgctatgt

SEQ ID NO: 14512 - DNA, 66 bp, Homo sapiens
gttgttggtggtggtggtgatgatggtgttggttttggagacagtgtctcgctctgtcacccaggc

SEQ ID NO: 14513 - DNA, 110 bp, Homo sapiens
tatatatatatacatatatatgcgcatatatatacacatatgaaagtatatatatactttcagagtatatatatatgcgcatatatatgtataatttcagagtatatatg

SEQ ID NO: 14514 - DNA, 109 bp, Homo sapiens
atcagtttttggtcccttaggtaatgaaattgtcttaaagtctaaaataaatttctaattttaaaaaaagtacgtggacagttttgtactctgaagtgcttataacgat

SEQ ID NO: 14515 - DNA, 118 bp, Homo sapiens
gcatggtggtgtagtggattgggacgtgactccggcagccacatttttttgatttaaattctcatttttcaactccctgtgtaaccaagagcagatcgcagtgtgcattcctctttgc

SEQ ID NO: 14516 - DNA, 65 bp, Homo sapiens
gggcagctttgagatttggagcaaattattggatctctgatagtcactccctcagatactgcact

SEQ ID NO: 14517 - DNA, 95 bp, Homo sapiens; identical to SEQ ID NO: 68

SEQ ID NO: 14518 - DNA, 93 bp, Homo sapiens; identical to SEQ ID NO: 69

SEQ ID NO: 14519 - DNA, 58 bp, Homo sapiens; identical to SEQ ID NO: 3368

SEQ ID NO: 14520 - DNA, 76 bp, Homo sapiens
ctctatatatatatatatatatatatatatatatgtatatacacatctatatctatacatatctatatatatagag

SEQ ID NO: 14521 - DNA, 118 bp, Homo sapiens
tgcttaggattgtcttggctatacgggctcttttttggttccatatgaaatttaaagtagttttttctaattctgtgaagaaagtcaatggtagcttgatgggtatagcattgaatct

SEQ ID NO: 14522 - DNA, 101 bp, Homo sapiens
gtatgtgtgtatgtatgtgtgtgtgtgtttatatatataatgtttccatattctataaatatatatgtatatgcacacacatatgtatatattatacatac

SEQ ID NO: 14523 - DNA, 101 bp, Homo sapiens
cgtgtgtgtgtgtgtgtgtatatgtgtgtgtgtgtgtgtgtgtgtatatatatatatatacacacacacacagacacatatataatatatatatgtatatg

SEQ ID NO: 14524 - DNA, 64 bp, Homo sapiens
tatatgtgtctgtgtgtgtgtgtatatatatatatatacacacacacacacacacacacatata

SEQ ID NO: 14525 - DNA, 83 bp, Homo sapiens
tcctgactgtgtatctctctctgtaccagtttgcccaaaagtatgactgcaatagttccaagaggtgatatacttccaaggga

SEQ ID NO: 14526 - DNA, 95 bp, Homo sapiens; identical to SEQ ID NO: 68

SEQ ID NO: 14527 - DNA, 93 bp, Homo sapiens; identical to SEQ ID NO: 69

SEQ ID NO: 14528 - DNA, 127 bp, Homo sapiens
gtgtgtgtgtatatatatatgtctatatatgtacatatgtctatatatgtctatatatgtctatatatatctatatatatctatatatgtatgtgtgtgtgtgtatatatatatacacattcagtag

SEQ ID NO: 14529 - DNA, 133 bp, Homo sapiens
tggtttttgtcgttggttctgttcatatgctggattatgtttattgatttgcgtatgttgaaccagccttgtatcccagggatgaagcccacttgatcatggtggataagctttttgatgtgctgctggattc

SEQ ID NO: 14530 - DNA, 95 bp, Homo sapiens; identical to SEQ ID NO: 580

SEQ ID NO: 14531 - DNA, 93 bp, Homo sapiens; identical to SEQ ID NO: 69

SEQ ID NO: 14532 - DNA, 93 bp, Homo sapiens
tactcttgcttgttttttttttttttttttttttttgggatggagtctcgctctgtcacccaggctggagtgcagtggcgcgacctcagctca

SEQ ID NO: 14533 - DNA, 71 bp, Homo sapiens
tgtgtgtacatatatatacatgtatgtttatgtatatttatatatggcatatgtgtatctatatgttagca

SEQ ID NO: 14534 - DNA, 80 bp, Homo sapiens
tgtctgtttttctctctatcaaaactctagtgccaagctcagtagctggggtgtatttatggaaagaaaatagataggca

SEQ ID NO: 14535 - DNA, 87 bp, Homo sapiens
aacagccagtgataaacatgtttttttctcttaaatagataaaagaaccgaataagggagaaagttgggttgaacaaattggttgtt

SEQ ID NO: 14536 - DNA, 95 bp, Homo sapiens; identical to SEQ ID NO: 68

SEQ ID NO: 14537 - DNA, 93 bp, Homo sapiens; identical to SEQ ID NO: 69

SEQ ID NO: 14538 - DNA, 82 bp, Homo sapiens
ggcacatggtataccaggagatcgtttggtgcttgatgtcaatgaatcaggagcatcagaactatttttcttgtattaagct

SEQ ID NO: 14539 - DNA, 201 bp, Homo sapiens
tatatgtgtatatatatacatatatatgtgtatatatatatacacaaatatatgtatatatatacacatatatatgtatatatatacacatatatatgtgtatatatacacaaatatatatgtgtatatatgtgtatatatatacacacatatatgtgtatatatacacacacatgtatgtgtatatatatacacatatat

SEQ ID NO: 14540 - DNA, 99 bp, Homo sapiens
ggataatgggataatgtacaaatacaggagaaggggcagctttgctcctcaggcctgagagaagagtgactgctatgctttgattatttgtgtccctcc

SEQ ID NO: 14541 - DNA, 60 bp, Homo sapiens
gtgagacagagtctcactctgtcgcccaggctggagtgcagtggtgtgatctctgctcac

SEQ ID NO: 14542 - DNA, 113 bp, Homo sapiens
gcaatccctgccttatggacactaaacttaggttgatcctatcctttatttcagatgtattatttaaatatattttgaaacttggccagagaagtttcgtaatgtaatgatgt

SEQ ID NO: 14543 - DNA, 58 bp, Homo sapiens
tgagacagagtctcgctctgtcacctaggttggagggcagtggtgcgatttcagctca

SEQ ID NO: 14544 - DNA, 58 bp, Homo sapiens; identical to SEQ ID NO: 1435

SEQ ID NO: 14545 - DNA, 119 bp, Homo sapiens
gtcttgtcattttttaagtcattgcttttagagatttttttaacctcacatatatttttgtttcttagcataagagggaggaaaatcaaaagctcaaatagagaatttaaaaatgagac

SEQ ID NO: 14546 - DNA, 116 bp, Homo sapiens
gaggatggagaaatggagagttgttgtttgataggtacagaattttagtttcatactataaaaacattttgtaaatctgttgcacaacaatgctaatcctactgagctatacactt

SEQ ID NO: 14547 - DNA, 86 bp, Homo sapiens
tgagagaagtcatatgcatttttgtttttttttttgagatgaagtctcgctctgtcaccaggctggagtgcagtggcacaatctca

SEQ ID NO: 14548 - DNA, 109 bp, Homo sapiens
gtcagtcaagctgtcaggtacatttaggcactaaagttttttttcaataaataaataaatgaacaaagacattattagtgattgagtttaagctacagtttcatttgac

SEQ ID NO: 14549 - DNA, 143 bp, Homo sapiens
atatggctgttgttgaatatacatacatatatatttatgtgtatatatatagatatgcacatacatgtgtatgtatatatagatatatgcatacatacatatgtgtatatgcgtatatatatgcatacatagatgtaaatgta

SEQ ID NO: 14550 - DNA, 105 bp, Homo sapiens
gtttggtactctggcttaactctgtggttaaaatgggtgataatgagttataactcatttttattttattttttcatgggtctagtaggatgttcaaagccagat

SEQ ID NO: 14551 - DNA, 92 bp, Homo sapiens
gttgggtcatggccctggctctcacaagtgactgtgggcagaagtagaaaggatccttgtctttttgtggggctgggggactatgaaatggc

SEQ ID NO: 14552 - DNA, 74 bp, Homo sapiens
gctctggttcaaacgcctctgacactttcaccttggcctcctaaagtgttgggtttacaggtgtgagccactgc

SEQ ID NO: 14553 - DNA, 58 bp, Homo sapiens; identical to SEQ ID NO: 2051

SEQ ID NO: 14554 - DNA, 104 bp, Homo sapiens
tctttatacatatatattctcagaatatgtgtatatatatgtgtatatattctgtatacatatatagatatatatacagagagaatatatatatgtatgcagga

SEQ ID NO: 14555 - DNA, 79 bp, Homo sapiens
gaagctcagttcagtcactatcagtgagcctcaagctttggcttatgtaaaaagctcctggagagattgagaaagcttc

SEQ ID NO: 14556 - DNA, 58 bp, Homo sapiens
tgaggcagagtctcgctctgtcacccaggctggagtgcagtggcgcgatcttggctca

SEQ ID NO: 14557 - DNA, 108 bp, Homo sapiens
cactagtgctaatggtttagggcctcaatcttttttttttttttttttttttttttttttttttttttttttgagacagtgtctggctctgtcacccaggctggagtg

SEQ ID NO: 14558 - DNA, 93 bp, Homo sapiens
actcacacaatcacatacgcaatacatgatatgtatatgatatatatatataatattaacataaacggtgtgtgtgtgtgtgtgtgtgtgtgt

SEQ ID NO: 14559 - DNA, 65 bp, Homo sapiens
ttgagatggagtctcactctgtcacccaggctggagtgcaagggtgtgatcttggctcacttcaa

SEQ ID NO: 14560 - DNA, 102 bp, Homo sapiens
gaggtagcaagtggggggatgaatatggttatatggcaattaagtgaagtaattttcttgtactttccttaaaggtttaccaacaacttctgcttatatttt

SEQ ID NO: 14561 - DNA, 92 bp, Homo sapiens
gcctagttctggttttcttgattatttttatgtcatttctaaattttattttggaccatttaataatagctacagaatcagcttggctgggt

SEQ ID NO: 14562 - DNA, 76 bp, Homo sapiens
tgggattacaggcgtgagccaccatgcccagcctcttgtcttctttttttgagtctgagtctcactctgtcaccca

SEQ ID NO: 14563 - DNA, 64 bp, Homo sapiens
tgagacagagtctcgctctgtcacccaggttggagtgcagtggcagtggcgtgatctcggctca

SEQ ID NO: 14564 - DNA, 72 bp, Homo sapiens
gtttttttgagatggagtctcactctgtcacccaggctggagtgcagtggtgcgatcttggctcactgaaac

SEQ ID NO: 14565 - DNA, 58 bp, Homo sapiens; identical to SEQ ID NO: 2595

SEQ ID NO: 14566 - DNA, 113 bp, Homo sapiens
ttgtgcccttaatctctcacttctttagagagtatctatttatttattcttgcattgtgataaaggaatacctgaggctgggttatttataaagaaaagagctttaaggccag

SEQ ID NO: 14567 - DNA, 86 bp, Homo sapiens
tggactttgaggactattgtttgttttttgggacagagtctcactctgtcacccagactagagtgcagtggcacgctcatggctca

SEQ ID NO: 14568 - DNA, 77 bp, Homo sapiens
gtgtatgtttttaaaaagccagtgctcactttttgtatttaaatttcaaaaatgaggctgggtacagtggcgtgcac

SEQ ID NO: 14569 - DNA, 128 bp, Homo sapiens
gatgttgagtattcaggcactggtggtggagccactgggggcaggagatactctcatgtgtgtataagcatctgtatctgcttcagatttgcataaatctggatgtagataatccacagcagctttca

SEQ ID NO: 14570 - DNA, 106 bp, Homo sapiens
tttctttggctgggcaaaagcatttcagtataattaggtcccatctatttatttttgtttttgggtgcttggtcatgaactctttgcctaagccaatgtctagaag

SEQ ID NO: 14571 - DNA, 93 bp, Homo sapiens
ggtgtttggggttttttttgagacagggtctcactctgtcacccaggctggaggacagtggcatgatcatagttcattacagcctcgaccacc

SEQ ID NO: 14572 - DNA, 60 bp, Homo sapiens
gtgaaactgggtctcactctgtcactcaggctagagtacagtggtgagatcatggctcac

SEQ ID NO: 14573 - DNA, 71 bp, Homo sapiens
cttttttttcaaggtcagtctggctctgtcacccaggctggagtacagagtggcctgatcttggctcaaag

SEQ ID NO: 14574 - DNA, 81 bp, Homo sapiens
gggcaatagatttactgtcacagaatgaaagaattttttttttttttttttttttttttagagacaggctctctgtcgccc

SEQ ID NO: 14575 - DNA, 59 bp, Homo sapiens
atggagtgatcccgaccttaacagaatttttttttctttgagatggagtctcactccat

SEQ ID NO: 14576 - DNA, 101 bp, Homo sapiens
agataacgaaccgctgctattccagtaagcagacaaacatgtctaaaaattatgtttattttaccatgtacctttgttactaatatcagctattgttattt

SEQ ID NO: 14577 - DNA, 76 bp, Homo sapiens
tttcagataagtgacacagtgaattttcattctcttttttttgagatggagtctcactctgtcacccaggctggag

SEQ ID NO: 14578 - DNA, 113 bp, Homo sapiens
ggatatatcaatgagttgaatgcagattccacagtaccttagaaaaaaatttgttggatatatatattttttaaatctgcttgtcccattctgctgttcagctgttagtgtct

SEQ ID NO: 14579 - DNA, 86 bp, Homo sapiens
tatttaaatatttcaatatatgtattgaattatttaagtatttcaatatatgtattgaattatttaagtatttcaatatatgtatt

SEQ ID NO: 14580 - DNA, 86 bp, Homo sapiens
gagatgtcaaataatttacctaacagtcccatttacatggatgtaactctatttttatgtaaacattttaggtaaatgggcctctc

SEQ ID NO: 14581 - DNA, 94 bp, Homo sapiens
ggatggctaatttcaggtgagtctgcaggaccgtagatagaaagaatttatgggatgtaaagaaaaaaattcactgaagaggaggtagtgattt

SEQ ID NO: 14582 - DNA, 91 bp, Homo sapiens
gggcacgctggtgacctctggcattccttggttcctgcattaccgtccctgtctgtgcattctccctgtgtgcctgtgtcccagtttcccc

SEQ ID NO: 14583 - DNA, 77 bp, Homo sapiens
atgatggaatttatatatatatatatatatatatatatatatatatatatatatatatatgatggaatactactcat

SEQ ID NO: 14584 - DNA, 111 bp, Homo sapiens
atgaaataagacatgaaatatttgagacatatatgtatatatatacacacacacacgtatatgtatatatgtatatggtatgaagtccttgaaatctgatgtgtattttat

SEQ ID NO: 14585 - DNA, 88 bp, Homo sapiens
ggctagattcatgcattctttcagtgtttgagggcctgctgtgtgctgatgctgcttcaggatctggatgtggagagatgagtaagcc

SEQ ID NO: 14586 - DNA, 111 bp, Homo sapiens
gaagtacatgaccaagtggatccaggtgacctgaagcaaagacacgtggcctggccttctctctgtcaccctctgtttgtctcctccacagtcactcctgtcaacatcttc

SEQ ID NO: 14587 - DNA, 58 bp, Homo sapiens; identical to SEQ ID NO: 454

SEQ ID NO: 14588 - DNA, 101 bp, Homo sapiens
ttcaagttaaaccttttttgtcaagaatactacaacttttttgtttttaatctaaataaggacaaggtgttctgcaggttaaagagggtgatgagagtgaa

SEQ ID NO: 14589 - DNA, 115 bp, Homo sapiens
ctgtgctctgtgagttcctgagaggctcagggattgtctggactgcgaagctggagtcacagtgcaagtccaagtgatttactttgggatggcctctgagctcactttgggatgg

SEQ ID NO: 14590 - DNA, 81 bp, Homo sapiens
gttggggtgtgtgtgtatgtgtgtgtgtgtgtgtgtgtaccaatatatgtacacacacatactcggcatggaatagctgag

SEQ ID NO: 14591 - DNA, 93 bp, Homo sapiens
gtagtcccagctactcaggaggctgaggtaggaggatcacttgggcctggggagtcaaggctgcagtgagctgagatcttgccactgcactcc

SEQ ID NO: 14592 - DNA, 111 bp, Homo sapiens
tctatacctatcacggaagtctctgcttgtaagagtgtctccctctcagtatcagggcaagaaggatgcgtggaagtcactggagacttttgtcaatgaagcaggtgctga

SEQ ID NO: 14593 - DNA, 86 bp, Homo sapiens
gcgtgtgcatgtgtgtgtgtgcgtgcatgtgtgtgtgtgtgcgcgtgcatgtgtgtgtgtgtgtgcgtgcatgcgtgtgtgtgtgt

SEQ ID NO: 14594 - DNA, 84 bp, Homo sapiens
tgagaccctgtctctctctctattatataattttatatatatatatatatatatatatatatatatggaaaagggaaagggcca

SEQ ID NO: 14595 - DNA, 119 bp, Homo sapiens
tgaaatggcagggttgggatttgaactcaagagtcttactgtagactctgtgctctgagccaccatgctaagctatctagagggagatgtcctgtgttactgtggcagccgtgttagca

SEQ ID NO: 14596 - DNA, 85 bp, Homo sapiens
gaggaggttgcagtgaaccgagatcacaccactgcagtccagcctgggcaacagagctgactcagtctcagtcagtcaatcaatc

SEQ ID NO: 14597 - DNA, 79 bp, Homo sapiens
cttggttattttggagactccagcttatttttttttttttttttttttttttgagatggagtctcgctctgtcaccagg

SEQ ID NO: 14598 - DNA, 94 bp, Homo sapiens
ggctctaaaagttgcctctgtctctcgctctgccttatgccccttggtcaaattctttcctctgaggaagcaagaactgaggttgctgcagacc

SEQ ID NO: 14599 - DNA, 133 bp, Homo sapiens
caattttggattttatgctgtaggaaaaaacaatgagcaccattcattcatttagtgagtagttactgagctctagctgtgtgccctctgctgtgttggagacagaggtgactatcagccgatgctttggatg

SEQ ID NO: 14600 - DNA, 100 bp, Homo sapiens
gtagttatgaggaatagaattcttttagaagcaggcagcatgaacttatacttccttgtacttacttctttaagaaaccagtcttaaccctcctttctac

SEQ ID NO: 14601 - DNA, 85 bp, Homo sapiens
ccagggaccatcgtgtggatctctttcatctcatactcctggggcgcaggctgccagagatgagagagagctgtggggtctgagg

SEQ ID NO: 14602 - DNA, 89 bp, Homo sapiens
tcttttttaagttgacataaaattgtatatatttatcatatacaacatgttttgaaatatgtatacattgtgtaatggcttaatcaaga

SEQ ID NO: 14603 - DNA, 84 bp, Homo sapiens
attagctgggcatagtggtgtgcctggagtcccagctactgaggaggctgaggtagaaggatcacctgtgcacaggaggttgat

SEQ ID NO: 14604 - DNA, 72 bp, Homo sapiens
gtgatagagtaggcttctttttcttcctttctttcttttttttttttttaagacagagtctcactctgtcac

SEQ ID NO: 14605 - DNA, 85 bp, Homo sapiens
acagcgacagatttttttttaaattagcttattttaagccttgaataaggctcgagaatcaagcttttctgaatctgtcctctgt

SEQ ID NO: 14606 - DNA, 112 bp, Homo sapiens
atatatacatatctcacatatacacatatatatctcatatatatgatatatatacatatatgtatcatatatatgatatatacatatatgtatatgtgtatatgtgagatat

SEQ ID NO: 14607 - DNA, 117 bp, Homo sapiens
ctgggtggggtggtacatacctgtagtcccagctactcaggaggctgaggtaggaggatcgcttgaccccaggagtttgaggctgcagtgagctataattgtgccactgcactccag

SEQ ID NO: 14608 - DNA, 118 bp, Homo sapiens
tgtgagccatcatgccggacctagagcccatttcttttcttttttttttttttgtttgtttttttttgtttttttgagacggagtctggctctgttgcccaggctggagcacagtggc

SEQ ID NO: 14609 - DNA, 82 bp, Homo sapiens
ccacagacctagtattttggctgactttttatatattagctacttaattctttactaaagtcagtcaatctagcagttgttg

SEQ ID NO: 14610 - DNA, 91 bp, Homo sapiens
tgggggcagtgggcagtgtagggaaaaatgggatcacactgaacatactgggtagttttttgtttttttttttcagcgtctcactctgtca

SEQ ID NO: 14611 - DNA, 89 bp, Homo sapiens
tgcaattttcagatttggggagactgactttttttttttttttttttttttgagatggagtgtcactctgtcacccaggctggagtgca

SEQ ID NO: 14612 - DNA, 100 bp, Homo sapiens
tagaacggtaggaaatgccagcgtgtgcgtctgtctggggctgtgcacagactccacaaaggacggattgtccacggctttgtgcattcctagggtctta

SEQ ID NO: 14613 - DNA, 92 bp, Homo sapiens
ggtctttggcaatttctccatttgatgtctgtgcatgcgcatgcatatgcatgtatttaaataattgaacattagagaatacttgggagtcc

SEQ ID NO: 14614 - DNA, 114 bp, Homo sapiens
ttttaaatgtaggggtagacatgtatgctataatttatatgtctttttcatttcattttaaaagtaacaaaaacacatttaaaaagtaacaacatgtattaccaacacttggaa

SEQ ID NO: 14615 - DNA, 127 bp, Homo sapiens
cttgaaacaacagaaatctattgtctcacactctacgtgggggtgtagaagtctgagatcaaggtgtcagcagggccgggttgcctgtgaaggctccagcagcgaatccttcctcacttcttcccac

SEQ ID NO: 14616 - DNA, 108 bp, Homo sapiens
aacgtgttatcaagggtaaactttctgtttttattattcttttaacttttattttaagttcaggggtacatgtgcaggtttgttatatagatagattgatagcatgtt

SEQ ID NO: 14617 - DNA, 72 bp, Homo sapiens
ggcagatcaagacttttctgaagggcccactgtatgacccctgtctcagtctccttctgtctttatgctgct

SEQ ID NO: 14618 - DNA, 87 bp, Homo sapiens
ccgcaaccaatcactgacaggttttgaagaagtgctgtgattggccagtgatcatgttgtgcatctattattacttagtgactgtgg

SEQ ID NO: 14619 - DNA, 96 bp, Homo sapiens
gttgagaaggttgagattctaaatgtttatattacttactccagggttattcatttggcaaatggtagaacaacattagaattaaagcttcgggat

SEQ ID NO: 14620 - DNA, 56 bp, Homo sapiens
gagacaggatctcactctgtcactcaggctggagtgcagtggtgcaatcacagctc

SEQ ID NO: 14621 - DNA, 81 bp, Homo sapiens
ttcagaacttaacaggtgtcggactctgttttttttttttttttttttgagacagagtctcattctgtcacccaggctgga

SEQ ID NO: 14622 - DNA, 130 bp, Homo sapiens
tcccttttgaatgtgttggtggtatgtcctgggacgtgcagccacctggctgtcacggtgtctgagtgccaccagatggggattttacagacaaagtcaggtgctgtttcccagcctgggcctatggata

SEQ ID NO: 14623 - DNA, 111 bp, Homo sapiens
gtttgcatgtactacttcttttaatcttaagaaaattaacaggtagaaattattatctttattttacagatggaaaagctgaagtccataaaaattaagtaacatgcaaat

SEQ ID NO: 14624 - DNA, 122 bp, Homo sapiens
ctggcctggctgccactcccagagcccctggaactctggcccaaggctctctgactgactgcttcccagatcttcttggcttagcggctgaagactgacgctgcccgatcaccttagaagcc

SEQ ID NO: 14625 - DNA, 95 bp, Homo sapiens; identical to SEQ ID NO: 68

SEQ ID NO: 14626 - DNA, 93 bp, Homo sapiens; identical to SEQ ID NO: 69

SEQ ID NO: 14627 - DNA, 81 bp, Homo sapiens
cactgtagacctattaaaatggctaaatttttttttttttttttgagatggagtttcgctgttgtcgcccaggctggagtg

SEQ ID NO: 14628 - DNA, 71 bp, Homo sapiens
agacacctgagatcttgctctgtctccactgggaaaagccgtgtgaggacacagtgagaaggcggcagtct

SEQ ID NO: 14629 - DNA, 118 bp, Homo sapiens
cttacgctgaagtcttggctttacagattcattttatttcttttcaacagtgattttgtatatctgtactgggagctggagggagagtgaaatacgtaaccctgagagtgaaagttag

SEQ ID NO: 14630 - DNA, 67 bp, Homo sapiens
ccagctgtaaagtggtgatggcaggagaaaccctacagggactggctcacacacacacagggactgg

SEQ ID NO: 14631 - DNA, 67 bp, Homo sapiens
tcaagtggcaggttagagtcctcaagggatggcgccatatcagggtctcagtatctgtctctcttga

SEQ ID NO: 14632 - DNA, 114 bp, Homo sapiens
gcatttgaaattggagatgctataaaggatcagacataattggtgactatttaaatttaaattatttaaatttaaaattcagttctatggtgacattagctctgtttcaagtgc

SEQ ID NO: 14633 - DNA, 62 bp, Homo sapiens
tgtatatatatgtgtatatatgtatatgtgtgtatatatatatgtgtacatgtatatataca

SEQ ID NO: 14634 - DNA, 62 bp, Homo sapiens
ctggtaggtggagggacctggattggaatcatggattttagtctggctcctgaactcatggg

SEQ ID NO: 14635 - DNA, 58 bp, Homo sapiens
tgaggcagagtctcactctgtcgcccaggctggagtgcagtagcgtgatctctgctca

SEQ ID NO: 14636 - DNA, 58 bp, Homo sapiens
tgagactgagtttcactctgtcacccaggctggggtgcagtggcgtgatctcagctca

SEQ ID NO: 14637 - DNA, 56 bp, Homo sapiens
gaaacagggtctcgctctgtcgctcaggctggggtgcagtggtgcgatcttggctc

SEQ ID NO: 14638 - DNA, 73 bp, Homo sapiens
tctgcccatgtgttttttactatgtctatatttatttgttaaaagtagatgtggtacacaacaaatgtataga

SEQ ID NO: 14639 - DNA, 118 bp, Homo sapiens
agagattctaataatagaattgaattcaaaagaaactgtctttgattttgtatatacttaaataagaaactgtagagagtggaaactaaagcttttgttttcatgttctgttttcttt

SEQ ID NO: 14640 - DNA, 90 bp, Homo sapiens
tacatgggtaatggatatggtcaagagtgttttgagtctatatatatatatagatatatatacacatgtgcatatgtatatcataatgta

SEQ ID NO: 14641 - DNA, 117 bp, Homo sapiens
tctatctatctatctatatcatctatctatctacctatctatcatctatctatcaaatgagagagagagagagagacagaggggagtgggagagagatattgattcatgaagatgga

SEQ ID NO: 14642 - DNA, 93 bp, Homo sapiens
tacatatatatgtatgtgtgtgtatatatatttatatatatgtgcatatatatgtgtacatgtaatatataatatatatgtatttatatataa

SEQ ID NO: 14643 - DNA, 101 bp, Homo sapiens
actacacatattgtttatatataatacatatgttgtatattatatatgacatattatatattatgtaattatatgttttgcatatataatatgtatgtagt

SEQ ID NO: 14644 - DNA, 146 bp, Homo sapiens
gcctcagtttctcttctgcatgggtgttagatgattttttttttgtttttcttttttcttttttttttgagacagagtctctccctgtcacccaggctggagtgcagtggcgtgatctcggctcacggcaacctccgcctcccggg

SEQ ID NO: 14645 - DNA, 108 bp, Homo sapiens
atatatatgctatatatatatactatatacatgccatatatatgctatatatatatatatagctatatatacatatatatgccatatatatgctatatatatttctgt

SEQ ID NO: 14646 - DNA, 75 bp, Homo sapiens
gcttcattctctgtctccctctcttattccctaaatctatcagtaagtttaggtatgcaggagggttagagttgc

SEQ ID NO: 14647 - DNA, 66 bp, Homo sapiens
tgaggtggcttttgttatcattcacagatgacactgaacattgggatgacaacataagcaacctgg

SEQ ID NO: 14648 - DNA, 152 bp, Homo sapiens
tcggagccagggaaggcagggataaaggctgctcttgatgagttccatcagaaaacttttttttttttttcctggatcagacagaacccactgaacagagatgaaaatattctcttcagagtttggttaattcactaaggattggaataagt

SEQ ID NO: 14649 - DNA, 89 bp, Homo sapiens
agatatggcaatatgtagtagagtagccatgcctaatttaatgttatttatattgaaatgctggctcacacacacaactgcaaatttct

SEQ ID NO: 14650 - DNA, 111 bp, Homo sapiens
atgtctatccgttttccacattctccctggacctgtcttctccctctctcagtggctcataccccttgaagagacaactggtttggagagcaaaacagaagcagcaaacat

SEQ ID NO: 14651 - DNA, 150 bp, Homo sapiens
atatatggaggtactatacatatatatatatagagagagagaatatatatatatatactttatatgtaggtgtatatatatactttatatatatgtgtgtgtgtatatatatatatagagagagatatcccactatatatatataaagtg

SEQ ID NO: 14652 - DNA, 85 bp, Homo sapiens
tgaccttgggctttcagcctccagaactgtgacaaaataaatgcatgctatttcagtcactcagtctgtggttgttaccgtagca

SEQ ID NO: 14653 - DNA, 85 bp, Homo sapiens
ccagcctgggcaacatagtgagatcccatgtctacagaattttttttttttttgagatggagtctcactgtgtcacccaggctgg

SEQ ID NO: 14654 - DNA, 94 bp, Homo sapiens
ggtaggtagcagggctgggatttgaacccaggttgtgtgatgtccgtatactgcctccttcactgcctctctcactcctttcttgcacatgtcc

SEQ ID NO: 14655 - DNA, 86 bp, Homo sapiens
agtatgtatgtatataactatgtatatatgagtgtgtttatataaagatatatataatagatttatacagttataacatatatcct

SEQ ID NO: 14656 - DNA, 116 bp, Homo sapiens
cagtgtttttcttgttactgtaactggaatcaatttcttgtttttctttttttttttaatggaagaaccttaagatatgagtgattcataaacgtcttcactatcaaggtatattg

SEQ ID NO: 14657 - DNA, 109 bp, Homo sapiens
attcctatgcccagggtgtctgtgtctctgtttcttttttactttttctttctttactttttttttttttttttaagatggagtctcactctgtcacccaggctggagt

SEQ ID NO: 14658 - DNA, 112 bp, Homo sapiens
gtgtacggtttgatggtccttagtgtattcagagttgtgcatctaccaccacaatacatttttatatattgtcatcacctctagaagaaaccttacagccattagctatcac

SEQ ID NO: 14659 - DNA, 88 bp, Homo sapiens
gagttcacctgagatctggttgttcgaaagagtctgggacctccctcctctcactcttgctccctctcaccatgtgacacacctgctc

SEQ ID NO: 14660 - DNA, 89 bp, Homo sapiens
acaccacaagcagtaaacatatatatatgtatacatatatatacacattatatatgtatacatatatatatgtttactgcttgtggtgt

SEQ ID NO: 14661 - DNA, 90 bp, Homo sapiens
gcctttatttaaaaattgccttagtgtaacaagtgtgacagttaatcacctcaatgtcacacactcactgcaatcgtcacactctgaggc

SEQ ID NO: 14662 - DNA, 106 bp, Homo sapiens
agtagcctagtgctgatgttactgattttgtcctgcttttattttatattttgagctggctaaagtgacttaccagtttgtcagttgatttttttttggcttttct

SEQ ID NO: 14663 - DNA, 103 bp, Homo sapiens
ggtaggtgtatgatacataggggaaaaacacatacatatataggttatatgaatatatgtatatctccatatatatatgttatatacccataaaatatgtacc

SEQ ID NO: 14664 - DNA, 119 bp, Homo sapiens
atagatagatctgagatgtttttaccacatacagaaaaataggaatgaagtgaggtgataagtttatttaattattcatttttatatttcacatgtgagatcatgcaatatttatttgt

SEQ ID NO: 14665 - DNA, 105 bp, Homo sapiens
ggtcaaaagttagtttaattggaagctgatattcaggctatgcctatcaatctatcaatatatattttgaggcatctctgttctttctaatggatctaactgtcc

SEQ ID NO: 14666 - DNA, 98 bp, Homo sapiens
gatagaaaaagatattccatgtcaatggaaaccgaaaaagaggagtagttattctttttttttttttttttttttttgagatggagtctctctctgtc

SEQ ID NO: 14667 - DNA, 65 bp, Homo sapiens
aagtaaaaagtgtgtgtgtgtgtgtatacatatatatatatatatatatacctaaatttttattt

SEQ ID NO: 14668 - DNA, 98 bp, Homo sapiens
tgctgtgtttatctgcctgggtgttttctttttttcctctctctgtgtgtgtatacatgtgtgtgttgatagtgagcagaacatagccaggagcagca

SEQ ID NO: 14669 - DNA, 57 bp, Homo sapiens
ggaggcagcataactgcagtccttgcagggagtctctctgtgtatgtgtctgtctct

SEQ ID NO: 14670 - DNA, 58 bp, Homo sapiens; identical to SEQ ID NO: 1391

SEQ ID NO: 14671 - DNA, 56 bp, Homo sapiens; identical to SEQ ID NO: 1392

SEQ ID NO: 14672 - DNA, 108 bp, Homo sapiens
ccagcctgggcaacatacaagatcctgtctcagaaaaacaaatacaacatacaccttctcctctgttgtctctgtcataggaactaaccgtgctgtactctgtgctgg

SEQ ID NO: 14673 - DNA, 106 bp, Homo sapiens
actcagtcggtctgggctgggtcctaggcataattattttatttttattttttatttttttgagatggagtcttgctctatcacccaggctggagtgcagtggcgt

SEQ ID NO: 14674 - DNA, 79 bp, Homo sapiens
ggcagatatatatgtgtgtgtgtgtgtgtgtgtgtgtgtataaaatgcatatatataatgcatatatatatgtattgac

SEQ ID NO: 14675 - DNA, 80 bp, Homo sapiens
tccactcagtcctctgtctgtgtgtatctgtgtccctgtttcctcttcgtataaggatgccagtcagattggatgaggga

SEQ ID NO: 14676 - DNA, 92 bp, Homo sapiens
cagtgccaagtatgtagtgtgtgcttagtaaatatttattgaatgaatgaatgaatgtagcttgagaacactggaaatgttctttggctctg

SEQ ID NO: 14677 - DNA, 107 bp, Homo sapiens
gaagagtaaattatgaagatgcttttcagctgaaaaatgttattattctttgtttttcaaatagcaaaacccagtccaatgtatggcatttgaattatgtatttttc

SEQ ID NO: 14678 - DNA, 142 bp, Homo sapiens
gcctgggcgacagagcgagatgttgtctccaaaaaaaaaaaaaaaagactatatctcccttttttttttttttttttttttttttgagacggagtctcgctctgtcacccaggctggggtgcagtggcgtgatctcggctca

SEQ ID NO: 14679 - DNA, 66 bp, Homo sapiens
tgagagatagtctcactctgtcactctgttgcccaggctggagtgcagtggtgtgatttcggctca

SEQ ID NO: 14680 - DNA, 123 bp, Homo sapiens
tcttggttttgactttctatttatatttttgtttttactcatttataatttaatattttattgcatatgttcttgtttataaaatgcttgggtagagaaaggcaaaaatgaggcaggaaatta

SEQ ID NO: 14681 - DNA, 71 bp, Homo sapiens
aagggaacactgtacactggtgggaatataaattagcacagccattacagaaaacagtgtggagttccctt

SEQ ID NO: 14682 - DNA, 58 bp, Homo sapiens
tgagacggagtctcactctgtcacccaggctggagtgcagtggtgcgatctctgctca

SEQ ID NO: 14683 - DNA, 103 bp, Homo sapiens
ccagttggtggtttgaattttcttatgaatgtgaactttaaatatttatataagaacataaagaatatgtcatatttagagataaatttaagaaaataggtgg

SEQ ID NO: 14684 - DNA, 58 bp, Homo sapiens
tgagacggagtctcgctctgtggctcaggctggagtgcagtggcgcgatctcgactca

SEQ ID NO: 14685 - DNA, 99 bp, Homo sapiens
tatacaaatatgtgtatatgtgtgtatatctttaataagtggatgaaaaatgcatttatttaataaatatatatacacacatttatatgtgtgtgtata

SEQ ID NO: 14686 - DNA, 112 bp, Homo sapiens
tgcttaatctgtctctgggtcacatgttgctaattcttgcaatatttcagactttttattttatatctgttgtggtgatctgtgatgagtgatctttgatgttactattgca

SEQ ID NO: 14687 - DNA, 112 bp, Homo sapiens
ggatatatatatttagatatacatacacatcccagttatatatgcgatacacacacacacacacacacacacatacacgcataccagctatgtatagggagtatatatatcc

SEQ ID NO: 14688 - DNA, 89 bp, Homo sapiens
gaacatcaggtaattatcagagtttgtaagtatatatttccttgactgatcaaagaaggtatctgtctctctgactagcctgtaggttc

SEQ ID NO: 14689 - DNA, 108 bp, Homo sapiens
gctgggttgggatgataaatggtcattgaattttgcaaactggaagtcacagatgactgtgaccaagcagtttcagtgggtggcagaagagaaaaatctaaattgagc

SEQ ID NO: 14690 - DNA, 113 bp, Homo sapiens
gtgtatgtgtgtatacatatgtgtatgtatgtgtgcatatacatgtgtatatatgtgtatacatatgtatatatgtgtgcatatacatgtatatatgtgtgtatacatatgtg

SEQ ID NO: 14691 - DNA, 105 bp, Homo sapiens
gtcttaacactattgaatcttctgggcatagatatttctgcatttgtttagaatgtaagcatgtatgtattttttctcagctctttaagtttccagtgttcagat

SEQ ID NO: 14692 - DNA, 73 bp, Homo sapiens
gaaggatattaaatgtgtatatacatgtgtgtatatgtgtgtatacatgtatatatatatatgtttgaccttc

SEQ ID NO: 14693 - DNA, 75 bp, Homo sapiens
tggagcacacagaacacacacagcatttaccaatgaagtttgccatttcatatgtgcatggttcgtagtgcccca

SEQ ID NO: 14694 - DNA, 94 bp, Homo sapiens
tgtatgtgtgtacactgtgtgtgcatatatatataatcatatatttgtatttttagagaagatatatatacacacacacacacacacacacaca

SEQ ID NO: 14695 - DNA, 95 bp, Homo sapiens; identical to SEQ ID NO: 68

SEQ ID NO: 14696 - DNA, 93 bp, Homo sapiens; identical to SEQ ID NO: 69

SEQ ID NO: 14697 - DNA, 103 bp, Homo sapiens
ggattgtcttagctataagggctcttttttggttgcatatgaaatttaaagtagttttttctaattctgtgaagaaagtcaatggtagcttgttggggatacc

SEQ ID NO: 14698 - DNA, 58 bp, Homo sapiens
tgagacggagtctcactctgtcactcaggctggagtgcagtggtgcaatctcggctca

SEQ ID NO: 14699 - DNA, 88 bp, Homo sapiens
gatcaagaggttggcaaggtaggttccctctgaggcccctctctttggcttgcagatgtccactctccctctgtctctttacaagatc

SEQ ID NO: 14700 - DNA, 95 bp, Homo sapiens; identical to SEQ ID NO: 68

SEQ ID NO: 14701 - DNA, 93 bp, Homo sapiens; identical to SEQ ID NO: 69

SEQ ID NO: 14702 - DNA, 130 bp, Homo sapiens
tgagctttgaaagagatgatttgagtacaaaccccatctcccaagtggcggggccggccttgtgtctgtcactctctttctttactacaatcctgtggtcattctttatgcagcaggcaggaagagcccc

SEQ ID NO: 14703 - DNA, 232 bp, Homo sapiens
tacatatatatatacacacatatatgtgtatatatgtacatatatatgtatgtgtgtatatatatgtgtatatatgtatgtgtatatatgtaatatatgtgtgtatatatgtgtatatatgtacatatatgtatgtgtatatatatgtatctgtatatatatgtatatgtgtgtgtatatatatatgttaggtatatatatgtgtgtgtgtatatatatgtgtgtatatata

SEQ ID NO: 14704 - DNA, 104 bp, Homo sapiens
gagggaaaatgagaataatggaaaggaatatgtaatttttcttttgtgaggaattaaagctaggatatatatttatttttattatactaaaatcattttaactt

SEQ ID NO: 14705 - DNA, 93 bp, Homo sapiens
gttttgagaatctgtagagagaagagtcagtgcacagcttaggctacatagatcaacgttgggtattggacctttctggaatcagagaagaac

SEQ ID NO: 14706 - DNA, 113 bp, Homo sapiens
cgtgcagtgtgtgtgtgtgcgcgtatgcgtacaggggttccgtgcagtgtgtgtgtgtgtgtgtgtgcctgtgtgtatatatgcgtacaggggttccatgcagtgtgagtgcg

SEQ ID NO: 14707 - DNA, 111 bp, Homo sapiens; identical to SEQ ID NO: 13350

SEQ ID NO: 14708 - DNA, 81 bp, Homo sapiens; identical to SEQ ID NO: 7982

SEQ ID NO: 14709 - DNA, 111 bp, Homo sapiens
tcaatgcattgcttagggttcaccagagaaacgtgtgtgtgtgtgtgcgtgtgtgtgcgcgtgtgtgtacatgtctgtgtaggagggtgagacagacagagatttcgttga

SEQ ID NO: 14710 - DNA, 82 bp, Homo sapiens
cactgtgtgcctggctccgtgttaagtgctatttcagtgaaatgttagcactgtaaaatggtttcagaaaaaggcatttgtg

SEQ ID NO: 14711 - DNA, 95 bp, Homo sapiens; identical to SEQ ID NO: 68

SEQ ID NO: 14712 - DNA, 93 bp, Homo sapiens; identical to SEQ ID NO: 69

SEQ ID NO: 14713 - DNA, 95 bp, Homo sapiens; identical to SEQ ID NO: 68

SEQ ID NO: 14714 - DNA, 93 bp, Homo sapiens; identical to SEQ ID NO: 69

SEQ ID NO: 14715 - DNA, 59 bp, Homo sapiens
acaagtcagagagagggactggggtgggtcaactcacactcagcctcactggctactgt

SEQ ID NO: 14716 - DNA, 81 bp, Homo sapiens
agcaccgtgttttatgtagaagaatgagggtgtctgaaagaatgggtctctttatttatttttatttctgagacagggtct

SEQ ID NO: 14717 - DNA, 99 bp, Homo sapiens
tgtggatatataaaaaatacttgcatatatatacatgtatatatgtataatacatgtacgtatacatgttatatatatgcatgtatatatgtatttata

SEQ ID NO: 14718 - DNA, 70 bp, Homo sapiens
ggccagggttggagggcaggagtaaccccctggagaatatgggaatgtcctgtctcttagtcactctgtc

SEQ ID NO: 14719 - DNA, 90 bp, Homo sapiens
ggtgaatgcagaatccacacactctgtttctctctgcattaatgctgtgctttggtgtgacgcattgagtagagtcgtggagcatctacc

SEQ ID NO: 14720 - DNA, 102 bp, Homo sapiens
ccactagtgtgctctgtcggagaatatatatatgtatgtacatatgtgtgcagtctgtatttatgtatatatacgtatatgtacatgagaggcagtgtgggc

SEQ ID NO: 14721 - DNA, 98 bp, Homo sapiens
gtttgtttttgaaggggatgtgtaagtggaggggctggtggttttttgttttttggtttttattttcagtttctgagatcttcctgtttgtaacaagc

SEQ ID NO: 14722 - DNA, 61 bp, Homo sapiens
tatatatgtgtatgtatatgtatatgaaaatactatggatatatatatgcatatgtatata

SEQ ID NO: 14723 - DNA, 95 bp, Homo sapiens; identical to SEQ ID NO: 68

SEQ ID NO: 14724 - DNA, 93 bp, Homo sapiens; identical to SEQ ID NO: 69

SEQ ID NO: 14725 - DNA, 139 bp, Homo sapiens
ggggtttacatatatatgtgcatatgtatatatgaatatctattacatatgtatatttatgtatgtacattacatatgtatatatgaatgtctattacatatgtatatttatgtaaatatattacatatgtatatatgc

SEQ ID NO: 14726 - DNA, 74 bp, Homo sapiens
atggaatatatatatatatattatatatatatatataatagtatatattacataatgtgtgtgtatatctctat

SEQ ID NO: 14727 - DNA, 116 bp, Homo sapiens
acaattgagttatgtgtagtaatcttgtattctgcaaactggatgtgctgattttttttttaattctagtgacatctttgtggattccgtaggattttctctataaaagtaattgt

SEQ ID NO: 14728 - DNA, 83 bp, Homo sapiens
tgtgtgtgtgtgtatgtgcatgtgtgtgtatatatatatattttatatatatatatttatgtacatatgtatatacataccat

SEQ ID NO: 14729 - DNA, 129 bp, Homo sapiens
ctacaaatacaaaaaaattagctgggcatggtggcgggcacctgtggtcccagctatttgggaggctgaggtagtaggatcacttgaacctgggaagcgaaggttgcagtgagctgagatcgcaccact

SEQ ID NO: 14730 - DNA, 77 bp, Homo sapiens
caatctgttctcattcagcatttcctaagaacctactaagggccagagattagggaatgttgactgagagcaggctg

SEQ ID NO: 14731 - DNA, 112 bp, Homo sapiens
ggcacagtaaaagctgaagattaaatgtgtgtgcaaatattgggtataatttgaagtaaattatttatattgtttatttaatatcaagctttgaaatagttttgactgagtc

SEQ ID NO: 14732 - DNA, 60 bp, Homo sapiens
ttgagacagagtctcactctgtcatccaggatggagtgcagtggtgtgatcttggctcag

SEQ ID NO: 14733 - DNA, 115 bp, Homo sapiens
gccaggggtggtgatggttgcctgtagtcccagctatttgggaggctgaggttggaggatcacttgagcccaggaggttgaggctgcagtgagctgcgatcatagcactgcactg

SEQ ID NO: 14734 - DNA, 79 bp, Homo sapiens
agtttatatttttaaatgttactacaaaatgttccactggcaagcctgggaattctaagtggcatgaaaagatcagact

SEQ ID NO: 14735 - DNA, 80 bp, Homo sapiens
caaagtcaatgtgcacatctgcttttgggcatttgtatatttttataaacagtcacagaagcatttgttaacattctgtg

SEQ ID NO: 14736 - DNA, 89 bp, Homo sapiens
tctcccccactgctgcttatgatctgagtttcttgttcatacatttgtggccacgcaacagagagagagagaaccggcagatacggaga

SEQ ID NO: 14737 - DNA, 82 bp, Homo sapiens
tatatatatgtagatatatagatatagatatctatatatctatatatatagatatctatagatatatatctatatagatata

SEQ ID NO: 14738 - DNA, 72 bp, Homo sapiens
tatatatagatatatcgatatatatagatatatctatagatatatatctatatatagatatatctatatata

SEQ ID NO: 14739 - DNA, 116 bp, Homo sapiens
agttttactttagtgtttttttgcttgcatatttatttatgcatatttattttatataattgaggtattactgcatatagaattttgagcatattttatgtaattgaggtattact

SEQ ID NO: 14740 - DNA, 81 bp, Homo sapiens
gctgaaatttttattttttaagtagaatgcagtagaggtgcttggcatcatatcacctttaaatagttttatttatttagc

SEQ ID NO: 14741 - DNA, 120 bp, Homo sapiens
gtagtgataatgtagcgagattttctgttgtgcttgatctaaccatgtggttgcgaggtatgagtaaaacatggttccgtcaagcaccatggaacgtcacgcagctttctacagcatgac

SEQ ID NO: 14742 - DNA, 71 bp, Homo sapiens
gctatagatcatcagtctctctgccacactgcatggtctgtaggagtagagagaatgtttctgtttctata

SEQ ID NO: 14743 - DNA, 104 bp, Homo sapiens
accttattttacttaataatggccccaaagtgcaagagtagtgatgttggtaatttggacaagcccaagagaaactgtcaagtgcttcctttaagtgaaaaggt

SEQ ID NO: 14744 - DNA, 63 bp, Homo sapiens
atacacacatatgtattgtgtatgtagcagtgtatgtatatatgtgtatatatatgtgtgtat

SEQ ID NO: 14745 - DNA, 107 bp, Homo sapiens
tatatacacacatatacatacacacatacatatgcgtgtatgtatatgtatatgtatatacacatgtacatacatatacatatatacacacatacatacatatgtat

SEQ ID NO: 14746 - DNA, 112 bp, Homo sapiens
aagcaaatgaatcaaatgtttttgtctgagcacaaaacaaagagacatatttttttttttactgtctgcttatcaagtaatgaataaaaatatttgtttttcattttgtctt

SEQ ID NO: 14747 - DNA, 90 bp, Homo sapiens
attattccatgtatagctttgattctaaaatgcatgattttttttttgtttttaatgcatagagttctgttggatatgctctggaatagt

SEQ ID NO: 14748 - DNA, 104 bp, Homo sapiens
tctggaaatgatagatatgaagttcatgtttgctgtattaattttccactctttcataaaggcactggatgtattctgcaactccttcagactgaatttctagg

SEQ ID NO: 14749 - DNA, 93 bp, Homo sapiens; identical to SEQ ID NO: 69

SEQ ID NO: 14750 - DNA, 96 bp, Homo sapiens
ttttgtaattcaactgctagcaaaattattttctttattgttatatatttgtacgattaaaaggagaaaataggatcagcattgaaacgtacaaaa

SEQ ID NO: 14751 - DNA, 117 bp, Homo sapiens
tgctgtgtagaagctttttagtttaatgagatcccatttatttatttttatttttgttgcatttgatttgggggtcttagtcatgaattctctatgaaaaagacacatgcacacgca

SEQ ID NO: 14752 - DNA, 73 bp, Homo sapiens
agagctgagagtgcagagtgtggccaggggcagtggctccccactgtaataccagcgctttggaggccaaggc

SEQ ID NO: 14753 - DNA, 79 bp, Homo sapiens
taatctatattttactgtgaagatattttgtagatgtgattaacatctataatcagttgactttaagtagatcagatta

SEQ ID NO: 14754 - DNA, 84 bp, Homo sapiens
tatgtatacatacacacatttacatgtacgtatatctagttatacatatgtatatatgtatatgtatgtgtgtgtgtatatata

SEQ ID NO: 14755 - DNA, 82 bp, Homo sapiens
agagtgtaagaatgcagtttgaaaagacctttcaactccaatgtgccccaaggtcttttttgtttgtttgtttttgttttct

SEQ ID NO: 14756 - DNA, 94 bp, Homo sapiens
gagaagatggtagtggagatgagagtgagcagaatggatacaaagctggaaactgccccttccaggagctgctagggcttctcttcagattgtc

SEQ ID NO: 14757 - DNA, 106 bp, Homo sapiens
gacaggttaagtaacttgctcaaggtcacacagatggaattagaagtagtattttaataaaacatgttctctgtctttgctgacttcattacaagatgctgccttc

SEQ ID NO: 14758 - DNA, 95 bp, Homo sapiens; identical to SEQ ID NO: 68

SEQ ID NO: 14759 - DNA, 93 bp, Homo sapiens; identical to SEQ ID NO: 69

SEQ ID NO: 14760 - DNA, 116 bp, Homo sapiens
gcaattgtgaatcgtgttgtgataaaaatatgcatgcaggtgtcttttttttaatactttaaattctagggtacatgtgcacaatgtgcaggtttgttacatatgtatacatgtgc

SEQ ID NO: 14761 - DNA, 106 bp, Homo sapiens
gctgggtagaatgaatgcctcagtgctcaggccctgtcatgtgttggagacaaatgtttttgttcatttccctggtaagcacaggtacaaattccttaacaaaggc

SEQ ID NO: 14762 - DNA, 81 bp, Homo sapiens
gtgtgtatatatatatgtgtgtgtatatatatatgtgtgtgtatatatatatgtgtgtatatatatatgtgtgtgtgtgta

SEQ ID NO: 14763 - DNA, 58 bp, Homo sapiens
tgagacagagtctcgctctgtcacccaggctggagtgcagtggtgcgatctctgctca

SEQ ID NO: 14764 - DNA, 98 bp, Homo sapiens
acacacacacacacacacacacgtatatgtatgtgtatatatacatatgtgtgtatatgtatgtgtatatatacacatatgtgtgtatatgtatgtgt

SEQ ID NO: 14765 - DNA, 119 bp, Homo sapiens
ttgttggttctggctggcaggtgtagaagagtatatatatacatatgtatatatacatatatatacacactcacacatatgtatgtattttctctttaattaattagcttttaatagga

SEQ ID NO: 14766 - DNA, 88 bp, Homo sapiens
atatgtgtatagatacatatatacatgtacatatacacgtgtatatatatacatgtgtatgtatatatgtacatatatatatacatgt

SEQ ID NO: 14767 - DNA, 58 bp, Homo sapiens
tgagacagagtctcgctctgtcacccaggctggagtgcagtggcgcgatctctgctca

SEQ ID NO: 14768 - DNA, 56 bp, Homo sapiens
gagacagagtctcgctctgtcacccaggctggagtgcagtggcgcgatctctgctc

SEQ ID NO: 14769 - DNA, 110 bp, Homo sapiens
gttgatgtgtatatttacgtatgtgtgtgtgtatatatatatatataatataaaatatatatataatatatgtatatatatacatatatatgtatatttgcaatataaac

SEQ ID NO: 14770 - DNA, 98 bp, Homo sapiens
gctttctttgggaattttgtgtgtatgtgtttgtttgttgagacagtgtctcactgtcacacaggctgcagtgcaatggcacagttataactcactgc

SEQ ID NO: 14771 - DNA, 95 bp, Homo sapiens
gcagtgtctcaaaaaaacagagagagtgtagggatgaagagtgcctatgaggtaggtttttttttttttttttttttttttttttgagacggagt

SEQ ID NO: 14772 - DNA, 82 bp, Homo sapiens
caccactagacacctctcctctggggcctgctgagaagtctctctctctgggttctaggcacagttctagaaggtgtgagtg

SEQ ID NO: 14773 - DNA, 107 bp, Homo sapiens
tttttatttaatctcctagaataagatgtgtgtggatatgtgtgtacgtattttttttttgtattttatatatttaagtgcaacatcttaaggagagagaaagaagg

SEQ ID NO: 14774 - DNA, 118 bp, Homo sapiens
gcctcccaagtagctgggactacagatgtgtgccaccacacccagcaaatatatatatatatatatatatgtatttttttgtgtgtgtggaaacggggttccgccatgttgcccaggc

SEQ ID NO: 14775 - DNA, 70 bp, Homo sapiens
tatctatctatctatctatctccttatctctctatgtggcggtgggggggaagagcaagagagagagata

SEQ ID NO: 14776 - DNA, 85 bp, Homo sapiens
tgatagctcctgccttgcatggttgatctacatttgtggtaaatgagtgttgagtacctaatgcaatgccttcaggtagctatta

SEQ ID NO: 14777 - DNA, 78 bp, Homo sapiens
caatcctgaataaatatcattttttttagaaagtctccttttctaaagcctgtatagaaagtgtgttattcaggtttg

SEQ ID NO: 14778 - DNA, 95 bp, Homo sapiens; identical to SEQ ID NO: 68

SEQ ID NO: 14779 - DNA, 93 bp, Homo sapiens; identical to SEQ ID NO: 69

SEQ ID NO: 14780 - DNA, 97 bp, Homo sapiens
tatgagttgtttggtaaagcaaatgtgacatttaaaagtctgatgaaatgttttctaaagtgacttcgtcagtttacatttctaccagcaatttata

SEQ ID NO: 14781 - DNA, 110 bp, Homo sapiens
tacatgatgcatgatttttttgtgtgtgtatacatatgtatatatgtatgtctatatatggacataaatatacagatttatatatacacacagatatgtgtgtgtgtatc

SEQ ID NO: 14782 - DNA, 70 bp, Homo sapiens
tgtgtgtatatataaatctgtatatttatgtccatatatagacatacatatatacatatgtatacacaca

SEQ ID NO: 14783 - DNA, 72 bp, Homo sapiens
gtctttgtctcaagattggtttgaatatttgaggaagccattcattaatttttttttttttgagacagagtc

SEQ ID NO: 14784 - DNA, 124 bp, Homo sapiens
gccgacaatcagggtagaagcagtccagtcagaaggaattacatgtgcaaaacccagaggtagtaccatgttctggaaactgcaatgagacccatgtggctagagctgagtgaaccagaaggat

SEQ ID NO: 14785 - DNA, 109 bp, Homo sapiens
ggtgtctggatctggtttgcagatggccatcttctccttttgttttcacctggcagagagcagagagagagtaagggcaagttctcatgtctcttcctacaagggcact

SEQ ID NO: 14786 - DNA, 56 bp, Homo sapiens; identical to SEQ ID NO: 88

SEQ ID NO: 14787 - DNA, 68 bp, Homo sapiens
tttattgagacagaatctcactctgtcactcaggctggagtgcagtggtgtgatcttggctcactgaa

SEQ ID NO: 14788 - DNA, 84 bp, Homo sapiens
tttgtgtcctcacccaaatatcatgtcaatttgtaatactcaatgttggaaaagaggcctggtaggaggtgactggatcatagg

SEQ ID NO: 14789 - DNA, 75 bp, Homo sapiens
attttgagagggagctatctgtttttaattcctcaggtttcatgaggaaaacaagttttttttttttctcaaaat

SEQ ID NO: 14790 - DNA, 102 bp, Homo sapiens
tacaggagcagtgactttgttctggtcattctcaactccctcttagttttatttatttatgtatttatttagtgagcatctcagagctagactgcgattgta

SEQ ID NO: 14791 - DNA, 108 bp, Homo sapiens
ctttgaacttttaagctgatgtttgaacaaggtaagacttttagggttattgggatgtgatgaatgtatttttttatgtgagaaagacatgagttttagaagtcgagg

SEQ ID NO: 14792 - DNA, 115 bp, Homo sapiens
atatatatatatatatatatatatatgtatatatatgacgtgtatatatatgtatatatgtacatgtgtatatacacacatgtaaatatatacacatatatacatatatacacac

SEQ ID NO: 14793 - DNA, 87 bp, Homo sapiens
gtaatatatagtgatatatattatatattgatgtattaatacacaataatgtacattatatattgatatataatcatatatattata

SEQ ID NO: 14794 - DNA, 58 bp, Homo sapiens
tgagactgagtctcgctctgtcacccaggctggagtgcattggcgtgatctcggctca

SEQ ID NO: 14795 - DNA, 83 bp, Homo sapiens
gagagtcagacttttgctcatgggaatgttctctgcctggcctcagtgtaatatccctgacctaatgaaagcaaatggttctc

SEQ ID NO: 14796 - DNA, 83 bp, Homo sapiens
tatgtgtatgtatatataaatgcatgtatatgtgtaatatatatgtctatgtgtatgtgtgtgtgtatatatatatatatata

SEQ ID NO: 14797 - DNA, 88 bp, Homo sapiens
gataatagagcttacatgttgtggggcaaaggtttgaaccccaatctcttgactccagaattcatagttttaatcattacttgttatc

SEQ ID NO: 14798 - DNA, 118 bp, Homo sapiens
ttcaggatgattccagtgcattacatttattgtgcactttgtttctattattatattgtaatatatcatgaagtaattatacagcccacgataatgtggactcagtgggaatcttgag

SEQ ID NO: 14799 - DNA, 113 bp, Homo sapiens
tcaatgcccgtataagttgtgatttggtgttctttcagaagaaaattttgtttatttttacaactaacattcattaagagtattacacataagtatggtatggaaagctttga

SEQ ID NO: 14800 - DNA, 70 bp, Homo sapiens
gagctggcagctgatgagatggcgcccacctagactgaggctggctctgtctctcccagtccacggactc

SEQ ID NO: 14801 - DNA, 109 bp, Homo sapiens
ttggtgaggctgtggggaaaagggaacgctcgtacactgttggtggaaatgtaatgtaaattagtccagcaattgtggaaagcagtttggaggtttcacaaagaactaa

SEQ ID NO: 14802 - DNA, 101 bp, Homo sapiens
ttttgttgaaatgaatgcataactgtataatgtgacttttaactttgattttttatgtagaaaaattatggatcacatggcagtggatcacctaagcaaaa

SEQ ID NO: 14803 - DNA, 85 bp, Homo sapiens
acatatgtatgtatggatatggatatatatctatatatatatagatatatatatatggatggatgatatgtaaactaatatatgt

SEQ ID NO: 14804 - DNA, 112 bp, Homo sapiens
gttttgttttttgtccattctgccaatctgcatctttcaagtggagcatttaggatgtttacattcaatgttaatattgagatgtgaggtgaggtactgttccaatcattat

SEQ ID NO: 14805 - DNA, 89 bp, Homo sapiens
taagtacactaggtgtgttttgagcagcacagagagaaaaaatatttccatctcatttgttcaagatatatttttattcatgtagctta

SEQ ID NO: 14806 - DNA, 116 bp, Homo sapiens
cacggtcaaggctgcccgggcgctggcttagggaggtctcagagcctgtcactgtccgtcccacgggggcaaggccaggcctgctccgtcgtgcagtcgggcgcctctgtgactgt

SEQ ID NO: 14807 - DNA, 80 bp, Homo sapiens
ggtgcacatctgtttttgttgattgcatggaatctgctgaaatattcttgaaagtacaactagaaataggtgtaaaaacc

SEQ ID NO: 14808 - DNA, 114 bp, Homo sapiens
tgaaattgacataatatgtttatagacatctaattgaacctttgtaaattttgacttagcagttttaatttaatattttacagcagcaattagatttctttttgtcatgactca

SEQ ID NO: 14809 - DNA, 103 bp, Homo sapiens
acaaattccagcagtactagccatattggtatcagcaatagaaatcacagatattctattttcaaatgatagctattgctgatatctagaaatgttgtcttgt

SEQ ID NO: 14810 - DNA, 58 bp, Homo sapiens; identical to SEQ ID NO: 1868

SEQ ID NO: 14811 - DNA, 108 bp, Homo sapiens
cagtgtcctatgtctttctctttccctctgacaaagagtttcctttttattactatatttttaataataaattggggaactccagaagaaacatgctccttggctctg

SEQ ID NO: 14812 - DNA, 99 bp, Homo sapiens
tcagatagaggtgggggatggttttgcatgtgtctatttaattaattaattaattatttttttttttgagacagagtctgtctctgtcacccaggctgg

SEQ ID NO: 14813 - DNA, 97 bp, Homo sapiens
gaatagagtaattccttttaaattctgaaaaaatattccaacatgggattttatttttttattttttatttttttgagatggagttttgctcttgtc

SEQ ID NO: 14814 - DNA, 118 bp, Homo sapiens
ttcaaatatattgtcattaattcatgaatagaggacttttataaagtttatttttagttctttttatagaatgtatctaattggctcctctttcttgactagtggtgataatgttgaa

SEQ ID NO: 14815 - DNA, 95 bp, Homo sapiens
cttaagcttgatgttaggtacagggggctctatttatttatttattaatttatttaatgtattgagacagagtctcactgtcacccaggctagag

SEQ ID NO: 14816 - DNA, 95 bp, Homo sapiens; identical to SEQ ID NO: 68

SEQ ID NO: 14817 - DNA, 93 bp, Homo sapiens; identical to SEQ ID NO: 69

SEQ ID NO: 14818 - DNA, 110 bp, Homo sapiens
ccactttcatgtctctggaatatgtacaggcatcaacctaaacttttctgatggattgaaatgttgtttgtcaaaccaatgtgcaattgtttgggtgacatgttacatgg

SEQ ID NO: 14819 - DNA, 60 bp, Homo sapiens
gaatgtatacatatgcatgtatgcatgtataaatatatgtgtatgtatatgtatgcattt

SEQ ID NO: 14820 - DNA, 95 bp, Homo sapiens; identical to SEQ ID NO: 68

SEQ ID NO: 14821 - DNA, 93 bp, Homo sapiens; identical to SEQ ID NO: 69

SEQ ID NO: 14822 - DNA, 79 bp, Homo sapiens
tatatatgtatataagtgtatatatgtatatatgtgtatatatgtatatatacgtgtatgtatatgtgtatatatatat

SEQ ID NO: 14823 - DNA, 70 bp, Homo sapiens
tgtgtgtgtatgtatacacatatataaatatatatgtgtatatatgtgtgtctatatatatacacacaca

SEQ ID NO: 14824 - DNA, 95 bp, Homo sapiens; identical to SEQ ID NO: 68

SEQ ID NO: 14825 - DNA, 93 bp, Homo sapiens; identical to SEQ ID NO: 69

SEQ ID NO: 14826 - DNA, 104 bp, Homo sapiens
ctagaggtttggttgttttttttttttgagacagagtctccctctgtcacccatactggagtgcagtggcgtgatcttggctcactgcaacctcagcctcctgg

SEQ ID NO: 14827 - DNA, 112 bp, Homo sapiens
acaaattatagtacatagtaggcactcaataaatatgtgtaaataaagatatatatataatatttgtaaatacgcacataaatatgcatgtttatatgtatctgtaatatgt

SEQ ID NO: 14828 - DNA, 113 bp, Homo sapiens
ctgaaaaacatctgaaaatgtccctctgagaaaggacttagtatcaatatttagattttatatctaaatgattcccaatattcttgtcaattctgcatggtcaggttaaacag

SEQ ID NO: 14829 - DNA, 101 bp, Homo sapiens
ttgacctctaagtgtgcatagatttatgtgtgtgtgtatatatatatatgcacacaaatataaacacataaacttacgatgcaaattatttttatggttaa

SEQ ID NO: 14830 - DNA, 119 bp, Homo sapiens
atcagaaaatgtgttaatgtatatttttatagaaagcagtcaaaagtaaatatacgttaaatgaatgaattaatgtttgatgtgcatgactactttctgacatgtcacacattcttgat

SEQ ID NO: 14831 - DNA, 116 bp, Homo sapiens
atatatacatatatataaatatatatacacatatatgtatataaatacatatatatacacatatatatgtgtgtatatatatatgtgtgtatatatatatatatgtgtgtgtgtgt

SEQ ID NO: 14832 - DNA, 113 bp, Homo sapiens
tatctaccttctagacttctgacaaggattgaaatatgtgtgtatgtgtgtttgttcactctctcacacacatacaactcctagcactatggtgggaaaatagtaggtaagta

SEQ ID NO: 14833 - DNA, 114 bp, Homo sapiens
ggacaccaggcatatgacattagagcctacccatatgtcttcattttatcttaattactttttttttttttttttttgagacagagtctcgctgtgtcacccgggctggagtgc

SEQ ID NO: 14834 - DNA, 58 bp, Homo sapiens
tgagacagagtctcactctgtcacccaggctggagtgcagtggtgcgatctcatctca

SEQ ID NO: 14835 - DNA, 113 bp, Homo sapiens
atcctgaagggagacagatttgtgggcaagccctctactctcctccctgggaatctccactctagagagagaggagtggcagctctcattttgatcttcctgagacacagggt

SEQ ID NO: 14836 - DNA, 58 bp, Homo sapiens; identical to SEQ ID NO: 3385

SEQ ID NO: 14837 - DNA, 56 bp, Homo sapiens; identical to SEQ ID NO: 3386

SEQ ID NO: 14838 - DNA, 72 bp, Homo sapiens
atgtgtatatatgtatatatgtacatatatatgtatgtgtgtatatatgtacatatatacatatacacatat

SEQ ID NO: 14839 - DNA, 72 bp, Homo sapiens
gacaaagttggtcttttctcaaatgaatgagtttctttatttttattttttgaggtagggtctcactctgtc

SEQ ID NO: 14840 - DNA, 81 bp, Homo sapiens
gtggttccttactcccagcgtgtctctcggtctgtcttcctggcccttcggctgggggaccccagctgctctccctgcctc

SEQ ID NO: 14841 - DNA, 99 bp, Homo sapiens
tgtctttgctatacgggctctgtttggttccatatgaaatttaaagtagttttttctaattttgtgaagaaagtcaatggtagcttgatgggaatagca

SEQ ID NO: 14842 - DNA, 102 bp, Homo sapiens
gtgacagtgagaccctgtctctcagacatacttttaaaaaagggtttttttttaatttttttaatttttagagtttctttggagccattctcttgctgttgt

SEQ ID NO: 14843 - DNA, 58 bp, Homo sapiens
tgagacagagtctcgctctgtcacccaggctggagtgcagtagtgcgatcttggctca

SEQ ID NO: 14844 - DNA, 102 bp, Homo sapiens
tagaaatagagaacattgaagaaacacacagataatctcacataattccaccacacaactactgattatcttgatgtgtttctttatagatttttaccccta

SEQ ID NO: 14845 - DNA, 147 bp, Homo sapiens
cctaaatgtaatagtctgatcatgatgctgaataaatatgtctttttttttttttttttgagactgagtctcggtctgtctgtcgcccaggctggagtgcagtggcgcaatctcagctcactgcaagctccgcctcccaggttcaca

SEQ ID NO: 14846 - DNA, 85 bp, Homo sapiens
ccagaattaataattgcttaaataatattgaactttatatttttctgaagtgcaatacatttggaggtaggcattttagggctgg

SEQ ID NO: 14847 - DNA, 57 bp, Homo sapiens
tctatcatctgtggctgcttttgtgcttcagtggcagagttgagcaggtacaataga

SEQ ID NO: 14848 - DNA, 105 bp, Homo sapiens
ctgggcatgatggtgcatgcctgtagtcccagctgctctggaggctgaggtggaaggatcgattgagcccaggagtctgaggttgcagtgagctatgattgtgcc

SEQ ID NO: 14849 - DNA, 99 bp, Homo sapiens
ttcttatgttgtttttaatgtcattattgcttgttttctttagcctacggatgttagagaaatttgtatttatgatattttcatttgtatatataagga

SEQ ID NO: 14850 - DNA, 91 bp, Homo sapiens
ccactgagcaaacctaagaagtggtcacaacaaagagtgagcacaagaaaaatcacttcctgaatgtgaccagatttatgctgtttcgtgg

SEQ ID NO: 14851 - DNA, 86 bp, Homo sapiens
ctcaccagtcactcactcactcactcgcccagagcaacttccagtcctgcaagctccatttgtggtaagtgcctagactggtgtag

SEQ ID NO: 14852 - DNA, 70 bp, Homo sapiens
gtgctctgtgtgtctctccttctcctggaaccaccaggacagcctggggatggcagacgcacaagagaac

SEQ ID NO: 14853 - DNA, 96 bp, Homo sapiens
gcttcctttattttattttattttacacaaagtctctctctgtcgcccaggctagagtgcaggttgtgtgatcactgagtacctgggactattggc

SEQ ID NO: 14854 - DNA, 82 bp, Homo sapiens
gtgttcacaaagtgcctggcactgtgactgtcacaggagacacagtcccaaaatagtgtcagcagcagcacaatgatggcat

SEQ ID NO: 14855 - DNA, 58 bp, Homo sapiens
tgagactgagtctcactctgtcacccaggctggagtgcaatgccgtgatctcagctca

SEQ ID NO: 14856 - DNA, 103 bp, Homo sapiens
acagagcgagactctctcagaaaaaaaaaaaaaaaattcagttctgcagtctcactagcctctttttctttttttttttttttgagacagactttcactctgt

SEQ ID NO: 14857 - DNA, 119 bp, Homo sapiens
gggcttgtgtgagagattttgtttgaagaaagagctctgttaatggaaaaaccaaaatatatatatatatttgtttgtttgtttgtttgttttttagacggagtctcgctctgtcgccc

SEQ ID NO: 14858 - DNA, 58 bp, Homo sapiens; identical to SEQ ID NO: 884

SEQ ID NO: 14859 - DNA, 56 bp, Homo sapiens; identical to SEQ ID NO: 885

SEQ ID NO: 14860 - DNA, 71 bp, Homo sapiens
gcctaatgatgtgtttctctctctctctttttttttttttttgagatggagtctcactctgtcacctgggc

SEQ ID NO: 14861 - DNA, 115 bp, Homo sapiens
ttgtactctagcctggcaacagagcgagactctatctcaaagaaaaaaaaagaaaaagcctctttattttatttttgaaacaggatcttgctgtgttgcccagactagagtgtag

SEQ ID NO: 14862 - DNA, 103 bp, Homo sapiens
actatgaatgttattagtaattttgtaactcaataaagatattgggagaactacatgtcactaaatttttttttgtcttgcagaatcaccagtgatttttagt

SEQ ID NO: 14863 - DNA, 75 bp, Homo sapiens
ccagtgctgccccgataaggcaggaaatctactagctgcccacacgtgcctcctgtctctgtctctctgccctgg

SEQ ID NO: 14864 - DNA, 116 bp, Homo sapiens
tcagatggtaagtggtgggtagtgacattcagtgaaggaagagacctcacatttttttttgttcgttttgttttgttttttcaaatgtttattttatgtacaaagaactatcatgg

SEQ ID NO: 14865 - DNA, 104 bp, Homo sapiens
tagagagctgaaaagatctgttacctgactttattttattttttgagacagagtctcgctctgttgctcaggctggagtgcagtggtgtgatctttcctcgctg

SEQ ID NO: 14866 - DNA, 115 bp, Homo sapiens
gatggttgtcatagaaaaccatgcaccagtaagaaagctaggaactagatttttttttttttttttgagatggagtctcactctgtagctcaggctagagtgcaatggcaccatc

SEQ ID NO: 14867 - DNA, 58 bp, Homo sapiens
tgagactgagtctcgctctgtcacccaaactggaggacagtggcatgatcttggctca

SEQ ID NO: 14868 - DNA, 86 bp, Homo sapiens
atgtatatataggtatatatgtgtatgtatatgtgtgtgcatatgtgtgtatgtatatataatatacatatataatatatgtatat

SEQ ID NO: 14869 - DNA, 112 bp, Homo sapiens
tgctaacagactgcctggctcagtgtagctcaaaatccatctttatttttatatgatagtttaaatgatttaatgagtggctgtcactgacaaggcacttggggtctgtgca

SEQ ID NO: 14870 - DNA, 74 bp, Homo sapiens
tcatggtcatccctctgtgaatgtcactctcagttgcaagtactggtggctccagggagtgtgtatgaccctgg

SEQ ID NO: 14871 - DNA, 66 bp, Homo sapiens
gtgtgtatgtacttatgtatgtgtatatatatgggtgtatatgtaaatatatttgtacacacatac

SEQ ID NO: 14872 - DNA, 63 bp, Homo sapiens
gatggcagagagattaatttatttttatttttatttttttgagatggagtctctctctgtctc

SEQ ID NO: 14873 - DNA, 58 bp, Homo sapiens
tgagacagagtctcactctgtaacccaggctggagtacagtggtgcgatctcagctca

SEQ ID NO: 14874 - DNA, 117 bp, Homo sapiens
gcattccaggtttaatgttagatagacctttcatgtttatcctgctgattttcttcttgaaattttcacacagaagatgtgaaaaggttttggactctcaaactgccttcgttttgt

SEQ ID NO: 14875 - DNA, 83 bp, Homo sapiens
tccagggatggaatggggctctctctctctttttttttttttttttttttgagatgaagtgttgctctgtcacccaggctgga

SEQ ID NO: 14876 - DNA, 58 bp, Homo sapiens
tgagactgagtctcgctctgtcactaaggctggagtgctgtggcgtgatctcagctca

SEQ ID NO: 14877 - DNA, 101 bp, Homo sapiens
tgctgcaccttcacatcaccttcctctctgtgtctctgtgtcttctccagtactcatgagaacatcagtcattggatgtagggtgcaccctaaatccagca

SEQ ID NO: 14878 - DNA, 274 bp, Homo sapiens
atatatatatatatatgtgtgtgtgtatatatatatatatatatacgtatatatatgtgtgtgtatatatatatatacgtatatatatatgtgtgtgtatatatatatatatatgtatatatatatgtatatatatatgtatatatatgtgtatatatatatatatatgtatatatatatgtatatatatatgtatatatatgtgtatatatatatatgtatatatatatgtgtatatatatatatgtatatatatatgtgtatatatatatat

SEQ ID NO: 14879 - DNA, 58 bp, Homo sapiens
tgagacggagtctcgctctgtctcccaggctggagtgcagtggcgtgatctctgctca

SEQ ID NO: 14880 - DNA, 65 bp, Homo sapiens
gctgagtgaacagactgagcaaaggcatgaaaatggttttgtacaatgttagtttatggaacagc

SEQ ID NO: 14881 - DNA, 87 bp, Homo sapiens
tgtatatatgtatacacatatgtatatgtgtatacacatgtatatatgtatatgtgtacacacatgtatatatgtatatatgtatac

SEQ ID NO: 14882 - DNA, 117 bp, Homo sapiens
gcctagcccagcactttggcgacattgaatactcactgacaactggctaatgactgagcactcaccctgcttttatgggcagccacgtcccaggagcaagaggcaaggtggctaggc

SEQ ID NO: 14883 - DNA, 58 bp, Homo sapiens; identical to SEQ ID NO: 2595

SEQ ID NO: 14884 - DNA, 102 bp, Homo sapiens
gcaatatctcttccgaatttttgccttgtctttttatatacttatgtgtgtatatatatatatggtgtattaataaacagaagttcttaatgagagtactgc

SEQ ID NO: 14885 - DNA, 61 bp, Homo sapiens
cctgctcactcaccctctctcagctgctactggcggtcaatggcgggggtgttgtggaggg

SEQ ID NO: 14886 - DNA, 95 bp, Homo sapiens; identical to SEQ ID NO: 68

SEQ ID NO: 14887 - DNA, 93 bp, Homo sapiens; identical to SEQ ID NO: 69

SEQ ID NO: 14888 - DNA, 98 bp, Homo sapiens
tctttgccatgatttttatacctgttggaaagcttagttaacaacacagatgtgtctgtggagagtcacttaagaaaataggcaaaattaggattaga

SEQ ID NO: 14889 - DNA, 95 bp, Homo sapiens
gtagatgttacgattggggttgggaagtttttttctctcactgtctgtgtcagataaccactgggggctcaccatctgcatttgtgtccataagc

SEQ ID NO: 14890 - DNA, 102 bp, Homo sapiens
tcaaaaagaaccagtgacagctatttcatgttttaagcattcagactaattgtagtctttatgtttttatgacacaaaacagctttcagttgactctgttga

SEQ ID NO: 14891 - DNA, 84 bp, Homo sapiens
gcactaataacaagcatggtaatttaattacttgtgaatttgttcaacaaagtaggaaagggctgtgcttcttgtattgtttgc

SEQ ID NO: 14892 - DNA, 69 bp, Homo sapiens
tatttttaatgtttcctgacatatgtgtgtgtgtgtatatatatatatatatatgtctatatgtagata

SEQ ID NO: 14893 - DNA, 58 bp, Homo sapiens
tgagactgagtctcactctgtcacccaggctggagtgcagtggtgtgatctcagctca

SEQ ID NO: 14894 - DNA, 56 bp, Homo sapiens
gagactgagtctcactctgtcacccaggctggagtgcagtggtgtgatctcagctc

SEQ ID NO: 14895 - DNA, 109 bp, Homo sapiens
ggagaccagtgctgggaggatgaggttatttctcaggctctttctctctgggttgctcacagctcatgcaggtgcctgcaactgcctctgggttctaggaactgtctcc

SEQ ID NO: 14896 - DNA, 80 bp, Homo sapiens
gtatagacaggcctagaagaatgcatatatatatatttgcatgtgtaaatgtgtgtatgtgcatatttatgcccctgtgc

SEQ ID NO: 14897 - DNA, 56 bp, Homo sapiens
ctctcagagcagagagaggacatgcacagtgttttcctttgtggttctttgcagag

SEQ ID NO: 14898 - DNA, 86 bp, Homo sapiens
gaatcttcttcagaggcacacagccctcctaggttgacagtttatattttttattccagggaactttgtgtttctggttgtgattt

SEQ ID NO: 14899 - DNA, 95 bp, Homo sapiens; identical to SEQ ID NO: 68

SEQ ID NO: 14900 - DNA, 93 bp, Homo sapiens; identical to SEQ ID NO: 69

SEQ ID NO: 14901 - DNA, 68 bp, Homo sapiens
gggcgtggtggctcacacctgtaatctcagcactttgggaggctgaggtaggtggatcacttgaggcc

SEQ ID NO: 14902 - DNA, 102 bp, Homo sapiens
tgtgtatgttgatttttgtatcctgtaactttactgaatttgttaattagttctaatagcttttcagtggagtcttcagtttttcccaaatacaatatcata

SEQ ID NO: 14903 - DNA, 63 bp, Homo sapiens
ttgagacagattctcactctgtcagcctgttgcccaggctggaatgtggtggtgtgatctcag

SEQ ID NO: 14904 - DNA, 113 bp, Homo sapiens
ggggttcaggaccagcctggacaacatagtgagacactgtctcttagaaaaaggtgattttttttttttctttgagacggagtcttgctccgtcacccaggctgctggagtgc

SEQ ID NO: 14905 - DNA, 78 bp, Homo sapiens
tgtgcattgtgggagaatttgatcaccaaacctttaaggacttctggctctgaccctctgattctgtgatggtgcata

SEQ ID NO: 14906 - DNA, 75 bp, Homo sapiens
gagaaattactttacaagagagaccagcattattgtatcacagtagtgtatttcttcttcaaatagtagtttgtt

SEQ ID NO: 14907 - DNA, 78 bp, Homo sapiens
gtctcactctgtcactcaggcctcccaggttcaagcgattctcctgcctcagcctcctgagtagctgggactagaggc

SEQ ID NO: 14908 - DNA, 93 bp, Homo sapiens
ctagaagggagccattagaaaatgagacctgtctatactttttttttttctttttttttctgagacagagtctcaccctgtctcccaggctgg

SEQ ID NO: 14909 - DNA, 85 bp, Homo sapiens
attgataggcacctggcttcattccatgttattgctattgtgaatagcactgcagtgaacatatggatgcatgtgtactttcaat

SEQ ID NO: 14910 - DNA, 77 bp, Homo sapiens
gagccgagttgaatcaaaagaactgtgttattcacagggaagaagttcaacatagtagtggttcagaacaaggtctc

SEQ ID NO: 14911 - DNA, 92 bp, Homo sapiens
gccctgcaccgtgccctggacctggttaaagatcgacccctgacctaaaatggttatgttatctatagattccagacattgtgtggaaaagc

SEQ ID NO: 14912 - DNA, 71 bp, Homo sapiens
caaaagtgactgtgtgtgtgtatgcatagatataaaatcattatatgtatatataaaaacattctcttttg

SEQ ID NO: 14913 - DNA, 98 bp, Homo sapiens
cagaagtttccttaaagtttttctttttgaaaacagaatagagaatattttttttttctattcttggatattgtttaaaataaatttaggactctctg

SEQ ID NO: 14914 - DNA, 106 bp, Homo sapiens
tgctttttcttctttatttagttgaattttccttgtaaatgtttttaagaataaacatttatttttaaaatactttttcatttactgaaaaattgagaagatagta

SEQ ID NO: 14915 - DNA, 115 bp, Homo sapiens
ggccagccagcgcccccaggccaccagcactccccaggagggcctgccctgcctgcctggctgccacacctctagcccaggtcagctgctggctctgtcctctgaggtttgcttg

SEQ ID NO: 14916 - DNA, 74 bp, Homo sapiens
agatctctgtcgggtgcatagcttgcaaatattttatcctattctgtaagttggttgtttacttgatagtttct

SEQ ID NO: 14917 - DNA, 95 bp, Homo sapiens
gtgccgtgaaagtggggcctgcaggctgttgctactctgccaagactccaagtagctctgtctgtcagactgaaggtcccagtggagtggttcac

SEQ ID NO: 14918 - DNA, 82 bp, Homo sapiens
ttgaggtgtcttcttcatgaaataaaacttgtgtgtaactacagggcacacttacacttgatggcattggaagaaatctcag

SEQ ID NO: 14919 - DNA, 58 bp, Homo sapiens; identical to SEQ ID NO: 637

SEQ ID NO: 14920 - DNA, 78 bp, Homo sapiens
gcaggatataggattcatggttggaatttattttctttaaaaatgctgaaaataggcccctaatgtttcctggcttgc

SEQ ID NO: 14921 - DNA, 106 bp, Homo sapiens
atatagaaatgctactgatgttggcatgttgactttgtaacctttgattttattgaaattttttattctaacaattttttcatggcgtctttagagttttctatat

SEQ ID NO: 14922 - DNA, 92 bp, Homo sapiens
ctcaggaacttctctacaggcacaagcagaatctgtctggtcggcttaccataaagagtctctgtctgtcaaatggaggtatctttcctgag

SEQ ID NO: 14923 - DNA, 88 bp, Homo sapiens
tgatggactagactctgcctcactctttaagtcaaaattacaaaggagaaggaggctatgagagtgagtaaagggtttaaggaaatta

SEQ ID NO: 14924 - DNA, 131 bp, Homo sapiens
ggaaggtagatccccagctttctgctgggccctgttgacatcaccacagaagaaatggggctctgactcacactatctcattgcagtcagagtgcaaactcagcttccactctgatatgggattgaagggg

SEQ ID NO: 14925 - DNA, 91 bp, Homo sapiens
ggtgagatctatgtagtgacacacatttgagagtcagcagtgtataggtggcaatttatagtgttgtcaatcagcatatttttttaaaacc

SEQ ID NO: 14926 - DNA, 81 bp, Homo sapiens
gttgttgtttgttttctgagacggagtctcactctgtcaccgaggctggagtgtagtggcgccatctctgctcactgcaac

SEQ ID NO: 14927 - DNA, 88 bp, Homo sapiens
atataattacaactcatatatgtgactggtgtgtgtatatatatatacacacactatatatatgtgtatatatatgagtagtatatat

SEQ ID NO: 14928 - DNA, 94 bp, Homo sapiens
tcttctatctgcttataatctctctatatatatctctctatatatatattcacagaagcagagggtcaaaaaatggaggagaaggtttggaaga

SEQ ID NO: 14929 - DNA, 256 bp, Homo sapiens
tgtattttatatatatatacatatgtatgtgtatatatatatatatacacatatgtatgtgtatatatatatatacacacatatgtatgtgtatatatatatatacacacatatgtatgtgtatatatatatatacacacatatgtatgtgtatatatatatatacacacatatgtatgtgtatatatatatagatacatatatgtgtgtgtgtgtgtgtgtatatatatatatatatatatatatatatatatat

SEQ ID NO: 14930 - DNA, 108 bp, Homo sapiens
agtctgaaggcaatggattgagatatttatagtaccaaaagataaaatctgtcaaccataaatttttttttttttttttaagatgaagtctcgctctgtcaccaggct

SEQ ID NO: 14931 - DNA, 113 bp, Homo sapiens
gcgccggtagttagtgctactaaatatttgctaaatgaatgcattattaagttattttttaccttaatatgagaaattgagagtttcagacatttttagtgctataattgggc

SEQ ID NO: 14932 - DNA, 67 bp, Homo sapiens
tcacaagttggcagaagagagagagtgcaggagaaactgccatttttttcttttttcttttttttga

SEQ ID NO: 14933 - DNA, 58 bp, Homo sapiens
tgagtcagagtctcactgtgtcacccaggctggagtgcagtggtatgatcttggctca

SEQ ID NO: 14934 - DNA, 82 bp, Homo sapiens
ttagacctaattttactctgttataaatgtagctgtacgattataaacagctgaggagatcagtggaatgaagttaggctaa

SEQ ID NO: 14935 - DNA, 113 bp, Homo sapiens
gtctaggtctttcagaaagttttaggataatgtctataaatgcagaagcttcctgtcagatgagacagtgcagaaatagagcatttgaatctatcattaaagagccaagggat

SEQ ID NO: 14936 - DNA, 98 bp, Homo sapiens
ggtcatggtggcattcacctgtagtctcatttactcaggaggatgaggtaggaggatcatttgaacctgggaggtagaggtttcagtgagccaagatc

SEQ ID NO: 14937 - DNA, 78 bp, Homo sapiens
tatatacatataaatatatatacacacacacatacacatatatgtatatgtgtgtgtatatatatatgtgtgtgtata

SEQ ID NO: 14938 - DNA, 94 bp, Homo sapiens
gtttttctgttcatggagagatagttaacatgcttgagtctgtggtgcatataatctgtcgcaattaactaactctgctgtcatacaggaaaat

SEQ ID NO: 14939 - DNA, 103 bp, Homo sapiens
ggaaacacacaacctgccacccgccgcactgtctgtccctctgtgtgagcgtgtgcacgcgccacatggggaaaagcagtgctaccggtgacctgtgctgtcc

SEQ ID NO: 14940 - DNA, 110 bp, Homo sapiens
gaaattagtgttatatataaatatatatatattttttacatttaaattattcctagaatggaataggaagaattgaagaatacttagatgtttataagcaaacaaatttt

SEQ ID NO: 14941 - DNA, 115 bp, Homo sapiens
acatattttaaatgatttatctaagcaaataattttgtgtaaataaatatttcatactatttaaaaatagaggtttcagaaaacagtgtgtgcttagcttgtcatttctgtatgt

SEQ ID NO: 14942 - DNA, 87 bp, Homo sapiens
ggtttccctttatttcttctatttggctgattgctttggctaggacttccagtagtatgttgaatagaaatggtgaaagtgggcacc

SEQ ID NO: 14943 - DNA, 98 bp, Homo sapiens
cttcattagcagctgttgtgtgtttatatatgtatgtgtataatatgcatattccgaggcaattatcattagcggctgaaattatcaaaactttgaag

SEQ ID NO: 14944 - DNA, 92 bp, Homo sapiens
cattatttcattttttatgacgtgggtcacattgacaataatattattctttatttttgttgttgttgctcttgttattaagtggaattgtg

SEQ ID NO: 14945 - DNA, 100 bp, Homo sapiens
aagttctggtatgtccttgtatgtgtatgtgtgtatatatatttctatatagttgtgggtctatttttatgcatttatcatccccaaggaggtaggactt

SEQ ID NO: 14946 - DNA, 105 bp, Homo sapiens
atgctgcttatttcagctaaatgttgctttgagactaggaatacagtattgtttttcatattctaaaatgcaaaagtagtaaaaatcaactcagcatagcagtgt

SEQ ID NO: 14947 - DNA, 96 bp, Homo sapiens
atgaatatacctatatatgtatatgtataaatttatatatgtgaccatattaatattgatgaatacttacatatacacttgtgtaaatatatacat

SEQ ID NO: 14948 - DNA, 104 bp, Homo sapiens
gtggggtacacccagaagtctttctataggtttttatttatatgtgaggggaaaatatttctcacattatttatacttttaaggagtttttgttgcatacctac

SEQ ID NO: 14949 - DNA, 75 bp, Homo sapiens
acattagtcttcaactcctttgagtaaatccagcatgcttgctggattatatggttagaggatgtttagttttgt

SEQ ID NO: 14950 - DNA, 70 bp, Homo sapiens
atatgtgttttgtacatatatgtatatatacataaatgtatatatacttgtatatactataaatatatat

SEQ ID NO: 14951 - DNA, 106 bp, Homo sapiens
acttcttgatagtgttctttgaagcataaagttttaaattttgatgaagttcagtttatctattttttctttgttgcttgtgctttaggtgtcatatctaagaagt

SEQ ID NO: 14952 - DNA, 72 bp, Homo sapiens
tatgtgtatatatatgtatatatgtgtatgtgtatatatatacatatatgtatatatatgtgtgtatgtatg

SEQ ID NO: 14953 - DNA, 89 bp, Homo sapiens
gaatgattccaaatggcctccttactccgttttttttttttttttttttttttttttaaatggagacggagtctcactctgtgtcgttc

SEQ ID NO: 14954 - DNA, 110 bp, Homo sapiens
cagaatctgcaaagaggaggtagaatagtaaagacttgattttcagaatcagacatacctgagagtgaacagagtgagatcatttaccagttacaaggaggcagagagtg

SEQ ID NO: 14955 - DNA, 104 bp, Homo sapiens
gatctgaaccagctagagtgagattttttttttcattatgataacctccaggctacaggtttttatcataacattattttactcctagatctcctggtcatgtt

SEQ ID NO: 14956 - DNA, 116 bp, Homo sapiens
gttgggcatggtggtgtgtgcctgtggtcccagctgcttgggaggctgaggtaggaggatcacttgggcctggaaggttgaggctgcagtgacccaagatcgtgccattgcgctcc

SEQ ID NO: 14957 - DNA, 71 bp, Homo sapiens
ccagtcagagggccctgggtgtttttttgttttgtgtttgagatggagtctcactctgtcacctaggctgg

SEQ ID NO: 14958 - DNA, 68 bp, Homo sapiens
ctcagtctgtcactcaggctggagtgcactggcacacaaaaagctcactgcagcctgggacttctggg

SEQ ID NO: 14959 - DNA, 96 bp, Homo sapiens
tgaggtgttgatcaaggcaatttctgtatatatttaaagatggtgatttaaattacacagaaataaatgtgtgttgatttagacatttgtgtctca

SEQ ID NO: 14960 - DNA, 60 bp, Homo sapiens
gtgtcactgtcagcctcactgctgggggagccccccaggtagctgagaccacagccacac

SEQ ID NO: 14961 - DNA, 103 bp, Homo sapiens
ccatttacaaacttttgggtggggggtgcttttttattttttatttatttatttattttttgagacatagtctcactctgtcgcccaggctggagtgcaatgg

SEQ ID NO: 14962 - DNA, 70 bp, Homo sapiens
gtgtgtgtgtgtgtgtgtatatatgtatatgtgcatacatatatatgtgtatatatatacacatatatac

SEQ ID NO: 14963 - DNA, 136 bp, Homo sapiens
catatatgtgtgtgtgtgtgtgtgtgtgtgtatgtgtgtgtgtatacacatagatatatgtgtatatatgtatatatacgtgtgtgtagatatacatatatatgtgtgtgtatatatacgtatatatatgtgtgtg

SEQ ID NO: 14964 - DNA, 93 bp, Homo sapiens
tgtgtgtatatatatacatatatgtacatgtatatgtatatatgtatgtacatatatacacatatatatacatatatgtacatatatatgtgt

SEQ ID NO: 14965 - DNA, 122 bp, Homo sapiens
catatataaatatttcctatttttgaatatgcacatattttgtacatatataaatatatatgtatgtataaaatagaaaatatatgtgcatattcaataattcatatatgctttgatatttg

SEQ ID NO: 14966 - DNA, 73 bp, Homo sapiens
gctttatatgtttcattttatagcatataattatgtttatgcataatattatgtgcttaatgagcatgttagc

SEQ ID NO: 14967 - DNA, 99 bp, Homo sapiens
agttccttcacagtaaaggaaaaaaatcaacatagggaagagaaagcttaccatccgtgagcacctaggttgattccatttgctattgtgaatagtgct

SEQ ID NO: 14968 - DNA, 105 bp, Homo sapiens
ggtcttcagaggtcctaatgctatttttttcatgagattatgatgttgttattaaaaaatgagacatagtgcaatctccgagagcttgtcaggacttcagctacc

SEQ ID NO: 14969 - DNA, 78 bp, Homo sapiens
gggttgctgggtcactctgtctctgcggggccgggggttcgtgtcgccggcccgcaggctgcagggttaccgccatcc

SEQ ID NO: 14970 - DNA, 79 bp, Homo sapiens
tgagatagagtctcgctctgtcacccaggctggagtgcagtggcgtgatctcaactcactgcagactctgcctcccggg

SEQ ID NO: 14971 - DNA, 85 bp, Homo sapiens
attcctaatagcaaaaaggtagacacaacccaaatgtccattcatgagtgagtggacacagtgtggtctatgtatacaaaggaat

SEQ ID NO: 14972 - DNA, 108 bp, Homo sapiens
ccccaaagacgtcgacaaattaatctccaggaaccagtgaatatgttatgttacatgtcaaaagagactgtgcagatgtaattaaggttatggattgtaaaagggggg

SEQ ID NO: 14973 - DNA, 95 bp, Homo sapiens
gtgccacataatcctgctcactgagctatagaagtgaagaaactgctgggcatcactctctcccactcactgaactatgggagcaaaaatggcac

SEQ ID NO: 14974 - DNA, 118 bp, Homo sapiens
tcattaattatagatgctttctatttcagtggatacctagggaattcaattaataactcatctcactgcctgagttctggaaacactgagaaacaaacagaagcatacaagacaagga

SEQ ID NO: 14975 - DNA, 94 bp, Homo sapiens
tgaaaaatggtagctagacaaaactactgcctttactttcgaaagtctgttttggggaatacagttcagatttagttctagttactatttggta

SEQ ID NO: 14976 - DNA, 83 bp, Homo sapiens
ctcattgcttatattatgtgtgttctgtaataatttctttttatttttattacaagatatataggatatgtgtatatagtgag

SEQ ID NO: 14977 - DNA, 58 bp, Homo sapiens; identical to SEQ ID NO: 1435

SEQ ID NO: 14978 - DNA, 100 bp, Homo sapiens
tgactgcaatttgttttcctagtttaggtttccaaatagaatgttaaaatgtatatagctgtggggaggagaggttactcaggaacataaaagtaagtca

SEQ ID NO: 14979 - DNA, 62 bp, Homo sapiens
agagtctcacactgtcacccagtgcagatacccagtgtcactggagtgcagtggtgtgctct

SEQ ID NO: 14980 - DNA, 95 bp, Homo sapiens; identical to SEQ ID NO: 68

SEQ ID NO: 14981 - DNA, 93 bp, Homo sapiens; identical to SEQ ID NO: 69

SEQ ID NO: 14982 - DNA, 75 bp, Homo sapiens
tggctcttggggaagttaggctcctagcctcccatagagaatgggagatagaggcactgtctttctctgtggtta

SEQ ID NO: 14983 - DNA, 70 bp, Homo sapiens
tacacatatatatttatctataaacatgtgtatatatgtatacatagatgtgtatatatatatatgtgta

SEQ ID NO: 14984 - DNA, 114 bp, Homo sapiens
gcatgagttatcatatctggtcattacatacataatgttaggtatttttcattataataatgattatctgattctttatgtagagttttatttaccttttagtctagtccatgt

SEQ ID NO: 14985 - DNA, 118 bp, Homo sapiens
aggctgggtgcagtgggttatgcctgtaatcacaacactttgggaggcagaggtggaaggatcacttgggctcaggaatttgaaaccagcctgggcaacacagtgatgccctgtctct

SEQ ID NO: 14986 - DNA, 112 bp, Homo sapiens
agtttgtgttttggtactgctaattctacatctttttcctcaccatctgacactagtctgaaagcactcatctctatcagtaaggaagagaagtgagcaccggaattaaatt

SEQ ID NO: 14987 - DNA, 84 bp, Homo sapiens
tatgtgtatatatatatgtgtgtgtgtgtgtgtgtgtatgtgtacatatatatgtgtgtgtatatatatgtgtgtgtgtgtata

SEQ ID NO: 14988 - DNA, 76 bp, Homo sapiens
ggcgcaagatgaggactgagaagtcagtgaggagcacacctccaagttcctttgggccatgtttacatctccctcc

SEQ ID NO: 14989 - DNA, 113 bp, Homo sapiens
atatttgcatatatttacatatatatgtctatataaatagaggtatacatgtacatatgtgtatatatattcatacatttacccacatatgtgtatatttatatatttatata

SEQ ID NO: 14990 - DNA, 107 bp, Homo sapiens
tcatgggagtaggttagttatcaagagagtgtttttttaataaagcaagcctgactactggtgtctctctcacacacactttcttgactttctgcctactgttatgg

SEQ ID NO: 14991 - DNA, 71 bp, Homo sapiens
gtactgggtgtggttgcctactgattttctgtccaaagaccctccaagtccaggaaaccaaacacctatgc

SEQ ID NO: 14992 - DNA, 57 bp, Homo sapiens
gtgaaatgcagagcgccgtcgccgtggacacagtcacttggtctctctgtgtatcac

SEQ ID NO: 14993 - DNA, 95 bp, Homo sapiens; identical to SEQ ID NO: 68

SEQ ID NO: 14994 - DNA, 93 bp, Homo sapiens; identical to SEQ ID NO: 69

SEQ ID NO: 14995 - DNA, 82 bp, Homo sapiens
agaagatttatttctattttgtaacatggagcctatctttatgatgacaaggttcaaggtgtggccgtgggagagattttct

SEQ ID NO: 14996 - DNA, 82 bp, Homo sapiens
catatgtgtgtatatgtgtgtgtatatatatataacacacacatgttatatatatatacacacacacatgtatatatatatg

SEQ ID NO: 14997 - DNA, 91 bp, Homo sapiens
ctgtttgggtgaagatgattatgcttattccccatggccctctttaggcaagagtgggaagctttctttgtttttttaatcacctcgatag

SEQ ID NO: 14998 - DNA, 180 bp, Homo sapiens
atatatatatatataaatatatatatatgtgtgtgtatatatatgtgtatatatgtgtatatatatgtgtatatatgtgtatatatatgtgtatatatatgtgtgtatatatgtgtatatatatgtgtatatatatatatatatatacacacacatatatatatttagatctgtaagtat

SEQ ID NO: 14999 - DNA, 144 bp, Homo sapiens
tatgtatatatatatatgtatacatatatatatgtgtatacatatatgtatatatatgtgtatatacatgtatatatatgtatatgtgtgtgtgtatatatatatatatatatatacatatatatatatacacacacattccca

SEQ ID NO: 15000 - DNA, 85 bp, Homo sapiens
tagagttaggcatcttgttgcaatgacttctggtaaagcctccatcctatggcatctgttagagtgtttcttgatgtcttaccta

SEQ ID NO: 15001 - DNA, 58 bp, Homo sapiens; identical to SEQ ID NO: 1435

SEQ ID NO: 15002 - DNA, 58 bp, Homo sapiens
tgtgcgtttacatatgtatgtatatatatgtctctctgtatatatatatgcgcgcaca

SEQ ID NO: 15003 - DNA, 109 bp, Homo sapiens
atatacataagatatgtgtctgatacatatctgacatctatacaagatatataaatatatatcagatatatgtcagatatcatatatgagatatatatcagatttatat

SEQ ID NO: 15004 - DNA, 97 bp, Homo sapiens
gagatatatatcaacatatagatatatatatctaatgtataggtatctacatatagatatatttatatgtaagatatataaatctgatatatatctc

SEQ ID NO: 15005 - DNA, 81 bp, Homo sapiens
atgtatcattgtgcatatataatatacatactgtatttgtatgtatacaaatatgtatgtgtgtatgtgccaaatatacat

SEQ ID NO: 15006 - DNA, 101 bp, Homo sapiens
ccgcaaaaatagaaattatgtgtgtagttggttgagtaaataggagtttctttttttatttttattaatttagagagtacagctacaattttgttacgcgg

SEQ ID NO: 15007 - DNA, 86 bp, Homo sapiens
tgccttgtctcagatgagactgtggacttggatgtttgggttattgctggaatgatttaagactttgggggactcctgagaaggca

SEQ ID NO: 15008 - DNA, 113 bp, Homo sapiens
agttgatgtgtcccatacaattgtgtgacgtaactgcacatatatatatacatatttatataaatatgtatatatatatttttgtgacagagtctcactttgtcggccaggct

SEQ ID NO: 15009 - DNA, 93 bp, Homo sapiens
acatttatgcaattacagaatatattatatatgcatatatatttgtgtttgtgtctatatgtatatatatgtgtgtgtgtgtgtgtgtgtatt

SEQ ID NO: 15010 - DNA, 94 bp, Homo sapiens
ggaaacagtctgcatgtttgtttgctttttctctacagccacattgagctagtgccaaagagagtaagataatagtaactgtgaggttgttttc

SEQ ID NO: 15011 - DNA, 63 bp, Homo sapiens
gtaatctcaacactcaggaggctgaggtaggaggatggcttgagtctgggaagttgaggctgc

SEQ ID NO: 15012 - DNA, 110 bp, Homo sapiens
cttctgcttgaaacagtatactgataaagttattgcaatttgttttgtgttgtattttgtatttataatatattttgaattttcttgagtcagtttttcaattccagaag

SEQ ID NO: 15013 - DNA, 86 bp, Homo sapiens
ccacatactccataacctcaccagcatctgttattttttaactttttaataataaccatctggtgtgagatggtatctcattgtgg

SEQ ID NO: 15014 - DNA, 105 bp, Homo sapiens
gatgtctttgttatacaggctcttttttggttccatatgaaatgtgaagtagtttttttctagttctgtgaagaaagtcaatggtagcttgatgggaatagcatt

SEQ ID NO: 15015 - DNA, 102 bp, Homo sapiens
gatgagttgaatgcatagtgatcaaggggggttatttaggatatcattgcccaagtacaatttatttttaagtatagtcaacctgctgtgctatcaaacatt

SEQ ID NO: 15016 - DNA, 87 bp, Homo sapiens
tgtgtgtatatatgtgtataaatatgtgtgtatatatgtatatatatgtgtatgtttatatacacaacatgcacacacatgcacaca

SEQ ID NO: 15017 - DNA, 59 bp, Homo sapiens
gcgtgtgtgtgtatatgtatatatatggaaaatatataattatatatgcatatatgtgt

SEQ ID NO: 15018 - DNA, 114 bp, Homo sapiens
gtctctgatatatatatatacgtgtatatatatatgtgtatttatatatatatgtgtatatatatatgtgtgtatatatatatatatatatatatatatatatatatcagcacg

SEQ ID NO: 15019 - DNA, 108 bp, Homo sapiens
atggaagataagtgaatgtgtgtatacaataagaatagtttcaaatttagagtagattattattttaattctttttgtacagggaaatttacttgaattattttctat

SEQ ID NO: 15020 - DNA, 97 bp, Homo sapiens
tttctttcctgcatgagtattttcctggctcacttcagctaccactgtccacactggtagactagagaatagtaaaagtcaccatctagggatgaaa

SEQ ID NO: 15021 - DNA, 86 bp, Homo sapiens
ccactcttgcaagccaatttttgctctgtttgtttgtttttgagacaaggtctcactctgtcaccctagaggttggagtgcagtgg

SEQ ID NO: 15022 - DNA, 85 bp, Homo sapiens
ttatgcagtgttcacacaaaatttatttttaataagaaaagtactgaaagttatgttcaaaataaatgtgtgaacatatgtgtga

SEQ ID NO: 15023 - DNA, 106 bp, Homo sapiens
tatatacacaaactggtatatatatatatatatatatatatatatacacacaaactggtatatatatatatatatatatatatatatatacacaaactggtatata

SEQ ID NO: 15024 - DNA, 112 bp, Homo sapiens
ttttggcattgttagcgtgcctctcctacttggaaagacagaatagtgtgtacagattcacactgaatttttttccaagaagcaacacaggaatttagctgaaaaactgaaa

SEQ ID NO: 15025 - DNA, 116 bp, Homo sapiens
tctttttcagattgtttgctgttggcatatagaaatactactgattttgtagttgattgtgtatcctgcaactttagtaaagttctttatcagttctaatagatttttggtggagg

SEQ ID NO: 15026 - DNA, 59 bp, Homo sapiens
tggcagctgactggatggtgcccactcaggttaagagtgggtctgtctctgtcagtcca

SEQ ID NO: 15027 - DNA, 119 bp, Homo sapiens
ccaccgtggcctcccgaagtgcaataacaggtgtgagccaccatgtccagaccatctttttttttttttttttttttttgacacagtctcactctgtttcccaggttggagtacagtgg

SEQ ID NO: 15028 - DNA, 117 bp, Homo sapiens
tgacaactttcatattaatatccttggtttctgtgatgtttaatactgaggtttcaacttgattggattgaagcgtgcaaaatagtgttctgaggtgtgtctgtgaggtttttgtca

SEQ ID NO: 15029 - DNA, 102 bp, Homo sapiens
ttgtttgcctcctgatatggaatactatttatatcaatttaatattgtgagtgttcattttgttgattttgataaaaactgttttctaatgatggcatttaa

SEQ ID NO: 15030 - DNA, 122 bp, Homo sapiens
tggatagattcaaatttttgagacatttattcatagtttagaatagtatacattgatatattttaatttaatgcctactgtctttctttgaaaatatgctcattttgctgtgtagtatctat

SEQ ID NO: 15031 - DNA, 178 bp, Homo sapiens
gtatatatatttatatatatatatataccttatatatatatatacacaccatatatatatatacaccatatatatatgtgtatatatgtatatatgtgtatatatttgtgtatatatatacacgtatgtgtatacatatgtatatatatatacacaccatatataatatggtgtatat

SEQ ID NO: 15032 - DNA, 148 bp, Homo sapiens
gtttgcatatatatatatatatggtgtgtatatatatatgtgtatatatgtatatatatatgtgtatatatttgtgtatatatatacatatgtgtatacatatgtatatatatacacacaccatatatatatatacaccatatataca

SEQ ID NO: 15033 - DNA, 76 bp, Homo sapiens
gtgtgtgtgcttgtgtgtgtgtatatatatgtatatatacatatacatatatatacacacagatatacatatatat

SEQ ID NO: 15034 - DNA, 112 bp, Homo sapiens
cttagtgctctgtgtgcacatgctcctgtgtaaggttagttgcttttcctgttcaaccctgtggctgtagtttgttgttgcttgggcgagtgtgcacgtgtgagcatatgag

SEQ ID NO: 15035 - DNA, 86 bp, Homo sapiens
atcaaaatttgatatatatatcatatattatatataatgggtgacagacaatcattatatagatgtaatgtatataatgagttgat

SEQ ID NO: 15036 - DNA, 103 bp, Homo sapiens
tatctggaaacttgtgggaagtgcagattcttaagtctacctcacacttactgactctgagattctgggaataaatctgcattttataacagtcttccatata

SEQ ID NO: 15037 - DNA, 58 bp, Homo sapiens
ccaggcagacagaagccagagaacacttggaggccagtgtggaagcctgtgtggctgg

SEQ ID NO: 15038 - DNA, 80 bp, Homo sapiens
ccccactttggggtccctctgcctctggagcacttgttgctggggtctcagaggtcacagaggtcaccaggatagtgggg

SEQ ID NO: 15039 - DNA, 90 bp, Homo sapiens
gattcatatatatatggattctatatatatggattctatttatatatatggattctatatatatggattctatttatatgtatgtgaatt

SEQ ID NO: 15040 - DNA, 128 bp, Homo sapiens
tatatatgtgtatatataaaatatagaggtttatatatgtgtatatataaaatatagaggtttatatatgtgtatatataaaatatagacgtttatatatgtgtatatatagacaattgactaaattt

SEQ ID NO: 15041 - DNA, 80 bp, Homo sapiens
gtgtgtgtgcctgtgtgcatgcctgtgtgtgcatgtatgtctgtgtatgtgtgtgtatgtgtgcgtgcctgtatgtctgc

SEQ ID NO: 15042 - DNA, 114 bp, Homo sapiens
agatgtatatttgtgaggtggttatattttcagaaagctattacataattattagattcttaattatgaatttatgtatgctaatttgaagataaaattttcgcaaaggcttct

SEQ ID NO: 15043 - DNA, 78 bp, Homo sapiens
gagaagtaggtgagagattgaatctcacattgtttactctttataaatgtgttttcatcaactaaacacttgtttctc

SEQ ID NO: 15044 - DNA, 119 bp, Homo sapiens
ttgtatatgtatgtatatatgtgtacgaatatatatcatatatgtatatatgtgtacaaatatatattgtatatgtatgtatatatgtgtattaatatatatgtatgtatatattatat

SEQ ID NO: 15045 - DNA, 61 bp, Homo sapiens
tgtatatgtatgtatatatgtgtatgaatatatattgtatatgtatgtatatatgtgtacg

SEQ ID NO: 15046 - DNA, 117 bp, Homo sapiens
gaatttactctgacccatctggccctggtaccttctgttttggaatgttattcattattgattaaatttctttaatagatacaggtcaatgcatattgtctattttaatgtaaattt

SEQ ID NO: 15047 - DNA, 74 bp, Homo sapiens
acagtagataaatgtagctgtgggtacaagtgcaaatgtagctctatctcctgtctggctatctgtctgtctgt

SEQ ID NO: 15048 - DNA, 95 bp, Homo sapiens; identical to SEQ ID NO: 68

SEQ ID NO: 15049 - DNA, 93 bp, Homo sapiens; identical to SEQ ID NO: 69

SEQ ID NO: 15050 - DNA, 79 bp, Homo sapiens
cttctctgtttcaattttttcttttaaaatttgaaataagttcaaatctgagaaggagaaggaaatgacagttgtgaag

SEQ ID NO: 15051 - DNA, 102 bp, Homo sapiens
gcagggattgcattgaatctgtggattattgtgagcagtaagaatatttcaacaatattaattattccatttcatgatgagcagatgtttgcatttatttgt

SEQ ID NO: 15052 - DNA, 95 bp, Homo sapiens; identical to SEQ ID NO: 68

SEQ ID NO: 15053 - DNA, 93 bp, Homo sapiens; identical to SEQ ID NO: 69

SEQ ID NO: 15054 - DNA, 114 bp, Homo sapiens
tgtggtattgatttgtatttctctgatgattaatgacaattaatattttttcatatgcttgttggttgtatgtatgttttcttttgagaagtgtctgctcttgtcctttgccca

SEQ ID NO: 15055 - DNA, 74 bp, Homo sapiens
aagataagtgggtgtagaggtgtgtgtacgtatatatatatatatatatgtttatgcatctatatgttttgtat

SEQ ID NO: 15056 - DNA, 107 bp, Homo sapiens
acatcaccttttatatttgtgtttcttaggaatattaattttgttttaaaagcaaaaactttaatagacagtggatgttataagagccattttgtccaggtgggggt

SEQ ID NO: 15057 - DNA, 100 bp, Homo sapiens
ttatggccataccagtttcaagagtatcagtagatgagagattttgttgtttactcaaaaactaagggtctctggtttgcatgtgctctctatgtcatga

SEQ ID NO: 15058 - DNA, 83 bp, Homo sapiens
atttccaaggttgctctcagtacactggtttgagctactgtcctgtgatataatacagtgtttgttgattttactttggaagt

SEQ ID NO: 15059 - DNA, 58 bp, Homo sapiens
tgagacagggtctcactgtgtcacccaggctggagtgcagtggcgtgatcttggctca

SEQ ID NO: 15060 - DNA, 76 bp, Homo sapiens
tatgtatatatatatgtgtatatatatatatgtgtatatatatatatatatatatatatatatatatatatacata

SEQ ID NO: 15061 - DNA, 58 bp, Homo sapiens
tgagatggagtctcgctctgtcactcaggctggagtgcagtggcgcgatctcggttca

SEQ ID NO: 15062 - DNA, 111 bp, Homo sapiens
ggccccagcagctgagactacaggcatgacagcatgcctggctaattttcatattttttgtagagaggggttttgccatgttgtctagactggtctcaaactcctgggctc

SEQ ID NO: 15063 - DNA, 156 bp, Homo sapiens
gtgcacatatttgtgtgggcaggtgtgcacatgtgtatgtgtgtaagcaggtgtgcacatgtgtctgtgtgagcaggtgtgcactgtgtgtgggcaggtgtgcacatttgtctgtgtgtgtgggtcaggtgtgcacatgtgtctgtgtgtgtgggc

SEQ ID NO: 15064 - DNA, 113 bp, Homo sapiens
tggactgtgtccctcttccgtttctgctgtagacccataagcatctaatagttaagtttgttttttaatttgatctcttgatttaacacagagagagctgacactgctgttga

SEQ ID NO: 15065 - DNA, 116 bp, Homo sapiens
gtgactcctcttttctcaggcagggacacagagcaggatgtggggccaggcaggaaaccacagggtctctgtgtccctcagacacctgggactggaatggacactgtggccctaca

SEQ ID NO: 15066 - DNA, 58 bp, Homo sapiens; identical to SEQ ID NO: 1435

SEQ ID NO: 15067 - DNA, 70 bp, Homo sapiens
agtcttaatctccagccactgaaatctaaaaggatgataagatttgagtgtaatggacaactttgaggct

SEQ ID NO: 15068 - DNA, 115 bp, Homo sapiens
cctgacattttaatgatcaccattctaactggtgtgagatggcatctcattgtggttgtgatttgcatttctctgatgaccagtgatgatgagcattttttcatgtgtctgctgg

SEQ ID NO: 15069 - DNA, 91 bp, Homo sapiens
ctgtggttttgatttgcatttctctaattatgaagttaataatttcataattttattaaatttgatgaaatcaactcaagatggattacag

SEQ ID NO: 15070 - DNA, 117 bp, Homo sapiens
gtagatggcggtcttctctccctgtggttcttgattgtgtttcctgtatgaatgtctgggtttgaatttttatttttataagaacatgaattgtatgggattaggggcccactctac

SEQ ID NO: 15071 - DNA, 67 bp, Homo sapiens
cagcactcacgtctgggtctctgtctctcccaccagaataggggctcctttacggatgggggtcctg

SEQ ID NO: 15072 - DNA, 82 bp, Homo sapiens
atttccatcattccgcttgcgcagtcatgtctaagtgtctctttaatgaacatggacagtctgtcactcagagtagggagat

SEQ ID NO: 15073 - DNA, 61 bp, Homo sapiens
gagagggcaaacttgtcttgtcccagtttccaaggggaatgtttccagattttgccctttt

SEQ ID NO: 15074 - DNA, 70 bp, Homo sapiens
tggaatggtatgaccagagcagttcacccacctccaaggtgtcagcctgtctgtgagtcaaacaaggcca

SEQ ID NO: 15075 - DNA, 86 bp, Homo sapiens
atatatacatagaaacatatacatatgtacaagtatatatgtaggtatatgtgtatgaatatatgaatatgtatatgtatgtgtat

SEQ ID NO: 15076 - DNA, 62 bp, Homo sapiens
atacacatatacctacatatatacttgtacatatgtatatgtttctatgtatatatgtgtgt

SEQ ID NO: 15077 - DNA, 95 bp, Homo sapiens; identical to SEQ ID NO: 68

SEQ ID NO: 15078 - DNA, 93 bp, Homo sapiens; identical to SEQ ID NO: 69

SEQ ID NO: 15079 - DNA, 116 bp, Homo sapiens
gttgcactgactgtgttgttggtaggagtccagagatgtttttattttgttttgttttgtttttttgagacaaagagtctccctctgttgcccaggctggagtagagtggtgcaat

SEQ ID NO: 15080 - DNA, 111 bp, Homo sapiens
gttggctcttatgggaatttggaattccagagtttttcattatctgcaagtgcatctgatgatccatgaccgtaggaaattgtaactgctgaggttccattcatgccacac

SEQ ID NO: 15081 - DNA, 113 bp, Homo sapiens
tgcattcaactctccttctccatgctgtaaggtgttttattttctttaaaatttaattttattttatcttacattctaggatacatgtgcaggatgtgcaggtttgttatgta

SEQ ID NO: 15082 - DNA, 76 bp, Homo sapiens
gcacagaaatctgagtggacagaaaaatgcattaagtgttaaaatatatttttctccacttcagatatctttttgc

SEQ ID NO: 15083 - DNA, 95 bp, Homo sapiens; identical to SEQ ID NO: 68

SEQ ID NO: 15084 - DNA, 93 bp, Homo sapiens; identical to SEQ ID NO: 69

SEQ ID NO: 15085 - DNA, 85 bp, Homo sapiens
actttgaagttagaggagacctggggtcagattcctcggcaagttacttgacctctctcactctcagatctcttggctttaaagt

SEQ ID NO: 15086 - DNA, 116 bp, Homo sapiens
ggttctgagcctatattcgtgatgtgctagttctgtagtctgtgtgtctgtgtatgtcatgttttacagattttgacatgaacctagcttcataaaaattaattagggggttctcc

SEQ ID NO: 15087 - DNA, 62 bp, Homo sapiens
ctggagtcagacagaccagggtttgtgtccaagcctgtcactctctagctgtgtgactccgg

SEQ ID NO: 15088 - DNA, 86 bp, Homo sapiens
gtctgcttttggcttggtgcaatggctcatgcctgtaagctgggaggctgaggtaggaggatcacttgaggtcaagagttagagac

SEQ ID NO: 15089 - DNA, 81 bp, Homo sapiens
gtgtgtatatgtatatgtacatatgtgtgtgtatgtatctgtacatatatatgtgtgtgtgtatatatatatatgaatgca

SEQ ID NO: 15090 - DNA, 77 bp, Homo sapiens
aggagtctctctgtaactcagtgcagtcttgccctcgtggtgtctctagcactgagcatcagggaagctgggcttct

SEQ ID NO: 15091 - DNA, 82 bp, Homo sapiens
tcattttattttattttattttcttgagatggagtctcgctctgttactcaggttggagtacagtggtgtgatcttggctca

SEQ ID NO: 15092 - DNA, 106 bp, Homo sapiens
gggaatgacagacggcaggcacgggcctccgcctccacagctgtcccagccccacgggaatgacagacagcagacacgggcctccccctccacagctgtccttccc

SEQ ID NO: 15093 - DNA, 58 bp, Homo sapiens; identical to SEQ ID NO: 1847

SEQ ID NO: 15094 - DNA, 117 bp, Homo sapiens
atatatttttatcactctcaaaatcatggtagttattatacctgtgggcaaatcttgttatttaatacattaataatgatgtccatatattacaatattatgcttttaaaagtatat

SEQ ID NO: 15095 - DNA, 77 bp, Homo sapiens
ggggctactcagaggtttacagttccccacctgctttctggcaggctgactctgtgactgccttcaccaccttcccc

SEQ ID NO: 15096 - DNA, 68 bp, Homo sapiens
gggcctgagaggacctccgtgtgaggcaatgcatttcccaggtcacctctgtgtctctctccaggctt

SEQ ID NO: 15097 - DNA, 62 bp, Homo sapiens
tgagatggagtctcactctgtcaccaggctggagtgcagtggcatgatcttggctccctcca

SEQ ID NO: 15098 - DNA, 76 bp, Homo sapiens
ctaagagctcctttcagcaactttactgtgcaaattgagtttaattcgttgagtttagttcagaaggagctaagag

SEQ ID NO: 15099 - DNA, 58 bp, Homo sapiens; identical to SEQ ID NO: 315

SEQ ID NO: 15100 - DNA, 119 bp, Homo sapiens
ctattgcctagtgactttgtagatgacatagtgtggtagcgtaatcatttaatttttaaaaatatatttagtgtagcctaagcatacagtgttataaagtctacaggagtgagcagtag

SEQ ID NO: 15101 - DNA, 86 bp, Homo sapiens
ggaaaagccataaacatttcagacattggtcttggcattgttgagctgctgaaccactattgtttgaatttttgttacttacagcc

SEQ ID NO: 15102 - DNA, 99 bp, Homo sapiens
ggagagctgagagagattgttcctgtggagaagcagggcaggtgaactgagatagaactctccaaagccctctgagccttcaccaatctttaagccttc

SEQ ID NO: 15103 - DNA, 97 bp, Homo sapiens
aagtaaaacaataacaaaaaaaggtgtgtagctcctctcacactctctcatgctccttttcccaccgtgtggagatgcctcactccctgttttcctt

SEQ ID NO: 15104 - DNA, 89 bp, Homo sapiens
agctgacagtgactgttgatggtgggatgatgtgtgagttttatgttctttcttatgcattcattgtatttattaacctttcaaaagct

SEQ ID NO: 15105 - DNA, 108 bp, Homo sapiens
tctctctactccttccctcgaatttggactgaccctctctctcactagctttgaccaatagaatgtggtggaagaaaagtgcaacttctgaggttgggacttaagaga

SEQ ID NO: 15106 - DNA, 114 bp, Homo sapiens
tcctgatatttagtaacttcttaatacatagctaccttcatttttattatatttattattaagtaaagtgaatgcttaagaacagagagagctatagagcagctataaaaagga

SEQ ID NO: 15107 - DNA, 74 bp, Homo sapiens
atacatacacatgcatatgtatatatctatatgtatacatgcatatctatgtacacacacatatgtgtatgtat

SEQ ID NO: 15108 - DNA, 107 bp, Homo sapiens
gagctggaagagaagcacaatatgttgtttatcactgtcactgtcagacattcaagtacaaagaattttctgcaggtaagcaggcttgacatgcaaaatttcagttt

SEQ ID NO: 15109 - DNA, 87 bp, Homo sapiens
ggtgatgaattccctcagttgtcgcttgtctgggaaagaatatttcttcttcattatggaaggacagctttgatgggtatagtcttc

SEQ ID NO: 15110 - DNA, 80 bp, Homo sapiens
ggaaaatagactccctgatgaaaggcagaaagaaatttgtcctctctctgtctctgattcaaacagtgaggatgagttcc

SEQ ID NO: 15111 - DNA, 72 bp, Homo sapiens
ttctgtcagtgactctgtgaataaggggtgagctacgcaccgcctattcattctgctgtcaagaaatctgac

SEQ ID NO: 15112 - DNA, 90 bp, Homo sapiens
tatggttccctctctcactcacagtctggtagggaaagagaaatgaatacaactagctgtggtacaaggcaagatgtgagaagtaccatg

SEQ ID NO: 15113 - DNA, 95 bp, Homo sapiens; identical to SEQ ID NO: 68

SEQ ID NO: 15114 - DNA, 93 bp, Homo sapiens; identical to SEQ ID NO: 69

SEQ ID NO: 15115 - DNA, 64 bp, Homo sapiens
agtgacaggctttgatttgtttacagtaggtgaacaactacttagagaagtctgactgctcact

SEQ ID NO: 15116 - DNA, 90 bp, Homo sapiens
atgcatatatatatatatatgtatacatatatatgtgtgtgtatatatatgtgtgtatatatgtgtgtatatatgtatatatatatgtgt

SEQ ID NO: 15117 - DNA, 87 bp, Homo sapiens
cccgggaggcagaggttgcagtgagctgagattgcatcactgctctctagcccgggcgacagtgtgagtctctgtctcaaaatcaat

SEQ ID NO: 15118 - DNA, 95 bp, Homo sapiens
gtgaaaaatggtatttcagtgtggctttaatttgtagttatttaattatgagtaactttgaaatttttttcatatgtatgagagccattttttat

SEQ ID NO: 15119 - DNA, 100 bp, Homo sapiens
gagaccctgggagccccctgcaactgtttgcaaagtatttatgtatatacatgtaaatctaagtacgtgcatttttctgtggataagttccatatttttc

SEQ ID NO: 15120 - DNA, 78 bp, Homo sapiens
aggaactattggatccacagactacaaagctgtgaggaccccttcagtttctgtctctctgtttctactagttagcct

SEQ ID NO: 15121 - DNA, 58 bp, Homo sapiens; identical to SEQ ID NO: 2263

SEQ ID NO: 15122 - DNA, 78 bp, Homo sapiens
ctccagcctgggcaacagagcaacactccgtcaaaaaaaaaaaaaagacaaggtctcactctgtcacccagactggag

SEQ ID NO: 15123 - DNA, 82 bp, Homo sapiens
gttgctcaggctggtatcgaactcctggcctcaagcaatccgccagcctaagtctctgtctctgtgccagcctactatcaac

SEQ ID NO: 15124 - DNA, 112 bp, Homo sapiens
tgagtaataatagagcccacctcctagggatgttgtgagaattgagtgagttaatctgcgtaaattgctttagaatcatgcctagcacagagtaagctctatataagcctta

SEQ ID NO: 15125 - DNA, 117 bp, Homo sapiens
gattacaggtatgagctaccactgctggcctaggatggctttaaggaaggggatgagtgatttttttttttttttaatccataggcactagagtttggttaatttttgcctcttgtt

SEQ ID NO: 15126 - DNA, 108 bp, Homo sapiens
gtttcagccatttcatccaataaagccttctaaagccttttttttttgagacagggtctcactctgtcactcaagctggagtgcagtggcgtgatcttggcttactgc

SEQ ID NO: 15127 - DNA, 115 bp, Homo sapiens
cctgcactccagcctaggcaacagagtgagaccctgtctcaaaaaaacaaaagaaaacatgatttttttttttaagacaaggtctcgctctgtcaccctggctggagtacaatgg

SEQ ID NO: 15128 - DNA, 95 bp, Homo sapiens; identical to SEQ ID NO: 68

SEQ ID NO: 15129 - DNA, 93 bp, Homo sapiens; identical to SEQ ID NO: 69

SEQ ID NO: 15130 - DNA, 136 bp, Homo sapiens
gctttgagatgtggattgtggctgggcatgatggctcatgcctataaatccagcattttgggaggctgaggtagaaggatcacttgaggccaggaattcaagaccagactgggcaacagagtgagaccttgtcttt

SEQ ID NO: 15131 - DNA, 85 bp, Homo sapiens
atgtgtgtgtgcatgtatgtgcgtgcatattgtgcgtatgtgtctgcatgtgcatgtgtgtttgcatgtgtgtgcatgcatgtgt

SEQ ID NO: 15132 - DNA, 124 bp, Homo sapiens
gtgtgtgtatatattatctatacatatatgtgtgtgtatatattatatatacatatgtgtgtgtatatattatatatacatatgtgtatatatatatttatatatatatatatatatatatata

SEQ ID NO: 15133 - DNA, 59 bp, Homo sapiens
tgttttgagtcagagtctctgtcacccagcctggagtgcagtggctttatctcggctca

SEQ ID NO: 15134 - DNA, 85 bp, Homo sapiens
gcccaccaccacacttggctgactgttgtatttttatttttattttgaaacggagtctcactctgtctcccaggctggagtgggc

SEQ ID NO: 15135 - DNA, 113 bp, Homo sapiens
ttgtattttttttgtagagatggggtctcacgaggctagtctcgaatttcttttttttttttttttgagagagagtctcgctctgtcacccaggttggagtgcagtggtgcag

SEQ ID NO: 15136 - DNA, 93 bp, Homo sapiens
ttggatttgggtagaaatcattatgtctatttaattaaatatagtggcatttaataataagtgggaacatgattatcttctgcactagactag

SEQ ID NO: 15137 - DNA, 97 bp, Homo sapiens
agcctgggggacagagcgagactccatctcaaaaaaaaaaaaaatgtgtaatcttcatttatttatttagagagggtctccttctgtcgcccagtct

SEQ ID NO: 15138 - DNA, 93 bp, Homo sapiens
ccaagctgggactacagttgtgtgtcactacacctggctaaattttttaattttttgtagaggtgagggtctcattaatgttgtctaggctgg

SEQ ID NO: 15139 - DNA, 67 bp, Homo sapiens
agtttttgggggttgtgtttgttttttgtttttttaagagacagggtctcactctgccacccaggct

SEQ ID NO: 15140 - DNA, 86 bp, Homo sapiens
ttcttaagagatggggtctcactctgtcactgaggctggagtgcagtggcacaatcatagctcagtgcagcctccaactcctagag

SEQ ID NO: 15141 - DNA, 88 bp, Homo sapiens
actccatgcctgcctcccactatggctatacttttttctttattgagttgcttgacttgaataaaaatgttagtcaaggcatggatgt

SEQ ID NO: 15142 - DNA, 116 bp, Homo sapiens
gatgaaggccagtcacccataatgttgaatgagtttttgtcaatatttttataagcatcatatttatagctattgagtggctctgaagcatcatcacactgtgactttctgccatc

SEQ ID NO: 15143 - DNA, 118 bp, Homo sapiens
agtgtgagttatgattagagatttagttgggctttttttgtaagtaaactttttctttttgagatgggagtctggctctgttgcccaggctggcagttggttgtgaccttggttcact

SEQ ID NO: 15144 - DNA, 72 bp, Homo sapiens
ctatacatctctatgtacgtgtgtgtgtgtatatgtatatataaatgcaaacccacacatagagtgaataga

SEQ ID NO: 15145 - DNA, 58 bp, Homo sapiens
tgatacagagtctcgctctgtcacccaggctggactgcagtggcgtgattttggctca

SEQ ID NO: 15146 - DNA, 115 bp, Homo sapiens
gcctgatttcttacagcattttaaagattcttcctcagtcagacactctcacacaccatttgatgagcagaagaccaccatctttgcagagcgcacttgaacagaatccagcggc

SEQ ID NO: 15147 - DNA, 62 bp, Homo sapiens
gtggggctgagtgctttgttcttttttttttttttttgagacggagtctcactctgtccccc

SEQ ID NO: 15148 - DNA, 95 bp, Homo sapiens
aactttttctaggaagtctagattgtacactctgctgtagtgtgaaattatttcattttaagcaataaacagcctgtgcttcttaagagcttgtt

SEQ ID NO: 15149 - DNA, 91 bp, Homo sapiens
cagttagcaaggtagtagagccctgtgtgcctgtgtgtttgtctgtatatatatgtgtattagtctgttttcatactgctataaagaactg

SEQ ID NO: 15150 - DNA, 84 bp, Homo sapiens
tctagcgtgggcgataggagtgagaccccgcctttttttttttttttttttgagatagagtctagctctgtcacccaggctgga

SEQ ID NO: 15151 - DNA, 60 bp, Homo sapiens
gttgagatggagtctcactctgtcacccaggctggagtgcagtggtgtgatctcaactca

SEQ ID NO: 15152 - DNA, 58 bp, Homo sapiens; identical to SEQ ID NO: 4546

SEQ ID NO: 15153 - DNA, 80 bp, Homo sapiens
cacactggaagtatacaggagaagctttgtgaaaaaagataatttttttttttgacggagtctcgctgtcacccaggctg

SEQ ID NO: 15154 - DNA, 91 bp, Homo sapiens
atgaccagtatggtctcactaccaagaacaggctttattccaggagcctggcagcctctattcttgaatgcatccccctatactgtctcat

SEQ ID NO: 15155 - DNA, 75 bp, Homo sapiens
cctttcctcttgggtcatacagcagctgcatgtgggtgtccccactgttcctacgtaaaccccccatgggacagg

SEQ ID NO: 15156 - DNA, 104 bp, Homo sapiens
ttaataactcagaggctgggtgaggtggctcatgcctgtaatcctagcactttgggaggttgaggtaggaggatggcttgaggccaggagttcgagaccagcct

SEQ ID NO: 15157 - DNA, 85 bp, Homo sapiens; identical to SEQ ID NO: 15131

SEQ ID NO: 15158 - DNA, 125 bp, Homo sapiens
tatatatacacacacacactgtgatatatatatatacacacacactggtatatatatatatttatatataaccactgtgtgtgtgtatatatatgtatatatatgtgtgtatatatatgtgtgtg

SEQ ID NO: 15159 - DNA, 67 bp, Homo sapiens
atatatatacacacacacagtggttatatataaatatatatatataccagtgtgtgtgtatatatat

SEQ ID NO: 15160 - DNA, 62 bp, Homo sapiens
ccagtatccagagtgactcttttattttttgagatggagtctcactctgtcacccaggctgg

SEQ ID NO: 15161 - DNA, 86 bp, Homo sapiens
atatacacatacatatatgcatgtatatgtatacatacatgcatatatgtatgtatacctacgtatgtatgtatgtatgtgtatat

SEQ ID NO: 15162 - DNA, 73 bp, Homo sapiens
tctgtgtttaaaaaaagaaacaattctacacggaatttctggtagaattttttttttttttttttccgacaga

SEQ ID NO: 15163 - DNA, 76 bp, Homo sapiens
ctgcttgagcccgaggggcagagtttacagtgagctgagactgcatcactgcactctagcctgggtgacagagcgg

SEQ ID NO: 15164 - DNA, 95 bp, Homo sapiens; identical to SEQ ID NO: 580

SEQ ID NO: 15165 - DNA, 93 bp, Homo sapiens; identical to SEQ ID NO: 69

SEQ ID NO: 15166 - DNA, 80 bp, Homo sapiens
gctcacagtcttttgtaacagtgcttgacatagaggaagggagagatgattgtgtccagtctgctcaggatcctggaagc

SEQ ID NO: 15167 - DNA, 83 bp, Homo sapiens
gcaagatttttgcatttggttttttgttttttttttaatctgtgatatagcacagatgaaagctgaagctcgttaattcttgc

SEQ ID NO: 15168 - DNA, 115 bp, Homo sapiens
ggctgcagctgcgtgtgacccatgggagacagtgcagggcgggaagaaggggaggccagcgtctctccctcactctgcctcctggggtttccgcagcagctgcttctctggagcc

SEQ ID NO: 15169 - DNA, 81 bp, Homo sapiens
tgactgcatctctctgtgctgttgtttttttcttaataaaatgggggatataatgatagctacctcttagggttgttgtca

SEQ ID NO: 15170 - DNA, 79 bp, Homo sapiens
gcttgaggccatcatgaggacattctttttttttttttttttttttttttttgagagagtctcgctctgtcgcccaggc

SEQ ID NO: 15171 - DNA, 57 bp, Homo sapiens
gggtctctctctctgccactcaggccacagtgcagttgacgcagggcaggggagccc

SEQ ID NO: 15172 - DNA, 93 bp, Homo sapiens
ccagcctgggcaacatagtgagtctctgtttctgttaaaaaaatgtttaagggctggcacggtggctcacacctgtaatccccagtactttgg

SEQ ID NO: 15173 - DNA, 131 bp, Homo sapiens
tatgtatacatatatatgtatatatgtatgtgtatatatacacatatatacatgtatatgtatatatgtatgtatatatatgcatatatatatacatgtacatgtgtatatgtgtgtgtatatatatgtgt

SEQ ID NO: 15174 - DNA, 76 bp, Homo sapiens
aggccatttctggaacttgaaaggattttagaaccaatgctatctgcactgaagtcagtcaggacagagatggttt

SEQ ID NO: 15175 - DNA, 109 bp, Homo sapiens
caataaattcttcatgtagctttgtcttggaagaattgatgcacctcccagttttattttagaatttttttgagggcactataagacattctaattgagacacttgttg

SEQ ID NO: 15176 - DNA, 64 bp, Homo sapiens
ttcctcagctgggcgaccgtggccattgacttcctctctgtgcctcagttgctccatctgtgaa

SEQ ID NO: 15177 - DNA, 59 bp, Homo sapiens
ctcagctgggcgaccgtggccattgacttcctctctgtgcctcagttgctccatctgtg

SEQ ID NO: 15178 - DNA, 87 bp, Homo sapiens
tgtgtggctcagatatatatctatatctatagatctatctatatatatgtctatatgtatgtgtatgtatatatttaaggctccata

SEQ ID NO: 15179 - DNA, 66 bp, Homo sapiens
ccctgtgtctctgtgactcagcgtgtcctctcctcttttataaggacaccagtcattgacttaggg

SEQ ID NO: 15180 - DNA, 58 bp, Homo sapiens
tgagactgagtctctctctgtcacccaggctggagtgcagtggtgcaatctcagctca

SEQ ID NO: 15181 - DNA, 83 bp, Homo sapiens
gaacagagagggcatattgtagttgtgatatgaatgtgagctcttatcattcagctatttcttcagttatgcaatttgtgttc

SEQ ID NO: 15182 - DNA, 116 bp, Homo sapiens
tatgtgtatgtacgtatatgtatgtatgtgtatatatgtatgtgtatgtgtacgtatgtatatatatgtatgtgtatatatatgtatgtgtgtatatatataattatatatatata

SEQ ID NO: 15183 - DNA, 112 bp, Homo sapiens
actctatccttttgaagctcataaaaagcctacaaaatagagttatacattttttattatgattttagaaaaaaatgagacttggggtgattaaatgatttaggggtaaagt

SEQ ID NO: 15184 - DNA, 117 bp, Homo sapiens
gtgcatgtctctgggaaatcttcatatctgtttggggttcattttttcttctacaaaaatggtgggacacatacatgacctatctctacagggcaggacttttgggaaataatgcac

SEQ ID NO: 15185 - DNA, 73 bp, Homo sapiens
ttgtttttttgagatggagtctcactctgtcacccaggctggagtgcagtggtgtgatctcagctcactgcaa

SEQ ID NO: 15186 - DNA, 58 bp, Homo sapiens; identical to SEQ ID NO: 1215

SEQ ID NO: 15187 - DNA, 72 bp, Homo sapiens
tgtacatatagtctaggtgtgtagtaggattggccatctaggtttgtgtgagtacacactgtgatgtttaca

SEQ ID NO: 15188 - DNA, 73 bp, Homo sapiens
acttaggtggaccactgagcacacatgagcatgtgtgtgtctatctgtgtgtgtgtgagtccatatgattagt

SEQ ID NO: 15189 - DNA, 119 bp, Homo sapiens
aatgcctgttgccttgatgcgttttcaatatttcagaccctagctattcttcatttttatagataattaatggtctgcaggtctggaaaggggaactaaactgggagtcaaacgttggg

SEQ ID NO: 15190 - DNA, 102 bp, Homo sapiens
tccacttaagagaaatttaggaaatcattatgagagagagagagagagagagagatgctcctttgtaacacttgtgatttcctagaacaatggttaggagga

SEQ ID NO: 15191 - DNA, 68 bp, Homo sapiens
cagagtcttagaagatcagtggctgtttgcctgtttgccagatgggcatggttgggaagggcattctg

SEQ ID NO: 15192 - DNA, 95 bp, Homo sapiens
tcttgatctggcacgtggttgaggctgacttggagaagttggagcctctcactgcctctcaggcagcctgagaacgtgaagccagtgctttggga

SEQ ID NO: 15193 - DNA, 93 bp, Homo sapiens; identical to SEQ ID NO: 12951

SEQ ID NO: 15194 - DNA, 115 bp, Homo sapiens
taacctcctgggagcatctgacactattttcttctttttttaaacaatgtttatttattttttaaatttataatttaagttttgggatatatgtgcagaatgtgcaggtttgtta

SEQ ID NO: 15195 - DNA, 58 bp, Homo sapiens; identical to SEQ ID NO: 1725

SEQ ID NO: 15196 - DNA, 58 bp, Homo sapiens
tgagacagagtttccctctgtcactcaggctggagtgcagtggcgtaaactcagctca

SEQ ID NO: 15197 - DNA, 98 bp, Homo sapiens
cttgatcttgcttctgagaggtaacactggggagggtgggggtatacctctccacatctttttcttttatttttattttttaagttctgggatacaag

SEQ ID NO: 15198 - DNA, 80 bp, Homo sapiens
aacactctctccaacactcacacattttagactgtcagccagggtaagttgtgtgtaatgttcagtgtgaaggggctgtt

SEQ ID NO: 15199 - DNA, 60 bp, Homo sapiens
tgagacagagtctcgctctgtcacccaggctggagtgcaatggcgcgtggtctctgctca

SEQ ID NO: 15200 - DNA, 112 bp, Homo sapiens
gtcttaatcttcatgtcaaatatcttgattttagaaatattggacacttatagtttttttttaaaaaaaactaagtattactattgggataattactaatatgagataggat

SEQ ID NO: 15201 - DNA, 120 bp, Homo sapiens
gtgctgtcctctggcctaggttaatttgatccccagtggaaagatgagtcacagagggagtctctgtgcctctctcatgtactggagtttcattcacttttgtcagccagacgttgtcac

SEQ ID NO: 15202 - DNA, 79 bp, Homo sapiens
tacacactatatatgtatatatacacatatagccatatatacgtatatatatggatatgtgtgtgtgtgtatatatata

SEQ ID NO: 15203 - DNA, 64 bp, Homo sapiens
tatgtgtgtgtgtatatgtatatacacacgtatgtatgtgtatatatgtatatgtatacatata

SEQ ID NO: 15204 - DNA, 92 bp, Homo sapiens
cccaggtactacatcaagggctgcggatgagccactgagacttgctggcttcagatgagactcagcacattaacagctgtggtagctatggg

SEQ ID NO: 15205 - DNA, 95 bp, Homo sapiens
gatttgtgcttccctatgattagtgattttgaacatcattttcgatgcttattggccattgctatatcttctttagggacacggctactcgagtc

SEQ ID NO: 15206 - DNA, 80 bp, Homo sapiens
gtattatgtatgtatataaatgtaagatatgtgtgtgtataaatatatacatatatatttcccagaagtaaacatgatac

SEQ ID NO: 15207 - DNA, 95 bp, Homo sapiens; identical to SEQ ID NO: 68

SEQ ID NO: 15208 - DNA, 93 bp, Homo sapiens; identical to SEQ ID NO: 69

SEQ ID NO: 15209 - DNA, 101 bp, Homo sapiens
ggggcactatttctcctagttcacaggtttccctattgctacaaaatttgttgtacacttttgtttgttaaatacaatttgtggacagatatatctgtcct

SEQ ID NO: 15210 - DNA, 95 bp, Homo sapiens; identical to SEQ ID NO: 68

SEQ ID NO: 15211 - DNA, 93 bp, Homo sapiens; identical to SEQ ID NO: 69

SEQ ID NO: 15212 - DNA, 95 bp, Homo sapiens; identical to SEQ ID NO: 68

SEQ ID NO: 15213 - DNA, 93 bp, Homo sapiens; identical to SEQ ID NO: 69

SEQ ID NO: 15214 - DNA, 95 bp, Homo sapiens; identical to SEQ ID NO: 68

SEQ ID NO: 15215 - DNA, 93 bp, Homo sapiens; identical to SEQ ID NO: 69

SEQ ID NO: 15216 - DNA, 95 bp, Homo sapiens; identical to SEQ ID NO: 68

SEQ ID NO: 15217 - DNA, 93 bp, Homo sapiens; identical to SEQ ID NO: 69

SEQ ID NO: 15218 - DNA, 63 bp, Homo sapiens
tctcctttgactctgtgtctcacatccagggcatgatgatgcaagatatgggctctcaggagg

SEQ ID NO: 15219 - DNA, 71 bp, Homo sapiens
gtgcgggtcactctgtgtctggccgtctgttatcgggtgtgtctggttaggggtggaggagcgcccgtcac

SEQ ID NO: 15220 - DNA, 113 bp, Homo sapiens
agaaatatgaagagaatgaggactgcagtccaactagaagtaaaatatgtttttttttaaaaatgcactatttcatgacttaataaatatgcatcctctatcttacgtactct

SEQ ID NO: 15221 - DNA, 106 bp, Homo sapiens
ctgttggcatgaagaaatgctaatgaactttgtacgtggattttgaattcttcagcttttctgaatttgtttatcagttctaatagatttttggtgcagtctttag

SEQ ID NO: 15222 - DNA, 101 bp, Homo sapiens
agttaataagtttctgttccttataaattaccaataagatacttaatttgtggtggcagtatgttaagaagtttgaaggaactagaatttatgtcctagct

SEQ ID NO: 15223 - DNA, 99 bp, Homo sapiens
gtgtgtgtgtgtatatgtatacacgtatatatatattcatatatatgtatatatgtatatattcatgtgtgtgtgtatatatatatcaagtcatcacac

SEQ ID NO: 15224 - DNA, 95 bp, Homo sapiens; identical to SEQ ID NO: 68

SEQ ID NO: 15225 - DNA, 93 bp, Homo sapiens; identical to SEQ ID NO: 69

SEQ ID NO: 15226 - DNA, 111 bp, Homo sapiens
cttttaccaggggaataatcacagctgtgtagaaataggcacacattttattgtgtttttatacaatcaatggaagaactttttaaaactagctttcttcttggaatgaag

SEQ ID NO: 15227 - DNA, 112 bp, Homo sapiens
ccttgcagcccatggtgatagtttatagggtgctatgttatttttgtttacttgagtggatatttatacacatgcctctttagattcaggtgttttcattttttttgtcagg

SEQ ID NO: 15228 - DNA, 103 bp, Homo sapiens
gctgggcttggtggtgcatgcctgtaatcccagctactcgggaggctgaggtagaagtatctcttgaacccgggaggcagaggttgtgctgagccaagatcgc

SEQ ID NO: 15229 - DNA, 95 bp, Homo sapiens
gcccacttgttgatggggttgtttgtttttttcttgtaaatttgtttgagttcattgtagattctggatattagccctttgtcagatgagtgggt

SEQ ID NO: 15230 - DNA, 113 bp, Homo sapiens
ctgaccgcgagtgatctgcctgcctgggcctcccgaggtgcctggattgcagacagagtctcactcactcagtgctcaatcttgcccaggctggagtgcagtggcgtgatctc

SEQ ID NO: 15231 - DNA, 100 bp, Homo sapiens
ttttctgcaagttcactgacagtaagtatagtcctagaaaacattattaatttatgtctgtttaattacatctattcttactggtgaattgccagcaaaa

SEQ ID NO: 15232 - DNA, 84 bp, Homo sapiens
gctggggagcagtcagactgcctcactccttgccagacaagactccactcttgcttccagcacagtgactgagctgctcctagc

SEQ ID NO: 15233 - DNA, 75 bp, Homo sapiens
ggagcagctcagtcactgtgctggaagcaagagtggagtcttgtctggcaaggagtgaggcagtctgactgctcc

SEQ ID NO: 15234 - DNA, 118 bp, Homo sapiens
tcctgagagcagtgaaatatagtggaagtttgcttctttgtttatttcttatttttaataggttgttttggggggaattaatgacaggagcagatttgggtatgtacacattaatgga

SEQ ID NO: 15235 - DNA, 76 bp, Homo sapiens
ggagtttcttctctgcactatggtaagaaaagccctcccattcacaatgcctgggtgactatcagggtgagacttc

SEQ ID NO: 15236 - DNA, 75 bp, Homo sapiens
gactagagcatcaattctctctctctttttttttttttttttttttttttttttgagatggaggcttgctctgtc

SEQ ID NO: 15237 - DNA, 81 bp, Homo sapiens
ttagatcatagaggcagatccctcatgaatggcttcatgtcatccccttggcaatggctgagttctcactctgagatctgg

SEQ ID NO: 15238 - DNA, 80 bp, Homo sapiens
ccacccaaatcatctcaagttgcaatccccatgtgttgggatagggacctggtgggaggtgactgaacaatgtgaggcgg

SEQ ID NO: 15239 - DNA, 179 bp, Homo sapiens
tgcatcctcaacatctgttattttttatcttcttaataatagttattctgactattgtgagatggtatctcattgtggttttgatttgcatttctctaatgactagtgatattcaacttttttatatgtttgttggtcacttgtatgtcttctttagagaaatgtctgttcatttccat

SEQ ID NO: 15240 - DNA, 72 bp, Homo sapiens
gtatgtgtatgtgtctgtgtatgtatatatatctgtatgggtatatatatatgtataggcacatatacagac

SEQ ID NO: 15241 - DNA, 93 bp, Homo sapiens
gcaattccccagcaggaaagtggaccacgtatagactctcactcaccctctcctgtactggagagtcattcctggttcttggctggtcttggc

SEQ ID NO: 15242 - DNA, 119 bp, Homo sapiens
gatttcatggaattcttgtcttaattatattttatatgtttgtgttgtatatgtgtatatatatatatatatatactagattgcaatatcaaatgttatttcttacaagggttacagtc

SEQ ID NO: 15243 - DNA, 117 bp, Homo sapiens
gcataatgttttataggttcatccatgtggtaacatgtatcagtatttcattatttttattgccaagtaatattccattgtatgcatataccacattttaccttttcatttatcagc

SEQ ID NO: 15244 - DNA, 72 bp, Homo sapiens
gtgtgcatgtgtatatatatgtgtgtatctatgtgtttatatatatatatatatatatataattttgaagac

SEQ ID NO: 15245 - DNA, 98 bp, Homo sapiens
agctaaagaattgtgagtagaagagaagtgtgcactttctgctcaagccttttaagaagactgtgccttctctttcctgtcttgcctcttcacttgct

SEQ ID NO: 15246 - DNA, 84 bp, Homo sapiens
ggtgtctacagccacaaggctggtgtgcggttagggcttgcttttgtaccacttccccacctgacactgtgtctgtgtaacacc

SEQ ID NO: 15247 - DNA, 95 bp, Homo sapiens; identical to SEQ ID NO: 68

SEQ ID NO: 15248 - DNA, 93 bp, Homo sapiens; identical to SEQ ID NO: 69

SEQ ID NO: 15249 - DNA, 82 bp, Homo sapiens
tgtgttatttgaacagatgttgcagctatatttggagagatgtagccactaacctatgtatatatttatcttcaaatggcca

SEQ ID NO: 15250 - DNA, 145 bp, Homo sapiens
atagatatatatctgtatatatctctgtctatatagatatatatctgtatatatctctttatatagatatatatctatatatctctacctagatatatatagatatatatatctatatatctctacctagatatatatagatata

SEQ ID NO: 15251 - DNA, 90 bp, Homo sapiens
ctatagatctatatatagagagacatatagatctttatatctatatagagagagacatatagatctttatatctatagagagacatatag

SEQ ID NO: 15252 - DNA, 139 bp, Homo sapiens
ccagtaccagggtgactaagaaatgtcttctattattattattattattactggagacaaagtctcactctgtcacccaggctggagtgcagtggcatgatctcagctcactgcaacctccacctcctgggttcaagtg

SEQ ID NO: 15253 - DNA, 74 bp, Homo sapiens
gtcttttggatagtggccattctaactgcagtgagatgatatttcactgtggttgtgatttgcatttccctgat

SEQ ID NO: 15254 - DNA, 96 bp, Homo sapiens
gatttcaatctttatttatgactgaatatttatttatgagatatatatatatatatatatcacatcttatttattcattcatctgttgatgaactc

SEQ ID NO: 15255 - DNA, 78 bp, Homo sapiens
gcctttcacgtgagtgaccatgtaactcctggcccaggtggggcccttctgtgagtgacagcagacacagtgattggc

SEQ ID NO: 15256 - DNA, 76 bp, Homo sapiens
actgatctgacaggagacagagctcaggcaataatgcttgctcacctgccactcatctcctgctgtgcagaccagt

SEQ ID NO: 15257 - DNA, 58 bp, Homo sapiens
tgagtcggagtctcactctgtcacccaggctggagtgcagtggtgctatctcagctca

SEQ ID NO: 15258 - DNA, 107 bp, Homo sapiens
aacctgaggtgaccaggagactctattcagcatttgtaaagaaaaaaattccaatctttttttttttttttttttttgagacaggttcttgctctgtcaccctcgtt

SEQ ID NO: 15259 - DNA, 86 bp, Homo sapiens
agtgctggggatgagaacatggaaactggaagaaatgaagcaagagattcatttcatttcatttttttttatttttgccctaaact

SEQ ID NO: 15260 - DNA, 75 bp, Homo sapiens
tttttggtgttacactcagtaaagaatgactggaaaattaaaatccagtagttagagagctgtaagcattaaaaa

SEQ ID NO: 15261 - DNA, 66 bp, Homo sapiens
attgtttttgagatggggtctcactctatcgctcaggctgaagtgcagatctcagctcactgcagt

SEQ ID NO: 15262 - DNA, 85 bp, Homo sapiens
gtatgtatagaatacatattctatatgtatgtattgcatttatatgtgtctgtgtatatgcatatgtatatgtgtctgtgtatat

SEQ ID NO: 15263 - DNA, 85 bp, Homo sapiens
tacagatttgtgtgcatgtgtgtgtatacacacctatatatatttgtatatgtacatatatatacacatacacacaaaatctgtg

SEQ ID NO: 15264 - DNA, 100 bp, Homo sapiens
gtgtgtgtgtgtatatatatatatatatgattgtgtgtgtgtatatatatatatgattgtgtgcatacatatgtatatatgtatgtgtgcatatgtatat

SEQ ID NO: 15265 - DNA, 140 bp, Homo sapiens
catatatatatatatatatatatatatacacacacacacacacatgcacaccatggtgtatatatatatatatgttatgtgtgtgtgtgtgtgtacatatatatatatgtacacacacacacacacacaccatgtatata

SEQ ID NO: 15266 - DNA, 113 bp, Homo sapiens
ttgtaaatgtatgaaggagaaagatttcattttttatattattattaatgtttagattgaatttaatgattttatttgtggtcattttccatgatggttatactaatttacaa

SEQ ID NO: 15267 - DNA, 70 bp, Homo sapiens
gtgctgaatctctggatttgggaagctatgtgtcttcaaaagtcactccatctctctgagatttaagtgc

SEQ ID NO: 15268 - DNA, 111 bp, Homo sapiens
ccactacatcgctatctctgtgtccttgggcaggtgtagtcagccactctgtggctcagatttctcctgtgaaaataataatagtagctatttcttagcgatgttgtaagg

SEQ ID NO: 15269 - DNA, 95 bp, Homo sapiens; identical to SEQ ID NO: 68

SEQ ID NO: 15270 - DNA, 93 bp, Homo sapiens; identical to SEQ ID NO: 69

SEQ ID NO: 15271 - DNA, 151 bp, Homo sapiens
atgtatatatgtatatacatgtatgtatatatgtatatgtatatacatgtatgtatatgtgtatatgtatatatgtatatgtatatacatgtatgtatatatacagctatatacatgtgtatatatatacagctatatacgtatatacata

SEQ ID NO: 15272 - DNA, 80 bp, Homo sapiens
tgtgtgtatatatatacatatgtatacatatgtgtgtatatatacatatatacgtgtgtgtgtgtatatatatatataca

SEQ ID NO: 15273 - DNA, 110 bp, Homo sapiens
ccaagtaaaaactgaccgtgtatatttaatttgaaccagctttgagtgtttttttttaaaattggctgtccatcagtaattaaaaatgtgtggccacatgaatgtcttgg

SEQ ID NO: 15274 - DNA, 94 bp, Homo sapiens
gggctagaatgatgtctgcattttctgtgtaaatgagtgaaatgttgtttggcaagtttcactttggagtacatagcttgagagcaagaagccc

SEQ ID NO: 15275 - DNA, 78 bp, Homo sapiens
tatacatacatacatatatatgtatatatatacatatacaatacatatatatgtgtgtgtgtatatatatatatatat

SEQ ID NO: 15276 - DNA, 167 bp, Homo sapiens
atatatgtatgtatgtatacatatatatgtatatatatgtatacatacatacatatatgtatatatacatacatatatatgtatatatatacatatatatgtatgtgtatatatatgtgtatatatgtgcatgtgtgtgtgtgtgtgtgtgtgtatatatatatatg

SEQ ID NO: 15277 - DNA, 97 bp, Homo sapiens
ttttctgtgtgtgtattctatataaaatagtttatatttactttagaaaatatatgttaatataaacacatgtatatatttatacacacatattaaa

SEQ ID NO: 15278 - DNA, 118 bp, Homo sapiens
tatactttcaagtggacaaacttgtataaatggtccatgttttatttatttatttatttattatactttaagttttagggtacatgtgcacaatgtgcaggtttgttacatatgtata

SEQ ID NO: 15279 - DNA, 81 bp, Homo sapiens
ggtaactgaaactgacaaaagcgaaaacagggataagggggaactaatatgtctgttgttttttgtttgttttttgctgcc

SEQ ID NO: 15280 - DNA, 95 bp, Homo sapiens; identical to SEQ ID NO: 580

SEQ ID NO: 15281 - DNA, 93 bp, Homo sapiens; identical to SEQ ID NO: 69

SEQ ID NO: 15282 - DNA, 114 bp, Homo sapiens
aaaagtgtatatgtatttgtggggggcagttagtgttacatttttattgtaaatttattacagttcgatatgtgattttgagtgaaattcattgcaatatgaatgaaaattttt

SEQ ID NO: 15283 - DNA, 117 bp, Homo sapiens
acttccaccctgcaccccaaccacaaatacataggaaggttttattttattttgtctttctgatttaaatctacctttgctttcagagtgatatttttggcataaatgcattgaagt

SEQ ID NO: 15284 - DNA, 76 bp, Homo sapiens
gagctagggagagatttggagtggttgtagtttaagacagaatgacaactttattcactcactcactcacttactc

SEQ ID NO: 15285 - DNA, 91 bp, Homo sapiens
acccagtctgtttgcagtggtgagagtagactgtctgggcaaggagactggtcaagagggcactgcttttacctaggtgagagacagtggt

SEQ ID NO: 15286 - DNA, 91 bp, Homo sapiens
gtgtatatatatatgtgtatatatatatgtgtgtgtgtatatataacatatatacacacacgcatatatatgtgtgtatatatatacacac

SEQ ID NO: 15287 - DNA, 104 bp, Homo sapiens
ataaatgaacctctgcatgtgaatatatatatgtgtgcatatatatgtatatatacatatgtacatatttctatacatgtatgtatttgcactggaagtgttat

SEQ ID NO: 15288 - DNA, 56 bp, Homo sapiens
gtatatatatatgtgtatatctatatcaatatatagatatatatgtgtatatattc

SEQ ID NO: 15289 - DNA, 83 bp, Homo sapiens
ctagttagggatctgatagcagtggtttagacttttttgttttttctttttgagacgtagtctctctctgtcacccaggctgg

SEQ ID NO: 15290 - DNA, 95 bp, Homo sapiens; identical to SEQ ID NO: 68

SEQ ID NO: 15291 - DNA, 93 bp, Homo sapiens; identical to SEQ ID NO: 69

SEQ ID NO: 15292 - DNA, 101 bp, Homo sapiens
catgttattgtatgtatttaagatctaaaatgtaatgtgtatatatgtgtctatatatatatatatataatagtgctaacttatgtatatgtagtaaaatg

SEQ ID NO: 15293 - DNA, 98 bp, Homo sapiens
ggatcaccagtggcctatagaaattttttgttgttgttttcaaaatagtgctggagataagaacttgaggttttattgtggagcagaaatttgggttc

SEQ ID NO: 15294 - DNA, 90 bp, Homo sapiens
tctaagctctggtaatattattatttttttgatttcttaaaaggaggagcagatgggaaaagtaacttgtagtgggtcacatagcttaga

SEQ ID NO: 15295 - DNA, 80 bp, Homo sapiens
tgtctagcattatattgagctgcaaagaattttatgtttttcaataatctttcagggaagctcaatatataaaatagata

SEQ ID NO: 15296 - DNA, 117 bp, Homo sapiens
ataagtttagagtatttgttcttgtttatctctgacaaagaggtgttctctaagaaattttatattttataatctttcctctgaaatatgagaaagacatggaatctcctgagttat

SEQ ID NO: 15297 - DNA, 74 bp, Homo sapiens
attaggagattgactgttagtagtatgctctggagagaagtctgagagcatagctggacaacctttctgctagt

SEQ ID NO: 15298 - DNA, 58 bp, Homo sapiens
tgagatggagtctcactctgtcacccaggctggagtgcagaggtgtgatctcagctca

SEQ ID NO: 15299 - DNA, 110 bp, Homo sapiens
aggtttcgatcttaccatttcctgcctctgataacttaggcaagttactcaacctctctgtgcctcagtttcttcagtagtacaatggaaacaataaatagtgaatatct

SEQ ID NO: 15300 - DNA, 114 bp, Homo sapiens
ttgttattgactaaggagggaaaagctgggagaagagaaagtgcatgggcaatatcagattggttttgtatctgtttcgtttgacatgccttttagaaactcaaatagaaacaa

SEQ ID NO: 15301 - DNA, 74 bp, Homo sapiens
cacatacatatatgtatgtgtctgtatatatatgtacacacatatgtgtatatttgtatgtatatgtgtatgtg

SEQ ID NO: 15302 - DNA, 118 bp, Homo sapiens
gaccagtgtctatattttagagcatcctgatttaataagacgttttattttatttatttatttatttatttttttgagatggagtctctctctgttgcccaggctggagtacagtggc

SEQ ID NO: 15303 - DNA, 63 bp, Homo sapiens
tatatgtgtgtgtatacatatgtatatatgtatctatatatacatatgtatgacacctgtata

SEQ ID NO: 15304 - DNA, 117 bp, Homo sapiens
actgcataacttgtctaacaaatgaacatagattttatttatttatttatttatttatttatttatttatttattttgagatggagtctcactctgttgcacaggctggaacgcagt

SEQ ID NO: 15305 - DNA, 121 bp, Homo sapiens
ctctagtgcttgtgaacttgaggcataaatatcagtgattttcttatttccatttttaattttaattttatttttagagatgaggtcactctctgtcacccaggctagagtgcagtggcac

SEQ ID NO: 15306 - DNA, 95 bp, Homo sapiens; identical to SEQ ID NO: 68

SEQ ID NO: 15307 - DNA, 93 bp, Homo sapiens; identical to SEQ ID NO: 69

SEQ ID NO: 15308 - DNA, 58 bp, Homo sapiens
tgagacagagtctcgctctgtcacccaggctggagtgcagtgtcgtgatctcggctca

SEQ ID NO: 15309 - DNA, 115 bp, Homo sapiens
caggtgtatctggttctgagactctgcctgaaatcactgttctctcattctctcacacatcctgggggagaggggacagattccatttcatgcagagggaagagttataagcctg

SEQ ID NO: 15310 - DNA, 100 bp, Homo sapiens
acatacatatgtatatacatgtgtatatatgtatatatgcatatatatgtatatacgtatatgtgtatatatacatacacacatatatacgtatatatgt

SEQ ID NO: 15311 - DNA, 134 bp, Homo sapiens
gtaactgcatatatatacgtatatatgtattttatatatacatacgtatatacgtatatatgtgtatatatacgtatatatgtattttaatagctgaagtaactgcatatatatacatatatacgtatatatgt

SEQ ID NO: 15312 - DNA, 74 bp, Homo sapiens
gagtagaaacaatagacatattctagatcttgaaaaacactctttgatctggctgtgatagttgtgttttattc

SEQ ID NO: 15313 - DNA, 93 bp, Homo sapiens
atgagatagatatatatatatatgtgtgtgtatatgtatatatatacacacacatatatatacacacacacatatatacgtatatatatacat

SEQ ID NO: 15314 - DNA, 142 bp, Homo sapiens
atatatatatatatatatacacacatatatacacacacgtatatatgtgtgtgtatatatgtatatatatacgtatatatgtgtgtgtgtatatatatgtgtgtgtatatatatacatatacacacacatatatatatatat

SEQ ID NO: 15315 - DNA, 112 bp, Homo sapiens
tgggagaaatgcctatgggttcaattgctaggttgtaaggtagttgtatgtttaatgtttaaagaaattgtccaactgttttcctgagtagcaataccattttatattccca

SEQ ID NO: 15316 - DNA, 119 bp, Homo sapiens
gatagttctgttatttgcacttggttgcgtctgttagcttgctgccactgttttgtgactgtggtgtgtgagcttatcttcagcggacataccttgcagctaaggttgagggatacatc

SEQ ID NO: 15317 - DNA, 94 bp, Homo sapiens
atatatatgtgtgtgtgtgtatatatatatatgtatatatgtatatgtatatatatgtgtatatatgtatatgtgtgtgtgtgtgtgtgcgcgc

SEQ ID NO: 15318 - DNA, 135 bp, Homo sapiens
gcatagaaggtgtttcgtaaatgtgtgttgggttaattcaggagcttgaatctccagacgcacagtggctcacacacttatgtgtgcatcagaatcactgtgggcatttgttaaaatgcaagttccagattccca

SEQ ID NO: 15319 - DNA, 95 bp, Homo sapiens; identical to SEQ ID NO: 580

SEQ ID NO: 15320 - DNA, 93 bp, Homo sapiens; identical to SEQ ID NO: 69

SEQ ID NO: 15321 - DNA, 64 bp, Homo sapiens
gacaaatgcttcaaatcagggcttttctcaagagagctagctggttgttaagtatttctctgtc

SEQ ID NO: 15322 - DNA, 119 bp, Homo sapiens
ttggggtactgatacctcatacgcagagtgacaaatctgatggatggactttttttttttttttaatcgggcatcaggttgtattttcttctaatgaggatttggaagtcggtgaccaa

SEQ ID NO: 15323 - DNA, 117 bp, Homo sapiens
ttatatttttaaacaaatctgtttatgccagttatacttattgtgattatgtaattcaattaaatattacataattcaataaagtgcgattcaaaagcaagagttgtttcagtgtaa

SEQ ID NO: 15324 - DNA, 107 bp, Homo sapiens
caggatacagaattctaggctggtggggtttttttttttctcattattttttatttttcttgagatggagtctcgctctgtcacacaggctagagtgcagtggcatg

SEQ ID NO: 15325 - DNA, 95 bp, Homo sapiens; identical to SEQ ID NO: 68

SEQ ID NO: 15326 - DNA, 93 bp, Homo sapiens; identical to SEQ ID NO: 69

SEQ ID NO: 15327 - DNA, 56 bp, Homo sapiens
gagacagggtcttcctctgttgcccaggctggagtacagtggtttgatctctgctt

SEQ ID NO: 15328 - DNA, 72 bp, Homo sapiens
ctgggtgtggtggtgtatacctgtggccccagctactcagggggctgaggtaagaggatcacttgagcctag

SEQ ID NO: 15329 - DNA, 62 bp, Homo sapiens
gctggctcactctgtgccagtcacagggaattcaaacctggcttggtcccagtgaagcctgc

SEQ ID NO: 15330 - DNA, 135 bp, Homo sapiens
gcctggacaatgcagcaagatctcatctctttttttttttttttttttttttgagatggagtctcactctgtcacccaggttggagtgcagtggtgcgatcttggctcactgcaagctccacctcccgggttcac

SEQ ID NO: 15331 - DNA, 118 bp, Homo sapiens
ccagctttgttctttttgcttaggattgtcttggctatgtgggctcttttttggttccatatgaaatttaaagtagttttttccaattctgtgaagaaagtcattggtagcttgatgg

SEQ ID NO: 15332 - DNA, 93 bp, Homo sapiens
tcttggatatagaaggggctcaataaatatttgttgaatgaatgaatgaatgaatgaatgaataagtgagcctaggttcaatgactgtcaaga

SEQ ID NO: 15333 - DNA, 84 bp, Homo sapiens
taaattttccttgtcaggcatttgaagcacttacaaaaattaaatgtatttataagtgtagtttcaaatgtttaaggaaattta

SEQ ID NO: 15334 - DNA, 122 bp, Homo sapiens
gtgtatatatatatcagtatatatatatatcagtgtgtatatatatatcagtatatatatacatcagtatatatatatcagtatatatatacatcagtatatatatatatatatatatatat

SEQ ID NO: 15335 - DNA, 95 bp, Homo sapiens; identical to SEQ ID NO: 68

SEQ ID NO: 15336 - DNA, 93 bp, Homo sapiens; identical to SEQ ID NO: 69

SEQ ID NO: 15337 - DNA, 119 bp, Homo sapiens
ggctattgtcttgaaagttaatattagagtgtgaaatctgcaaggcaggccatggagaaaggaagatggatgtaaagttggggagatcaagaacaagctggaagacacaggaatgagct

SEQ ID NO: 15338 - DNA, 80 bp, Homo sapiens
ctctgggaaggatgtttgagtagagagaagattgagtctaggaattcaacttcctccactttactgatggggaaccagag

SEQ ID NO: 15339 - DNA, 116 bp, Homo sapiens
catttggaactggaagatttacctaattcctgtactcccattgcatcttggaagttactaacttgatttttattttacaggctcataggtggaaaggacttgccttgtctcagatg

SEQ ID NO: 15340 - DNA, 80 bp, Homo sapiens
ccgggtctcactctgtcactctggctgcaatgcaggggtgcactcatagctaactgcagccgtgacctcctgggctccgg

SEQ ID NO: 15341 - DNA, 118 bp, Homo sapiens
cccgacacagaagagttggtgcagtggaatgaggctggatggagagaagttcctcttctttctttccttttttttttttttttttgagatggactctcgctctgtcacacagcctggg

SEQ ID NO: 15342 - DNA, 71 bp, Homo sapiens
gcggattcagaggacaggacagaacacttgggcaagtgaatctctgtctgtctgtctgtctgtctgtctgt

SEQ ID NO: 15343 - DNA, 67 bp, Homo sapiens
gcggattcagaggacaggacagaacacttgggcaagtgaatctctgtctgtctgtctgtctgtctgt

SEQ ID NO: 15344 - DNA, 63 bp, Homo sapiens; identical to SEQ ID NO: 5796

SEQ ID NO: 15345 - DNA, 63 bp, Homo sapiens; identical to SEQ ID NO: 5796

SEQ ID NO: 15346 - DNA, 63 bp, Homo sapiens; identical to SEQ ID NO: 5796

SEQ ID NO: 15347 - DNA, 107 bp, Homo sapiens
gcagcacacactaaatagctatgtgcttcttttctttcctttttttttgacaaggtctcactctgtcacccagattggagtgaagtggcaagatcatggcttactgc

SEQ ID NO: 15348 - DNA, 63 bp, Homo sapiens; identical to SEQ ID NO: 5796

SEQ ID NO: 15349 - DNA, 67 bp, Homo sapiens; identical to SEQ ID NO: 15343

SEQ ID NO: 15350 - DNA, 71 bp, Homo sapiens; identical to SEQ ID NO: 15342

SEQ ID NO: 15351 - DNA, 77 bp, Homo sapiens
ggaagcggattcagaggacaggacagaacacttgggcaagtgaatctctgtctgtctgtctgtctgtctgtgtgtct

SEQ ID NO: 15352 - DNA, 63 bp, Homo sapiens; identical to SEQ ID NO: 5796

SEQ ID NO: 15353 - DNA, 67 bp, Homo sapiens; identical to SEQ ID NO: 15343

SEQ ID NO: 15354 - DNA, 63 bp, Homo sapiens; identical to SEQ ID NO: 5796

SEQ ID NO: 15355 - DNA, 67 bp, Homo sapiens; identical to SEQ ID NO: 15343

SEQ ID NO: 15356 - DNA, 71 bp, Homo sapiens; identical to SEQ ID NO: 15342

SEQ ID NO: 15357 - DNA, 67 bp, Homo sapiens
cagaggacaggacagaacacttgggcaagtgaatctctgtctgtctgtctgtctgtctgtctgtctg

SEQ ID NO: 15358 - DNA, 63 bp, Homo sapiens; identical to SEQ ID NO: 5796

SEQ ID NO: 15359 - DNA, 67 bp, Homo sapiens; identical to SEQ ID NO: 15343

SEQ ID NO: 15360 - DNA, 71 bp, Homo sapiens; identical to SEQ ID NO: 15342

SEQ ID NO: 15361 - DNA, 67 bp, Homo sapiens; identical to SEQ ID NO: 15357

SEQ ID NO: 15362 - DNA, 110 bp, Homo sapiens
catcttttgctcagtcaatatagtgaaaggtttgagctttcaaagaatctaaattttttcattctactgctctccaaccttctatttgattgatttatgctctaattatg

SEQ ID NO: 15363 - DNA, 80 bp, Homo sapiens
ccgggtctcactctgtcactctggctgcaatgaaggggtgcactcatagctaactgcagccgtgacctcctgggctccgg

SEQ ID NO: 15364 - DNA, 115 bp, Homo sapiens
gtctcattagagggatctagtagtgcatgtcttggtgagtgggttgatagtggtagacaaatgtttggtgtctggtcagtgccaacctgggctgtgggacttggtcagtggagac

SEQ ID NO: 15365 - DNA, 127 bp, Homo sapiens
tccagctttgttctttttgcttaggattgtcttggctatatgggctcttttttggttccatatgaaatttaaagtagttttttctaattctgtgaagaaagtcagtggtagcttgatggggatagca

SEQ ID NO: 15366 - DNA, 76 bp, Homo sapiens
tgcgaggcactggcatgaggttggaaggaggaagtgaaggcctatttcttctctctgggactctgtgtgtatggca

SEQ ID NO: 15367 - DNA, 98 bp, Homo sapiens
aaggagttaggtctgactttggcagccgctgtgtgcagtgataaaggcgtctcagacggtctcacacagctggggcatccaagggtattatattcttt

SEQ ID NO: 15368 - DNA, 82 bp, Homo sapiens
ttgtgggagaagtcagtagcaagaggaacagggactgagctgcataagatctctccctgactctgtgccacacagccagcag

SEQ ID NO: 15369 - DNA, 90 bp, Homo sapiens
gtggaaagttacagtcgtcttttagacaactatttagacgtctctttagatgactaaatagagtgaaaagtgacagctgtcactttctgc

SEQ ID NO: 15370 - DNA, 64 bp, Homo sapiens
ttctctgcctctctgtctcactcctttccctggaagaaggagtgcctgatctaagtgctgagag

SEQ ID NO: 15371 - DNA, 95 bp, Homo sapiens; identical to SEQ ID NO: 68

SEQ ID NO: 15372 - DNA, 93 bp, Homo sapiens; identical to SEQ ID NO: 69

SEQ ID NO: 15373 - DNA, 100 bp, Homo sapiens
atatatatacatatatacatatatatcatatattcatatatatattcatatatatattcatatgtattcatatatatgtgtgtgtgtatatatatatata

SEQ ID NO: 15374 - DNA, 212 bp, Homo sapiens
tatatatatatatacacacacacatatatatgaatacatatgaatatatatatgaatatatatatgaatatatgatatatatgtatatatgtatatatatgaatatatatgaatgaatatatatgaatatatatatgaatatatatgaatatatatatgaatatatatgaatatatatgaatatatatatgaatgtatatgaatatatatat

SEQ ID NO: 15375 - DNA, 82 bp, Homo sapiens
actcagacactactctaagaaggggaagatattttacttcatgagtgagtgatttttttcttttaagactcaaggtgtgagt

SEQ ID NO: 15376 - DNA, 80 bp, Homo sapiens
ggtgttgagtgaacataggcagcagccagggagtggttacagacccagtgctgtgctgccttcaggtctgacccagtgcc

SEQ ID NO: 15377 - DNA, 84 bp, Homo sapiens
cttcctactgcaagtatctgtgactctctttctgaggaatttctctggctatgggagcttgcatggtctgcttggagtaggctg

SEQ ID NO: 15378 - DNA, 110 bp, Homo sapiens
tgcttaggattttcttggctatatgggctcttttttggttccatatgaaatttaaagtagttttttctaattctctgaagaaagtcaatggtagcttaatggggatagca

SEQ ID NO: 15379 - DNA, 95 bp, Homo sapiens; identical to SEQ ID NO: 68

SEQ ID NO: 15380 - DNA, 93 bp, Homo sapiens; identical to SEQ ID NO: 69

SEQ ID NO: 15381 - DNA, 127 bp, Homo sapiens
ttgttcttttggcttaggattgacttggcgatgcgggctctttttggttccatatgaaatttaaagtagttttttccaattctgtgaagaaagtcattggtagcttgatggggatggcattgaatct

SEQ ID NO: 15382 - DNA, 83 bp, Homo sapiens
gttgcaagcctggctaaaaggcagtggttgaattgagtgatgggagtagtttgaacttgagtgctggtggtgaggattggaat

SEQ ID NO: 15383 - DNA, 95 bp, Homo sapiens; identical to SEQ ID NO: 68

SEQ ID NO: 15384 - DNA, 93 bp, Homo sapiens; identical to SEQ ID NO: 69

SEQ ID NO: 15385 - DNA, 111 bp, Homo sapiens
tcaggactacagagcggccctttgcttccacttctctcctcccactgacaccatctctctctattcctggaagagcactccagcagagggaaaagtatctggaaatactga

SEQ ID NO: 15386 - DNA, 119 bp, Homo sapiens
tctaatgttgtaatagtacaggtatattataggtacatgagtaggaggatgtgatctggaaccaggctgcatagcttcaaaacttagccccctatgtgtttctgaacaagctatttaga

SEQ ID NO: 15387 - DNA, 103 bp, Homo sapiens
gtaagttagttccaagatggccaaataggaacagctccggtctgcagctcccagcatgatctatgcagaagatgggtgatttctgcatttccaactgaggtac

SEQ ID NO: 15388 - DNA, 86 bp, Homo sapiens
acagaacatgtgagggacagtgacaagacaacagagtgtcctggggttttttgtttgtttgtttttgttttttaggttttttttgt

SEQ ID NO: 15389 - DNA, 95 bp, Homo sapiens; identical to SEQ ID NO: 68

SEQ ID NO: 15390 - DNA, 93 bp, Homo sapiens; identical to SEQ ID NO: 69

SEQ ID NO: 15391 - DNA, 116 bp, Homo sapiens
ggaatcaggagtgaaaaggaagattctgattaattatcctaagagaagacagtcatcactttcattagcttctaagggttatttgtggtttttgcctttttgctgggtatgatgac

SEQ ID NO: 15392 - DNA, 104 bp, Homo sapiens
tgatgctgggaagggccaaacctccggagtatggaacagctggggctccttgggcatctctctctgtatttctgttgttttcccacatggtctttttagcatta

SEQ ID NO: 15393 - DNA, 106 bp, Homo sapiens
gagacaccgtgcttggtcttgcaagtttctatgtatatataaaagtagctatggtacatctgtattatggaattatatgcagtaattttttttgagatggagtctc

SEQ ID NO: 15394 - DNA, 96 bp, Homo sapiens
cacaaacctggtggcttaaagcaacatacatttattgttttacagttctggagcccagaagtttaaaatcagttttgctaggccatcatcaaggtg

SEQ ID NO: 15395 - DNA, 88 bp, Homo sapiens
tgtatatatgtgtatatgtgtatatatgtgtgtatgtatatacatgtgtatatatgtgtatatatatgtgtatatatatatatgtata

SEQ ID NO: 15396 - DNA, 116 bp, Homo sapiens
tccagctttgttctttttgcttaggattgacttggctatatgggctcttttttggttccatatgaaatttaaagtagttttttcttattctgtgaagaaagtcaatagtagcttga

SEQ ID NO: 15397 - DNA, 95 bp, Homo sapiens; identical to SEQ ID NO: 68

SEQ ID NO: 15398 - DNA, 93 bp, Homo sapiens; identical to SEQ ID NO: 69

SEQ ID NO: 15399 - DNA, 59 bp, Homo sapiens
agagtggacagaatggggacttgggtggtttccagctgcgactctgtctctgtccctct

SEQ ID NO: 15400 - DNA, 80 bp, Homo sapiens
tcacctcgttaagcctctgtgtctctgtgtgaaatggggcttctgcctgcttcatagattctaaggcttgcataaagtga

SEQ ID NO: 15401 - DNA, 105 bp, Homo sapiens
tggtttaaatgtgaattaagtgttttgttgatcatgtatatatatatatatatgtatatatatatatatggctttagcagatatgaaatagcacatatagtacat

SEQ ID NO: 15402 - DNA, 75 bp, Homo sapiens
tcctctccaccagaatttttactatttcaggaggaggtgaatccctgtgaggtagatttctgattttggagatga

SEQ ID NO: 15403 - DNA, 93 bp, Homo sapiens
gttttaggaatggggtctctctctatctctgtctcaaaatatcttattgtatgtaatatttttggaccacaggtaagtgaaaccatggaaagc

SEQ ID NO: 15404 - DNA, 68 bp, Homo sapiens
ttttttgagtcagagtctcgctctgtcacccaggctggaatagagtggtgccatctcggctcactgaa

SEQ ID NO: 15405 - DNA, 81 bp, Homo sapiens
ggagtctctctctgcctcccaggctggaatgcagtggtgcaatctcggcttactccacctcccgggttcaagtgattctcc

SEQ ID NO: 15406 - DNA, 95 bp, Homo sapiens; identical to SEQ ID NO: 580

SEQ ID NO: 15407 - DNA, 93 bp, Homo sapiens; identical to SEQ ID NO: 69

SEQ ID NO: 15408 - DNA, 61 bp, Homo sapiens
ggcttttggagaagactgtgaggtctgagagagaccttaaagcagaggatccagctaagct

SEQ ID NO: 15409 - DNA, 95 bp, Homo sapiens
ggtgggaggatggcttgagcctggggaggcagaggtttcagtgagccaaatacacacacagacacactgctttagtctcatactttcttgcttcc

SEQ ID NO: 15410 - DNA, 95 bp, Homo sapiens; identical to SEQ ID NO: 68

SEQ ID NO: 15411 - DNA, 93 bp, Homo sapiens; identical to SEQ ID NO: 69

SEQ ID NO: 15412 - DNA, 117 bp, Homo sapiens
agaggaaagttgagttggggctgagggaagaggcaggattcttttttttttaatttatttttattatttattttataatgtttcccctccccttagccccactagaatgtcagctct

SEQ ID NO: 15413 - DNA, 70 bp, Homo sapiens
aacagtggtgaaagtgggcatccttgtctggttccagatattaggggaaagctttatacttttccttgtt

SEQ ID NO: 15414 - DNA, 88 bp, Homo sapiens
tatttttgcttcctgatcagccctcttctctgtctcacttactgtccaactagagatagaaaaggggaccaagtggctcgcacctgta

SEQ ID NO: 15415 - DNA, 105 bp, Homo sapiens
caagcctgtcttagggtcctgcagcactcagtcactctgacactgaccaggagctgcaccttgaagggtggcttgctgcaaatgcaggggtggcttttagagtgc

SEQ ID NO: 15416 - DNA, 111 bp, Homo sapiens
tgcttaggattgtcttggctatacaggctcttttttggttggatatgaaatttgaagtagtttttttctaattctgtgaagaaagtcaatggtagcttgatagggatagca

SEQ ID NO: 15417 - DNA, 117 bp, Homo sapiens
gatgcctcttcctatcctcaaagtgttagaataactcacattctcctctttttgtacagattcccagtggtagaagtgtgtggtgcaaaggcacttaggtggacaggtttggccctc

SEQ ID NO: 15418 - DNA, 111 bp, Homo sapiens
ttacactgaatccagatgcagagtcagtgtgtcattttcttctttgtactgaaaatctttttattttaaaggtgaagcaacacatagtcttttatccataacttagtgtag

SEQ ID NO: 15419 - DNA, 112 bp, Homo sapiens
catgggttcccctccagtgatggttctcaatggagtgtagagatactaagcattggtgctcactccctttctctctgtttagaaatttataggggcaacttgggatgctgtg

SEQ ID NO: 15420 - DNA, 73 bp, Homo sapiens
agttctggaggcgagaagtctgagttcaaggtgtcagcagcgttgatttcttctgaggcctctatccttggct

SEQ ID NO: 15421 - DNA, 71 bp, Homo sapiens
ctcaccctgtcagtgtctctccccatccctcagtgtcctaagtccagggggacatactgtcagcccctgag

SEQ ID NO: 15422 - DNA, 66 bp, Homo sapiens
cagtgcctctctctgagcctcagtttgctcttctgtaaaatggaggcattggtcttgagggtgctg

SEQ ID NO: 15423 - DNA, 58 bp, Homo sapiens
tgagacaaggtctcactctgtcacccaggctggagtgcagcagtgcaatcttggctca

SEQ ID NO: 15424 - DNA, 80 bp, Homo sapiens
agggtgcgcttcagttttcaaaggttgtctgacacagtatactggccatgggggtgatctacagaagactggagaattct

SEQ ID NO: 15425 - DNA, 76 bp, Homo sapiens
agtgggggaaaatattggttcttgtgtcagaagaggaaatacttttttttttttgagacagagttttgctcttgtt

SEQ ID NO: 15426 - DNA, 63 bp, Homo sapiens
tttgatcactatatatgtgtgtgtatatatatatatatatatatatggaatgtggtggtggga

SEQ ID NO: 15427 - DNA, 77 bp, Homo sapiens
ctggactcaggcagtcatcccacctcatcctcccaaaatgctgggattacaggtgtgagccactgtgtctgtctcag

SEQ ID NO: 15428 - DNA, 58 bp, Homo sapiens; identical to SEQ ID NO: 315

SEQ ID NO: 15429 - DNA, 103 bp, Homo sapiens
tatgttgattttgtaacctgtaactttactgaatttgtttattagttctaatagttttttggtggagtctttaggtttttttttaaatataagatcatatcat

SEQ ID NO: 15430 - DNA, 121 bp, Homo sapiens
caaagtgctaggattacaggcgtgagctgctgcaaccagccagcatctgttattttttgtctttttaatagtaaccactctactggtataaggtggtatctcattgtggttttgatttgca

SEQ ID NO: 15431 - DNA, 85 bp, Homo sapiens
tatatatatatatatatacacacacatatatatacacacacacacatatatatacatatatgtgtgtatatatatatatctgata

SEQ ID NO: 15432 - DNA, 72 bp, Homo sapiens
atatatatatatacacacatatatgtatatatatgtgtgtgtgtgtatatatatgtgtgtgtatatatatat

SEQ ID NO: 15433 - DNA, 87 bp, Homo sapiens
tggaaaacagtgtggagactcttttttttttttttttttttttttttttttttttttttttgagacagagtctcactctgtcaccca

SEQ ID NO: 15434 - DNA, 102 bp, Homo sapiens
gggtatacagttgttccctgaactgaaatgagaatacaagcagaagcaaagtgtgctctctgctgtgtctgtttcacctcagtctgaggattctgaagatcc

SEQ ID NO: 15435 - DNA, 91 bp, Homo sapiens
ggctcatgttcatgtaaattatttttgtaaagacacgtactgttataaaaacagaggtgtttttcgtgcttcccctttgcagttaatggcc

SEQ ID NO: 15436 - DNA, 80 bp, Homo sapiens
gtgcagtgtagagtatcttgtccttttccttttttttttttttttttttttgaggcagggtctcactctgtcactgaggc

SEQ ID NO: 15437 - DNA, 86 bp, Homo sapiens
ggttcaaagccatttaaagtgattttcatgttttcagattagtatagtacaagcatttttaaattgcttgaagtggcattttttcc

SEQ ID NO: 15438 - DNA, 58 bp, Homo sapiens
tgagatggagtctcactctgtcacccaggctggagtgcagtgatgcaatctccactca

SEQ ID NO: 15439 - DNA, 76 bp, Homo sapiens
ttggtcacttctgggtctgtgagaggacagcggaccagcgtgtcgttgtcttctttcccatacaaggagcggtcaa

SEQ ID NO: 15440 - DNA, 73 bp, Homo sapiens
tgccattgggggtcttgaggctctgctgtaaaagcttaatgcattttgcatcactgtgtcacactcactggca

SEQ ID NO: 15441 - DNA, 95 bp, Homo sapiens; identical to SEQ ID NO: 68

SEQ ID NO: 15442 - DNA, 93 bp, Homo sapiens; identical to SEQ ID NO: 69

SEQ ID NO: 15443 - DNA, 58 bp, Homo sapiens; identical to SEQ ID NO: 637

SEQ ID NO: 15444 - DNA, 58 bp, Homo sapiens
tgagacagggtttcactctgtcactcaggctggagtacagtaatgcgatcttgactca

SEQ ID NO: 15445 - DNA, 95 bp, Homo sapiens; identical to SEQ ID NO: 580

SEQ ID NO: 15446 - DNA, 93 bp, Homo sapiens; identical to SEQ ID NO: 69

SEQ ID NO: 15447 - DNA, 111 bp, Homo sapiens
ctatggatattagggctatgttttggtttcatatgcattttagaattgtctttttctaattctgtgaggggtgatactagcattttggtagggattgcattgaatctgtag

SEQ ID NO: 15448 - DNA, 90 bp, Homo sapiens
caagtactttccctgtatgtctcaggctgattttttttttttaaactctcttactgtcagtaagagagacatgtctggactagatgcttg

SEQ ID NO: 15449 - DNA, 95 bp, Homo sapiens; identical to SEQ ID NO: 68

SEQ ID NO: 15450 - DNA, 93 bp, Homo sapiens; identical to SEQ ID NO: 69

SEQ ID NO: 15451 - DNA, 108 bp, Homo sapiens
tggtaggtcctttgggggtgccaagccttctctctgtcactgaatcccacctccaggtgctcaggtccaggtgtggggatagcaggctgatctacccttctgcctcca

SEQ ID NO: 15452 - DNA, 94 bp, Homo sapiens
gaagtaggggcaaggccccagccctcagaccccctgagacttctctggctggtggtgcgcatctcctcttccagaagtttcaacgcagtggggg

SEQ ID NO: 15453 - DNA, 98 bp, Homo sapiens
ctctatgaatgcatttactcttttgcttgtatgtaatatcaatatttaattgtaattataatctatatactgggtgtgtggggtaagacaacataggg

SEQ ID NO: 15454 - DNA, 64 bp, Homo sapiens
cagtgagccagggtctcactctgtcacccaggctggagtgcagtggcatgatcttggctcactg

SEQ ID NO: 15455 - DNA, 76 bp, Homo sapiens
cctttctgtctgtctgtgtgtaatctctggcttataaggaagcatgggattgcatttagggcttggataatccagg

SEQ ID NO: 15456 - DNA, 116 bp, Homo sapiens
tgggtaacagagcaagactccatctcaaaaattaaataaataaataaataaataaataaataaataaataaaactattcaatttttttttttgagacagtctagctctgtcaccca

SEQ ID NO: 15457 - DNA, 58 bp, Homo sapiens
tgagacaaaatctcactctgtcactcaggctggagtgcagtggtgtgatcttggctca

SEQ ID NO: 15458 - DNA, 120 bp, Homo sapiens
gaaagagtgaggaattctcactagtatttttttttttttttttgagagagtctcactctgtcgcccaggctggagtgcagtggtgtgatcttggctcactgcaacctccaccgcccgggt

SEQ ID NO: 15459 - DNA, 79 bp, Homo sapiens
gatcaaaatagttactgatatgtgacacttacttaagacttccttttcttgtatgaagtggttgtcatatgtattggtc

SEQ ID NO: 15460 - DNA, 95 bp, Homo sapiens
ctgtcaccttcccattttcttctggacattttaaaaaatatttttaattttagaaccatttttagatgtacagaaaaatggacaaggtagtacag

SEQ ID NO: 15461 - DNA, 100 bp, Homo sapiens
tatatatatatatatatatgtatatatgtgtatatatatacgtatatatgtatatatgtgtatatatatacgtatatatgtatatatgtgtatatatata

SEQ ID NO: 15462 - DNA, 95 bp, Homo sapiens; identical to SEQ ID NO: 580

SEQ ID NO: 15463 - DNA, 93 bp, Homo sapiens; identical to SEQ ID NO: 69

SEQ ID NO: 15464 - DNA, 64 bp, Homo sapiens
tgactgtatatgtgtatatatgtatgtgtgtatatatgtatgtatgtatatatgtattcattca

SEQ ID NO: 15465 - DNA, 90 bp, Homo sapiens
gaaccagataagtagcttttttttttttttttgagacggagtcttgctctgtcacccaggctggagagtgcagttgcacgatctctgttc

SEQ ID NO: 15466 - DNA, 116 bp, Homo sapiens
ttcttgcaggagtaaggtggtatcacactgtggttttaattggtgtttccctgatcattagtgatattgatcattttttcatgtttgttggccatttgtatatcttcttttgagaa

SEQ ID NO: 15467 - DNA, 130 bp, Homo sapiens
ggataggtttttattcactggagagggcagtgaaagacttggcataggatatatgagatttttttttttagcacatcatcattttcactccctgctttgatcaaaagttgtttttacctcttgccctctt

SEQ ID NO: 15468 - DNA, 95 bp, Homo sapiens; identical to SEQ ID NO: 68

SEQ ID NO: 15469 - DNA, 93 bp, Homo sapiens; identical to SEQ ID NO: 69

SEQ ID NO: 15470 - DNA, 103 bp, Homo sapiens
tgcttgggtatcatctgggggctttttaggaaatgcagcctctctggctcacttcagatctactgaatcagaatctgcatcttagcaagatgatgcttatgca

SEQ ID NO: 15471 - DNA, 76 bp, Homo sapiens
tcttgaaagctaaaagtgctgctaggtctcaaagttctttatttttttgagacagggtctcactttgttgccaagg

SEQ ID NO: 15472 - DNA, 66 bp, Homo sapiens
ggcatggtgatccacatctataatctcagctatatgggaggctgaggtaggaggatcacttgagcc

SEQ ID NO: 15473 - DNA, 81 bp, Homo sapiens
gaaaaataagtgactgaattgatcatttttattgtatagaggaatctcccacaaaatgattgatcagtttaattaagtttc

SEQ ID NO: 15474 - DNA, 116 bp, Homo sapiens
gaagtgaatttctctttttactctacctctgtataattttttttttctttttttggagacagggtcttgctctgtcacccagactggagtgcagtggtgtgatcacagctcactac

SEQ ID NO: 15475 - DNA, 76 bp, Homo sapiens
ggagttactgtttaatgggttcagaatttctagttgagatgatgaaaaagttctgaaaatggacagtggtgatgcc

SEQ ID NO: 15476 - DNA, 95 bp, Homo sapiens; identical to SEQ ID NO: 68

SEQ ID NO: 15477 - DNA, 93 bp, Homo sapiens; identical to SEQ ID NO: 69

SEQ ID NO: 15478 - DNA, 77 bp, Homo sapiens
gtcaacagtaggttatcagtatttaagtttgggggcattaaaatgcatacacagatttgactgtgcagagggttggc

SEQ ID NO: 15479 - DNA, 97 bp, Homo sapiens
tgtgtagtcagggttgagaactgaggctactcatgagctgagggcttggaagagtcacacagaacaatcagtgcttacgccttgcgaaaattacaga

SEQ ID NO: 15480 - DNA, 90 bp, Homo sapiens
gggtggtcaaggtgggtgggtcacttgaggtcaggaaattataattcttttttttttttttttttgagacagcgtctcactctgtcaccc

SEQ ID NO: 15481 - DNA, 124 bp, Homo sapiens
gggtttatttctgggttctctatctgttccattggactatgtgcctatttttatagcagtactatgctgtttggtgactatggccttttagtagtttgaaatcagataatgtgatacctccaga

SEQ ID NO: 15482 - DNA, 61 bp, Homo sapiens
tatatatagtgtgtatgcatatatatatatatagtgtgtgtgtgtatatatatagtatata

SEQ ID NO: 15483 - DNA, 116 bp, Homo sapiens
agagcgttcctgccacctgagtcattctgtcctgtgctgctctgtcaccctgtgagtgtgaagcccctgctccggccctccaggaggaaggaggcagagtgaagccaggcatctct

SEQ ID NO: 15484 - DNA, 111 bp, Homo sapiens
gaattgtcctggcctgcttaggagctgttttctgtcttggatgaattggtgcttttctaagaagaaagagagctgtgatggactgcagcagaagtaaaccctggggcatgc

SEQ ID NO: 15485 - DNA, 73 bp, Homo sapiens
tttcagtctagacatcagtgtggatttattctttttttttgagacgagtctcgctctgtcgcccaggctggaa

SEQ ID NO: 15486 - DNA, 95 bp, Homo sapiens
ggccaggtatggtggctcattcctgtaattccagtactttgggaggctgaggtaggaggatgacttgaggccatgagttcaagacctgcctgggc

SEQ ID NO: 15487 - DNA, 117 bp, Homo sapiens
catagaatataaaaatttgagtacatagtacataatcagggtaagtattgtttttataaaatttgtacttttattttgtgtgtgtgagtgtgtgcatagtagttgctgtgtgaaatg

SEQ ID NO: 15488 - DNA, 98 bp, Homo sapiens
cctaaaattaatatatataaaacatatatatatatgtaaaattatgtgtgcgtggtgtgtgtatgtatatatgtataaacttatataactgtttcagg

SEQ ID NO: 15489 - DNA, 101 bp, Homo sapiens
cagactggagactgtctgaactttttattataataagtataattattttatttatttatttggctaaaaaaattttttttgagacagtctcttgctctgtc

SEQ ID NO: 15490 - DNA, 92 bp, Homo sapiens
tccagcctgggcaacatagtgagacccccgtctctacaaaattttttgttttttgttttgagatgaagtctcactctgtcacccaggctgga

SEQ ID NO: 15491 - DNA, 67 bp, Homo sapiens
ttcccagtctgtctgcatcttgttattggactcgagaacaagcagccagacctcatttgtctgggaa

SEQ ID NO: 15492 - DNA, 81 bp, Homo sapiens
tctggaggcagggtcagtgtgtagagtgtgaagtcaataaaggtggatggagtactgtggagacagattctttcctgtgga

SEQ ID NO: 15493 - DNA, 74 bp, Homo sapiens
gtttgtcaggcacatgagcaagtggtcaggacctgttctgggctccagaatcctcactgctcttcctgacttac

SEQ ID NO: 15494 - DNA, 105 bp, Homo sapiens
cccaatccagtgttctttccattaacccacattgtcctcctctctgctcattgtctgtgcttggactggaagaggcaaagatgggttagccactacagaatggga

SEQ ID NO: 15495 - DNA, 89 bp, Homo sapiens
aagatgatgggacccagagggtcaggtggctccctgtccatcagcggggtgatcctaagccagtcactgtctctcagtttcagtttctt

SEQ ID NO: 15496 - DNA, 82 bp, Homo sapiens
ctgaagacagtgatgaagagacttgaatgctcatttctggttatgctatgaatgacctctgtcactctgagtcatttctgag

SEQ ID NO: 15497 - DNA, 95 bp, Homo sapiens; identical to SEQ ID NO: 68

SEQ ID NO: 15498 - DNA, 93 bp, Homo sapiens; identical to SEQ ID NO: 69

SEQ ID NO: 15499 - DNA, 100 bp, Homo sapiens
actctgctttactttccatcttagcactcattatcacctaaaatattgcatacttatttgtttatatgaaatgataatgagtgtcataagggcaaggagt

SEQ ID NO: 15500 - DNA, 78 bp, Homo sapiens
gcatgtctgtctcattgctctctctgtctctgactttcatgagccattcagaggaagcagaagcagaggcaaggctgc

SEQ ID NO: 15501 - DNA, 119 bp, Homo sapiens
gacctgtataaatttgtgctatcatttgctcatgctgaaaaatgatagatagtaatttttttaatttaactttattttattttaagttccagggtacatgtgcaggatgtgcaggtttg

SEQ ID NO: 15502 - DNA, 96 bp, Homo sapiens
cactcagatctgccttgaaaagaagtttgggttttatcttttttatttttatttttatatgagatggagtcttgctctgttgcccaggttggagtg

SEQ ID NO: 15503 - DNA, 77 bp, Homo sapiens
tttgagtcatatgggttccacttttgaggatggcttgataccattctcacagtagtgagtgagttcttgctctcaag

SEQ ID NO: 15504 - DNA, 66 bp, Homo sapiens
ggacttttaaactgagcccactcattatctgcgagagaagagagagttggcagagtggggaagtac

SEQ ID NO: 15505 - DNA, 95 bp, Homo sapiens; identical to SEQ ID NO: 68

SEQ ID NO: 15506 - DNA, 93 bp, Homo sapiens; identical to SEQ ID NO: 69

SEQ ID NO: 15507 - DNA, 84 bp, Homo sapiens
tctctctctctatatatatataagtatacatatcatatatatatatcttttatatatatatagatagatagatatagatataga

SEQ ID NO: 15508 - DNA, 110 bp, Homo sapiens
caggtaaccagctcaggcaataatttttaaatcaaacttcatgatctaggaagtaaactgatcatacagaggtcagaatgacatttatgggcttgagagatttctatctg

SEQ ID NO: 15509 - DNA, 95 bp, Homo sapiens; identical to SEQ ID NO: 68

SEQ ID NO: 15510 - DNA, 93 bp, Homo sapiens; identical to SEQ ID NO: 69

SEQ ID NO: 15511 - DNA, 95 bp, Homo sapiens; identical to SEQ ID NO: 68

SEQ ID NO: 15512 - DNA, 93 bp, Homo sapiens; identical to SEQ ID NO: 69

SEQ ID NO: 15513 - DNA, 95 bp, Homo sapiens; identical to SEQ ID NO: 68

SEQ ID NO: 15514 - DNA, 93 bp, Homo sapiens; identical to SEQ ID NO: 69

SEQ ID NO: 15515 - DNA, 94 bp, Homo sapiens
cagtaaaatcctgcattgctctttagacatttaaagtcagaatttcatttaatatttttgaagttagaattgcactgtggtaatgaggggactg

SEQ ID NO: 15516 - DNA, 80 bp, Homo sapiens
tgttctatgggcatgcatgcatgtgcatctgcatgtgtgcagttatgtgaggtgcatgtatgtgtgtgtgctgttgagca

SEQ ID NO: 15517 - DNA, 80 bp, Homo sapiens
cagtttccatgtagttgtgcagttttgaatgtttcttaatattgggttctaatttgattgcattgttgtctgagagactg

SEQ ID NO: 15518 - DNA, 126 bp, Homo sapiens
gtgtgtgtgtatatatgtgtatatatatgcacgtgtgtgtatatatgtgtatatatgtatatacatgtttatacatatacatatgtgtgtatatatacatatgtgtgtatatatatacgtttatgc

SEQ ID NO: 15519 - DNA, 87 bp, Homo sapiens
ttttccatctggaggtcttaagtgattttcatgaaattattttagcatctttttcttgaaaatcattaatggaaggatggtggaaga

SEQ ID NO: 15520 - DNA, 95 bp, Homo sapiens; identical to SEQ ID NO: 68

SEQ ID NO: 15521 - DNA, 93 bp, Homo sapiens; identical to SEQ ID NO: 69

SEQ ID NO: 15522 - DNA, 66 bp, Homo sapiens
gtcatatatacacaacacatggcataaatatatatctgtgtgtgtgtgtctatgtgtgtgtttgac

SEQ ID NO: 15523 - DNA, 90 bp, Homo sapiens
ggtaagttctattatgccagggactttgcattgtttatgattatatacttaatacccaaaagagttcctggctaaacgtaggtgtttact

SEQ ID NO: 15524 - DNA, 76 bp, Homo sapiens
agcattcccctgtgtgcgcatggccaccaggaggcttccggtgtaatggtgacctctgtgtcactcaggcagtgtt

SEQ ID NO: 15525 - DNA, 95 bp, Homo sapiens; identical to SEQ ID NO: 68

SEQ ID NO: 15526 - DNA, 93 bp, Homo sapiens; identical to SEQ ID NO: 69

SEQ ID NO: 15527 - DNA, 110 bp, Homo sapiens
ctccaaaggtattttacatattgtgtgtgtacacatttgtatatgcatgtgcatatgtgtgtgcatgtgcatgtgaactccgcaagctggatttacttccctcattggcg

SEQ ID NO: 15528 - DNA, 60 bp, Homo sapiens
ctctgccactctctgtgggtcaaggtaagtcacagcccagcctggattcaagggacagag

SEQ ID NO: 15529 - DNA, 112 bp, Homo sapiens
agaaaatttttaaaaggtgattaattttaaaaccatctcatgttctaacatttatatatttttatttgtgacatttgctagaatatattggttagatttttaccttgtttct

SEQ ID NO: 15530 - DNA, 95 bp, Homo sapiens; identical to SEQ ID NO: 68

SEQ ID NO: 15531 - DNA, 93 bp, Homo sapiens; identical to SEQ ID NO: 69

SEQ ID NO: 15532 - DNA, 82 bp, Homo sapiens
acataatatacatttatgtatgtgtatgtatgtttatatgtataacatagtatatggtgtgtgtgtgtgtgtgtgtgtgtgt

SEQ ID NO: 15533 - DNA, 101 bp, Homo sapiens
atactgagtgagcacaaatatcttgtttgcttattacatttctttttttaaaaataaatgtgacatttatgttttaagtaaatgtgtttcttattgagtgt

SEQ ID NO: 15534 - DNA, 122 bp, Homo sapiens
gtgggcaccctggcagccatcctttgagttgaggacaccttctttttactttctttctttcttttctttttttttttttttttttgagatggagtctctctctgttgcccaggctacagtgc

SEQ ID NO: 15535 - DNA, 96 bp, Homo sapiens
tctgctgctactgttttggtattttgataaatgctaggactaaaaattagtgtcttagtatatattttattacaaggaaagggttaatgagtatga

SEQ ID NO: 15536 - DNA, 110 bp, Homo sapiens
tagaacatttatttgttacactgttttgctcatgtgactagaattgtgattttctatatgtgaattatttttactaaaacatgaaattagaatgtgttgctcagagtctg

SEQ ID NO: 15537 - DNA, 99 bp, Homo sapiens
ctgggtttgaactgcatatgtctacatatatatgaatatttttcagtaaatgcattggaaaatatttgaagatttatgacaatttgaaaacaatcccag

SEQ ID NO: 15538 - DNA, 95 bp, Homo sapiens; identical to SEQ ID NO: 68

SEQ ID NO: 15539 - DNA, 93 bp, Homo sapiens; identical to SEQ ID NO: 69

SEQ ID NO: 15540 - DNA, 77 bp, Homo sapiens
agtacagacatttttgagggatacattagctgacattcataagtttaaaaatgtatcacttctgaattgcatgtact

SEQ ID NO: 15541 - DNA, 111 bp, Homo sapiens
cagtgacacaattgacaagttaagatttttgtacttgtttgatagatgcattgtttatggttaatgtatatatttaattatagtaattggtgaatttgaggtgttatgctg

SEQ ID NO: 15542 - DNA, 82 bp, Homo sapiens
gttatataggaaaactttgtgcaggtttgttatataggtaaacttgtgtgatgagattttgttgtacagattatttcatgac

SEQ ID NO: 15543 - DNA, 104 bp, Homo sapiens
agtcagatgttccacactgaattccagagttcctcagcaagataaaggatttttttttttttttcattcatggtggcaacttgctggacagtgaacattttatt

SEQ ID NO: 15544 - DNA, 95 bp, Homo sapiens; identical to SEQ ID NO: 68

SEQ ID NO: 15545 - DNA, 93 bp, Homo sapiens; identical to SEQ ID NO: 69

SEQ ID NO: 15546 - DNA, 108 bp, Homo sapiens
ctggctcataggcagaaaggacttgccttgtttcagatgagacatcagactgtggacttttgagttaaggctgaaatgagttaagactttggggtactgttgggaagg

SEQ ID NO: 15547 - DNA, 104 bp, Homo sapiens
ggaagtttctaaacgatgtgtgtattgctgaaaataaaactactttggtaatgaaaagtctttttgttatactccagtaattacatagtttaagtgacacttcc

SEQ ID NO: 15548 - DNA, 95 bp, Homo sapiens; identical to SEQ ID NO: 68

SEQ ID NO: 15549 - DNA, 93 bp, Homo sapiens; identical to SEQ ID NO: 69

SEQ ID NO: 15550 - DNA, 107 bp, Homo sapiens
gttgtttgataaaatatactcacttttatgcttctattaaaatattgttcacaaattgtcattatttttggtagaacacaaattatgtgaggttttgttataacaac

SEQ ID NO: 15551 - DNA, 96 bp, Homo sapiens
tgggctcttttatggttccatatgaattttataatagatttttctagttctgagaagaatgtcagtagtagtttaatgggaatagcattgagccta

SEQ ID NO: 15552 - DNA, 69 bp, Homo sapiens
aatgtcgaggctctgctggagcagccgtcagtgagcacactgggctctcacctggctgctgttgatatt

SEQ ID NO: 15553 - DNA, 109 bp, Homo sapiens
atatatatatgaggacatatatatatgaggatatatatgtgtatatatatatatgtacacacacacacatacacacacatacatatatgtatatgtgtgtatatatata

SEQ ID NO: 15554 - DNA, 114 bp, Homo sapiens
tgacaaaactagagcacattggtattggtattattattttggtaaatttattttattttattattattatagtttaagttttagggtacatgtgcacaatgtgcaggtttgtta

SEQ ID NO: 15555 - DNA, 74 bp, Homo sapiens
cgccagggctttgtgtgtctatttgtctctgtatgtcagagacatgtggcaagagagacagggttcagatgggg

SEQ ID NO: 15556 - DNA, 169 bp, Homo sapiens
atatatgtatatgtatatatatatgtatatatacacatgggatatgtatatatatatatgtgtgtatatatacacacgggatatgtgtatatatatgtatatatatacacacacacacataggatatgtgtatatatatgggatatgtgtgtgtgtatgtgtgtgtgtg

SEQ ID NO: 15557 - DNA, 116 bp, Homo sapiens
atcctcataagaatcatggcttgtttactgagtcagttttagaaagtaaagtagtaacccccttatccatgggggttatgtttgaagttacacagcagatgcctgaagctgtggat

SEQ ID NO: 15558 - DNA, 96 bp, Homo sapiens
gggtctaagaaaggctatgctgaactcttgtacataaattttaaatgataataatattttgtatattgtttgagacaaagctttctttaaagattc

SEQ ID NO: 15559 - DNA, 111 bp, Homo sapiens
gcaattaccacacacaaatttctgagctggcattttattctgaattttgtctttgtttttgattacattgactagagggttgccaaattagcaattcatgctgtactttgt

SEQ ID NO: 15560 - DNA, 102 bp, Homo sapiens
gtataattttatatatgcatataatatgtgtaacattaacatcttacatttgatggttgtgatatattttttatattgtataagtattgtataatactatac

SEQ ID NO: 15561 - DNA, 97 bp, Homo sapiens
cctttattgtattctttttttttttttttttttttttgtgagacagagtctcgctctgtcacccaggctggagtgcagtggtgggatctcggctcac

SEQ ID NO: 15562 - DNA, 99 bp, Homo sapiens
cctggggtttttcaagtgctccaagtactaattctgtacattgggtcttgaaagttgcaatgaaaagaacaatggactgtagagcatgataaaaccagg

SEQ ID NO: 15563 - DNA, 117 bp, Homo sapiens
gcagatgctggctccatgcttgtacagcctgcagaaacatgagctaattttgtttataaattaccaagtctcagatgtttctttacagcaatgcaagaatggcctaactcttactgt

SEQ ID NO: 15564 - DNA, 86 bp, Homo sapiens
gctatataataaaatgatgataggttggggataggttggaccaatatttctaatttctgttagttattttatttgatgtatatagc

SEQ ID NO: 15565 - DNA, 59 bp, Homo sapiens
tgggggctggacccaggctgcagcatgtgacaaggctgccagtctctgtccatctctca

SEQ ID NO: 15566 - DNA, 99 bp, Homo sapiens
gcttatacaatagtaagaggatgataattatgaaagataggtttctttttttttttttgaaacagtctctctctgtcacccagactagagtgcagtggc

SEQ ID NO: 15567 - DNA, 103 bp, Homo sapiens
attacctgattgaatatttctttctgtatatgcttaacttcaggcattctcaacatctgcttgtagattgaaatgtacagatgtagacattgaattaattaat

SEQ ID NO: 15568 - DNA, 111 bp, Homo sapiens
ctatttgacattgtactagccattttcatctttttcttaattattattgttttctacaacaggtgctggagaggatgtggagaaataggaacacttttacattgttggtgg

SEQ ID NO: 15569 - DNA, 66 bp, Homo sapiens
tctacatctatgcgtgtgtgtgtgtgtgtgtatatatatatatatatatataaatgtgtagacaga

SEQ ID NO: 15570 - DNA, 109 bp, Homo sapiens
gagtctgattttcttatgtcatatatatatatatatacccttaatcaaaatttaagttttttatatatttaccaatatcggatattttacccagagagaacaaagactc

SEQ ID NO: 15571 - DNA, 113 bp, Homo sapiens
ttgaattctctcagtgggggttgatatttcaaaggactgatatctatttttatttttatttttggcaagaggagggagttatatgaagaatcatttgttatatggagagtcaa

SEQ ID NO: 15572 - DNA, 101 bp, Homo sapiens
ttcttgggactcagatacatctgaaagtgtcagacagacagactggccaggcagggcttccagcaaactattgtatgagaattagagatggcttctaggaa

SEQ ID NO: 15573 - DNA, 96 bp, Homo sapiens
atgttgctacattttactgagtagagggatgaggcaaatacaggttatgtcctttctgtgggagcaggcttcatttcagactacagttggctgcat

SEQ ID NO: 15574 - DNA, 85 bp, Homo sapiens
caaacagccaagcagaggaaaagttcgagatggggcagttccaagatggtggtgcccccctccctgaatccctgagaggcccttg

SEQ ID NO: 15575 - DNA, 93 bp, Homo sapiens
gctgcatcctgtgtgatacttaacctgtctgtgtctcagtctcctcatttataaaatggagataagagtattttgttaatatataggtgttgt

SEQ ID NO: 15576 - DNA, 103 bp, Homo sapiens
gattggtatccttataaaagggacttcagagagctcacttactctctttctgccatgaatagacatgaaaagctggcactctgcagtccaaaagagggccgtc

SEQ ID NO: 15577 - DNA, 75 bp, Homo sapiens
gctctcttcactttctgtcatcagaagagctcatcacagacccaagcatgttctggtggaggaggttaatagagc

SEQ ID NO: 15578 - DNA, 101 bp, Homo sapiens
gtgctgtgcgtccacctccttacctgcctgcctgcctgcctgcgtgttctgtgccacgcgtctgcctccctgcctgcctgcccgtgtgttctgtgctgtgc

SEQ ID NO: 15579 - DNA, 93 bp, Homo sapiens
ttgtttattccctcttgtctgtggggccttgaggtcattttgagaatacagctgaatgacagacaagtgtcagcagacaagtgacagttacaa

SEQ ID NO: 15580 - DNA, 96 bp, Homo sapiens
tcattgtagggatctttcaccttcctaattagctgtatttctagatattttattctttttgtggctattgtgaatgggattgcattcttgatttgg

SEQ ID NO: 15581 - DNA, 69 bp, Homo sapiens
ccaggttcctcaggtctgagactttttatgttttattttttgagacagggtctctgtcacccaggctgg

SEQ ID NO: 15582 - DNA, 95 bp, Homo sapiens; identical to SEQ ID NO: 68

SEQ ID NO: 15583 - DNA, 93 bp, Homo sapiens; identical to SEQ ID NO: 69

SEQ ID NO: 15584 - DNA, 86 bp, Homo sapiens
tgagaccgagtctcactctgtcaccaggctagagtgcagtggcatgatctcggctcactgcaacctctgcctccctggttcaagtg

SEQ ID NO: 15585 - DNA, 121 bp, Homo sapiens
tctataaagtatttctatgctcagatgtacagggaaagtattgacagtagaaagagagaagagccttttcctgtaccaaatgctggtcaagtcctttttctatttgaactttagtagaaat

SEQ ID NO: 15586 - DNA, 72 bp, Homo sapiens
gactcggtgcccatgacagccaggcctgttgcctcaacctcccaagagcctggctcggtgtctgccagaatc

SEQ ID NO: 15587 - DNA, 58 bp, Homo sapiens; identical to SEQ ID NO: 3368

SEQ ID NO: 15588 - DNA, 95 bp, Homo sapiens; identical to SEQ ID NO: 68

SEQ ID NO: 15589 - DNA, 93 bp, Homo sapiens; identical to SEQ ID NO: 69

SEQ ID NO: 15590 - DNA, 169 bp, Homo sapiens
gcaacagcgttctgtgtgtgtgtatatatatatacacaaaggatatatatatacaaagaatatgtgtatatatatgtgtgtatatatatatacacaaagaacgtgtgtgtgtgtgtatatatatatatatatatatacatacatacacaaaggatatatatgtacatgt

SEQ ID NO: 15591 - DNA, 72 bp, Homo sapiens
gatacacacacacacacacacatacatatgtgtgtatgtatatatgtgtatatatgtgtgtgtctgtgtgtc

SEQ ID NO: 15592 - DNA, 87 bp, Homo sapiens
gaaacatcatgttcagcctggtattgaaaagcaaaggacagtatattattttctctttgttttttaaggttgaggccatttgctttc

SEQ ID NO: 15593 - DNA, 117 bp, Homo sapiens
gcattcttcactccggcactacgtcttccaagccaacgaagccaaaggtcatagaatatgaaacatagtttttgttaagggatcataagacgtaaaagtgacacgtgaaattctggc

SEQ ID NO: 15594 - DNA, 76 bp, Homo sapiens
ttgcagagtccctcaatgtctcagtggctcccccatcccttgaggagctcctagccaagcaaaggagacactgtaa

SEQ ID NO: 15595 - DNA, 91 bp, Homo sapiens
catttggatagactatgtcagaggaaagatctgtggctcaatggcttctgttcagatttttttgtcccatggggtgctcccttgatgtggt

SEQ ID NO: 15596 - DNA, 110 bp, Homo sapiens
tcagctgtgaatcagtctggtcccggacttcattttgttggcaactttttaattatcattttaatctcactgcttgttatgggtctgttacagtttggatttcttgctgg

SEQ ID NO: 15597 - DNA, 89 bp, Homo sapiens
gaaaatcaggttcgatcacctgctctttaacgctgtcttgttgacagtagacagtcagtaaaaagggcatgaatgactaaatgtttttc

SEQ ID NO: 15598 - DNA, 116 bp, Homo sapiens
ggagtgttaaatggtcaactttatatgggcggatgtacagtagattatatacaaatactatgttattttatataaggaatttgagcatccatgaagttttatatctgtgggggtcc

SEQ ID NO: 15599 - DNA, 95 bp, Homo sapiens; identical to SEQ ID NO: 5211

SEQ ID NO: 15600 - DNA, 115 bp, Homo sapiens
tatgttgaagagagtaatcatagcatcgacatgtaattatatatagatttttacattaatacttgcaatacctgtgtgtgaatacagtgactatacatagatttttttcagcatg

SEQ ID NO: 15601 - DNA, 97 bp, Homo sapiens
gagaaagaaaggaagagagaagggacaaaagaaataccagtgtgaaaaatatatatttatcagaaaattcttttcagtctcccttccttgttaactc

SEQ ID NO: 15602 - DNA, 79 bp, Homo sapiens
ggctatgtttaatggctggctctcagaatgcctgaggattcaacaaccagctctgagaagctcaccatgagatgaagcc

SEQ ID NO: 15603 - DNA, 91 bp, Homo sapiens
tgtatgtatattgcatatacatatatataatttaaagacatagtggagactaggtagaaaaagaggtatatgtatatgtgtatgtatatca

SEQ ID NO: 15604 - DNA, 79 bp, Homo sapiens
ttgactgcctcaatagttagaatatatctggatatatatatatatgattctgatatggtctgactgtgtcctcattcaa

SEQ ID NO: 15605 - DNA, 95 bp, Homo sapiens; identical to SEQ ID NO: 68

SEQ ID NO: 15606 - DNA, 93 bp, Homo sapiens; identical to SEQ ID NO: 69

SEQ ID NO: 15607 - DNA, 100 bp, Homo sapiens
gtcagtgtacataactgtgtatatacatatgtgtacatatgtgtatatatgtatatatgtacatatgtgtatatatgtatatatacatatatacataagc

SEQ ID NO: 15608 - DNA, 78 bp, Homo sapiens
gctcagtctgtgtctgtgtctggggctcagcagagcatctgctctgtaagtgttcctactgtggactataacctgggc

SEQ ID NO: 15609 - DNA, 81 bp, Homo sapiens
gtttattcccattcacattattgagatgccattacagtatgtctgtggctctactttatgataccattttgggaatctagc

SEQ ID NO: 15610 - DNA, 97 bp, Homo sapiens
caaaagggacacgtgacacgtaattctatctatatagattttaagaacaaggaatatttacctatggtgatagaaatcagtgttgtggttacttctg

SEQ ID NO: 15611 - DNA, 78 bp, Homo sapiens
cttatggttatctatgtgagtatatatgtatgtatatatatgtgtatatatacatatatagatgaactcagaataaga

SEQ ID NO: 15612 - DNA, 108 bp, Homo sapiens
tttgtctcaaaaagatctgtttgaagcatgttaatttattctaagttttggtctcactcagtgagtgaggctcttaatgatgtgtttagtcaaacattttgtcccaaa

SEQ ID NO: 15613 - DNA, 92 bp, Homo sapiens
aatacacacaggattttgatgacttagtataaaatagaaagtgaaataactcaatattttatattaataacatattaattacatgttgtatt

SEQ ID NO: 15614 - DNA, 57 bp, Homo sapiens
ggtgcccaccaccatgcccagataatttttctattttagtagaggtggtgtttcacc

SEQ ID NO: 15615 - DNA, 92 bp, Homo sapiens
tatatatactatatataggatatatatactatgtatatatatatgtatgtatgttctacatgtagtgtgtatatatatcctatatatagtgt

SEQ ID NO: 15616 - DNA, 83 bp, Homo sapiens
gtgtatatatatacttacatagatatgtatatatgtatacatatatatgtgtgtgtgtgtgtgtgtgtgtgtgtgtgtgtata

SEQ ID NO: 15617 - DNA, 103 bp, Homo sapiens
acgctataatcatcaactgtataaagttttaattgtcctttaaaagtaaacaactttgtaatcttaggataattttataatactgtgagacgttgtgttgcgt

SEQ ID NO: 15618 - DNA, 101 bp, Homo sapiens
gctttataatgtctggataagtgcttaattgtgtttttgtggtaacagttgtcattttcttattccatgtttaacaccctttcctagacctcttgtaaggc

SEQ ID NO: 15619 - DNA, 87 bp, Homo sapiens
atttgcaaatatatacatatatttgtgtctacatgtatatctttatatatattatctacatatatatgtatatatacatatgtaaat

SEQ ID NO: 15620 - DNA, 100 bp, Homo sapiens
ttttctgatatacagtagtgctaccataaactttttcattgtctatatattatatatatataattgtagagtctaaatggtagtttcttcttttagagag

SEQ ID NO: 15621 - DNA, 119 bp, Homo sapiens
tagaatttgggtatgaatttatctggcctagggcttttttgattggtagatttttagttactgattctttttgaatttattgagacttgctttatggtcaagaacgtgctgaatcctag

SEQ ID NO: 15622 - DNA, 113 bp, Homo sapiens
tttatataaatgcacttctagggactgaaatcatttacacaacattagatatatttttataaagcattagattctttgtgaatgcagtttgaatggaaggggtttgagatgaa

SEQ ID NO: 15623 - DNA, 101 bp, Homo sapiens
aactcatctctttctggcttgttggctgagttcttattttatactgaatatttgtttatatacatcaaggagaaaacaaaatgagctaagaatgatgtgtt

SEQ ID NO: 15624 - DNA, 113 bp, Homo sapiens
tgtaaacaaagctacagcactaggaccttttgcatacaagtttttgtgtagaaatatatttttatttctcttacgtaatatttaagaggggcagtgatgagtcttgcagtaca

SEQ ID NO: 15625 - DNA, 61 bp, Homo sapiens
tgggcagcgtgctgtggagaggcagcagctctcctgctggactctctcagtctctggtcca

SEQ ID NO: 15626 - DNA, 61 bp, Homo sapiens
ccgcactatgactctctgtggctctgggcatagggctgggaccatcagggttggtgtgtgg

SEQ ID NO: 15627 - DNA, 97 bp, Homo sapiens
agcaatgatattgaggtactatgttgagggcctggggtgagaatctgaaagtggctggcttcagatgagactcagcacattaccagctgtggtggct

SEQ ID NO: 15628 - DNA, 81 bp, Homo sapiens
atacatatgtatacacacatatataatatatatgtatgtatgtgcgtgtgtgtatatatatatgtgtgtgtatatatgtat

SEQ ID NO: 15629 - DNA, 113 bp, Homo sapiens
ccaactttgcaatcaacaaaatgaaaacaataatgctctttcacaagttttttatttaattattgaaacattctaaggtattatgtggtttttatatggaaatatgcagttgg

SEQ ID NO: 15630 - DNA, 118 bp, Homo sapiens
cttgaaaatttagtctgggtcttagactattttcttttttaaaatattctttatttttgttatttatttatttatttttaagacagtgtcttattctctctcaggctggagtgctagg

SEQ ID NO: 15631 - DNA, 76 bp, Homo sapiens
ctctcagccatgcacactcccacacacacaggctgggtgccctggtgtgtgggaaaatttaacgtgggctgcagag

SEQ ID NO: 15632 - DNA, 91 bp, Homo sapiens
ccataacaggggcagtgcaggcacagtcccacaggtgttggccctcttctgagaccctccctctctgcctgcctaaccagcccctacctgg

SEQ ID NO: 15633 - DNA, 105 bp, Homo sapiens
catatgtaaattactatttatgtatttgtgtgtaattatgtatgtatataaaacttttaattacacacatatatgcatatgaatatatatgaaaccatgcatatg

SEQ ID NO: 15634 - DNA, 136 bp, Homo sapiens
gaaatttatcagtctcttaatagtgtccttcaaatggaagttacatttgacaatgttgtctgtgacactctttgaggcttctttgtgtaagagtcaatttcatttcatatatgtcaacatccatgtattgaaaggc

SEQ ID NO: 15635 - DNA, 111 bp, Homo sapiens
atgaagaaagacacagaaacctgatttgaaaaacatagatctgtttatatatataatctgttcatatatatataacaccttctgttttcaaaaaaattctgtttactttat

SEQ ID NO: 15636 - DNA, 73 bp, Homo sapiens
gtctggcacagtggctcactgcctgtaatcccagcactttgggaggccgaggcgggcagatcatgaagtcagc

SEQ ID NO: 15637 - DNA, 78 bp, Homo sapiens
ttttcttcatccagtccactgttgataggcatctaggttggttccatgtctttgctattgtggagtgttgcagggaaa

SEQ ID NO: 15638 - DNA, 132 bp, Homo sapiens
agcagacatgcccagcacagccatggggctgcaggaagggggtgctgggttttttgcttgagacagtctcactctgtcacccagcctggagtggagtggtgtgatcttggctcaatgcaacctccaccttcc

SEQ ID NO: 15639 - DNA, 107 bp, Homo sapiens
tgtgtgtgtgtgtgtacgtgtatatatgtatatacatatgaagtttcatttatgtatatatgtctatacatacatttttctgtatatatatatatatatatatgtac

SEQ ID NO: 15640 - DNA, 92 bp, Homo sapiens
agtgtgcaatatgtattcatttaatatatatgttacatataaaattgaatccctaacacatgtagcatatattgtcatatataatgtatatt

SEQ ID NO: 15641 - DNA, 148 bp, Homo sapiens
tatgtgtatatatatatgtgtgtatatatgtatatatgtgtatatatgtatagatatgtgtatatatgtgtatatatgtatatgtgtatatatgtgtgtatatgtatatgtagatatatatgtgtatatatacacatatgtagatata

SEQ ID NO: 15642 - DNA, 95 bp, Homo sapiens; identical to SEQ ID NO: 68

SEQ ID NO: 15643 - DNA, 93 bp, Homo sapiens; identical to SEQ ID NO: 69

SEQ ID NO: 15644 - DNA, 95 bp, Homo sapiens; identical to SEQ ID NO: 68

SEQ ID NO: 15645 - DNA, 93 bp, Homo sapiens; identical to SEQ ID NO: 69

SEQ ID NO: 15646 - DNA, 74 bp, Homo sapiens
tgcacacatatgtatatgtatatatacatgcacacatatgtatatgtatatatacatgcacacatatgtgtgta

SEQ ID NO: 15647 - DNA, 118 bp, Homo sapiens
atatatgtgtatatgtatatatacatacacatatatgtgtatgtatatatacatatacacatatatgtgtatgtatatatacatatacacacacatatatgtgtatatgtatatatac

SEQ ID NO: 15648 - DNA, 135 bp, Homo sapiens
tatatatatatgtgtatgtatatatacatatacacatatatgtgtgtgtatatgtatatatacatacacatatatgtgtatatgtatatatacatacacatatatgtgtatgtatatatacatatacacatatat

SEQ ID NO: 15649 - DNA, 90 bp, Homo sapiens
gtttagcataacaatgccaatcatactgaaaagcagatattagagaatatctaattctctttgcttttgaagaatgagaattgttgagac

SEQ ID NO: 15650 - DNA, 95 bp, Homo sapiens; identical to SEQ ID NO: 68

SEQ ID NO: 15651 - DNA, 93 bp, Homo sapiens; identical to SEQ ID NO: 69

SEQ ID NO: 15652 - DNA, 71 bp, Homo sapiens
ctgggttcctggtggggtctgaccctgggtctgtaatattgggcaggtcacacggtctctctgagcctcag

SEQ ID NO: 15653 - DNA, 70 bp, Homo sapiens
atgtatgtatgtatgcgtgcatgtatgtatgtatgtatgcgtgcatttatgtatgtatgcatctatctat

SEQ ID NO: 15654 - DNA, 106 bp, Homo sapiens
ctttcactgacttttacatgttcaaaccagtgtgatgaatggatattttattttgatataatgatgagatgtcatatgagatgtattggatgcaaagtactgagag

SEQ ID NO: 15655 - DNA, 138 bp, Homo sapiens
gagaaatggagtcaataggatctctgtctacatgagagagagactgagagaaagacagagattatctctctctctgtatatatatatatatatatatatatatgtgtgtgtgtgtgtgtgtgtgtatatgtatataca

SEQ ID NO: 15656 - DNA, 114 bp, Homo sapiens
tatgtttatgtatattgcttatatgtttatgtatattgtatatgttgatgtatatacataaacatatattccttatatgtttatgtatattgctcatatacatataatttatac

SEQ ID NO: 15657 - DNA, 91 bp, Homo sapiens
aaagattgtggatttttgcaaatgtgcttgtattcttttattttttttcataaaagtttcttgagcaccaattgtatatctgatattcttt

SEQ ID NO: 15658 - DNA, 57 bp, Homo sapiens
tgagatggagtctcactctgtcacccaggctggagtgcaatgagggatctcatctca

SEQ ID NO: 15659 - DNA, 85 bp, Homo sapiens
gtatttgtgcattatatatatatatgcatacatacatatatgtctatttacacatatatgtgtagttacatatttgtacatatac

SEQ ID NO: 15660 - DNA, 91 bp, Homo sapiens
catttatatatgtatgtaaatatatttcatatatacacatatatgtgaatatacatacgtgtgtatatgtacaaatatgtaactacacata

SEQ ID NO: 15661 - DNA, 118 bp, Homo sapiens
caggaatgaaaggaaataaagtacacgtggaagagggccaagcaggcaacttgagagatcactgagagaatgcactgatgacctttgacttggcattttatatgttggcatacttctg

SEQ ID NO: 15662 - DNA, 93 bp, Homo sapiens
tattgaaaggttttaacctgggagtaaataagggctgcttgagctattgagctgaagtcaagtgtttttcttctggcatttccacttgcaatg

SEQ ID NO: 15663 - DNA, 95 bp, Homo sapiens
ggggacattgttctaagtggtttacgtatgtattaatttattttcctcaaaacaagtcttaaaaaatgtatgtgaggtcttggagatatttcctc

SEQ ID NO: 15664 - DNA, 118 bp, Homo sapiens
tgtgtgtttattaagcagagtgcaataacttgcctggaattttggtgtatgtgcccatgggtgtgtgctgagtgtgtggaaaggttgttggaaggctggaagaaagggtagggagagg

SEQ ID NO: 15665 - DNA, 62 bp, Homo sapiens
caggtacctcagtgggaaatgcagatatcacctgtcttctgtgtctatctcactgggatctg

SEQ ID NO: 15666 - DNA, 115 bp, Homo sapiens
ccatctgctctaggggtaagctgccagtgtaattctttttttttttttttttttttttttttttttttttttttgagacggagtttcactctgttgccaggctggagtgcagtgg

SEQ ID NO: 15667 - DNA, 83 bp, Homo sapiens
atatatatatatacgtgtgtatttatatatatatatatacacacatatatatgtatataagttatgcgtgtaatttgtatata

SEQ ID NO: 15668 - DNA, 59 bp, Homo sapiens
ggcactcgcccccagtcggggtctagttaacagactgactctgtctgtctgggtcggcc

SEQ ID NO: 15669 - DNA, 61 bp, Homo sapiens
aatggcagagtagggtgtacctccatgaagaactggggattcactctttctctgtggcatt

SEQ ID NO: 15670 - DNA, 99 bp, Homo sapiens
gagatggggcattaaagagatgactgagagaggccagttatgagattttgttcttataaaatccactttggcttcctcagttttctcttgtttcctttc

SEQ ID NO: 15671 - DNA, 115 bp, Homo sapiens
agtgtgtagatttctattgtaccctttttatgtatgtttcaaaatgttagaatgaaaatttatttctattttgagggaacttagccttacatgaggaagcaagaaagtacatatt

SEQ ID NO: 15672 - DNA, 106 bp, Homo sapiens
atatatattgcatatatatatctcgcatatatatattgtatatatatatctcgcatatatatattgtatatatatatcttgcatatgtgtatatatgtatatatat

SEQ ID NO: 15673 - DNA, 89 bp, Homo sapiens
gatgttcagtgcgtgtaatcagggaatacgcacatactgtgaatctctcacattcttacctgcttcctgcttcccaggcactttttatc

SEQ ID NO: 15674 - DNA, 106 bp, Homo sapiens
atatcactgagtgtgggtgtgcgagagagagagagacagaccaaatgttctttaacttttttttaaattaagcatttatcctaatgatgtgacttcaggatgatat

SEQ ID NO: 15675 - DNA, 117 bp, Homo sapiens
tgttctgactattctgggacccttgagattctatatgaattttaaaatttgtttttctatatctacaaaaaaaactcattggtatttttatagggatttcactgaatttgtagatca

SEQ ID NO: 15676 - DNA, 102 bp, Homo sapiens
agctgggatcaaggacagtgccgtccttctctcagagtgccatccctactttagtagctgagtactcagaagagagagaggtggttgcctggggccctagtt

SEQ ID NO: 15677 - DNA, 118 bp, Homo sapiens
aagttttgtcctatcaaatgactcattcaagccacagtgccaattgaatttaaatgttatcataatatttatatttgagggcaaacagctttgtgggtttctgtcaagatttttaact

SEQ ID NO: 15678 - DNA, 86 bp, Homo sapiens
ctttttggtcttaatatcacagtgtcatatatttctgtatatttttgcagaaatctttgaaaatgtttttccttgacataagaaag

SEQ ID NO: 15679 - DNA, 77 bp, Homo sapiens
caaagagtgcagagagtgcacatgcttccttttgtgtagaaattctaggtgagaggcatatgtatttcatgatgttg

SEQ ID NO: 15680 - DNA, 82 bp, Homo sapiens
gccttagagtccattgagcttcagttgcctccgctgtaaaatggggatggtggcagcaggcttcataggcttggtgagaggt

SEQ ID NO: 15681 - DNA, 119 bp, Homo sapiens
acaaacatattgtatacagtatatatactgtaaacattgtatacagtatatatatatatactgctgtatatatatgtgtgtgtgtatatatatgtatatatacatatatgtatacacca

SEQ ID NO: 15682 - DNA, 70 bp, Homo sapiens
tctagatatatatatacaaacagatatatatctatatctatctatgggtatgtatatgtatgtgtttaga

SEQ ID NO: 15683 - DNA, 84 bp, Homo sapiens
ggtattgtaagaagatggtagctccagctgaacatctagacctgaaaggagtaggggctgaggtgccttctgagcagagagacc

SEQ ID NO: 15684 - DNA, 86 bp, Homo sapiens
gtgtgtgtgtgtatatatatatatgtatgtgtgtatatatacgtatatatacgtatatatatttgtgtgtgtatatatatatacat

SEQ ID NO: 15685 - DNA, 105 bp, Homo sapiens
agaattatggtagcatatgttctttattcctcctttgtcactcagtttgtctgttattagaatttctgagtgatggtatttgtaagagaaggttttatctattct

SEQ ID NO: 15686 - DNA, 111 bp, Homo sapiens
gtttatatatacatatatgtgcatgtgtttgtgtatatatatatatatatatatatgcatatataaatatatatatatatatgtaaaatcagtcaaacctagttgcacatg

SEQ ID NO: 15687 - DNA, 70 bp, Homo sapiens
cctgatgatctgtcactgtctctcatcacccccagatgggactgtctagttgcaggaaatcaagctcagg

SEQ ID NO: 15688 - DNA, 116 bp, Homo sapiens
gtaagttgtggatctgctggaaagccataatgaagagtttctaattttttttttgtagtcaattgggaacaaactgaaattatgaaggtaacagcataatgtgtcctgtcatttat

SEQ ID NO: 15689 - DNA, 116 bp, Homo sapiens
ggtgactaaaataattcacaacagtatggatgtcatttgttatattttattttcatggttatatgaaaatttctgtttatactttgtgtagatgcttataggtggattaaatcacc

SEQ ID NO: 15690 - DNA, 140 bp, Homo sapiens
tggcatagtgagtttggggtctcgagattttattttcttttcacttttttttttcttttttgagacagaatctcactctgtcacccaggttggagtgtagtggtgcgacctgggctcactacaacctccgtctcatgggt

SEQ ID NO: 15691 - DNA, 95 bp, Homo sapiens; identical to SEQ ID NO: 68

SEQ ID NO: 15692 - DNA, 93 bp, Homo sapiens; identical to SEQ ID NO: 69

SEQ ID NO: 15693 - DNA, 88 bp, Homo sapiens
gtgtgtgtgtgtctgtgtagtgtgtgtatatatatatatatatatatatatatatatatatacacacactacacagacacacacatat

SEQ ID NO: 15694 - DNA, 92 bp, Homo sapiens
gcagctctcatcaatagctttcttacactggctgtctcacactgtctgccctgtctcggctgcttgaggcggcagctccaacacacagctgc

SEQ ID NO: 15695 - DNA, 95 bp, Homo sapiens; identical to SEQ ID NO: 68

SEQ ID NO: 15696 - DNA, 93 bp, Homo sapiens; identical to SEQ ID NO: 69

SEQ ID NO: 15697 - DNA, 76 bp, Homo sapiens
ggtgtgagggatcagagaaaggggaagcaataccctgatgaacatcttctcccttactctctgtttcagtcacgcc

SEQ ID NO: 15698 - DNA, 82 bp, Homo sapiens
caggatggggtcagtcagattggaaccttcttttttttatttttattttttgagatggagtctcgctctgtgacccaggctg

SEQ ID NO: 15699 - DNA, 67 bp, Homo sapiens
tatatatacatatatatgtttatatatatttacctgtgtaaatatgtatgtgtatatatgtatgtat

SEQ ID NO: 15700 - DNA, 66 bp, Homo sapiens
agcaaagcactataagatgctaagcaataatgtctaagacactgtctctttcatctttgtgctgct

SEQ ID NO: 15701 - DNA, 93 bp, Homo sapiens
ctgttttccatctgttgttcatattgagtaatttcttttttttttttttttgagatggatggagtcttgctctgttgccaggctggagcacag

SEQ ID NO: 15702 - DNA, 98 bp, Homo sapiens
tttggaagttcagagtgaggggtgctgaacatatgtagttatttattgaatcattgatggtaattgcagaattagaaaccactacaatgtgctacagg

SEQ ID NO: 15703 - DNA, 110 bp, Homo sapiens
gggaacagagcagtacactcactctctcctggtagactgagctgagagaggacaggaaggggctgagctgagcttgctgcctcccaaacacacctattagatactcagtc

SEQ ID NO: 15704 - DNA, 56 bp, Homo sapiens
gagaccgagtctcactctgtcacccaggctggagtgcagtggtgtgatctcggctc

SEQ ID NO: 15705 - DNA, 171 bp, Homo sapiens
gttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttaggg

SEQ ID NO: 15706 - DNA, 105 bp, Homo sapiens
tgcataactcttgtgtacctacaaatttttttctattttcatccatgaaagtaaaggctttaacaaacagaatgacatatagatgtgtgtatgcatgagtgtgta

SEQ ID NO: 15707 - DNA, 100 bp, Homo sapiens
ctagctgtgaatttgggcaagttactggtgctctctgaccctcagtctttttatctgcagaatggggttactcaaggcacctactttctgaaattgttgg

SEQ ID NO: 15708 - DNA, 77 bp, Homo sapiens
gggggaggcaaagctcacagcctcaatctctgtgccatcggcatgtgtgtgcagggcgtgagtttaccctctttccc

SEQ ID NO: 15709 - DNA, 118 bp, Homo sapiens
gttactagattctactaattttcctgtccccagagtttaagtgcttttcttttttttttttttttttgagaaggagtctcgctctgtcgcccaggctggagtgcagtggccttatctg

SEQ ID NO: 15710 - DNA, 95 bp, Homo sapiens; identical to SEQ ID NO: 68

SEQ ID NO: 15711 - DNA, 93 bp, Homo sapiens; identical to SEQ ID NO: 69

SEQ ID NO: 15712 - DNA, 118 bp, Homo sapiens
gactgtccagttggcccccttgagtaacagagctatccagtaggtgtagtgtttatgttgacgacaggttggcattctgaggaggcatttgttacatcgttgttggtaagtgggagtc

SEQ ID NO: 15713 - DNA, 111 bp, Homo sapiens
cagtgatttgaagtgatttaatgaagccactgttagcgattaagatgaatctattaagcatatttttttcttcttttttgagatggagtctcactctgtcgctgaggctgg

SEQ ID NO: 15714 - DNA, 95 bp, Homo sapiens; identical to SEQ ID NO: 68

SEQ ID NO: 15715 - DNA, 93 bp, Homo sapiens; identical to SEQ ID NO: 69

SEQ ID NO: 15716 - DNA, 99 bp, Homo sapiens
tatgatttcatttatttttcatttgctgaggagtgctttacttctgattatgtgatcaattttagtgtaagtgccatgtggtgattagatgaatgtata

SEQ ID NO: 15717 - DNA, 96 bp, Homo sapiens
gtgaaatgtattcaacttatgagagtagacagctcattgcacagtattctgcacactattgggctttgaatgattcatgatgaagtagcaaatcac

SEQ ID NO: 15718 - DNA, 111 bp, Homo sapiens
tgaatatgattttattacattaatagcaattatcacactggtttacaatagtgtctctctcactctacactatgaactgtggtaaggcagggagtgtgatttatgtttata

SEQ ID NO: 15719 - DNA, 100 bp, Homo sapiens
aatctcatgtttcttggaggtttcgttcttttttaaaatttcttttttctttatttttgcctaagttgattcaaagaactggtcttcgagctctgagatt

SEQ ID NO: 15720 - DNA, 95 bp, Homo sapiens
gcaactttattccaaagtacatgattgatctatgtatatatttttctaaatttatattatcatgggtctcagcatgtgtgtgtgtgtgtgtgtgt

SEQ ID NO: 15721 - DNA, 66 bp, Homo sapiens
tgagtagcttttgggaaagagggatacgttgtttactctctttctgtgtcccatagagtatagtca

SEQ ID NO: 15722 - DNA, 102 bp, Homo sapiens
gatatctttgaattttatacatgcttagatagtatatgtatatttttctttaatatatgtaaagaaaatgtgataattaaaatgtgtgaaatttaatgtgtt

SEQ ID NO: 15723 - DNA, 116 bp, Homo sapiens
taagacaggtttgctagcaacaagttgtctgtttttgttggcttgggaatgtattttttttttattttttatttccttcagttttggaaaatagttttgtggtagataaagttcta

SEQ ID NO: 15724 - DNA, 108 bp, Homo sapiens
gcttcctaaattgtagaaactagactgaatactcttgaaaaacatggctatggctatggtagaattaagtgatggtggatttcaaagagtttttaaatttataatggt

SEQ ID NO: 15725 - DNA, 80 bp, Homo sapiens
atgttgagtgtgagcagacaggaaggcatgtgagccagccctttgtgcttttatctccccctgttttacacaatcaatgt

SEQ ID NO: 15726 - DNA, 78 bp, Homo sapiens
ctcagccagacacagtgactcatgcctgtaatcccagcactttgggaggccgaggtgggtgggtcatctgaggtcagg

SEQ ID NO: 15727 - DNA, 137 bp, Homo sapiens
gccttttatgtctttctcttgcctaattgctttggtcaaaacttccagtactatgttgaataacagtagtgagagtgcacatccttgtcttttctggttcacaggggaatgcttctagcttttgcccattcattatg

SEQ ID NO: 15728 - DNA, 107 bp, Homo sapiens
gtgtaatataatatatgtgggatctttcatgcaaatttgtgtaaatatgtgtgcatatgcatgtatgtatgtgtgtgtaaggaagaaatgaaacaaagctatgacac

SEQ ID NO: 15729 - DNA, 107 bp, Homo sapiens
gtgtaatataatatatgtgggatctttcatgcaaatttgtgtaaatatgtgtgcatatgcatgtatgtatgtgtgtgtaaggaggaaatgaaacaaagctatgacac

SEQ ID NO: 15730 - DNA, 88 bp, Homo sapiens
gtatatatgtgtgtgtatacatatatatgtattgtgtatatatatagtaagtttgtgtatatgtgtgtatatatatatatatacacac

SEQ ID NO: 15731 - DNA, 80 bp, Homo sapiens; identical to SEQ ID NO: 15725

SEQ ID NO: 15732 - DNA, 78 bp, Homo sapiens; identical to SEQ ID NO: 15726

SEQ ID NO: 15733 - DNA, 108 bp, Homo sapiens
gggcatctgcaagaacgacatcaaacattgactcttgtagttttgtcgtaattttcttgttcaaaactacatctttacagagattattaacacagtctgtagattccc

SEQ ID NO: 15734 - DNA, 107 bp, Homo sapiens; identical to SEQ ID NO: 15729

SEQ ID NO: 15735 - DNA, 75 bp, Homo sapiens
gtgtgagaagatgtctcattgtagttgtgatttgactttctctgatgatcagtgatattgagcatcttttcacat

SEQ ID NO: 15736 - DNA, 88 bp, Homo sapiens; identical to SEQ ID NO: 15730

SEQ ID NO: 15737 - DNA, 102 bp, Homo sapiens
tatgcggttaaaaagctcggtagcaatcagtcaagagtatgagctctgaagccacattctctgaggtcaaatcctggctctgcctgctttactagctgtgtg

SEQ ID NO: 15738 - DNA, 112 bp, Homo sapiens
acaaaataaaaagtgtaacatatttgcttaatttgtgtaaagattattaaactatatttagtttagtatacagctttacatatctaaatatttaatacatactattatttgt

SEQ ID NO: 15739 - DNA, 72 bp, Homo sapiens
cagtggccaagcctcaccctgggcgagctggggcaggctcactctctcaggcacagtgaggaaggcacactg

SEQ ID NO: 15740 - DNA, 90 bp, Homo sapiens
tatatatatacatatatatatatatatatgtatatatacacatatatatgtgtgtgtatatatatatgtgtatgtgtgtgtatatatgtg

SEQ ID NO: 15741 - DNA, 117 bp, Homo sapiens
tggggtgttgtgtaaatgacttctttcactgagcataattttttgtttttttaaaatagtttttagattaattcatgttgtagtgtacattaatacctcatttattcttacagcact

SEQ ID NO: 15742 - DNA, 112 bp, Homo sapiens
aatatacatatccatttcattgcatatatatatatagagagagagagagagagagatattttcaaatgtgtgtatatatatccaatggaatggacatatatatatgtatatt

SEQ ID NO: 15743 - DNA, 104 bp, Homo sapiens
tctaatagctgtgcccttggccttcatgtgtgcaatgttatgaggttgatctgcaagcaatggaatgtgcaccatatggatcccatggtagattgccttgtaga

SEQ ID NO: 15744 - DNA, 69 bp, Homo sapiens
gcagtggtgtgttcagggctcactgcagcctcaacctaccaaggtcaagtgactctctcactctgctgt

SEQ ID NO: 15745 - DNA, 70 bp, Homo sapiens
gtcacctctcagagtctctgtgttaggtgggctcagttgtgtgttccttccacagagtttcttaggtagc

SEQ ID NO: 15746 - DNA, 58 bp, Homo sapiens
tgaggtggagtctcactctgtcacccaggctggagtgcagtggtgcgatctcggctca

SEQ ID NO: 15747 - DNA, 120 bp, Homo sapiens
ggaagtagaccactaatggcttcaaactaaaagaattctacagaaaacatgcctgaaataaacacaagtgatttagtagaacaaaaacataggattaaagccgagtggtgccactattcc

SEQ ID NO: 15748 - DNA, 76 bp, Homo sapiens
aaggatgttggaacacagtttctgagcaaatattgcctgcagagtggcaatattgttcaatatttttaatgtcctt

SEQ ID NO: 15749 - DNA, 104 bp, Homo sapiens
tcaagtctatgaaaggcttttaaagtgtcaaataattcaaagtaaatttgaaagaattgacagagaatttgtgtattttaatttgagtcatcatagatagttgg

SEQ ID NO: 15750 - DNA, 77 bp, Homo sapiens
tatctatatatctatatctatatctatctatatatgtctatatagatagatatatatataggccaatatacctgatg

SEQ ID NO: 15751 - DNA, 76 bp, Homo sapiens
aaggatgttggaacacaatttctgagcaaatattgcctgcagagtggcaatattgttcaatatttttaatgtcctt

SEQ ID NO: 15752 - DNA, 74 bp, Homo sapiens
ggaggtaacttctctttttgatatttaaaaaacagagtgggaagactgtgtttttcaaaggagggaattaatcc

SEQ ID NO: 15753 - DNA, 102 bp, Homo sapiens
gcatttagattgatttcatgtctttgctatggtgaatagttttatatagagtaaaatgtatatttgtctgtagtaaacatacatgtgcatgttctaatttgc

SEQ ID NO: 15754 - DNA, 77 bp, Homo sapiens
ttctcactcactgggtcagtctaatcagtataatgtcgtcaatataatggactagtgtgataccttgtgaaagagaa

SEQ ID NO: 15755 - DNA, 107 bp, Homo sapiens
ctggaatgtatgtatttgaatagtggtgcattcctttttaatcaattatttttttaaaaaaaattgtattgcactgtagtcagatatgtctaaaataaatacttcag

SEQ ID NO: 15756 - DNA, 74 bp, Homo sapiens
atatatgtatatatacacacatgtacatatatatacatgtatatatatatacatgtacatatatatacatgtat

SEQ ID NO: 15757 - DNA, 116 bp, Homo sapiens
atggcatctaattgtaacatattttagaacaggataacaaagtgcatctccaactgtaatcacaatgatgcgtatgagacagtgcatctctttcttcttgatgtataagctgccat

SEQ ID NO: 15758 - DNA, 58 bp, Homo sapiens; identical to SEQ ID NO: 10

SEQ ID NO: 15759 - DNA, 105 bp, Homo sapiens
tagatttggtgacataaaatggaaggtggcaaacaatataaaactgaagaataagaagaaactttatttttatctgttgtacatccaggtatgatatcaaagatg

SEQ ID NO: 15760 - DNA, 100 bp, Homo sapiens
ttttttaatgtcagataaagtctggaaacaacccaagagttcctgatacactcacaggcagctttcaggaggccaacaggcatttttttgaagggaaaaa

SEQ ID NO: 15761 - DNA, 106 bp, Homo sapiens
ttaggcttccaaatgaatcaggaacaggcacatagagggcattgagacagtcgtatgtcaatctgtctctctttgattgagaacctgaaatgtttgaattttctga

SEQ ID NO: 15762 - DNA, 75 bp, Homo sapiens
tggtaaagaggaagaaaatgggaacagttaaggagatacttatttcctatgtcttatatttctttttttttagca

SEQ ID NO: 15763 - DNA, 65 bp, Homo sapiens
ttcattctgagtgggactctgtctatctttttttaaatttggtcttgaggtctctctcaggagaa

SEQ ID NO: 15764 - DNA, 67 bp, Homo sapiens
gtgggttcattattgccagagagactttattacaaaagtgagtcctctctggctcttactgtctcac

SEQ ID NO: 15765 - DNA, 58 bp, Homo sapiens; identical to SEQ ID NO: 2257

SEQ ID NO: 15766 - DNA, 67 bp, Homo sapiens
tgatgtgtgtgtgttcatgtgtatagacataagtatatatatttatacatatatatacacatataca

SEQ ID NO: 15767 - DNA, 85 bp, Homo sapiens
gtggggaaaagattgagaaatcggatggttgctgtgtctgtgtagaaagaggtagacatgggagacttctcattttgttctgtac

SEQ ID NO: 15768 - DNA, 111 bp, Homo sapiens
gctgaaagaacacctgggggagggtaggtagctgggacatggccttattctctctctctgagagccctgtgcacagtatcagcagttttactctctctctcctgttccagc

SEQ ID NO: 15769 - DNA, 95 bp, Homo sapiens; identical to SEQ ID NO: 68

SEQ ID NO: 15770 - DNA, 93 bp, Homo sapiens; identical to SEQ ID NO: 69

SEQ ID NO: 15771 - DNA, 95 bp, Homo sapiens; identical to SEQ ID NO: 68

SEQ ID NO: 15772 - DNA, 93 bp, Homo sapiens; identical to SEQ ID NO: 69

SEQ ID NO: 15773 - DNA, 67 bp, Homo sapiens
atttatattatcacatgcatatatgtgtgtatgtatatatgtgtgcatgtgcatgcatagtaaaaat

SEQ ID NO: 15774 - DNA, 95 bp, Homo sapiens; identical to SEQ ID NO: 580

SEQ ID NO: 15775 - DNA, 93 bp, Homo sapiens; identical to SEQ ID NO: 69

SEQ ID NO: 15776 - DNA, 108 bp, Homo sapiens
atgaatttaaccttgatggcatttgtctcgacagatcatgagttttttttttttttattatactttaagttttagggtacatgtgcacattgtgcaggttagttacat

SEQ ID NO: 15777 - DNA, 83 bp, Homo sapiens
ggaaatggcttacaatttcttgacttacaagaatacaaaatcttaacgtattctggtttgagcttgtatacatgctgatttcc

SEQ ID NO: 15778 - DNA, 79 bp, Homo sapiens
tggccaaggcactctgcctctctgagcctcagttttattttttgtttgtttgttttggagagagaggcccactctgtca

SEQ ID NO: 15779 - DNA, 93 bp, Homo sapiens; identical to SEQ ID NO: 69

SEQ ID NO: 15780 - DNA, 110 bp, Homo sapiens
ataaaattaatgctgatggtaaaattaaatgagtatttcatatttctaacaatatatgtattttaggttatgagttaacattaaatttttctgtccagtgttttaagtat

SEQ ID NO: 15781 - DNA, 159 bp, Homo sapiens
caggaccctcagttctttaaggatggactaaatgactggtatcattgcttaccaaagtgtcttttttttttttttttttgagactgagtctctctgtcacccaggctggagggcagtggcacaatcttggcccactgtaaccttcacctcctgggttca

SEQ ID NO: 15782 - DNA, 97 bp, Homo sapiens
gaagcctacttctgtcaatttgtcagactcattctctgtccagttttgttcccttgctggccaggagttgtgatcctttgaaggagaagaggcattc

SEQ ID NO: 15783 - DNA, 89 bp, Homo sapiens
ccatcaatctttggaccactggcttgatttgtttaacttttttattttctaaaaatcacggaagcttgagctacaggttcatgtgttgg

SEQ ID NO: 15784 - DNA, 81 bp, Homo sapiens
tccttatttatttgtgttttttaaacatactcatacttccctctattgtttgtgtcatagagagcacaaatcagatttgga

SEQ ID NO: 15785 - DNA, 73 bp, Homo sapiens
ctagtatggttacgaggcgaacagattttttttttttttttgagacagagtctcgctctgtcgctcaggctgg

SEQ ID NO: 15786 - DNA, 88 bp, Homo sapiens
gacagagcgagactccgtctcaaaaaaaaaaaaacctacatagtatgatggatttttttttttttttgagacagagtctcactctgtc

SEQ ID NO: 15787 - DNA, 132 bp, Homo sapiens
ttgcaaaacgagataataccttgcagtgtatatacatatatatatatatatatatagtttgtatatactgtgtgtgtatatatacacactgcaagatatctcattttgcaatatatatacatatatatatat

SEQ ID NO: 15788 - DNA, 58 bp, Homo sapiens
tgagaccaagtctcgctctgtcacccaggctggagtgcagtggcgtgatctcggctca

SEQ ID NO: 15789 - DNA, 79 bp, Homo sapiens
cagcccgggcaacacagtaacacccagtctctttttaaattattttttaagacagagtctcactctgtcacccaggctg

SEQ ID NO: 15790 - DNA, 95 bp, Homo sapiens; identical to SEQ ID NO: 68

SEQ ID NO: 15791 - DNA, 93 bp, Homo sapiens; identical to SEQ ID NO: 69

SEQ ID NO: 15792 - DNA, 102 bp, Homo sapiens
tgacaagtgagtcgtagactctgaaaaggcaggatcaagacactgggtcttcttattgttgatttttgtttttctttttagaatcagggtctcactctgtca

SEQ ID NO: 15793 - DNA, 103 bp, Homo sapiens
tgagaggtttgtttgtttgtttgttttgagacagtctcactctgtcgcccaggctggagtgcagtggcatgatcttggctcactgcaaactctgcctcccggg

SEQ ID NO: 15794 - DNA, 120 bp, Homo sapiens
gatatagatgggattaataggctatggttattatctattgcttttaagcaaggtatgtaaagatctttgcacccctttctagaagatgggttgtgacaaagagaactttgtattagtatt

SEQ ID NO: 15795 - DNA, 95 bp, Homo sapiens; identical to SEQ ID NO: 68

SEQ ID NO: 15796 - DNA, 93 bp, Homo sapiens; identical to SEQ ID NO: 69

SEQ ID NO: 15797 - DNA, 95 bp, Homo sapiens; identical to SEQ ID NO: 68

SEQ ID NO: 15798 - DNA, 93 bp, Homo sapiens; identical to SEQ ID NO: 69

SEQ ID NO: 15799 - DNA, 99 bp, Homo sapiens
atgtaaatatagtatacaatgtatttataatgtcacatatatacatacatgtgtatatgtatatgtatgaaaatgctttgtaaattgttaagcattaca

SEQ ID NO: 15800 - DNA, 144 bp, Homo sapiens
gtgtgtgtgtgtgtgtgtatatatacaggtatatatgtgtatgtatatatatatacacaaacgtatatatatatacacacgtatatatgtatatatatacgtgtatatgtatatatatatacgtgtatatatgtatatatatgt

SEQ ID NO: 15801 - DNA, 160 bp, Homo sapiens
acatatatgtatatgtatacacatatgtctacatatatgtgtgtatatattatacatatatgtgtatatatacatatgtgtgtatatatacatatgtgtgtgtatatattatacatatatgtgtgtatatatacatatatgtgtgtgtgtgtgtatatat

SEQ ID NO: 15802 - DNA, 107 bp, Homo sapiens
tggatgaggtatgatgaaatgtatgagatgctcgatatgatatatcccctgattggatcatcacatattgtatatgtgtagcaaaacatcccaccgtaccccataca

SEQ ID NO: 15803 - DNA, 77 bp, Homo sapiens
cttggatggtcagagcagtgtgtggagactcacatcgttaacttttgctccaagaactactgcaggaacataccagg

SEQ ID NO: 15804 - DNA, 85 bp, Homo sapiens
tcctgccctaaccatgggtggcctcaggatgcttttttttttttttaagacagagtctcgctctgtcgcccaggctggagtgcag

SEQ ID NO: 15805 - DNA, 105 bp, Homo sapiens
actgagagataaaacaaactacagtgactatactagtttttcctgacacaagaaagacaggtggtggggggtagacagtatatcactctacttgtcagtctcctc

SEQ ID NO: 15806 - DNA, 112 bp, Homo sapiens
tttagaacagtaccaccaaattgttggcactcaaattttaattgttatcatgatattattattatttatatttatattgctgtagaatctaagtgcttcaatgtgttctaag

SEQ ID NO: 15807 - DNA, 110 bp, Homo sapiens
tatggacacacaggggcacagaagccaggctttaaaaaatatatatataaatatataaatacgtatatatatatgtgtgtgtgtctgtgtatatatgtgtgtgtgtatat

SEQ ID NO: 15808 - DNA, 117 bp, Homo sapiens
agaagtgttccctgatcgtcacatccataccaacatctactgttttttgattttttgataacggccactgttacaggagtaagatggtatcgcattgtggttttgatttgcatttct

SEQ ID NO: 15809 - DNA, 102 bp, Homo sapiens
atgtattaaatttgtatcctgttaatttactgaatttgttcatcagttgtaagagttttctggtgggatcctttggttttcctagatacaagattatgacat

SEQ ID NO: 15810 - DNA, 114 bp, Homo sapiens
atttgtcttgatgtggttctttttgagtttgtccgaattagaatttgttgagtttcttggatgtttacattttttgtcaaatttggcaagcttttagacattatttccttaaat

SEQ ID NO: 15811 - DNA, 79 bp, Homo sapiens
tcttgctcacactctctctggctctccatgcttgcttacaagctgagaagttgagaactgcctacggagggtggcaggg

SEQ ID NO: 15812 - DNA, 106 bp, Homo sapiens
tagcagtcatcttacgtagatagcagtctgatggaccagaacatggatatcactaataactctgtatttctgtctcactgtaagcaggctacgttattttcagcta

SEQ ID NO: 15813 - DNA, 86 bp, Homo sapiens
tggtcatcttgttgtctctttgagtctgactgagtctggggcttttatgggcctcagaagggaggaagtatacaccgattggtcca

SEQ ID NO: 15814 - DNA, 75 bp, Homo sapiens
ataggtgtgtttatacatatatatatgtataaacatttaacatatgtatgtgtgtatatacatgtataaacacac

SEQ ID NO: 15815 - DNA, 107 bp, Homo sapiens
tcagaaaaatttctaaactgttgatgtatgtcaccgtatgcatatgtaatgaattatcaagtccaaattagtgtatgtggagatatgatcacaggtatggattctga

SEQ ID NO: 15816 - DNA, 96 bp, Homo sapiens
tcttctacagtttctctccaggaccctatctgacatttcatctaagtctctgtgtctatgtaggcctcaagcctggtgagccataattttagatga

SEQ ID NO: 15817 - DNA, 99 bp, Homo sapiens
ggaatcagagtgaaggttaaagagctttcatatgtgaaacataaaggataatactttatttttttcattaaattgccttactgagtttcttctgtctct

SEQ ID NO: 15818 - DNA, 83 bp, Homo sapiens
agtgtcagtctatttctgtgtctgtagttacaaattttggatctgaaaaatgttcaatttacgtcatgaaatggagctggcct

SEQ ID NO: 15819 - DNA, 73 bp, Homo sapiens
cacctatatagatcacctgtcatgaatggagctttcaggactggaagttgctctgtatgactctgagtgagtg

SEQ ID NO: 15820 - DNA, 110 bp, Homo sapiens
atataattttaagaatgtgtgtgtattatatgtgtgtatatacatactcataatatgtatatattatgagtgtatatatattatacatgagatgtatatattatgtatat

SEQ ID NO: 15821 - DNA, 93 bp, Homo sapiens
ggagagaccctggggcagctctggggtccagggccccaaggctccatcctgaatctgtggccctgtgtccctgcctgcctctggtccattgcc

SEQ ID NO: 15822 - DNA, 121 bp, Homo sapiens
gtatatatacatgtgtgcatatatgtgcatatacatatatatgtatatatacatatgtgcatatacatatatatgtatatatacatatgtgcatatgtgtatacatataaatgtactgcgc

SEQ ID NO: 15823 - DNA, 71 bp, Homo sapiens
atttggctctctgtttgtctgttattggtatataagaatgcttgtgaggggtggagccaagacggcctaat

SEQ ID NO: 15824 - DNA, 95 bp, Homo sapiens; identical to SEQ ID NO: 68

SEQ ID NO: 15825 - DNA, 93 bp, Homo sapiens; identical to SEQ ID NO: 69

SEQ ID NO: 15826 - DNA, 107 bp, Homo sapiens
ttgggccaagatgaaacagaataatttggagtctgtctgttctgactgagctcacccaagtcggggctcagaaaccagctcagattatggttaatgttggataccag

SEQ ID NO: 15827 - DNA, 116 bp, Homo sapiens
accaatagtgtatatgcattcatttttctccacaacctcaccagcgtgttttgttttgttttttactttttaataatagccattctgattggtgtgagagagcatctcattgtggt

SEQ ID NO: 15828 - DNA, 93 bp, Homo sapiens
tcttcatggtgtctgatgagaaatctgctgtcattctgtttttttctttttttcctatagtaagcagttatttctctctcgctgctttgaaga

SEQ ID NO: 15829 - DNA, 60 bp, Homo sapiens
gcgggagtgtgtgggccctgggctgttagagcagaactgagtgagttcagatgctcctgc

SEQ ID NO: 15830 - DNA, 113 bp, Homo sapiens
catatcagatgctttgtaatgttagacaaaatattgcctttctaacattcatgattttcttttaaatgttttatttaaagaaaggcagttctagaattctgcatcctagaatg

SEQ ID NO: 15831 - DNA, 72 bp, Homo sapiens
gggtttggtgacatctgtctgcctgtgtccagctgggatggctagagtcaggcagggcagggcttggggcct

SEQ ID NO: 15832 - DNA, 59 bp, Homo sapiens
tgagtcttgagacagaagacagggggcatggctgtcccaggtgttcggctgcaagttca

SEQ ID NO: 15833 - DNA, 82 bp, Homo sapiens
agtgacaacatgagactttgaagatgatataaaaggcactgtggcttactgcttactctgtctctctgtctcgtaattcact

SEQ ID NO: 15834 - DNA, 116 bp, Homo sapiens
acatataatatatatatatacacatatatacatgtatatattatacgtatatacatatatatgtctatatatacatatatgtatatataatacatttgtgtgtgtgtacacacata

SEQ ID NO: 15835 - DNA, 83 bp, Homo sapiens
acacatatacataaactctctttatatatgtataatatctatatattttattatatatagtaaaatagtaggtgtatgtgtgt

SEQ ID NO: 15836 - DNA, 115 bp, Homo sapiens
tatagggtgcaacatagtatatgttgtgtatatatgtctatatacattgtctatatatgtatatacatattgtctatatatgtatatataacatatactatgttatatagggtac

SEQ ID NO: 15837 - DNA, 73 bp, Homo sapiens
ctatataacatagtatatgttatatatacatatatagacaatatgtatatacatatatagacaatgtatatag

SEQ ID NO: 15838 - DNA, 70 bp, Homo sapiens
tctgttcacctggctgtcagaagatacagtggatggcatagtccagcatcttttcttccagggaaactga

SEQ ID NO: 15839 - DNA, 84 bp, Homo sapiens
cctgcctcagcctcccaagtagctgggactacaggcgcctgccactatgcccggctaattttttgtatttttagtagagacggg

SEQ ID NO: 15840 - DNA, 66 bp, Homo sapiens
tatatatatatgtgtgtgcatatatgtgtgtgtgtatatatatctgtgtatatatgtatatatgtg

SEQ ID NO: 15841 - DNA, 107 bp, Homo sapiens
tttttctgtagaataatataataaaaatgcgataggtttcagagggaaaattcattttagtttttaatctgaactgtctcagctggggatgtggtatggcagagagg

SEQ ID NO: 15842 - DNA, 111 bp, Homo sapiens
gtattctcattttattcttgccataaccctatgaagtaggtgctgctatatttctttcattattcaataaatgtttggagttcctactatgtgctaggtattgtgctgtac

SEQ ID NO: 15843 - DNA, 87 bp, Homo sapiens
actcgttgatggggttgtatgtatttttcttgtacatttgtttgagttatttgtagattctggatattagccctttgtcaaatgagt

SEQ ID NO: 15844 - DNA, 64 bp, Homo sapiens
tagttgatgaacatgatgtggttaatcatgaatgttggttgataacatttgtttacattaacta

SEQ ID NO: 15845 - DNA, 100 bp, Homo sapiens
ggcaagtgtatggcaaagcagtgtaaagatgattgttattaagactaaaatgaataataagggcaagtaataaatatactgtaaagcacagacactcgtt

SEQ ID NO: 15846 - DNA, 129 bp, Homo sapiens
gttctccgtgcctagtttcactcctgtggctgtgttggtgcaagggaagggtactggagggtgcagtgttgtctggctctgtgcccaccaaggttccaactgcaaggcccgtctggtgggaggaggggg

SEQ ID NO: 15847 - DNA, 56 bp, Homo sapiens
tgagacagtctcactctgtcacccaggctggagtgcagtggcgtgatcgtgtctca

SEQ ID NO: 15848 - DNA, 202 bp, Homo sapiens
atatatatatatatatatacgtgtatatatatatatacgtgtatatatatatgtatatatatatacgtgtatatatatatgtatatatacacgtatatatgtatatatatacgtatatatatgtgtatatatatatatacgtgtatatatatatacacgtatatatatatatatatacgtgtgtgtgtatatatatatatat

SEQ ID NO: 15849 - DNA, 92 bp, Homo sapiens
ctgtcatgtgaaagctgtgccggtgactggcttccctgatcctgccctgctccagtctgagcctcactgactccgagtgttcagcgttttag

SEQ ID NO: 15850 - DNA, 85 bp, Homo sapiens
tcataggcagttctttaatctgactgtctctcagttacctcatctgtaaaaatgagaataacacagttccaaaggatcaccatga

SEQ ID NO: 15851 - DNA, 58 bp, Homo sapiens
tgagacgcagtcacgctctgtctcccaggctggagtgcagtggcgcgatctcggctca

SEQ ID NO: 15852 - DNA, 116 bp, Homo sapiens
tacttggtggttgtgcattcttcaccaaagggccatatttagtttatattttatttgtcttatgcctcattttattataagctccttttgaaaaagaacaatagatcatctctgta

SEQ ID NO: 15853 - DNA, 110 bp, Homo sapiens
ctaatctatgtatatatattggggaggtgaggaaaaatataaataacaaaatatattaaaatattttctaacacagtttttgatctcttcactctaaatattgtgattgg

SEQ ID NO: 15854 - DNA, 62 bp, Homo sapiens
tgtgtgtatatgtatgtgtgtatgaatgtatgtatatatttccacacatacagatacataca

SEQ ID NO: 15855 - DNA, 79 bp, Homo sapiens
gtctcgaggaaacccatgaaaaacagcttctgtggtaaagatgtcacaccaaataggatgttgtcgggattgttgagac

SEQ ID NO: 15856 - DNA, 62 bp, Homo sapiens
gcctgagtctgtctgtctttttgatgattcttgagcctccgaaaggcagccatgtgtcaggc

SEQ ID NO: 15857 - DNA, 170 bp, Homo sapiens
catgtatatatgtttttacatatattgatatatatatcatgtatatatgtttttacatatatatgtatatgtgtatatatatcgatatatatgtgtatatgtatcgatacatgtatatacatatatacatatatatcgatatatatgtaaaaacatatatacagatatat

SEQ ID NO: 15858 - DNA, 135 bp, Homo sapiens
atacattccatgcaatggatatatctgtatatatgtttttacatatatatcgatatatatgtatatatgtatatacatgtatcgatacatatacacatatatatcgatatatatacacatatacatatatatgta

SEQ ID NO: 15859 - DNA, 79 bp, Homo sapiens
ggggaagttgtgagaactgaatgaggaaatgtgtgaaatgtccctagaacagtacgtgatctaaattcagtttttctcc

SEQ ID NO: 15860 - DNA, 82 bp, Homo sapiens
ggggggcaacaggagagcaattctcaggtcccaggcagagtgtatggggcacgggtagaagcagctttgttgagggcttgcc

SEQ ID NO: 15861 - DNA, 108 bp, Homo sapiens
gctatcctttttgttcttctgaatagttttatggagaagaaagctgatattagtattttcatttaaataaatagtaaattgtttgagatcatacagaaagtttgtggc

SEQ ID NO: 15862 - DNA, 106 bp, Homo sapiens
tataaagtctggatattaatcccctgttggatgaatagtttgcaaatattttctcccgttgtgtaggttgtctgtccatgctgttggttatttcttttgctgtgtg

SEQ ID NO: 15863 - DNA, 110 bp, Homo sapiens
tggcaacccagtattgaacaagtccatgggcaccatttttaccacaacgtgtgttcattttgtgtctctgtgtcacattttggtaacttgcaacatttaaaactttgtca

SEQ ID NO: 15864 - DNA, 79 bp, Homo sapiens
aaacttggttccaggcagactgggaggaaagcagtcttggaaatggaaacttgagtctcttactgtctgctcaaagttt

SEQ ID NO: 15865 - DNA, 112 bp, Homo sapiens
taagtcttttgcccattgtttagtaggttgtttcctattttgaatttttttaattttattattattatactttaagttttagggtacatgtgcacaatgtgcaggtttatta

SEQ ID NO: 15866 - DNA, 162 bp, Homo sapiens
gtatatatatatatgtgtatgcatatgtatatatatgggtatatatatatgtgtatacatatgtatatatatatgggtatatatatatgtgtatacatatgtatatatatatgggtatatatatatgtgtatacatatgtatatatatgggtatatatatat

SEQ ID NO: 15867 - DNA, 132 bp, Homo sapiens
ggaccaggcacagtggctcacgtcaacacttcaggaagctgtaatcccaacacttcaggaggctgaggttgaaggatcacctggggttagaagtttgagaccagtctggccaacatggtgaaaccccatctc

SEQ ID NO: 15868 - DNA, 81 bp, Homo sapiens
ggaaaccggcaggggtggcatctggtgactcaggcactgccctgcccacaccttcagtcactctctgctataatccttgcc

SEQ ID NO: 15869 - DNA, 109 bp, Homo sapiens
aaagatcttcaacagggcgtgcctatgactaattgggatagcaaatatatatattatttttgaaaatatagactcctaggcactgcttactggaattctgattttcttt

SEQ ID NO: 15870 - DNA, 69 bp, Homo sapiens
gaggtcacggaagaagagtatttgttgttttaagaatgagacatcagatatgtcttaagatgtgtcttc

SEQ ID NO: 15871 - DNA, 116 bp, Homo sapiens
gattgcagcagcagggagctcaagtaaggacatgggcaatcattctttctggtaagcaagtttggtgattttgttgaaatgatcttaagtgtggtggtgttgagtgctgagaattc

SEQ ID NO: 15872 - DNA, 91 bp, Homo sapiens
tctgaaagtgattgaagtcagaggggtattcaacagccagcactgtattgttggtccatgaatttttttgtttgaaatagagactttttga

SEQ ID NO: 15873 - DNA, 95 bp, Homo sapiens; identical to SEQ ID NO: 68

SEQ ID NO: 15874 - DNA, 93 bp, Homo sapiens; identical to SEQ ID NO: 69

SEQ ID NO: 15875 - DNA, 102 bp, Homo sapiens
agcttctcagagtgtatcacagagatcttgatgtgaacttttgtgtttcctcacatacacactcacatccactccctctctcccgacacacacttcctagct

SEQ ID NO: 15876 - DNA, 114 bp, Homo sapiens
aggagcatggccacaccccagatggaaggagcctgggtccctgagtcactgcctggaggacaggctgctgctgaggagcatcatttagactttatgggggtgagaaatgaactt

SEQ ID NO: 15877 - DNA, 110 bp, Homo sapiens
gcctcctgaatagctgggactatagtgtgcaccaccatgcccgcttagttttttattttttgcagagatggggggaaggtgggtggtcttgctgtgttgcccaggatggt

SEQ ID NO: 15878 - DNA, 104 bp, Homo sapiens
gcgggcatggtggtgcacactatagtcccagctattcaggaggctgaggttggaggatcatttgagcctgggaagttgaggctgcagtgagccatgattgtgtc

SEQ ID NO: 15879 - DNA, 100 bp, Homo sapiens
ttgctgggtcaaatgatatctctggttctaggtctttttttttttttttttttggagattgagtctcactttatcactcagactgttatttgtgcagtgg

SEQ ID NO: 15880 - DNA, 95 bp, Homo sapiens; identical to SEQ ID NO: 580

SEQ ID NO: 15881 - DNA, 93 bp, Homo sapiens; identical to SEQ ID NO: 69

SEQ ID NO: 15882 - DNA, 117 bp, Homo sapiens
gttatagtaacatttctttaaacattgttatatgtttaaatatatttaatatataaattaaacataatatatttaatatattaaatgtatttaaacattgctatatgttactataac

SEQ ID NO: 15883 - DNA, 113 bp, Homo sapiens
tcagtctgaagcatcagcactcccattttaataagatataaaatattctttctacccaattctttttttttttttttttttgagatggagtctctgtctgtcacccaggctgg

SEQ ID NO: 15884 - DNA, 95 bp, Homo sapiens; identical to SEQ ID NO: 68

SEQ ID NO: 15885 - DNA, 93 bp, Homo sapiens; identical to SEQ ID NO: 69

SEQ ID NO: 15886 - DNA, 95 bp, Homo sapiens; identical to SEQ ID NO: 68

SEQ ID NO: 15887 - DNA, 93 bp, Homo sapiens; identical to SEQ ID NO: 69

SEQ ID NO: 15888 - DNA, 95 bp, Homo sapiens; identical to SEQ ID NO: 68

SEQ ID NO: 15889 - DNA, 93 bp, Homo sapiens; identical to SEQ ID NO: 69

SEQ ID NO: 15890 - DNA, 76 bp, Homo sapiens
ggaggctgaggtggaaggatcagttcagcccaggaagtcaaggctgcagtgagctacgatcacttcactacactct

SEQ ID NO: 15891 - DNA, 111 bp, Homo sapiens
ttgaagtccttcctaataaatgactaagtgaggataccatattttctttttttttttaattaatttttttttgagatggagtcccactctgtcacccaggctggagtgcag

SEQ ID NO: 15892 - DNA, 106 bp, Homo sapiens
gtgtggtggcccatacctgtagttccagctacttgggaggctgaggtggaaggatcacttgagcctgggaggtcgaggctacagtgagctgatggtaccactgcac

SEQ ID NO: 15893 - DNA, 100 bp, Homo sapiens
taagactacaggcacagctcaccacacccagctaattttttcttttttgttttgagagatggggtcttgctctgatgttgtggctggccttgctgtgttg

SEQ ID NO: 15894 - DNA, 58 bp, Homo sapiens
tgagagggagtctcactctgtcacccaggctggagtgcagtggtgtgatctcagctca

SEQ ID NO: 15895 - DNA, 99 bp, Homo sapiens
cagaagcctggcatcaggtcctggggactggggctgccagtgggcacctccaggtgctggctgcctctgtccctgtcactgagtgccctgtccctggct

SEQ ID NO: 15896 - DNA, 78 bp, Homo sapiens
gcgaggtgcggaggactcaacatgctgtttctttcttttttgagatggggtctcagggtctccctctgtcacttaggc

SEQ ID NO: 15897 - DNA, 87 bp, Homo sapiens
gagaaataaaaatctgttgtttaagccatccagtcagggtattttgtgtggcagctggaggtaagacaacacctttaactatttttt

SEQ ID NO: 15898 - DNA, 104 bp, Homo sapiens
agttcaactgtgttgtaccatgtaatagtacttcaggtactaataaatgattattattcatttattgctgaatattccatcatatggctataccacattttact

SEQ ID NO: 15899 - DNA, 86 bp, Homo sapiens
agtccacaaattatttgatactttttcaaaatgtggtgtctaattccctccactcaagtgtagttagtgactgtagttagtgggct

SEQ ID NO: 15900 - DNA, 107 bp, Homo sapiens
tatatatatgggggaagaatgggaggtggctgaggtgtgtgcatatatatataatatattatattatatatatatacacaccatgtaatagtctctctatatatata

SEQ ID NO: 15901 - DNA, 115 bp, Homo sapiens
gtatttctatctccatgttgagctggaagtaagatttgttttagaagcagagtgttggttgtagagaatggattaaaaggggtcaagcttgatacagggagactggttaaggtat

SEQ ID NO: 15902 - DNA, 81 bp, Homo sapiens
gagagacaggaaagtgaggtcacaagggaggggggcaagggacagttgacccctaatttaacatcgcagcttctgaatctt

SEQ ID NO: 15903 - DNA, 97 bp, Homo sapiens
gagtgagtgaatgagtgactgagtgaatgaatgagtgagtgagtgattgagtgagtgagtgagtgagtcagtcagtcagtagactgttgactgatcc

SEQ ID NO: 15904 - DNA, 76 bp, Homo sapiens
aatagatgcaggcccaaggaataatcaaaggctgcaaaagcaagttggttgtttattttttgggtttttgtttgtt

SEQ ID NO: 15905 - DNA, 96 bp, Homo sapiens
ttgaagtgggaggatcacttgagcctgggaggtcacagtgagctgagatcatgccactgcaccccaggctgggtgcagagtaagaccctgtttcaa

SEQ ID NO: 15906 - DNA, 82 bp, Homo sapiens
tccatggggcctctctgtgtgcctgtggctcctctcctgtctctgataaggacacttgtgattgcatttagagtcccttgga

SEQ ID NO: 15907 - DNA, 96 bp, Homo sapiens
gggtgggattggatctgtgagaatattaagccctggaccactaaaagtgtctctctctgtttaacttggttgtttcactggctcctatatatacct

SEQ ID NO: 15908 - DNA, 74 bp, Homo sapiens
agcctccagaggggcttaggcaggtggatctgcccttgtgctgtatctaccactctgtctctctgattgaagct

SEQ ID NO: 15909 - DNA, 120 bp, Homo sapiens
gagactggagagtgcgaaaagaaactgtggcatgtatccctggctgcctctgtgccaggcttcgagttggtggcagttgcattcttttaccagggcctcagtgctatagggcagctgcag

SEQ ID NO: 15910 - DNA, 93 bp, Homo sapiens
gtgtatatatatagtatgtgtgtatatatatgtgtatatatgtgtatgtacacatatatatggtgtgtgtatatatatagtatgtgtatatat

SEQ ID NO: 15911 - DNA, 95 bp, Homo sapiens; identical to SEQ ID NO: 68

SEQ ID NO: 15912 - DNA, 93 bp, Homo sapiens; identical to SEQ ID NO: 69

SEQ ID NO: 15913 - DNA, 116 bp, Homo sapiens
catagttgcactacccagggatagacctgctaacatatctttctattcaagttatatatacatatatatgtctcatatatacacatatgtgaaggctaatactgagcgtcaacttg

SEQ ID NO: 15914 - DNA, 101 bp, Homo sapiens
tctaattcgatttggtggttcggctgcccgcggtgctttcaaagacgttttctgcagtcagaaaacacagcggtcatatcgaatcatgactgtcttttagg

SEQ ID NO: 15915 - DNA, 113 bp, Homo sapiens
ctgggaatgttggattgtctgaagttgaagcacagttttctctctgagccctctaaagaagtcttttagttgttgataatcaaatttgctccttcagaaactaaaattccaag

SEQ ID NO: 15916 - DNA, 122 bp, Homo sapiens
tgtgcctggccatatatatatatatatgtgtatatatatatatatatatatatgtgtatatatatatatatgtgtatatatatatatgtgtgtgtatatatatgctatatatatattttagc

SEQ ID NO: 15917 - DNA, 179 bp, Homo sapiens
atgtataaaaaacatttacttagaaatatatacaatgactacatatatgtatgtgtttgtatatatatacacatatatatgtgtatgtatatatgtgtgtatatgtgtgtgtatatatatgtgtgtgtgtgtgtatatatatatatatgcattatgtattagctacttaaataatgtgt

SEQ ID NO: 15918 - DNA, 80 bp, Homo sapiens
ggtcacagagctagtaggtagtagagttgggaattaaacccaggtttttctgtctacctgtaaagtctgtgttcttgacc

SEQ ID NO: 15919 - DNA, 64 bp, Homo sapiens
gggttgtttctccctcttggttattgtggttaatgctgctatgaacaggggtatggaggtatct

SEQ ID NO: 15920 - DNA, 88 bp, Homo sapiens
ggagtcttggtctgtcgcccaggctggagtgcagtggcgcaatcttggctcactgcaagctctgcctcctggcttcatgccattctct

SEQ ID NO: 15921 - DNA, 111 bp, Homo sapiens
tccgaaatcaataaagttgctgtatttacagaggtgagtaacttccgtcaactatttatatcatttaatttttttttttgagacggagtctcactctgtcaccagtctgga

SEQ ID NO: 15922 - DNA, 75 bp, Homo sapiens
acctgctttgctccatttctaaagcaagtttttttgttttttgaccataaaactagctgagaagcctagcatggt

SEQ ID NO: 15923 - DNA, 76 bp, Homo sapiens
caaggtgcgtgacatggatgcgaccatctggcgtgtgaatgcacagatctgtctgtgtgtgtatgtttgcatcttg

SEQ ID NO: 15924 - DNA, 112 bp, Homo sapiens
agattatcttgactatgcgggctcttttttggtgccatatgaaatttaaagtagttttttctaatccagtgaagaaagtcagtggtagcttgatggggatagcattgaatct

SEQ ID NO: 15925 - DNA, 81 bp, Homo sapiens
taacagaaaagctacaatgtgtttttgaaactataaagtgaatggtttcttgggaaaaattgtggatttgtatatctgttg

SEQ ID NO: 15926 - DNA, 82 bp, Homo sapiens
atatatacccactatatactatatatagtatatatataatatatagtataaatagcatatgtagtatttagtgtgtgtgtgt

SEQ ID NO: 15927 - DNA, 79 bp, Homo sapiens
tggcagagtcctgattttgttgcagtttcccaccctttcctagttgtgagcgaatcaggaaatttatatccctttgcca

SEQ ID NO: 15928 - DNA, 109 bp, Homo sapiens
ttgttgaattatttaagttacttatagattctgagtgtttgccctttgtaggatgtatagtttgcaaatattttctcccattctgcaggttgtctgtttagtttaatag

SEQ ID NO: 15929 - DNA, 103 bp, Homo sapiens
aggctttggtttgtttttgttttgtttttttgagatggagtctcactctgtcacccatgctggagtgcaatgacatgatctcagctcaccacaacctctgcct

SEQ ID NO: 15930 - DNA, 93 bp, Homo sapiens
ggaatatagtgcttactttccaaatagttgatgtctttaaaattatctgtttttaatttgaaagaagtcagtgttgttatagctctttatttc

SEQ ID NO: 15931 - DNA, 115 bp, Homo sapiens
tgcctaaatgaagcttacctaacacaagtgtttgtagggcatatcacagcctttttgtactcaggaacactagacagccctctagcactatgtttagggacaattttaaacagta

SEQ ID NO: 15932 - DNA, 82 bp, Homo sapiens
tattcagtaaatactttcccaagtgaaacaagttgttttttttttaaagcaccttgctattactttgaagtatttggggatg

SEQ ID NO: 15933 - DNA, 58 bp, Homo sapiens; identical to SEQ ID NO: 1725

SEQ ID NO: 15934 - DNA, 115 bp, Homo sapiens
atgtttaatacaccttatattttataaggctaagtatatatctgtaccttatattttatattttatataaggtatatatatatgcaccttataatatgttatataccttaaatat

SEQ ID NO: 15935 - DNA, 88 bp, Homo sapiens
gcctaaatgaattagagtggaaaggccatgggtcagagtgttggaagcactggcattttgagcagtttctccaccaattcttcaatgc

SEQ ID NO: 15936 - DNA, 85 bp, Homo sapiens
gttggaattctcttgcattaattggattaagcatatggaatctatattaagcaatgccttttaatgtagtccctagagtgctgac

SEQ ID NO: 15937 - DNA, 95 bp, Homo sapiens; identical to SEQ ID NO: 68

SEQ ID NO: 15938 - DNA, 93 bp, Homo sapiens; identical to SEQ ID NO: 69

SEQ ID NO: 15939 - DNA, 86 bp, Homo sapiens
ctagagcctgttcagagagagcagagtcctatgctgtattatctatgggataaatgctgcaagataaatctctcacatggttacag

SEQ ID NO: 15940 - DNA, 94 bp, Homo sapiens
tagggacttattctggttttactttgtttttttttttttttaaaaagaaagaaattaaaaatcttcaagtgaaaccacgactatggacttgccc

SEQ ID NO: 15941 - DNA, 76 bp, Homo sapiens
tccagtctgtgaccactgctatagatgactcttctttttttttgagacggagtctcgctctgtcactcaggctgga

SEQ ID NO: 15942 - DNA, 117 bp, Homo sapiens
tttttgcttaggattgtcttggctatatggctcttttatggttccatatgaaatttaaagtagttttttctaattctgtgaagaatgtcaaaggtagcttgatggggatagcaagga

SEQ ID NO: 15943 - DNA, 97 bp, Homo sapiens
tatatagctatataatagctctatatatatagctatataatagctctctatatatatatagctatataatagctctctctctatatatagctatata

SEQ ID NO: 15944 - DNA, 105 bp, Homo sapiens
cctaggcaacagaatgagaccctgtctcaaaaaaaaaaaaaaaaaaaaaaaagaaagaaagaaaaagaaaaaaatttgagagacagtctcactctgtcacccagg

SEQ ID NO: 15945 - DNA, 58 bp, Homo sapiens
tgagttggagtctcactctgtcactcaggctggagtgcagtggggcaatctcagctca

SEQ ID NO: 15946 - DNA, 97 bp, Homo sapiens; identical to SEQ ID NO: 1307

SEQ ID NO: 15947 - DNA, 88 bp, Homo sapiens; identical to SEQ ID NO: 1308

SEQ ID NO: 15948 - DNA, 81 bp, Homo sapiens; identical to SEQ ID NO: 1309

SEQ ID NO: 15949 - DNA, 77 bp, Homo sapiens; identical to SEQ ID NO: 1310

SEQ ID NO: 15950 - DNA, 98 bp, Homo sapiens
ctgttctgggtagcccgactggtaggtgaatcatccctttgcccagtatatctgtctatactctctgcctgtcacttagtagccttcccagttatcag

SEQ ID NO: 15951 - DNA, 117 bp, Homo sapiens
ttctctagatgtcctttgtctctgggagtgttaacgggaacaaatggtgttgctaatgaagtaaaattgtttttgtgttcaataattagattttagtacaaggaagatgacttagaa

SEQ ID NO: 15952 - DNA, 95 bp, Homo sapiens; identical to SEQ ID NO: 68

SEQ ID NO: 15953 - DNA, 93 bp, Homo sapiens; identical to SEQ ID NO: 69

SEQ ID NO: 15954 - DNA, 116 bp, Homo sapiens
tgttgcaaggggtggattggacactgagcttttgtacgcagaaaagaagttttattttactttttgaaacttttcattctgttgcatttttttcctgtttgaattttatgttgaca

SEQ ID NO: 15955 - DNA, 78 bp, Homo sapiens
ttttgcacatctttcttgagcttcttgtgttaaaattcaccacttcagtggtgagcagagtgagaaatgtgaacaaag

SEQ ID NO: 15956 - DNA, 90 bp, Homo sapiens
tgtgggtgttcacagcagcagtggtgacagtatggcacaagggatcaggggttctcactggtgactgtgtgtacattcacactgatggtg

SEQ ID NO: 15957 - DNA, 169 bp, Homo sapiens
gtatatatacatatgtgtatatatatgtgtgtatatacacacacacgtatatatgtatatatacatacatatacatatgtgtacatgtgtatatatacatgcatatacatatatgtatatatacatacatatatatgtgtgtatatatatattccatcatatgtatatg

SEQ ID NO: 15958 - DNA, 112 bp, Homo sapiens
ggattgacttggcgatgtgggctcttttttggttccatatgaaatttaaagtagttttttccaattctgtgaagaaagtcattggtagcttgatggggatggcattgaatct

SEQ ID NO: 15959 - DNA, 68 bp, Homo sapiens
ccatgaaccattgttggtcatggactagtaaactgttactagtctgtgatgagacagtacagaaatgg

SEQ ID NO: 15960 - DNA, 151 bp, Homo sapiens
tatatgtgtgtgtgtatatgtatatatacacatatatgtatgtatacatatatatgtatatatacacatacacacacacatatatatgtatatatatacctacatacatttatacatacatatataggtatacatatttacaagtacatac

SEQ ID NO: 15961 - DNA, 80 bp, Homo sapiens
atatatatgtgtgtgtgtatgtgtatatatacatatatatgtatacatacatatatgtgtatatatacatatacacacac

SEQ ID NO: 15962 - DNA, 81 bp, Homo sapiens
gctagcacaggtgctgtatgaatcattttctttcttttttttttttttgagatggattctcactctgtcactcaggctggt

SEQ ID NO: 15963 - DNA, 89 bp, Homo sapiens
aatcctgagcaagttacatagcctctctctgtgcctcagtttcctcattcataaagtggggactcaggaaggattggcctcctaggatt

SEQ ID NO: 15964 - DNA, 85 bp, Homo sapiens
gggtctcactgtgtcacccaggtttgaagtgcagtggtgtgatcacagctcactgcagcttcaaccccctggcttcaagagatcc

SEQ ID NO: 15965 - DNA, 115 bp, Homo sapiens
gggtaatgtgatgcctttatatatgtgtgtgcgtatatgtgtgtgtatatatatatatatacacacacatatacgcacacacacattattatatatacgcacacacacattattt

SEQ ID NO: 15966 - DNA, 66 bp, Homo sapiens
atgtgtgtgtgcgtatatgtgtgtgtatatatatatatatacacacacatatacgcacacacatat

SEQ ID NO: 15967 - DNA, 95 bp, Homo sapiens; identical to SEQ ID NO: 68

SEQ ID NO: 15968 - DNA, 93 bp, Homo sapiens; identical to SEQ ID NO: 69

SEQ ID NO: 15969 - DNA, 95 bp, Homo sapiens; identical to SEQ ID NO: 68

SEQ ID NO: 15970 - DNA, 93 bp, Homo sapiens; identical to SEQ ID NO: 69

SEQ ID NO: 15971 - DNA, 74 bp, Homo sapiens
atgtttgtaaacatatgaacatttgtatacaagcctttgtatgtttatatttgtatgcatatgtttatgaacat

SEQ ID NO: 15972 - DNA, 106 bp, Homo sapiens
gtgtgcatatatgtgtatatatacacgtgtgcatatatacatatgtgtatatatgtgtgtatatatatgtgcgtgtgtgtgtgtatatatatatatatatgaatat

SEQ ID NO: 15973 - DNA, 95 bp, Homo sapiens; identical to SEQ ID NO: 68

SEQ ID NO: 15974 - DNA, 93 bp, Homo sapiens; identical to SEQ ID NO: 69

SEQ ID NO: 15975 - DNA, 95 bp, Homo sapiens; identical to SEQ ID NO: 68

SEQ ID NO: 15976 - DNA, 93 bp, Homo sapiens; identical to SEQ ID NO: 69

SEQ ID NO: 15977 - DNA, 79 bp, Homo sapiens
acacagtgggcactcaataaatgtctgttgaattgaaatgcgttacattcaacgggtatttattgagcacccactctgt

SEQ ID NO: 15978 - DNA, 70 bp, Homo sapiens
tcttcactagaattttagttatatttggcagaataaagttttttattctataacttgcttttagtgaaga

SEQ ID NO: 15979 - DNA, 71 bp, Homo sapiens
cggcactcagactgaatcactcagcacatgtaactattaagtttgtgtttgaaggttctgggtgggtgctg

SEQ ID NO: 15980 - DNA, 117 bp, Homo sapiens
gtaacagataggagatggatgactatatttatgtgtgtgtgtgtatatatatattatatatgtatgtatacacacacaaacacacgtaaagaaacacatattctcacagattgttat

SEQ ID NO: 15981 - DNA, 96 bp, Homo sapiens
gccacgccagctttcttgtggttgttgtttgcttgaatttttttttttttttttagataggatctcactcagtcacacagtttggagtgcagtggc

SEQ ID NO: 15982 - DNA, 75 bp, Homo sapiens
cttcctgatgtctagattgtccggtgcccatgtcttagtgaaaggtacagcgacagaactaagagtgcagagaag

SEQ ID NO: 15983 - DNA, 69 bp, Homo sapiens
gtacaatgtgcagacattttaattcaatatgatggaattccatcaatattttattatgtttgccatgac

SEQ ID NO: 15984 - DNA, 104 bp, Homo sapiens
agtaagatgaagatttagttgaataatgataattagacaggtatatatatgtttacatatatatgtatatatttggattgattagtgacaacttttaaagtgct

SEQ ID NO: 15985 - DNA, 56 bp, Homo sapiens
tgtatatatgtatatatgtatacacacatatatgtatatatgtatatatgtataca

SEQ ID NO: 15986 - DNA, 56 bp, Homo sapiens; identical to SEQ ID NO: 15985

SEQ ID NO: 15987 - DNA, 94 bp, Homo sapiens
atatatgtgtgtatacatatatacatatacatatatgtgtatatgtatatatacatatatacatatgtgtgtatatatacatatatacatatat

SEQ ID NO: 15988 - DNA, 106 bp, Homo sapiens
atatatgtgtgagtgtatatatgtgtatatgtatatatatgtgtgtatatatgtgtgtgtgtatacatatatacatatatacatgtgtgtacatacatatatacat

SEQ ID NO: 15989 - DNA, 107 bp, Homo sapiens
ttgaaatgtgtgctttacttactttatatattgtctgtctctttatgtctgtatgttgatatagatgcaattagatatataaagtttcattgaagtgaataatttga

SEQ ID NO: 15990 - DNA, 71 bp, Homo sapiens
tagggttcttgtgctttctaaagagaaatatcccaggcctcagcactgtgtatctctgtcagtacacccta

SEQ ID NO: 15991 - DNA, 85 bp, Homo sapiens
ggaggctgttaggagggttgtggccttttagtggcttggtttgcatatacaaagtacacagtcaggtgagttatctcctatctcc

SEQ ID NO: 15992 - DNA, 79 bp, Homo sapiens
ctgctctgaacattgaagagcctgcaattcctgaagaatgacagtctctatcactgtgtacagttactgagaaatgcag

SEQ ID NO: 15993 - DNA, 73 bp, Homo sapiens
gcctgcagcaggaagttgaagttacttgtttctggtctaccagccatgttcctactctctgtgtgactctggc

SEQ ID NO: 15994 - DNA, 102 bp, Homo sapiens
ctgaacaaatgactcatttaaaattagtacagttaaggcatggtggattaaattctacttcttcttttttttttttttttgagacggagctctgttgtccag

SEQ ID NO: 15995 - DNA, 108 bp, Homo sapiens
catggccccagacactgtgattgtcactgtcaccgtgcattagatttgtctttttttttatttttatttttttgcgggatcacagagcacatagtctttggtgttttg

SEQ ID NO: 15996 - DNA, 127 bp, Homo sapiens
tatatatatatacctatatatacgtatatgtatatatacgtatatataggtatatatgtatatatatgtgtatatatgtatacacataggtatatatatacttatataggtatatatatatatatat

SEQ ID NO: 15997 - DNA, 95 bp, Homo sapiens; identical to SEQ ID NO: 68

SEQ ID NO: 15998 - DNA, 93 bp, Homo sapiens; identical to SEQ ID NO: 69

SEQ ID NO: 15999 - DNA, 71 bp, Homo sapiens
gtgagtgagtgagtgagtgagtgagtgagtgaattagcatggcttcacgggcactttgcttggctcctcgc

SEQ ID NO: 16000 - DNA, 76 bp, Homo sapiens
gggtgaggcgaggagccaagcaaagtgcccgtgaagccatgctaattcactcactcactcactcactcactcactc

SEQ ID NO: 16001 - DNA, 117 bp, Homo sapiens
tgttgtttgctgggttggttgctatgggaacattattgctcatggtcctggcatccttggggccaggtaacacaagaagaagatggatgcctgggtggagagacagacagacacaca

SEQ ID NO: 16002 - DNA, 118 bp, Homo sapiens
accagcagcatcagcattccctgagcctcatcccagaccgacagaatctgcatctgcatgtaaaaaagattcccgggtaatttgcaaggatattgaagtttgagatgctgtggtggtg

SEQ ID NO: 16003 - DNA, 115 bp, Homo sapiens
aagaccaggtggcttaaagagaagacacttatttttttgctgattctagaggccagaagtctgagatcaaggtgtcagctgggttacttccttccaaagcccctctccttggctt

SEQ ID NO: 16004 - DNA, 111 bp, Homo sapiens
gaaggtggggtgggtagggaatgactaacattattgagcactatatgtatgtatatatgtatatgccagggattgtgctaagtactttccacatatatttatgtcatctgc

SEQ ID NO: 16005 - DNA, 111 bp, Homo sapiens
tatcagttaaaataagcaagccaccgttgtcatgaggtattaatgtgctagttcaagcatttaaaattattttttgatcatgtctgtgagccctgagtttggaatatggtg

SEQ ID NO: 16006 - DNA, 64 bp, Homo sapiens
tgtatgtactatgtatatatgtattatatgtattagagatatggtgcatatgtatgtacacaca

SEQ ID NO: 16007 - DNA, 100 bp, Homo sapiens
tcctaaaagtactgtctatgtaattaacattattttaggtatttcattatgattataattcttaggaatgaaaatagtgttttacaaaagcagttatgga

SEQ ID NO: 16008 - DNA, 58 bp, Homo sapiens
tgagacagcatctcactctgtcgctcaggctggagtgcagtggcgagatctcaactca

SEQ ID NO: 16009 - DNA, 84 bp, Homo sapiens
ggcataggcagcactagagacatgagagttgattgtgatcacataaatcacaattacttatttgtcagacggcaggcagaggtc

SEQ ID NO: 16010 - DNA, 82 bp, Homo sapiens
tgggggtgaagtgaatagactgtgagcacacatcttgaatcccaccacttgatgtgtgtgctttgtcactctctcatcgtca

SEQ ID NO: 16011 - DNA, 115 bp, Homo sapiens
tatattcttagtgtcttatccattcagctggagaatgaaaaaacagataatttttttttttcaagttcaatagctcttggggataagtggtttttggttacatggatgaattgta

SEQ ID NO: 16012 - DNA, 171 bp, Homo sapiens
gtgtgtgtgtgtcagagagagatatgtagatactttgtgtgtgtggttgtgatatacatgtatgtatatattttgagatccctatgtatgtgtgcttgtgatatatatatgtttacatatgtgcatatataacatacatatatacacatacatactacagaattatttgca

SEQ ID NO: 16013 - DNA, 279 bp, Homo sapiens
atatatatgtatatatacatatgtatgtatatatgtatgtatacatatgtatgtatatatgtatatatatgtatatgtatatatgtatatatgtatatatacatatgtatatgtatatatgtatatatacatatgtatatgtatatatgtatatatacatatgtatatgtatatatgtatatatacatatgtatatgtatatatgtgtatatatatgtatatgtatatatgtatatatatgtatatatacatatgtatatgtatatatgtatatataca

SEQ ID NO: 16014 - DNA, 102 bp, Homo sapiens
tatatatatatgtgtgtctatgtgtgtgtgtgtatatatacatatatacatatacatatgtatatatacatatatatacatatatacatatacatatatata

SEQ ID NO: 16015 - DNA, 116 bp, Homo sapiens
ttgtgaaatacattgtatgtttatgtatacatgtatgtgtgtgtagatatatgactaaattaatacatatatttatttatacatacccattcagatgtatagacaatgttaaaagc

SEQ ID NO: 16016 - DNA, 95 bp, Homo sapiens; identical to SEQ ID NO: 68

SEQ ID NO: 16017 - DNA, 93 bp, Homo sapiens; identical to SEQ ID NO: 69

SEQ ID NO: 16018 - DNA, 95 bp, Homo sapiens; identical to SEQ ID NO: 580

SEQ ID NO: 16019 - DNA, 93 bp, Homo sapiens; identical to SEQ ID NO: 69

SEQ ID NO: 16020 - DNA, 74 bp, Homo sapiens
caaatcactcagactctgtcactgactgggaaatcctccccacatcccagagcacagggagcttgagtggtttg

SEQ ID NO: 16021 - DNA, 87 bp, Homo sapiens
ggattgcagacagagtctccctcactcagtgctcaatgttgcccaggctgaagtgcagtggcgtgatctcggctcgctacaacctcc

SEQ ID NO: 16022 - DNA, 73 bp, Homo sapiens
tgtatctctcaaaaggtggtgctgaataggagtgttctatctctgtcagctcatcagcctctggggaagtaca

SEQ ID NO: 16023 - DNA, 117 bp, Homo sapiens
ctgtgtcttttaattggagaatttagcccttttacatttaaggttaatattgttatgtgtgaatttgatcttgtcattatgatattagctggttattttgctcattagttgatgcag

SEQ ID NO: 16024 - DNA, 116 bp, Homo sapiens
ggtggtgtggtcagcgcactgggctctgcgtctgtgtgatggtgggccagacagttaacctctctgtgtctctatttcttcactggcgaatgggggcactagcagcccccacctcc

SEQ ID NO: 16025 - DNA, 56 bp, Homo sapiens
tgtgcctgtgatcccagctactcaggaggctgaggtagaaggatcatttgagccca

SEQ ID NO: 16026 - DNA, 99 bp, Homo sapiens
gcccaccccccacccatcagcctgagcagagcccaccctctgagtcacccactcacacagccaccgcgtcttatcacagctgatgatggtcttcaaggt

SEQ ID NO: 16027 - DNA, 82 bp, Homo sapiens
ctgggattacaggcgtgagccaccgcaccctgccgaaaaaaacttttttttttttgagacggaggctcgctctgtcccccag

SEQ ID NO: 16028 - DNA, 93 bp, Homo sapiens
gactagctgggattacaggtgtgctccaccacacctgactaattttgtatttttagtagggtccagggtttcaccatgttgaccaggctggtc

SEQ ID NO: 16029 - DNA, 95 bp, Homo sapiens
caagaccatctgcagagtggactggcttcaagtttttttttttaattaatcacccttatagttagaatttgttttgcagttgcatgtttatcttg

SEQ ID NO: 16030 - DNA, 88 bp, Homo sapiens
gggctcctgtttgtagctagataaggttaactttgtttttctttttttttgagacggagtttcactcttgttgcccaggctggagtgc

SEQ ID NO: 16031 - DNA, 76 bp, Homo sapiens
atatatatatatataatttcaccacaataaaaactttaatgcaagtttttatgtatgcatgtatgtatgtgtatgt

SEQ ID NO: 16032 - DNA, 65 bp, Homo sapiens
ttgcaacggagtctcactctgtcacccaggctggagtacagtggcgcgatcttggctcactgcaa

SEQ ID NO: 16033 - DNA, 111 bp, Homo sapiens
gtgtcaggtttctccattgtggagttactccatacagtatagagagtgcacttgcatgctgtacttttcatgctgtactttttggaaggaagtcactatgcaaacccccac

SEQ ID NO: 16034 - DNA, 94 bp, Homo sapiens
acttcagagtgaatgacaggaaagctggccactctcatttcttaatttttttttttttttagagacacggtcttgctgtcactccggctggagt

SEQ ID NO: 16035 - DNA, 58 bp, Homo sapiens
tgagacagagtctcgctctgtcactcaggctggagtgcagtggtgcgatcttggctca

SEQ ID NO: 16036 - DNA, 82 bp, Homo sapiens
gactgccatgtctcatatgtcactgtgtatctgtctccaacagagtgtttgcatattgtacataatggattaattgcatgtc

SEQ ID NO: 16037 - DNA, 120 bp, Homo sapiens
tcagtgtactgatttttgtgtgttgattttggatcctacaactttactgtatttgtttatcttaacagttttttggtggagtctctggggttttctatatataaggacacgttattggca

SEQ ID NO: 16038 - DNA, 75 bp, Homo sapiens
gctgggcttggtggtgcactcctttagtcccagctgctcaggaggctgaggtaggaggatcacttgagcccgagc

SEQ ID NO: 16039 - DNA, 119 bp, Homo sapiens
gggattacaggcctgagccacggtgcccagcctgaagtatggttttattcagtggctcccttacactgtctgtctctgtctcggctgcccgctctggctctgagtctcctgtcgctccc

SEQ ID NO: 16040 - DNA, 70 bp, Homo sapiens
tttttttgaaacagggtctcactctgtcacccaggttggaatacagtgatgtgatcttggctcactgaaa

SEQ ID NO: 16041 - DNA, 68 bp, Homo sapiens
ttgttgtttcgagacagtctcactcactctgtttcctgggctagagtgtagtggcatgatcacagcag

SEQ ID NO: 16042 - DNA, 58 bp, Homo sapiens
tgagactgagtctccctctgtcacccaggctggagtgcaatggtgtggtctcagctca

SEQ ID NO: 16043 - DNA, 74 bp, Homo sapiens
aggaagggatttgattttttttcttagaaaacttttgagtttcaaagtttggaaggggaaaataatgccttttt

SEQ ID NO: 16044 - DNA, 77 bp, Homo sapiens
gaggcggaggttacagtgagccaagatcatgccattcattgcactccagtccaggcgacacactgagactctgtctc

SEQ ID NO: 16045 - DNA, 78 bp, Homo sapiens
ttcataaaacacacaaatgtaaatgtgtgtgtgtatatatatgtgtatatatacattttgtttttgttttgagatgga

SEQ ID NO: 16046 - DNA, 77 bp, Homo sapiens
tctgtgtctcctatatttgatagtttatgctgaaaggggtcagcgtaaattattatttttaaattaggaaatacaga

SEQ ID NO: 16047 - DNA, 103 bp, Homo sapiens
gtttccaagcggtcttatctgtgttttactgtctgctctttctggctgcttgtagttagaagagaagtgatttccttgaaatgcatgaggctagaaagggagc

SEQ ID NO: 16048 - DNA, 112 bp, Homo sapiens
gggagtttcaatgaatagagcatacagttggaggagctgtggggcagagaagagacttagtacactgcggtgagccagcatgtctttgatgttatcggttgaataaactgtt

SEQ ID NO: 16049 - DNA, 104 bp, Homo sapiens
tgtgtgtatatgtacacatatatatacatacatatgtgtatatatgtgtatatatatgcatatatatacacatatgtatatatatgtgtgtatatatatataca

SEQ ID NO: 16050 - DNA, 105 bp, Homo sapiens
tggagataaggatggaatggcaaggcaattctctctctcttttttttttttttaccaaaaaaggggggaaaaaggatattagttttgttatcttcctcaattaca

SEQ ID NO: 16051 - DNA, 69 bp, Homo sapiens
tacttttgagacagagtcccactctgtcacccaggctggagtgcagtggtgtgatcttggctcattgta

SEQ ID NO: 16052 - DNA, 98 bp, Homo sapiens
gcatgatggcacatgcctgtagtctcagcttctcgggaggctgaggtaggaggatcacttgagccagggaagttgaagctgcagtgagccacgattgc

SEQ ID NO: 16053 - DNA, 58 bp, Homo sapiens; identical to SEQ ID NO: 47

SEQ ID NO: 16054 - DNA, 80 bp, Homo sapiens
gccatcctaggtgctatttctagctgtcaatattttctttaatatgtagcacccagaaagaagtaccacattgaggaggt

SEQ ID NO: 16055 - DNA, 78 bp, Homo sapiens
ggcaccagtgtctctgtctgtcaaattcctggggtcacttgccaagtttttgttgcatctcattggagagaaagtgcc

SEQ ID NO: 16056 - DNA, 58 bp, Homo sapiens; identical to SEQ ID NO: 3380

SEQ ID NO: 16057 - DNA, 118 bp, Homo sapiens
cctacattgcttcagtatttgggaatatctccactggcatcatttctttttattttaaaaaaataggttatctataaagattttatatgcctcagaacatccttgaagcaattaacgg

SEQ ID NO: 16058 - DNA, 95 bp, Homo sapiens; identical to SEQ ID NO: 68

SEQ ID NO: 16059 - DNA, 93 bp, Homo sapiens; identical to SEQ ID NO: 69

SEQ ID NO: 16060 - DNA, 70 bp, Homo sapiens
gtgtgtgtgtgtgtgtgtatgaatatgtatcgtgtgggcacgtgtgtgtctgtgtgtgccacgtgcatgc

SEQ ID NO: 16061 - DNA, 95 bp, Homo sapiens; identical to SEQ ID NO: 68

SEQ ID NO: 16062 - DNA, 93 bp, Homo sapiens; identical to SEQ ID NO: 69

SEQ ID NO: 16063 - DNA, 84 bp, Homo sapiens
tatatatgtatgtatatgtatatattatatgctatatgtataggtgtgtgtatatatatagcatatgtgtgtgtatatatatat

SEQ ID NO: 16064 - DNA, 100 bp, Homo sapiens
gaaaggatgaaagaagagaaaaaatcgagtttgggtaaaccttgaaaagttctttaggtgtgcatttttttttttttttttttttttttgcatctgaatc

SEQ ID NO: 16065 - DNA, 114 bp, Homo sapiens
agatttaaaggggtgtcaggcttataggcatttttatgtatttaattataaacactttgtatggctatttctaaaatctgcatttgctttcttaaggttaattcctttagttct

SEQ ID NO: 16066 - DNA, 100 bp, Homo sapiens
gcttgagtgtgagacctgtttcctgccaggaccttgactgactcaacacatatacagaagagattgagcagagttctacagatctcacagccctccctgc

SEQ ID NO: 16067 - DNA, 58 bp, Homo sapiens
tgagacaggctctcactctgtcgcctaggctggggtgcagtggtgcaatcttggctca

SEQ ID NO: 16068 - DNA, 100 bp, Homo sapiens
acacacacatatatacacatatacatatatacacatatgtgtatatatatgtgtgtgtctgtgtatgtatatatatatatatatatatgtatgtatatat

SEQ ID NO: 16069 - DNA, 117 bp, Homo sapiens
catacatatatatatatatatatatacatacacagacacacacatatatatacacatatgtgtatatatgtatatgtgtatatatgtgtgtgtatatatattcttctgtaatatata

SEQ ID NO: 16070 - DNA, 108 bp, Homo sapiens
tgatcatgccactgcactctagtctgggtgcagagtgagtctgggtgtaggatgcagagagaccctgtctcactctgccacccagactagagtgcagtggcatgatca

SEQ ID NO: 16071 - DNA, 58 bp, Homo sapiens; identical to SEQ ID NO: 3380

SEQ ID NO: 16072 - DNA, 97 bp, Homo sapiens
tgctatcatgtagagtaggtattttttacagattgaaggttgataaattttttaatacttttgagagagaaaactatctgtgtatacacatgaagta

SEQ ID NO: 16073 - DNA, 76 bp, Homo sapiens
ggaggctgaggtggaaggatcacttgaggccaggagctcaaggctgaagtgagccatgattataccactgcactcc

SEQ ID NO: 16074 - DNA, 113 bp, Homo sapiens
acttaggaaataaacattttgtgtgtgtgtgtatatgtatgtgtttatatataatatatgtatgtatgtatgtatatgcataaaatatactgcaatagagaaacttttaaagt

SEQ ID NO: 16075 - DNA, 118 bp, Homo sapiens
ggattttcaagttgatcaatgagcattggcttccacttaaagtcaccagctgcattagcctctaacaagagagtcagctctgttctttggagctttaaagccaggcattaacttctcc

SEQ ID NO: 16076 - DNA, 117 bp, Homo sapiens
ttggttggatgacagtattcttaaatgagactggaggtcagtgaaaagggaagtcaagaatttatttatttatttatttttaattgagatagagtctcactctgtcgcccaggctgg

SEQ ID NO: 16077 - DNA, 111 bp, Homo sapiens
ggctacccttagttttaatgctttactttactttgttgttattaaaaagtttattttttacatgaggttattagtttttcaataatgttcttcagctttagagagggtacc

SEQ ID NO: 16078 - DNA, 86 bp, Homo sapiens
gagaactcttcctatgatatttgagcaatagtaaagtatgttaatactttgaaccattctatctcaagctgctagaaagaggtttc

SEQ ID NO: 16079 - DNA, 122 bp, Homo sapiens
tgtatccctgaatctatatatatgtgtgtgtatatatgtgtctgtatatatatttatatatatacatatatatgggatatatacacacatgtatgggatatatgcatacacatatatatagg

SEQ ID NO: 16080 - DNA, 117 bp, Homo sapiens
ggttatgctcattttgcagatggggacattgaagcacagagagatgaatgaatgaatgaatgaatgaatgaatggacagtttggccccaaagctcagggtcttcgaaatgagagact

SEQ ID NO: 16081 - DNA, 105 bp, Homo sapiens
ttgctttgtgtctatagtcagcagatgatggatactaattataattttacatattttaatttacacattatttgcattcgattatatttcagatacaaactgtaa

SEQ ID NO: 16082 - DNA, 62 bp, Homo sapiens
gaggtctcactctgtgactcaggctggagtgccgtggtgtgatcacagctcactgcaacctc

SEQ ID NO: 16083 - DNA, 80 bp, Homo sapiens
gcgagacctgagcaccagggctgccactggccttgcagacagagctcagtcagctgttcctgggctttgggtccctttgc

SEQ ID NO: 16084 - DNA, 95 bp, Homo sapiens
tgtcttgcaaaaaaatttacatatatgtatgtgtatatatatatgtatgtgtgtatatatatatacatatatgtatgtatataaatggcttcaca

SEQ ID NO: 16085 - DNA, 83 bp, Homo sapiens
agtgacttacaataaggggaaaaagtaactgctaactaaagaaaacagatgagttttctcagttcactttctgtcccctcact

SEQ ID NO: 16086 - DNA, 95 bp, Homo sapiens; identical to SEQ ID NO: 5211

SEQ ID NO: 16087 - DNA, 110 bp, Homo sapiens
gggcacaggaagagttttggggatgcctggaaaagttctctatttttaaatatatagttatttgtagaggacttgttttatataattcattaagatgtgtgtatgtgtgt

SEQ ID NO: 16088 - DNA, 87 bp, Homo sapiens
gggggctcatggacagagggcttgggaagaagcagatctgggcgacaccagacaggccatgtcactctctgaccctctgtctcctcc

SEQ ID NO: 16089 - DNA, 119 bp, Homo sapiens
gctcaaagagaggtaagaggtggggtcaaatgaaaggggtccagtgatatgtaaagaagattctgtttgtggggttacttcctggaaagacattctgcctccttttggccttgtggctt

SEQ ID NO: 16090 - DNA, 95 bp, Homo sapiens; identical to SEQ ID NO: 68

SEQ ID NO: 16091 - DNA, 93 bp, Homo sapiens; identical to SEQ ID NO: 69

SEQ ID NO: 16092 - DNA, 127 bp, Homo sapiens
tccagcattgttctttttgcttaggattgtcttggctatatgggctcttttttggttccatatgaaatttaaagtagttttttctaattctgtgaagaaagtcaatggtagcttgatgaggatagca

SEQ ID NO: 16093 - DNA, 82 bp, Homo sapiens
ttgtgtgtatatatgtggctatatatatatatatatatatatgctatatatatatgtgtgtgtgctatatatatatatatag

SEQ ID NO: 16094 - DNA, 114 bp, Homo sapiens
ttctaaggcatgattgattattttcagatctgacaactcaaaagtgtttatgaacatgtcattatatttcattttactttgagacaaggtctcgctctgttgcccacgctagag

SEQ ID NO: 16095 - DNA, 84 bp, Homo sapiens
gatgtcttcctctgactcagtgtcctgtcttaaaatgtcatggtgcattgatgaagaagagtgagagtcagagagagagatgtc

SEQ ID NO: 16096 - DNA, 74 bp, Homo sapiens
tctctctctgactctcactcttcttcatcaatgcaccatgacattttaagacaggacactgagtcagaggaaga

SEQ ID NO: 16097 - DNA, 154 bp, Homo sapiens
gtatatctgtatacatgtatatagatatattcatgtatatttatatacatgcatatagatatattcatgtgtatttatatacatgcatatagatatattcatgtgtatttatatacatgtatatagatatattcatgtgtatttatatacatga

SEQ ID NO: 16098 - DNA, 95 bp, Homo sapiens; identical to SEQ ID NO: 68

SEQ ID NO: 16099 - DNA, 93 bp, Homo sapiens; identical to SEQ ID NO: 69

SEQ ID NO: 16100 - DNA, 58 bp, Homo sapiens; identical to SEQ ID NO: 7432

SEQ ID NO: 16101 - DNA, 88 bp, Homo sapiens
tactgtaacacagacatatgtttatcagttttcaaattatcttaggttagaagctggagtctgtgacaatctgtgtctggatgtggta

SEQ ID NO: 16102 - DNA, 64 bp, Homo sapiens
tgtatgtatgtgtgtgtgtgtgtgtgtgtgcatgcacatgtgcatatatatctatatatatgca

SEQ ID NO: 16103 - DNA, 74 bp, Homo sapiens
gtacagttttaggtggtagaaacagaatctgaccctggattctgcaaccctccctgtttcccactgcactgttc

SEQ ID NO: 16104 - DNA, 104 bp, Homo sapiens
aggccaagtctgcaactccgtgttctaggtgtcagtgtttgtgttcagggtcaggtgacacagacagagagacagacattgagagagagagggagaatgagcct

SEQ ID NO: 16105 - DNA, 70 bp, Homo sapiens
ggtcagtgcttcagcgagagaagttctgtatttatttttgagacagggtctcactctcagtctgttgacc

SEQ ID NO: 16106 - DNA, 59 bp, Homo sapiens
tgagatgggagtctcactctgtcacccaggctggagtacagtagtgtgatcttagctca

SEQ ID NO: 16107 - DNA, 58 bp, Homo sapiens; identical to SEQ ID NO: 2540

SEQ ID NO: 16108 - DNA, 90 bp, Homo sapiens
ccaggggttctcaggtggcatcaggtgattttttttttctttttttttttttttttttgagacggagtctcactctgtcacccaggctgg

SEQ ID NO: 16109 - DNA, 136 bp, Homo sapiens
gtgtgtatgtatatctgtgtgtatatatatatctgtgtgtatatatgtatatatatctgtgtgtgtgtatatatatataatatcatgtgtgtgtatatatatacatatcacgtgtgtgtatatatatgcacacaca

SEQ ID NO: 16110 - DNA, 127 bp, Homo sapiens
tcgtgtgtgtgtgtgcatatatatacacacacgtgatatgtatatatatacacacacatgatattatatatatatacacacacacagatatatatacatatatacacacagatatatatatacacac

SEQ ID NO: 16111 - DNA, 80 bp, Homo sapiens
gaggagggagcggttgagacagggtctcactgtcgctcaggctggagttcagtggcagtatctcaactccctacaacctc

SEQ ID NO: 16112 - DNA, 94 bp, Homo sapiens
attgtacatgttcagtctgatgcttttgaattctttgtttttttttttttcagagggagacagtgtctttctgttgcccaggctgaagtgcggt

SEQ ID NO: 16113 - DNA, 77 bp, Homo sapiens
ccacttggtgtgtcttgtggtgggcatttaaaacttttttttgaataaataagtgaacctttagacatgctgtcagg

SEQ ID NO: 16114 - DNA, 58 bp, Homo sapiens
tgagactgagtctcgctctgtcacccaggctggggagcagtggcgctttctcagctca

SEQ ID NO: 16115 - DNA, 58 bp, Homo sapiens
tgagagagggtctcactctgtcacccaggctggagtgcagtggcatgatcttgtctta

SEQ ID NO: 16116 - DNA, 96 bp, Homo sapiens
ttctgaagggaaggagggggagtactgagattagtgttggcatggggcttaccataccaataaatttgtatctttatttctatcatttgtaaagaa

SEQ ID NO: 16117 - DNA, 113 bp, Homo sapiens
tcattttaaaacatctaatttcccatctgtaatatatataacacaatttattttttctctaaaaatttaggagtttgtatgtgtgtgtcacagaaagatattagttttattga

SEQ ID NO: 16118 - DNA, 95 bp, Homo sapiens; identical to SEQ ID NO: 68

SEQ ID NO: 16119 - DNA, 93 bp, Homo sapiens; identical to SEQ ID NO: 69

SEQ ID NO: 16120 - DNA, 70 bp, Homo sapiens
cctgaatagaacaaaaaggcaggggaagggagaattccctctctctctctgcctatctgtttgagttggg

SEQ ID NO: 16121 - DNA, 94 bp, Homo sapiens
tacgtatatagataaatatatacatatatagatacatgtatataagtatatatatatatatatagtatacatatgtgtatatactatgtatgtg

SEQ ID NO: 16122 - DNA, 95 bp, Homo sapiens; identical to SEQ ID NO: 68

SEQ ID NO: 16123 - DNA, 93 bp, Homo sapiens; identical to SEQ ID NO: 69

SEQ ID NO: 16124 - DNA, 106 bp, Homo sapiens
ttgtcttaggatttggaagtggataaaactggttttttaaaaatgtttttatttgtaagaacagttgaaagttgcagctatttggagactatttttgaatttacaa

SEQ ID NO: 16125 - DNA, 141 bp, Homo sapiens
acacataggataggtatacactatatatatattgtatatacataagatatatatacacatatacatgtatatatctatatatattcatatatattccatgtgtatatatacatgtatgtatctgtatatatccatatatat

SEQ ID NO: 16126 - DNA, 58 bp, Homo sapiens; identical to SEQ ID NO: 5218

SEQ ID NO: 16127 - DNA, 107 bp, Homo sapiens
aatatattttggtcctatacataggtatgatggagctaactctcactggctcagtagagctgataatgggtatctcttcctaactctgtgttcagtgacattatgtt

SEQ ID NO: 16128 - DNA, 116 bp, Homo sapiens
agtggttgtttgtactgcgtggttttgaggggggttaagaatagcaagtccaagtacattattattatttcaaccttctcttgaaaagaaaatgccatgcagtgtatgcatttgct

SEQ ID NO: 16129 - DNA, 58 bp, Homo sapiens; identical to SEQ ID NO: 293

SEQ ID NO: 16130 - DNA, 95 bp, Homo sapiens; identical to SEQ ID NO: 68

SEQ ID NO: 16131 - DNA, 93 bp, Homo sapiens; identical to SEQ ID NO: 69

SEQ ID NO: 16132 - DNA, 89 bp, Homo sapiens
aaacgtgcctcaatataatgttgtgtttttgtagataacatacaagggtcactatgagaaacatgggcattatgtttttaagtgtgttt

SEQ ID NO: 16133 - DNA, 78 bp, Homo sapiens
ataggcctgtgccactaggcctgactaatttttgtatttttcatagggatggggtttcactgtgttgcctaggcttgt

SEQ ID NO: 16134 - DNA, 109 bp, Homo sapiens
catattgatttgctttcttttggttatatgctcagcagtgggattgctaaataatatggtagttctatttttgtttttttgagaagtctccatacagtttttcatagtg

SEQ ID NO: 16135 - DNA, 89 bp, Homo sapiens
tgttgcttgttaggatatctagggaaaatagactgtgaaggcacagctattgacttcctagtttatttatctaaataattgaagcaata

SEQ ID NO: 16136 - DNA, 85 bp, Homo sapiens
ctgttgttctccacacagcagagtgttcctttatttatttattgagacagggtcttgctctgttgcccaagctggagtgcagcag

SEQ ID NO: 16137 - DNA, 79 bp, Homo sapiens
agagatgggagtctcactctgccactcaggttggagtgcagtggtgcgaccatagctccctacactctaagttctgggc

SEQ ID NO: 16138 - DNA, 85 bp, Homo sapiens
gcagaaaagatatacatatatgtatatatatatacacacacatatatgtacacacatatatgtatatatttgtgtgtgtgtgtgt

SEQ ID NO: 16139 - DNA, 112 bp, Homo sapiens
catggtaccaagatatttggtcaaatattattctggatgtttctatgaaagtatttttttagatgagattaacatttaaaatggtaaactgagtaaagcacttgaacaagtg

SEQ ID NO: 16140 - DNA, 112 bp, Homo sapiens
tctagtaactatgacagtccatggcacatggtaggtactcaataactgttaggtattctagcttttatttttagcccctcaccattttgttcaggatattgcagtaagtgga

SEQ ID NO: 16141 - DNA, 95 bp, Homo sapiens; identical to SEQ ID NO: 68

SEQ ID NO: 16142 - DNA, 93 bp, Homo sapiens; identical to SEQ ID NO: 69

SEQ ID NO: 16143 - DNA, 103 bp, Homo sapiens
gataatattggaagtatacactgagtatgtatatgtgtgtgtgcatatatatgtatatacatatatacacatataatgtgtatactccgccttcaatcttatc

SEQ ID NO: 16144 - DNA, 91 bp, Homo sapiens
gatgtccttcactgtctctctgagtctcattcttgacaccgtcctgtggtgtaactagggaaagactatttaagagagatttggagatatt

SEQ ID NO: 16145 - DNA, 92 bp, Homo sapiens
tgatagagtgagactccgtcttaaaaaaaaaatccaatttatttaatttattaatttaatttaattttacgagacagagtctcactgtgtca

SEQ ID NO: 16146 - DNA, 105 bp, Homo sapiens
gagcatagaaggaaataaacactagctgcaggtaaaagtgcaagtactgcagtgaaatttgtcattatttatcaaacagctaaaaatgtgtattttctttttctt

SEQ ID NO: 16147 - DNA, 110 bp, Homo sapiens
acatagttagggggctaagtgtgctagttcaaatctctcttcctcttcttcttcttttttttaatttataaagataagaggtttctttggcccacagttctgcaggatgt

SEQ ID NO: 16148 - DNA, 95 bp, Homo sapiens; identical to SEQ ID NO: 68

SEQ ID NO: 16149 - DNA, 93 bp, Homo sapiens; identical to SEQ ID NO: 69

SEQ ID NO: 16150 - DNA, 74 bp, Homo sapiens
gctccaaggagagagaggggaaaccaagcactcccatgcacccatgggagggtccctgccaccctgctgtgagc

SEQ ID NO: 16151 - DNA, 92 bp, Homo sapiens
tataagattgcaaccactattagtatatatatatatactatgtggttgtatatatatatataagtatatatatattatatatatatatacta

SEQ ID NO: 16152 - DNA, 119 bp, Homo sapiens
agttagctgggcatggtggcggatgcctgtagttccagctactcgggaggctgaggtaggaggatggtgtgaacccgggaggtggagcttgcagtgagccaagatagcaccactgcact

SEQ ID NO: 16153 - DNA, 93 bp, Homo sapiens; identical to SEQ ID NO: 69

SEQ ID NO: 16154 - DNA, 106 bp, Homo sapiens
gaaggtatctgaagtagatgataaagatataaaatgtgtaacgtaattgacagtcttcaaatagttattctttttttattttattttatttattttatttattttt

SEQ ID NO: 16155 - DNA, 107 bp, Homo sapiens
gagtagctaggactagaggcatgcaccaccagaccaagctaatttttattttttgtacagataggctcttgctttgttgcccaggctggtctcgaactcctggcctc

SEQ ID NO: 16156 - DNA, 135 bp, Homo sapiens
ggtgatttgttttagatgaggtctcgagggtggtgccccatagcccttataaatagagacaccagagagagttctctctcccttgtgcacagagaagaggtcatgtgagtacacagtgagaaggtggctacctct

SEQ ID NO: 16157 - DNA, 111 bp, Homo sapiens
agctttgttctttttgcttaggattgtcttggctatatgggctccttttttggttccatatgaaatttaaagtagttttttctaattctgtgaagaaagtcaatagtagct

SEQ ID NO: 16158 - DNA, 90 bp, Homo sapiens
tgtaatgacctctggcagatgtcactgatcacttgggagacagaatttttccacttcaatccatcttcatttatgtccttggtcattgca

SEQ ID NO: 16159 - DNA, 73 bp, Homo sapiens
tcctgcagcaggtgagctgtggccagagcccaaggatgaagggggctccctcactctgtgactgtgaagagga

SEQ ID NO: 16160 - DNA, 146 bp, Homo sapiens
atgttataagatacatacatacatattttatatattttttatatatacacatatatacatattttatattttttatatataaatatatataatggtatacatgtatatacataaaatgtaaaatggtgacggtgtctgtagtggaa

SEQ ID NO: 16161 - DNA, 112 bp, Homo sapiens
gtcagtggtcaacaggctctatgcagtgcgacctgaaaaagtgaggccagctccagggacctcactgtctctgtcattttcttgtgtttcatagacttctgtgtaggtgact

SEQ ID NO: 16162 - DNA, 70 bp, Homo sapiens
tttttttgacacaaggtctcactctctcacccaggctggaatgcagaggtgtgatcttggctcactgaaa

SEQ ID NO: 16163 - DNA, 58 bp, Homo sapiens
tgagacagagtctccctctgtcacccaggctggagtgcagtggcatgatcctggctca

SEQ ID NO: 16164 - DNA, 69 bp, Homo sapiens
ggtgggcgaacagagtctcactcactctattgcccaggctggagtgcagtggcgtgatctcggctcact

SEQ ID NO: 16165 - DNA, 114 bp, Homo sapiens
atacgtatatatgtgtgtatatatacgtatatatatgtgtgtgtatatatatgtatatatatacgtatatatacacacacatatatatacatatatatatacgtatatatgtat

SEQ ID NO: 16166 - DNA, 92 bp, Homo sapiens
atacatatatatatatgtatatatatatatacgtatatatgtgtgtatatatacgtatatatgtgtgtatatatacgtatatatgtgtgtat

SEQ ID NO: 16167 - DNA, 104 bp, Homo sapiens
caggaagacaaccataaaatttgggccattagagtgaaataatttgtctttattttaaaaggatcactttgcctcctctgttggaatagaatgtgtatgtactg

SEQ ID NO: 16168 - DNA, 84 bp, Homo sapiens
agagaacatgtggatacacttaagggaaaataccttttagctctgtgagtaattctccccaggtgtctgtctgtctgtctgtct

SEQ ID NO: 16169 - DNA, 70 bp, Homo sapiens
gcagtggtttgctgaacagccattaaaatgttgtagaataattattaatggtgtggaaggatgctattgt

SEQ ID NO: 16170 - DNA, 73 bp, Homo sapiens
gttgtttttgagctggagtctcactctgtcacccaggctggagcgcagtggtgtgattttggctcaccacaac

SEQ ID NO: 16171 - DNA, 119 bp, Homo sapiens
gagttcttgatttgattctcagcttggtcattgtgggtgcatagcagggctactgatttttgtacattaattttatatcttgaaactttgctgaattcatttaccagttctaggagctt

SEQ ID NO: 16172 - DNA, 89 bp, Homo sapiens
aagaatcagtgcagtgagaagacagtcagctttctattctggaatcagcaagagatgggagttaatagtctcttctgcattgtgttttt

SEQ ID NO: 16173 - DNA, 76 bp, Homo sapiens
aactaactatatgtgtatatatgcatatatttatgtgtgtatatatatacatgcacacatacacatacagttagtt

SEQ ID NO: 16174 - DNA, 61 bp, Homo sapiens
tgtgacactgacagtctgtctggaggtcagggctaaactggctgatgatttagatgtcaca

SEQ ID NO: 16175 - DNA, 102 bp, Homo sapiens
atgtttagtgtatatatgtatatatagatgtgtgtatgtatgtatatatatagatgtgtgtatatatgtatgtatatatacatatatataccatagagacgt

SEQ ID NO: 16176 - DNA, 95 bp, Homo sapiens; identical to SEQ ID NO: 580

SEQ ID NO: 16177 - DNA, 93 bp, Homo sapiens; identical to SEQ ID NO: 69

SEQ ID NO: 16178 - DNA, 86 bp, Homo sapiens
gcgcacccctgccatgggggtcccaagagccatgggggcaagaggggctggctggctctttcctccccgcagcgcggtgtcgcccc

SEQ ID NO: 16179 - DNA, 72 bp, Homo sapiens
ttgggcatgatgctgtatgcctgtagtcccagctacttgggaggctgaggtagaaggatggcttgagcccag

SEQ ID NO: 16180 - DNA, 90 bp, Homo sapiens
tctcagatcacactttctgttcatcagaacttcctatctgttaatttattaatttatagcattggagtgttcttttgtagaagtctgaga

SEQ ID NO: 16181 - DNA, 95 bp, Homo sapiens
tagggagtgtatgtgtgtgtgcttgtatgtttatggatggtatgtaatgaagtgacgagacatataaagtgaaaattatcatatatattgctcta

SEQ ID NO: 16182 - DNA, 113 bp, Homo sapiens
ttctgttacttattaaatgcatcaaagtatttctttctttctttctttttgttgatgttgttggagagggaaaaagagaaaggtcagggaaagatggtaatgtagaaggagga

SEQ ID NO: 16183 - DNA, 104 bp, Homo sapiens
gtgcctaatttacacattacattttatcataagtatctatgtatgtatgtataggcaaaaacatagcatacataggatttgatatgaacaatggtttcaggcat

SEQ ID NO: 16184 - DNA, 78 bp, Homo sapiens
ctatctatgtatctttatatggatatctataggataactatcctatctatatatccttatataaagatatatatttag

SEQ ID NO: 16185 - DNA, 95 bp, Homo sapiens; identical to SEQ ID NO: 68

SEQ ID NO: 16186 - DNA, 93 bp, Homo sapiens; identical to SEQ ID NO: 69

SEQ ID NO: 16187 - DNA, 105 bp, Homo sapiens
tcctaatgtatgcttgtgtttagctatcttcttgctgttgacttctaattttgttgcattatggtcaggaaaatgtggtctggacaatgtcaatcgtatagtgga

SEQ ID NO: 16188 - DNA, 115 bp, Homo sapiens
accttttgttccctactctatttcgaggtgaaagagaatgctaatgtaatgataagtaaatgattctttcacatttggctttccttccatcttcaatttaaaaagttagctaggt

SEQ ID NO: 16189 - DNA, 98 bp, Homo sapiens
tgttgtaccagcagccaacacctttgagactttgatcatctgactaggaagacttgccctgatatgagacctcagggagtggaggtcactggagaaca

SEQ ID NO: 16190 - DNA, 58 bp, Homo sapiens; identical to SEQ ID NO: 315

SEQ ID NO: 16191 - DNA, 90 bp, Homo sapiens
ttcagtacactccagagttccaaaatagctacatcagacagattctctcagtgtaattgttgtctgggtgggctgaaagattcctggtgt

SEQ ID NO: 16192 - DNA, 110 bp, Homo sapiens
tgaaccacatcattaagctgaaatgtgtgtatatatatacgtgtatatatatatacatatagtgtatatatatgtgtatatatacacgtgtgtatgtgtgtgtgtgcgca

SEQ ID NO: 16193 - DNA, 111 bp, Homo sapiens
gttttctttatggtctaatatgcagaatacactatcttgaatttttctacttcagttcaactttagagatcccattcttagtttctgtatagtttagtagaataagaaaat

SEQ ID NO: 16194 - DNA, 95 bp, Homo sapiens; identical to SEQ ID NO: 68

SEQ ID NO: 16195 - DNA, 93 bp, Homo sapiens; identical to SEQ ID NO: 69

SEQ ID NO: 16196 - DNA, 112 bp, Homo sapiens
ggacaagtgctcagatatatccaaatattggaatacacacagagatacattttaattttaacattaaaattttgtctttatacaagtattttatttgggttctaagtaattc

SEQ ID NO: 16197 - DNA, 93 bp, Homo sapiens
tgtgtatgtatatatgtatatcatatatatgtgtgtgtatatatatcatatatatatgtgtgtatatatgtatatcatatatatgatggaata

SEQ ID NO: 16198 - DNA, 98 bp, Homo sapiens
gtgtatatatatatacatgagtgtgtatatatatatatcctatatatatatcctatatatatatgagtgtatatatatatatatcctaaataaactca

SEQ ID NO: 16199 - DNA, 114 bp, Homo sapiens
tgtatcgatgggcacatatgaataatatgtctatatgtctatatatgtgtatatatatgtattgtatgtatgtatgtttatgtgtatatgtacatatgtgcataaatgtatata

SEQ ID NO: 16200 - DNA, 95 bp, Homo sapiens
atatatatatatatgtgtgtatatatgtatatgtatatgtgtatatatacatatatgtacacacatatatatacatatatatacacatatatata

SEQ ID NO: 16201 - DNA, 220 bp, Homo sapiens
tgggtatatatatatgtatatatatgtatatatgtgtgtatatatatgtatatatgtgtgtatatgtatatatgtatatatatgtgtatatatgtgtatatatgtatatatgtgtgtatatatatgtgtatatatatgtgtatatatatgtatatatatgtgtgtacatatatgtatatatacacatatacatatacatatatacacacatatatatata

SEQ ID NO: 16202 - DNA, 82 bp, Homo sapiens
ttcaagtaattttatatttattgttgtagtttggttccacagaacacagactgtgagacagatgtttgtgaaatgtattggg

SEQ ID NO: 16203 - DNA, 82 bp, Homo sapiens
ttctgtggtaggctttgaagtatttaaggatgggacattggttgttgtttctgtagtatctggtatagttcctaccttagag

SEQ ID NO: 16204 - DNA, 76 bp, Homo sapiens
atatatatatataaataaaatatatatataaaatattgatatatatgagaatatatatatttgtgtgtgtatatat

SEQ ID NO: 16205 - DNA, 111 bp, Homo sapiens
gtgggtttgattttcatttctctgatgattagtgatgagcatttttttgtatttttgttggtcacttgtatgttttcttttgagaaatgcctgttcatgtcatttgctcat

SEQ ID NO: 16206 - DNA, 146 bp, Homo sapiens
tatatatatatatatatatatgtatatatatatatatacacacacacacacatatacgtgtgtgtgtatatatacacacatgtatatatatacatatatacatgtatgtatatatacacacacacgtatatgtatgtgtatatgta

SEQ ID NO: 16207 - DNA, 98 bp, Homo sapiens
tacacatacatatacgtgtgtgtgtatatatacatacatgtatatatgtatatatatacatgtgtgtatatatacacacacacgtatatgtgtgtgtg

SEQ ID NO: 16208 - DNA, 90 bp, Homo sapiens
tggagcccagagctgtgcagtactgcagatgccagcactcctttggctgcctctgatggtgtctcagtctgtgacatgtcccccagtcca

SEQ ID NO: 16209 - DNA, 67 bp, Homo sapiens
agagctgagccatgcacacagaagaaaccttttttttttttttttttgtgagacggagtttcgctct

SEQ ID NO: 16210 - DNA, 97 bp, Homo sapiens
ggaagagtgacatgtctctcactttatttatttatttatttatttatttatttatttatttatttatttatttttgagatggagtctcactctgtcc

SEQ ID NO: 16211 - DNA, 58 bp, Homo sapiens; identical to SEQ ID NO: 10934

SEQ ID NO: 16212 - DNA, 162 bp, Homo sapiens
tcatacataagttacatggatacatagactaacaaatgcataagtgtatgcacacacacacacacacacacacctgtcagtctatctctatgtatcatatatagaaacatacatatatatatatggtaaatatatatatatggtaaaaaaatatatatggta

SEQ ID NO: 16213 - DNA, 89 bp, Homo sapiens
ttttaatgtgtaaggtaccctgtgtgtgtatgtatgtatgtatgtatgtatgtatgtatgtatgtgtcctagtactttgagcattaaga

SEQ ID NO: 16214 - DNA, 105 bp, Homo sapiens
atatatatatatacatatatgtgtatataaatatatacacatatatatgcacatatgcatatgtgtatatatttatgtaatacatgttcatgtttatatatttat

SEQ ID NO: 16215 - DNA, 104 bp, Homo sapiens
gctttccccaaactgcattgccagatcttctcagctctgacccacagtcactgtgccaaaagctgccaggaatgccaagtgcatggtgattttgtgacgtagag

SEQ ID NO: 16216 - DNA, 80 bp, Homo sapiens
ttcatggcctgttactgtgtgaaatgattagaaaagtgtttttttttttaatttttctttcatggtggctaggtaaggaa

SEQ ID NO: 16217 - DNA, 116 bp, Homo sapiens
actggacctttaaagctttttctgttacctttatacttggccttggtctagaagagtctcacagactctgtctctgcccaagctaattccaggaaatgctgtctattctattcagt

SEQ ID NO: 16218 - DNA, 71 bp, Homo sapiens
tgagacagtgtctcactctgtcacccaggctgaagtgcagtgcagtggtgcagtggtgcaatcatggctca

SEQ ID NO: 16219 - DNA, 90 bp, Homo sapiens
gtgacacatctacatatgagatattgatgatcatgttgtcttttatgttatcactatatccacaactgtttctgttatctcaggtgtcac

SEQ ID NO: 16220 - DNA, 101 bp, Homo sapiens
cacacatgttgaggatatttgggatagtgagaggaatattgtgaggaagtgttgtcagaacttcagtaggattttacagtccatcatcactcaaattgttg

SEQ ID NO: 16221 - DNA, 106 bp, Homo sapiens
tattggcttcctataccctcttccctgctccttgactcatgagtgtcagtactctgccctgatgtcatagccaaagagaaccctgaatgtacagctggcataaata

SEQ ID NO: 16222 - DNA, 123 bp, Homo sapiens
ttgttcttttggcttagaattgacttggcgatgcaggctcttttttggttccatatgaaatttaaagtagttttttccaattctgtgaagaaagtcattggtagcttaatggggatggcattg

SEQ ID NO: 16223 - DNA, 128 bp, Homo sapiens
gtgtgtgcatgtgcatgtgcgcaagtgtgcgtgtgcgtctgtaagcatgtgcatacgtgtgtgcatgtgcatgtgcatgcctatgtgtgagcgtgtgtgtgcatgtggatgtgtgcatgtgtgtgcat

SEQ ID NO: 16224 - DNA, 83 bp, Homo sapiens
gcatatatatatatatacacacacattgcatatatatgtatatatacatcgtgcgtgtatgtgtgtctgtgtgtgtattgtta

SEQ ID NO: 16225 - DNA, 115 bp, Homo sapiens
gagctggaggcagtgcttctgtctgactgtatttcttttcttttttctttcttttttttttttttttgaggagtcttactctgtcacctaggctagagtgcagtggctcaatctt

SEQ ID NO: 16226 - DNA, 112 bp, Homo sapiens
gtatgacagtgtggttagctcaggataattttaaaatcaacagaaatctcttttttttttttttttttttttttgagatggagttttgctcttgttgcccaggctggagtgc

SEQ ID NO: 16227 - DNA, 116 bp, Homo sapiens
caaacagaaagccacactgaatgtctccaatctccatttagttccaggaaataacacttctctaggaccattccaaatgtgggttgagattttcagttgccactcagtaatgtttg

SEQ ID NO: 16228 - DNA, 109 bp, Homo sapiens
acctgagactgggaaacatcaagttaatagaaacaatataatttataattttacatgatttcatatattatttttctgttagccttgtaaactttccaatgactcaagt

SEQ ID NO: 16229 - DNA, 86 bp, Homo sapiens
ggtaaccatccttctctctctgtgactataagttcaattgttttgatttttagatcacaaataagtgagaacatgtgatgtttatc

SEQ ID NO: 16230 - DNA, 105 bp, Homo sapiens
tatacatatgtgtatatagacatatatatgtatatatttattcaaatatgtctatatatagatatatgtatacatatttgtatatatatgtgtgtgtatatatat

SEQ ID NO: 16231 - DNA, 100 bp, Homo sapiens
gaagactgcagcattttgggagggacaggaaaagcatatgtgatttgtcaaaatttattttcttttgtgaactgaaatccaatcatgatgttgcaacttt

SEQ ID NO: 16232 - DNA, 101 bp, Homo sapiens
atatatatatatatgtatgtgtgtgtgtatgtatatactatatatgtatgtatatacatacatgtatatgtatgtatatacatacatgtacatgtatgtat

SEQ ID NO: 16233 - DNA, 112 bp, Homo sapiens
tgtgtatatgtgtatgtgtatatatgtgtatatatgtgtatatatgtgtgtgtatatatatcctgcattttatatatatgctatatatatatgtatatacatatacacacac

SEQ ID NO: 16234 - DNA, 67 bp, Homo sapiens
tgcaggatatatatgtgtgtgtgtgtatatgtatatacatatatatatagcatatatataaaatgca

SEQ ID NO: 16235 - DNA, 79 bp, Homo sapiens
tttgaaggttttagagatgtgtatattttgattatggtcatgattatatgattatatacacttttcaaaactcatcaag

SEQ ID NO: 16236 - DNA, 92 bp, Homo sapiens
gaaggttttaaaaagaggagttcccctgcacaagctctctctctctgcctgctgccaaccaggtaagacatgagttgcttctccttgccttc

SEQ ID NO: 16237 - DNA, 95 bp, Homo sapiens; identical to SEQ ID NO: 68

SEQ ID NO: 16238 - DNA, 93 bp, Homo sapiens; identical to SEQ ID NO: 69

SEQ ID NO: 16239 - DNA, 111 bp, Homo sapiens
gtttctccttgtaaagcagctgttaggaaagcttaattagtttttaattaatgagaattaatgtgctgaaaattttgtgagttttcaaccacatcatgaatagtttgagac

SEQ ID NO: 16240 - DNA, 79 bp, Homo sapiens
catttgacttgagattttgttcatttgtcagtaatgtattatccagagggtgaaagaaatcttaactggaagtcaaatg

SEQ ID NO: 16241 - DNA, 90 bp, Homo sapiens
tgaagttgaaccattctctctctctgtcaatatgagctgcttgaattgcattcctcttctcctgaaagagaggaggcattttttatttca

SEQ ID NO: 16242 - DNA, 95 bp, Homo sapiens
tgcctaaaggtcctgatgtagtagttacagggtgagatccagatattttaattttttaagctcataattttatagtacttgctatatgccaggca

SEQ ID NO: 16243 - DNA, 95 bp, Homo sapiens; identical to SEQ ID NO: 68

SEQ ID NO: 16244 - DNA, 93 bp, Homo sapiens; identical to SEQ ID NO: 69

SEQ ID NO: 16245 - DNA, 116 bp, Homo sapiens
aggcaccagatgtgtcaaggagattgagaagaggaaggagctcaagaaagcaatccaatatatttatttatgaactcctggacttcatcatgagctgcacatgtatatctgatcct

SEQ ID NO: 16246 - DNA, 98 bp, Homo sapiens
ttttaaaaataggtaaagcattattcaggtctgcaggtgatgaattgtttcagtttttgtatatctgaaaacacttatatttgccttcagttttgaaa

SEQ ID NO: 16247 - DNA, 110 bp, Homo sapiens
gcaaatcagagcagttggtcactctaatagtatcacaatttaattatttcttgattacctaaaagggtttattgtattatgatatggggagaaagaacatactgagttgt

SEQ ID NO: 16248 - DNA, 86 bp, Homo sapiens
ttttatggctgagtagtgtgtgtatgtaaatgtggtgtatatatatctatatatctctctatatatactaatacaaatacataaaa

SEQ ID NO: 16249 - DNA, 116 bp, Homo sapiens
ttcttgctgctcagttacattgactgccagcaattttttttctggatgatttctgatacagatacatttcctagaaaatgagagggttaaagttaaagtgtatcattaaggcagaa

SEQ ID NO: 16250 - DNA, 82 bp, Homo sapiens
ccaagcctgggaagagggactcacactaccccctgagagctggggacaccgtggatggaggtctgactgcctgactgcctgg

SEQ ID NO: 16251 - DNA, 79 bp, Homo sapiens
tgagacagagtctcactctgtcacccaggctggagtgtggtggtgggatcatggctcactgcaacctctgtctcctggg

SEQ ID NO: 16252 - DNA, 119 bp, Homo sapiens
gccccggtgtgtgatgttccccttcctgtgtccatgtgttctcatggttcaattcccacctatgagagagaagagtgagaacatgcagtgtttggtttttggtccttgagatagtttgc

SEQ ID NO: 16253 - DNA, 65 bp, Homo sapiens
tgacaatatctcagaagagactgatgagcagtggtctgattatcaatttttttgaaggtgggtca

SEQ ID NO: 16254 - DNA, 118 bp, Homo sapiens; identical to SEQ ID NO: 1929

SEQ ID NO: 16255 - DNA, 98 bp, Homo sapiens
ttaaccatgttctggggtttctgggataactgaagttttaccactaactttagatatatatttttttttccttaagccctaagatcattaacagttaa

SEQ ID NO: 16256 - DNA, 105 bp, Homo sapiens
ccttctgacaaaagcagttttgagatgtttctctattactaaattagaattttctttttttttcttctttcattagagagacagggtcttgctctgtcacccagg

SEQ ID NO: 16257 - DNA, 103 bp, Homo sapiens
agtgttgggatcacaggtgtgagcacacccagccaagaaatcatagaattcttttttttttttttttttttttgagatggagtctcactctgttgcccaggct

SEQ ID NO: 16258 - DNA, 63 bp, Homo sapiens
tggagacagggtctcgctctgtcgctcaggctggagtgcagtggcatgatctcttaggctcca

SEQ ID NO: 16259 - DNA, 103 bp, Homo sapiens
aggagagggagcgtaaggaagaaagagggaaaggttaaatgttcaagaatttatctatttaaacaagagatttctttctggtcgattttggttagtttttcct

SEQ ID NO: 16260 - DNA, 71 bp, Homo sapiens
tcctatgagaatcaattgccacagcttatctgacaggagacagagctcaggcagtaatgtgagtgatggga

SEQ ID NO: 16261 - DNA, 108 bp, Homo sapiens
gataggggcttttatactctattgcttctgggtttaaaaagtgactttgaaaatatttttatatgtttagagggtatttaaaaccagtttgcacttgaaagctttgtc

SEQ ID NO: 16262 - DNA, 89 bp, Homo sapiens
cagagtatgtatagcagagatcagatatatcttcatatgaatatatacctatgtgactatatgtctaatctttgctatactccattttg

SEQ ID NO: 16263 - DNA, 120 bp, Homo sapiens
cctgcaggtttgcaggtgctctttctctgtctctgctgcaaggtgtacatctctttctgtctctctccattgcagctcaagggatccagggtcaaggctgctctgcatatttgtgaaagg

SEQ ID NO: 16264 - DNA, 95 bp, Homo sapiens; identical to SEQ ID NO: 68

SEQ ID NO: 16265 - DNA, 93 bp, Homo sapiens; identical to SEQ ID NO: 69

SEQ ID NO: 16266 - DNA, 105 bp, Homo sapiens
ttttcaaaatgctagcaaccgtatgcaagtcttatctgtgtataaatgtctgtacatagtataattcaaacttgtaaattacaaatatatgaaggcttttgaaaa

SEQ ID NO: 16267 - DNA, 94 bp, Homo sapiens
ggaaacacaggcctcatgggacccagcaggccaggaggaccggaacatctccttgtctatgtctgtctctctctgagggccttgtgcacgttcc

SEQ ID NO: 16268 - DNA, 105 bp, Homo sapiens
tatgatatatatctttatatacacatgtataaatagatttatatataaaaaattttatatattttatatattcagtactctgtgtatgtacatgatctatacata

SEQ ID NO: 16269 - DNA, 90 bp, Homo sapiens
tgggtgtctcatttttatacttttgtgtatgtttatatcacaaatataagtatatatatttctaagtatagtataagttaaaagaaccca

SEQ ID NO: 16270 - DNA, 95 bp, Homo sapiens; identical to SEQ ID NO: 68

SEQ ID NO: 16271 - DNA, 93 bp, Homo sapiens; identical to SEQ ID NO: 69

SEQ ID NO: 16272 - DNA, 72 bp, Homo sapiens
ttatatatatgtctatgtatatatattgtgtatatgtgtgtatatataatatatacatatatatgtatatgg

SEQ ID NO: 16273 - DNA, 115 bp, Homo sapiens
gttgggtgtggtggcacccacctgtagttacagctactcaggaggctgaggttggaggatcatttgagcccaggagttagaagctgcagtaagctgtgattgcaccactgcactt

SEQ ID NO: 16274 - DNA, 75 bp, Homo sapiens
gagtctcactctgtcacccaggctggagtgcaatggcacgaacacagctcactgcagcctcgacgtctggggctc

SEQ ID NO: 16275 - DNA, 106 bp, Homo sapiens
tgtctacctcttgggattattgtgaggatcaaattaatttaaatggatatgaaatcaattttaaattctagtgatggcacataatggatcgagttaaggaaagata

SEQ ID NO: 16276 - DNA, 70 bp, Homo sapiens
atccatctgtctgtctatctgtctgtctttctctcctgactgtcacaggacagaagcaaagagagaggat

SEQ ID NO: 16277 - DNA, 68 bp, Homo sapiens
gtctttggaagagcagaagatgttaatcttgattatattcaaatgagcatttttttttcttttatggc

SEQ ID NO: 16278 - DNA, 91 bp, Homo sapiens
actatagccttagtttcttataaggaaatagaaagtatactttatgaccttgcattccttatcgattaactccttcctcctgggctatagt

SEQ ID NO: 16279 - DNA, 97 bp, Homo sapiens
gtgagttgaaaattagcaattaaggtctggaagaaaagggaatttgttgagcccaaagacactttctccttcctaacattttattttttgaacttac

SEQ ID NO: 16280 - DNA, 97 bp, Homo sapiens
tcccctgggtcagtgggaggctgttaaggtgaagctgggcagagaaaagagtgagcagcagctgaaagccaagttctatgggaaggagccatgggga

SEQ ID NO: 16281 - DNA, 95 bp, Homo sapiens; identical to SEQ ID NO: 68

SEQ ID NO: 16282 - DNA, 93 bp, Homo sapiens; identical to SEQ ID NO: 69

SEQ ID NO: 16283 - DNA, 102 bp, Homo sapiens
ctatttcatttgccttatatttgtcagcttatagaatctatttgtatacgaatgttgcaaatagtttatttttattttgactttatgtagctcttggtatgg

SEQ ID NO: 16284 - DNA, 111 bp, Homo sapiens
tatttgattagcacccaagagatgacaggtacaattctgggtccttagtgttcactcaaaactgagagaagagcgatctcctagctggtacctggtctagtagacaagata

SEQ ID NO: 16285 - DNA, 95 bp, Homo sapiens; identical to SEQ ID NO: 68

SEQ ID NO: 16286 - DNA, 93 bp, Homo sapiens; identical to SEQ ID NO: 69

SEQ ID NO: 16287 - DNA, 58 bp, Homo sapiens
tgagacagagtctcactctgtctcccaggctggagtgcagtggtgcgatctctgctca

SEQ ID NO: 16288 - DNA, 115 bp, Homo sapiens
gcctcctgagtagctgagaccacaagtgtgtgccacggtacctggctaatttctttatttttttgtggaggtgggggtctcattatgttccacaggctggtctcaaactcctggc

SEQ ID NO: 16289 - DNA, 90 bp, Homo sapiens
tgtaggcatattacattcaacagtctcagctgagccaacttccgtgttatgttggcccaggcatcagacatgtgagtgaagaagcctcca

SEQ ID NO: 16290 - DNA, 185 bp, Homo sapiens
tatatactctctttctgtgtgtgtatatatagtgtgtatctattacacatgtataagtatatacatatgttttggtgtatatatatgtgtacatatgtcttattatataaatgtatatataagtatatacatacattataagtatatacatatttcagtgtacaattttgtagatatatgtacac

SEQ ID NO: 16291 - DNA, 113 bp, Homo sapiens
gtcaaaattatttttagcttttgtaacttctgtgcctttcctttcttttttttttttttttttttgagatgaagtctcgctctgttgcccaggctggagtgcagtgtcgtgac

SEQ ID NO: 16292 - DNA, 95 bp, Homo sapiens
tctatctctagaaatagtaagttgaattattgagaataagctcaaggtccatatcagttttcaatttatttatttatttatttttttgagataga

SEQ ID NO: 16293 - DNA, 119 bp, Homo sapiens
gcctccagctttgctctttttgcttaggattgtattggctatatgggctcttttttggttccatatgaaatgtaaagtagttttgtctagttctgtgaagaaagtcaatggtagcttga

SEQ ID NO: 16294 - DNA, 76 bp, Homo sapiens
gttgaggacaaaagaaaaaatattgagaggtgacaatgtgccagcagccctcactcactctcggtgcctcctcggc

SEQ ID NO: 16295 - DNA, 105 bp, Homo sapiens
cagaaaaattagtatgatagtatcattagtattgttctcgtaatcattattattatattggattacagtgacttattatatggctatctccctgagcagcttctg

SEQ ID NO: 16296 - DNA, 103 bp, Homo sapiens
tcccattgaggaagatgttagctgtgggtttgtcatatatggcctttattattgaggactatattattattctatattattatgagttttcctcatgacagga

SEQ ID NO: 16297 - DNA, 75 bp, Homo sapiens
ccaagggttgcaaagatctgtgggagaaggtggtttcccaggcaggctcgcacagtcactcactgcttcccttgg

SEQ ID NO: 16298 - DNA, 110 bp, Homo sapiens
tatatattataatatatacattatatagtatgttaatataaattatttatatataagatgtaatttataaatacacaccttatatatatatgtgtgtgtgtgagtgtata

SEQ ID NO: 16299 - DNA, 69 bp, Homo sapiens
tcccatgtgaggcctggtaagggcacagcttggcatcagctcagtctcagtcaccaactcacatgaggg

SEQ ID NO: 16300 - DNA, 97 bp, Homo sapiens
taatcactatttaatttgtgtatataacttttatatatatatacacacacatatgtgtgtgtgtatatatatgtatatatgtgtaaaaataggatta

SEQ ID NO: 16301 - DNA, 113 bp, Homo sapiens
acaagacagacagaaatgcacttgtatatgttttcttttacaattctttttttttttttaatactttaagttttagggtacatgtgcacattgtgcaggttagttacatatgt

SEQ ID NO: 16302 - DNA, 107 bp, Homo sapiens
gaaaggtgctttatacaggttcacaggggctttaagtgtgctggaaatgctctgttttttttttaatctgagttgtgggtacattgttctttcttttataatccttc

SEQ ID NO: 16303 - DNA, 72 bp, Homo sapiens
gagacaacggaggtcacttgtgtcacagttttctttgtttgagtgtgggatatgttcttcatgggttgtttc

SEQ ID NO: 16304 - DNA, 85 bp, Homo sapiens
cagcaccactccagtctatcatgagcagtcccttccactctgcctccagatggaatcgtatcagagaagactgagtgaaaagctg

SEQ ID NO: 16305 - DNA, 114 bp, Homo sapiens
tctttgtttccacagttctctttcagtaaacaaaaattgcctgttttatttttttaagtttcttgagacaggacaatacttgagctaattattagagaaaatggcaaatttaga

SEQ ID NO: 16306 - DNA, 114 bp, Homo sapiens
atatataattctattaaatacaaatcatataattgtgtgtatatattatatatatgtttatatctaatatatattatatataatatatgtttatatctaatatatattatatat

SEQ ID NO: 16307 - DNA, 57 bp, Homo sapiens
tgagacaggtctcactctgtcgctcagcctgcagtgcagaggcgtgatcttggctca

SEQ ID NO: 16308 - DNA, 101 bp, Homo sapiens
tattccctaggaatattatatatgtttatttttttctcttctatatttccagctttctggaggaataattgacaaataaaattgtgtatatttttggagta

SEQ ID NO: 16309 - DNA, 73 bp, Homo sapiens
gttgaatatggtacatatatattatatacatattttacatatatgcatatattatatatgtattatatataac

SEQ ID NO: 16310 - DNA, 108 bp, Homo sapiens
agccctctcagcagagtgcatgtgtgtgtgagagagagagacacacacacacatatatatgtcaatacttgtctccattcacatgatcacccactacagggctcttgt

SEQ ID NO: 16311 - DNA, 105 bp, Homo sapiens
gtgagaattctaatattttttggctttcatttattagattttaagaatggattgatatattcttttacataataaataaaaaatgagtattagtttgggttctcc

SEQ ID NO: 16312 - DNA, 90 bp, Homo sapiens
ttttgtatcttgaaattctgctgaagtttttttttttaaatcagatcaaggggctttcagacagagatgattgattttctaggtatagaa

SEQ ID NO: 16313 - DNA, 95 bp, Homo sapiens; identical to SEQ ID NO: 68

SEQ ID NO: 16314 - DNA, 93 bp, Homo sapiens; identical to SEQ ID NO: 69

SEQ ID NO: 16315 - DNA, 95 bp, Homo sapiens; identical to SEQ ID NO: 68

SEQ ID NO: 16316 - DNA, 93 bp, Homo sapiens; identical to SEQ ID NO: 69

SEQ ID NO: 16317 - DNA, 80 bp, Homo sapiens
gaaaataattttttaattattatttggtgaatgaatacatttgctgtcagtttatcctgtaatagttaatctttattttc

SEQ ID NO: 16318 - DNA, 84 bp, Homo sapiens
ttcatgactatttaatctaaaacttttaagagctacccattgtctatgaaagtggttctcaaaagtttttagagatgttgtgaa

SEQ ID NO: 16319 - DNA, 95 bp, Homo sapiens; identical to SEQ ID NO: 68

SEQ ID NO: 16320 - DNA, 93 bp, Homo sapiens; identical to SEQ ID NO: 69

SEQ ID NO: 16321 - DNA, 99 bp, Homo sapiens
tgatccaaagacttctgttcttaggctcctgatgtcacaaatatatatatatctttgtgaagaacgtcaaggttaatatagatttagaagaggtgatca

SEQ ID NO: 16322 - DNA, 93 bp, Homo sapiens
tcagaatctggtgatctcagcttgtttctctgcctgtgtctcacaaggccaaaatgaaagtgtctgcaggtctttgttccttttctggattct

SEQ ID NO: 16323 - DNA, 90 bp, Homo sapiens
atgcgggctccttttggttccatatgaaatttaaagtagttttttccaatactgagaagaaagtcaatggtagcttaatggggatagcat

SEQ ID NO: 16324 - DNA, 121 bp, Homo sapiens
tgctttattatatttggcctgattatctgtataaagtgcagcacgaataataataattttttatgatactttaagttctggggtacatgtgcagagtgtgcaggtttgttacataggtata

SEQ ID NO: 16325 - DNA, 114 bp, Homo sapiens
tggctacctagtattccattctatatatgtaccacattttcttttttaaatatatatatatttttattatactttaaggtctagggtacatgtgcacaatgtgcaggtttgtta

SEQ ID NO: 16326 - DNA, 99 bp, Homo sapiens
tcattacagagatatcttccttataatctttattgaatttgttcaatttaattagatatgcagatttaaaagggaagaaaattagatacatgtgtgaga

SEQ ID NO: 16327 - DNA, 85 bp, Homo sapiens
gctgaggtcttaggcttctgttcatgtgactgttttaatgtctgttgatatttccaacagtatgctcatccctgcacttctcagt

SEQ ID NO: 16328 - DNA, 71 bp, Homo sapiens
ttgtttttgagacggagtctctcactgtcactcgggctggagtgcaatggtgcgatctcggctcactacaa

SEQ ID NO: 16329 - DNA, 108 bp, Homo sapiens
gctggaactacaggcacacatcaccacacccagctaactttttaatttttagtagagacaaggtcttgctgtgttgcccaggctgatgtcaaacttctgagctcaagc

SEQ ID NO: 16330 - DNA, 92 bp, Homo sapiens
gtggtaatggaagagggtgggctttgagtttagtcacaggagttacaggagtctttttttttaaactttaagaaacttattccatgtagtat

SEQ ID NO: 16331 - DNA, 98 bp, Homo sapiens
cagcctgagcgagagagcaagactcagtctcaaaaaagaaaaagaaaacagtattttattttattttgagacggagtcttgctctgtcacccaggctg

SEQ ID NO: 16332 - DNA, 108 bp, Homo sapiens
tgccaatgtccatagaagatataccaatgatttgttgaaaaaaaaaattttttttttttttttgagacagagtcttgttctgttgcctagtctggaagtacagtggca

SEQ ID NO: 16333 - DNA, 115 bp, Homo sapiens
tgggcatggcttgcagctgttttcatgttcctgccacttgtcagactgcagctgtcactgactctcaggatggcaagtcttctctgggggactaaaggcagtgcaagtttgcaca

SEQ ID NO: 16334 - DNA, 91 bp, Homo sapiens
ctcctttgtagcaccattaggaatgattttacgttttactctttatttgaggactctctctctctcttactggactgtatgctcattggag

SEQ ID NO: 16335 - DNA, 74 bp, Homo sapiens
ttgttttttttgaggcagagtctcactctgtcacccaggatggagtgcagtggtgtgatttcggctcactgcaa

SEQ ID NO: 16336 - DNA, 105 bp, Homo sapiens
tttttagaagtaatagacttgggaacagaaaagggatgttgttaactttttttttttttgaaccgaagttaacacccagcactgtcctttctttacttagcgaaa

SEQ ID NO: 16337 - DNA, 95 bp, Homo sapiens; identical to SEQ ID NO: 68

SEQ ID NO: 16338 - DNA, 93 bp, Homo sapiens; identical to SEQ ID NO: 69

SEQ ID NO: 16339 - DNA, 103 bp, Homo sapiens
cctgtttttctgaaaactcagttaccttagctgctgggaatcgcagtgcaagattacactctgtggaactgcccagagcggggaaaatgaggagggtgacagg

SEQ ID NO: 16340 - DNA, 98 bp, Homo sapiens
tgttgggtgaagaatgagaggtagtaggagatacagttttttatttttaatgactgactttatcagagctttatggggctgatcatgtttatttaata

SEQ ID NO: 16341 - DNA, 65 bp, Homo sapiens
agtctttacatcagtagagaaatggatgcacagatcatctgtgtgcctctcactgagcccccgct

SEQ ID NO: 16342 - DNA, 104 bp, Homo sapiens
gaaatgcctatactaaatggttatggtttggcattgttagaataactagacagaagaaagtgatgttaaataccatactctttactaaatagatgggaagtttc

SEQ ID NO: 16343 - DNA, 117 bp, Homo sapiens
gaggatgctgatctgccatggagaatggggcaaatgcagggagagaaacgatgaagaattctctctctctgtgtgtgtgcgctgcccgtgcatgcttgcatgcttggagagagagaa

SEQ ID NO: 16344 - DNA, 95 bp, Homo sapiens; identical to SEQ ID NO: 68

SEQ ID NO: 16345 - DNA, 93 bp, Homo sapiens; identical to SEQ ID NO: 69

SEQ ID NO: 16346 - DNA, 223 bp, Homo sapiens
tatgtatatatatagagagatagatagatatttatatacatagatatttgctctctctgtgtgtgtgtgtatatatatatatacatacatatacatatgtatgtatgtatgtatgtatgtatatgtatgtatatatatatatacatatgtatgtatatatatatacacatatgtatgtatatatatatatacatatgtatgtatatatatgtatgtatatata

SEQ ID NO: 16347 - DNA, 67 bp, Homo sapiens
tatatggagagaatgtatatgtatatgtatacatttatatatacacatacatttatacatttatgta

SEQ ID NO: 16348 - DNA, 65 bp, Homo sapiens
gcttgatcagtccaagagaatgggcctcagtcttgaggctttttctttaattattgatagaaggc

SEQ ID NO: 16349 - DNA, 90 bp, Homo sapiens
aatataattacatgtacatatatgtatgtacatatatacattttcatgtgcatatatatgtatatacatatatgtacataattttatatt

SEQ ID NO: 16350 - DNA, 84 bp, Homo sapiens
ggtgtgaccagaagacaagagtgagagctttctgttatgcccggacagggccaccagagggctccttggtctggcggtgacgcc

SEQ ID NO: 16351 - DNA, 106 bp, Homo sapiens
tctgttaatagttaattatataaggtgtgtagatgttggcagtgttctggttggtgtagagtagaatgctgatagcttatggcacttaaataaaactttaacgtga

SEQ ID NO: 16352 - DNA, 87 bp, Homo sapiens
gcttcttcttaatctctgaatttatttatttgagtccataaaaaacttttagaactgatgaatgaattcagtaaaggtacaggacgc

SEQ ID NO: 16353 - DNA, 97 bp, Homo sapiens; identical to SEQ ID NO: 1307

SEQ ID NO: 16354 - DNA, 88 bp, Homo sapiens; identical to SEQ ID NO: 1308

SEQ ID NO: 16355 - DNA, 81 bp, Homo sapiens; identical to SEQ ID NO: 1309

SEQ ID NO: 16356 - DNA, 77 bp, Homo sapiens; identical to SEQ ID NO: 1310

SEQ ID NO: 16357 - DNA, 109 bp, Homo sapiens
tcaagacagctattttgaatttcctgtctgaaagatcagatgtctctgtcactctaagatttgtcactttggtgaggtcatttttttttcgatattcatggtgctttgg

SEQ ID NO: 16358 - DNA, 60 bp, Homo sapiens
gtgagtgtgtgtgtgtatatacacatgtatatacatgtgtatatatgtatgtatatgtat

SEQ ID NO: 16359 - DNA, 116 bp, Homo sapiens
ctaagtagtattccggtgtgtgtgtgtgtatataaacacatacacatatgtgtataaatatacatatatgtatatacccatatacacatatatatacacaatggaatgctacttag

SEQ ID NO: 16360 - DNA, 116 bp, Homo sapiens
ctaagtagcattccattgtgtatatatatgtgtatatgggtatatacatatatgtatatttatacacatatgtgtatgtgtttatatacacacacacacaccggaatactacttag

SEQ ID NO: 16361 - DNA, 82 bp, Homo sapiens
atacatatatatgtatatgcacatgtgtatatatacatatatatgtatatgcacatatatgtgtatatgtatatatatgtgt

SEQ ID NO: 16362 - DNA, 110 bp, Homo sapiens
cacatgcaaatatgtgtgtatatatacatatatatgtatatgcaaatatgtgtgtatatatacatatatatgtatatgcacatgtgtatatatacatatatatgtatatg

SEQ ID NO: 16363 - DNA, 116 bp, Homo sapiens
atatacatatatatgtatatatacacacatatttgcatatacatatatatgtatatatacacacatatttgcatgtgtctgtatgtatatatgtgtgtatatatgggaaatgtctg

SEQ ID NO: 16364 - DNA, 103 bp, Homo sapiens
ccatatacacacatttatatgtgtatatacacatatgtatagccatatttacatatatatatatatacacacatgtgtttatgtttatatggtaagactgtgt

SEQ ID NO: 16365 - DNA, 68 bp, Homo sapiens
actcacgtaaggctggaggtctgcatacaaccctaggaagagtgtagatagaattcagagagctgagt

SEQ ID NO: 16366 - DNA, 95 bp, Homo sapiens
ggtctctgtgtgtgcatgagcagctgatctgaagactccacacagctctgtgtgtcagacccaaggtcctggtggcatgagctcacaaggggatc

SEQ ID NO: 16367 - DNA, 103 bp, Homo sapiens
ttctggacttttcttttttaggagattttagattacttattgaatatctttaattgttataggtctgatgaaattttttatttccttttgagtcagtttggaa

SEQ ID NO: 16368 - DNA, 106 bp, Homo sapiens
gtactatttcatagcttttatattcttctttgagtgatatttatttgtgaacttttaatttttacttataaactggaagtttgagtgtagagtttgtgttttttac

SEQ ID NO: 16369 - DNA, 113 bp, Homo sapiens
ttatttatcattatattttaaactaagactggagagaatgtatatacatacataattccatatgtatgtatgtatgtatatgataagccttatatttattatactgtgaatga

SEQ ID NO: 16370 - DNA, 67 bp, Homo sapiens
tgtatgtatatggtatatatatggtgtgtgtgtatatatacagtgtatatatctgaatatatataca

SEQ ID NO: 16371 - DNA, 103 bp, Homo sapiens
tcagtgagtcagatttggcttgtaaagaaatggataatttcttacaattatgtagaatgttattatatttcttgcattgctatgaagaaatacctgagactga

SEQ ID NO: 16372 - DNA, 113 bp, Homo sapiens
tatagctttgctggatatggtattctcagatgatagtgttcttattttttttttttaatatcactttgaaaatgtcatccgagtcccttgtggcctgtttggtttctgttgtg

SEQ ID NO: 16373 - DNA, 58 bp, Homo sapiens
tgtgtgtgtatgtatatatgtgtgtatgtgtatgtgtatatatatatatatacataca

SEQ ID NO: 16374 - DNA, 130 bp, Homo sapiens
gtgtgtatatatatatacacatatatatatgggtgtgtgtatatatgtatgtgtgtatatatatgtatgtgtgtatgtacatatgtgtgtgtgtatatatatacacacacacatatgtacatacacacat

SEQ ID NO: 16375 - DNA, 69 bp, Homo sapiens
cctttgtgatttatttttgtaatactctttgaattatgctgattcagagtgtattttgtctcgcattgg

SEQ ID NO: 16376 - DNA, 94 bp, Homo sapiens
atgtatgttccaggacattttggcttgagagcattaaattattttccttttctatatttgaatcttcctaaaacctgtttcttggaatatacat

SEQ ID NO: 16377 - DNA, 106 bp, Homo sapiens
tgtgaagctgaaccaaccaaaacatgaattggatactgggtgagaaaaaattagtgattttgtagaactaatctgatgtgttttttttgtttgttcctgcaacata

SEQ ID NO: 16378 - DNA, 116 bp, Homo sapiens
tgttcctatcagtgtacaccagaaagcaaactaactcgtaaacagagagcacacagggcctgcccaggcgtgtttgtttgtatactgcttatttaactgctatacattgaaaagca

SEQ ID NO: 16379 - DNA, 93 bp, Homo sapiens
tgcagtcactgagattcttcactttcttactgtctcttacttttatttttttattttgtaggcagtgcagtggctctatcttggctcactgta

SEQ ID NO: 16380 - DNA, 107 bp, Homo sapiens
gattttcatgatgtttatctttgattctgttaatatggcatatcatattttattgatttgtatatgttaaaaaaatcctctatcacggggataaattccacttgatc

SEQ ID NO: 16381 - DNA, 73 bp, Homo sapiens
ttttttttgagacagggtctcacactgtcacccaggctggagtgcagtggcgtgatctcggtctcagttgaaa

SEQ ID NO: 16382 - DNA, 87 bp, Homo sapiens
tgcttaaaggttgtgtaagggtgtgcataggtatacatgtatatatatatatatgcacatttgaacaaactataattcccactagca

SEQ ID NO: 16383 - DNA, 58 bp, Homo sapiens; identical to SEQ ID NO: 285

SEQ ID NO: 16384 - DNA, 101 bp, Homo sapiens
atatctatatatagatatatatctatacacacacacatggatataagtatgtgtgtgtgtgtgtgtatatatatatgtgtgtgtgtatatatatgtgtgta

SEQ ID NO: 16385 - DNA, 100 bp, Homo sapiens
aggatgggaatattgattggagtgaattttaaggagattttactttattttttagacataaaggaatctgattattttaagcatctgaggtttctatctt

SEQ ID NO: 16386 - DNA, 104 bp, Homo sapiens
atatatatgtatacatatatgtatgtatatatatgtatacatatatgtatatatgtatgcatatatatacatatatatacgcattatatatatatatatttgca

SEQ ID NO: 16387 - DNA, 59 bp, Homo sapiens
tgagacaagagtctcactctgtcacccaagctggagtgcagtggtgtgatctcggctca

SEQ ID NO: 16388 - DNA, 111 bp, Homo sapiens
ggttatgcatatctgctaatttattgctcttgaatttaggtgtggagaagaactggtttcatactatgtattttttacttaacctacttgggagatgtttagttgttaact

SEQ ID NO: 16389 - DNA, 95 bp, Homo sapiens; identical to SEQ ID NO: 68

SEQ ID NO: 16390 - DNA, 93 bp, Homo sapiens; identical to SEQ ID NO: 69

SEQ ID NO: 16391 - DNA, 109 bp, Homo sapiens
ggttcacagatgaccatcttttcactcagttttccatggcagaaagaggtcagagagctctctgggatatcttttataaaggcactgtgaaaggaatatattttgggcc

SEQ ID NO: 16392 - DNA, 87 bp, Homo sapiens
tagccggggatatcgcccacgtctgtggtcccagctacttgggaggctgaggtagaaggatcacttgagcctgggtagtccaggctg

SEQ ID NO: 16393 - DNA, 118 bp, Homo sapiens
tcatataactgaacttaaaatcagatttacttggaaataaatcaaagtttgtgaagtgaatcttaatgtttatttttagctgataagaagagtagatttggttaagtattgagtgtga

SEQ ID NO: 16394 - DNA, 98 bp, Homo sapiens
tataagtgtccatttgctctagctccatttgaaaagtctgtccttcaaccattgaattacttttgtagcttttcaaaaatcagttgggcatatttgta

SEQ ID NO: 16395 - DNA, 81 bp, Homo sapiens
ttggtctttgtttagaagtttgttgatgtttctgtaatcagaaacatgggcaggaacttatcacttgtttatatcaactag

SEQ ID NO: 16396 - DNA, 109 bp, Homo sapiens
ttgaagagatgcatatcttattacacagcaactcttatatgaatatacgtatgcatgtagtatgtatgtatttgtgcatggatgtatgactggatgtgttttctctcaa

SEQ ID NO: 16397 - DNA, 113 bp, Homo sapiens
actaccttgatgttgttctttatgtattccgaattttctactttttttaaattttattttattattaatatactttcagttttggggtacatgtgcacaatgtgcaggttagt

SEQ ID NO: 16398 - DNA, 82 bp, Homo sapiens
gagattgtttctatatctatctatatctatatatatgtctatgtctatatctatagatatatatatatatcaaacaatactc

SEQ ID NO: 16399 - DNA, 82 bp, Homo sapiens
agttttagggtacatgtgcacaacgtgcaggttagttacatatatatatatgtgtcatgttggtgtgatgcacccattaact

SEQ ID NO: 16400 - DNA, 79 bp, Homo sapiens
tgtatatctatccatgtgtgtgtgtgtgtatatatatatatatatatatatatatatatatatatatgagtttattaca

SEQ ID NO: 16401 - DNA, 58 bp, Homo sapiens
tgagatggagtctcactatgtcactcaggctggagtgcagtggtgcgatcttggctca

SEQ ID NO: 16402 - DNA, 97 bp, Homo sapiens
tatatattatcttgatattatatatttatatcatcttgagatatatatctctatatattatcttgatatatctatatgttatcttgatatgtatata

SEQ ID NO: 16403 - DNA, 60 bp, Homo sapiens
ggaggagatctggaagaattttctggattaccaggcagagattcttttttttttttctcc

SEQ ID NO: 16404 - DNA, 95 bp, Homo sapiens; identical to SEQ ID NO: 68

SEQ ID NO: 16405 - DNA, 93 bp, Homo sapiens; identical to SEQ ID NO: 69

SEQ ID NO: 16406 - DNA, 70 bp, Homo sapiens
ttgttttgagatggactctcacactgtcacccaggctggagtgcagtggtgggatcccggctcgctgcaa

SEQ ID NO: 16407 - DNA, 95 bp, Homo sapiens
gcatcacacaatataccatgtaacatgttcccctggaatctaaaataaaacagattcaatatatgtatattgttatacagtatatgtccaggtgc

SEQ ID NO: 16408 - DNA, 99 bp, Homo sapiens
agatatatatatacaattatatgtatatatatctatacatacacacacatacatacatatatgtgtgtatgtataatatatacatatatatatacattt

SEQ ID NO: 16409 - DNA, 91 bp, Homo sapiens
atgtatatatatatgtatatattatacatacacacatatatgtatgtatgtgtgtgtatgtatagatatatatacatataattgtatatat

SEQ ID NO: 16410 - DNA, 95 bp, Homo sapiens
tgttccagtaggtctgtttgctttctattcctgtgatttgtttatgtttttaatttttgtgggtacatagtaggtacatatatttacagggtaca

SEQ ID NO: 16411 - DNA, 95 bp, Homo sapiens; identical to SEQ ID NO: 68

SEQ ID NO: 16412 - DNA, 93 bp, Homo sapiens; identical to SEQ ID NO: 69

SEQ ID NO: 16413 - DNA, 127 bp, Homo sapiens
cctgtgtgataatagttgaactccatctcaaaaaaaaaaaaagatggggtctcactctgtcactcaggctggagtgcagcggtgcaatgttggctcattgcagctcagtctcccgggctcaagtgat

SEQ ID NO: 16414 - DNA, 103 bp, Homo sapiens
aaagtctgtctgaaatcaaagctgtgtgctttctgtgtatctctctgtcccttcaatggcaggggttgtagtagtcagctgttcattttttcaactggacttt

SEQ ID NO: 16415 - DNA, 95 bp, Homo sapiens; identical to SEQ ID NO: 580

SEQ ID NO: 16416 - DNA, 93 bp, Homo sapiens; identical to SEQ ID NO: 69

SEQ ID NO: 16417 - DNA, 116 bp, Homo sapiens
gtcttccaaactcctgttcatgttgatagcttgatctcctccacaaatcacaaatgttctttttttttttttgagatggagttttgttcttgttgcccaggctggagtgtaatggc

SEQ ID NO: 16418 - DNA, 58 bp, Homo sapiens
tgagatggagtctcactctgtctcccaggctggagtacagtggtgtgatctcagctca

SEQ ID NO: 16419 - DNA, 58 bp, Homo sapiens
tgagatggagtctcactctgtcactcaggctggagtgcagtggtgcgatctcagctca

SEQ ID NO: 16420 - DNA, 58 bp, Homo sapiens; identical to SEQ ID NO: 3380

SEQ ID NO: 16421 - DNA, 105 bp, Homo sapiens
tattgtttttatgccataacactagcccaaggtgttggtggattcaattgtatacaatttatttttcataatatagccaccttggatgtgtttattgtgacaata

SEQ ID NO: 16422 - DNA, 108 bp, Homo sapiens
gcttgcattccagtgtaggataggacagggttgagattagtactcttttttttttttttttttttttttgagaaagagtctcgctctgttgtcaggctggagttaagt

SEQ ID NO: 16423 - DNA, 79 bp, Homo sapiens
gtgtgtgaatcatggtagaatctacagaaataaatacatacttctgtgtataaatctctgtcagttactctctacacac

SEQ ID NO: 16424 - DNA, 82 bp, Homo sapiens
ttgagagactgaggcaggaggatcacttgagttcaggagttcgataccagcctgggcaacacagtgtgactctgtctcttaa

SEQ ID NO: 16425 - DNA, 85 bp, Homo sapiens
ttttattcatatctatctagagagagatatatatgtatgggtaaatatatatatatagactttgtatataaatgtatggattgaa

SEQ ID NO: 16426 - DNA, 108 bp, Homo sapiens
gtagggattatgggaactacaattcaagatgagatttgagtgaggacacagccaaaccacatcagtcaggctcacatctctgcttcctgttactgtgctccttccctc

SEQ ID NO: 16427 - DNA, 87 bp, Homo sapiens
tctggactctccattttgttccacaggtgtatgtgtgtgtgtatatatatatatatctgttttgatgctagaactgtactgttcaga

SEQ ID NO: 16428 - DNA, 95 bp, Homo sapiens; identical to SEQ ID NO: 68

SEQ ID NO: 16429 - DNA, 93 bp, Homo sapiens; identical to SEQ ID NO: 69

SEQ ID NO: 16430 - DNA, 100 bp, Homo sapiens
tctcttgaccaaagcttaaaatttcatccaaagagagaaaagagagaaaataattgattttaattctttgtgtgaaactgacagcattactttcatgaga

SEQ ID NO: 16431 - DNA, 90 bp, Homo sapiens
ttccattttaatatatatataagtatatatgaatatatataatgttccattatatataatttacgtatatatgtgtatgtatatatggaa

SEQ ID NO: 16432 - DNA, 96 bp, Homo sapiens
cctcagactctggaggaaaaatgccttatagtcctctgcacaatggtttggccaaattatttatctgcgggaaggactgggttggcctcaggaagg

SEQ ID NO: 16433 - DNA, 68 bp, Homo sapiens
tctagctacatatacatatgtacatagctatcaatatatctgtgtacatatgtgtatatatagataga

SEQ ID NO: 16434 - DNA, 95 bp, Homo sapiens; identical to SEQ ID NO: 68

SEQ ID NO: 16435 - DNA, 93 bp, Homo sapiens; identical to SEQ ID NO: 69

SEQ ID NO: 16436 - DNA, 69 bp, Homo sapiens
gatcaggaaatagcatgattagtttcctggcagctccatgctgtcagtcccatcagttaatttcttttc

SEQ ID NO: 16437 - DNA, 107 bp, Homo sapiens
ttgtgtctgaaaaggtgtatatttattttggggtgtttacaggtgatagtactttttatttaagtttgtatcctgtgtattttctttattacattttttacatacaa

SEQ ID NO: 16438 - DNA, 82 bp, Homo sapiens
gtggctatatatatatatacatatggctttatacatatattctatatgtataaagtggtataagtatatatttatatattac

SEQ ID NO: 16439 - DNA, 73 bp, Homo sapiens
tagttggctgattaggtagttctttagcatagtaaaattatgtattgggtctggctgcctctgtctgtcacta

SEQ ID NO: 16440 - DNA, 95 bp, Homo sapiens; identical to SEQ ID NO: 68

SEQ ID NO: 16441 - DNA, 93 bp, Homo sapiens; identical to SEQ ID NO: 69

SEQ ID NO: 16442 - DNA, 88 bp, Homo sapiens
cgagtctggttgttgctgtgaagttaatttgtagatgtgattaacatttaaatcagttgactttaaataaaggagatttttacccttg

SEQ ID NO: 16443 - DNA, 69 bp, Homo sapiens
tggggaggacacagtccagggcggaactctatccatctgtctgtctgtctgtctgtgtctatctcccta

SEQ ID NO: 16444 - DNA, 95 bp, Homo sapiens; identical to SEQ ID NO: 68

SEQ ID NO: 16445 - DNA, 93 bp, Homo sapiens; identical to SEQ ID NO: 69

SEQ ID NO: 16446 - DNA, 93 bp, Homo sapiens
gttaactttgctaattaccaggatgtaaagaaatgagagctgaagcaaatggaaacctctcatttattatttttctagaaatggcaagatagc

SEQ ID NO: 16447 - DNA, 95 bp, Homo sapiens; identical to SEQ ID NO: 68

SEQ ID NO: 16448 - DNA, 93 bp, Homo sapiens; identical to SEQ ID NO: 69

SEQ ID NO: 16449 - DNA, 60 bp, Homo sapiens
atacatatatgtatttatatttctacctgtaactacctgtgtataaatacatgtgtgtat

SEQ ID NO: 16450 - DNA, 88 bp, Homo sapiens
gtggcaggagagagaagaatgagagctgagtaaagcaggaagccgcttgtaaaaccatcagatttcatgagaacttactcactatcac

SEQ ID NO: 16451 - DNA, 98 bp, Homo sapiens
cagcctgggcaacatagcaagactctgtctctaaaaaaataccttttttttttttttttttttttttgagacggagtctcactctgtcacccaggctg

SEQ ID NO: 16452 - DNA, 182 bp, Homo sapiens
atatatgcatgtatgtatgtatatatacctatatatgcatgtatgtatgtatatatacctatatatgcatgtatgtatacatgtgtgtatacgtatgtatacatgtgtgtatacatgtatgtatacatgtatgtatacatgtatgtatacatgtatgtatacatgtatgtatacgtatatat

SEQ ID NO: 16453 - DNA, 134 bp, Homo sapiens
ccaactgcttgttgtgatgtgatcttctgctgtgtttttttttttttctttttttgaggcagaatctcactctgtcactcaggctggagtgcagtggcgcaatctcggctccctgcaacctccacttcccaggt

SEQ ID NO: 16454 - DNA, 95 bp, Homo sapiens; identical to SEQ ID NO: 68

SEQ ID NO: 16455 - DNA, 93 bp, Homo sapiens; identical to SEQ ID NO: 69

SEQ ID NO: 16456 - DNA, 122 bp, Homo sapiens
tatatatgtataaatatatacatacattatgtatgcataaatatatacacatatatgtataaatatatttacacatatgtatgtatatatgtatgtttccacatatatatgtatgtatatat

SEQ ID NO: 16457 - DNA, 112 bp, Homo sapiens
aaacatatatattatatgtgtatatataaaatacatatatacacaaacatacatataatatatatgtatgtttctatatgtatatccatatgtccaatatacatatatgttt

SEQ ID NO: 16458 - DNA, 109 bp, Homo sapiens
ttctttgtagtcttggcatctttcactttattgcttctaccataaacagtattattattttttaagtgtataagggcaaagtgaagggagagtggtagtatcaaaagaa

SEQ ID NO: 16459 - DNA, 85 bp, Homo sapiens
gtatatatacacgtgtatatatgtatatatgtgtatctatgtgtacatatatgtgtgtatgtatatatatgtgtacatatatgtg

SEQ ID NO: 16460 - DNA, 63 bp, Homo sapiens
ctgtcgctctctgtatgtgtgtgtgcgcacacatgtgtgtctgtgtccaaataaagaggatag

SEQ ID NO: 16461 - DNA, 58 bp, Homo sapiens; identical to SEQ ID NO: 315

SEQ ID NO: 16462 - DNA, 111 bp, Homo sapiens
gatatttttaatcacacatcactattatgacattatttttgagtgagtgttatcaatatttatttttaaataaatatataatgtactaataagttatgtgtgttgtacatc

SEQ ID NO: 16463 - DNA, 114 bp, Homo sapiens
ttgttagtctaatggtttaaaaggaaatgagcatgactctttgtgactgtgtcattgacagggccacatcctcaagcagagtttgaatcagtacttatttgttaaagataacag

SEQ ID NO: 16464 - DNA, 87 bp, Homo sapiens
ttccaaaatttttctttttattgatttctagttttattttactgtagtcagagaagatgcttgaaatgattaaaaaaaattttggaa

SEQ ID NO: 16465 - DNA, 61 bp, Homo sapiens
tatatgaatttgtttatatagtatttatgtccatataatactatatgaatatgttcatata

SEQ ID NO: 16466 - DNA, 110 bp, Homo sapiens
agtagattaccaggggagtgggaaactcaatcatgaagacagaagtcagagtgaacctactagggatctggcctctaaccctttctgactatttcatgggtaagaatatt

SEQ ID NO: 16467 - DNA, 127 bp, Homo sapiens
tatttcttaagacatatatatgtatatgtgtttatatatatgtgtatatgtgtgtgtgtatatatatatatatatatatatatatatatatatatatatgtgttttaagacataatgatattacata

SEQ ID NO: 16468 - DNA, 74 bp, Homo sapiens
gagctcagtggctgttcattttacacaatataagtattgatgttcctaagtgcacagcctatatagcatagctc

SEQ ID NO: 16469 - DNA, 70 bp, Homo sapiens
ggtgagcatgacttgggtgatcctcctgtcttagccttctaagtagctggaactgcaagtgcatgacacc

SEQ ID NO: 16470 - DNA, 97 bp, Homo sapiens
agaccttcattttcctcagtgtgagtgtgtgatcggggtcagagggtctctctttcccacttccacagtttgggcactcagaatatttggggtgtct

SEQ ID NO: 16471 - DNA, 144 bp, Homo sapiens
tgtgatatatatatatatatatgcatacatatatataagtatacatatatatgtatgcatatgtatatacatatatacacatatatgtatacatatatacgtatatacgtacatacgtatatacgtatatatgtatatatgtat

SEQ ID NO: 16472 - DNA, 58 bp, Homo sapiens; identical to SEQ ID NO: 3964

SEQ ID NO: 16473 - DNA, 88 bp, Homo sapiens
tgagtcatctgcattttgctgttctgtgtgtgcgtgtgcacatgtgtgtgtgactgtgtgtgtaatagcatttaaaatagatggatta

SEQ ID NO: 16474 - DNA, 109 bp, Homo sapiens
cttaaaatagtaaaacatgctgtaaacagatgtgctgtcctccaggttttgttatcatatttatagaacacaggcagagtcaatttagcataattttatgggtcctgag

SEQ ID NO: 16475 - DNA, 81 bp, Homo sapiens
tgaagtttttttttatcatgacagaatagacagaggaaagaggtatcttccaaatactgtgttgttcagaaaagaacttca

SEQ ID NO: 16476 - DNA, 58 bp, Homo sapiens
tgagacagggtctcactctgtcacttagactggagtgcagtggtgagatctcgggtca

SEQ ID NO: 16477 - DNA, 107 bp, Homo sapiens
ggtctctttacataataccattagtatcaaatgctatgttcattcttttttcttcatttttatctgactaagttagtttggagcaccagcctttgatatctgagatt

SEQ ID NO: 16478 - DNA, 115 bp, Homo sapiens
ctggatgtcagattcttggttgacaatttttttttctcagcactttgaatacattattttgttatattttggccttcaatgtttctgatgagaaatcaactcttaatcttttcag

SEQ ID NO: 16479 - DNA, 73 bp, Homo sapiens
ggcagtgatgggaaagtgaaggaagcagaaatggccaagggccatcctctgtcagtaattcactctgtcagcc

SEQ ID NO: 16480 - DNA, 117 bp, Homo sapiens
gattttgtggtttcatctaaggttcatgacccataatagaatttcaataattgacatgtcatattttattttctttaattttttggtccagatttccctttcttgaggacacatgtc

SEQ ID NO: 16481 - DNA, 87 bp, Homo sapiens
gattacaggtgtgagcatcttcaattgttttttatgtttgtatagcattttttttttttttaacagatggtgtctcactctgtcatc

SEQ ID NO: 16482 - DNA, 69 bp, Homo sapiens
ttgagatgcagtctcactctgtcacccaggctggcccaggctggagtgcagtggtgggatctcggctca

SEQ ID NO: 16483 - DNA, 58 bp, Homo sapiens; identical to SEQ ID NO: 605

SEQ ID NO: 16484 - DNA, 95 bp, Homo sapiens; identical to SEQ ID NO: 68

SEQ ID NO: 16485 - DNA, 93 bp, Homo sapiens; identical to SEQ ID NO: 69

SEQ ID NO: 16486 - DNA, 93 bp, Homo sapiens
cacagtgagagaaagtactgtgtcattaaatcttgattccatgtttatatgtatattttctgggttgtgatataaaacatttctttccaagtg

SEQ ID NO: 16487 - DNA, 108 bp, Homo sapiens
actgctgatagtgttgactgtgtagcattgcatcacgtcacaaagggctaggttgtattgtagtatgaatgtgtcctgtggtgcttggcacaggaagtatgcagtagt

SEQ ID NO: 16488 - DNA, 99 bp, Homo sapiens
agattttaggccttgttcagagctactattcaataaaggtgaattaaattgtgatcattttattttatctttatttgaagcctttcaagggaaaagtct

SEQ ID NO: 16489 - DNA, 70 bp, Homo sapiens
gatgtgtgtgtctgtgtgtgtatgcatatatatatatatatatatatatatatatatatatatatatatt

SEQ ID NO: 16490 - DNA, 113 bp, Homo sapiens
ttccactcctcttcctgacttctgtctgagcaccaagctcagttctctctctttcagtttcctcagattagacagcagctctttattaggcaaggtgaggtggaggaagggaa

SEQ ID NO: 16491 - DNA, 88 bp, Homo sapiens
taccagtctatctatatctatctatagatatgtagatatatatttatgcaatctatatctctctatatatagatagttatatctggta

SEQ ID NO: 16492 - DNA, 118 bp, Homo sapiens
aaaaacaattaaaaattaagttatctaagagatgtgctcccaaattatcctttgtataaaacttatttatttgatataacatatgttttagataattttttttcttttgtttgttttt

SEQ ID NO: 16493 - DNA, 95 bp, Homo sapiens; identical to SEQ ID NO: 5211

SEQ ID NO: 16494 - DNA, 91 bp, Homo sapiens
catgagttgtgttattgtttgttgatctgcccccttttcatgtcagaacagagagaaatgacagttcctagagcagagcaagatgcttatg

SEQ ID NO: 16495 - DNA, 115 bp, Homo sapiens
atttcaaactttattgttattatatctgttatagtaatcagtgatttttaatttttttaatttttaatttttattgctacatagtaggtatatatatttatggggtacatgagat

SEQ ID NO: 16496 - DNA, 95 bp, Homo sapiens; identical to SEQ ID NO: 68

SEQ ID NO: 16497 - DNA, 93 bp, Homo sapiens; identical to SEQ ID NO: 69

SEQ ID NO: 16498 - DNA, 113 bp, Homo sapiens
tgaaagattttcacaggttgtagaagttttagtggacagttttttcccttctaacactctaaatctgtcacactatcatcttttaagttatatactttttgaaaattctttca

SEQ ID NO: 16499 - DNA, 76 bp, Homo sapiens
ggctgtagtgatgggaggtaacttctttttttttttttttttttttgagatggagtctccctctgtcacccaggct

SEQ ID NO: 16500 - DNA, 113 bp, Homo sapiens
gtgtatctatatatatatgaattcaccatgtgtatatgtaaatttaaatatatataaattatttactgtacatatataaaattatagagaatttgtgtattatgaacgatcat

SEQ ID NO: 16501 - DNA, 86 bp, Homo sapiens
agttttagggtacatgtgcataacgtgcaggtttgttacatatatatatatacatgtgccatgttggtgtgctacacccattaact

SEQ ID NO: 16502 - DNA, 104 bp, Homo sapiens
ctccaatgcatcctttttgcacttaagttaatcagtgactgtctctgtgttttccaggtccgtcattggtcagcttctccagaaggtgagggtttctgtgtgag

SEQ ID NO: 16503 - DNA, 107 bp, Homo sapiens
gcattctgagtctagcagcagtagagaggcccatgtgttttttgtttgtttgtttttgtttttttgtttagagatggagtctcgctctgtcacccagtctagagtgc

SEQ ID NO: 16504 - DNA, 92 bp, Homo sapiens
tgtttatatataccatatacacacagatatatatgtgtatatatgccatatacacacatatttatgtatatgtatatgtgtatgtatgtaca

SEQ ID NO: 16505 - DNA, 60 bp, Homo sapiens
gtatatatgtatatgtatacatatatacatgtatgtatgtatacatgcatacatatatac

SEQ ID NO: 16506 - DNA, 235 bp, Homo sapiens
atgaatatttggtgtgcatatatagatacataaacacacatatgtacatatatacacaccatatatgtatatatgtatatataccatatatgtatatatattatatatgtatgtgtatatataccatatatgtatatgtgtatatataccatatatgtatatgtgtatatataccatatatgtatatatgtatatatacatatatgtatatatgtatgtatatatgtatgcatgt

SEQ ID NO: 16507 - DNA, 108 bp, Homo sapiens
gtgtgtatacatatgtatgtgtgtgtgtgtatatatatatattttcaattctctctcaatatatataaaacacatatatatgtttccaattctattgtgtgtacatgt

SEQ ID NO: 16508 - DNA, 66 bp, Homo sapiens
ggggggcagatctctcatgaatgaatgcgttggtgccatccttacagtgatgagtgagtgctctct

SEQ ID NO: 16509 - DNA, 94 bp, Homo sapiens
gttctattgcctgagttccttgatgaggggacactctcgctttctgactgacattcctgtgcctcacatcgagttgaaggctggcaacacaaac

SEQ ID NO: 16510 - DNA, 90 bp, Homo sapiens
ctgggaaaaaggcaggtaaagtagtttggacattgatatagttaagctttgtgtcccaaaccaaatctcatcttaaattgtactccccag

SEQ ID NO: 16511 - DNA, 86 bp, Homo sapiens
ggtccaggcaggagtgataagagagtgttcagtgggacaggcaacgactgggtcaggaagagctctgtattccagtttaagggact

SEQ ID NO: 16512 - DNA, 116 bp, Homo sapiens
tttctattctgaattttttctaatgagcattgatcagtagtttttctttttaatagtaataccccatgaagaggcagctctagctgaaagccctgtaggactgatttgaggagaaa

SEQ ID NO: 16513 - DNA, 158 bp, Homo sapiens
gtatttttatacattctatgtatataaatacatagaatatgtatacaaatatatgtatttgtatacattctatgtatataaatacatagaatatgtatacaaatatatgtatttgtatacattctatgtatataaatacatagaatatgtatacaaat

SEQ ID NO: 16514 - DNA, 80 bp, Homo sapiens
attctatgtatttatatacatagaatgtatacaaatacatatatttgtatacatattctatgtatttatatacatagaat

SEQ ID NO: 16515 - DNA, 80 bp, Homo sapiens; identical to SEQ ID NO: 16514

SEQ ID NO: 16516 - DNA, 78 bp, Homo sapiens
tatacaaatatatgtatttgtatacattctatgtatataaatacatagaatatgtatacaaatacatgtatttgtata

SEQ ID NO: 16517 - DNA, 56 bp, Homo sapiens
atgtatttgtatacatattctatgtatttatatacatagaatgtatacaaatacat

SEQ ID NO: 16518 - DNA, 112 bp, Homo sapiens
tgaagcctgcaggaagaaacctgtgaacaagtgagtgggagaattcacagtggagtcagctccagctcctaactcttactatttattcatacctggtgtcgtcttggtttta

SEQ ID NO: 16519 - DNA, 104 bp, Homo sapiens
cagtggtaccttgtctttggcaaaggaagattcttgccctgagaatttttaggtatttttttttttggcatggtgtacctcggcttcccaatgggtactaattg

SEQ ID NO: 16520 - DNA, 113 bp, Homo sapiens
ggtcttcttcctatttccttcttacttaatttaacagccacttgatgatttgagattttttcttttataaattattgtagctgtatatgtatgtgtatggaatatgcaaggcc

SEQ ID NO: 16521 - DNA, 117 bp, Homo sapiens
caagaatgggcatggtacatagtaggagctcagaaaatctttgcataatgaatgaatgaaagattgtaggttgtgtgctgggtcttttttttttcttgaaatccatgattttttttg

SEQ ID NO: 16522 - DNA, 58 bp, Homo sapiens; identical to SEQ ID NO: 2051

SEQ ID NO: 16523 - DNA, 107 bp, Homo sapiens
tccaaatctttgctattgtgaataatactggaataaatgtgcaaatatctctttgatatacttattttctttcttttgggtttatactaagcagtgggatttctgga

SEQ ID NO: 16524 - DNA, 74 bp, Homo sapiens
tgtacatgtttatacatatatacatacatacatgtttagatatacgtttatatgtatatatgtatacacataca

SEQ ID NO: 16525 - DNA, 76 bp, Homo sapiens
ggtctgagagcagacattgtatgatttccactttttttttttttttttttctgagacggtgtctcgctctgttgcc

SEQ ID NO: 16526 - DNA, 134 bp, Homo sapiens
tctaaggatgggggtggtgggtggaattttatttattttgttttttttttatttttgagacggagtctcactctgcctcccaggctggagtgcagtggcacgatcttggctcacttcaacctctgcctcctggg

SEQ ID NO: 16527 - DNA, 80 bp, Homo sapiens
cctttttgtgtattgggagtccaggcatggcctagctgggtatatctgactcagagtctctcacaagtctgtaatcaagg

SEQ ID NO: 16528 - DNA, 72 bp, Homo sapiens
cactgtggcctggcactggcggaaaaaacagccctcactggaggcaggctggctgtttgcgaggcctcggtg

SEQ ID NO: 16529 - DNA, 95 bp, Homo sapiens; identical to SEQ ID NO: 68

SEQ ID NO: 16530 - DNA, 93 bp, Homo sapiens; identical to SEQ ID NO: 69

SEQ ID NO: 16531 - DNA, 109 bp, Homo sapiens
tagaaactctcaataccagaataaattacatatattatgtgtgtgcttaagtatttttattttactattgcacacacatatatcctatcctggctaaacactgttttta

SEQ ID NO: 16532 - DNA, 118 bp, Homo sapiens
ggaaactagttttggacttctgtccttcactattgtgagagaaaatgttttcattgtttttaaactacaaggttgaggtaattttttacagtagtcacaggaaactaatacagtgtct

SEQ ID NO: 16533 - DNA, 111 bp, Homo sapiens
tgttctcagttctttattttcatattgtaggtaaaattttttttttttaaccatttgatggtatttataaaagttgatttgggacctttaaaagtagaattctgatggaca

SEQ ID NO: 16534 - DNA, 58 bp, Homo sapiens
tgagacagagtctcactctgtcacccaggctggagtgcagtggtgagatctcagctca

SEQ ID NO: 16535 - DNA, 107 bp, Homo sapiens
gtctcctttctctcagatattattatgcagcattaccccttgttcaatgtgtgtcaacagatttatgacagagtgctaacatgatctatatactgggttctctgaac

SEQ ID NO: 16536 - DNA, 116 bp, Homo sapiens
gtttgagaactccatttggactactatgtcgctaccaacaggtggtgttatttttagatttttaaattttagccattctgagtgggtgtgtagtggtaccttattgtggttttgac

SEQ ID NO: 16537 - DNA, 109 bp, Homo sapiens
tataaatatattttatgcttgggaaatttcagaataatatgttgaatatgtatatatatatatatatatactggtatttctggtttgacttaagcaaaatttgcttata

SEQ ID NO: 16538 - DNA, 102 bp, Homo sapiens
gattgtcttggctataggggctttttttcaataccatatgaaatttaaagtagttttttctaaatctgtgaagaaagtcaatggtagcttggtagggatagc

SEQ ID NO: 16539 - DNA, 72 bp, Homo sapiens
ttgttttttgagtcagagtctcacactgtcacccaggctggagtgcaatggtgcaatctcggctcactgcaa

SEQ ID NO: 16540 - DNA, 102 bp, Homo sapiens
tggccattctaacaggtgtgaggtgatatctcattatgtttttgatttgcatttctctgatgattagtgattttgaggattttttcatttacttgttggcca

SEQ ID NO: 16541 - DNA, 58 bp, Homo sapiens; identical to SEQ ID NO: 1409

SEQ ID NO: 16542 - DNA, 67 bp, Homo sapiens
tttgattatgtatgcttatgtgtttttctcactctcagtcgatctaacacataagcatttgttcaaa

SEQ ID NO: 16543 - DNA, 74 bp, Homo sapiens
atatttacaaatcatatatatatgtatatatatatatcatatatatgtatatacacatatgtgtgtgtatatat

SEQ ID NO: 16544 - DNA, 105 bp, Homo sapiens
atcccacttgcccacttggtcatggtatatgatccttttaatatgtatacaattttgttctctagaattatattgaggatttttacatctgtgttcattagggat

SEQ ID NO: 16545 - DNA, 94 bp, Homo sapiens
gtactttcaagtctttgatatctgtttttagtgatacagtttatttttttaaaagcaaaatctaattctgatgtcaaagttttaattgttgtac

SEQ ID NO: 16546 - DNA, 58 bp, Homo sapiens
ggctgaaatgggattaattggaagaaatgaatttttctaattgatttcatgatcagac

SEQ ID NO: 16547 - DNA, 74 bp, Homo sapiens
tgatctatctatctatgtatgttggtggttctcaccccctgccacacacatacctgggacatttggtagtatca

SEQ ID NO: 16548 - DNA, 113 bp, Homo sapiens
attttcttcctcaatcttacaagttaatgatctgaaggaatatttctttttattaaataacaaagaatgaaaaggatgttatttgttcagttctaagttgagttttagaagat

SEQ ID NO: 16549 - DNA, 76 bp, Homo sapiens
aaattgggcaagttgtctgagctcctacaactaattgcttgtaaagttgaagtgagaaaagacgatctgcaagttt

SEQ ID NO: 16550 - DNA, 102 bp, Homo sapiens
atggctaatttttggagaatcaatgttatctatagaactaaggtgacatgaaagagaagatgtcatttatttgctattatgtttggtataaaaaaaggccat

SEQ ID NO: 16551 - DNA, 95 bp, Homo sapiens; identical to SEQ ID NO: 68

SEQ ID NO: 16552 - DNA, 93 bp, Homo sapiens; identical to SEQ ID NO: 69

SEQ ID NO: 16553 - DNA, 118 bp, Homo sapiens
tgtttaaagggttattgagttcacaaggttagtctgcaagaattattagtcatgtcactaaaatttattttgtttgtacttaccttgagtattaactcactcacctatgcagtaagca

SEQ ID NO: 16554 - DNA, 75 bp, Homo sapiens
tctcataagcttttagagcactgtgcaattttcctccttaagacttttgtaattgtagttctattgtttgtgtga

SEQ ID NO: 16555 - DNA, 116 bp, Homo sapiens
cagtctgtggccttaatgagcggaaaatctcagtgggacatcaaataatttatgtatatacatataaatggtatgatggaactccctgattatttataacaatgaagtaagaactg

SEQ ID NO: 16556 - DNA, 95 bp, Homo sapiens; identical to SEQ ID NO: 68

SEQ ID NO: 16557 - DNA, 93 bp, Homo sapiens; identical to SEQ ID NO: 69

SEQ ID NO: 16558 - DNA, 77 bp, Homo sapiens
gagacgaagtctcactctgtcacccaggctggagtgcagtggagagatctcggctcactgcaagctctgcctcccag

SEQ ID NO: 16559 - DNA, 148 bp, Homo sapiens
aaaagacaatcagaaatttatcaggcaaatggtgtatgtgtgcatgtgcatgtctgtgtgtgtgcacattcgggtgcatctagaggtgaagtctgaggttgttttttttttttttttttgagacaacagtctcactctgttgccctgg

SEQ ID NO: 16560 - DNA, 67 bp, Homo sapiens
ttttgagaaagactgtcggtaaccccaaagcccatctgggtcacagtgactgactctaagctcagaa

SEQ ID NO: 16561 - DNA, 80 bp, Homo sapiens
gtgtgtgtatatatatatatacgtgtatatatacgtgtatatataagtatatatatacgtgtgtgtgtgtgtatacatat

SEQ ID NO: 16562 - DNA, 81 bp, Homo sapiens
gacattactattgtacatgttactttttataatgtttgtatttatatacattataaatctcacatgtcatggtataatgtt

SEQ ID NO: 16563 - DNA, 99 bp, Homo sapiens
tcctaggtattttattttctttgtagcaattgtggatgggagttcatatgtgatttgcctctctgtttgcctgttgttggtgcatagaaatgctaggga

SEQ ID NO: 16564 - DNA, 109 bp, Homo sapiens
cttccttgcacaaaacgagtagtgaaacaagtctctgaagctgtgtctctctgaaagggtagagtcggaatgcgtgctctgtggctgtcttatttgtgtttccaggagg

SEQ ID NO: 16565 - DNA, 113 bp, Homo sapiens
ttggttttgtctgtctctttacagagatctttggcatatgtaaagttatcttacgacatagagcaactccatgagctagtgtattattgttcccttttaatagatgagaacaa

SEQ ID NO: 16566 - DNA, 95 bp, Homo sapiens; identical to SEQ ID NO: 68

SEQ ID NO: 16567 - DNA, 93 bp, Homo sapiens; identical to SEQ ID NO: 69

SEQ ID NO: 16568 - DNA, 69 bp, Homo sapiens
gtgtgtgtgtgtgtgtgtgtctgcctatgtgtgtttgtacatagtggtctgatgcaataccatatttat

SEQ ID NO: 16569 - DNA, 111 bp, Homo sapiens
tcagtttggagtctgtgaaggagaagaaccatgcttctaacacaggttttttttttttttttttttaaatgtgctaatagattgttctcgcctttagagaataagtactga

SEQ ID NO: 16570 - DNA, 89 bp, Homo sapiens
ataacatagcagaattgcaaagaggattagagagagcaagagggggctgaacttgtttttttttttttttttttttttgttgttgttgt

SEQ ID NO: 16571 - DNA, 97 bp, Homo sapiens; identical to SEQ ID NO: 1307

SEQ ID NO: 16572 - DNA, 88 bp, Homo sapiens; identical to SEQ ID NO: 1308

SEQ ID NO: 16573 - DNA, 81 bp, Homo sapiens; identical to SEQ ID NO: 1309

SEQ ID NO: 16574 - DNA, 77 bp, Homo sapiens; identical to SEQ ID NO: 1310

SEQ ID NO: 16575 - DNA, 102 bp, Homo sapiens
gatttctgttaggtccttttggtaaagtgtcaagtttaggtcctgaatatttttgttagttttctgccttgatgatctctctgtcagtggagtgttgaagtc

SEQ ID NO: 16576 - DNA, 84 bp, Homo sapiens
gggagaagcatggtttcccagggtcacacattcactcactgcttctctgagtgggggaggtttgcttggctccatgttgctccc

SEQ ID NO: 16577 - DNA, 106 bp, Homo sapiens
gcatttcttttcctccacaacttcaccagcacctgttatttttttacttttaacaattgccattctgactggtgtaagatggtatctcattgtggttttgatttgc

SEQ ID NO: 16578 - DNA, 104 bp, Homo sapiens
ctaagggacgagtgttgaagttctccactattaatgtattggagtctatatttctatttagatctagtagtatttgttttgtgaatctgggtgctccctgttgg

SEQ ID NO: 16579 - DNA, 70 bp, Homo sapiens
ccagtagtgtacagggttcccttttctttttttttttttagacagggtctcactctgtcacccaggctgg

SEQ ID NO: 16580 - DNA, 112 bp, Homo sapiens
acattatgtaggtattagcatctttttttcatgtaactaactcttatttatttatttaaaaaagtttatttccataggttattggggaagaggtagtgttggttacatgagt

SEQ ID NO: 16581 - DNA, 66 bp, Homo sapiens
ggctggggaatggggtaggtgtggtttcggtgattcatgactgtctctctgaccctcttcaatgcc

SEQ ID NO: 16582 - DNA, 113 bp, Homo sapiens
caactccagaatttccatttatttcatggaatatagttcatttatatagttatatgtcacttaatgatggagatatgttctgagaaatgagttgtaaggcgattttgccattg

SEQ ID NO: 16583 - DNA, 143 bp, Homo sapiens
tatgaagtacatgactgcgtgtgtgtatatacatatgtatatacatgtatatatgtatatatatgtgtatatatgtatatatgtgtatatatacacacacagtcatgtgctgcatatatatgtgctgtatatatatatacaca

SEQ ID NO: 16584 - DNA, 119 bp, Homo sapiens
gtaagagtttgttcccttttcactgcaaacctcaccagcatctgttgttattattattattattttttactttttaataatagccattctgactggcatgagatgggaactcattgtgc

SEQ ID NO: 16585 - DNA, 95 bp, Homo sapiens; identical to SEQ ID NO: 68

SEQ ID NO: 16586 - DNA, 93 bp, Homo sapiens; identical to SEQ ID NO: 69

SEQ ID NO: 16587 - DNA, 80 bp, Homo sapiens
cttgggcaatatatacatataaacatatatgtatatatataatatagttacatttatgtttgcatgtgtgtgttttagag

SEQ ID NO: 16588 - DNA, 110 bp, Homo sapiens
ctttccgtgaggtgtaaggtaactctcaaagcattttatgtatattatttattttaatcatcacattagtcttactgttctggggcatctatacgcaatggcagggggag

SEQ ID NO: 16589 - DNA, 115 bp, Homo sapiens
gtggattttagcaacatttgcctgaggcccagtggccttggtgtttcactctgagactgagtcaagcacattctggagacctctgggagaaaggctatggctaggtggtgttcac

SEQ ID NO: 16590 - DNA, 63 bp, Homo sapiens
ggtggacagcctctcagtgactctggggccgctgggtgttcctgaactgatggtgtcttagcc

SEQ ID NO: 16591 - DNA, 115 bp, Homo sapiens
aaagttttgtgggtaatagagtttcttacatgggaagcctaaaagtatatttatttttcattgactgaaaataataacttcttcaggtaaagaactttaggttgacagttatttt

SEQ ID NO: 16592 - DNA, 140 bp, Homo sapiens
tctaaatcagtgtcaaattgcttgagtatgcaacctctagaataggattaacaaactctgtattctgattttgtttttctctagaatgtctaacacagtggttggcaatggtagaattaaagggtatgttgggagggtgt

SEQ ID NO: 16593 - DNA, 95 bp, Homo sapiens; identical to SEQ ID NO: 580

SEQ ID NO: 16594 - DNA, 93 bp, Homo sapiens; identical to SEQ ID NO: 69

SEQ ID NO: 16595 - DNA, 95 bp, Homo sapiens; identical to SEQ ID NO: 68

SEQ ID NO: 16596 - DNA, 93 bp, Homo sapiens; identical to SEQ ID NO: 69

SEQ ID NO: 16597 - DNA, 78 bp, Homo sapiens
tcagcactgagccctgtctctttctctctgtgcccagctggcatgaattggaaggcagaggaaccgagggagttctga

SEQ ID NO: 16598 - DNA, 114 bp, Homo sapiens
gtgtatatatatatacacacacatatatgtacacacatatatgtatatatgtgtatatatatatacacacatatatatgtgtgtatatatgtgtgtgtgtgtatatatatatat

SEQ ID NO: 16599 - DNA, 85 bp, Homo sapiens
tagtttgtaagtaaaaacattggaaggcagttttcatgaaaagaacgtgaatatcttctaaaatgtgtttttatttatctgattg

SEQ ID NO: 16600 - DNA, 62 bp, Homo sapiens
tgtgtgtgtatatgtatgtgtatatgtatgtgcatatatatgtgtatatatatgtatatata

SEQ ID NO: 16601 - DNA, 95 bp, Homo sapiens; identical to SEQ ID NO: 68

SEQ ID NO: 16602 - DNA, 93 bp, Homo sapiens; identical to SEQ ID NO: 69

SEQ ID NO: 16603 - DNA, 95 bp, Homo sapiens; identical to SEQ ID NO: 68

SEQ ID NO: 16604 - DNA, 93 bp, Homo sapiens; identical to SEQ ID NO: 69

SEQ ID NO: 16605 - DNA, 60 bp, Homo sapiens
tgagacagggtctctctctctctcgtccaggcttgagtacagtggcgtgaccttggctca

SEQ ID NO: 16606 - DNA, 95 bp, Homo sapiens; identical to SEQ ID NO: 68

SEQ ID NO: 16607 - DNA, 93 bp, Homo sapiens; identical to SEQ ID NO: 69

SEQ ID NO: 16608 - DNA, 94 bp, Homo sapiens
gaaatgaagatttgctttggaagatacttggaaagtaacatttatttttttctaaagtgctaattaaaggtttctttgggtagatcagaatttc

SEQ ID NO: 16609 - DNA, 109 bp, Homo sapiens
aggagcatggggtatgacttgaggaaggagttgcaatgacatatttatacatcacacatcacacacactgactttctcttcccactcatgctggaaaagccatgagcct

SEQ ID NO: 16610 - DNA, 114 bp, Homo sapiens
gaaaaaaaaatcactgaatgagaaattctgtgtgacttgtatagatgtgatgtgtatatcattctatataatatgtatacatatgtatttttacatttacgtgagaaacatttc

SEQ ID NO: 16611 - DNA, 90 bp, Homo sapiens
tcttcagagaaacactgatctcatctgtctcagacagacaattgtcttctgaaattttcatcttaggagagttcttgggtctttgctaga

SEQ ID NO: 16612 - DNA, 58 bp, Homo sapiens; identical to SEQ ID NO: 2051

SEQ ID NO: 16613 - DNA, 58 bp, Homo sapiens
ctacaagttcataggcagaagggacttgccttgtctcagatgagactgtggactgtgg

SEQ ID NO: 16614 - DNA, 82 bp, Homo sapiens
gttccagctgtatagtttattgtaatttctatgtaattatattacgaagatatcacatattagttccccatgttgctggaac

SEQ ID NO: 16615 - DNA, 109 bp, Homo sapiens
attagtgaggcttatttttggtctgtgttcataatgcttttttttccccatgagtcaatttatttctttgtattagaacaaataagacttatatagggcagtggctagt

SEQ ID NO: 16616 - DNA, 112 bp, Homo sapiens
gagagctgggatttcagattgtgtgaactctttggggtctccttatcaatagatgtttgtttaataaacgtctgggagatgtgtggcagaatttggttggagacctgctttt

SEQ ID NO: 16617 - DNA, 69 bp, Homo sapiens
cactgatatggtttggcgtttggctctgtgtccccacccagatctcaagtcaaattgtaattctcagtg

SEQ ID NO: 16618 - DNA, 102 bp, Homo sapiens
gtttgatacagagttgcaggaatcaactaaattttttgtctaaaatgcacattcactagacagcaagttgctgtgtctgaattctgcacacatctttccaat

SEQ ID NO: 16619 - DNA, 111 bp, Homo sapiens
gctaggatgtgtacttactattaaagggggcatacagcatcagataagggtaccatattttattctgttttgttttcttattcgatggctctgtttctcaaactcctatgt

SEQ ID NO: 16620 - DNA, 101 bp, Homo sapiens
cctgatgtgaatgacacaaagtgaactctgctgcctcatttttttttttcgttttttgaaaaaaaaatttttgaagacagggtctcactttgtcactcagg

SEQ ID NO: 16621 - DNA, 64 bp, Homo sapiens
ggaatccaaatagagagaggaaggggtagagggatgtctgtgtctgtctctttctacggtgtcc

SEQ ID NO: 16622 - DNA, 110 bp, Homo sapiens
caaatggcaaatgtttgaagtgtgggccctacactgaagttcttcacaatgttaatctatacatgtatgaagattttcattttaaagcctttcatgttaaatattgtttg

SEQ ID NO: 16623 - DNA, 110 bp, Homo sapiens
accttcagtctctcataaccaccattctaccttctgcttctacaaagcatgtttgtgtgtgtgtgtgagtgtgtgtgtgtgtgtgtgtgtgtgtgtgtgtgtgacagggt

SEQ ID NO: 16624 - DNA, 109 bp, Homo sapiens
ggtcactaaagaactaaagattagacctgggccatcgatgttaaccaataaaaacaaagctttgtttatatctatatatctatgtgtgtatctattttggtatgtgacc

SEQ ID NO: 16625 - DNA, 95 bp, Homo sapiens; identical to SEQ ID NO: 68

SEQ ID NO: 16626 - DNA, 93 bp, Homo sapiens; identical to SEQ ID NO: 69

SEQ ID NO: 16627 - DNA, 118 bp, Homo sapiens
aaacaacaatctttgcttctaacattagccttccagagctggtgtggattattattttttaaaatttaatggttgtcaaaagcctgttttgggtaaagttgattcataaatgttgttt

SEQ ID NO: 16628 - DNA, 106 bp, Homo sapiens
ggtgtcaaattgacttatgaattttgtgagactcgtaatcctatttaattgcaaagtatttttgtaattgaaaatacgtgtatattcatcaccaaatcttgacatc

SEQ ID NO: 16629 - DNA, 106 bp, Homo sapiens
ctttgtatgtgtctacacacatatgtatacatgtatgtatatgtccataagtatggatattttatttatatactttctatatgtgtattatgttacacaataaaag

SEQ ID NO: 16630 - DNA, 60 bp, Homo sapiens
gagacagagtctcactcactctgtcgcccaggctggggtgcagcagtgcgatctggtctc

SEQ ID NO: 16631 - DNA, 108 bp, Homo sapiens
tcttgtagagattaaatgaaacaaagtacaagaaatcatctagcatagttctttttatatagatgatcaagatgatttactgtcattctttcttttgctctaatttga

SEQ ID NO: 16632 - DNA, 100 bp, Homo sapiens
aggtacagaaattcttgtaagaaattgtttcttatgtgccaaggtgaagttaatcaggaaaggtattttagaaaaagtgaatacaggttgaactgtgcct

SEQ ID NO: 16633 - DNA, 111 bp, Homo sapiens
tttctgctttcttctctgcatccttcttcaggcaataagaagagtcactgatcagtttttaattttatttcctggagagatatgcagcatggagctttaaaaactcaggga

SEQ ID NO: 16634 - DNA, 82 bp, Homo sapiens
tgagtcagggtctccctctgtcactaaggctggagtgaagtggtatgatcactgctcagcacggcctcaacctcctaggccc

SEQ ID NO: 16635 - DNA, 111 bp, Homo sapiens
gttaccacacagtgggtcatgctacaggggatcaactaactggtttttttttttttttttttttttttgagaccgagtcttgctctgtcacccaggctggagtgaagtggc

SEQ ID NO: 16636 - DNA, 81 bp, Homo sapiens
ctctgtctgtgaacagtgtgtccacattgatgtctgtagtaactgctgaccaattgacagattagtatgtttcaggtggag

SEQ ID NO: 16637 - DNA, 82 bp, Homo sapiens
tttgtttaccaatgaatacacagtgcatagcaccatacctggcatgagtgctctgtcactcagtgtttgttgatttaataag

SEQ ID NO: 16638 - DNA, 75 bp, Homo sapiens
gcaaatatattggtctgtgtatataaataaaaacagaactctgtgtgtatgtgtatatatatatgtatgtattgc

SEQ ID NO: 16639 - DNA, 88 bp, Homo sapiens
gataagaagactctagtttctttgtttaagtagctgtcagagggtttatatggctaataaggctaaaaggagattagagttacccatc

SEQ ID NO: 16640 - DNA, 114 bp, Homo sapiens
gaatgtaatttaagaaagagcattgaaggaaataaaatgtgaaaatcaccatgtttcattgaatatatttgaattacattttctttacctcatttgtcctattcttaaacattt

SEQ ID NO: 16641 - DNA, 87 bp, Homo sapiens
ttgttttttgagtcagagtctcactctgtcacccaggctggagtgcagtggtgcgatcttggctcactgcagcctctgtctcccggg

SEQ ID NO: 16642 - DNA, 81 bp, Homo sapiens
ccagaggcgcagaagaggaagagcagtctcacggcaggtgtgatcgatcacactgaccagacaaggccctcctgccactgg

SEQ ID NO: 16643 - DNA, 76 bp, Homo sapiens
catggatgaggctccgggccctaagggtggcagcgcctgtcagtctctgcctgcctgcgttcgtgttagggctagg

SEQ ID NO: 16644 - DNA, 103 bp, Homo sapiens
ggggcttcttggacctcctgacttgaggtggcgtctgttgcactggtcctcacacagaaggcagtgtccacctatctgcgccatggggcatcctcattttccc

SEQ ID NO: 16645 - DNA, 108 bp, Homo sapiens
gaagatgtcttgcacccatgagctgtaccatcagtaggtctatttttatttatattttcttatttcagatctctgtttacatcactaggtctaaaagcagacttcttc

SEQ ID NO: 16646 - DNA, 111 bp, Homo sapiens
gtcttgacccactgtgttttcatcagcatgtgctgggggtttgaggctctctgtctgtctcctcctagacgaaatgctgtcttttgccgtgatagccacatccgttaagat

SEQ ID NO: 16647 - DNA, 119 bp, Homo sapiens
tatttgtttttcttcattagatttctgagctggaagcactgtactgaagtcttgaaatgtataagattattattataaattggaagcacgggagacagggtggaattgaagaagaaata

SEQ ID NO: 16648 - DNA, 66 bp, Homo sapiens
cttccctgttccacttagttaggctagacctcaggtctgcacagcagactgagctgacacaggaag

SEQ ID NO: 16649 - DNA, 104 bp, Homo sapiens
atatatgtgtatgtgtatatgtgtatgtgtgtatacacagatgcagaggcatatatatatatatatatatgatatacatatggacacagacacacatgtacaca

SEQ ID NO: 16650 - DNA, 118 bp, Homo sapiens
ctgtactactttctagctccatgaccttgagcaagtttctttacctctctgagactcagtctcccagactatgaaactgcgttgagactccatatcatggcagagagaacacaggtag

SEQ ID NO: 16651 - DNA, 100 bp, Homo sapiens
acattgattttgtagcctgaaactttactgaaattgtttatcagttctgggagccttctggtggagtctttaggattctttatgtatagaattatattgt

SEQ ID NO: 16652 - DNA, 95 bp, Homo sapiens; identical to SEQ ID NO: 68

SEQ ID NO: 16653 - DNA, 93 bp, Homo sapiens; identical to SEQ ID NO: 69

SEQ ID NO: 16654 - DNA, 117 bp, Homo sapiens
tgctgttatatgatgtctgaaaatcattatttcatgtatttggatttctagctgttttaggtgaaacggtaaatccagcctctgtgacctatgattatgaccttctttcgctttgta

SEQ ID NO: 16655 - DNA, 78 bp, Homo sapiens
tgtgtgtatatatatagtgtgtatgtatatctgtgtgtatatatataatgtgtatatatatctgtgtgtgtatatata

SEQ ID NO: 16656 - DNA, 79 bp, Homo sapiens
agtgtctggctctgtcgctccggctggagtagagtggtatgatcacagctcacggcagctgcagcctcgacctcccagg

SEQ ID NO: 16657 - DNA, 72 bp, Homo sapiens
ctgggtgtggtggctcatacctgtagtcccagctacttgggaggctgaggtagaagaatcacttgaacctgg

SEQ ID NO: 16658 - DNA, 112 bp, Homo sapiens
tgtaagttacctgttcagttgcggtcttttattcaggagtgaagtttatttgatttattcatcaagactttctctgtctcaggatataagattttaaatggtgaagaatgca

SEQ ID NO: 16659 - DNA, 117 bp, Homo sapiens
tggaggttaaaggcaagatgtaggttggttagattatgtctctttcactgtcataattttctcattgttatgatcttgcaaagagagtttcattcctacttgggcatcaagactcca

SEQ ID NO: 16660 - DNA, 78 bp, Homo sapiens
agttagagtcaggggatgttttgtttctttttttttttttttttttttttttttgagacagagtctcctgctggagct

SEQ ID NO: 16661 - DNA, 79 bp, Homo sapiens
gttaaaactgtggaacttgagaagttgtaggatctatagatcccacaatattttaaagattttgaatagttactgtagc

SEQ ID NO: 16662 - DNA, 95 bp, Homo sapiens; identical to SEQ ID NO: 68

SEQ ID NO: 16663 - DNA, 93 bp, Homo sapiens; identical to SEQ ID NO: 69

SEQ ID NO: 16664 - DNA, 112 bp, Homo sapiens
gtcccagatttactgtttttcttgcaacagaaagatttttagaatgttcattaatgacaaagaaatatttaatatatttttagaactttcttgtagatcggtagttctagac

SEQ ID NO: 16665 - DNA, 118 bp, Homo sapiens
tatatatataaattcccttctcattcatatatatatatatatatatatatatgtaatcccctctcattcacatatataaatgtgtatatgtatatatgtgtgtgtgtgtatatatata

SEQ ID NO: 16666 - DNA, 118 bp, Homo sapiens
tgtatatgtatgtatatatacacatatgtgtgtatgtgtatatacacacacacatatgtgtgtatgtatatatatatctatatatacacacatatgtgtgtgtatgtgtatatatata

SEQ ID NO: 16667 - DNA, 109 bp, Homo sapiens
ttcttctgtatactttaaataatacctagattacttataatacctaatacgatgcaaatgctatgtaaatagttgttatactgtgttgtttagggaataatgacaagaa

SEQ ID NO: 16668 - DNA, 82 bp, Homo sapiens
catggctgtagtcccagctattcaggaggctgaggtagaaggatcacttgagcctaggatgttgaggctgcagcgagccatg

SEQ ID NO: 16669 - DNA, 95 bp, Homo sapiens; identical to SEQ ID NO: 68

SEQ ID NO: 16670 - DNA, 93 bp, Homo sapiens; identical to SEQ ID NO: 69

SEQ ID NO: 16671 - DNA, 118 bp, Homo sapiens
gtgacttcgttatttttcatggctgagtaggattccatggtatgggtgtgtgtgtatatatatatatctacacatatacatacacattttctttatccagtcatccactgatggacac

SEQ ID NO: 16672 - DNA, 66 bp, Homo sapiens
atgtgtgtatatatgtgtgtacatatcatatacacacatatatgtatgtacatatcacacacacat

SEQ ID NO: 16673 - DNA, 65 bp, Homo sapiens
tgagacagagtctcactcactttgtggcccaagcatggagtacagtggggcaatctctctgctca

SEQ ID NO: 16674 - DNA, 103 bp, Homo sapiens
atgctaaatgatgagttaatgggtgcagcacaccaacatggcacatgtatatatatttaacaaacctgcacattgtgcacatgtaccctaaaacttaaagtat

SEQ ID NO: 16675 - DNA, 90 bp, Homo sapiens
ccagatctggtggagagggaggggcttgggattggatgaacattttttttttttttttgagacagagtctcgctgtgtcacccaggctgg

SEQ ID NO: 16676 - DNA, 93 bp, Homo sapiens
aaatggctgtgatctaaaaattgtttaaagtatatgtgtatatatattatagtttatatatatacattcacacacacatagacacacacattt

SEQ ID NO: 16677 - DNA, 93 bp, Homo sapiens
aaatgtgtgtgtctatgtgtgtgtgaatgtatatatataaactataatatatatacacatatactttaaacaatttttagatcacagccattt

SEQ ID NO: 16678 - DNA, 95 bp, Homo sapiens; identical to SEQ ID NO: 68

SEQ ID NO: 16679 - DNA, 93 bp, Homo sapiens; identical to SEQ ID NO: 69

SEQ ID NO: 16680 - DNA, 115 bp, Homo sapiens
gtctttccaggtctactctcgtctcttttggttttgaggccgagtgatctgacagatcacagagccaagacaggtgcacccctctccccttatcttccttctgtgagttcaggtc

SEQ ID NO: 16681 - DNA, 58 bp, Homo sapiens; identical to SEQ ID NO: 303

SEQ ID NO: 16682 - DNA, 81 bp, Homo sapiens
aaatatgtgcatatgagattagactacatctaatccataaattggagcagatgttttgtgtatttcatcatgtgcatgttt

SEQ ID NO: 16683 - DNA, 116 bp, Homo sapiens
ttgccagagatcatgggaccagagtatgtaaacctcctgggtctctgtgtgtgcctgagtggctgctttgacaagactccacacagctttatgtatctgacccaaggccctggtgg

SEQ ID NO: 16684 - DNA, 67 bp, Homo sapiens
ggttgctattggggagggtgagtgcagccttaggtgaggtggctctctccctctgtctgaagttccc

SEQ ID NO: 16685 - DNA, 111 bp, Homo sapiens
gcactcccattcctttcagtgcactgccattgttttaaacggaaatgtagcccctgctactttatttctagatttataaacagtacacaagaatattctcatgggctatgc

SEQ ID NO: 16686 - DNA, 95 bp, Homo sapiens; identical to SEQ ID NO: 68

SEQ ID NO: 16687 - DNA, 93 bp, Homo sapiens; identical to SEQ ID NO: 69

SEQ ID NO: 16688 - DNA, 74 bp, Homo sapiens
aaggaacacttccactctgctggtgggaatgtaaactagtacagccactacagaaaagagtgtggagattcctt

SEQ ID NO: 16689 - DNA, 115 bp, Homo sapiens
tcaggttgggaattgtgtgtgcccttctttgagggcacaaccagagaattttagacttagaacagagtgaggactattacagtccatcattttacaaatgaggacattaaggttc

SEQ ID NO: 16690 - DNA, 98 bp, Homo sapiens
gtgttcttatttcttaatgtagatgcttatttataattttagatgcaatatgatgtagtcataggcccatctggtatctaggcaggaatgtagtccat

SEQ ID NO: 16691 - DNA, 59 bp, Homo sapiens
ctggtggtggggtgagggaagggtaacacagcagactcctctcactgtcactttcccag

SEQ ID NO: 16692 - DNA, 160 bp, Homo sapiens
tgtacgtttatgtatatatgtatatttatgtaaaaattacacatatatatgtatatacatatatatttatgtatacatgtatgttgaaatatataataggaattggatattgaatttatatattatatataaaatatatattgaacataatatatattgt

SEQ ID NO: 16693 - DNA, 95 bp, Homo sapiens; identical to SEQ ID NO: 68

SEQ ID NO: 16694 - DNA, 93 bp, Homo sapiens; identical to SEQ ID NO: 69

SEQ ID NO: 16695 - DNA, 95 bp, Homo sapiens; identical to SEQ ID NO: 68

SEQ ID NO: 16696 - DNA, 93 bp, Homo sapiens; identical to SEQ ID NO: 69

SEQ ID NO: 16697 - DNA, 107 bp, Homo sapiens
gagttgagagttaggtcagaggtttatttggtttatttatttgtatatttagttgcttgtatatttgctaaaattgcttagtcctctaacaccatggggctcctatc

SEQ ID NO: 16698 - DNA, 111 bp, Homo sapiens
cccttgtggtgtgaaatggggcggggctaggatgaaaaagtgagtaggttgtgagctcaaccatgggctctatttgtgctcttgttctgggcctcatgaatgttaggaggg

SEQ ID NO: 16699 - DNA, 101 bp, Homo sapiens
acctaccttctgcaggcacttctgggtatctctgtctctctgtctttgctatctgggctaaacaggtacgaggcagcaatttcctctgtagcagaataggt

SEQ ID NO: 16700 - DNA, 84 bp, Homo sapiens
ggcagaatctactgtgtttgttaaatattttgcagtccttaggaggacatttttgtttttttataaagagcagtaaattctgtc

SEQ ID NO: 16701 - DNA, 84 bp, Homo sapiens
gtactttttagcctcagaggttttttttgttttgttttgtttttttaaagacaggatctggttttatcactgaggctgaagtgc

SEQ ID NO: 16702 - DNA, 95 bp, Homo sapiens; identical to SEQ ID NO: 68

SEQ ID NO: 16703 - DNA, 93 bp, Homo sapiens; identical to SEQ ID NO: 69

SEQ ID NO: 16704 - DNA, 74 bp, Homo sapiens
aagagctgattgaatactcaaagactatttcccacctaattgttagtttttctttgattattcataaggttctt

SEQ ID NO: 16705 - DNA, 97 bp, Homo sapiens
tataaatctatgtatgtatgtgtatatgtatatgtatagatataaatgtatgcatattaatatatatttatatttacaatacatatataacatatat

SEQ ID NO: 16706 - DNA, 80 bp, Homo sapiens
atcagcaagttatatatatatatgtgtgtgtgcatatatatatatatatatatatatatatatatatatgagctgtaggt

SEQ ID NO: 16707 - DNA, 114 bp, Homo sapiens
atataagaaattgagtgagtaggtttgctttttgcgtcatgatataaagaatccttaaagtttttttttttttaatgaagcaccccatgtgtgctctctcaggtatctgtatat

SEQ ID NO: 16708 - DNA, 120 bp, Homo sapiens
caggctagccacaggtcttacaagtagtaacaaatctcatttttttttttttttttttttttttttgagacagtggttcactcttgttgcccaggctggagtgaaatggcatgatctcag

SEQ ID NO: 16709 - DNA, 69 bp, Homo sapiens
ctgaaagtcacactgggcagtctgtcacgtatcgaaacatgcagaagagagactgtacagaacgtgcag

SEQ ID NO: 16710 - DNA, 87 bp, Homo sapiens
gtctgggcaacacagtgagaccccatctctacaaatgtatattttttacattagctaggcgtggtgggacacacctgtagttctaac

SEQ ID NO: 16711 - DNA, 100 bp, Homo sapiens
atttagcaagtataggaactcagactagagacagaatgagattcaaatagcttgactctcttgtcttgtatatatgtgtgtgtatctttcacttctaaat

SEQ ID NO: 16712 - DNA, 85 bp, Homo sapiens
ggtgtgggcctaatctgatagaattgctggtcttgtaagaggaaaacagcctgtctttctctgtgtgcataccaagaaaaggccc

SEQ ID NO: 16713 - DNA, 106 bp, Homo sapiens
gaacaatgccattttgtatagtctgtggatgtcgtagatggtagttatgtaatgaatgctttggacatttttaaacatttacacatgcaaggcttcaatgtttggc

SEQ ID NO: 16714 - DNA, 114 bp, Homo sapiens
ttcatggcaagttgtagtaaatgggtaccatccagtgtaactgcagcacttacaaaatgaggagaatgtagactgcagccatactacaatgggacttgtacgcaatgttaagga

SEQ ID NO: 16715 - DNA, 95 bp, Homo sapiens; identical to SEQ ID NO: 68

SEQ ID NO: 16716 - DNA, 93 bp, Homo sapiens; identical to SEQ ID NO: 69

SEQ ID NO: 16717 - DNA, 92 bp, Homo sapiens
ttggtggattgtatggtaacagcatgtttagttttgtgagaaattgccaaactgtctttcatggtggttgtatctttttgcatttccactaa

SEQ ID NO: 16718 - DNA, 95 bp, Homo sapiens; identical to SEQ ID NO: 68

SEQ ID NO: 16719 - DNA, 93 bp, Homo sapiens; identical to SEQ ID NO: 69

SEQ ID NO: 16720 - DNA, 95 bp, Homo sapiens; identical to SEQ ID NO: 68

SEQ ID NO: 16721 - DNA, 93 bp, Homo sapiens; identical to SEQ ID NO: 69

SEQ ID NO: 16722 - DNA, 69 bp, Homo sapiens
gcctgagacccatccgtttacataacagacacagcactgtggtctcctgtgtgactgttaggtctgagc

SEQ ID NO: 16723 - DNA, 102 bp, Homo sapiens
caatatatatcaaaggccttgaaataaatataaatgtatttttgaaaatacacaagaggtgtgtatatttgtattataagatgtctggttttttgtgtgttg

SEQ ID NO: 16724 - DNA, 122 bp, Homo sapiens
gagaaaccggaagcagcgtgcagttaaactttagagtaccaagacaccacacaacacagacatgacagtgtgcaatttgaatgtaactcttagtatgatcctccatgttccagttttcaggt

SEQ ID NO: 16725 - DNA, 120 bp, Homo sapiens
taggatgtatttttcccagcagtgcctccacttgactaggtagtatgtaaatgtgcataaactttttaaatttatggttaagagggttcatgatgttataattaagggacagactaggtc

SEQ ID NO: 16726 - DNA, 79 bp, Homo sapiens
tatctgtttgtaaaatgtgaatatgtatttctctctgtgtggggaagggtggatatacagaaatgtgagtaaacagata

SEQ ID NO: 16727 - DNA, 111 bp, Homo sapiens
gggaagaactcttttttagtggatgatatttgagttcaggtttttggttgttaacaagttaagtaggatctgacctttcaggaaaatggtatctcagacagattttttccc

SEQ ID NO: 16728 - DNA, 86 bp, Homo sapiens
caagaagagagagagaaaaagaaagggattgagggagaggagagagaattctctagtgtcttttttttttttttttttttgagatg

SEQ ID NO: 16729 - DNA, 114 bp, Homo sapiens
agccctagaacagctggagatcatttgcctccaggataggacttggaagagactttttctgtctcctatattcctggagctgctctggttctcttcttgcccaggtctagtcct

SEQ ID NO: 16730 - DNA, 98 bp, Homo sapiens
ccactgcactccagcctgggcgacagagcgagactccttggttttgttttgtttttgagactgagactcactctgtttcccaagctgaagtgcagtgg

SEQ ID NO: 16731 - DNA, 87 bp, Homo sapiens
tgttatttttgaagagccagatatacatagatgcatatttttttcattagaaaatacctgctctgagtatactctggtaagattgca

SEQ ID NO: 16732 - DNA, 116 bp, Homo sapiens
gtttccaaattgcagtgttggaaaaggtcttagagattatctggcacaatattattattttatagttcagagaagttaagtgccttgatccaggacacatggctactggtggaaac

SEQ ID NO: 16733 - DNA, 107 bp, Homo sapiens
tcaatggaatgtggatagtgcgtttgatttagtaggattagagtaattgtatttgtgacatttcaaacactcagttgaattaaacatgtggcaattccatctgttgg

SEQ ID NO: 16734 - DNA, 70 bp, Homo sapiens
tgagaatgaatgttgaattttattaaatgcatttttggcatgtaagaaatggatccgatgtttgttctca

SEQ ID NO: 16735 - DNA, 58 bp, Homo sapiens
tgtcattattacatgatgtatagtatacaattaaatatatcatgtaatatgtatgaca

SEQ ID NO: 16736 - DNA, 99 bp, Homo sapiens
tttgggaaatcttacagatatgcttttttaaaattagcatcatgcaaaataagcaaaaaaatatttttttaaaattagcatcctgcaaaattacccaaa

SEQ ID NO: 16737 - DNA, 90 bp, Homo sapiens
gctttggtaaattagaagccagaagtagaacagaagatagaatcattttatttttataagaaaccatactatgaatttgattaccagagc

SEQ ID NO: 16738 - DNA, 73 bp, Homo sapiens
atatttatatatatttatggtatacaatatgatgctttgttatatgtatacagtgctgaatatgtatttgtat

SEQ ID NO: 16739 - DNA, 74 bp, Homo sapiens
tgatgtagtgaaaggcaggtcagggagaggaaaacaacctgggctttttatagtctctctgagtcactgaatca

SEQ ID NO: 16740 - DNA, 98 bp, Homo sapiens
gctgcctagatttaaagcagtggaattgaggttcagagactttaggggatttcctaaacttgactctctcactctatttcagtgctgtgtgaggtgac

SEQ ID NO: 16741 - DNA, 101 bp, Homo sapiens
gccaggcacaaaagattacttttgtatgattctatttatatgaaatgttcagaacaggcaagtctatggagacagaacataaactagtggtcgcctagggc

SEQ ID NO: 16742 - DNA, 98 bp, Homo sapiens
gaggcaggagaatcgcttgaacctgggaggcagaggttgcagtgagctgagagtgaccactgcactccagcctgggtgacagagtaagactctgtctc

SEQ ID NO: 16743 - DNA, 116 bp, Homo sapiens
taggtgctccaggaatcacctagattttagtgacaagataaaagatgtttggttttcacagtgccagttcatttgcttgtttccatgtttgttttgtgacccttggtaagtctgct

SEQ ID NO: 16744 - DNA, 104 bp, Homo sapiens
gggaattggtatgcttctgcttctatcaggttgtctcggggattgagacttctattagtctctttaactctgagtctcagagaatgtggagagagcctattctc

SEQ ID NO: 16745 - DNA, 96 bp, Homo sapiens
caagttacttaacttatctgaatgtatttttttgtctttaaaactgggataataattccattcaggaagatggaaatagataagttatgttaattg

SEQ ID NO: 16746 - DNA, 143 bp, Homo sapiens
atgtataatatacgtatatacgtatatatgtatgtatatacgtatatacgtatattatatgtatgtatatatgcatatacctatattatgtatatacgtatatacctatattatgtatatacgtatattatgtgtatatatga

SEQ ID NO: 16747 - DNA, 77 bp, Homo sapiens
acatatattatatgtatgtgtatatatatacatatattatatgtatgtgtatatatgtatatgcatatattatatgt

SEQ ID NO: 16748 - DNA, 74 bp, Homo sapiens
actgtaagtgtatatatgtaagtgtatatatacatatatagtatataaacatattgtatatatacatatatagt

SEQ ID NO: 16749 - DNA, 89 bp, Homo sapiens
ttgaaaccacttcatctctccttactctcactctgtcttctacctcagcaatgttcaggtcagtttaattgaggtgtaggtggtagtaa

SEQ ID NO: 16750 - DNA, 194 bp, Homo sapiens
atatgtgtatatatgtgtgtatatatgtgtatatatgtatatatgtgtatatatgtatatatgtgtgtatatatgtatatatgtgtatatacatatatgtatatgtatatgtgtgtatatacatatatgtatatgtatatatgtgtatatacatatatgtatatgtatatatgtgtatatatatgtattttagc

SEQ ID NO: 16751 - DNA, 115 bp, Homo sapiens
agtttgaaatggtagagtgaggaaaaagcagaattttttataggaagaaaactcattttgttaatgggcatatttagatataaaaagctttttttttttttaactatccaagact

SEQ ID NO: 16752 - DNA, 115 bp, Homo sapiens
cctgactttttaatgattgccatcctaactggtgtgagatggtatctcattgtggttgtgatttgcatttctctgatggccagtgatgatgagcattttttcatgtgtcttttgg

SEQ ID NO: 16753 - DNA, 106 bp, Homo sapiens
gcactacagactggatgatgcagtgagaccctgtctctctctttttttttttttttttttttttttttttgagatggagtcttactctgtcgccaggctagagtgc

SEQ ID NO: 16754 - DNA, 187 bp, Homo sapiens
acatatatacacatatatacacatatatgtatatatacacatatatacacatatatatgtgtatatatacatatatgtatatatatatacacacacacataaatatgtgtatatatgtatatatgaactatgtatccatgtttcagaaatatgtatatatatgtgtgtgtgtgtgtatatatgtgtg

SEQ ID NO: 16755 - DNA, 187 bp, Homo sapiens
gtgtgtgtatatatatatacatatatgtatatatacacatatatatgtgtatatatgtgtatatatacatatatgtgtatatatgtgtatatatgtatatatatacatatatgtgtatatatgtatatatatacatatatgtgtgtatatatgtgtgtgtgtgtatatatatatatatatagacaga

SEQ ID NO: 16756 - DNA, 107 bp, Homo sapiens
ggcatggtagttgtatgactgtggttccagctgcttgggaggctgaggtaggaggatcacttgggcccaggaggtggaggctacagacgctgcagtgagccatgatc

SEQ ID NO: 16757 - DNA, 115 bp, Homo sapiens
actaagttttcttaggaggattctattactgttttaggaggattctctggttgctattctgtaagaagagactgaagaaaatggagcatgggaacagtcagcaaggtcaattagt

SEQ ID NO: 16758 - DNA, 116 bp, Homo sapiens
ctttgttctttttgcttaggattgtcttggctatgtgggctcttttttggttccatatgaaatttaaagaagttttttccaattctgtgaagaaagtcaatggtagcttgatgggg

SEQ ID NO: 16759 - DNA, 104 bp, Homo sapiens
ttgtggaaagactaggattcttatttttccaggtttcttctcataaaaggagctaagctatgtgatgagagtgaggaaagcattaagagtacctgagaacacaa

SEQ ID NO: 16760 - DNA, 89 bp, Homo sapiens
tacatgtctatcatatgacacaacaatttcactcttggaatatacccaataagaatgtatgtatgtatgtatacatagatagatatgtg

SEQ ID NO: 16761 - DNA, 95 bp, Homo sapiens
gatctggaaaagacacatatttttttatttctactatatgacattctgaaaaaagaaaacctagagacagtaaagaagttagtgactgccaggtt

SEQ ID NO: 16762 - DNA, 74 bp, Homo sapiens
gaggacttcagcatggcagagatgatctgtggtatcacacactgactctggaacatctcaatgctcatagcctc

SEQ ID NO: 16763 - DNA, 113 bp, Homo sapiens
ttcaaaccttcaccagaatgttatttatttttcataatagtatttttaactggggtaaaaaatatttcattatgatttggatttgcattttcctgatgattagtaatgttgag

SEQ ID NO: 16764 - DNA, 118 bp, Homo sapiens
aagagcataagaaaaaatatatatacacacgcacatatacatagagtttttagaactgttttattaattatattattgttactatgtatgtgatgtgtggtgctttttcttggcactt

SEQ ID NO: 16765 - DNA, 86 bp, Homo sapiens
tatataggtgatatataggatatatataggtgatatatatatgatatatatatatcctctctctctatatatatatatgtatacac

SEQ ID NO: 16766 - DNA, 110 bp, Homo sapiens
gtgttacacagctctaaataatgaatgcaaatatcatgttctctcttaggaatttttcttttattattatcaatagagagcaaggtgtaagctaggtgcatggtgaacat

SEQ ID NO: 16767 - DNA, 82 bp, Homo sapiens
tatatatatatatattatatatatagccctggactaggcctatggcgctctctctctctatatgtgtatgtgtgtgtgtata

SEQ ID NO: 16768 - DNA, 60 bp, Homo sapiens
tatatatatatatatatatatatatatatatatatgcatgtgtgtgtgtatatatatata

SEQ ID NO: 16769 - DNA, 223 bp, Homo sapiens
taagttgcaacccaatttttatatatatgtaaaatatatatgtatatacacacacatatatatatataaattaggttgcatatatatacataatatataaattgggttgcgacttactaggttaaaaaatatagcacttttgtataagtataatgtgtatatatatttacatgtatatatcaggttgcatatgtatctttgcctatgtctatgttttttttag

SEQ ID NO: 16770 - DNA, 115 bp, Homo sapiens
gcagaagtcttatcctcatgatgaaaatactaggagaaaaactgtcctttatatatatgtatatatatggtatttttttttttttttttttttttgagatggagtctcactctgt

SEQ ID NO: 16771 - DNA, 69 bp, Homo sapiens
acccagtcaaagacccagagggcccactgagctgcccaaaattctgtcttccctctgtgtcagcttggt

SEQ ID NO: 16772 - DNA, 93 bp, Homo sapiens; identical to SEQ ID NO: 69

SEQ ID NO: 16773 - DNA, 216 bp, Homo sapiens
gtatatagatatatctatagaaatctatataaatctctatatagatattttatagatatatctatatatctatatatctatatctatagatatctatatctgtatatctatatatctctatatctgtatatctgtatatatctgtatatctctagatctatctatatatatatatatatgtctgtatctatagatatagattttttttttgacaga

SEQ ID NO: 16774 - DNA, 111 bp, Homo sapiens
actgaatggtgaagagagctagaatatggtcatgagaagaagaaaaaaaagtctgtttttttatctgtttaaccatgcccttatgccttttttcttttctttttagtccca

SEQ ID NO: 16775 - DNA, 115 bp, Homo sapiens
gtatacatatatactgtgtatatatatactgtgtatacatatatactgtgtatacatatatacttgtatatatatacacagtgtatatatacacagtgtatatatatactgtatg

SEQ ID NO: 16776 - DNA, 133 bp, Homo sapiens
gtatatatatactgtgtgtatacatactgtgtatatatatactatgtgtgtatacatgctgtgtgtatatatatgtgtatatacatactgtgtgtatatatataccgtgtatatgcatactgtgtgtatatat

SEQ ID NO: 16777 - DNA, 105 bp, Homo sapiens
tatgtataatgtgtatatatatacgctgtgtatatatatactgtgtgtatatatatatatgctgtgtatatatatactgtgtgtatatatactgtgtattacata

SEQ ID NO: 16778 - DNA, 144 bp, Homo sapiens
gagtatatatatatacacggtatatatatacacagagtatatatatatatacacggtatatatatacacagagtatatatatatatacacggtatatatatacacacagtgtatatatacagtgtatagagacagtgtatatac

SEQ ID NO: 16779 - DNA, 76 bp, Homo sapiens
gtgtatgtgtgtgtatgtgtgtgtgtctatatatgtgtgtatatatatagacacacacacatacacacacacacac

SEQ ID NO: 16780 - DNA, 106 bp, Homo sapiens
ttggctaggattctttaggtatttcaggtatggagtttgtgtacttcaggtagtgtctgtattttaaatatattttctatatttcaggtttagagtatttagccaa

SEQ ID NO: 16781 - DNA, 97 bp, Homo sapiens
gtttgctattttgttacattggtctatgtgactattttttttttattactatactttaagttttagggtacatgtgcacaatgtgcaggttagttac

SEQ ID NO: 16782 - DNA, 113 bp, Homo sapiens
gttcctgtgacaagctggggcctgaaagggagactcccctgacagtctgagcaggaggctgaatctgtcactgtctggctggcagggctgaaagggttgtctgcggcaagagc

SEQ ID NO: 16783 - DNA, 77 bp, Homo sapiens
tacagacaatatatatagcatcatcacatttctgttaagtgtgtgtgtgtgtgtgtgtgtgtgtatgtatgtgtgtg

SEQ ID NO: 16784 - DNA, 110 bp, Homo sapiens
tctcatctttgtgggcttatctacctttgatctttgaggttgctgacctttgaaagggtttcttttttattatactttaagttttagggtacatgtgcacattgtgcagg

SEQ ID NO: 16785 - DNA, 109 bp, Homo sapiens
gtttctttcttctgcatatggttatttagtttacccagcactatttttttattttttatttgtttagagtcagtgtctggctctgttgcccagacaggagtacagtgac

SEQ ID NO: 16786 - DNA, 119 bp, Homo sapiens
gcaagcagaatgagggctctaagacctcactattactttgggactttatgtttaattttatctacagacaacaataacaaaagctgaagagataatgggtcctgtcaccattctgttgt

SEQ ID NO: 16787 - DNA, 112 bp, Homo sapiens
ggatctttttggcttctgttttagggtgctgtgtacccctcacagctaggaggcttatctctgaggttgtagatagtatttacaaatagaacttgagttaacttgaaggaac

SEQ ID NO: 16788 - DNA, 66 bp, Homo sapiens
gggaagactggcttctgcagcccagtgtggcttcacactagtcagaagacacagattctgtatccc

SEQ ID NO: 16789 - DNA, 111 bp, Homo sapiens
ctgtgagaaatgaatgttacaacagcctaagctgactaaaacaagtactaaatttctttattaagatttctgagttctgctaggcttggtggcttgtacctataactccag

SEQ ID NO: 16790 - DNA, 80 bp, Homo sapiens
tacgtgtgtatatgtatgtatatatgtgtgtgtatatatatatatatatatatatatataaaaatgcacataagcatgtg

SEQ ID NO: 16791 - DNA, 92 bp, Homo sapiens
agcagtcttgaaaaattgagttaatataaagtatagaatatgaaagtagctcaatgccttctcagtggttcttctttgtactcaatactgct

SEQ ID NO: 16792 - DNA, 70 bp, Homo sapiens
ttgttttgaaacggagtctcactctgtcacccaggttggcgtacagtggcatgatctcggctcactgcaa

SEQ ID NO: 16793 - DNA, 67 bp, Homo sapiens
gctgcctgggtctagtcagtaatcttgccctgcacagacctcttactgtctgaccacaggccttagc

SEQ ID NO: 16794 - DNA, 58 bp, Homo sapiens; identical to SEQ ID NO: 514

SEQ ID NO: 16795 - DNA, 96 bp, Homo sapiens
ttgtgatttaggatcttgataaggcattgaagttcattattagtttattcaaaaattgatatttgaactgttacttaataaaggttagtactacag

SEQ ID NO: 16796 - DNA, 79 bp, Homo sapiens
gatcagattctaggcttttgttttgatgggttgatgggagactttttttttttctttgagacagagtctcgcttctgtc

SEQ ID NO: 16797 - DNA, 71 bp, Homo sapiens
ggtagtcagtagtgattttcatttactaaaacctacaatataaggttgtgtacttggaacacttcattgcc

SEQ ID NO: 16798 - DNA, 109 bp, Homo sapiens
tgagtgttcccttttctctgcaacattgccagcatgttgttttttgattttattaaaaagtcaaaaaatgataatagtatcccattgtggttttgatttgcatttctca

SEQ ID NO: 16799 - DNA, 118 bp, Homo sapiens
tctttaatcctcatttattgagtgttttacttctgaatataattctcattattgttgaatatatattttaattgttgacatgaatattaaaagtatgcactgaatatggattcaagga

SEQ ID NO: 16800 - DNA, 106 bp, Homo sapiens
cgaaagtgatacctttctggaattgccactggaagactagtgtactattaattattttcattgtagtcagtgctgtaatcttccaggattcatttcagtatttttg

SEQ ID NO: 16801 - DNA, 90 bp, Homo sapiens
tgattttgtatcctgcaactttactgaatttgtttatcagttgtaatagtttttcagtagagtttttaggtttttccaaatataagagca

SEQ ID NO: 16802 - DNA, 84 bp, Homo sapiens
ctgttattgagatctctgagtggagtgtgagggcactgtgcaaccagatggcctggctctgccttctgagaacttctttcccag

SEQ ID NO: 16803 - DNA, 73 bp, Homo sapiens
gaggtggaggttgcagagagctgaaatcgcaccagtgcactccagcctgggtgagacagtcagactctgtctc

SEQ ID NO: 16804 - DNA, 95 bp, Homo sapiens; identical to SEQ ID NO: 68

SEQ ID NO: 16805 - DNA, 93 bp, Homo sapiens; identical to SEQ ID NO: 69

SEQ ID NO: 16806 - DNA, 69 bp, Homo sapiens
ggttcagtgtgtgtctgagttcaggcttgattccagccattagccttgtgacttgaccatcatagaatc

SEQ ID NO: 16807 - DNA, 98 bp, Homo sapiens
ttgagtaactcttaggatggaattgctgtgttatagggtaggtattatatttaactttataagcagctgtcaaatagtttcacaaaagagttgtacaa

SEQ ID NO: 16808 - DNA, 89 bp, Homo sapiens
aagagagaaaagaatttagatagagtggttactttgtcacttggttgagggctgaagataacattttgatttttttttttttttttttt

SEQ ID NO: 16809 - DNA, 58 bp, Homo sapiens
tgagatggagtctcactctgtcacccaggctggagtgcagtggtgagatctcggctca

SEQ ID NO: 16810 - DNA, 121 bp, Homo sapiens
gccctatggtggaattcacaccccaatcaccaccctggagcacccaaagactgtcctgacagagcagaggcaggagtccagccgcaggtcttagttggggctagtgtgatcctcagcacca

SEQ ID NO: 16811 - DNA, 83 bp, Homo sapiens
ccacctcttcatgcctgaactgagtgagcagaatggtagcaacagcaaggaccaaaccattctctgctcttcaggagatgtgg

SEQ ID NO: 16812 - DNA, 82 bp, Homo sapiens
tgtaggggtgaggaaaagggagaaagagagagaggcaggagatagctctgtgtctctcacaatgtaatttcctttctttggg

SEQ ID NO: 16813 - DNA, 77 bp, Homo sapiens
gcttataataggagaaattaggtcctaaaagataaaatttatttattttttacaacctaatttttaacactagaagt

SEQ ID NO: 16814 - DNA, 100 bp, Homo sapiens
taggtgctacatgggagtggactcagggtctttgctgcttcagtctctcccaggctcagtcttagagtatgcttgttttcactcattgttcttctgccta

SEQ ID NO: 16815 - DNA, 76 bp, Homo sapiens
tccttctcttcaggaagtttcaagtatattaatatataaatttagtatttcttggaacattttgattctaatagga

SEQ ID NO: 16816 - DNA, 101 bp, Homo sapiens
gcagtctatattatgtcattatttttgaatacatttatatataaatttttatgtagattagatagatatacacagatatatgtacatatgtatagaactgt

SEQ ID NO: 16817 - DNA, 100 bp, Homo sapiens
cctaaggaaatctgaataatgtatgcactttgtttaataatattgtatcattatttgttgtaaaaaatgtgccatattaatctgagattttaacaatagg

SEQ ID NO: 16818 - DNA, 65 bp, Homo sapiens
atatatgtgtgtgtgtgtatatatgtatatatagtgtatacacatatatacacacacacgtatat

SEQ ID NO: 16819 - DNA, 115 bp, Homo sapiens
tttgaaaaaagtgtatactaatatagagttttgaaggagtattaggggaattactagtgtttttgttctatttcctcaggtatttggaggaggtaagttgcagttatttttcaga

SEQ ID NO: 16820 - DNA, 98 bp, Homo sapiens; identical to SEQ ID NO: 1311

SEQ ID NO: 16821 - DNA, 105 bp, Homo sapiens
gagtatatatacatatatcaagtaggatatatatataaatttttttatatgtttatatttatatattgtatatattgtatatttatgtatgtatggaaagtgccc

SEQ ID NO: 16822 - DNA, 61 bp, Homo sapiens
tctctcccaaggctgactgatgaaggtctccctctgtctgagtcagtctataaggactgga

SEQ ID NO: 16823 - DNA, 110 bp, Homo sapiens
gtatgtatatatgtatgtatatacacacacgcgtatacatatgtgtatgagtaatatgtatatatatacatacatagggatgatatatatgtgtgtatgtgtgtgtgtgt

SEQ ID NO: 16824 - DNA, 96 bp, Homo sapiens
ttattcttttttatgaatgcatattattccatggtgtatatataccacatttatttatgtatgtgtgcatgtgtattcatggtagaatgatttata

SEQ ID NO: 16825 - DNA, 94 bp, Homo sapiens
aagcaaatctggaaaatgagatacttgcacagttggaaatgttgaacaaaagttatttattttatagacagtgacattatcttataggtagctt

SEQ ID NO: 16826 - DNA, 58 bp, Homo sapiens
tgagatggagtctcactctgtcactcagggtggagtgcagtggcgagatctcagctca

SEQ ID NO: 16827 - DNA, 108 bp, Homo sapiens
tggacaagaactgtgtaaacatttcctattcttttcattgatgaaagaattttattcatattttggaagggagcatgcagttggaaataatcttatataaattgttta

SEQ ID NO: 16828 - DNA, 177 bp, Homo sapiens
gtatatgtgtgtgtgtatatatatatacacacacatatgtgtatatatgtgtatatgtatatatgtgtacatatatgtacacatatgtacatatatgtgtgtacatatatatgtgtacatatatgtgtacacatatgtgtatatatacacacatgtatacatatatatatatgcatg

SEQ ID NO: 16829 - DNA, 82 bp, Homo sapiens
atgcatatatatatatgtatacatgtgtgtatatatacacatatgtgtacacatatatgtacacatatatatgtacacacat

SEQ ID NO: 16830 - DNA, 104 bp, Homo sapiens
aggtgttcatgggagcggccaaaccaagcagccgagacagagcagacagtgtaagagagctgctgatgagagagctgctggataaagccgtatttcacctacct

SEQ ID NO: 16831 - DNA, 88 bp, Homo sapiens
ttttcccatttgagactccctctcactcccagctgaggcctgcttctgggagtgtgggttggaggaggaactctgggagccgggaaga

SEQ ID NO: 16832 - DNA, 117 bp, Homo sapiens
ggtgatggccctatcaaaaagattttagaatcagaaagtatgatttttatttaaatagattagttcaacttcaatagtgtcatgtttttttcttctgaaatttcttgaaaattacca

SEQ ID NO: 16833 - DNA, 168 bp, Homo sapiens
tatatacatgtatatatgtatacatgtgtatatatacatgtatatatgtatacatgtatatatgtatatgcacatgtatatatgtatacatgtatatatatatacacatgtgtatatatgtatgtatatatgtatacatgtgtatatgtatacatgtgtatatgcata

SEQ ID NO: 16834 - DNA, 118 bp, Homo sapiens
atgtgtatatatgtatacatgtgtatacatgtatatacatacatatatatgtatacatgtatatacatacatatatatgtatacatgtatatacatacatatatatgtatacatgtat

SEQ ID NO: 16835 - DNA, 111 bp, Homo sapiens
tgagggcccatatgtgttcatgtaagttctttttctttttttacgtttatttatttattattataatactttaagttttagggtacatgtgcacaatgtgcaggctactta

SEQ ID NO: 16836 - DNA, 80 bp, Homo sapiens
atggtgatagaattgaactgtgtgtgtgtgtgtgtatacacacattatatatatatgtacacacattacatatacattat

SEQ ID NO: 16837 - DNA, 103 bp, Homo sapiens
ggcagctctacccctgtcgctttgcgggatacagtctccctcctggctactttcacaggctggcattgtctgcggtttttctaggcacagggtgtaagctgtc

SEQ ID NO: 16838 - DNA, 81 bp, Homo sapiens
atatgtcatcaatatataaatatgtacttaagttatgaataaatatgattatggcttaagacatattatagcctgatatat

SEQ ID NO: 16839 - DNA, 94 bp, Homo sapiens
ggtagctagtttccctcagagaaagtgacagatgaatgagagcaatgaagaaatcataatgccttttatgttctaatcttggaaatcatgcgcc

SEQ ID NO: 16840 - DNA, 95 bp, Homo sapiens; identical to SEQ ID NO: 580

SEQ ID NO: 16841 - DNA, 93 bp, Homo sapiens; identical to SEQ ID NO: 69

SEQ ID NO: 16842 - DNA, 123 bp, Homo sapiens
ctgggggacccagctcacgtgtgtgggggccgtgcgtgtccgtttcgcctgttcatgtatgtcacacatgtgagagtccacagcgagggcagcctttacacgcgatggcccagaggagcgagc

SEQ ID NO: 16843 - DNA, 95 bp, Homo sapiens; identical to SEQ ID NO: 580

SEQ ID NO: 16844 - DNA, 93 bp, Homo sapiens; identical to SEQ ID NO: 69

SEQ ID NO: 16845 - DNA, 75 bp, Homo sapiens
agcatgctttaaccattttttaggtattgtatacatatttaaatactgtatatatatttaaaagatgtccatgct

SEQ ID NO: 16846 - DNA, 87 bp, Homo sapiens
ttgtgccaattatagaaaacaaaatcaacatctagtcattgttttgtacacataaaagttgttgatttcttttctaaattagtataa

SEQ ID NO: 16847 - DNA, 71 bp, Homo sapiens
ttgtttctgcatgtgtctataagggtgttgccagagggcactgacatttgagagagcacaatgagagacga

SEQ ID NO: 16848 - DNA, 77 bp, Homo sapiens
ttcatttcagtcctaacagagagaagatagtttggagagcatttttcccaaaaaccttcctctgttgttgaaatggg

SEQ ID NO: 16849 - DNA, 93 bp, Homo sapiens
gtctttacatgatcttccttctgtgtgtgtctgtgtcccactctctttttataaggacactagtcatataggtttaaagctaaccctaaagac

SEQ ID NO: 16850 - DNA, 107 bp, Homo sapiens
actttccttccagtttcaaaatgcccacatttcccaagactcccccatattctttttttaattatattttaagttctggggtacatgtgcagaaactgcaggtttgt

SEQ ID NO: 16851 - DNA, 106 bp, Homo sapiens
atgtgtgtatgtatatgtccttaagggcagagcctactatttattcatttttaaatccccaggcctcagcctacagcttgacacatattaaaaaataaacacatat

SEQ ID NO: 16852 - DNA, 116 bp, Homo sapiens
ttcattgtgactggttgtcctgctttcctcagattttcttccgccatctctgacagcttcttgatctgtccccaggtgggtgctgcgctcgacaggtgttgcttgtgacagatggg

SEQ ID NO: 16853 - DNA, 64 bp, Homo sapiens
atgatacctctttgacctaactattcatatatctatatgaatgttaagaccaaaaaggtatcat

SEQ ID NO: 16854 - DNA, 95 bp, Homo sapiens; identical to SEQ ID NO: 68

SEQ ID NO: 16855 - DNA, 93 bp, Homo sapiens; identical to SEQ ID NO: 69

SEQ ID NO: 16856 - DNA, 116 bp, Homo sapiens
gtaatacttgcttcttacattttgactttcacatcaggccttccttcctaggaatcagagttcagacagaggagaggtctctttgggctgagtttcaggagtgactttaggataca

SEQ ID NO: 16857 - DNA, 73 bp, Homo sapiens
gcaagtctgtaaaatgacagctagggatgtctctgacccttatagggagagtgagatgtcactgttgacttgc

SEQ ID NO: 16858 - DNA, 87 bp, Homo sapiens
agctgacataacacttggggggccatagacaggtgaaagatggttttattcagcagctctcttacactgtctgcctttgtctcagct

SEQ ID NO: 16859 - DNA, 95 bp, Homo sapiens; identical to SEQ ID NO: 68

SEQ ID NO: 16860 - DNA, 93 bp, Homo sapiens; identical to SEQ ID NO: 69

SEQ ID NO: 16861 - DNA, 78 bp, Homo sapiens
cacttctatttgtatgtgtgtgtatatgtctgtatgtgtaaatacttacatgtatatatgtgtatatatgtggctgtg

SEQ ID NO: 16862 - DNA, 72 bp, Homo sapiens
tatctctgtgtgtgtttatctgtgtgcatctgtgtctatgtttgtgtgtgcacagatccacactgtgagatg

SEQ ID NO: 16863 - DNA, 90 bp, Homo sapiens
cttgcttttggctacagaatcatcatctgcatctggagatttccactgggactttctggaggcaggtgaggatggtgaactaaaaagaag

SEQ ID NO: 16864 - DNA, 95 bp, Homo sapiens; identical to SEQ ID NO: 68

SEQ ID NO: 16865 - DNA, 93 bp, Homo sapiens; identical to SEQ ID NO: 69

SEQ ID NO: 16866 - DNA, 115 bp, Homo sapiens
tatactttaagttctagggtacatgtgcacaacgtgcaggtttgttacatatatatatatacatgtgccatgttggtgtgctgcacccattaactcatcatttacattaggtata

SEQ ID NO: 16867 - DNA, 79 bp, Homo sapiens
ggacggagttggcactcactgactgtcagggactttatcaaaagtgctcgaaaaaggtttgcagtccacattctcctcc

SEQ ID NO: 16868 - DNA, 80 bp, Homo sapiens
tgagacagagtctcaccctgtcactcagactggagtgcagtggcgtgatctcagctcactgcaatctccatctcctgggt

SEQ ID NO: 16869 - DNA, 74 bp, Homo sapiens
gctgagtagagagtgaggcagagatgagagagaggatactaaattttattttttatttatctttttatttcagc

SEQ ID NO: 16870 - DNA, 114 bp, Homo sapiens
atatgtgtatatgctcacactttacatatataactatgtgtatatatgtatatgtgtatgtatatatatacatataaaataagcatatttcttagttgtatttactgaaagagt

SEQ ID NO: 16871 - DNA, 86 bp, Homo sapiens
ggtacagtgcaatagttcttcatcataaatatgagcaatattttgctttttttttttttttgagatggagttttgctcttgtcacc

SEQ ID NO: 16872 - DNA, 102 bp, Homo sapiens
ggttttatttagttttcttcaaatatcacatgcttaaaattagtattctctgattattactgtatttgttattcactggagacatctgcataagtgatgacc

SEQ ID NO: 16873 - DNA, 86 bp, Homo sapiens
ctgagagtagggtgcatgcaaactctccctcagtgacagtgtcacagacaagggtttaggatgctcaaacccttcccctcctgcag

SEQ ID NO: 16874 - DNA, 116 bp, Homo sapiens
tccatgtactgtttggatttcatgtcatggtcttacattttatttataattttaattgtacagttttacagtatattacttcaaatgtcttgtgcatgtaaaagacagtatagaga

SEQ ID NO: 16875 - DNA, 81 bp, Homo sapiens
ctcatgatttggctctctgtctgtctgttattggtgtatatgaatgctggtgatttttgcacacagattttgtatcctgag

SEQ ID NO: 16876 - DNA, 71 bp, Homo sapiens
tcatgagggtgaactctcatcatgggattagtgctctcctaagaagagacaccagagagaggacacagtga

SEQ ID NO: 16877 - DNA, 113 bp, Homo sapiens
gcagaataaaacctactttttaaaaaataaatgaagcattgttatgaagtatgagtttgttgtagacaatttaacatttttatgtcagatatattcagagtaggtatgtttgt

SEQ ID NO: 16878 - DNA, 94 bp, Homo sapiens
ttgtagtaaatgtatgcgtgtatttagcagggtgtttgtgatgatcaatttatatatatatggaaggtgttgaagcctacagaagttgctgcag

SEQ ID NO: 16879 - DNA, 110 bp, Homo sapiens
gactgggttcttttagcttaggttacctagaactttaaaagttaattcttgaatatataaatattgactatcatgttaggttacttgagtatattactatgactacagtt

SEQ ID NO: 16880 - DNA, 80 bp, Homo sapiens
ctctttctattttttaatttttaccttcataggagaggactttttcttgaaagtgtatttcctgtgttggttagataggg

SEQ ID NO: 16881 - DNA, 87 bp, Homo sapiens
cactactttggactgctagaggagctgtagctcacatacaccctcactgactgactagctcgcagattccatagcttaggccaggtg

SEQ ID NO: 16882 - DNA, 74 bp, Homo sapiens
ttctatttaaaaagtaacacatgcaattatatacatatatatgtatgtatgttgtatgtatgtatgtagtggaa

SEQ ID NO: 16883 - DNA, 82 bp, Homo sapiens
tagaagggggtctgtctgcccttcttactgtttatattagtaagatgagtaaggcagtgagaagttagagatctctatttta

SEQ ID NO: 16884 - DNA, 115 bp, Homo sapiens
tatattaatacatataatatatactaaaatatattttctgaatatatattctgtttcttaatatatatgtattcagaaaatatattagtatataatatataatacatataatata

SEQ ID NO: 16885 - DNA, 62 bp, Homo sapiens
gagacagagtctcactctgtcacccaggctggagtgcagcggtgcgatcttggctcagtctc

SEQ ID NO: 16886 - DNA, 114 bp, Homo sapiens
catgcgattgcatcacagtgatttttctttaaaagctaagaaaacaaagtttgtgattttttttttttttttttttttttgcagggaagttattttatggttaccagtctaatg

SEQ ID NO: 16887 - DNA, 77 bp, Homo sapiens
gccaggtatgagagcagtgttgtgtctcttctctcttgaaaaggatatgttactctctggtattttattcacatggc

SEQ ID NO: 16888 - DNA, 101 bp, Homo sapiens
gttgcttcttcttagaatggatgtagttccttctgaacatcaaaagaggtatgagttcagtgttagctctctgcatgaatccatttcctaagatcttgaac

SEQ ID NO: 16889 - DNA, 100 bp, Homo sapiens
tctttggatatatatgcagtagtggggattttttaatcctgtggtaattttatttttatttcttgtaggaaacctcatactattgttcataatgcaggga

SEQ ID NO: 16890 - DNA, 95 bp, Homo sapiens
ggagggtcccacgcctgcagtctcactcactgttagcacagcagtctgagatccaactgcaaggtggcagtgaggctgggggaggggcgcctgcc

SEQ ID NO: 16891 - DNA, 109 bp, Homo sapiens
ttgttggaagattttaaattactgactcaatatccttctagttacaggtctattcagattttatatttttttcattattgtgtcttggtagagtttgtgtttctagcaa

SEQ ID NO: 16892 - DNA, 139 bp, Homo sapiens
atagcatgtgctcattcatgtctctgtgtcacattttggcagtactcataatattttagacttttaaattattattatatctgttatggtgatttttgatcagtgatctttgatgttattgtaattgcttgggggtggc

SEQ ID NO: 16893 - DNA, 99 bp, Homo sapiens
ggtgtggtggctcatgcctgtagtcccaggtactcgggaggctgagctagaaggatggcttgagcccaggaggttgaggctgcagtgagttgtgatgtc

SEQ ID NO: 16894 - DNA, 69 bp, Homo sapiens
cctggtttcatctctgcagtacacagagttctggacagatgggggactctgggtgtgtctgtggccagg

SEQ ID NO: 16895 - DNA, 83 bp, Homo sapiens
acagaggagacttttaactcagaatctgcattttttttttttttttttttttttttttttttggagaaggagtctcactctgt

SEQ ID NO: 16896 - DNA, 89 bp, Homo sapiens
gcatgagaatggactaatacaagttgtcatctagactagtctgctcaaagcttgtcttcagtcaactaggtatagtcctgattccaagt

SEQ ID NO: 16897 - DNA, 79 bp, Homo sapiens
tgcagtttttccccctttcgaaacagtctcactctgtcccccaggctggagtgcagtagtgtgatctcggttcactgca

SEQ ID NO: 16898 - DNA, 114 bp, Homo sapiens
tatacacatttatttttgtatgatgtgtatatatctgtatacatgcatgatgtatatatatatgtatacatgcatgtgtgtgtagatatgtatataatactatacatttgtatg

SEQ ID NO: 16899 - DNA, 66 bp, Homo sapiens
atatatgtatatgcatgtctatgtatacatatatgtatatgtatacatatatgcatatgcatgtat

SEQ ID NO: 16900 - DNA, 85 bp, Homo sapiens
ccaggtggtaatgtgagagctggggagcggctataaatacagatgaagcttcactcactcactcacatcctgccatgaagcctgg

SEQ ID NO: 16901 - DNA, 102 bp, Homo sapiens
tcccattgggagaacctaggcctggagttcttttttttttctttaaattttttttttttttatattttagaaacagaatctcactctgtctcccaggctgga

SEQ ID NO: 16902 - DNA, 82 bp, Homo sapiens
agggttgaaactgcagcaaacagatgccttctttatagctggagaggctgtgagaagagactgtcctgtgggcaagaactct

SEQ ID NO: 16903 - DNA, 113 bp, Homo sapiens
gtctgcagcctctattttgatgttgggattttttggtacgcttttttttttttgatcttttatttctagcttcctcactattctgagatatcaaaatggatctctactgggat

SEQ ID NO: 16904 - DNA, 113 bp, Homo sapiens
taatatagtctatattataatatgttacatattataatatagtctatattataatatatgttatatattatagtctatattatatattatatattataatatagtctatatta

SEQ ID NO: 16905 - DNA, 106 bp, Homo sapiens
aactctcaataaattaggtattgatgggttgacaggtcttatacacactttgtatatgtctttctactgcctgctagcctccattgcttctaatgataagacagtt

SEQ ID NO: 16906 - DNA, 109 bp, Homo sapiens
tttgactttagataacatgattactgtgtgcctgggtgatgattttttttttttttttgagatgtatttcccaggtgttctctgagcttcttgtatctggatatttaga

SEQ ID NO: 16907 - DNA, 92 bp, Homo sapiens
ggttgttcttgttttgggagctgaaagtctcatatttttagaactcctatattattctctgtggatgtagtttctgaggacaggatctagcc

SEQ ID NO: 16908 - DNA, 88 bp, Homo sapiens
tggcaggttttaaagggaggggggagattttgctataaagtttatatttttaggtgtatagctttttttctaattctttttatctcca

SEQ ID NO: 16909 - DNA, 89 bp, Homo sapiens
tcattgtacaatgcataatgaactaaggagatagaatttttattcttcaaaaatgccatttagtttttacatgtgcattgtaacaaaga

SEQ ID NO: 16910 - DNA, 94 bp, Homo sapiens
ttatatatacaggcttgtcattgtcatatatatatattacattgtcatatatatcattgtcatatatatgacaatgacaaacctatatatatag

SEQ ID NO: 16911 - DNA, 95 bp, Homo sapiens
aaaatttatgtgtgtgtgtgtgcatacatatatatatgtgtgtgtgtgcacacatatatatatgtatgtatgcatgtatctgtatatatagtttt

SEQ ID NO: 16912 - DNA, 114 bp, Homo sapiens
tgagaggaaagacccgatgaattgtagtttctttggaaataatttttattttattttatgtgattgtgtgtgtgtccaaattgtgctttaatttagctgtggtacaggatctca

SEQ ID NO: 16913 - DNA, 99 bp, Homo sapiens
gggaaaattgttgtcacagcaaatgtacacttgagtgattcaaacgtaattggttatatgattcattttgaatatatttactgtaacaactcgtaaacc

SEQ ID NO: 16914 - DNA, 74 bp, Homo sapiens
accttgtgttcatgccctaggtatctatagaagttttaactttggagatgatgacttagggtatctggtggaag

SEQ ID NO: 16915 - DNA, 104 bp, Homo sapiens
gaggtgcataagctgtttgtaacaatatatttaaggttctgtttttaacaatatatttaagacctggaaatgctattattttaacagctgcaatatttaccctc

SEQ ID NO: 16916 - DNA, 65 bp, Homo sapiens
tgtatatatgtgtatatgtatacatgtgtgtatatgtatacatgtatgtatatgtatatatatat

SEQ ID NO: 16917 - DNA, 97 bp, Homo sapiens
aacaggtgctagaaatagaagtacatgcagagaataggctgaatgcacttgaatagtgattttgttgttcattgtatggtgtaaatctacaaatgtt

SEQ ID NO: 16918 - DNA, 99 bp, Homo sapiens
cacccagtctggacttcctacccttcctctcagtagctcactctgacatggctctgcccaggactgggtcatgttaggctgtgtgggtggagaaactcc

SEQ ID NO: 16919 - DNA, 100 bp, Homo sapiens
tagagatagtagttggtgttggactgaaaataagtgtgttcaaggtccttgaatgtacgaaaaccactaccattcctatacaccaacaatagctaagctg

SEQ ID NO: 16920 - DNA, 69 bp, Homo sapiens
tttgtttagcctttaacacttcacattgatggaatacatgagtgtagaagtgtgtagaagccagacaga

SEQ ID NO: 16921 - DNA, 68 bp, Homo sapiens
gggtggatgcggatttctggagctcctatatggacaatcttgtggcgcgctctctctgtctctcactc

SEQ ID NO: 16922 - DNA, 100 bp, Homo sapiens
ccttaggcagcagagcccagagcaggaggacaaagcaaagatgccctcgctcggctgcatactcaccctgtctgtgactgttgctatgatcagggcgttt

SEQ ID NO: 16923 - DNA, 82 bp, Homo sapiens
gactgtgggcaagagggttcttcatattagaatattattattattattattattattttttgagatggagtcttgctctgtc

SEQ ID NO: 16924 - DNA, 96 bp, Homo sapiens
cccagctacttgggaggttgaggtaggaggatcactagagcctcggaggtcgaggcttcagtaagccatgatcctgccactgcactctagcgtggg

SEQ ID NO: 16925 - DNA, 56 bp, Homo sapiens
gagactgagtctcgctctgtcacccaggctggagtgcagtggcgagatctcggctc

SEQ ID NO: 16926 - DNA, 88 bp, Homo sapiens
gctccttgcccaccatacgcaagctattctattttctttttctttttttattgagatagagttttgctcttgtcccccaggctggagt

SEQ ID NO: 16927 - DNA, 131 bp, Homo sapiens
ctcccaagtaactgagactacaagcgagagcaactgtgctcagctaatttttttttttttttttttttttttttgagtcagagtctcgctctgttgctcaggttggagtacaatggcgcaatcttggctca

SEQ ID NO: 16928 - DNA, 88 bp, Homo sapiens
tttttcatggtcagttagagcatgagaatgtggtcttaaaatgcagagagtaatacctccttgatttctttctctgactcgtgaagaa

SEQ ID NO: 16929 - DNA, 145 bp, Homo sapiens
tgcccagtctgcccttagtttttggttcagccacgttcccctgagttttttttttttttttttttttagaggaagtctcactctgtcacccaggatggagggcagtggcgcaatctcagctcactacaacctccgcctcctgggt

SEQ ID NO: 16930 - DNA, 58 bp, Homo sapiens
gatgatgatgatgatgatgatgatgatgatgattattattattattattattattatt

SEQ ID NO: 16931 - DNA, 87 bp, Homo sapiens
tatagaaatttatatatacatatataatatataattatgtgatcttgtgtatatacgtatgtatatatgtatatatgatcttgtgtg

SEQ ID NO: 16932 - DNA, 71 bp, Homo sapiens
acacatatatattaatatatgttatatatgtgtgtacgtatatatagaatagtgtgtgtgtgtgtgtgtgt

SEQ ID NO: 16933 - DNA, 89 bp, Homo sapiens
cttatatgtatatgttatatataacatatactttatgtatatgttacttatatatgaagtatatgttatatataacgtgtgtgtgtggg

SEQ ID NO: 16934 - DNA, 105 bp, Homo sapiens
tgttgtcattggtgtttttggtgccttaggtgattgttgactgagaggagagcctttggttaatagaggaaaccactggccataattaaggggagaatgagagga

SEQ ID NO: 16935 - DNA, 56 bp, Homo sapiens; identical to SEQ ID NO: 7986

SEQ ID NO: 16936 - DNA, 80 bp, Homo sapiens
ctctctctctctctttctcatcactgacccttaggggggccatatcatgagcagccctatgaagaagaccatgaggtgag

SEQ ID NO: 16937 - DNA, 88 bp, Homo sapiens; identical to SEQ ID NO: 1308

SEQ ID NO: 16938 - DNA, 81 bp, Homo sapiens; identical to SEQ ID NO: 1309

SEQ ID NO: 16939 - DNA, 77 bp, Homo sapiens; identical to SEQ ID NO: 1310

SEQ ID NO: 16940 - DNA, 95 bp, Homo sapiens; identical to SEQ ID NO: 68

SEQ ID NO: 16941 - DNA, 93 bp, Homo sapiens; identical to SEQ ID NO: 69

SEQ ID NO: 16942 - DNA, 95 bp, Homo sapiens; identical to SEQ ID NO: 68

SEQ ID NO: 16943 - DNA, 93 bp, Homo sapiens; identical to SEQ ID NO: 69

SEQ ID NO: 16944 - DNA, 78 bp, Homo sapiens
tgacagttttatgtgtcaacttggctaggctatggtggccagttgtttggtcaaacactagtctatatgttgctgtga

SEQ ID NO: 16945 - DNA, 103 bp, Homo sapiens
gcagtgttttttaaaaatttatgtatatgtgactacatgaaaaatacattactgtgtttcttgatgttttatgacctgtacacaaagtgagaccagcagatgc

SEQ ID NO: 16946 - DNA, 89 bp, Homo sapiens
gttttacctggacaggcaggaaatggagttgaaatgggaaaagtttttcatttttatggattaaacccatctgttatgttcactaaggc

SEQ ID NO: 16947 - DNA, 95 bp, Homo sapiens; identical to SEQ ID NO: 68

SEQ ID NO: 16948 - DNA, 93 bp, Homo sapiens; identical to SEQ ID NO: 69

SEQ ID NO: 16949 - DNA, 77 bp, Homo sapiens
gtgtcaaatggtagttctgttttaagttatttgagaaacctccaaattgcttttcacagtggctgaactatttacat

SEQ ID NO: 16950 - DNA, 86 bp, Homo sapiens
gttcttcctctgttcttggatcttagccagttttcaaaactagagctcactgactgaagagtggctggacccccaggaagaaggac

SEQ ID NO: 16951 - DNA, 115 bp, Homo sapiens
gtgagcatgtgtgcctgtgtgcatgtgtgtactgtgtgtgtgtgcatgtgcatgtgtggggtgtgcaggtgcatggaccagatgtgcacgcgagagtacagtcacacttgtgtgc

SEQ ID NO: 16952 - DNA, 76 bp, Homo sapiens
ggaggaagaaaggggtgaactggccaaccacagagaatttttttttttctgagatggagttcctctattgttgccc

SEQ ID NO: 16953 - DNA, 63 bp, Homo sapiens
gacttagtgccattctcacagtagtgagtgagttctcattctggtgagactgggttacttctc

SEQ ID NO: 16954 - DNA, 104 bp, Homo sapiens
atatgtaaacatatatatgtaaatatgtatataagtatatgtgtgtatgtatatgtaagtatatatgtatacttatatacatatttacacatatagaaacatgt

SEQ ID NO: 16955 - DNA, 94 bp, Homo sapiens
ttattattttttgggacaaagtctccctctgtcgctcaggctggagggcagtggcatcgtctcagctcactgtaacctctgcctcctgggttca

SEQ ID NO: 16956 - DNA, 104 bp, Homo sapiens
tttgttatggctgagtagtattccatggtatgtatgtatgtatgtatacactcacacacacacacacacttacataccatggaatactattcagccataacaaa

SEQ ID NO: 16957 - DNA, 100 bp, Homo sapiens
tatatatatgtatatgaaggaactatatatataggttatatatatatgtatgaaggaacatatatatgtgtgtatatatatgtgtgtgtatatatatata

SEQ ID NO: 16958 - DNA, 76 bp, Homo sapiens
catttattgtccctctttctagattgaaatgcctatgtggaaaacagtttcaagagacagattcaggtggtaagtg

SEQ ID NO: 16959 - DNA, 57 bp, Homo sapiens
tgagacagggtctcactctgtcactaggctggagtgcagtggtgtgatcacagctca

SEQ ID NO: 16960 - DNA, 79 bp, Homo sapiens
tagctacacaagctgaactccaaacaaaatgctttttttttttttttttgagatggagtctcgctgtgtcaccaggctg

SEQ ID NO: 16961 - DNA, 107 bp, Homo sapiens
tgaaatgatgacaggataaagaacaatgatcaagttgtagcttgaattcttgtcattcagtctcaactaaatttagctaattttttttttattttgttatattttta

SEQ ID NO: 16962 - DNA, 139 bp, Homo sapiens
cacatttcaaatacatatatatgtgtgtgtatatatatatgtatgtatgtatatatgtatgtatgtatatatatacgtgtgtgtgtgtgtgtgtgtgtgtatatatatatatatatatatatttatatatatgtatttg

SEQ ID NO: 16963 - DNA, 112 bp, Homo sapiens
gtgggaaagtaatttgagactatgtgaatatcctatttgttatcaaatttttaatttattcatgcctagtaatttgatcaacatagactcatagtttattattttatcccat

SEQ ID NO: 16964 - DNA, 99 bp, Homo sapiens
tccacaacgcagtctcttttaagtcatggaactcacagagcacagaactcagcagaatggattctgctgtgaaccatgaggaaccgaattgcaggtgga

SEQ ID NO: 16965 - DNA, 58 bp, Homo sapiens; identical to SEQ ID NO: 5651

SEQ ID NO: 16966 - DNA, 84 bp, Homo sapiens
acagagagggtggagcaaaggagggtagagcaaaggatcttggtgactttttttttttttttttgtgacagagtctcactctgt

SEQ ID NO: 16967 - DNA, 77 bp, Homo sapiens; identical to SEQ ID NO: 1310

SEQ ID NO: 16968 - DNA, 95 bp, Homo sapiens; identical to SEQ ID NO: 68

SEQ ID NO: 16969 - DNA, 93 bp, Homo sapiens; identical to SEQ ID NO: 69

SEQ ID NO: 16970 - DNA, 108 bp, Homo sapiens
cattcttcagaggttatggtaacccgtaaaagtgtaaggttattttcagttttattttctaaatgatttcctcttgcatgtcattataggaccaaatttctaagtatg

SEQ ID NO: 16971 - DNA, 66 bp, Homo sapiens
acatatatatgtatatatgtatataaatacatatatgtgtatatgtatataaatacatgtatgtgt

SEQ ID NO: 16972 - DNA, 79 bp, Homo sapiens
atacatgtatgtgtatatgtatataaatacatgtatgtatatacatgtatgtatatatatgtattatatatatgtatat

SEQ ID NO: 16973 - DNA, 95 bp, Homo sapiens; identical to SEQ ID NO: 68

SEQ ID NO: 16974 - DNA, 93 bp, Homo sapiens; identical to SEQ ID NO: 69

SEQ ID NO: 16975 - DNA, 63 bp, Homo sapiens
tatatatgttcatgtatatgtatatatagtacatgtatatatatatatacatgtatatatgtg

SEQ ID NO: 16976 - DNA, 81 bp, Homo sapiens
acagccctgagaaagagaatgcgttcctagggggaggtctctgaaatggctgctctgggactgtctctcttttacagttgt

SEQ ID NO: 16977 - DNA, 79 bp, Homo sapiens
tggctgtcagcagtcactaaggaaacatgtttcttcttcacctcttgagacagaaaacatctcctccaactgtgggcca

SEQ ID NO: 16978 - DNA, 111 bp, Homo sapiens
tcggggtggtgattgctgaaggttggggtagctgtgtcgatttatttttttcttttttgagatggagtttcactctgtcacccacgctggagtgcagtgtcacaatcttgg

SEQ ID NO: 16979 - DNA, 116 bp, Homo sapiens
cattggccttgggcaagttctctattttcccacatgatcccataagcctcacactgactgtcagatcatagtcattttatgggttgctggaattaaggttagctagggctcagtgt

SEQ ID NO: 16980 - DNA, 95 bp, Homo sapiens; identical to SEQ ID NO: 580

SEQ ID NO: 16981 - DNA, 93 bp, Homo sapiens; identical to SEQ ID NO: 69

SEQ ID NO: 16982 - DNA, 65 bp, Homo sapiens
tgagacagagtctcactctgtcactcaggctggagtgcagtggtgctacctcagatctcggctca

SEQ ID NO: 16983 - DNA, 82 bp, Homo sapiens
taaagaaaggaagaacaccagagaataagtgaaggtaaaataaaaattttactttgcacattcttttttttttttttttttg

SEQ ID NO: 16984 - DNA, 103 bp, Homo sapiens
gtgggatggaccagaatatctctgaataataggggcttacataagttagaagtttatttcattattgtgtaaaataagtctggaggtagaaagttcattccat

SEQ ID NO: 16985 - DNA, 85 bp, Homo sapiens
ctattgtagctaaaaattgtatctattttacttagctgcctttggtagcatttgaaagtgaatgcaaaatttctggacaaaatag

SEQ ID NO: 16986 - DNA, 101 bp, Homo sapiens
cataattctacttgagtttgtctctcaaatatgttgtcactaaattttttatatagtttgccctgggagaatatgtgggacaatatctcttcagttttatg

SEQ ID NO: 16987 - DNA, 75 bp, Homo sapiens
acttttcctccaatgtgttttcttgcattccaggggctcttgtttctggaactgcatgtgcttcataggaactgt

SEQ ID NO: 16988 - DNA, 107 bp, Homo sapiens
gtgtctatgtttagtaaaactaccattgcaactagaaatataatttacaaaagaaataaattattttgtaaaaatttaatgcttgcaaaggacttaaacagggacat

SEQ ID NO: 16989 - DNA, 79 bp, Homo sapiens
tagcctttgacagggtgtgagaaagtagtcctttttttttttcttttggagatggagtctcactctgtcacccaggctg

SEQ ID NO: 16990 - DNA, 183 bp, Homo sapiens
atacatatatctatatatacatatacatgtatccgtatatgtatatatgtatctatatatacatatacatgtatccgtatatgtatatatgtatctatatatacatatacatgtatccgtatatgtatatatgtatctatatatacatatacatgtatctgtatatgtatgtatctagatata

SEQ ID NO: 16991 - DNA, 97 bp, Homo sapiens
ctcacattcagttttctagttgtatttttatctattgtataaaaatacaatgttataaaagaaaggtgacagtacagtcagaagatctgaggtagag

SEQ ID NO: 16992 - DNA, 118 bp, Homo sapiens
atattttgctatggttgggtggagcagtgtgtaaaggttagctagcggtggttttcaatttttctatatcactgttaagttcctgtttactggttttatcaattacttagaggagtgt

SEQ ID NO: 16993 - DNA, 121 bp, Homo sapiens
cactgctttgtattttagttgttctaataggtatggggtaacagctcctcatatttttaaaatatatttttgtcagtgcttgtggttattatatgtccatacaggtagaaaaaattaaagt

SEQ ID NO: 16994 - DNA, 116 bp, Homo sapiens
ttcataaggaataggaaaagtaactttttataattatattgaggatctcaaatttttattttacttaaaaatatgagattccatgaaattgcaaatacttctcttttcagtatgga

SEQ ID NO: 16995 - DNA, 98 bp, Homo sapiens
atatgaatacattgcatatttatacacataaatatgtatgtatgtatgtgtttacatacagaaacactatatatatgtgtgtgtgtgtatgtacatat

SEQ ID NO: 16996 - DNA, 85 bp, Homo sapiens
gaagtgatattacatatgagacaagtgaccttgggcaagttgtgaaaattctaagtttttgatttctcatctgtaaattcatttc

SEQ ID NO: 16997 - DNA, 116 bp, Homo sapiens
cagtagccacataaaattatggagcattgaaaggtgactagtgtgattgaagaaatgaattttcattttatttaattttaattactttttatttaaatagccccatgtggctaggg

SEQ ID NO: 16998 - DNA, 116 bp, Homo sapiens
tattatctttgcattctacctaaccagatcaaggagagagtgtacgctttggtttgaatgtttaaaactatgttttatttggtcatggatttggcagatagaatttacatttaatg

SEQ ID NO: 16999 - DNA, 96 bp, Homo sapiens
agtttcaagtgctatgatgtttattttaaaatgtataaacatttcaaattttaaaacaaacatacttttaaaacaaatattatagcacttgaaatt

SEQ ID NO: 17000 - DNA, 105 bp, Homo sapiens
tatttctgtgtctatttctattcctctatgtgtgtatatgtatacatattatgtatgtatatataattatagtatatacaattttttagtatatccacattaata

SEQ ID NO: 17001 - DNA, 84 bp, Homo sapiens
ctctctgttttagcaactggatctgattagggtagcaagaatgacttgattgatacagatagcccagtggttctcaacagaggg

SEQ ID NO: 17002 - DNA, 96 bp, Homo sapiens
agtattatatgtatatatatgtgtgtgtgtatatatatatatttatatatatatgtatatatttatatttatatatatatatatatatatatatat

SEQ ID NO: 17003 - DNA, 109 bp, Homo sapiens
cactggggtcagtcggggcacactggtgttcattgctgctgtgattttgttgttgtgaaatgatttttctttgccgtgtaatgttctggaggttccatgaaatccactg

SEQ ID NO: 17004 - DNA, 97 bp, Homo sapiens
acagtataatgcttgctttattatgatacccatatatatatatacactttcatgtatatatatatagataggtgggggaaagagttgagccaactgt

SEQ ID NO: 17005 - DNA, 116 bp, Homo sapiens
aatatggaaagcttgtctgaactacagtgcacacatacacactcacacacacacacacaaatgcctgtgccagagcatgtgtctgtgcatatgtaaggtaatggagttgggttatt

SEQ ID NO: 17006 - DNA, 61 bp, Homo sapiens
attacccagtctctggtagttctttttacagtgtgagaacagactaacacagatgggtagt

SEQ ID NO: 17007 - DNA, 84 bp, Homo sapiens
aagtctcacgagatctgatggttatataaaggagagttcccctgcacacactctctttgcctgtcaccatttaagatgtgactt

SEQ ID NO: 17008 - DNA, 115 bp, Homo sapiens
atgtttcatatatataatatgtatatatatacatatatgtgtatatatgtgtgtgtaaatatatgtatattttatatatgtgtgtgtatatatatatataatatatatattacat

SEQ ID NO: 17009 - DNA, 88 bp, Homo sapiens
aagtgggtggctttctcataagttagcaggtcagggactgattgcagtgtgtctgactctctctggctttcaagacagtgtcccattt

SEQ ID NO: 17010 - DNA, 81 bp, Homo sapiens
cctgtcccaggcctgagatgggagagagcacagttccagtgcctactgctgaggtgctttccacaattctggctgtgcagg

SEQ ID NO: 17011 - DNA, 100 bp, Homo sapiens
tcatatttggcctgcaggactatgctcatttataagttgtgaagaatatataggaaatttatttcaatttattgtaagtggcaacctcagggccctttga

SEQ ID NO: 17012 - DNA, 76 bp, Homo sapiens
gctgctgggggtggtggagaggggtggcatttatgattcaagactgtcttttctatctctcagtgcctctgtcagc

SEQ ID NO: 17013 - DNA, 121 bp, Homo sapiens
accatgaggtgctggggttttctttactgggagacctttgggagacttttttttttatttttttgagtcagggtctcgctctgtcacccaggctggagtgcagtggtgtgatctcagctca

SEQ ID NO: 17014 - DNA, 99 bp, Homo sapiens
tgataggctgctggatttggtttgccagtatgttattgagaattttttttattatactttaagttctggggtacatgtgcagaatgtgcaggtttgtta

SEQ ID NO: 17015 - DNA, 56 bp, Homo sapiens
gagacagagtctcgctctgtcacccaggctggagtgcagtggcgcgaccttggctc

SEQ ID NO: 17016 - DNA, 112 bp, Homo sapiens
ttagtatagcattgtctattgcgggtcttttgtggttccatatgaattttaggattgtttatttctatttctgtgaggaatgtcatttgtattttgatagaaattgcactga

SEQ ID NO: 17017 - DNA, 120 bp, Homo sapiens
agcacaggtggaaaacgtggaagggcaggcaggaaagacagccatactcagtgtaacattgaggaagtacgttgtaatttctttctgaccttttcatttctctaaaagtgcttctgtgtg

SEQ ID NO: 17018 - DNA, 95 bp, Homo sapiens; identical to SEQ ID NO: 68

SEQ ID NO: 17019 - DNA, 93 bp, Homo sapiens; identical to SEQ ID NO: 69

SEQ ID NO: 17020 - DNA, 74 bp, Homo sapiens
ccaaggcagggtggtgcatgcctgtagtcccagctacttgggaggctgaggtaggaggatcacttgagtcgggg

SEQ ID NO: 17021 - DNA, 112 bp, Homo sapiens
cagtgtgtgacaactggtatgttaaacattatgtgagaagactaagtatttttttttcttcttcttggtatgacacattgtttcaatgtacaatcttggtaagaacaggctg

SEQ ID NO: 17022 - DNA, 107 bp, Homo sapiens
agataagaagcctgatactcagagaggataaatagtttacccagttacaatattaataaataaactgggactatatctgtctttggattctttgattcttttttatc

SEQ ID NO: 17023 - DNA, 115 bp, Homo sapiens
ttctgggtacatatatatgtgtgtgtgtgtatatatacatatatgtgtatatatatgtgtgtgtgtatatatacatatatgtgtatatatatatatgtatatatgtgcaaaagaa

SEQ ID NO: 17024 - DNA, 114 bp, Homo sapiens
gatatatagattaattacatcagatccatttgcatcgtcagaggggtgatctgtttttatttttagtaacatgcttttgagcaaaaaaatggtgtattaagtagaagaatgatc

SEQ ID NO: 17025 - DNA, 144 bp, Homo sapiens
tatatgatatatatgactatatatatcatatatatgatatatatgacatatatatatgatatatatgactatatatatatcatatatatgatatatatgactatatatatagtcatatatatgatatatatgactatatatata

SEQ ID NO: 17026 - DNA, 116 bp, Homo sapiens
gtgttctaaaacttcatgggggtggtgggtacacaactgtatacgatgtatgcttaaaatgtatttatactttattgtgtataaattatagctcaatgaaatagtttttaaaaaac

SEQ ID NO: 17027 - DNA, 91 bp, Homo sapiens
gtttgccatcgtggaggccttttaagtctgttgttttagtgtcatatggttatagaatgaaaagatgaagttctccagttatttggttcac

SEQ ID NO: 17028 - DNA, 58 bp, Homo sapiens
tgagacggagtctcgctctgtctcccaggctggagtacagtagtgtgatctctgctca

SEQ ID NO: 17029 - DNA, 69 bp, Homo sapiens
ctgccagtgtctgtgactggctgtgcaggggcactctggtcctgaggcacatccagcagacaagggcag

SEQ ID NO: 17030 - DNA, 116 bp, Homo sapiens
ttgtattttacatggtacaaattaaaagcaatgggggtttaaaatttttatatctcagattttttttttcttttttgagatgcagttccactcttgttgcccaggctggagtgcaa

SEQ ID NO: 17031 - DNA, 94 bp, Homo sapiens
gtgaaccactgttgcttaaggattcagaggctctggactcaaataaccttcatttttctgcctcagtctctgtctgtgtaatggggataatcac

SEQ ID NO: 17032 - DNA, 63 bp, Homo sapiens
ttgaggcagagtctctccctctgtcacccaggctggagtgcagtggcatgatctcaatctcgg

SEQ ID NO: 17033 - DNA, 116 bp, Homo sapiens
tccagctttgttctttttgcttaggattgtcttggctatacaggttcttttttggttccatatgaaatttaaagtagttttttctaattctgtgaagaaagtcaatggtagcttga

SEQ ID NO: 17034 - DNA, 95 bp, Homo sapiens; identical to SEQ ID NO: 68

SEQ ID NO: 17035 - DNA, 93 bp, Homo sapiens; identical to SEQ ID NO: 69

SEQ ID NO: 17036 - DNA, 76 bp, Homo sapiens
gaaggtgcttctctgtgcctctgacacaggcccccaaagacaagatcagcctgtgtgggagcaagggatggccgtc

SEQ ID NO: 17037 - DNA, 83 bp, Homo sapiens
gaggatggaaggacgaggtgggcagttatgggcagctggcattttgggtgagcccagcttcacacagcctctctgcctcagct

SEQ ID NO: 17038 - DNA, 102 bp, Homo sapiens
cagccaagttaagggtctgtagtcttaggagagagccccaaaatcaaattttgctaccccactccctctctgtgtgactttaagcaccatctaacctttctg

SEQ ID NO: 17039 - DNA, 81 bp, Homo sapiens
gtgttcttacaagaagagacaccagagagtgagctctctatggctcactctctctttcttgctttccctctttctgagcac

SEQ ID NO: 17040 - DNA, 65 bp, Homo sapiens
tgctcccaggactctggaaggggatcactttccttcttggtctcacatctctcacagtctgagca

SEQ ID NO: 17041 - DNA, 107 bp, Homo sapiens
tcaggtggcgcagggtaattctagttgggacacatttgccacattgtctaacactgactcacagtgagaaagttattcccatgctcaattccttttcagtcttctga

SEQ ID NO: 17042 - DNA, 69 bp, Homo sapiens
tgtttttgagatgaagtctcactctgtcacccaggctggagtgcagtggtgcgatcttggcttattgca

SEQ ID NO: 17043 - DNA, 88 bp, Homo sapiens
gcagcagtggttttatagagatttgctttatgattatttgttaaactgaacatatattctatgtatttttctgcataattattgtttc

SEQ ID NO: 17044 - DNA, 96 bp, Homo sapiens
ttatgaattctctcagatacagacatttcttggcaacctgtggttaaatcctctgctgatagagatgagtgtgtgctcagaaatgagagtttgtga

SEQ ID NO: 17045 - DNA, 95 bp, Homo sapiens; identical to SEQ ID NO: 68

SEQ ID NO: 17046 - DNA, 93 bp, Homo sapiens; identical to SEQ ID NO: 69

SEQ ID NO: 17047 - DNA, 72 bp, Homo sapiens
ctgggcatagtggttcaagcttgtaaactcagcattttgggaggttgaagtgggtggatcacctgaggtcag

SEQ ID NO: 17048 - DNA, 108 bp, Homo sapiens
attcatttggaattaatttttgtgtatgatgtgaggtaagtgtataaattctttttatatgtagatattcaattgtcccagcacaatttgttgaaaatacaattgaat

SEQ ID NO: 17049 - DNA, 95 bp, Homo sapiens; identical to SEQ ID NO: 68

SEQ ID NO: 17050 - DNA, 93 bp, Homo sapiens; identical to SEQ ID NO: 69

SEQ ID NO: 17051 - DNA, 99 bp, Homo sapiens
ctgccctcattcttgaagctctctctttctcacagagtaatcagagttgtcttttaaatattcattcaagagggaatgagttgttcaaaatctgggaag

SEQ ID NO: 17052 - DNA, 87 bp, Homo sapiens
taatattccattgtatgggtataccacattttgtttatctgatcatcagttgatggccatttgggtgtgtccatattttgactatta

SEQ ID NO: 17053 - DNA, 89 bp, Homo sapiens
caggtgtctgccactacacttggctaattttttaattttttgtagagataggagcttgctaagttgcccaggttggtttggaactcctg

SEQ ID NO: 17054 - DNA, 90 bp, Homo sapiens
tctcccaggaggttctcacccaccctctgtctgaggccaggccctgacactcacccacacagaggatgttgaagctgaagccctgagtga

SEQ ID NO: 17055 - DNA, 76 bp, Homo sapiens
atatgtatatatgtgtatgtgtgtgtatatatatatatatatatatgtatatatgtatatatatgtatgtatgtat

SEQ ID NO: 17056 - DNA, 113 bp, Homo sapiens
aatggcaagaatttgtcacatagtagtgactgtggtcactttgagtttttttttttttttttcagaatgaggtcccaggttactgtctatgtaccttatgttcaataactatt

SEQ ID NO: 17057 - DNA, 79 bp, Homo sapiens
gtgtgtatgaggttctgtgtctgtgtgtggctcggtttgagtgtacgcatgtccagcacatgccctgcccgtctctcac

SEQ ID NO: 17058 - DNA, 91 bp, Homo sapiens
ccagactgagcaatgcagtgagacccagtctctaccaaaacaaaattttttttttttttgagtaagagtctcactctgtcacccaggctgg

SEQ ID NO: 17059 - DNA, 119 bp, Homo sapiens
gtgtggtggtgcgcacctgtggtcccagctgcttgagaggctgaggtggaaggatggcttgagctcaggagattcaggttgcagtgagccatgatcacatcatcacactccagtctggg

SEQ ID NO: 17060 - DNA, 84 bp, Homo sapiens
atatagtgagaccctgtctctacaaaaaacatttatttttatttatttattattattatttttggagacagagtctcgctctgt

SEQ ID NO: 17061 - DNA, 76 bp, Homo sapiens
tggtgtgtgtgggtttttgttttattatttttatttattattattatttttgagacggagtctcactctgtcacca

SEQ ID NO: 17062 - DNA, 90 bp, Homo sapiens
tggtagtctctgtcggatgctgctcacaggcattctctgaggtgcgactccaggactgatgagagaaagcagacatcctacgggatgcca

SEQ ID NO: 17063 - DNA, 86 bp, Homo sapiens
ggacacatgcagtacatgcgagtgtgcacatgtgggtgagcacacacaggcatccacatggacacatgcagtacatgcgagtgtgc

SEQ ID NO: 17064 - DNA, 82 bp, Homo sapiens
gctggagccatcatgcatgggttggaatttttggtctactgggtaaccgcaggcaatgacttaatctctctgtgtctccggc

SEQ ID NO: 17065 - DNA, 65 bp, Homo sapiens
agagcacttactctgaggagggttgaatggccagttagcggccctctggtcaggatgagagcttt

SEQ ID NO: 17066 - DNA, 112 bp, Homo sapiens
ctcatcccacacatgcatgtacattactgtcatcacttgggtgccatcagtctcactctctggtggaaagatggtgctcccggggctgcaggtgtgatgtaggtgacgtgag

SEQ ID NO: 17067 - DNA, 123 bp, Homo sapiens
gtgtgagcatgtgtgagtgtatgtgagagtatgattgtatgagtatatgtatgtatgtgtgcatgtgtatgtgtgagtgtaagagtgtgtgtgtatatatgtctgaatatgtatgtgggtgtg

SEQ ID NO: 17068 - DNA, 83 bp, Homo sapiens
gggcaattcctagaaagggatgcagctgtgagctgttatcaacctacacccaggatagcactctcactctgtcccagttgcct

SEQ ID NO: 17069 - DNA, 67 bp, Homo sapiens
ctgtctgactgtcactgactttagctcctgctcctagcaggggtctgagggcaccgaggttaggtgg

SEQ ID NO: 17070 - DNA, 109 bp, Homo sapiens
ggctgaagtagctgaatttcaaggattataacattccaaacctctagaacccatcttctggaaactcaaaatgtatgatttaaaattttatttttacttatttttggcc

SEQ ID NO: 17071 - DNA, 73 bp, Homo sapiens
tgatatatgcatatatttacatatataaatatttacatatatttgtgtaagtatatttatatatgcatataca

SEQ ID NO: 17072 - DNA, 155 bp, Homo sapiens
atatatttacatgtattatatatctgtatgcatacatatatgtatagaatacatataaatatgtacagctatataggtatatgtatgtatatataaaatatacacatatttttatatgtataaacctgtataggtatacatatttacatgtattc

SEQ ID NO: 17073 - DNA, 95 bp, Homo sapiens
tgcatacagatatataatacatgtaaatatatttatattacagatatataatacatgtaaatatatttatatttgtgtgtatatttgtatatgca

SEQ ID NO: 17074 - DNA, 83 bp, Homo sapiens
tgggcaaggagaacttgaccaagaggtggttccagcaggtagggtagggaattaattatttttgttaacttcctcaaggccca

SEQ ID NO: 17075 - DNA, 77 bp, Homo sapiens
cctgagtgacagtgagactctgtctcacaaaaaaaaaagaagaaaaaaaaaagaggcaagagtgtcagagtcagagg

SEQ ID NO: 17076 - DNA, 71 bp, Homo sapiens
ttgtttttgagatggagtctcactctgtcacccaggctggagtgcagtggtgcgatctcggctcgctgcaa

SEQ ID NO: 17077 - DNA, 93 bp, Homo sapiens
ttggaactttgttctgtaaatatatatatgtgtgtgtgcatgtgtgtgtatatatatgcatgtatgtatgtatatataaaacaaggcttctgg

SEQ ID NO: 17078 - DNA, 66 bp, Homo sapiens
aggtttgcacttgcatgtggaggagtcagagaaggcccctctgaaagatgacattgagcagacact

SEQ ID NO: 17079 - DNA, 65 bp, Homo sapiens
gctgacaaggtgactacattctgtctttttttttttttttttgagacggagtctcactctgtcgc

SEQ ID NO: 17080 - DNA, 73 bp, Homo sapiens
ctgggaagagtccagcgtatgtggcaactgggcatttgcatgtgtcacccacagtctggatctctctcctcag

SEQ ID NO: 17081 - DNA, 78 bp, Homo sapiens
ttgtgaagactagagtttttgttcttaggtcctgaagccctttgctggattccaaagtacgtgggctctgactcacag

SEQ ID NO: 17082 - DNA, 79 bp, Homo sapiens
ggcacccccacccactgtctcactggattctggccagggcccacaatccccaagagaaagggcagtgctggggagtggc

SEQ ID NO: 17083 - DNA, 97 bp, Homo sapiens
gtcactttggtggtctcagtgttggctgagcctgagcttgtaaattccttcaaaggagagagaagagtcacagcctgcaccatagcactcacttggc

SEQ ID NO: 17084 - DNA, 103 bp, Homo sapiens
ggcccagggtagcagaggccatgaagaactctttccaagttgttgtttttttttgttttttttttttgggggggggggacaatgtcactctgtcagtcaggct

SEQ ID NO: 17085 - DNA, 80 bp, Homo sapiens
gagaaaagaggatgcttatacactgctggtgggaatgtaaattagttcagccagtgtagagagcagtttggatatttctc

SEQ ID NO: 17086 - DNA, 90 bp, Homo sapiens
atgtccacatcctaatgcctagacctgtgaatatgttgttaccttatatggcaaaacggactttgcagatgtttgcagatgtgaatacat

SEQ ID NO: 17087 - DNA, 134 bp, Homo sapiens
agccacagtctccactgtctggcttctggccacacaggaggaggaaaaggacgggctgtgacactggctctctgtgccctggcctcagctgctctgtggggctgcagaaaaggacagaggcagaggtgtaagtt

SEQ ID NO: 17088 - DNA, 82 bp, Homo sapiens
tggagggagtgagctctgtggattgctgtgtagattttatttattgattgatttatttgagacagagtctcactcttgtcca

SEQ ID NO: 17089 - DNA, 77 bp, Homo sapiens
cctctgcctctgtggctgcatgaattttttactttttttttttgagatagagtttcactctggcacccaggctgagg

SEQ ID NO: 17090 - DNA, 114 bp, Homo sapiens
gtagagatggggttttggtgtgttgcccaggctgagcagtaatattttgaaaggaatcttttttttttttctgagcagtaggtctcagtaatgcacttaaaatattcagtatac

SEQ ID NO: 17091 - DNA, 58 bp, Homo sapiens
tgagccggagtctcgctctgtcacccaggctggagtgcagtggtgcaatctccgctca

SEQ ID NO: 17092 - DNA, 93 bp, Homo sapiens
ggtgaagtcagaggttattacagtatttttttttgagacagagtctctctctgtcacccaggctggagtacaatggcaggatctcggctcact

SEQ ID NO: 17093 - DNA, 112 bp, Homo sapiens
gagacaagggctcactatgttgcccagactgggccaaaactttttttggtggggaggggacagagtctcactgtctcactatatcgcccaggctggtgaactcctgggctcc

SEQ ID NO: 17094 - DNA, 94 bp, Homo sapiens
accaaaatctcatccttctagggctgcattttccattccctctgacactctcatagtaagaatgttgaattgtccctagtaggtgtgagctggt

SEQ ID NO: 17095 - DNA, 92 bp, Homo sapiens
gatagagtgagatcataggaagggacaagtaataaataggaggagaactttttttttttttttttttttttaagatggagtctctctctgtc

SEQ ID NO: 17096 - DNA, 93 bp, Homo sapiens
tccagattttagctgtttctcttttactgtataaatttatgtatttccaaattacatatgtatatattccagagatgattttagctttcagga

SEQ ID NO: 17097 - DNA, 68 bp, Homo sapiens
ctggctgacagcttgttctttttctaccatgtgagaatgcaaggagaagtcagcagtctgcagcccag

SEQ ID NO: 17098 - DNA, 58 bp, Homo sapiens
tgagactgagactgtctctgtcgtccaggctggagtgcagtggcacgatctcagctca

SEQ ID NO: 17099 - DNA, 77 bp, Homo sapiens
tactgcagcatatagcaggaggctctttttttttttttttgagatggagttttgctcttgttgcccaggctggagta

SEQ ID NO: 17100 - DNA, 96 bp, Homo sapiens
agaaatagggatgtaactcctgaagtgattttgttcttatcagctctaatgagattatgatattcattatcattatggtggttactttctttcttc

SEQ ID NO: 17101 - DNA, 89 bp, Homo sapiens
caggcgcatgccaccacgcctagctaatttttaatttttctgtagagacagggtcttactttgttacacaggctggtttcaaactcctg

SEQ ID NO: 17102 - DNA, 96 bp, Homo sapiens
cagcatacataaaggtgagtctgttgagtgagtacattttatttttattttatatatatatttgtgagatagggtctcactctgtcacccaggctg

SEQ ID NO: 17103 - DNA, 58 bp, Homo sapiens
gtgactgagtctcacactgtcacccaggctggagtacagtggcgcgatctcggctcac

SEQ ID NO: 17104 - DNA, 92 bp, Homo sapiens
actgctgaagcacacagtaactgacacaatttcatctttagttttttttctttttttagtgacatggtctcagtcacccaggcttgagtggt

SEQ ID NO: 17105 - DNA, 73 bp, Homo sapiens
gctgagttatttttgagacagtctcattctgtcacccagactggagtgcagtggcacgatctcaactgactgc

SEQ ID NO: 17106 - DNA, 109 bp, Homo sapiens
gagaaaaactaaaaacgttccaaataaatgagcaacatcaataaatggttttatttatttatttatttatttatttatttatttatttatttgagacggagtcttactc

SEQ ID NO: 17107 - DNA, 68 bp, Homo sapiens
tgcagcccagacagacagactctgtctaggtgacctcgggctttagtctgtctctctttgaagctaca

SEQ ID NO: 17108 - DNA, 116 bp, Homo sapiens
ttctcacgagatctgatggttaaaagtgtctggcaatttccccttcactctctcgctctctcctgccaccatgtaagaaataaagccacacctacaattatctgatctttgacgaa

SEQ ID NO: 17109 - DNA, 65 bp, Homo sapiens
ctgcccctgcacactccctctgtggctctggggaaccaggggccacaagtgaggatgctggtcag

SEQ ID NO: 17110 - DNA, 72 bp, Homo sapiens
gtgagttgagggtctgcctgtcttcagcagcataaaacggtggaaggagaacaggccttgaaatcaactagc

SEQ ID NO: 17111 - DNA, 103 bp, Homo sapiens
tccagctctgtgtttactcttcagtgaaaatggtggcaaatgtatgcaaaacagatgctgtgacacatggtttgttgtcaagagcagaggtcagagggcagga

SEQ ID NO: 17112 - DNA, 115 bp, Homo sapiens
ctctgccttcttgtctcagctcatactgtaaacaagtgtcctttctttcttttttttttcttttttttttttttaagatggagtttgcttttgttgcccaggctggagtgcagtg

SEQ ID NO: 17113 - DNA, 80 bp, Homo sapiens
ttccctagctggtcatcttgtctgtggggtggtgacattggcacacactgcctctctgattcagagtacagaagagggaa

SEQ ID NO: 17114 - DNA, 118 bp, Homo sapiens
gcagtgctgggctccaagcagaccttcaggaacccctgttctactgtccttgctggagacagaagagacacaggcttttctctttgggaggctccaggcttaggctcacccacagcat

SEQ ID NO: 17115 - DNA, 99 bp, Homo sapiens
ggagccagactctggggccatgtctagtgagaatgctgctctgttccacccctcagaacagtgccacacacccacactgactgtcctcagaaggtgacc

SEQ ID NO: 17116 - DNA, 74 bp, Homo sapiens
gtgtgtgtatatgtgcacatatatgtacatacctatgtatgtgtatgtatatgtatatgtgtatatacatgcat

SEQ ID NO: 17117 - DNA, 78 bp, Homo sapiens
gagtttgcctatctgacagatgaaggtgtggagatatttactaattaactctcattagtcattgattgaaggctgctc

SEQ ID NO: 17118 - DNA, 91 bp, Homo sapiens
tctggcttctccactagggcttaagctccggagggcaggacgctgctgtgtccgcagtgctgacagtgcagtcagtggaggtgcaaacaga

SEQ ID NO: 17119 - DNA, 102 bp, Homo sapiens
atggagccaaggctggaattggtgtggaaggtcatgagcttagtctctctcatactctgaatagaacatgccacccactctgtctgacttttggatttctgt

SEQ ID NO: 17120 - DNA, 81 bp, Homo sapiens
tctgagatggagtctcacactgtcacccaggctggagtatagcggcatgatcttggctcatggtagcctccgtcttccagg

SEQ ID NO: 17121 - DNA, 118 bp, Homo sapiens
atgttgacagagcagttggatgtgtcacgcatgtatttatgtaactaaaatttgtttttattgaacatttagattttgtgcatttaaatatcatggcttttaagggtatgtttaacat

SEQ ID NO: 17122 - DNA, 97 bp, Homo sapiens
catttctgttatggttttacagtgtggttttgtgtcttttttttttttttagtgaaaaaaaaaagaggactgcagttgtcatactatggtttgtgcc

SEQ ID NO: 17123 - DNA, 92 bp, Homo sapiens
gcctggcagccactcccagagcccctggaactctggcccaaggctctctgactgactccttcccagatcttctcggcttagcggctgaaggc

SEQ ID NO: 17124 - DNA, 88 bp, Homo sapiens; identical to SEQ ID NO: 1308

SEQ ID NO: 17125 - DNA, 81 bp, Homo sapiens; identical to SEQ ID NO: 1309

SEQ ID NO: 17126 - DNA, 77 bp, Homo sapiens; identical to SEQ ID NO: 1310

SEQ ID NO: 17127 - DNA, 59 bp, Homo sapiens
tgtgtgtgtgcatgtgtgtgtgtgtgtatgtatatatatatatgcattcttttcagacg

SEQ ID NO: 17128 - DNA, 99 bp, Homo sapiens
tattttatcaatatagtgtgttaacagtagacattataaatatcatatagatgatattttattaatattattgtgtgttaacactagacatcataaata

SEQ ID NO: 17129 - DNA, 127 bp, Homo sapiens
tgatagatatcatagataatattctattaatatcacagtatgttaacactagagatattgtagatatcatagagatgatattctattaataccacagtgtgttaacactggagatattacagatatc

SEQ ID NO: 17130 - DNA, 75 bp, Homo sapiens
ggccttcagaactgtgaaagaataaatgtgtgttgttttaagctactaagtttgtgttaatttgttctggcagcc

SEQ ID NO: 17131 - DNA, 87 bp, Homo sapiens
ctcccctctgagtctctgtgtgtcagatctgcccatccttcctaaggacactagccattggatttagcacaatttacaggagtggag

SEQ ID NO: 17132 - DNA, 76 bp, Homo sapiens
gaggtggtagatgacagtacagtgagtgatagagggccagggaaggtctccagctagacactccatttgcttattc

SEQ ID NO: 17133 - DNA, 101 bp, Homo sapiens
gattttttcacccgactgaaaatcagtgggtatcttgtttgcatggtggtattggtcatctgagacagtctctcactgaagcatggtctggtgcagttgtc

SEQ ID NO: 17134 - DNA, 73 bp, Homo sapiens
caggacctcatgcattctttccagtagagttttattttatatgtattcactttggtttgcctgtgaggtgttg

SEQ ID NO: 17135 - DNA, 58 bp, Homo sapiens
tctctctcactgggtccctcccacaacacatgggaattatgggagctacaagatgaga

SEQ ID NO: 17136 - DNA, 115 bp, Homo sapiens
gggccacaagggagaaagctttacagtaccttgtatgtctgtctgtctgtcagtgtggccttgagctctttctcctcttgctggtagtagagatcttccctggggcctttgacag

SEQ ID NO: 17137 - DNA, 83 bp, Homo sapiens
ggaagggcaacaagtgtgtatctgtgtgtgtgggtctgtgtgatgtgcaaataacagactcctctatctgtgtgtccagatcc

SEQ ID NO: 17138 - DNA, 87 bp, Homo sapiens
gtggctttgattggagggtgtgaggcgatccagggccctttgttacacagtctctctctctctctctccagccagccctagagccac

SEQ ID NO: 17139 - DNA, 95 bp, Homo sapiens
cgcagtttctagtataatggggtcctactatccccagtcactcactcacttaaatgtttattgagtgtctactgtggaccaggctaggaactgag

SEQ ID NO: 17140 - DNA, 91 bp, Homo sapiens
tatatatatatatagagagagagagttctatatatatattgttctattatgtatatatagagagactgagtcttacttgatatatattata

SEQ ID NO: 17141 - DNA, 77 bp, Homo sapiens
gcacaatactgaatgagacactcgctctcagagtctgcaagtgcagggttgggagtaggtgtctccttcagttttgc

SEQ ID NO: 17142 - DNA, 99 bp, Homo sapiens
ggggtgcctgttgagaggtgggaatagggggcatggtgggtggaattcctttttctttatactttttatcctttataaatcatgttgttgctttacctt

SEQ ID NO: 17143 - DNA, 70 bp, Homo sapiens
gtggggtcgtcagtcactgatctctgggtcactctctcaccttccttggagattttagttcctgtcctac

SEQ ID NO: 17144 - DNA, 114 bp, Homo sapiens
actttgaggctattccaataaagctgctttacacatttgaattcaagcttttatatgtatatacatttattcttgtcatgtaaattctactgctgagagcagaatggctgagtc

SEQ ID NO: 17145 - DNA, 95 bp, Homo sapiens; identical to SEQ ID NO: 580

SEQ ID NO: 17146 - DNA, 93 bp, Homo sapiens; identical to SEQ ID NO: 69

SEQ ID NO: 17147 - DNA, 58 bp, Homo sapiens
tgaggcggagtctcgctctgtcactcaggctggagtgcagtggcgccatctcggctca

SEQ ID NO: 17148 - DNA, 58 bp, Homo sapiens
tgagacagagtctccctctgtcacccaagctggagggcagtggcatgatctcagctca

SEQ ID NO: 17149 - DNA, 117 bp, Homo sapiens
gtgtcatcatttctgggctcctattctgttctattctatgtgtctgttttaccagtactgtgctgtttggttactgtagtcttgtaacatagtttgaagtcaagtaatgtgatgcct

SEQ ID NO: 17150 - DNA, 111 bp, Homo sapiens
ttatgatttcaaaccaattttaatgcattatttccaaactcagtttcttttattttttttacattaaaaagatttagattcagggagtacctgtgcaggtttgttacataa

SEQ ID NO: 17151 - DNA, 79 bp, Homo sapiens
gtcctgagatgaattagtaagtggtccatggatccagctctttctgtgtgcctggctgcctgctagcccctcccaggtc

SEQ ID NO: 17152 - DNA, 63 bp, Homo sapiens
tgcccagagcagctaggggcagcggcacaatgggatggccatctctccctccctctctgggta

SEQ ID NO: 17153 - DNA, 108 bp, Homo sapiens
gtgtcgtcatgtcctcttcctctccgtgtgtctgtctctgtgtctaaatttccccgttccttaaaggtcaaaatcacactggatgagggctaactctaatgacttcat

SEQ ID NO: 17154 - DNA, 95 bp, Homo sapiens; identical to SEQ ID NO: 68

SEQ ID NO: 17155 - DNA, 93 bp, Homo sapiens; identical to SEQ ID NO: 69

SEQ ID NO: 17156 - DNA, 113 bp, Homo sapiens
ttcatatctttgctattgagaatactactgcaataaacatatgagtatatgtatctttttgatatattgatttattttccttttggtagatacacagtagtgagattgctgga

SEQ ID NO: 17157 - DNA, 87 bp, Homo sapiens
ggaagccttcactgactgctgttggccagttgagctcatacattaacaaaaggcaaaatgactctcagacactcagtctggctctcc

SEQ ID NO: 17158 - DNA, 95 bp, Homo sapiens; identical to SEQ ID NO: 68

SEQ ID NO: 17159 - DNA, 93 bp, Homo sapiens; identical to SEQ ID NO: 69

SEQ ID NO: 17160 - DNA, 114 bp, Homo sapiens
ggcttagctaattgcaacatgttaaagtggctttgactaacatcactatcactagtgacaagtcacagttgacaagcaagggttgtatttggctgactccatttcttccctgcc

SEQ ID NO: 17161 - DNA, 105 bp, Homo sapiens
ggttgtgctcttcttatgagaatctaatgcctgatgatctgtcactgtctctcatcatccccagatggaaccatttagattcaggaaaataagctcagggctccc

SEQ ID NO: 17162 - DNA, 107 bp, Homo sapiens
ggcttccacacacggtgagtataagcaggctgggctgcatcaattaagtcactctgtgtctgggagaattctggtgaggcacagtcaaaactcaagtggagaaagcc

SEQ ID NO: 17163 - DNA, 77 bp, Homo sapiens
gcagagatgaatatttgttagaagggtgcccctaacgtctggtgtttgcattctttttaaatattgatctatattgt

SEQ ID NO: 17164 - DNA, 75 bp, Homo sapiens
gagatgaggagacagagtgcactgtgacaactgagtcaaatggcagtgattccagtgtttttgttttgtcaattc

SEQ ID NO: 17165 - DNA, 76 bp, Homo sapiens
catatatatatatatatgtatgtatgtatatgtgtgtatatatacatatgcatgcatgcatgtatgtatgtatatg

SEQ ID NO: 17166 - DNA, 77 bp, Homo sapiens
agccaggtgtagtggcagatgcctgtagtcccagctactaaggaggctgaggtaggaggatcacttgagcccaggct

SEQ ID NO: 17167 - DNA, 120 bp, Homo sapiens
tatgtaaggctggatccaggggtcaagttacatcataggactaggggtttgtgtgtgtctcattctgtctccctgctcctatgttggttttgtgctcaggttgtttggttccatgtagtg

SEQ ID NO: 17168 - DNA, 95 bp, Homo sapiens; identical to SEQ ID NO: 68

SEQ ID NO: 17169 - DNA, 93 bp, Homo sapiens; identical to SEQ ID NO: 69

SEQ ID NO: 17170 - DNA, 79 bp, Homo sapiens
tcaggtgggagaatgacatcaagcaattgtgcagttgtgatgagtgcaaagttgtgagggtcaggggtgacttttctga

SEQ ID NO: 17171 - DNA, 58 bp, Homo sapiens; identical to SEQ ID NO: 1435

SEQ ID NO: 17172 - DNA, 80 bp, Homo sapiens
ttcagaagacactcagcacacccctggaaattaatggatgaatggatcacattccctggctgctgggttaagcttatgag

SEQ ID NO: 17173 - DNA, 110 bp, Homo sapiens
tgagggaaggggatcacttgtgagactgaacaccaggaggtggggatcttaggagccactctcaagtctgtctgcacaaaagagatccaaaaataccagactcccactca

SEQ ID NO: 17174 - DNA, 99 bp, Homo sapiens
agaagggtctttgtacctggtttcttaatgttcatgatgctcctccttctaagcatgaatagtcaagcttcatgggcaaggcaccaggcagcccctgct

SEQ ID NO: 17175 - DNA, 61 bp, Homo sapiens
tgagatgggaatctcactctgtctcacccaggctggagtgcagtggtgggatcttagctta

SEQ ID NO: 17176 - DNA, 93 bp, Homo sapiens
gaaagtctcaagaatggagagaatagagctgtttatttggttaaaacatttattttataaaatctttattatacattcattcttttgggtttc

SEQ ID NO: 17177 - DNA, 95 bp, Homo sapiens; identical to SEQ ID NO: 68

SEQ ID NO: 17178 - DNA, 93 bp, Homo sapiens; identical to SEQ ID NO: 69

SEQ ID NO: 17179 - DNA, 110 bp, Homo sapiens
agacaggaattgggtttggatctgaagaaataggtagttttgcaggagtctctgtggggagaaatcagacagaactgagtcaccagatgtttgagaaccaatggaggtct

SEQ ID NO: 17180 - DNA, 63 bp, Homo sapiens
ttctgactgcctccgtctgtctgttattctgctttggagcacatagctgtggggtggtcggga

SEQ ID NO: 17181 - DNA, 111 bp, Homo sapiens
aggtccatgcgtaagtagatgcatgtgtgtgtatgtgcgtgtgcatgtgtgtgtatgtgcatgtgcatgtgtgggtatgtatgtgtgcctgtgtatgtgtgtgtggagact

SEQ ID NO: 17182 - DNA, 117 bp, Homo sapiens
cattgcactccagcctgggcgacagagggagactctgtcttgaaaaagaaaaaaaagtccttttttttttttttgagacggagtctcgctctgtgtcgcccaggctggagtgcagtg

SEQ ID NO: 17183 - DNA, 73 bp, Homo sapiens
acagagcgagactccgtctcaaaaaaaaaaaaaaggacttttttttctttttcaagacagagtctccctctgt

SEQ ID NO: 17184 - DNA, 91 bp, Homo sapiens
gtaggacccatgagattctctggggcttcgctgaatagttaccttgtcctcaatgatggcaatgatgtctccaacagtctcaaaatccagc

SEQ ID NO: 17185 - DNA, 76 bp, Homo sapiens
tttcccctcaagtaatctggcttatttcctccaattgccgtccctttagacttgagacagattctggaaggggaaa

SEQ ID NO: 17186 - DNA, 58 bp, Homo sapiens; identical to SEQ ID NO: 1265

SEQ ID NO: 17187 - DNA, 116 bp, Homo sapiens
ggccattagtaggggagggctggagataactctttattgagaagagtctgtggacaaaggggtctatgaactctagagtcaggacaaagattacatatttgaagcacctcaaggct

SEQ ID NO: 17188 - DNA, 110 bp, Homo sapiens
tatatacatatatatgtcggtatatatatatgtcggtatatacatatatatgtccgtatatatatatatatgtcggtatatatatatgtcggtatatatatgtcagtgtg

SEQ ID NO: 17189 - DNA, 142 bp, Homo sapiens
gtattccatcatatatatatatatatcggtgtgtgtatatatatatatatatatatatatatatatatgtcgatgtatatatatatatgtcggtgtatatatatatgtcagtgtatatatatatgtcggtatatatatatgt

SEQ ID NO: 17190 - DNA, 58 bp, Homo sapiens; identical to SEQ ID NO: 13670

SEQ ID NO: 17191 - DNA, 58 bp, Homo sapiens; identical to SEQ ID NO: 315

SEQ ID NO: 17192 - DNA, 64 bp, Homo sapiens
gtctacagagtgctgggctggctctctttttttaagagatagagtctcactctgtcacccaggc

SEQ ID NO: 17193 - DNA, 106 bp, Homo sapiens
gcacactagcctgagtgacagagtgaggcgttgtctcaatttttttttttttttttttttttgggatgagacagagtcttgctctgtcacccagagactgaagtgc

SEQ ID NO: 17194 - DNA, 117 bp, Homo sapiens
cagcctcctgaatagctagggctacaggcctgcatcacgtgacacccagctgattatttattttttgtacagatgggggcctcattatgttgcccaggctgttctcaaactcctgga

SEQ ID NO: 17195 - DNA, 103 bp, Homo sapiens
agcctggtgacagagcaagactctgtctcaaaaaaaaaaacaaaaaacggaaagaaattttttttttttttaagagacacagtttcactctggtttccaggct

SEQ ID NO: 17196 - DNA, 116 bp, Homo sapiens
aagattacattcttaggtgtatttgctccttggtcctctggaatgttacatggatatggaatgtaaggttgcccaactgggctatacagtagggttgcttaatgaatgtttatctt

SEQ ID NO: 17197 - DNA, 81 bp, Homo sapiens
tggcgacagagtgaggccctgtctcagaaaattcttttttttttttttttttgtagagacagggactcactctgtctgtca

SEQ ID NO: 17198 - DNA, 77 bp, Homo sapiens
ctgggcagagtcgctctcactgtcagataaaggggcccctgttctgattcccatcagtgacaagggatgacgctcag

SEQ ID NO: 17199 - DNA, 139 bp, Homo sapiens
agtctcagtttctctatagaggtacttgatatggcaactgatgagagagagagactgagactgagaagagagagcccaagacagaagctgcaaagtcttttttttttttgagacggagttttgctctgtcacccaggct

SEQ ID NO: 17200 - DNA, 73 bp, Homo sapiens
gcagtaagccgtgattgtgccactccactccaccctgggtgacagagcagagtgtacatttcatgaaggctgt

SEQ ID NO: 17201 - DNA, 105 bp, Homo sapiens
ggcatggtgacacgctctgtagtcccagctactcaggaggctgaggtggtaggattcattgcttgagcttgggaggtggaggttgcagtgagctctgatcatgtc

SEQ ID NO: 17202 - DNA, 104 bp, Homo sapiens
gtagatcagttatttgagttcattcttgctgagtttgtttttcattctgtaaaacaggtgatttgatgaaggctgctgcaggagagttcgcagatgatccctgc

SEQ ID NO: 17203 - DNA, 116 bp, Homo sapiens
gtcagttggtccactagaatgcagtctgaaaaatatctcaaacaccagtctttttttttaattagatgggatcttgctctgttatctaggctggagtgcagtggcacgatcttggc

SEQ ID NO: 17204 - DNA, 96 bp, Homo sapiens
ccacatgtcaagttgctgattttgttccattgtaagaagagcgtgtgcagactgcttagccgtaggaaatgagcaaaattaatcttcgtcagctgg

SEQ ID NO: 17205 - DNA, 81 bp, Homo sapiens
atgtcagggctcagtttctctgcttttaaaacaagactggtctgagtctatgtctcaggcataaagctaagcatttgacat

SEQ ID NO: 17206 - DNA, 69 bp, Homo sapiens
gcaatttcctaaagagcctctctgcttctttccctcttcacagaagtcagagagatcttggttttttgt

SEQ ID NO: 17207 - DNA, 103 bp, Homo sapiens
caaatgaaattggaacataaaagtagtagaggagaggttagagagcgtacatttagctttttttttttttttttgaaagcttttggtgagaaattgtctgttg

SEQ ID NO: 17208 - DNA, 108 bp, Homo sapiens
ttcattttctggatacaagtcctttgtcagatatgtgatttacaaatatgttctgtttgtaagtttttattcttttaacaatttcacagaggtttttattttaatgaa

SEQ ID NO: 17209 - DNA, 112 bp, Homo sapiens
gtctagtacagtgtactgattgctcagaaaacaagtttatttatgtataatacaaacatgcaatgatgataacggtgttgggggatgaggcaggcactgtttataacagggc

SEQ ID NO: 17210 - DNA, 95 bp, Homo sapiens; identical to SEQ ID NO: 68

SEQ ID NO: 17211 - DNA, 93 bp, Homo sapiens; identical to SEQ ID NO: 69

SEQ ID NO: 17212 - DNA, 95 bp, Homo sapiens; identical to SEQ ID NO: 68

SEQ ID NO: 17213 - DNA, 93 bp, Homo sapiens; identical to SEQ ID NO: 69

SEQ ID NO: 17214 - DNA, 57 bp, Homo sapiens
ggacatctgtctgaaggagcacctgactctggtctgggtgactctgtgacactgttt

SEQ ID NO: 17215 - DNA, 66 bp, Homo sapiens
gccaggcacttttttttttttttgagacagggtcttgctctgtcacacaggctgaagtgtggtggt

SEQ ID NO: 17216 - DNA, 117 bp, Homo sapiens
gcctttagaattgttagcaataaatttctgttatatataaattatccagtctaaaatatttttattttatagcagcctgagtggactaagatagaaattggttctgagaagtagggt

SEQ ID NO: 17217 - DNA, 58 bp, Homo sapiens; identical to SEQ ID NO: 8823

SEQ ID NO: 17218 - DNA, 110 bp, Homo sapiens
gtgtgtatctatagctgtatatctttatctctgtatgtatatatactttaaggttattggtgtatgtataaatatataaagtacatttatacagaaaatgaagtacatat

SEQ ID NO: 17219 - DNA, 79 bp, Homo sapiens
agtctcactctgtcacccaggctggagtgcagtgttcttggctcgatgcaacctccacctcccaggttcaggcgattct

SEQ ID NO: 17220 - DNA, 117 bp, Homo sapiens
tgctccggcctgggcaacatggtaagaccccctctctaaaagaaattttttcttttcttttttctttttatttttttttaagacggagtctcgctctgtcactgccctgctggagta

SEQ ID NO: 17221 - DNA, 62 bp, Homo sapiens
tgggaaggagtctcactcactctgttgcccaggctggagtgcagtggcgtgatctcggctca

SEQ ID NO: 17222 - DNA, 113 bp, Homo sapiens
caagtgtactcattcccaattgacttatatctaggagagagacattttttattatttatttatttatttatttagagacagtctcgctctgtcgcccaggctggagcgcagtg

SEQ ID NO: 17223 - DNA, 85 bp, Homo sapiens
ggaagggagggaagagagaaggaaacagatatatggccattaaatcttcagcttatttgtttctttcttttcttttttttttttt

SEQ ID NO: 17224 - DNA, 107 bp, Homo sapiens
catgcagagcagtgcggcaggaactacccccgatctgggagcctgcctgggagcctgaggttgaggagaagggaaaggaggcattgctgctacagctgctactgctg

SEQ ID NO: 17225 - DNA, 90 bp, Homo sapiens
atggagtctggagccctgagtttgagactcgcactgccctgctgacttgcttaggggactgactccgactctgggtctcagtatcttcat

SEQ ID NO: 17226 - DNA, 82 bp, Homo sapiens
aattagctgggtgtggtgacgcacctgtaggcccacctattcgggaggctgaggtaggaggatcgcttgagcccaggaagtt

SEQ ID NO: 17227 - DNA, 151 bp, Homo sapiens
ctagtctgggcaacatagggagagctccctctctaaattaaaattaaaatttattttatttatttatttttttgagacggagtctcactctgtcacccaggctggagtgcagtggcgcgatctcggctcaccgcaacttccgcctcctggg

SEQ ID NO: 17228 - DNA, 95 bp, Homo sapiens
gattgttccgggaagctcgctcctggtggtttgaggagagtcagcccagtttgagggctcactgaacacacaaagcacttttcccacacgctttc

SEQ ID NO: 17229 - DNA, 77 bp, Homo sapiens
gaacgtgtgtgtgcatgtgtctgcacgtgtgcgtgtgtatgtgtgcgtgtgtgcgtgcgtgtgtgcatgtgtgtgtc

SEQ ID NO: 17230 - DNA, 95 bp, Homo sapiens
aagccatggccacatgagctttgagtgagatagatctgagtttgaatgctcgcctagtcattctctctcactaactttggcactaactttggctt

SEQ ID NO: 17231 - DNA, 75 bp, Homo sapiens
aaggtcacagagccagtaagtgacaaatggagtttaaactgacatctctgtctctctctgctaggtctgtgcttt

SEQ ID NO: 17232 - DNA, 112 bp, Homo sapiens
agatcggaaataaatatttacttaagtatgtttatgatgaagagtttttttatattactataaaaatagacaccttacataaacatattacagttggtgtttagatggctct

SEQ ID NO: 17233 - DNA, 88 bp, Homo sapiens
gaagccagggaattactgtactcagctactctcagctcatacttcccacttgtgagctgactgagctcagagggtgtttgcctgattc

SEQ ID NO: 17234 - DNA, 72 bp, Homo sapiens
gatgcagagggagcaggagctgaggtggagacggccactgcctctctcaccctctgttccatccctctgctc

SEQ ID NO: 17235 - DNA, 118 bp, Homo sapiens
tagaaaaaacgttttactccctttgggcttttgagctacagtgaagttttaatttttaattagaatagtttcatttattaaacgttctgcagaagtgttaggagagttgttttttgta

SEQ ID NO: 17236 - DNA, 105 bp, Homo sapiens
cagaccccattctcaaagattctgagtacgtttgagatgagacccagagaacctgcatttttttgtttttaaacaaacgtattcagcctctcttgagaaccactg

SEQ ID NO: 17237 - DNA, 131 bp, Homo sapiens
cctgggcaacagagtgagtccctgaattaattaattaattaattaatttatttgagacagagtctcgctctgtcacccaggctggagtgcagtgacatgatctcagctcactgtgacctctgcatcctggg

SEQ ID NO: 17238 - DNA, 80 bp, Homo sapiens
ggttctgggatccctgactcccactcactcagtagcctcacctgcttgggagggacacctcagtaagggaccccagtacc

SEQ ID NO: 17239 - DNA, 58 bp, Homo sapiens; identical to SEQ ID NO: 605

SEQ ID NO: 17240 - DNA, 100 bp, Homo sapiens
acatatatgtatataatgggaatcaataatgggaatatatatgtataatgtatgtatatacatatatgtgtgcatatcatgggaatcaatgcatatatgt

SEQ ID NO: 17241 - DNA, 95 bp, Homo sapiens; identical to SEQ ID NO: 68

SEQ ID NO: 17242 - DNA, 93 bp, Homo sapiens; identical to SEQ ID NO: 69

SEQ ID NO: 17243 - DNA, 96 bp, Homo sapiens
gatgaggagggagattcctgagagttcagactgagtagaagaagggctaaagatggcccctctgaaaagctgattgctactcatccttcaagtatc

SEQ ID NO: 17244 - DNA, 118 bp, Homo sapiens
gaggtcgggggcgtgttggacagtcctggtcgctgagtcatgctgaagcactctctttttgactcactctttgtgacgtaggtctttctcaccagtcaataaaatataatccgaaagc

SEQ ID NO: 17245 - DNA, 117 bp, Homo sapiens
cctcaagggtttgattgtggtataaggtgggttcagttgaccggctttgtctctggaagatttcagggggccaaggctcagctcacaactcctggactacgtgctctaactctaggg

SEQ ID NO: 17246 - DNA, 117 bp, Homo sapiens
ctgtgtgtgtgtgtatatatatgtatatatgtgtatatatatatgtatatatatatgatgggctctccttacatatatatctatatatgtacttatgtatatataagccaggcatgg

SEQ ID NO: 17247 - DNA, 78 bp, Homo sapiens
ctggggttctgacaacggtgtcaaaatttatttatgtgttttcaagaaataatagcactaggtctgttagaatatcag

SEQ ID NO: 17248 - DNA, 95 bp, Homo sapiens; identical to SEQ ID NO: 68

SEQ ID NO: 17249 - DNA, 93 bp, Homo sapiens; identical to SEQ ID NO: 69

SEQ ID NO: 17250 - DNA, 123 bp, Homo sapiens
gttttcttgtagtcgttttatagtttgatgtcttagatttaagtctttaatccattttaattcaatatttgtatatggtgagagataggggtctagtttcattcctctgcatatggatatcta

SEQ ID NO: 17251 - DNA, 91 bp, Homo sapiens
aggctttcttatttcctttcagcttcccttgagactgagcagagagagaaaattagctaaatcaggaatgcagggaatacagttgcagcct

SEQ ID NO: 17252 - DNA, 105 bp, Homo sapiens
acagtgtataagtgctcccttttctctgacacttcatcagcatctgttatttttttactttttaataatagccattctgactggtttgagagggtatctcattgt

SEQ ID NO: 17253 - DNA, 79 bp, Homo sapiens
ctgggactacaggctttgtcaccatgccttatttatgtatgtatgtatgtagagacaagggtcttgctatgttacccag

SEQ ID NO: 17254 - DNA, 119 bp, Homo sapiens
cgaggggcaggtgcgggtcctggggcggcagcagcgagtaggtgacctgggcgttggtgcctgagtctctgtctgtggcgctgacgctgccgatgtgcagggcggggctgttgttctcg

SEQ ID NO: 17255 - DNA, 90 bp, Homo sapiens
gctgtctctatccagcatccgtgtctgtctctctctcttggtctacacagcttacgaagaaagttataaccaccggaattgggaaacagc

SEQ ID NO: 17256 - DNA, 111 bp, Homo sapiens
ggcttgtagtggtcgtccaggaccatggccagccccctctctcggccaccgtcacactcactgtggctgtggccgacagcatcccagatgtcctggctgacttgggcagcc

SEQ ID NO: 17257 - DNA, 62 bp, Homo sapiens
atatatacacatacatatatacatatacatatatgtatatgtatgtatgtatgtgtgcatat

SEQ ID NO: 17258 - DNA, 68 bp, Homo sapiens
ttgcttgagatgagtctcactctgtcacccaggctggtgtgcaacggcatggtgttggctcactgcaa

SEQ ID NO: 17259 - DNA, 111 bp, Homo sapiens
ttaatttttatgttgatggatggtcttagtgcagagaagaacccagccaaatatatttatatttgatgctgttatttttgatgtactgtacctttgagcaatttgtattga

SEQ ID NO: 17260 - DNA, 119 bp, Homo sapiens
acaacggtagttaagagcactatcttgagaataaggtgaaccccgggttgaagtcctggctctgcctctgtgtgactttttgcagttctcttaacctctttaggcctcaatttctttgt

SEQ ID NO: 17261 - DNA, 59 bp, Homo sapiens
tgtctctctctgagtgccagaaaggttcttacccttgtctgagtgcactaggaggggca

SEQ ID NO: 17262 - DNA, 62 bp, Homo sapiens
atgtggctggttctgacattgcccacagctctgtgactatctgtcagcatcagcaagagcat

SEQ ID NO: 17263 - DNA, 58 bp, Homo sapiens
tgagaaggagtctcgctctgtcgctcaggctggagtgcagtggcgctatctcggctca

SEQ ID NO: 17264 - DNA, 74 bp, Homo sapiens
atatatgatatatgatatataatatataatatatacatattatatatagtctatatgtatatatatacatatat

SEQ ID NO: 17265 - DNA, 109 bp, Homo sapiens
ggtgttagaataatgcccagcacacaaacactttataaatatttgtaaatataattctaacagatgtttattgaatgcctcttatgtgccaggcactgttctagatgct

SEQ ID NO: 17266 - DNA, 58 bp, Homo sapiens; identical to SEQ ID NO: 1673

SEQ ID NO: 17267 - DNA, 58 bp, Homo sapiens
tgagacagagtctcactctgccactcagcctggagtgcagtggtgcaatctcggctca

SEQ ID NO: 17268 - DNA, 76 bp, Homo sapiens
gggatggggcagtgaagtgtgagtggtcaggggcatctaaccccatgactggcaagacactctagtgtgaacaccc

SEQ ID NO: 17269 - DNA, 68 bp, Homo sapiens
ctgagtgctgggtccctcagtggctctcgactggccccagagccggggagggtccacaggcaagccag

SEQ ID NO: 17270 - DNA, 58 bp, Homo sapiens
tgagactcagtcttgctctgtcactcaggctagagtgcagtggtgcgatattggctca

SEQ ID NO: 17271 - DNA, 58 bp, Homo sapiens
tgagacagagtctcgcactgtcacccaggctggagggcaacggcgtgatctcggctca

SEQ ID NO: 17272 - DNA, 70 bp, Homo sapiens
tatatatatacatatatatatatacgtgtatatatatgtatatatatatgtatatgtgtatatatatata

SEQ ID NO: 17273 - DNA, 112 bp, Homo sapiens
ccaaggtccattgggcctacagcccaagctctccactacaagtttcctcttttcttttttttttttttttttgaggcggagtctcgctgtctcccaggctggactgcagtgg

SEQ ID NO: 17274 - DNA, 117 bp, Homo sapiens
aaaagaaaatgaaaacaagaaaaagtcctaatatctaccaaattgttcacagtagttagtgtcgagagtgggctggggctggtgaagtgaggaggtgtctattttcttttcttttct

SEQ ID NO: 17275 - DNA, 80 bp, Homo sapiens
atgtatattgatatgtatgttttcatgtatatgtatattttatgtatgtttatacataaaacagtatattttttgtatat

SEQ ID NO: 17276 - DNA, 84 bp, Homo sapiens
ggtctatgatccatctccaggaggcattttggacactgatgagggcattgttgtttgtcaaagtgacaggggaggggtttaacc

SEQ ID NO: 17277 - DNA, 114 bp, Homo sapiens
ccaaattctaggttatgtcctctttgggaatgccctctcctccgcactgaatatatttatttcaatccggtgaatatttgttgagggcctctcatgtatatgacactgtggtgg

SEQ ID NO: 17278 - DNA, 61 bp, Homo sapiens
acagtgggaggagagagaggtcagtattcattcccctggtttcctctcttgcaagctctgt

SEQ ID NO: 17279 - DNA, 111 bp, Homo sapiens
gtaaattactacagtgtctggcacatggtaagtgctcaggggatgttagttattaatttaacaattttggaccaaaggcctactgtgtgtcaggtattctgttctaagtgc

SEQ ID NO: 17280 - DNA, 80 bp, Homo sapiens
tgctgtcaggcagcatttgaattcagtgatgtaactgcctgtgctgggcacttaaccaccgctgacactgcctttcatca

SEQ ID NO: 17281 - DNA, 83 bp, Homo sapiens
gtgcacagagtgttcgttttaagtaaaggtaaaatttttttttattttttattttttccccagacggagtctcactctgtcac

SEQ ID NO: 17282 - DNA, 58 bp, Homo sapiens
tgaggcggagtctcactctgtcacccaggctggagtgcagtggcgtgattccggctca

SEQ ID NO: 17283 - DNA, 121 bp, Homo sapiens
ctgagacatggagtgggaggggtatagggatgaagtcaccaccacagtgtctctcacattctttcagatctggctggagcagattcagaaaacctcttatctcccccaggcggatgatgtg

SEQ ID NO: 17284 - DNA, 68 bp, Homo sapiens
gggcaaagtcaggaggggaatgaagtctgcagagtccatactcccaaccccagctctctcctgctccc

SEQ ID NO: 17285 - DNA, 113 bp, Homo sapiens
gcagcaaggagagtatattttagtctttttcacagtgcctcgaatagtgtctttttctttttctttttaagatgaggtcttactgtgtcacccaggctggagtgcagtggtgc

SEQ ID NO: 17286 - DNA, 111 bp, Homo sapiens
gtgtcttttgaagggcaaacatttttaattttggtcaagttcaatttgttaatttttttctttttaaattgtgcttttgatgttaaatctaagtatttgcctaacctacac

SEQ ID NO: 17287 - DNA, 110 bp, Homo sapiens
tgcttaggattgtcttggctatacgggctcttttttggttccatatgaaatttaaagtagttttttctaattctgtgaaggaagtcagtggtagcttgatggggatagca

SEQ ID NO: 17288 - DNA, 118 bp, Homo sapiens
cagtggattcctgaaactgcagatagtaccaaaccccattgtgatagtctgtctggtaaccaagatggctactaactgactaatgggtgagtagtgtatgtatagcatggatacactg

SEQ ID NO: 17289 - DNA, 71 bp, Homo sapiens
tatttatatatacatgtatgtatacatatgtatacacatatatattatatacatatatatgtatataatta

SEQ ID NO: 17290 - DNA, 86 bp, Homo sapiens
tgcataatgtcctccagttccatccatgttgatgaaagagacataatttcattcttttttatggctgaataacatttcattgtgta

SEQ ID NO: 17291 - DNA, 75 bp, Homo sapiens
tatcaggattactctgtctctctctgtgcatgcatacagatgcctgttgacttaggatggggtaatgttctgata

SEQ ID NO: 17292 - DNA, 117 bp, Homo sapiens
tgctatgaacattcttgcatatgttttttggtgcatgtatatataccttcctgttatttatatatttaagagtgaaagtggctacatcataatgtccatatgcattagttttagtag

SEQ ID NO: 17293 - DNA, 84 bp, Homo sapiens
agttaatactatatatatatatatatatatatatatatatatgagtgtgtgtgtatatatgtatatatgtatatatacgtgact

SEQ ID NO: 17294 - DNA, 69 bp, Homo sapiens
ttctgtacttttgagtgcctctgcatggaagtgaaagaacttactcagcagaggcagcgtagcatagag

SEQ ID NO: 17295 - DNA, 98 bp, Homo sapiens
tgtgactatatgggatataaagtcactgagtcagtctgacattcaatgtagacctcatgtcagccttcaggaattgacatccttccccaaatattgca

SEQ ID NO: 17296 - DNA, 96 bp, Homo sapiens
tttctctgaggaagcagcatttaatctgagaactgacagttgagattgagcaagatgtggggagaatcaggagatggcattttaggggcagggagg

SEQ ID NO: 17297 - DNA, 85 bp, Homo sapiens
tacaatctcagttgagctcctttgtctttcagcccatatttgtctttatatttaaagactgaaagttagctgctttgagtctgta

SEQ ID NO: 17298 - DNA, 70 bp, Homo sapiens
ctctctctctctctcatgttgtgccagggccccgtgaggagcatcaggaaaagcgtgggacaaggaaggg

SEQ ID NO: 17299 - DNA, 68 bp, Homo sapiens
cttactgagatagggtctcactctgtcactcaggctggagtgcagtggcgtgatcatagctcattgag

SEQ ID NO: 17300 - DNA, 93 bp, Homo sapiens
gttaatgtgattagtacttttataagaagagacatgagagagcttacttctctctctgccctctagcaagtgagaatacaagaagaacatagc

SEQ ID NO: 17301 - DNA, 75 bp, Homo sapiens
gataagtattagtgatgttccattactctttatttttatgtaaaaataaatataagtggaagttctagtgctttc

SEQ ID NO: 17302 - DNA, 120 bp, Homo sapiens
atgcttataaaggagagggagactttatgttgtttattaatagatttgatttttatatttatcataagatgtaatatatgcaataagataaaaagtataatagcatgtcccttgcattta

SEQ ID NO: 17303 - DNA, 96 bp, Homo sapiens
catgaggaaattgaaacagagtaagtaatttgttaaacattattatggtagaaaatagtagactagacattttgaacttgttcctgagtccttatg

SEQ ID NO: 17304 - DNA, 115 bp, Homo sapiens
cttgtgtaacatgcatgttgtactgcattttctgctaactaaacttttattattattattattatactttaagttttagggtacatgtgcacaatgtgcagcttagttacataag

SEQ ID NO: 17305 - DNA, 104 bp, Homo sapiens
gcaagtttagggctcccattgattctacattatggtgagttgtataattatttcattatatagtgcaatgtaataataatagaaataagggactcaataaatgc

SEQ ID NO: 17306 - DNA, 86 bp, Homo sapiens
ccaacagcattgagaagtgagagtgggcagggtttcctgggcattttgcagaaggatggatgtttgcaatattagcattgctttgg

SEQ ID NO: 17307 - DNA, 103 bp, Homo sapiens
gttgaaaatgccaatccaggttccaggatagaatcacctgttattgacttctctgtttgtactagtgatgctggtaaccctgggatctttcactcggcttgac

SEQ ID NO: 17308 - DNA, 58 bp, Homo sapiens
tgagacagagtctcactctgtcacccaggctggagtgcattggtgtgatctctgctca

SEQ ID NO: 17309 - DNA, 87 bp, Homo sapiens
tagaacaataatgtaactgtgtgtttatgtgtatgtgcatgtgcatatttgtacatgcatgtgttcaaactcaatacttattttctg

SEQ ID NO: 17310 - DNA, 84 bp, Homo sapiens
gcctgggtaactttaggagttttgagtaggttgtatagatatttggctatttatatattctcctcattttggagctgaaaaggt

SEQ ID NO: 17311 - DNA, 58 bp, Homo sapiens; identical to SEQ ID NO: 7346

SEQ ID NO: 17312 - DNA, 95 bp, Homo sapiens; identical to SEQ ID NO: 68

SEQ ID NO: 17313 - DNA, 93 bp, Homo sapiens; identical to SEQ ID NO: 69

SEQ ID NO: 17314 - DNA, 95 bp, Homo sapiens
gtctaagtgtattcattgttcacttacaagtgaaaacagaaaatatttgtttttctgtttctgcattagtttacagaggataatgggataatgac

SEQ ID NO: 17315 - DNA, 121 bp, Homo sapiens
ggcttttcttagcatctattagagattggaacattattctatggcctttatatttatttgtttccaatgagatatctcatagattctctaatttctattgtccctggatcctgtctttggc

SEQ ID NO: 17316 - DNA, 95 bp, Homo sapiens; identical to SEQ ID NO: 68

SEQ ID NO: 17317 - DNA, 93 bp, Homo sapiens; identical to SEQ ID NO: 69

SEQ ID NO: 17318 - DNA, 107 bp, Homo sapiens
agggcagatagtttgagcaaggctagatcaaggcaaataatcaatgtgtctctcagtctcagttttgctttgtttcatactggctcattctcaggtaagttctccct

SEQ ID NO: 17319 - DNA, 81 bp, Homo sapiens
tgtcagccattacgagggtgtctctctgaggctcagttttagctgttctggcagaaggatatctattgcttttgggtgcca

SEQ ID NO: 17320 - DNA, 94 bp, Homo sapiens
gttttgatgacttgtctcttttgtcatatttcttatgcattctgaaatgtatttttctaattgtgtaagttaaaagaaaacaatttatcaaaat

SEQ ID NO: 17321 - DNA, 107 bp, Homo sapiens
ccatactatgttgaatatgagtggtgagagagggcattcttgtcttgtgccagttttcaaagggaatgcttccagctttttcccattcagtatgatattgagtgtgg

SEQ ID NO: 17322 - DNA, 91 bp, Homo sapiens
tttgttgaccaagtactctgtgccaggtattgtgtgagcatctttacatttattgttttacataattctggcaagaaaccaggaaaacaga

SEQ ID NO: 17323 - DNA, 95 bp, Homo sapiens; identical to SEQ ID NO: 68

SEQ ID NO: 17324 - DNA, 93 bp, Homo sapiens; identical to SEQ ID NO: 69

SEQ ID NO: 17325 - DNA, 72 bp, Homo sapiens
gaaggataccaaaaatgattttatatgtgtgtgtgaatatatatatacatatatgaaattttatgagctttc

SEQ ID NO: 17326 - DNA, 71 bp, Homo sapiens
ttatagtatatatatgtatgtatgtatgtgtgtgtatacatatatatatacatatatatgtatatatataa

SEQ ID NO: 17327 - DNA, 85 bp, Homo sapiens
tatgtcctcactctgtctctgtttcacctgtgtcctaaacttcttataaggacacaagtgatattggattagggctcaccacata

SEQ ID NO: 17328 - DNA, 98 bp, Homo sapiens
aggcagggtctcactctgtcacccaggctggagtgcaatgatgaaagctcactgcatcatctgcatccccggctcaagtgatcctcctacctgtgcct

SEQ ID NO: 17329 - DNA, 149 bp, Homo sapiens
gcacacacatgcacatacacacacacatacacacacacatttgagtgtgtatatttaactatgtatgtgtgtatatatatatgtgtgtgtgtatatatgtatgtatgtgtgtgtatatatatgagtataggatacataatacattttta

SEQ ID NO: 17330 - DNA, 95 bp, Homo sapiens; identical to SEQ ID NO: 68

SEQ ID NO: 17331 - DNA, 93 bp, Homo sapiens; identical to SEQ ID NO: 69

SEQ ID NO: 17332 - DNA, 116 bp, Homo sapiens
atcatggtgaagaaaggagctgtgagattggcctaatttagtctgagttctatttctgcctgtcactcactgtctgatgttgggcaaatcacttaaccttctgagtcttggtttcc

SEQ ID NO: 17333 - DNA, 75 bp, Homo sapiens
ctctagagagagctctgagagcacactagaggggtgcacaatcacatctgtaggggagctcaggactttctggag

SEQ ID NO: 17334 - DNA, 119 bp, Homo sapiens
tgaaggtcaaagatgccttccttctgcttataggtccctcccagatggattgtaaacaagtgtgcattacagccctaactgcactgggaaagaagagaggcattttggtacagccttta

SEQ ID NO: 17335 - DNA, 118 bp, Homo sapiens
ctctcacagaagtctagcctaattctggggccataagaggcattcatgcaaatgtattgaatttaaatcttattatattgatggtggtctcagttcaaggtgagaggctatgtgacag

SEQ ID NO: 17336 - DNA, 104 bp, Homo sapiens
ggctggcgccggccgctgagcaacacgctgccagtctgtgtgcctgtccctgtcgcgtcccagtctgtgtctgagtgtctgtttagctggtcgctgcttttgct

SEQ ID NO: 17337 - DNA, 112 bp, Homo sapiens
tctggcatacatatatagtatatatatatagtgtgtgtatatatatataaagtatacatatatatgtatatatataaagtcagatatatataaagtatatataaaagtcaga

SEQ ID NO: 17338 - DNA, 113 bp, Homo sapiens
ttatagagtaaaaaatgttaaagcaacctaaggttattttgttattgaataaacaaaagtatttgtttataaatgtagtgtagcctaagtgcaaagggtttataaatctgtag

SEQ ID NO: 17339 - DNA, 74 bp, Homo sapiens
gggattttactactacataagccaactttgggtctcactctgtcgcccaggctggagtgcagtggtgcgatctc

SEQ ID NO: 17340 - DNA, 77 bp, Homo sapiens
ttgtgtctctctttcacacaatctacatcccatggtgcaggaaccatgtctgtgtcattaatttgtgtctgacacaa

SEQ ID NO: 17341 - DNA, 66 bp, Homo sapiens
gagggttgttgtgagaaataagtgagatgattcatgtcacttagctcttagcacagagactggctc

SEQ ID NO: 17342 - DNA, 113 bp, Homo sapiens
gacatgaactccagtgagactaaaatctgaaaatgcatatatgtatgtataaagacatacatatttatatgtataatcatatatttctgctctagctttccctaattaatgtc

SEQ ID NO: 17343 - DNA, 95 bp, Homo sapiens
gaaagctagagcagaaatatatgattatacatataaatatgtatgtctttatacatacatatatgcattttcagattttagtctcactggagttc

SEQ ID NO: 17344 - DNA, 99 bp, Homo sapiens
gtgtatgtgtgtatgtgtgtaggggggctgtcagaaggtatattgcttccatttgccttgtgatacacacacacacacgcacacacacacgtacacaca

SEQ ID NO: 17345 - DNA, 70 bp, Homo sapiens
ttttttggagctggagtctcactctgtcacccaggctggagtacagtggtgtgatctcggctcactgaaa

SEQ ID NO: 17346 - DNA, 117 bp, Homo sapiens
actgtagtcctaaagtcattgttatcacagaggaagagaattgttctttttttttttttttttttttttgagacagggtctctctctatcgtccaggctggagggcagtggcacagt

SEQ ID NO: 17347 - DNA, 95 bp, Homo sapiens; identical to SEQ ID NO: 68

SEQ ID NO: 17348 - DNA, 93 bp, Homo sapiens; identical to SEQ ID NO: 69

SEQ ID NO: 17349 - DNA, 95 bp, Homo sapiens
ctgacttgctatctttcattcaatctttgtttttatgttccccctcaccccgctataaataccctggtatcctggactgtgggatagcaggttag

SEQ ID NO: 17350 - DNA, 95 bp, Homo sapiens; identical to SEQ ID NO: 68

SEQ ID NO: 17351 - DNA, 93 bp, Homo sapiens; identical to SEQ ID NO: 69

SEQ ID NO: 17352 - DNA, 113 bp, Homo sapiens
ttaagctgattggggccatgattgcctgtattgccatgtattgcctgatgttctcattgtttaaatatatataggaagctggaaatcaggacttttatgcaaaaatctcttaa

SEQ ID NO: 17353 - DNA, 74 bp, Homo sapiens
ttgcctggggttagcagtccatggtcagaaatgctcctggtaccatattcctaagactgtcactgactctgcag

SEQ ID NO: 17354 - DNA, 63 bp, Homo sapiens
ctgctcaggagtgcccgtgtcgggggtgaggttgctgtcacccactctcagtctccccagtag

SEQ ID NO: 17355 - DNA, 115 bp, Homo sapiens
tacaaaaattagctgggcatggtagtgcacacctgtaatccctggtacttgggaggctgaggtaggaggatcacttgagaccaggaggtggaggctacagtgagctttgattgta

SEQ ID NO: 17356 - DNA, 83 bp, Homo sapiens
gtgaccttgcataaaggcgtgtttctgcttgtgcacatgtgtgtatgtgcgcatcacacacactgtctccctagcttcttcat

SEQ ID NO: 17357 - DNA, 160 bp, Homo sapiens
actaagtaactctagtgatagcagtatatatatatatactgtatatatatacagtatatatatatatactgctatcactagagttacttagtcctcagaagagtatatatatatatatatatatatatatatatacactgctatcactagagttacttta

SEQ ID NO: 17358 - DNA, 79 bp, Homo sapiens
tctatatccttggcacctagagcaattctttttttttttttttcttgagaaggagtcttgctctgtctcccaggctgga

SEQ ID NO: 17359 - DNA, 71 bp, Homo sapiens
gtttagcaaaggctttagaatctttcagacctagggatgaatcccagttctgtcactcagcctctctgagc

SEQ ID NO: 17360 - DNA, 113 bp, Homo sapiens
atcatactccaagcagtggtggggggacagggggaagacagatatcagagccacctttgaaagatgggaaaaaaagacttgtctctcttcatctggtactgcttcaagttgat

SEQ ID NO: 17361 - DNA, 86 bp, Homo sapiens
aggggaactggctaatttgttttgtggttaaaggactaagtaaattttgttttattataccgcaagaaattagtcctggtatttct

SEQ ID NO: 17362 - DNA, 95 bp, Homo sapiens; identical to SEQ ID NO: 68

SEQ ID NO: 17363 - DNA, 93 bp, Homo sapiens; identical to SEQ ID NO: 69

SEQ ID NO: 17364 - DNA, 73 bp, Homo sapiens
tagaaagagatgagagctcatctccactgtcgtgggtacaggacagggaggtatgcttctttttttttttttg

SEQ ID NO: 17365 - DNA, 97 bp, Homo sapiens
caagcactgtaagaagggaatctgagctaaacgaagttggagaatgcttccctaggacatgagactgagctgagatccaaggttggacaggggcttg

SEQ ID NO: 17366 - DNA, 105 bp, Homo sapiens
gcattcagccattctttatctcttacacgcacgctctcacgctctctttatatatgagagagagtgtagggtcaatctagcagtggtaatgaattccttcagtgt

SEQ ID NO: 17367 - DNA, 70 bp, Homo sapiens
acaattctttggttatgtagctttcttgggcatcccgcaagaacaaagcctggctgaatcaaggaagagt

SEQ ID NO: 17368 - DNA, 79 bp, Homo sapiens
accatcactgtcactgtctgtaagatcactaggagtcatttccttggtggcactttaaggcactgtgaaattatctggt

SEQ ID NO: 17369 - DNA, 100 bp, Homo sapiens
attgaaaaacatatgtttgtgtgtgtataggtataaatgtataaatatatgcatatgtatgtatacatttatacctattcacacacacaaactttttaat

SEQ ID NO: 17370 - DNA, 103 bp, Homo sapiens
tatacacacacaaacatatgtttttcaatatcatatatatgtattatatatatgaatatcacatatatatgtgtgtgtatatatatatgtgatatttgaaaac

SEQ ID NO: 17371 - DNA, 118 bp, Homo sapiens
agcctaaaattggaagctaaattgtgtgagaaagacaagtacttcagagaagatagtgtggagtcgcaaaataagtttcatgagagctcatacagaaaacagcctaaaactagaagct

SEQ ID NO: 17372 - DNA, 105 bp, Homo sapiens
ccatgtggaactgtgagtctgttaaacctctttttctttataaattacccagtcttgggtatgtctttattagcagtgtgagaatagactaataaagccaattgg

SEQ ID NO: 17373 - DNA, 74 bp, Homo sapiens
gagaacacagttcttgctttccaccctgactctcacaggctgtgtgcaaactgctccggaacatgtgtgtgctc

SEQ ID NO: 17374 - DNA, 89 bp, Homo sapiens
tacaacagcctactatttcaggacaagcccatggagccagcagcttgctggctgcccacccactgtgggtctgagaggtggtgacagtg

SEQ ID NO: 17375 - DNA, 125 bp, Homo sapiens
ttggattccccagagcatggaagtctgatcccaggttgaacatatttcttctgaaaatgagcatcttggttctatagattcttatcttgctcacaggacttgctccaaaactgaattttcagaag

SEQ ID NO: 17376 - DNA, 81 bp, Homo sapiens
ttgagtttctttatgtatgtatgtatgcatgcatgtatgtagcatatatgcatgtttatatgtatttattcaaggcagtca

SEQ ID NO: 17377 - DNA, 95 bp, Homo sapiens; identical to SEQ ID NO: 580

SEQ ID NO: 17378 - DNA, 93 bp, Homo sapiens; identical to SEQ ID NO: 69

SEQ ID NO: 17379 - DNA, 149 bp, Homo sapiens
gtgtgtatatatatacatatatatagtgttgtgtttatatatacgtgtgtatatatatacacatatatagtgttgtgtatatatatacaagtgtatatatatgtatgtgtgtgtgtgtgtgtgtgtgtgtatatatatatatatatata

SEQ ID NO: 17380 - DNA, 62 bp, Homo sapiens
atgtgcacgtgtgtgtgtgcgtgtatgtatatatatatgtacagtatatatacagtgtatat

SEQ ID NO: 17381 - DNA, 79 bp, Homo sapiens
ctaggttactctgtgtatgtgtgtgtgtgcatgcgggggttgtgtgtatcacagagagagacagagagagaagacagag

SEQ ID NO: 17382 - DNA, 107 bp, Homo sapiens
tgatgtcattttagaacagcatttgtttgggagtcagaagacacggggcattatttgtctttatctctccttggagatgaatttaaatgtcacagtgtctctatctg

SEQ ID NO: 17383 - DNA, 98 bp, Homo sapiens
aggaatcggaacatgttcatgagggaaaaaaagtctttactaattcagtgctgattttttattttttacttcactgagtattatgtatctgtattttt

SEQ ID NO: 17384 - DNA, 82 bp, Homo sapiens
agtacaattgctgggttttatggtagttgcatgtttagttttttaacaaaatgtcaaactattttaccagagtagctgtact

SEQ ID NO: 17385 - DNA, 103 bp, Homo sapiens
ttggcttgtctttcctactcaaaacatccctgaacaaaagctttttttttttttgactagaatttactgaagctttgtggataatgaaaggaaggtgcactaa

SEQ ID NO: 17386 - DNA, 62 bp, Homo sapiens
gtatggcatggtggctgtgatccataccacctgcaggagaggacagtgtcaccaggctgcac

SEQ ID NO: 17387 - DNA, 87 bp, Homo sapiens
acttgttctatttatgactaagaaatggctgttaaaatctccaagtctaattgggatttgtctatttctttttcagttttatcaagt

SEQ ID NO: 17388 - DNA, 65 bp, Homo sapiens
atatacttatatacatgtgtatatatatgtatacatgtgtgtatatgcatgtatatatgtatata

SEQ ID NO: 17389 - DNA, 98 bp, Homo sapiens
gctatatgtctaaagaaatatacatatatgtgtatatgtggatttacatatgtaaatatatatatgtgtatgtttgtgtacttgttggaagtaatggc

SEQ ID NO: 17390 - DNA, 86 bp, Homo sapiens
ctctctatatatatatatatgtatgtgtgtgtgtgtgtgtgtgtgtatatatatatatatactctgagtatgtgtatacatatata

SEQ ID NO: 17391 - DNA, 94 bp, Homo sapiens
gctgtgtgtatatatatatgtgtgtgtatgtgtatatatatatgtaaaccatccatatatgtgtgagtatatatatgtgtgtgtgtgtgtatgt

SEQ ID NO: 17392 - DNA, 95 bp, Homo sapiens
caattgactatcatttgactttgcttaaattgacttgaaggtataaatgtgtatatttatggaaatataaagcagagcaattgaaaattcaagtg

SEQ ID NO: 17393 - DNA, 105 bp, Homo sapiens
gctgaggagaacagtgtgtattctgcagccattgaatgaaatgtgtaaatatttattagttttatcggttctatagtgtagattaaatacaatatttcttcttgt

SEQ ID NO: 17394 - DNA, 95 bp, Homo sapiens; identical to SEQ ID NO: 68

SEQ ID NO: 17395 - DNA, 93 bp, Homo sapiens; identical to SEQ ID NO: 69

SEQ ID NO: 17396 - DNA, 65 bp, Homo sapiens
cctctctgaccctcagtctcttcatctataggatggaggttggactcggaggttggactcaaagg

SEQ ID NO: 17397 - DNA, 76 bp, Homo sapiens
gggtggcaaagcagagttatcacagtccagataagagcctcctggcccctttctgtgttagctggtctttgtcctc

SEQ ID NO: 17398 - DNA, 104 bp, Homo sapiens
atatcctttaattgtactgcttgttatctcactctgtctctctggtccatctgtgaagaccactgagtgattttgaggaaattggcacataactgaaaggatgt

SEQ ID NO: 17399 - DNA, 115 bp, Homo sapiens
cggaagttaaacagtggcaggatgtcatggtttgaagggccatagaccttgttcctgacctgattcaccaacaccaactggctaaacgacctctctccagtcattttaacaatcg

SEQ ID NO: 17400 - DNA, 95 bp, Homo sapiens; identical to SEQ ID NO: 580

SEQ ID NO: 17401 - DNA, 93 bp, Homo sapiens; identical to SEQ ID NO: 69

SEQ ID NO: 17402 - DNA, 79 bp, Homo sapiens
tgcccggctgactttttgtatttttaatagagatgggtttttaaaaacttttttttattatactttaagttctagggta

SEQ ID NO: 17403 - DNA, 118 bp, Homo sapiens
cctgtctgtgaaatggtgttttttttttttttgttggtgtgtgttttttttttttaacttgggaccgccaagttgtaaagatgtatgtttttacctgacaggtataccacaggtagat

SEQ ID NO: 17404 - DNA, 58 bp, Homo sapiens; identical to SEQ ID NO: 2626

SEQ ID NO: 17405 - DNA, 84 bp, Homo sapiens
atttggtcaacatagtggatgtgaaatgatatcatttatcattttgtgatttttaaatttcatttccctaatggttaatcaaat

SEQ ID NO: 17406 - DNA, 80 bp, Homo sapiens
gctcaggacagtgggagacacagtggtctgatagtcagaccacccaacctctggtctcatcactgccactgagtctctgg

SEQ ID NO: 17407 - DNA, 58 bp, Homo sapiens; identical to SEQ ID NO: 852

SEQ ID NO: 17408 - DNA, 71 bp, Homo sapiens
gtttcactttctctgccacactgggagattcagggaccctgagcttcctctgtggaacctctgagagctgc

SEQ ID NO: 17409 - DNA, 81 bp, Homo sapiens
gtgacactctatcagtctcttttcctctctggacttctgttttcccatctgtaaaagagaggagatgatggctcttgttcc

SEQ ID NO: 17410 - DNA, 83 bp, Homo sapiens
ctacagggttttcactgcctccctcttacacacagagggttcccgtacaggcgtcttggaaggaggtgtccagacccatgtgg

SEQ ID NO: 17411 - DNA, 82 bp, Homo sapiens
agaggctgtgaacttgaaagtcatttgtgagttttgatctccagtttgcttgaaaatactcactttttctctctcagtctct

SEQ ID NO: 17412 - DNA, 112 bp, Homo sapiens
agctaagaaaacccttaagatcaccccagtaaggaaagctgagaccagagagggtccacagatggctcaaggtcacacagcaaactgggaatgggccttgggtttcctggct

SEQ ID NO: 17413 - DNA, 116 bp, Homo sapiens
ccagagcggagcagcgcagcgccctgtctcccagcctgaggtgcagtgctgcatctctggtcagttgggagtctgagatgaagcactgtagctcaggaagagagaagttgttctgc

SEQ ID NO: 17414 - DNA, 156 bp, Homo sapiens
agctggtccttagggacacggcggccttggcgctgaaggccactcgctcccaccttgtcctcacggtccagttttcccaggaatcccttagatgctaagatggggattcctggaaatactgttcttgaggtcatggtttcacagctggatttgcct

SEQ ID NO: 17415 - DNA, 76 bp, Homo sapiens
gatcactctgtctgtgactggccaggcctaggaaaatgcttgtgcctggagtttcaagggaccaagcagggtgttc

SEQ ID NO: 17416 - DNA, 89 bp, Homo sapiens
caggtgtcaagagagcacaaccagctcatgttgggtgcaaagctttgttaagaactttgaacttggcagggtgcggtggctcatgcctg

SEQ ID NO: 17417 - DNA, 86 bp, Homo sapiens
accctttggttcagcaactccatgtccaggaatctcttgaaagaaattaatcctctctatggatgaggctctagacacagaggtgt

SEQ ID NO: 17418 - DNA, 66 bp, Homo sapiens
gccttgtgccttgggctcagtccccacgggggtctttgcctctgactgtccctctgcctgcaatgc

SEQ ID NO: 17419 - DNA, 115 bp, Homo sapiens
tgtccctaccctgggacaaaggagaagatctataattattggttggaaggaattttatttttatttatttattttttgagccggagtctcactctgtctcccaggctggagagca

SEQ ID NO: 17420 - DNA, 80 bp, Homo sapiens
tcagcctgggcaacatagtaagacctttatttgtctctacaaaaaatttaaaaagagtctcactctgtcacccaggttgg

SEQ ID NO: 17421 - DNA, 117 bp, Homo sapiens
ggcttcagtgtctttttctgtgcccttctcagtgttcttgctcttctttcagagaagactctgacctcggaggagctgagccagctgcaggagctgctgtgcaatggctattgggcc

SEQ ID NO: 17422 - DNA, 89 bp, Homo sapiens
cccaatgtttgttgattctctgattgtgtttgttattgtagctgaaagaattctaagaccaatttcagtctgagagtctagacactggg

SEQ ID NO: 17423 - DNA, 67 bp, Homo sapiens
ctctgcagtgctgggatgttcaggctggagggcctcaccttctctgtgtctcagtatttagcagcag

SEQ ID NO: 17424 - DNA, 119 bp, Homo sapiens
acaccttcctcctgggtctggagagcccctggtttgccctttgtggccaggctcaaaggggagagaagtttgacaggacctgggcaggggaaggggtggactggagcctggccaggcct

SEQ ID NO: 17425 - DNA, 110 bp, Homo sapiens
ccaatgattgggcaagccatcttgaaggtttctgagtttttcttttttcttttttttgagacggagtctcactcagcctcccaggctggagtgcagtggcacaatcttgg

SEQ ID NO: 17426 - DNA, 73 bp, Homo sapiens
gtgtgtgtgtccatgtgcatgtgtgtgctcccgtgagctgtgtgaagacgcatgtgtgtgtgtgagcacgcat

SEQ ID NO: 17427 - DNA, 115 bp, Homo sapiens
aaactataatagtgtctggaatgtaggagacatttgataatatttctgattttattttaaaagtacagaactttttatggggtcattttgctgggtcccggttttattataattt

SEQ ID NO: 17428 - DNA, 56 bp, Homo sapiens; identical to SEQ ID NO: 324

SEQ ID NO: 17429 - DNA, 99 bp, Homo sapiens
ttgtgtgaagtttgagatccattgtactttttttttttgagacggagtctctctgtcactcaggctggagtgcagtggcacaatcttgtctcactgcaa

SEQ ID NO: 17430 - DNA, 102 bp, Homo sapiens
ctgcccatagggcaaatgtggcctgccagtttgtgacctctgttttcttaaaagggacagagaacacactgtggagctcagtagaggccaacttccctgcag

SEQ ID NO: 17431 - DNA, 96 bp, Homo sapiens
cctgcctgggtgacagagagaggtcccgtctctaaaaataaataattttttttctttttgttttgagatggagtcttactctgtcacccaggcagg

SEQ ID NO: 17432 - DNA, 56 bp, Homo sapiens
gtgcgagtgcatatgtgcacgtgtgtgcatgcgtgtgtgtgcatgtgcatgtgtat

SEQ ID NO: 17433 - DNA, 81 bp, Homo sapiens
tggggcaccgcgctgcgggcgggtactgcggagtcaggcaccaagggtccctgcctccctcactgctgagcgcgggctgca

SEQ ID NO: 17434 - DNA, 74 bp, Homo sapiens
acagaaacacgccatcccagcatctgtcctccagcttggagcttcttctgctgtgtgtctgtgtgcgtgtctgt

SEQ ID NO: 17435 - DNA, 116 bp, Homo sapiens
cgctctctgagcctcagttttcccttctatacagcaagattctgtacatcttttttttttttttttttttgagacagagtctcgctctgtcacccaggttggagcgcagtggggtg

SEQ ID NO: 17436 - DNA, 116 bp, Homo sapiens
ttaagttcattagagttactcttctagtcagagtcctggccacattttatgtaatattatttatatgtttgttaaggaggcgtctggtcctggagtacagtgacccttagatgact

SEQ ID NO: 17437 - DNA, 108 bp, Homo sapiens
gctatttattgaatatctcctacatgttctaggcactaaggaagacaaattatctttatttattgtgcttacatctactgggaaaatattcacaaaaaataagtaagc

SEQ ID NO: 17438 - DNA, 94 bp, Homo sapiens
ggggactgttgggaaggtatgattggttttgaaatgttaggatgtgagatttggaggggccaggggtggaattatatggtttggctgtgtcccc

SEQ ID NO: 17439 - DNA, 88 bp, Homo sapiens
gttcatggacacttccactctcactgtctcatctgtccctctcagcagccctatagaggaggcagagaagaaacagttgtccctgggc

SEQ ID NO: 17440 - DNA, 72 bp, Homo sapiens
gaggctcagagagtcagtgagttagggggagacgagggctagacccagtctcaggactttcttgattgcctc

SEQ ID NO: 17441 - DNA, 113 bp, Homo sapiens
tgggtgtgtgtgggtgtgtgtgtgggtgtgagtgtgcgtgtttttttttttttttttttttgagatggagtctcactctgtcccccaggctggagtgcagtggcatgatctcg

SEQ ID NO: 17442 - DNA, 110 bp, Homo sapiens
ttttgtcgaacattttcatagcctcttcatagtttgacttgtgtttttgtttgtttgttttttgagacagagtctcactctattgcacaggctggagtgcagtggcgaga

SEQ ID NO: 17443 - DNA, 58 bp, Homo sapiens; identical to SEQ ID NO: 7346

SEQ ID NO: 17444 - DNA, 78 bp, Homo sapiens
ccgtctctcactgtctcttcccccaaaatccagactgcatgtgaagaaaactggggcccagagatctcaagagactgg

SEQ ID NO: 17445 - DNA, 107 bp, Homo sapiens
tgtattatttatttatattatttatattattttttatttattaaaatgctaggcattttagaagacttctaaaaaatttgtacattgatacaaattttgatagtaca

SEQ ID NO: 17446 - DNA, 102 bp, Homo sapiens
ggcaaaatgattagcacattgccaggcacaaagtaaacaatgattattattattttgcttcatgatcccttactatgtgtatgcagaatatgctaatgtgct

SEQ ID NO: 17447 - DNA, 88 bp, Homo sapiens
gttgttttttgagacggagtctcactctgtcacccaggctggagtgcagtggtgcgatcttgactcactgcaacttctgcctcccggg

SEQ ID NO: 17448 - DNA, 181 bp, Homo sapiens
gcatgtgggatggatggagcaggtgtccacttagtggcatgtagagtggatggagcagatgtctgcttactagcatgtgggatgaatggagccgatgtccacttactggcatgtagagtggatggagcagatgtccacttattagcatgtgggatggatggagccgatgtccacttactag

SEQ ID NO: 17449 - DNA, 56 bp, Homo sapiens; identical to SEQ ID NO: 324

SEQ ID NO: 17450 - DNA, 85 bp, Homo sapiens
cacttttcctggccctgtctgtgagtctcatctcccttcaacaggacgatgctcagaagacacggctgcttttggtcttcaagtg

SEQ ID NO: 17451 - DNA, 134 bp, Homo sapiens
ggaggggcatcaggggtgaggagagttgcaatttttatttatttatttattgagacagagtctcactctgtcgcccaggctggagggcagtggcatgatctcagctcactgcaacctctgcctcctgggttcag

SEQ ID NO: 17452 - DNA, 66 bp, Homo sapiens
agtctgtctttctctgtgggtctcaggtgtaagatgagacaaatgggcagggtcagggatagaact

SEQ ID NO: 17453 - DNA, 80 bp, Homo sapiens
cttgtggtctctgtgtgactgtgtgacctggggcaacactacctgtccagggcctcagtttatccctcggtgaaaccaag

SEQ ID NO: 17454 - DNA, 109 bp, Homo sapiens
ggggaccccaactgtggcagaaacaaccgagtcaggactcagggagcaagagttctagtcctgtctctgcctctgactgactgtgtgaccttaagcagtatatttccct

SEQ ID NO: 17455 - DNA, 76 bp, Homo sapiens
gacataccagtggtggggtagggttgcacgggttctcaccctagccctgccacccagtcactcactcactgctgtt

SEQ ID NO: 17456 - DNA, 77 bp, Homo sapiens
ctggttccttcttctgtaaagtgggagaagttagactaaaagacctctaggtctccctctctgaagctgtgattcag

SEQ ID NO: 17457 - DNA, 115 bp, Homo sapiens
agatgactccagattatcaagtaagaaagttaagacagtatattaaaacatgtttctatatatatagaaaaattgtttctgtggttttactactttcataatttatctgtgttct

SEQ ID NO: 17458 - DNA, 60 bp, Homo sapiens
ttgaggtgtgatctcactctgtcacccggtctggggtgtagtggtgcaattacagctcaa

SEQ ID NO: 17459 - DNA, 58 bp, Homo sapiens
tgagatggagtctcactctgtcactcaggctggagtgcaatggtgtgatctcggctca

SEQ ID NO: 17460 - DNA, 64 bp, Homo sapiens
tatatagatatagatatagatggatatctatctatagatatctatctgtatctatatctatata

SEQ ID NO: 17461 - DNA, 95 bp, Homo sapiens; identical to SEQ ID NO: 68

SEQ ID NO: 17462 - DNA, 93 bp, Homo sapiens; identical to SEQ ID NO: 69

SEQ ID NO: 17463 - DNA, 96 bp, Homo sapiens
ccattctaactggcatgagatggtatctcattgtggttctgatatgcatttatctaatgaccagtaatgatgaactttttttcataggtttgttgg

SEQ ID NO: 17464 - DNA, 95 bp, Homo sapiens; identical to SEQ ID NO: 68

SEQ ID NO: 17465 - DNA, 93 bp, Homo sapiens; identical to SEQ ID NO: 69

SEQ ID NO: 17466 - DNA, 97 bp, Homo sapiens
tgcacaagtgtttaatctctgctagatctcaatttcttcatctgtaaagtgggaatgatagtctctgtgagaaaaaaaggcggtgatacatttgtca

SEQ ID NO: 17467 - DNA, 109 bp, Homo sapiens
gtctgctgtggatgccagcctggctcaatacacacagccagagagagtcacacagagtgacttgtgctggggttgggtaggggcaggaaggtaatcataatatcaggac

SEQ ID NO: 17468 - DNA, 95 bp, Homo sapiens; identical to SEQ ID NO: 580

SEQ ID NO: 17469 - DNA, 93 bp, Homo sapiens; identical to SEQ ID NO: 69

SEQ ID NO: 17470 - DNA, 106 bp, Homo sapiens
catggtcggaagctgctgaggttcctggagtactcgtcagaagccaatgaaaaaaacaccctagactctgactctgactctgactctgactctgactctgactctg

SEQ ID NO: 17471 - DNA, 95 bp, Homo sapiens
gtagtgagtggctactgggttagacagtgcacacacacagtctctcagaaggtctctggcaggattgagcgtcattgttgtcccccacttattac

SEQ ID NO: 17472 - DNA, 97 bp, Homo sapiens
tacatgtaatggatagtaggtaggctgttgctcagccacaaggctcctctgtgtgtctttgtgtttatggtcatgctctctctccatgctctgtgta

SEQ ID NO: 17473 - DNA, 95 bp, Homo sapiens; identical to SEQ ID NO: 68

SEQ ID NO: 17474 - DNA, 93 bp, Homo sapiens; identical to SEQ ID NO: 69

SEQ ID NO: 17475 - DNA, 119 bp, Homo sapiens
tgattggaagatttatttacattgaaacacacccagctaatttttgtatttgtagtacaaatttttgtatttttagtattcactatgttggccaggctggtctcaaacttctgacctca

SEQ ID NO: 17476 - DNA, 175 bp, Homo sapiens
atacatatatgcatatatgtatacatatacacatgtatatgtatatgtatatacgtatatatgtatatgtatttacgtatatatgtataatatattatacatatatataatatattatacatatatatgtataatatatacatatatatgtataatatatacatatatatgtata

SEQ ID NO: 17477 - DNA, 116 bp, Homo sapiens
tatatgtattatatataacacatatatacgtatataatatattatatatattatatatgtataatatatataacacatatattatatacgtatattatattgtatatgtacatgta

SEQ ID NO: 17478 - DNA, 95 bp, Homo sapiens; identical to SEQ ID NO: 580

SEQ ID NO: 17479 - DNA, 93 bp, Homo sapiens; identical to SEQ ID NO: 69

SEQ ID NO: 17480 - DNA, 82 bp, Homo sapiens
gtactataatattcttggaccacggttgactgagagtaaataaaactgcagaaaacaaaattgtgggtagggggactagtac

SEQ ID NO: 17481 - DNA, 104 bp, Homo sapiens
ggacgtacatcattggctctgagttctcaggcctttggtcatggacttagagttacattatttcttttagttattgggccttcagactcagaccaaattacacc

SEQ ID NO: 17482 - DNA, 95 bp, Homo sapiens; identical to SEQ ID NO: 68

SEQ ID NO: 17483 - DNA, 93 bp, Homo sapiens; identical to SEQ ID NO: 69

SEQ ID NO: 17484 - DNA, 108 bp, Homo sapiens
cctggtagttttcaaaatgtggaatacaaatgaataggaatattatgagctccaacctatatttttatagttttgaaatttcataagtaattctgaagagttattggg

SEQ ID NO: 17485 - DNA, 111 bp, Homo sapiens
tgctaaattctttacatatggtatttcatttaatcctcacaacagtctgtgagttgtgacagtttctgataatttacaactgaggaacttgaaacataaaagggttaagta

SEQ ID NO: 17486 - DNA, 123 bp, Homo sapiens
ggctgtctttcctcctgcatgtctgtgtcttcatgtggtggtctctgctctgtgtgtttgtctctcatctctcataaggacatcagtcttacgtggactaaggatcttacctgccagatagta

SEQ ID NO: 17487 - DNA, 95 bp, Homo sapiens; identical to SEQ ID NO: 68

SEQ ID NO: 17488 - DNA, 93 bp, Homo sapiens; identical to SEQ ID NO: 69

SEQ ID NO: 17489 - DNA, 100 bp, Homo sapiens
ggttaggtgttttaagtcacaggatgagataggaagttgtcacaagatacagatcataaatgccttgctgataaaacaagctgtggtaaagaagccagcc

SEQ ID NO: 17490 - DNA, 58 bp, Homo sapiens
actgtgtctcttattcactgtggtatcccaacccatagtacagtgtctaagacatggt

SEQ ID NO: 17491 - DNA, 116 bp, Homo sapiens
ggtaatttatatggaaagagttttagttcatagttctggtggctagaaaggtcaaaattgagcatctgcatctggtgagggcctcagcctacttcagctcttggtagacagttgct

SEQ ID NO: 17492 - DNA, 110 bp, Homo sapiens
gcccctactttgtttgttttgtaaggtcctcatggtgagaggactgtctgagaaacatgtctgtctctgtctctcacagctcctgttcccacaccttatgtatagttggc

SEQ ID NO: 17493 - DNA, 100 bp, Homo sapiens
gaccttgggcaagtgaagaccactctgagactcagtctttccagtgatgccatgggaagtttgggcataatttctagggtgacttctaacttcaagagtc

SEQ ID NO: 17494 - DNA, 80 bp, Homo sapiens
ttatgtatcacgggacccatgtacttgaagaaaagtaaaatcttattttttaatgatacatgtgtcacatctgatcatga

SEQ ID NO: 17495 - DNA, 89 bp, Homo sapiens
tcaacagactttgttggccaatgctaagtgaactgcacatttgatcctacagcaaaggtagatttcacaggcaccattgaagtacttga

SEQ ID NO: 17496 - DNA, 113 bp, Homo sapiens
ggattatcttggctatacaggctcttttctggttccatatgaaatttaaagtagtttatttctaattctgtaaagaaagtcaatggtagcttgatggggatagcactgaatct

SEQ ID NO: 17497 - DNA, 86 bp, Homo sapiens
ttatatgtatgtgtatttatatgtatgtgtagggatttttcttagggaaggatcaaatacacaactgtatttatatgtatgtgtag

SEQ ID NO: 17498 - DNA, 98 bp, Homo sapiens
ccagctctaggacataggtattgttatccccactttgcagacagaagacactgaggtttagagaggttgataatgattaaaaactatccaaaacctgg

SEQ ID NO: 17499 - DNA, 109 bp, Homo sapiens
actctctgtcccatgactctatttggctatgtttgtatcatttaactagtatttgaaatcattatatgtatttgtttcccaggacgtaaaccccaagggtacagggagt

SEQ ID NO: 17500 - DNA, 101 bp, Homo sapiens
cccatcaatcaacgagtggataaagaaactgtgattatatatatatatatatatatatatatcttttgtgatatgtttatatcattcttttaaagaatggg

SEQ ID NO: 17501 - DNA, 119 bp, Homo sapiens
gagaggattttccagaaactgaagctgacccatgtcccaagactatttcaaacatccatgacatatcacagacattaaggactcaagctctgtcgtcagactggtagaggtcatctctc

SEQ ID NO: 17502 - DNA, 95 bp, Homo sapiens; identical to SEQ ID NO: 68

SEQ ID NO: 17503 - DNA, 93 bp, Homo sapiens; identical to SEQ ID NO: 69

SEQ ID NO: 17504 - DNA, 98 bp, Homo sapiens
ctgcatcctgtctggatgggttcttggtctgtgtctctgtttcttagtcgctgttcctggggagctgggtctggcctgctcctgtccctcagccccag

SEQ ID NO: 17505 - DNA, 139 bp, Homo sapiens
tatatatatgtgtgtgtgtgtatatatatatgtatatgtgtgtatatatatgtgtgtatatatgtatatatatgtgtgtatatatacatacacatatgtatatatatgtgtgtatatatacatacacatatgtatatat

SEQ ID NO: 17506 - DNA, 92 bp, Homo sapiens
ggaaagacatgggatgtggaaagagtcgtccaggctgtgaggttacctactaaatagccttgtgagtcactctctcacacccaagttttctc

SEQ ID NO: 17507 - DNA, 117 bp, Homo sapiens
tagtaaaatggagtggagaagggaagtagatcatctttttattttatttattattattattattattattattattattattatttgagatggagtctcgctctgtcacccaggctg

SEQ ID NO: 17508 - DNA, 59 bp, Homo sapiens
ttggctagggctggtctaaatgctccctacatgggtgagtgttgactgagttcagccga

SEQ ID NO: 17509 - DNA, 106 bp, Homo sapiens
ttttgtatgttgattttgtatcctgaaactttactgaatttgtttatcagttcaaatagtattttggtggagtctttaggtttttccaaatataagatcatatcat

SEQ ID NO: 17510 - DNA, 101 bp, Homo sapiens
cagggagatgctgaatttccttgcttatagtagtgttctagtgctgtggacaataaagtgtgtgtgcatgtgcatgtgggtggggggaggtatacactgtc

SEQ ID NO: 17511 - DNA, 117 bp, Homo sapiens
gagcacctatacctctgagttggctgtgctgtgagaaactcatctccctttcttttcttttcttttttttttttttttgagatgaggtctcactctgccacccaggctggagtgctt

SEQ ID NO: 17512 - DNA, 62 bp, Homo sapiens
cacgtgtgtgtgtgtgtgtgtatgtgtaaatatatgcatatatatacatatatatgcatatg

SEQ ID NO: 17513 - DNA, 119 bp, Homo sapiens
gtgtaaatgagttagcaatggcacttccctgaatcattgcatcatccaaagactgcgaggtggcagctggcatctttggccactgctgtggatcaggcagcgtctgttgctctaggcac

SEQ ID NO: 17514 - DNA, 109 bp, Homo sapiens
agcggagagtgagtgagaagggtggggaaggaacacataatggaaagttttgaatttattttactttatttttttttctgagacaatatcttgttctgtcatccaagct

SEQ ID NO: 17515 - DNA, 77 bp, Homo sapiens
caccacttcctcagaggggaatctcagctgctgccccatgcaagcatcgcctctctctctgagtgaatccagtggtg

SEQ ID NO: 17516 - DNA, 140 bp, Homo sapiens
gaagcttagtttggctggatatgaaattctgggttgaaaatttttttctttaagaatgtagaatattggcccccactctcttctggcttgtagggtttctgcagacagacccactgttagtctgatgggcttccctttgt

SEQ ID NO: 17517 - DNA, 110 bp, Homo sapiens
tgcttaggattgtcttggctatacaggctcttttttggttccatatgaaatttaaagtagttttttctaattctgtgaagaaagtcagtggtagcttgatgggaatagca

SEQ ID NO: 17518 - DNA, 68 bp, Homo sapiens
ggtaacatgtggtgagaaatagcgtcctgagtgctagttcggactcagtctctgactggcgtgggacc

SEQ ID NO: 17519 - DNA, 140 bp, Homo sapiens
aggtctcaggtctcaggtctcagtctgtgtatgatgcaatagaaaaaacacaggcttggatctaggtcgagccttctttgccttctactagcagtgtgaactggaacaaagggctgaggttctctgaggtttagtttgtg

SEQ ID NO: 17520 - DNA, 74 bp, Homo sapiens
ggattactgagggcagctcagaagtgggagtggaaggctgagcatctccctcactctgtgcctctcagttttct

SEQ ID NO: 17521 - DNA, 106 bp, Homo sapiens
cacctggaatactctcccccttttgtttctttttttctttttttctaataaaagaatttaatctttttcaggaaatgattaagcattttggaagtaaatataggtg

SEQ ID NO: 17522 - DNA, 106 bp, Homo sapiens
cttttctttcttttcttcctattttttttctttattgtcactctcactctcactactgctttctaaagtctcagtagagaaagaggaggagggggaggaggaggag

SEQ ID NO: 17523 - DNA, 85 bp, Homo sapiens
atcccatttcctacaggacaagtctgtgtgtgtcagtctctgggtagacaggcatatgaagaggtgctgtggaagtgttggggat

SEQ ID NO: 17524 - DNA, 95 bp, Homo sapiens
tggaatcctagcactatgggaggctgaggtaggaggatcacttgaggccaggagtttgagaccaacctgagcaacatagtgagattccaactctc

SEQ ID NO: 17525 - DNA, 56 bp, Homo sapiens
gagactgagtctcacactctctcccattcgggagtgcagtggcgcgatctcggctc

SEQ ID NO: 17526 - DNA, 118 bp, Homo sapiens
ggtgactgagcgagactccatctcaaaaataaaaaataaaaagaaacgagaaaaaaactactatttttaatgatttttttcttttcttttttttgagacacagtctcgctctgttgcc

SEQ ID NO: 17527 - DNA, 77 bp, Homo sapiens
ccgccatggagctggggcagctggagcccaaggcagcaggcaggttgtgggtgcctctgttgtcaggctcaaggcgg

SEQ ID NO: 17528 - DNA, 58 bp, Homo sapiens
tgagacggagtctcactctgtcacccaggctggagtgcagaggcgtgatctcggttca

SEQ ID NO: 17529 - DNA, 95 bp, Homo sapiens; identical to SEQ ID NO: 68

SEQ ID NO: 17530 - DNA, 93 bp, Homo sapiens; identical to SEQ ID NO: 69

SEQ ID NO: 17531 - DNA, 84 bp, Homo sapiens
acagaataacaggttccagagtcactgcctgagttcaaattgcaactgccataggcaagttcccactctctctgtctcatctgt

SEQ ID NO: 17532 - DNA, 60 bp, Homo sapiens
gtgagacagagtctcactctgtcacccaggctggagtgtagtggtgtgatctcagctcac

SEQ ID NO: 17533 - DNA, 145 bp, Homo sapiens
ccaatctagacaacatagcgagatgctatctctacaaatatttttttctttttttttttgagatggagtctctctctgacacccaggctggagtgtggagtgcagtggcgtgatttcggctcccactgcagtttctgcctcctgg

SEQ ID NO: 17534 - DNA, 134 bp, Homo sapiens
cctgggcgacggagcaagactgtctcaaaaaaaaaaaaaaaaaaaagtttgttttgagacagagtctcgctctgtcacccaggctggagtgcagtggcgccatctcggctcactgcaacacctgcctcccgggt

SEQ ID NO: 17535 - DNA, 58 bp, Homo sapiens
tgagactgagtctcgctctgtcacccagcctggagtgcagtggcgcgatctcggctca

SEQ ID NO: 17536 - DNA, 92 bp, Homo sapiens
agcactgtaaacatttagtacttattggccttgggggtttttttgttttgtttttttggcccagttaggaaatgagaattagaatgcatgtt

SEQ ID NO: 17537 - DNA, 108 bp, Homo sapiens
atatctatatatatatgtgtgtgtatatacatgtatgtatgtgtatatatgtatatatatgtgtatatatgtatatatgtgcatatatgtgtgtatatatatatatat

SEQ ID NO: 17538 - DNA, 132 bp, Homo sapiens
cagcaacaccacagagagattcccatctctctttttttttttttttttttttgagatggagtctcactctgtgacctaggctgaagtacagtggcacgatctcggctcactgcaacctctgccttctgggtt

SEQ ID NO: 17539 - DNA, 71 bp, Homo sapiens
tggctggattgagggatgcccaaatggccagtgaagtactgttgctgggtgtgtctgtgagtgtgtggcca

SEQ ID NO: 17540 - DNA, 171 bp, Homo sapiens
atgtgtgtgtatgtatatacgggtatgcgtatatgcatatgtgtgtatatgtatatacatatgtgtatatgtatatgtatgtatatgtatatacatatatttgtatatgtatgtatatgtatatacatatgtgtgtatacatattttatatatatatatatatgcagatat

SEQ ID NO: 17541 - DNA, 80 bp, Homo sapiens
tatacatatatgtatatttatatacatatatgtgtgtgcgtatatacatatatgtgtatgtgtatatacatatatgtgta

SEQ ID NO: 17542 - DNA, 108 bp, Homo sapiens
tgggattttggaagagctacaactcatgtctcaagaaagggagggatgggtcccatctcatctcagtctctctttctcacggggcctctgtttttctctatctgctca

SEQ ID NO: 17543 - DNA, 95 bp, Homo sapiens; identical to SEQ ID NO: 68

SEQ ID NO: 17544 - DNA, 93 bp, Homo sapiens; identical to SEQ ID NO: 69

SEQ ID NO: 17545 - DNA, 87 bp, Homo sapiens
gagaatctaatgcttgatgatctgtcactgtctctcatcacccccggatgggactgtctggttgcaggaaaacaagcttagggtttc

SEQ ID NO: 17546 - DNA, 105 bp, Homo sapiens
ctggttatttctgcctgggccctttgtgatctctctcagagggtgaccgctcatcactcagatgacacagaggagatccacaccagcaacagtccaagtagccag

SEQ ID NO: 17547 - DNA, 115 bp, Homo sapiens
ttctgtgtttggccagtgtttaaggctgattttcacttgggcttagtgaacaatcaaagctgactgctttcttgggaatcagtggtggattctttagaggtcctaccttacaggg

SEQ ID NO: 17548 - DNA, 159 bp, Homo sapiens
atatatatatatatatatatatacacacacacgtatatatatacacgtatatatatgtatatatgtgtatacatatatacacactctcttgagccaaatatatatatatatgtatatatatgtatatgtgtgtgtgtgtgtgtgtgtgtgtgtgtgtgt

SEQ ID NO: 17549 - DNA, 73 bp, Homo sapiens
ctttaaaaatctcatctctctctctctgtatatataatcataagaatctcagagggagaggagaaagtgaaag

SEQ ID NO: 17550 - DNA, 98 bp, Homo sapiens
gcggaggggaaacatctcacagtgtaaatcttcggagattgcctcaggggaatactctgtcactctcaatgtcatctgtctcttccattcctctcttc

SEQ ID NO: 17551 - DNA, 98 bp, Homo sapiens
gggagagcataaatcttaatgagtctgttactgtctgccaattgctggtgatgagaccttgggcagataatttagccattcatagtctgttttcttcc

SEQ ID NO: 17552 - DNA, 99 bp, Homo sapiens
ttttccaaaacaggttatagtttaggatagaaaacaagtctgtacaagttaaaaaatacagaaatcatattaactatcttctctgactacagtggaaga

SEQ ID NO: 17553 - DNA, 95 bp, Homo sapiens
aggattattataaaatctttaggatgtgagaaaacacagaggtcacgtccaactccaatcctgcctctgttctcactacctgagtttctaatcct

SEQ ID NO: 17554 - DNA, 81 bp, Homo sapiens
gattaggcagagttcttcagagacaaagaaccaatacaggatatttacatatccttgtctctgtctgtatctctctctctc

SEQ ID NO: 17555 - DNA, 95 bp, Homo sapiens; identical to SEQ ID NO: 68

SEQ ID NO: 17556 - DNA, 93 bp, Homo sapiens; identical to SEQ ID NO: 69

SEQ ID NO: 17557 - DNA, 71 bp, Homo sapiens
gagatctggttgtttagagaggtgtgtggcatcttgccttcactctttctttctctcttgctccctctctc

SEQ ID NO: 17558 - DNA, 115 bp, Homo sapiens
atatagccaggtaaaaagagagtagatacacaaataagtgaatgtatgtatgtatgtatatatatatacacacacacacatacatgtgtgagaattttaaaaattatttctatat

SEQ ID NO: 17559 - DNA, 90 bp, Homo sapiens
gtgtgactatgcataggatgtcaaggataaaaatgaactttgtaatttagaaaatgcaaatatccactatgatatttgggattgtcacat

SEQ ID NO: 17560 - DNA, 65 bp, Homo sapiens
cgtgtatatatttacatgtacatttaaatatatctgtatattttacatgtatttatgtatacatg

SEQ ID NO: 17561 - DNA, 96 bp, Homo sapiens
agaatctaatgcccgatgatctgtcactgtctctcatcacccccagattggactgtatggttgcaggaaaacaagctcagggctcccactgattct

SEQ ID NO: 17562 - DNA, 114 bp, Homo sapiens
cctccagtggaagcactttcagtcaaccactaagcctatccttagtcaatggtatttttttttttccaaatatattattctagagactctggggctctgagaaagccaagaagg

SEQ ID NO: 17563 - DNA, 127 bp, Homo sapiens
gtacctggaaggagcagtaaggcatttgaggtgggcctctgttagagagtgtttctctctgggtcagtctttggtaaaaggagattaaggagaactgtgtaatccttgtgacccaagtgtgatccag

SEQ ID NO: 17564 - DNA, 110 bp, Homo sapiens
ggaagtacttaatttgtgtcaagagactctgggtgatgtgaatgtatacatttaaaataatatatatcattttaaatggttatctattggatacaaattgaaaaacttct

SEQ ID NO: 17565 - DNA, 106 bp, Homo sapiens
acataattggattccatggagcatccactgtctcactgtctctttttggctggtaagactaggaaggtgcaattgaggaactgattgtctagccaattcaccatgt

SEQ ID NO: 17566 - DNA, 67 bp, Homo sapiens
taaatatgtatacacacatgtacatatgtaaatatatattctgtatatgtatgtaaatatatattta

SEQ ID NO: 17567 - DNA, 77 bp, Homo sapiens
agagtctcactctgtcacccaggctggagtgcagtggcgctcactgcaacctcagccttccaggtgcaagagattct

SEQ ID NO: 17568 - DNA, 97 bp, Homo sapiens
cagctccacacacggctcggcctggacttgggagaccagttgcccctcagctgactgaactgtgtgtgctggttcctcttctggtttataactgtgc

SEQ ID NO: 17569 - DNA, 69 bp, Homo sapiens
atgaagctgctatagcacagctgggtggcccaggacaagttgctcagtttctctcagtctcagtttcgt

SEQ ID NO: 17570 - DNA, 82 bp, Homo sapiens
tatttatttttttgacacagggtctcactctgtcacccaagctggagtgcagtggtgcgatcttggctcactgcatggaata

SEQ ID NO: 17571 - DNA, 115 bp, Homo sapiens
gcattagcattcctcaacttgtaatatgctgataaattacattttagtgatgttttaaaaatctgtatatttatttttcagttaaaagttagttacatgaggccaggagtggtgc

SEQ ID NO: 17572 - DNA, 58 bp, Homo sapiens
tgaggcaagatctcgctctgtcactcaggctggagtgcaggggcttgatcatggctta

SEQ ID NO: 17573 - DNA, 96 bp, Homo sapiens
gctttaatatgacatcagaagtacatattgcctgctttacttgatttttatttacaagttttgggtaatgtttcttgatgaggaatgtggtagagc

SEQ ID NO: 17574 - DNA, 87 bp, Homo sapiens
ctgtctcaggtctcagctctgaaggtcattgagtgtcctgttgtcctcagtgatacatgtgagtgaccacccagacggtgcctgagg

SEQ ID NO: 17575 - DNA, 57 bp, Homo sapiens
gctaatggtggttgggttctttgactcaccagagagagaactcagatactgtagagc

SEQ ID NO: 17576 - DNA, 95 bp, Homo sapiens; identical to SEQ ID NO: 68

SEQ ID NO: 17577 - DNA, 93 bp, Homo sapiens; identical to SEQ ID NO: 69

SEQ ID NO: 17578 - DNA, 87 bp, Homo sapiens
tctagtcttaaatctgtctgagtcttttcgtttctttgttttttttttttttttgagacggagtcttgctctgtcacccaggctgga

SEQ ID NO: 17579 - DNA, 68 bp, Homo sapiens
cagaggttggcgaggtggcatctgagcccaggcatccttccctcagacctcacttctcaatcactctg

SEQ ID NO: 17580 - DNA, 81 bp, Homo sapiens
aatccagcatgagtggtgtccttttagaagggggaggtttggaaacagacacacactctgggagaatgccatgtgaagatt

SEQ ID NO: 17581 - DNA, 78 bp, Homo sapiens
gcgcatcccctccactctctctctgtctcactgcatgtgcagagaagaggccgtgtgagagcacagtgaggaggtggc

SEQ ID NO: 17582 - DNA, 80 bp, Homo sapiens
gaattctttctgtctgcctgactgtctttgatctgggacatcagtcttctgtctttgaagttggccttgaactggaattt

SEQ ID NO: 17583 - DNA, 117 bp, Homo sapiens
tttgggttttggtgtaaggaagagcaggtttcatggactataaatttttacttttcaaatatcgacaaattcttggtcatgccaaccactgcaagcttctatgttttagaaattgag

SEQ ID NO: 17584 - DNA, 123 bp, Homo sapiens
ccagcaaatggcagaaattttggatttgactttttttttttttttgagatggagtctcactctgtcacccaggctggagtgtggtggcgtgatcgcggctcactgcaagctccgccttctggg

SEQ ID NO: 17585 - DNA, 82 bp, Homo sapiens
gtccagctaattttatatttttagtacagatggggtttcacccgtctctactggaaatccaatgagacctaattagctagac

SEQ ID NO: 17586 - DNA, 81 bp, Homo sapiens
gactgtcactctcacaggttgagaccttatgttctggactatatgagtctcggagatttagaatgtgttatggtgacagtc

SEQ ID NO: 17587 - DNA, 113 bp, Homo sapiens
ggagattggccaaaggtttttgttttttgtttttgtttgtttgtttgtttttgagacagggtctcactctatcactcaagctggagcacagtggaaaaatcatggctcgctgt

SEQ ID NO: 17588 - DNA, 86 bp, Homo sapiens
ccaagcctttatcctggtgcaggactgtgtgtgacaggagagagggatctttgtccagttcacactaggacatgacagtgtcttgg

SEQ ID NO: 17589 - DNA, 80 bp, Homo sapiens
ttgtcagcttcaaatgagattggatgcaatgtgctgtgaagtgtcactgtcacactgaattgagtttgggaggttaacaa

SEQ ID NO: 17590 - DNA, 105 bp, Homo sapiens
tcttagggtttccccattgcctaataattgagttctaatttagcatgtatatatctaacatataggacataggtatttaggtatcagggtgcttagctttgtgga

SEQ ID NO: 17591 - DNA, 74 bp, Homo sapiens
agagaaaaccaacctcaggcagagtagctagggaagacctttctgactcactctgtctgagccagtttacatct

SEQ ID NO: 17592 - DNA, 122 bp, Homo sapiens
ttggggcggtggtggagaggcctcacgtgtgtgacctcggcggcgtcagggaggaaaaacaatatttgtatttttagtagaaacggggtttcactgtgttggctaggctggtctcgaactcc

SEQ ID NO: 17593 - DNA, 66 bp, Homo sapiens
gctctcacaattcatatacatacatacatatatatgtatgtatgtatatgtatatatatatgatgc

SEQ ID NO: 17594 - DNA, 114 bp, Homo sapiens
agcctcccgagtagctgggatcacaggtgcaaccatcacaccttgctaatttttcatttttaatagaggccaggtcatatcatgttgcccaggctggtctcaaacttctgggct

SEQ ID NO: 17595 - DNA, 70 bp, Homo sapiens
agtgtcactttgtataaatgtcttgattatagtatagaactatatagattccataatacaaggtgtcact

SEQ ID NO: 17596 - DNA, 104 bp, Homo sapiens
catctggaaacaaaggaagaaatggagcagtggtttgagagggaggcagagttaaagtactttttttattgcttatatttgattttgtttggttttctagcttg

SEQ ID NO: 17597 - DNA, 69 bp, Homo sapiens
gcctcttaagtctgggcatagttggagggtgtttaattgacagatgacagtttgctctgtcttgggggt

SEQ ID NO: 17598 - DNA, 60 bp, Homo sapiens
gtgagacagactctcgctctgtcacccaggctggagtgcaatggcgagatcttggctcac

SEQ ID NO: 17599 - DNA, 101 bp, Homo sapiens
gggcgatagagcgagactccatctcaaaaaaaaaaaaaaattgctaaaagtcaaatatttccttttttattttttaaggacagggtctcactctgttaccc

SEQ ID NO: 17600 - DNA, 100 bp, Homo sapiens
tggtatgccttttccctgagccctgggtccactgcaggaaacctggctgtcactgacactctcagaaaatgcaggggtctgctagaagagaggatatcca

SEQ ID NO: 17601 - DNA, 113 bp, Homo sapiens
tgaagtcctcctcagcagctaaaaggtcaggtatttatgaatttttatacattaaaaatggataccagcatgacctcattaaagagctgatattagtagaaaaggataggtca

SEQ ID NO: 17602 - DNA, 79 bp, Homo sapiens
tcagctctttaatgaggtcatgctggtatccatttttaatgtataaaaattcataaatacctgaccttttagctgctga

SEQ ID NO: 17603 - DNA, 128 bp, Homo sapiens
tatatatatgtatatatatatatacgtatatatacatatatgtgtatatatatacatatgtgtatatacatatatatatacatatatacgtatatacgtttatacatatatacgtatatacatatata

SEQ ID NO: 17604 - DNA, 85 bp, Homo sapiens
gggggacaaagttaaggcatagacttcttctcattattactcttttttttttttttttttgagatggagtctcactctgtcgccc

SEQ ID NO: 17605 - DNA, 103 bp, Homo sapiens
gcttgatggagttgttttttacgtcatatagaagaaaaaaaggagttacaaaaatatacttatattttcttttatatttacttatgtaattatctttatcagt

SEQ ID NO: 17606 - DNA, 76 bp, Homo sapiens
gagggctggaacctccctagggagcaggcgggggctggacagtctgccagacacacgctctctaggacacactctc

SEQ ID NO: 17607 - DNA, 91 bp, Homo sapiens
atgtaggtaaagtcacagcatgttgtttttagtcttggaggtttttgcaaaacagcctttaaaggacagcttggcaatggctttaaaacat

SEQ ID NO: 17608 - DNA, 101 bp, Homo sapiens
ccaggcaattaattctatgatgctgttaggtaggtaggtaggtaggtaggtaggtagatagacagacagacagacagacagacagatatagatgaagctgg

SEQ ID NO: 17609 - DNA, 138 bp, Homo sapiens
tatactgatatgtgtatgtgtatatatatatatacgtatgtatgtatatatatacacacatgtatgtatgtatatatatacatgtatgtatgtgtatatatatatatacatgcatgtatgtgtgtgtatatatataca

SEQ ID NO: 17610 - DNA, 114 bp, Homo sapiens
catttcttagtcacatatgcatgttaactgtccctttcaactagatgagagcaagaatgatttttttttttaacgtttaagttcagggccacatgtgcaggatgtgcaggtttg

SEQ ID NO: 17611 - DNA, 119 bp, Homo sapiens
gctttctgcatggtcctcagaacggggccaattttactcgtaagacttcttgtatttcttttttagatctcagaatttgttttattaagcccctcttctgtgctagacactgggcggag

SEQ ID NO: 17612 - DNA, 95 bp, Homo sapiens; identical to SEQ ID NO: 68

SEQ ID NO: 17613 - DNA, 93 bp, Homo sapiens; identical to SEQ ID NO: 69

SEQ ID NO: 17614 - DNA, 76 bp, Homo sapiens
gggacacaggagacctggttttgagtactgcccctgctgttatttagatatgtgagcctctgtgtctgtgtgtctc

SEQ ID NO: 17615 - DNA, 91 bp, Homo sapiens
gggcttgtttttgtgaaaagaaggaatgacaggaactagaaatgcagttgttgaatctggtggtctcatctctctgtctaaagacaagctt

SEQ ID NO: 17616 - DNA, 117 bp, Homo sapiens
gagtcaactacaagttagtcttgtagcatctgtatgtactatataaagatatatatactatattaagatatatgtactatataaagatagtctctggctaatttaagtagttttgtc

SEQ ID NO: 17617 - DNA, 118 bp, Homo sapiens
tttcattatgtactttactatttttttagtcatgcaaatgtattacacattcagaaaattttttaaatttctagaaaattacttttgctgaagacagaagtcttacggtattatgaga

SEQ ID NO: 17618 - DNA, 107 bp, Homo sapiens
gtcacttccatattcaaacagttaagttcatgtaggattatatatcataagttatttatatattgtcctgctgatgaacgttgggcttattttgagttttttgttat

SEQ ID NO: 17619 - DNA, 90 bp, Homo sapiens
tggtttgttagatagctttattgtgagtttatttccaaaggtaagaaatcactgggaatttcacaaactggagtcattttacttatacta

SEQ ID NO: 17620 - DNA, 86 bp, Homo sapiens
ctaggtactccagacagatgacaatgtccagagacagaaagaaagtctctctcatgtatctccttttagtctgcaaggattcctag

SEQ ID NO: 17621 - DNA, 68 bp, Homo sapiens
catagaaagtagaagagatcatttttgggtagaggatatccattagatatcttctctctctctctgtg

SEQ ID NO: 17622 - DNA, 80 bp, Homo sapiens
tgtttatatatgtgtgtgtgtatatatatgtgtgtgtgtatatatatatatatatatatatatatatatatatatataca

SEQ ID NO: 17623 - DNA, 88 bp, Homo sapiens
ccatgattagagtgttagaaccttaggctgccagcccaataatgtccagtgagagaagtgaggctggagactgagctcaacaacatgg

SEQ ID NO: 17624 - DNA, 95 bp, Homo sapiens
cccagctactcacgaggctgaggcaggagaatcgcttgaactcaggagacagaggttacagtgaactgagatcacgccactgcaccccagctggg

SEQ ID NO: 17625 - DNA, 75 bp, Homo sapiens
gcagagccagacagatatgtcagatttcagcgtccctgtttttttttttttttgagatggagtctggctctgtct

SEQ ID NO: 17626 - DNA, 72 bp, Homo sapiens
ttgggagagtctcactctgtcacccaggctggagtgcaacctccgcctcccgggttcaagcaattctcctga

SEQ ID NO: 17627 - DNA, 80 bp, Homo sapiens
tgagacagagtctcactctatcaccctggctggagtgcagtggcgtgatctcttctcactgcaacctctgcctcctgggt

SEQ ID NO: 17628 - DNA, 104 bp, Homo sapiens
ttagatgtttaggtcggaaatgtcagaggttaggtagagaggcatggatactaaaattgttgatctgtcatctattcctcatttctgaaacctaatgcaaatga

SEQ ID NO: 17629 - DNA, 86 bp, Homo sapiens
cacactgagaaactgtagctccatcagtgagtgaagcccacacccgcattactactctcagagactcactcactctctgctgtgtg

SEQ ID NO: 17630 - DNA, 95 bp, Homo sapiens; identical to SEQ ID NO: 68

SEQ ID NO: 17631 - DNA, 93 bp, Homo sapiens; identical to SEQ ID NO: 69

SEQ ID NO: 17632 - DNA, 111 bp, Homo sapiens
caagggtggaagaaatacaagtggatccctctggctgaaggccacagaggtcacagcctctgtggcacagtctccccccgccccaagagcttagaaccatccaccaacttg

SEQ ID NO: 17633 - DNA, 90 bp, Homo sapiens
tgtgcactcccaatgcctgtgcctgcatcaggtgaggtgggggacaccctgaggtccctctctgactcagacactggtctgggaatgcca

SEQ ID NO: 17634 - DNA, 133 bp, Homo sapiens
tcaatgtcataatatcattcgtcttctctaggtggatactagcatgttctctagatgtgaatggatgtgaaatgaattgaatgaaatcgaaggggaaaatcctcctctttcatgttcacactttgcacctttc

SEQ ID NO: 17635 - DNA, 105 bp, Homo sapiens
acagaaacgggagcagacactgggagaagtgagccaaggcagcaggtgtcctctgcgcctactcactactcttcctgtcttctgaaactcactcccctcatttgt

SEQ ID NO: 17636 - DNA, 58 bp, Homo sapiens; identical to SEQ ID NO: 1101

SEQ ID NO: 17637 - DNA, 56 bp, Homo sapiens; identical to SEQ ID NO: 1102

SEQ ID NO: 17638 - DNA, 150 bp, Homo sapiens
ccatctctgaaaagccgatgtgtatcctcagctttgagaactgaattccatgggttgtgtcagtgtcagacctctgaaattcagttcttcagctgggatatctctgtcatcgtgggcttgaggacctggagagagtagatcctgaagaac

SEQ ID NO: 17639 - DNA, 117 bp, Homo sapiens
gttacactccagcctgggtgacagagagagactgtctcagaaataaaataaataaataaataaataaacatgtgctgatcagagacagtggaatctgaccagtcttaggagcattgc

SEQ ID NO: 17640 - DNA, 72 bp, Homo sapiens
ggagaagtgacagtgtcctgggatgagcccagcagctttctttcctttctcactcagcctctgtctctctcc

SEQ ID NO: 17641 - DNA, 80 bp, Homo sapiens
gagaatgtgggtgcaaatgtagaagagtaaagtaaagatggggacttgtggaagtgcctctctgactgtctcattttctt

SEQ ID NO: 17642 - DNA, 119 bp, Homo sapiens
ctatctgctttagtttctgggctccagtttcattatatgcacaatgaggggaaaggggtcaacgatttttttttttttttttttttttgagacggagtcttactctgtcgccaggctag

SEQ ID NO: 17643 - DNA, 112 bp, Homo sapiens
aaggcgccagcaacacctgaaaaatgagaaaataatctttgaaacaagttttatattatataaaaacagccttggagtagtatcatggaaaaatcagagttttgttggactt

SEQ ID NO: 17644 - DNA, 69 bp, Homo sapiens
cctaattattctctcagtgactcacagctcacaggggtgattggctaagagtctgtggaagattgaagg

SEQ ID NO: 17645 - DNA, 110 bp, Homo sapiens
tgcttaggattgccttggctatatgggctcttttttggttacatatgaaatttaaagtagttttttcaaattctgtgaagaaagtcaatggtagcttgatgggtatagca

SEQ ID NO: 17646 - DNA, 91 bp, Homo sapiens
catggtgccaatatacactgtctgaatctcagtctctaaggggtctttaatccacgagataattcaagaaccttgcattgttgtcattatg

SEQ ID NO: 17647 - DNA, 95 bp, Homo sapiens; identical to SEQ ID NO: 68

SEQ ID NO: 17648 - DNA, 93 bp, Homo sapiens; identical to SEQ ID NO: 69

SEQ ID NO: 17649 - DNA, 72 bp, Homo sapiens
ctgtgatgttgctgtgaaggcattttgtagatgtgatgagcatctacaatcagttgactttaagtaaagcag

SEQ ID NO: 17650 - DNA, 87 bp, Homo sapiens
gtcttggtcttgatctcgatttgtttttctgtgtttttgactggtgaaacttacacaaacactggtagaaatggggccagccaggat

SEQ ID NO: 17651 - DNA, 73 bp, Homo sapiens
gccctgatacaggcttcttaagagtcaggacagagtgtggatgcagcttagtggactaggagaagggaggggc

SEQ ID NO: 17652 - DNA, 58 bp, Homo sapiens; identical to SEQ ID NO: 1409

SEQ ID NO: 17653 - DNA, 101 bp, Homo sapiens
tcactgggctgagatcaaggtgtaagcaagcctgttttttttttttttccagaggctatgagaagataatctgtttccttgccttcttcagggtttagtga

SEQ ID NO: 17654 - DNA, 128 bp, Homo sapiens
acatatgtatacatatatatagtacatagaatgtgtatgtatatagacagacatgtatatatatgtaaacatgtgtatgtatatgtatgtgtatataagtatgtacatattccatatatacatgctca

SEQ ID NO: 17655 - DNA, 74 bp, Homo sapiens
atatatgtgtatgtgtgtgtgtgtgtgtatatatatatatatacacacacacacacacatacatgtacatatat

SEQ ID NO: 17656 - DNA, 58 bp, Homo sapiens
gtgtgtatatatatacatatatatatatacgtatatatatgtgtgtgtatatatatac

SEQ ID NO: 17657 - DNA, 109 bp, Homo sapiens
ggaataattccaaagtgctatttactgtgaatactagaaagattatgtatgtatatataacacacatatatatcattctcaaaaacataaacactctggaagtgactct

SEQ ID NO: 17658 - DNA, 63 bp, Homo sapiens
cctgaattaatttctgagtatctctctctctctgagggtggagataagaacagagttagcagg

SEQ ID NO: 17659 - DNA, 76 bp, Homo sapiens
gacagagagttgctgagcaaatatcatcacagaaggatttttcttttttatgtaaggttgcagcagactttccttc

SEQ ID NO: 17660 - DNA, 71 bp, Homo sapiens
ctgtgagggtgtttccagaggaggttgacaggtgagtctgtggactgagaggggaaggtccaccctcaggg

SEQ ID NO: 17661 - DNA, 96 bp, Homo sapiens
cttacctaaaactgacatctctctttctctctccaagagatgagatggatatatggattttctctgagagagagagagagagagagagagagagag

SEQ ID NO: 17662 - DNA, 105 bp, Homo sapiens
tggcctgatagcacctcactcacctcgccaccgctgtattgggtctctcagtttctgagtctggacctttatgtggctgagttgagggatatgtagggaaatcca

SEQ ID NO: 17663 - DNA, 114 bp, Homo sapiens
attagttctggtgtttgcagcactatagggtaaatatgattaactagaattttttgaatattttcaaaaagctataagagaggactttaaatgctcacaacacaaagaaataat

SEQ ID NO: 17664 - DNA, 111 bp, Homo sapiens
ccagctgctaatacccacaattctactctcaactttcatgagctgaaactttttttttttagctcccacatatgagtgagaatatgtggtatttttccttctgtgcctggc

SEQ ID NO: 17665 - DNA, 69 bp, Homo sapiens
ggctgctgtgtatttgtgtgtgtatatgtatgtgttcgtatgtgtatgtatgtatgtatgtgtgtagcc

SEQ ID NO: 17666 - DNA, 108 bp, Homo sapiens
cagctggattatttgcagtcactcttggttttattgttaggattaaatttatttattcatcaaatcttttttttttgagacggagttttgctcttattgcccaggctg

SEQ ID NO: 17667 - DNA, 92 bp, Homo sapiens
catcttctggctttgacactgagaatggaggctctagggacaatgaaacatgtctttgtactctcagtctgtgtctttaagaaagaaaaatg

SEQ ID NO: 17668 - DNA, 60 bp, Homo sapiens
tgtttcagaggtgtctgaccacacagggacgcctgccttggtccttcacccttaggagca

SEQ ID NO: 17669 - DNA, 77 bp, Homo sapiens
gccactcccagagcccctgaaactctggcccaaggctctctgactgactccttcccagatcttctcggcttagtggc

SEQ ID NO: 17670 - DNA, 88 bp, Homo sapiens
gtcttacaacatatctacatgtatatatgtgtatatatagattcatataaacatacatacatatatatgcattcatatgttggaaaac

SEQ ID NO: 17671 - DNA, 102 bp, Homo sapiens
gtaagagactctggttcaactatatttcttatcatgatcattttaaatttttatttatttttatttttatagattcagaggttacatgatcaggtttcttat

SEQ ID NO: 17672 - DNA, 112 bp, Homo sapiens
aagaaaattgattaatatccaccttaggaagttatcaatcttagatgtttattttcaaatgaatctaaggatgtaagtggtatatctgtctgtgtggtttgcatctcttctt

SEQ ID NO: 17673 - DNA, 79 bp, Homo sapiens
tccttcagagggaatgtgtgtttctgtgcatgtgcatgcacatgtgtgtaaggaatgaaaggagaatactatctgggga

SEQ ID NO: 17674 - DNA, 116 bp, Homo sapiens
tcttattatgtatcaataccatgccaggctttggagatacaggaagataaatgacacatccagtctctgtgactcaaaaacttggaggctagtgggagaagaaaatatgtaacaga

SEQ ID NO: 17675 - DNA, 99 bp, Homo sapiens
tcattactgagcagttcacatgatgctattaaggttatcaagacttgacagatatgtcactgcctcttgttactcattttggttctgttcatgaggctg

SEQ ID NO: 17676 - DNA, 105 bp, Homo sapiens
gaatcagtgttgaattttgccacgttttctctgaacttagtgatgagatcatttatttttcttttctattcagttaatgagtcacggaaatgtattaactgattt

SEQ ID NO: 17677 - DNA, 89 bp, Homo sapiens
ctaatgagtcttcatatcttttcgaactcatctatttttatttaaaagtgatgaatagtggcagtttggaaaggtgcaatgttcattgg

SEQ ID NO: 17678 - DNA, 95 bp, Homo sapiens; identical to SEQ ID NO: 580

SEQ ID NO: 17679 - DNA, 93 bp, Homo sapiens; identical to SEQ ID NO: 69

SEQ ID NO: 17680 - DNA, 92 bp, Homo sapiens
catgtatgactttatatttgtatgatgtatatatgtatactactgtatatatatttgtatatgttatacatatatatttatattcacatatg

SEQ ID NO: 17681 - DNA, 84 bp, Homo sapiens
gttttgttttttgttttttttgttgttgttgttttgtttttaggtaaacattatctttaccacactgaaaacagtaagcaaagc

SEQ ID NO: 17682 - DNA, 76 bp, Homo sapiens
ttgttttttttgagatgaagtctcactctgtcacccaggctggagtgcagtggtgcgatcttggctcattgcaaca

SEQ ID NO: 17683 - DNA, 92 bp, Homo sapiens
ctgatatctttacctgtctcctatctctctctctcttttttgacctaaataaactttgacagagagagagagacagagagacagagagacag

SEQ ID NO: 17684 - DNA, 80 bp, Homo sapiens
tgagacagggtctcactctgtcacccaggttggagtgcagtggtgtagtctcgactcagtgaagcttctacctccctggg

SEQ ID NO: 17685 - DNA, 92 bp, Homo sapiens
gaacatgccagtggatatgtcttttctgtagagcagtgtatattattttgtatatatactcagtaatgggattgcaggtcaaattgttgttc

SEQ ID NO: 17686 - DNA, 118 bp, Homo sapiens
tgaaaaagaaagaaatatatatacatatatatatacatacatagtgtatatatatatagttatctttattcttatgtgtacatatatatgtgtgtgtatatatattttttctttttca

SEQ ID NO: 17687 - DNA, 99 bp, Homo sapiens
gacactatttagttcctttttatggctgagtagtattccatggtgtatatataccacattttgtttatctacttgtttgaaaggcattgaggttagttc

SEQ ID NO: 17688 - DNA, 110 bp, Homo sapiens
attctgagaagtggaaagtctgggttgagtaataagattttttttttttttttttttttttttttttttttttttgagatggagtcttgctctttcgcccaggccagagt

SEQ ID NO: 17689 - DNA, 95 bp, Homo sapiens; identical to SEQ ID NO: 68

SEQ ID NO: 17690 - DNA, 93 bp, Homo sapiens; identical to SEQ ID NO: 69

SEQ ID NO: 17691 - DNA, 111 bp, Homo sapiens
gagaaataaccttgatgtgtttgctgttgtcatccttcttcatgttgctgaaagcaagttgtgactggaagaaatatcggcacgttatagaatccaatagtgttagatctt

SEQ ID NO: 17692 - DNA, 85 bp, Homo sapiens
gatgtgtgcatgtgttgtgtgaaattagaccatatatatgcaatatatatatatgtatcaaatatataacatagatatattcatc

SEQ ID NO: 17693 - DNA, 105 bp, Homo sapiens
tgtgtatatatattttagcatatacattgtatttaagcttatgctttatatataaatattatagccatactttaaatatatgtatttgagcatatgtatatttca

SEQ ID NO: 17694 - DNA, 58 bp, Homo sapiens
tgtgactgagacagggcatagaaatgttgagacatcagtgtgctctctctctctctca

SEQ ID NO: 17695 - DNA, 79 bp, Homo sapiens
aatagctaataaaatgcaaatgttatgtaaatagttgttatgctgtattgctgttcatttgcatttttatattgttatt

SEQ ID NO: 17696 - DNA, 92 bp, Homo sapiens
catatatatacttatatatatatatacatatgtgtatatgtatacatatgtatgtatatatacatgtgtgtatatatatgtgtgtgtgtgtg

SEQ ID NO: 17697 - DNA, 68 bp, Homo sapiens
ttacactgcctctgactggctgggtggcctccttactccagtcagactctaaaccccaagctgtgtaa

SEQ ID NO: 17698 - DNA, 121 bp, Homo sapiens
gagatataaaattgtatgtatttgttgtctgcaacatgaattttttttttttttttttgagatggagtttcactcttgttgcccaggctggagtgcaatggcacaatcttggctctgctca

SEQ ID NO: 17699 - DNA, 95 bp, Homo sapiens; identical to SEQ ID NO: 68

SEQ ID NO: 17700 - DNA, 93 bp, Homo sapiens; identical to SEQ ID NO: 69

SEQ ID NO: 17701 - DNA, 100 bp, Homo sapiens
ctagaaaatctaatgggatggcaagtctggaaggatgtttaaatatttttaaacaaatgtgcttccaactaaagtcagcacaatggaaaacaattactgg

SEQ ID NO: 17702 - DNA, 60 bp, Homo sapiens
tgtatatatacatatatatgtatacatatatacatctatacatatatgtgtgtgtatata

SEQ ID NO: 17703 - DNA, 81 bp, Homo sapiens
gttccagcatgaaaacaggtaagctgagttctctctcagtcaagggaaggtcagcctttttgttctagtcaggctttgaac

SEQ ID NO: 17704 - DNA, 99 bp, Homo sapiens
tacatatatatatgtgtatatatatatgcatgtatgtatttatgtgtctgtatatcttcatacattaataaatgtgcatatatgtatatgtatgtatat

SEQ ID NO: 17705 - DNA, 100 bp, Homo sapiens
tgattctcttcttagcttgtggccactgggcagtccatgtccacatttttttttttttttgtgagacagagtctcgctctgtcgcccaggctggagtgca

SEQ ID NO: 17706 - DNA, 77 bp, Homo sapiens
tacatatttttggcaaagatttattattatttctttaggataaattcctagaggagtggttgtctgatcaaagtgta

SEQ ID NO: 17707 - DNA, 58 bp, Homo sapiens
tgagtcagagtctcactctgtcgcccaggctggaatgcagtggtgtgatctcggctca

SEQ ID NO: 17708 - DNA, 82 bp, Homo sapiens
ggtgaggtagtaggttctcaactctgttagcatttgctatcaatccaactgctttctatgttccagaatctgctgttttatt

SEQ ID NO: 17709 - DNA, 62 bp, Homo sapiens
ggggacacagaacacagagaagacaatgttagcaagggaatccttctctaacttctgtcccc

SEQ ID NO: 17710 - DNA, 119 bp, Homo sapiens
gttgcttgaagataggcaatgtggtggcctgctggaggttgaagtatatatttttttggttgagcaattaaagtatacaaaaatttcaagctgtgtcccaaaggtcttttgaaagcgat

SEQ ID NO: 17711 - DNA, 76 bp, Homo sapiens
gattttatatgctacgactttactgaatttgtttatcagttctaagagatttttggtgaagtctttggtagaaatc

SEQ ID NO: 17712 - DNA, 95 bp, Homo sapiens
ttgtttttttagacagtgtctcgctctgtcacccaggctggagtgcagtgtgtgatcttggcttactgcaacatctgcctcctgggttcaagcga

SEQ ID NO: 17713 - DNA, 109 bp, Homo sapiens
cgtgcttatttcaaggaaaaagggagaaagcaggaaacagatttacctttacatatatatgtatatttacacacgatttcccattctccattcactgatggtagggacg

SEQ ID NO: 17714 - DNA, 107 bp, Homo sapiens
tcagtgtggtggaaaggggtcagaatactgagaggagagcatttgggggaagactttctttctttttttttttttttagatattcaacattatttaatcattcagga

SEQ ID NO: 17715 - DNA, 143 bp, Homo sapiens
acatatatgtatatgtatctgtgtgtatatctatatctgtgtatatatatcacattttatttatatatatacatatgtgtgtatatatacatatctatgtatgtgtatatatatgttttcatttgtgtgtatgtatacacaca

SEQ ID NO: 17716 - DNA, 91 bp, Homo sapiens
acggagtgagtggaacagtgaacaaagacaggtgagcaagtggaggctgtctctgtagagcagaggtccccaaactttgtgtgctcacatc

SEQ ID NO: 17717 - DNA, 97 bp, Homo sapiens
tattactgctataaggatgtttgttagaattttgtttaaatttatttgaacacatgattttgttttttcacatcttaagtattatgtagaagtaatg

SEQ ID NO: 17718 - DNA, 120 bp, Homo sapiens
ctggatctttttctttagtaataagcatagcctccttagactttttaatttttatttttaatctttgtgggtacagagtaggtatatatgtttatgggtacatgagatgttttgatacag

SEQ ID NO: 17719 - DNA, 116 bp, Homo sapiens
cacataatatatatgtatacaatatgtatatgatatatacacatatataatatatatctatatatgtagtatgtgcgtattatatataatacatatatacatatatatatagcgtg

SEQ ID NO: 17720 - DNA, 64 bp, Homo sapiens
cccttttctaaactagtagatatggctgctccctcagggtagtatgtagattagttttataggg

SEQ ID NO: 17721 - DNA, 97 bp, Homo sapiens
gccatctacttctacaagaggatagtcaagtacagtgccagcagactgcgggcactcaaactttgttttgttgtttaacaagtaaaggaatgatggt

SEQ ID NO: 17722 - DNA, 101 bp, Homo sapiens
ctctccttctctgctgcaccagtctgccactctgccactctgctgctcttctgctcacagagcctggggtttgggatttatatgggtacaggatagttggg

SEQ ID NO: 17723 - DNA, 106 bp, Homo sapiens
ggataatcactctggttattgttggcatatagaccatatatatatatgtatatacacacatatatatatatagatgacccttgaacaaaacagatttgaattgtgc

SEQ ID NO: 17724 - DNA, 93 bp, Homo sapiens
tcaaatctgttttgttcaagggtcatctatatatatatatgtgtgtatatacatatatatatatggtctatatgccaacaataaccagagtga

SEQ ID NO: 17725 - DNA, 102 bp, Homo sapiens
ttcaagatgccgtttctaactgtgattattgttttctagctgagggaaaagatgaactttgtttatagataataattgttttatggaagccaaagtccagaa

SEQ ID NO: 17726 - DNA, 176 bp, Homo sapiens
tatacaaaaaaatttgagatatgtatatatatatgttcatatatatgtgtgtatatatatgttcatatatatgtgtatatatatatgttcatatatatgtgtgtatatatatgttcatatatgtgtgtgtatatatgttcatatatatgtatctatgtatttgtgtatatacatat

SEQ ID NO: 17727 - DNA, 111 bp, Homo sapiens
tattcttatgtttcccctccattgtatgagtaacccagaagtatagacatgtgatggttatctatctatctatctacctatctggttgttctgcagctgtagcatgttgtg

SEQ ID NO: 17728 - DNA, 76 bp, Homo sapiens
ccttgacatttgctgtcttctctctgtgaaatactctcacttcagatattcacaagactgactcaaatcatcaggg

SEQ ID NO: 17729 - DNA, 73 bp, Homo sapiens
agctgcactggcagtgtattggatggtgcccacccacactgagggtgggtctctctctcccagtctatcagct

SEQ ID NO: 17730 - DNA, 113 bp, Homo sapiens
ccgttatgggctacagaacccactgggaggtttagtctgtgtgaaccatttctagactgatgatagagatgtgttgagaagccagagttgttcttcagtgggttgcttgatgg

SEQ ID NO: 17731 - DNA, 112 bp, Homo sapiens
tacttcaaatgtttcacaattttaggatttatgtttaggtttatgcatcatactgaatttttatatatggtgtgagctatggatcaaagtcaattttgtgtgcatatgtgta

SEQ ID NO: 17732 - DNA, 69 bp, Homo sapiens
ttaccatgtgaaggggaggcagtggaggattctgattcacgtatactgtttttcttgatcccttggtga

SEQ ID NO: 17733 - DNA, 314 bp, Homo sapiens
ataaatatgtacatttatctatgtatttatatataaatatatatatttatatatgtatttatatatcaatatatatatttatatatgtatttatatatcaatatatatatttatatatcaatatatgtatttatatatgtatttatatatatttatatatgtatttatatataaatatataaatacgtatttatatatgtatttatataaatacgtatttatatatgtatttatataaatacgtatttatatatgtatttatataaatacgtatttatatatgtatttctataaatatgtatttatatatgtat

SEQ ID NO: 17734 - DNA, 188 bp, Homo sapiens
gtatttctatataaatatatatttatatatgtatttctatataaatatatatgtatatatgtatttatatatgtatttctatatatatgtatatatgtatttctatataaatatatatttatatatgtatttatatataaatacatatttatatatacgtatacgtatatatgtatgtatatatacat

SEQ ID NO: 17735 - DNA, 128 bp, Homo sapiens
agacagtactacctctaaagcaagagtctgtgagggttgcaatttcaggcagaagtgtcagtgcagagtgaagtaaacagccttcattctcctcttccgaatccttcagtaatttctcaacacctcat

SEQ ID NO: 17736 - DNA, 69 bp, Homo sapiens
atatatacatatgtgtgtgtatatatattagtatatgtacatacctgtgtgtgtgtatatatatatatg

SEQ ID NO: 17737 - DNA, 95 bp, Homo sapiens; identical to SEQ ID NO: 68

SEQ ID NO: 17738 - DNA, 93 bp, Homo sapiens; identical to SEQ ID NO: 69

SEQ ID NO: 17739 - DNA, 103 bp, Homo sapiens
tcttgagcagctgggaccacagatgtgtgccaccacatctggctaattttttttatttttagtagagatgggggtctcattatgttgcctaggctggtcttga

SEQ ID NO: 17740 - DNA, 106 bp, Homo sapiens
ggtaaaggtttctttttagatttttaaaggtgtcagactctcaatctctcctgcatggggtgggggtgaggggtggggaggcatagaaaggggatggggcatggct

SEQ ID NO: 17741 - DNA, 116 bp, Homo sapiens
tttcttatacatctacaggtttgaaaaaaataatatttgaaatgtagtctcggagccatctgccactctcattctcagattttgttgggtcagctcagaagttttgctgttagaaa

SEQ ID NO: 17742 - DNA, 106 bp, Homo sapiens
ctgaatatatatatacatatactcagttatatatatcaatatatatattcagttatatatatcaatatatatactcagttatatatatctatatacatatattcag

SEQ ID NO: 17743 - DNA, 108 bp, Homo sapiens
ctgaatatatgtatatagatatatataactgagtatatatattgatatatataactgaatatatatattgatatatataactgagtatatgtatatatatattcagtt

SEQ ID NO: 17744 - DNA, 101 bp, Homo sapiens
gtatgtatgtatgtgtatatatatatgtgtatatatatatgtatgtatgtatgtgtatatatatgtatatatatatatacacacccacatacatatttata

SEQ ID NO: 17745 - DNA, 76 bp, Homo sapiens
cctttttggttgacagttctctgtgtgcattatcctgtgttgatgacagtagagtgacatgtctggactctgtggg

SEQ ID NO: 17746 - DNA, 58 bp, Homo sapiens
tgagacagggtctcactctgtcacccaggctggagtgcagtggcgcgatcttggctca

SEQ ID NO: 17747 - DNA, 95 bp, Homo sapiens
catatatatgtgtgtatatatgtgtgtgtatatatatgtatgtgtatatatatatgtatgtatgtgtgtatatatatgtatgtatacatatatat

SEQ ID NO: 17748 - DNA, 110 bp, Homo sapiens
ctcactaaatattaaaatggatgtgtaaagttagatgtctgataaatagtatttttttagatagagttttttggcttaatacatattcagcagtttttaatatggttgag

SEQ ID NO: 17749 - DNA, 66 bp, Homo sapiens
tatgtgtgtgtgtgtgttttgagatagagtctcactctgtcatttaggatgcagtgcagtggcatg

SEQ ID NO: 17750 - DNA, 94 bp, Homo sapiens
atatatatatatgtgtgtgtgtgtatatatatacatatatatgtgtgtatatatacacatatatatgcgtgtgtatatacacgtatatgtgtat

SEQ ID NO: 17751 - DNA, 95 bp, Homo sapiens
gattcaagcctgtgattgattaagtatgaaagttaatcaatttaatttatgtgattgatgttgattctttcattttgaaattgcctgtttgtatc

SEQ ID NO: 17752 - DNA, 86 bp, Homo sapiens
tgcttagttttcagtgcttagctatgtgaatcttgaagacattatgattaactttatttataaattgtgatactgaaaactatgca

SEQ ID NO: 17753 - DNA, 84 bp, Homo sapiens
tgccattctgtctcactgtcttatttctggaggaacatggctcctgttacatccctcctcctgagagatccggatagaatgtca

SEQ ID NO: 17754 - DNA, 112 bp, Homo sapiens
ttctgtgtgtgtgtgtttgtgcacatgtacgtgtatatatgtatatgtatgtttatacatctatctatatgtatctatgtatttgtgtatctgtctatcatctataagagag

SEQ ID NO: 17755 - DNA, 91 bp, Homo sapiens
ctgggtcattactttgcactgtggtttatgaacaggtcagaatgtgattttttttaaaaactagcctgagttgtgacacagcctgacccag

SEQ ID NO: 17756 - DNA, 58 bp, Homo sapiens
tgagttggagtctcactctgtctccgaggctggagtgcagtggcaccgtgtcagctca

SEQ ID NO: 17757 - DNA, 107 bp, Homo sapiens
caatgctgagtgtgtggtgttaaagttcccaagagttactatattagggtgtctctctctctctttagagctaatatttgctttttatatctgattgactagtgttg

SEQ ID NO: 17758 - DNA, 68 bp, Homo sapiens
ttcttcatatataaatatgtataagtgtgtgtatatatatatacatatatatatatatatagagagag

SEQ ID NO: 17759 - DNA, 112 bp, Homo sapiens
tttctgctagcttaccctgattctgcttctggttcagatagtattttaatatttctagtgtgtctttttgtaagatatctgaaatctttttgtggaatgaagtggcatgaaa

SEQ ID NO: 17760 - DNA, 58 bp, Homo sapiens; identical to SEQ ID NO: 11194

SEQ ID NO: 17761 - DNA, 79 bp, Homo sapiens
tatgtatatatatgtgtgtgtgtatatatatatgtatatatatgcgtgtgtatatatatgtatgtgtatatatatatac

SEQ ID NO: 17762 - DNA, 69 bp, Homo sapiens
tgccaaagtgagctcctttcaatctgtttctgtcggccttcagaagacagagaggatacactggggaca

SEQ ID NO: 17763 - DNA, 86 bp, Homo sapiens
tcatgaaactcactcactgtttctttaggctcatggttggaataaatatttcagcctccctagcagttaggggtgaataaatatga

SEQ ID NO: 17764 - DNA, 56 bp, Homo sapiens
tgagtcagagtctcactgtcacccaggctggagtgcagcggcgtgatcttggctca

SEQ ID NO: 17765 - DNA, 111 bp, Homo sapiens
aaggcatgtataatatgccattatatatgtatatgtatgcatacctatatatctatatataatatacatatgtattttttctgttagtttccatttcctcgttcatgtctt

SEQ ID NO: 17766 - DNA, 113 bp, Homo sapiens
ggaaacttgggcaggagatgattgctcaatcccagcagactctcagaatctcacttggacccgaaagtgcatctgcttggtggcattgttcttcattcctgtcttcagcatcc

SEQ ID NO: 17767 - DNA, 108 bp, Homo sapiens
tgtatagtattccatggtgtgtgtgtatgtgtatatatatatatgtacacatatatatacgtatatgtgtacatatatatatatatatatacacacacatatatatac

SEQ ID NO: 17768 - DNA, 119 bp, Homo sapiens
ccacaattgtttatttaaaaattctatactttagaagagcacattttcaagagttacaagaatgtttttctttaaaatactctcgtaagtgctggattaaatataatatttcaagttgg

SEQ ID NO: 17769 - DNA, 81 bp, Homo sapiens
tgttctcatggtggtggtagtttgttcatttgtttatgctctgcgggtgaataaacccattctctcctccgcctgattata

SEQ ID NO: 17770 - DNA, 114 bp, Homo sapiens
tagattttgcattgtacacaattttaaattggagcaaggtgatcatatgtgcatatatattcatgtatatatgtaaatgtatgctttatatatatatgtgtatgtgtatatcta

SEQ ID NO: 17771 - DNA, 99 bp, Homo sapiens
ctgggaggatggtcagcgctcctggcttcatgggttatgcaagggccaagtgtaattgttcttgtataagatgtgtgttttcatttggctgcttctaag

SEQ ID NO: 17772 - DNA, 122 bp, Homo sapiens
gtatgtgtgtgtgtatatatatatgtacatatatatatgtacatatatatatgtacatatatatatgtacatatatatatgtacatatatatatgtacatatatatatgtacatatatatgt

SEQ ID NO: 17773 - DNA, 66 bp, Homo sapiens
tatgtgtgtatatatatttctgtatatgtgtatattatacaaataagaaatatatatgcttatata

SEQ ID NO: 17774 - DNA, 108 bp, Homo sapiens
ctcccctgacctagaaaacatagttttagaggtgaaagggactggttgagttcactgggcccaactcagtttcttttacttaaccattttattttggggtcatgtaag

SEQ ID NO: 17775 - DNA, 80 bp, Homo sapiens
ataggtacgtgtgtatgtatgtgcatgttgatgtgcacatgaatgcaaacatataagtatatctatacaagtgtgcttgt

SEQ ID NO: 17776 - DNA, 117 bp, Homo sapiens
atcttaaagttaggttgtatatgacagtgttgaaaagttgttggagtctcactctgtcacccaggcgggagtacagtggtgtgatcttggctcactgcaacctccacttccctgggt

SEQ ID NO: 17777 - DNA, 115 bp, Homo sapiens
gttgcctagtaaaatttttcggcataaggaaaagcatgttaataaaagcatattctatgaatattagaattttgacatgacagttttatgtcataagggatatatactttataac

SEQ ID NO: 17778 - DNA, 112 bp, Homo sapiens
tgtggctcatgatttcagtgtgattaccttcagtggaacaatgaagaaaatatttttgattttctaagatattattgttctttgatttcatggttaaaatgtagagctaaca

SEQ ID NO: 17779 - DNA, 103 bp, Homo sapiens
ggctgagtttcatttctccacttactggacccaccctttgagttccttatagttacttaatatttattgagtgtttggtatccagtggctttgcgcactagtc

SEQ ID NO: 17780 - DNA, 91 bp, Homo sapiens
tgatcacttgggtctctgttacacttttgtaatttttgcaatccttcaagtttttcattattattatatctgttatggggatctgtgatca

SEQ ID NO: 17781 - DNA, 108 bp, Homo sapiens
ggtggacacagtacagtcttggagatggcttgaaattttgtttttttttttcttttttggagatggagtctcgctctgtcacccaggctggaatgcagtgtcacaatc

SEQ ID NO: 17782 - DNA, 114 bp, Homo sapiens
tgggaacccagggactgaatgaaaagcaaatcggagagagacatgagagtgtgcacatacttggtgcaattcataagttttctcagtttaacctgcatcagttttgacctaagt

SEQ ID NO: 17783 - DNA, 84 bp, Homo sapiens
ctgggcaacaagagggaaactctgtctctcaatcaatcaatcaatcaatcaatcactctaaagattcggaggctccttccctag

SEQ ID NO: 17784 - DNA, 102 bp, Homo sapiens
gtgctctctttcaacaacctatccctgggttctgtcagtgggcaggtctgtctgtctgtcggcctacctgtatatgttccttaggtacatgttagtgatcat

SEQ ID NO: 17785 - DNA, 58 bp, Homo sapiens
tgagacagagtctcgctctgtcactcaggctggagtgcaatggcgtgatctcggctca

SEQ ID NO: 17786 - DNA, 115 bp, Homo sapiens
tgaaggcccttctatttgacgcttttattgacctcttataaagccctgtggtatgaggatgttttctgccatttcacaggacagagaggttcagatggtataggaggctgactca

SEQ ID NO: 17787 - DNA, 111 bp, Homo sapiens
gcatatatattatatatatatataaaatatataatattatatatataatatacatatatgtaaatgtatatgtatatattatatataatatatacatatatattatatata

SEQ ID NO: 17788 - DNA, 64 bp, Homo sapiens
ggacttcagtgtggagaaggagggaggaggaaactccatcactctcactcacaatagaaggacc

SEQ ID NO: 17789 - DNA, 95 bp, Homo sapiens; identical to SEQ ID NO: 68

SEQ ID NO: 17790 - DNA, 93 bp, Homo sapiens; identical to SEQ ID NO: 69

SEQ ID NO: 17791 - DNA, 73 bp, Homo sapiens
acccgccctgcctcgaagtccccttccctgctgtgaccaggtcaggtagaaggtggaataggagtgggcaggt

SEQ ID NO: 17792 - DNA, 81 bp, Homo sapiens
gggagttaattactatattctgtgaggttctggaatgaaaagatgattttcatagtccttggccttaggatagactaaccc

SEQ ID NO: 17793 - DNA, 105 bp, Homo sapiens
gcttttagcctcatgcatgcatatctttgtcagtatttttacttttgattctggcgtggtttggggaggaagaggagaaagatatgcatgttcagtgtgccatgc

SEQ ID NO: 17794 - DNA, 58 bp, Homo sapiens; identical to SEQ ID NO: 1409

SEQ ID NO: 17795 - DNA, 113 bp, Homo sapiens
gcttctctctctttcttttgtgtaaggctctgcatgacattccaattggtactttaaatatttttaaatgaaccacttttatgcaaaagttctaacacacaagaatgggatgc

SEQ ID NO: 17796 - DNA, 78 bp, Homo sapiens
gaggtaactctctccctctcagcgaggttgtcatcagcagaggcctggggtgggggtaggggagggttctaaaatctc

SEQ ID NO: 17797 - DNA, 115 bp, Homo sapiens
ttacatttagctcatgattccaaggtgtgatatatatatatacatatatatatacatatatatgtatatatatatgtatatatatatatatatggaagttcaatgctttctgtaa

SEQ ID NO: 17798 - DNA, 66 bp, Homo sapiens
gaagaggtttgtgcatgtgtgtatgtatgtatgcatgtatgtatgtatgtgcatgtaaaactgatc

SEQ ID NO: 17799 - DNA, 139 bp, Homo sapiens
atatatatatatatatatacacacacacacacatacacacaaatatatatgtgtatatgtgtatatatatgtgtatatatacacatatgtgtgtatatatgggtgtgtgtatatatgtgtgtgtatatatacatatata

SEQ ID NO: 17800 - DNA, 68 bp, Homo sapiens
atcaccctctctcacactctaggagggtttcctgcttgccttgtggaagaatgggaggaaaaggggat

SEQ ID NO: 17801 - DNA, 92 bp, Homo sapiens
atataaatatataatatatatatataatctgtagctataaatatatatatatctgtagctaaagattttatttacgtagaatatacctatat

SEQ ID NO: 17802 - DNA, 86 bp, Homo sapiens
taggtatattctacgtaaataaaatctttagctacagatatatatatatttatagctacagattatatatatatattatatattta

SEQ ID NO: 17803 - DNA, 159 bp, Homo sapiens
gagtatgtgtgcttgtgtgtgtatgtatatgtgtatatatacatccatattctagctatgtatttgtttatatatatatgcccatgttctaattatgtatatatgtatgcatatcatatacataatacatacaaatatatgtacacatgcccaaattgc

SEQ ID NO: 17804 - DNA, 89 bp, Homo sapiens
gctgcattgttactaagtgccagtctgtgtctctcaaccactggaggagggatgttcgattcagaagccacttaagctgcaagtcaggc

SEQ ID NO: 17805 - DNA, 100 bp, Homo sapiens
cacttcccccatggtgcggttttctttgcactagactgaagaaagagagttttaagttgcttcttctgcaagggcaagaagtcgcatggattggggagtg

SEQ ID NO: 17806 - DNA, 86 bp, Homo sapiens
ctgggattacaggtgtgagccactgtgcccagcctatttttatttttttatttattttggacacagggtctcattctgtcacccag

SEQ ID NO: 17807 - DNA, 106 bp, Homo sapiens
gctgttataccgtgtgtgtctgtgttttaaacattgtttatttgagacagggtctcactctgtcaccaggctacagtgcagaggcacagtcacagctcattgcagc

SEQ ID NO: 17808 - DNA, 87 bp, Homo sapiens
attttgatctacaacctttttggagggtgattcagcagtaggttcatactcctgaatcactcaccttgtaggatgttttcttgaggt

SEQ ID NO: 17809 - DNA, 75 bp, Homo sapiens
tatttgcgtatgtatgtgtgtatatatgtgtatatgtgtaatatacacatatatatctattttaaaatgagagtg

SEQ ID NO: 17810 - DNA, 85 bp, Homo sapiens
atgcatatgtatgtttatatatgtgtataaatatctctctctatatatgtatacatcttatatatacgtcacagtttttatgcat

SEQ ID NO: 17811 - DNA, 146 bp, Homo sapiens
atatatatatatatatatataatatatgtatgtgtatatatatatatatatatatatgtatgtgtatatatatgtatgtgtatatatatacgtatgtgtatatatatatgtatgtgtatatatatacgtatgtgtatatatatata

SEQ ID NO: 17812 - DNA, 91 bp, Homo sapiens
ctggttgtcctcttgtgatgtcagcagtagttctgatcttgatttttttttttttttttgatacagagtctcgctctgtcactgaggctgg

SEQ ID NO: 17813 - DNA, 58 bp, Homo sapiens
tgagacaggatctcgctctgtcactcaggctggagtgccatggtgtgatcttggctca

SEQ ID NO: 17814 - DNA, 58 bp, Homo sapiens
tgagacagagtctcgctctgtcacccaggctggagtgcagtggtgcgaactcggctca

SEQ ID NO: 17815 - DNA, 95 bp, Homo sapiens
ggtttggagtcagagttctgggaatggaatctggatgtctctcttactgtctgtgtgagcttgggctggtagatccacctctctgagcctcagcc

SEQ ID NO: 17816 - DNA, 131 bp, Homo sapiens
gtgtgtgtgtgtatatatatattctcatgtatatgtatatgtgaatatatatgtgtatatatgagtatatgtgtatatatatgagtgtgtatatatatgagtatgtacgtgtgtgtatatatatgtatata

SEQ ID NO: 17817 - DNA, 93 bp, Homo sapiens
ttggaattgtattcgaagatgtcagaccctctctggcacagatagccatcgtcgtcaattttgtactgcacatccccgagtctggttatccga

SEQ ID NO: 17818 - DNA, 85 bp, Homo sapiens
ttcaggggatctggggtgcagcccgggattctgctttttttttttttcgtttttgagacagtctcgctctgtcacccaggctgga

SEQ ID NO: 17819 - DNA, 109 bp, Homo sapiens
gtggaagcagtcgggagtcctagagatgctgtctgtgctcactctgtcaccccatcatggggcttccagagagcctttgagctctaaggcacccagcttgcagtaccat

SEQ ID NO: 17820 - DNA, 74 bp, Homo sapiens
ggatgtagagctagagctgccaattgtttgaaaattttttttttgttttgaaacagggtctcactctgtcatcc

SEQ ID NO: 17821 - DNA, 86 bp, Homo sapiens
ccagagagattaagaagcttgtatagttgaacagctggggagcatcaaaaccagagttcaaggcccagtctgtttggttccaaggc

SEQ ID NO: 17822 - DNA, 136 bp, Homo sapiens
ccgtgcctggcctactgagcattattttatttttaaattttatttatttatttttttagagacagagtctcgctctgtcacccaggctggagtgcagcggcatgatctcggctcactgcaacctctgcctcatggg

SEQ ID NO: 17823 - DNA, 58 bp, Homo sapiens; identical to SEQ ID NO: 637

SEQ ID NO: 17824 - DNA, 110 bp, Homo sapiens
tcttggaagttttcttactgccctcggcttctttacagtgctgccttgttgcatatggatcaagcagcattgtacagggctatgaaggcattgagacctgttcttcatga

SEQ ID NO: 17825 - DNA, 88 bp, Homo sapiens
gatgaacctttgggatgagtcttaaatttgttttgcttgatgcttggtagaatttttcaatttgaatactcattcaattctgggaatc

SEQ ID NO: 17826 - DNA, 71 bp, Homo sapiens
ccatgttggccaggctgggatatgtctatgtatttatgatgtatgtatatatatatgtgtggtccaagtgg

SEQ ID NO: 17827 - DNA, 123 bp, Homo sapiens
gacaagctctggtttaggaagagagctgtggcagcataaaggcctgaaagaggagacagagctgtcacccaaaatggacttgagagctccctgtggtttactctgtggctagaaaacactgcc

SEQ ID NO: 17828 - DNA, 71 bp, Homo sapiens
cagcctcttgggatagggtttatcttttttttttttttttttgaggtggagtctctctgtcacccaggctg

SEQ ID NO: 17829 - DNA, 112 bp, Homo sapiens
gccacttgtttgaactttgttctcaagattctgaacatcatgtcaattttagaagaatgtgaacagagattttgatcttgaggaaagtgttgagcccaggcaggtctagggt

SEQ ID NO: 17830 - DNA, 118 bp, Homo sapiens
agggagttggaagaaagattggctttttaaaatcaggaattacattatctgcaactgcatttgaacatttgtatattctttcctcatttctgaggggtttcattcttttaattaaact

SEQ ID NO: 17831 - DNA, 85 bp, Homo sapiens
ttcggggttggagtccaggctctgacactcagtagctgtgtgaagcggggcaagttacttcatgggtcagagctggttccctgaa

SEQ ID NO: 17832 - DNA, 82 bp, Homo sapiens
ggttttagcagaagggagcacaggctcgttcaggccttggcaacttactagtctcagtctctctccatgtaaaatgggaatc

SEQ ID NO: 17833 - DNA, 62 bp, Homo sapiens
atctatgtgtaattattgtataattatactttatgtgtattgtatagtagatacacacagat

SEQ ID NO: 17834 - DNA, 97 bp, Homo sapiens
gctcgttgtggatgaggttttttaaagatggaaagaaagaaacactgctctaacacaacagtgtttgatcatctctagtgtagcttacacaacctgt

SEQ ID NO: 17835 - DNA, 115 bp, Homo sapiens
cctctgatggtaggaagtatggttgtctccattctaagactcagagaagttagtgaccagcctaaccttacccagtacctggtgcagcccatatccatacacagtctaactctgg

SEQ ID NO: 17836 - DNA, 101 bp, Homo sapiens
gccaagcctctctctggcactgctaatgctgggggtaagtgaaaaaacagagtagagtgtgtggtctatacaaacaggtaggttcaagcctgcagcagagc

SEQ ID NO: 17837 - DNA, 58 bp, Homo sapiens; identical to SEQ ID NO: 10128

SEQ ID NO: 17838 - DNA, 118 bp, Homo sapiens
gccgttgcagagagggcaaaggcttgtggggtagtagtaggtggtcagggcagtcagaacagactgtgcggcaccacagcccatgttacagagctcggtcttcacccactggatgtgc

SEQ ID NO: 17839 - DNA, 72 bp, Homo sapiens
gttcttaagctctgggaatgtgacataccggggtaggtgtcattacagcccctcacactctgagtctgaaac

SEQ ID NO: 17840 - DNA, 58 bp, Homo sapiens; identical to SEQ ID NO: 2595

SEQ ID NO: 17841 - DNA, 118 bp, Homo sapiens
gggagtccatcatattattctctctactttttatgtgttttaaattttccataataaacagttttaaaatatatatataagagtattgacatacctatgaatgcaagatcggattaac

SEQ ID NO: 17842 - DNA, 107 bp, Homo sapiens
gtctggatgacagggcaagactccatcttgcgcggggggggggggagtggggatttttttttttttttttttgtgagacagagtctcactctgtcgcccaggctaga

SEQ ID NO: 17843 - DNA, 103 bp, Homo sapiens
ttcagagaaaacagaatttgagcttgtaggtagaattgtattctgctttcctagaaaatattctttctatttatacctcaataacaatctatgctttactgga

SEQ ID NO: 17844 - DNA, 116 bp, Homo sapiens
tatctctctcacagttgagtgagatacatacatatatatctctctcacagttgagtgagatacatatatatatatgtatctcacagttgagtgagatacatatatatatatctcac

SEQ ID NO: 17845 - DNA, 168 bp, Homo sapiens
gtatctcactcaactgtgagagagatatatatgtatgtatctcactcaactgtgagagagatatatatatatctcactcaactgtgagatatatatatatatatctcactcaactgtgagagagatacatatatatatatctaactcaactgtgagatatatatatat

SEQ ID NO: 17846 - DNA, 191 bp, Homo sapiens
atatacatatatatgtatgtgtatatatatatatatatatatgcatatatgtatgtgtatatatatatgcatatatgtatgtgtatatatatgcatatatgtatgtgtatatatatgcatatatgtatgtatgtatgtgtatatatatatgcatatatgtatgtatgtatatatatgtatgcatatatata

SEQ ID NO: 17847 - DNA, 82 bp, Homo sapiens
agcatatctatatatgtttatatataaatatcagcatatctatatatgtttatatataagtatcagcatatctatatatgtt

SEQ ID NO: 17848 - DNA, 108 bp, Homo sapiens
agtgggagaacttatatatgtgtgtgtatatttatatgtatatacacatgtttatatgtatatacacatgtttatatgtatatacacacacatatgtatgtgcttgct

SEQ ID NO: 17849 - DNA, 65 bp, Homo sapiens
gaggggagtcagagagcagacaggaggagaaaccgagcatccattctctctaactgactctcctc

SEQ ID NO: 17850 - DNA, 90 bp, Homo sapiens
ctttctgagcagagagtgagcacagagcacacatgtccaagtgggacatttattccttgccataaaaatcaccctcagaggttcagaaag

SEQ ID NO: 17851 - DNA, 84 bp, Homo sapiens
atatatatgtatatgcatatatatgtatgtatgtgtgtgagcatatatatgtgtgcatatgtatatatacatatatatatagta

SEQ ID NO: 17852 - DNA, 58 bp, Homo sapiens
tgagacacagtctcactctgtcacccaggctggagtgcagtggtgcgatctcggctca

SEQ ID NO: 17853 - DNA, 67 bp, Homo sapiens
tgtttgagacagagtctcgcactgtcacccaggctggagtgcagtggcgcgatctctgctcactgca

SEQ ID NO: 17854 - DNA, 92 bp, Homo sapiens
gcatatatctgtatgtatatatatgtgtgtgtgtatatatatatatgtgtgtgtatatatgtacatatatgtgtgtatatatgtgtgtgtgt

SEQ ID NO: 17855 - DNA, 94 bp, Homo sapiens
gataacaaaagattgtaacaagggctatgggagttatgagccaggaaccatgggtgaaaacctctctgtctgtctgtctgtctgtctgtctgtc

SEQ ID NO: 17856 - DNA, 98 bp, Homo sapiens
ggtggaatgaaaaagtgaatgaatgaatgaatgaatgaatggatgagtgactatgccagatcccccagttctttgcagtgttttgctggaattctgcc

SEQ ID NO: 17857 - DNA, 117 bp, Homo sapiens
ctgactcacactccagtcttattctaaagcccaaactctctctctctcttttttttttttttttgagatagagtcttgctctgtcacccaggctggagtataatggtgtaatctcgg

SEQ ID NO: 17858 - DNA, 75 bp, Homo sapiens
ccactctctgaggttgatccaattttggtgctcctggtctctccagggagagttgagagtgaccttaagcagtgg

SEQ ID NO: 17859 - DNA, 83 bp, Homo sapiens
agttgattttcacttggcattggaggcttttagagggaggatcccagactccccctctctgtcagtgctaatgaaactggact

SEQ ID NO: 17860 - DNA, 78 bp, Homo sapiens
tgcagcccagcatctctctgactgacactggcacccaggacaggcagggggaagctagcagaggggagggtgtttgca

SEQ ID NO: 17861 - DNA, 119 bp, Homo sapiens
gtgtcctaggctccttggatgatcagccaggtttggaagcactgatatgtagagatgtatgacagatgtgtgtttggacagaggaaattaggggccattttaggcagtatgggtggcac

SEQ ID NO: 17862 - DNA, 96 bp, Homo sapiens
gccattgttgttgttgttatttaccagctcctctctgtcactctgtcacaaggaaagagagcccccagggtttgagtaggcagcgatgcaagtggc

SEQ ID NO: 17863 - DNA, 73 bp, Homo sapiens
gggagacattctggatagtaaacaaatctgtactttgctctggagaaagacactgtatctgtctctgtcttcc

SEQ ID NO: 17864 - DNA, 127 bp, Homo sapiens
ctgggattacaggtgtgagccactgtgcccagcctattatattttgagcaagagtctcactctgtcacccaggctggatggagtgcagtggcacaatcttggctcactgcaacctttgtctctgggt

SEQ ID NO: 17865 - DNA, 121 bp, Homo sapiens
attctgctcctacacagaaacagggctcatggaataggaatgatttttctttgtttttgtttttggagatggagtctcactctgtcacccaggctggagtgcagtggtgccctctctactc

SEQ ID NO: 17866 - DNA, 92 bp, Homo sapiens
gtcaggaaggcagacagcacctgctgttggtgccaaggttactggacaggctgcgagggctctgtctgtctgtccgatgttcacaggccagc

SEQ ID NO: 17867 - DNA, 87 bp, Homo sapiens
ttgagacggagtctcactctgtcacccaggctggagtgcagtggcacaacatctgcctcccaggttcaagtgattctcctgcctcag

SEQ ID NO: 17868 - DNA, 91 bp, Homo sapiens
tcatgcatttggaggatacacaggtgacagagagcaatcgatgatcataatagccatcgtttattgaacacctgctgtataccaggcatgg

SEQ ID NO: 17869 - DNA, 81 bp, Homo sapiens
ataggcagtggaaagggagtgaatcactttaaaaggacggaagtgctgtgtagaatatattttctttcaataagtgcttgt

SEQ ID NO: 17870 - DNA, 86 bp, Homo sapiens
catgtgagctgagtcctcagtgaagagacaaggcagtcatgcagagtgagtgggggtaagtggagggtgaggaaacactgcaggtg

SEQ ID NO: 17871 - DNA, 58 bp, Homo sapiens; identical to SEQ ID NO: 6359

SEQ ID NO: 17872 - DNA, 100 bp, Homo sapiens
tgcttggtattatcagtctttttaattgtggccattctgtgcaattgtatttcattatagttataatttgcatttctttgaagaccagtgatatagagca

SEQ ID NO: 17873 - DNA, 72 bp, Homo sapiens
caggattggaatggtgtcaggatgacatgtgagtttcatggtcggtcagactgacttcagactccagctctg

SEQ ID NO: 17874 - DNA, 97 bp, Homo sapiens
gctatcttacattttgcctggtacagggtgtgctcaatatgtattttttttttttagatggtgtctcgctctgtcattcaggctggagtgcagtggc

SEQ ID NO: 17875 - DNA, 114 bp, Homo sapiens
tgctctagtctccaggacagaatttggttcaatatttctgtactcaatgaatatatttattaactctacaaatgtttattagattctttttatgtggagtcactatgttaggca

SEQ ID NO: 17876 - DNA, 80 bp, Homo sapiens
tgaagaagtccctcacatcccttgctgtattcctcagtattttattttctttgtagcaattgtgaatgggagttcattca

SEQ ID NO: 17877 - DNA, 90 bp, Homo sapiens
ggttggggaagttttcctggatgatatcctgaagtgtgttttccaacttggttccactctctttgtctctttcaggtacttcaatcagtc

SEQ ID NO: 17878 - DNA, 135 bp, Homo sapiens
tccagctttgttctttttgcttaggattgtcttggctatatgggctcttttttggttccatatgaaatttaaagtagttttttctaattctgtgaagaaagtcagtggtagcttgatgaggatagctttgaatct

SEQ ID NO: 17879 - DNA, 96 bp, Homo sapiens
cacaccattagactccagcctgagtgacagagagagaccccaaaacaatatatatataatttttctctctgctacttgccagatggtgtgccagtg

SEQ ID NO: 17880 - DNA, 238 bp, Homo sapiens
agtatatatatatatctatatatatatatatatatgctcagtgtgtatatatatatatgtatatatatgctcagtctgtgtatatatatatatgctcagtctgtgtatatatatatatgctcagtctgtgtgtatatatatatatatatatatatatatgctcagtgtatatatatatatatatatatatgctcagtgtatatatatatatatatatatatatatatatatacactga

SEQ ID NO: 17881 - DNA, 83 bp, Homo sapiens
cagagactatatgcagttctcattatgatgttttcttaaatcctaactgataaacttaaatgagaggcatttggtacaatctg

SEQ ID NO: 17882 - DNA, 99 bp, Homo sapiens
ggtagattacatttattgatttgtatatgtggaaccagccttgtatccgagggatgaagctgacttgatcgtggtggataagttttttgatgtgctgct

SEQ ID NO: 17883 - DNA, 95 bp, Homo sapiens; identical to SEQ ID NO: 68

SEQ ID NO: 17884 - DNA, 93 bp, Homo sapiens; identical to SEQ ID NO: 69

SEQ ID NO: 17885 - DNA, 58 bp, Homo sapiens; identical to SEQ ID NO: 87

SEQ ID NO: 17886 - DNA, 56 bp, Homo sapiens; identical to SEQ ID NO: 88

SEQ ID NO: 17887 - DNA, 90 bp, Homo sapiens
cttacaacttcatattcaagtatgtagtcatatatttagtgttccaaatgtatatatgattattttatgaataataattgaagctgttag

SEQ ID NO: 17888 - DNA, 81 bp, Homo sapiens
tctgactccttggctttgcagtgtttctattaaagtaggctttttgttctatttttattaggtacacttacaagtttcagg

SEQ ID NO: 17889 - DNA, 94 bp, Homo sapiens
gtgagtatacagagcaactggaatcctcatatactgttggtgacagcaaaatgctgtcactgtcactctgggaaacagtttgttagtttcttat

SEQ ID NO: 17890 - DNA, 111 bp, Homo sapiens
aaactctaactgaggccattcaaaagaaagagactggggaaacactgtctcttactcacagctctttctccgcatctctgtttttatgtctgactctgtctctgagagttt

SEQ ID NO: 17891 - DNA, 98 bp, Homo sapiens
agtatgaaatgggatgcaggtgttctgactcaagagagagaagaaacctgataaatgccgggtgtctactatgtgtcgagcactgtattctgggtcat

SEQ ID NO: 17892 - DNA, 64 bp, Homo sapiens
ggtggagatgaggaagggtttgttgaatccagagatgggtgagacagagtctcactctgtcact

SEQ ID NO: 17893 - DNA, 127 bp, Homo sapiens
atgctgtgattacaggtgtgagccaccacacctggctgtggctgaccctttcaagtgaccacagtgtggactcagggagatgagttccaagagggctggacatgggcttaagtgggatgccacggct

SEQ ID NO: 17894 - DNA, 80 bp, Homo sapiens
ctaaatgtaaggtggtggggcggggggagccaatagacttttttgaaagagatggaccctcactttgtcactcagtctgg

SEQ ID NO: 17895 - DNA, 129 bp, Homo sapiens
gccactgacctcgcctcactgatacccaggcgggtaaatcaaagctcagagagagaggtcagtgagcccaggacagagccaggattggaacccaggtattcagggattccactctgtggcccacagggg

SEQ ID NO: 17896 - DNA, 97 bp, Homo sapiens
gctgacagagctgctggctgctctccaggcgtcttcccccagtgaagaaccatcctcactacagacagcactgagaggtcacaccgagtcagccctc

SEQ ID NO: 17897 - DNA, 64 bp, Homo sapiens
gaaaccttctttgcctctctctggctgtggtcgcagcccagccctgggtggtcctgagggtttc

SEQ ID NO: 17898 - DNA, 113 bp, Homo sapiens
tgttctaaggctgccttctcagcgcctggtgcatagtaatgttgaattcaaagaatgaatgaatgaatgaatgaatgaatgaatgaatgtgcaaggccctagctctcagtgca

SEQ ID NO: 17899 - DNA, 105 bp, Homo sapiens
ggtgtgaatcttattttctctcactcatcactgctcatgtattcattctccatgaatatttatttgatttagatgaacttaattgagtatgagatggattctact

SEQ ID NO: 17900 - DNA, 129 bp, Homo sapiens
ttggtagtgattggctcaggagtggtcatgtggcccagttctggccaatgagatatgaggggaatttactgtgggccttttgggagagtttcctctttcctaagagacagccacaggaagcaaggatct

SEQ ID NO: 17901 - DNA, 67 bp, Homo sapiens
cctaccagagagaacagactgtggacgtgtgaactcatagtttggcatagctggaggctatggtggg

SEQ ID NO: 17902 - DNA, 65 bp, Homo sapiens
agagtaggaagatgggaggttctctgatcattggcaagactctgaatctctctggatcttagtct

SEQ ID NO: 17903 - DNA, 88 bp, Homo sapiens
gcttaagtctctctctctcacttacgtccctcgctggttctcattttgttttagtcatggatgaagtttggtgggtcatggctttagc

SEQ ID NO: 17904 - DNA, 82 bp, Homo sapiens
gtcagctgtggccgggaggtggggtcaatgtggtacaaacctgagctgggcagactggccctctctctgtctcagctcagac

SEQ ID NO: 17905 - DNA, 82 bp, Homo sapiens
aggactggctctgtgggtcactctgctcccaggtgggaaaaagaggtatcgggtagcgacagtgataaacacagtcgatcct

SEQ ID NO: 17906 - DNA, 58 bp, Homo sapiens
tgagatggagtctcactctgtcacccaggctggagtgcagtggcaggacctcagctca

SEQ ID NO: 17907 - DNA, 117 bp, Homo sapiens
ccaaagacttgagtggggacagatttaggaacagcttaaacttgatgttctggtgagatctcagtgtgtacaacttaagctgtctctacccttcaccaccaccttcagatccagtgg

SEQ ID NO: 17908 - DNA, 112 bp, Homo sapiens
ggttatcatatcctgtaagacctgcctgccttactgatgcttatgaatttttattttttgttttcttgagctgtcttgtagtgagagtagtgtgtatagtgtatttatatcc

SEQ ID NO: 17909 - DNA, 59 bp, Homo sapiens
tgagaccgagtctcactctgtcacccaggctggccatgcagtggtgcgatttcggctca

SEQ ID NO: 17910 - DNA, 56 bp, Homo sapiens
gagagagagtctcgctctgtcacccaggctggagtgcaatggcgtgatctcagctc

SEQ ID NO: 17911 - DNA, 80 bp, Homo sapiens
tgtctctttatttatttatgagcatgctcattcgataaacctgttgagtgcttcctgctccagataacgtgccagggata

SEQ ID NO: 17912 - DNA, 58 bp, Homo sapiens; identical to SEQ ID NO: 3270

SEQ ID NO: 17913 - DNA, 58 bp, Homo sapiens; identical to SEQ ID NO: 87

SEQ ID NO: 17914 - DNA, 56 bp, Homo sapiens; identical to SEQ ID NO: 88

SEQ ID NO: 17915 - DNA, 73 bp, Homo sapiens
ccgggtgcggtggcatgcacctcgtggtcccagttacttgggaggctgaggtagaaggatcacttgtacctgg

SEQ ID NO: 17916 - DNA, 75 bp, Homo sapiens
gacagagtgagaccctatctcaaaaagtttcctgtttttgtttttttttttttgagacggagtttcactcttgtt

SEQ ID NO: 17917 - DNA, 113 bp, Homo sapiens
gagctgccctagcgtagggctttgtccccgtcctgggtttgggggctggtgagagagcacacaccctgggtcacagagccagctctgctgctagagaaactcacaaggcattc

SEQ ID NO: 17918 - DNA, 76 bp, Homo sapiens
gattatagatgctaatcaggtctcactctgtcacccagcctggagtccagtggcatgatgatagctcactatagtc

SEQ ID NO: 17919 - DNA, 83 bp, Homo sapiens
aggtggctgtttcacactctgtcacaatggaggtagcagtttccttttgagggactggaaatgtgacctacttccttgtaaca

SEQ ID NO: 17920 - DNA, 68 bp, Homo sapiens
cagaatagagagtccataaataaacctacacttttgtgtttttttttttgagatggagtctcactctg

SEQ ID NO: 17921 - DNA, 58 bp, Homo sapiens
tgagacagggtctcactctgtcacccaggctggagtgcagtggtgcgatcatggctca

SEQ ID NO: 17922 - DNA, 112 bp, Homo sapiens
cctgtggtgtcagggcagggtcctgaagcctgagggtccagggttgagtcccagcttgggcacttaccaggtgtgaccttgggctggtcacgtgacctgtctgtgctgcagg

SEQ ID NO: 17923 - DNA, 87 bp, Homo sapiens
gaaatcagagtctaagatgtttagccaaactgttctctgtctgtgtgactgtggccaagctatgtacactctctgggcttcagtttc

SEQ ID NO: 17924 - DNA, 75 bp, Homo sapiens
tggactagcagggcaggtccaaccttccactgcccctgatggaatctctttgggcctcaggtaccctgcagtcca

SEQ ID NO: 17925 - DNA, 99 bp, Homo sapiens
gcttttattcatagtcaatgactcagtcattctggatctagatagaattgtctacactcactgtctcattcttcagcttgactcagcatgacttctggc

SEQ ID NO: 17926 - DNA, 59 bp, Homo sapiens
ggaggatgaaaggagaaaagcaggtgcttaggaggtattggctctctctctgtctctcc

SEQ ID NO: 17927 - DNA, 57 bp, Homo sapiens
ggggtaatgagtgagttcttttttttttttttgagacagagtctcgctctgtcaccc

SEQ ID NO: 17928 - DNA, 77 bp, Homo sapiens
gcctgggggatggagtgagatcatgtctctaaatatttttttttttttgagacagagtctcactctgtcgcccaggc

SEQ ID NO: 17929 - DNA, 58 bp, Homo sapiens
tgagacagagtctcactctgtcgcccaggttggagtgcagtggtgtgatctcggctca

SEQ ID NO: 17930 - DNA, 74 bp, Homo sapiens
ctgggtcataagatgtgagtgttctattttctttttcatttttttttgagacggagtctcactctgtcacccag

SEQ ID NO: 17931 - DNA, 111 bp, Homo sapiens
gccaggtgtggtgatgtgcgtctgtggtcccagcttcttgggaggctgaggtggaaggatctcttgagcccaggaggtggaggcttcagtgagccatgttcatgccattgc

SEQ ID NO: 17932 - DNA, 106 bp, Homo sapiens
atgccagtgagtacaagggcctgcttgtgtagggcctgcggtagaggcttactggtgttcttttttttttttttgagacggagtctcgctctgtcgcccagactgg

SEQ ID NO: 17933 - DNA, 94 bp, Homo sapiens
tatatgagtgtatgtgtgtgtgtatatatataatatatattacatatgtgcgtatatgtatttatatgtcatatatacatacacgtatcatata

SEQ ID NO: 17934 - DNA, 56 bp, Homo sapiens
gagtcagagagtctcactgtcacccaggctggagtgcagtggctccatcatagctc

SEQ ID NO: 17935 - DNA, 73 bp, Homo sapiens
taggtgacagagcctgaccctgtctctaatcaataaataatatttttttcagacagtctcgctctctcacctg

SEQ ID NO: 17936 - DNA, 92 bp, Homo sapiens
tggcttttttgttttgttttatcttgtcagtgctgagctgaacatacactggtagtatcagcaactctaactgatagcaaaccaggaagcta

SEQ ID NO: 17937 - DNA, 68 bp, Homo sapiens
tgagacgctcactctgtctccaaaaaaaaaaaaaaaaaaaaaaaaattttgtagagacagaggtctca

SEQ ID NO: 17938 - DNA, 69 bp, Homo sapiens
atatatactgcatatacacacgcagtacatatatatatatatgcagtgtgtgtgtgtgtgtgtgtatat

SEQ ID NO: 17939 - DNA, 101 bp, Homo sapiens
tgcaggagcccctaatgtgtagggttttttaaagactttttattttgaaataattatagattcataggaagttggaaaaatagtacataggagtccgtgta

SEQ ID NO: 17940 - DNA, 133 bp, Homo sapiens
aggaatcggagctgcctgtgattctctgaagttcccacccaaattcataactactcacagagcacagacagctgagcattgtctgcccccttgaaagggccgcctttgaagccggcagtggggcactgaacag

SEQ ID NO: 17941 - DNA, 88 bp, Homo sapiens
cctgctcttctatctcagggtctctgtgtgtttgctgtgatccaatggctgaggcacaagccaggcagccctggggaccccgggcagg

SEQ ID NO: 17942 - DNA, 110 bp, Homo sapiens
gggtctggtaggaagttgagaaatcggtttatggtagacagaacagagagacaagcagataatctctgtttttaaatctcctttggatttacgaatctttttaaagatct

SEQ ID NO: 17943 - DNA, 85 bp, Homo sapiens
gataatctcaaaagtactgactttttttttttgggcagtctctctctctgttgcccaggttggagtgcagttgctcgatcttgtc

SEQ ID NO: 17944 - DNA, 56 bp, Homo sapiens
tgacagggtctcactctgtctcccaggctggagtgcagtggtgtgatcacggctca

SEQ ID NO: 17945 - DNA, 95 bp, Homo sapiens; identical to SEQ ID NO: 68

SEQ ID NO: 17946 - DNA, 93 bp, Homo sapiens; identical to SEQ ID NO: 69

SEQ ID NO: 17947 - DNA, 128 bp, Homo sapiens
gtgtatgtatctcatatatgtatatgtgtatatatatcatatgtatatatatcatatacacacacagacacacacacatatcttggagtggaatttctgtgtcatagagtatatgtatatgtatatat

SEQ ID NO: 17948 - DNA, 96 bp, Homo sapiens
tgcatatttgaacagttttgttgaagtataatcagtgcataataaactatgtatatatgaaatgtatactttgataagctttggcacatgtataca

SEQ ID NO: 17949 - DNA, 150 bp, Homo sapiens
ctcagcttgagaaacaggaagaattgctgttgctcccgtctgctatttatgtttttcttttttttttttttgagactgagtctcactctgtcacccaggctggagtgcagtggtgcgatcttggctcactgaaagcttcatctcccaggt

SEQ ID NO: 17950 - DNA, 83 bp, Homo sapiens
tgagagccagtgaagtgtgtgtgcacataaagcacagaattccctaggatgcggccgggcacaggcatgttattggggactca

SEQ ID NO: 17951 - DNA, 106 bp, Homo sapiens
atggaatcactgggtctagcttgttctctaaccacatgatcttgagcaagtcgcacacactctctgagcctcagttgggggcagctacgacattggggggtcccat

SEQ ID NO: 17952 - DNA, 61 bp, Homo sapiens
cctctgtgtgtgtctgtgtcctaatttcctcttcttgtaaggacaccattcataccagagg

SEQ ID NO: 17953 - DNA, 103 bp, Homo sapiens
atctagccctgggaaaccagctctggcaggatggaggcagggtgtctagccagacgctcagtctctgttacagtcagagtggaggtcctggtctgatactacc

SEQ ID NO: 17954 - DNA, 128 bp, Homo sapiens
ggtgtgagtatctcattgtggtttagatttgcatttctctgatgattagtgatgtagaatatttttttctgtttattggccacttgtatgtcttcttttgagaagtgtctggttatgtcttttgccca

SEQ ID NO: 17955 - DNA, 83 bp, Homo sapiens
ggaaaaggaaggtgtgttttatcttcaaatgtctttatatttttgataggacacttggaggaaatcaggctttttgagaattc

SEQ ID NO: 17956 - DNA, 77 bp, Homo sapiens
tcacctgacccatctgcagtgagtggcgtttcctccaggaccctgactgacacactcaatcaagaccacgcagctga

SEQ ID NO: 17957 - DNA, 118 bp, Homo sapiens
aggagcagaggtaggagcagcacttctagttaggcaatcaacaactgcaaatgtatgtgtatgtatatatttgtgtgcattagaaatttttaatggtgctcactgaagactcctctgc

SEQ ID NO: 17958 - DNA, 119 bp, Homo sapiens
gtggtgtgttggtgtctgtgacacagaatggaagagaaactggaactgcaatgaacgcagactttttttttttttttttttcatttccactgaccaataaacagaactacaggtgcacc

SEQ ID NO: 17959 - DNA, 90 bp, Homo sapiens
ggtaaaactttatttttttttgtctttttcttgtggaaaggactatcctagtcctctgaagatcacagtctgaaatattagagttttgtc

SEQ ID NO: 17960 - DNA, 58 bp, Homo sapiens
tgagacagagtctcactctgtcacccaggctggagtgcagacgtgtgaccttggctca

SEQ ID NO: 17961 - DNA, 86 bp, Homo sapiens
aacacaggaacagtagacactgaggactctagaggcgggagggaggaagggagcatgggtcaacagtacctattgagtcctgtgtt

SEQ ID NO: 17962 - DNA, 80 bp, Homo sapiens
ccacaacctgatgctgcagatgctgccatcacccccattctacaggtgagagaagagtctcagaaatttcatgagttggg

SEQ ID NO: 17963 - DNA, 69 bp, Homo sapiens
tccgcctgtctctgtctcacccacggtggtgcatccagcagtggagagttagggcccagtgaagaagga

SEQ ID NO: 17964 - DNA, 106 bp, Homo sapiens
caagtcccaaggctgagagacagggcagctgatggtgtcactcacagtctgagacctgagaaactggggggctgccagtgcagctctcagagtctgaaggctggag

SEQ ID NO: 17965 - DNA, 77 bp, Homo sapiens
ggttctccagccttcagactctgagagctgcactggcagccccccagtttctcaggtctcagactgtgagtgacacc

SEQ ID NO: 17966 - DNA, 83 bp, Homo sapiens
tttaagaacaatgagagggacaactggggaaatgttgcagttatttgcttcaattcttctgatgtttgctcattgttttggaa

SEQ ID NO: 17967 - DNA, 63 bp, Homo sapiens
atgtgtgttgtttgtgtatatgtgtaagtctatatatatattatatgcacataccacacatat

SEQ ID NO: 17968 - DNA, 120 bp, Homo sapiens
gccaggatgagtcagagactgggggctgaggtcacacgcagactcacgcactcacttcctggtctggtggtggcgaccggtctgcctctgtggctgcttaaactttctcacaccatgggt

SEQ ID NO: 17969 - DNA, 76 bp, Homo sapiens
caatgctggccatatattttgctgttgtagttgttttaaacaaacagaaaactgtgaggtcagtgataaagcattg

SEQ ID NO: 17970 - DNA, 96 bp, Homo sapiens
tcctcatcttgcaagcacctgagtctctctctgtaaggtttctgttggcctcagggcagaccagggtaccagggagggcagaccagggtaccaggg

SEQ ID NO: 17971 - DNA, 66 bp, Homo sapiens
tttctgagtcagggtctcactctgtcacccaggctggagtgcagtggccccaccttggctcactga

SEQ ID NO: 17972 - DNA, 66 bp, Homo sapiens
atcacatagcctcaaggatgaccccggatccactctgggtgtgtctgtctccaaggtcagtgtgat

SEQ ID NO: 17973 - DNA, 70 bp, Homo sapiens
tgtacatatttttttcttttgggagagagagagagagaggatctcactctgtcacccagactagagtgca

SEQ ID NO: 17974 - DNA, 91 bp, Homo sapiens
tgcatgttttcctaatcacagcgtgctttcttgtctgctatttcatttgacttttttcaaccagccgctgaggtggggattattagcacgc

SEQ ID NO: 17975 - DNA, 104 bp, Homo sapiens
ctggaagatgtttctgatgatatgagccttggtgctctctctctctctctgagtattctgagaggggcaaaattgtttgtgattccatatttcaggatttccag

SEQ ID NO: 17976 - DNA, 95 bp, Homo sapiens
gccaattccagtcaatcaatcaatagataaatgtatgtacacatgtatatatgtatatgtgtgtgcatatgtatgcatgtgtgatatggtttggc

SEQ ID NO: 17977 - DNA, 114 bp, Homo sapiens
ttacagttttagctcttccacttagatctttgatttattgtgagttgattttttctttttcttttttgagatggagtctcactctgtcacctaagctggagtgcaatggcgtga

SEQ ID NO: 17978 - DNA, 115 bp, Homo sapiens
tttatttaagacacaaacaagttattgccaaggggctagattatgggaggcattaatttttattttatacacttccgtgttgtgattggtaattttatgtgtcaatttgagtggg

SEQ ID NO: 17979 - DNA, 73 bp, Homo sapiens
tcacagggagaagacatggaagcttcatgtttgggaccctcccagagctcactctatgtctctctccctatgg

SEQ ID NO: 17980 - DNA, 80 bp, Homo sapiens
gtgacctcatcgtcttcctcctgcatggtcttgatccctggcttcccagcctcagtgtctcagtcatgcattagactcac

SEQ ID NO: 17981 - DNA, 102 bp, Homo sapiens
gaaagcagggtatgaagcatgaagcagttggggctggttggatttctctctctctctctctctccactagtttcaggatttctctgtgtggtctctctctgt

SEQ ID NO: 17982 - DNA, 58 bp, Homo sapiens
tgagacagagtctcattctgtcactcaggctggagtgcagtggtgtgatctcagctca

SEQ ID NO: 17983 - DNA, 88 bp, Homo sapiens
tgcctgtctggatttgaagtaatggagaaaaaggaagcagcagcagaggttttttttttttttttttttttttttaatctcagaagta

SEQ ID NO: 17984 - DNA, 58 bp, Homo sapiens
tgagctggagtctcactctgtcacccaggctggggtgcagtgttggaatcttggttca

SEQ ID NO: 17985 - DNA, 95 bp, Homo sapiens; identical to SEQ ID NO: 68

SEQ ID NO: 17986 - DNA, 93 bp, Homo sapiens; identical to SEQ ID NO: 69

SEQ ID NO: 17987 - DNA, 81 bp, Homo sapiens
ccctaagctttacatgcataactctgcattgccctgggctccaaagctgaggccttgtcagagagcagtgactgagcaggg

SEQ ID NO: 17988 - DNA, 120 bp, Homo sapiens
acatatatatatatatatgtgtgtgtatatatatatgtgtgtatatatatatatatgtgtgtgtgtatatatatataaaactaaggatgtatatatacacacatatatccatatatatat

SEQ ID NO: 17989 - DNA, 139 bp, Homo sapiens
ggtgacagcaccttttaggctataaagagcaatagaagaatttgatcctttttttttttctttgtcagagtctggctctgtcacccaggctggagtgcagtagtgcgatttcagctcactgcaacctccacctcccagg

SEQ ID NO: 17990 - DNA, 113 bp, Homo sapiens
ctggattcttctactttttttgttttatggggtgttttttgtttttgtttttttttttaagagacagggtctcactctgtcacctaagctagagtggagtggagcaatcatag

SEQ ID NO: 17991 - DNA, 89 bp, Homo sapiens
cagggctattatgattaatgagttgatacatgttaacagaagtgtctgtgctcagcattgttggctgctattgttgttattatttcctg

SEQ ID NO: 17992 - DNA, 85 bp, Homo sapiens
ttcttagatgcaattgaagagggatttggagaataacccctcatggagggctaaatacctctctcactcactatcttccatagaa

SEQ ID NO: 17993 - DNA, 95 bp, Homo sapiens
gtataaacatatatatgtgtttatgtagatatatgtgtgtgtatatatacacataaacacacacatatttatatatatatatatatttagcatac

SEQ ID NO: 17994 - DNA, 66 bp, Homo sapiens
gctcactcactcactcacactcactagctcaacttgctagacgggtgtgggcgtaggtaagtgagc

SEQ ID NO: 17995 - DNA, 85 bp, Homo sapiens
tcttaattttacagcttcagcattgtaactcattggacaaagaaccataatttttttgttcttgttgaagaaactgaaataggga

SEQ ID NO: 17996 - DNA, 95 bp, Homo sapiens
gttgctgggttgaatggtagcactgttttaagctctttgagaaacgtccaaatgactttttcacagtggctgaactagtgtacattcccaccaac

SEQ ID NO: 17997 - DNA, 141 bp, Homo sapiens
tgcatacacatacatatgtgtgtatatgtatatatatgattcaatatatatattatgcaatacatatatatgtgtatatatattatgcaatatatatatataattgcaatatatatatatatatgcaattacctctataca

SEQ ID NO: 17998 - DNA, 69 bp, Homo sapiens
tgtatagaggtaattgcatatatatatatatattgcaattatatatatatattgcataatatatataca

SEQ ID NO: 17999 - DNA, 73 bp, Homo sapiens
gaccctcgaatctcagtgacttacaacaataacaattcttttttgttttgttttgtctttgagacagagtctc

SEQ ID NO: 18000 - DNA, 61 bp, Homo sapiens
ggctgagtgtagggcctgacatgatgtcatctgacttctgtctctctcacatcttttagcc

SEQ ID NO: 18001 - DNA, 58 bp, Homo sapiens; identical to SEQ ID NO: 1725

SEQ ID NO: 18002 - DNA, 119 bp, Homo sapiens
tcagggctcccactgattcaacatgatggtgacttgtctaattatttcattatatgttacaatgtaataataatagaactaaagtacacaatacatttaacgtgcttgaatcatcctga

SEQ ID NO: 18003 - DNA, 61 bp, Homo sapiens
tatatatatacagagcatatatatgtgtgtgtatatatatgtatatgtatgtgtatatata

SEQ ID NO: 18004 - DNA, 84 bp, Homo sapiens
gactcatggcaaatgctaaatgtgtctgcacgtgtgtgtttgtgcaagtgcatttgtgcacacgctaagcatttgaaacaagtc

SEQ ID NO: 18005 - DNA, 58 bp, Homo sapiens; identical to SEQ ID NO: 14834

SEQ ID NO: 18006 - DNA, 97 bp, Homo sapiens
ggcatgatatattttttctacactttttctttcaacgtgcctatggcattatatttgaagtgaatttcttgtagacagaatatagttgggtcatgtt

SEQ ID NO: 18007 - DNA, 69 bp, Homo sapiens
atatatatgaatatatatgtgtgtgtggtttccagagaaacagaacctatatatatatgtatatatata

SEQ ID NO: 18008 - DNA, 87 bp, Homo sapiens
gcctacttctgtcaatttgtttatctgatcccctatctagttctgtgcccctgatggagagactttgtaatcatttggagaagaggc

SEQ ID NO: 18009 - DNA, 82 bp, Homo sapiens
ggaaaccccagacagcagccagaaggtctgggctttagcaccagctctgtccccgactctctgtgtgacactgggccagtcc

SEQ ID NO: 18010 - DNA, 60 bp, Homo sapiens
gcaagatgctcagggcttgtagggcgaggggggcagtaggaagagtagtgagcttcttgt

SEQ ID NO: 18011 - DNA, 90 bp, Homo sapiens
catatcctatgcaggcgtgacatttaggcataagtgcgtctctgtgtctgtgaaagccagtgtgctgatgtcagcttgcctctgtgtgtg

SEQ ID NO: 18012 - DNA, 82 bp, Homo sapiens
agttctgactatgcatctgagtgtctgtctccgtgttgggtttgcaggttttggggggatgtatgtggtggtgtggggaact

SEQ ID NO: 18013 - DNA, 87 bp, Homo sapiens
tcagggagccaggcaaagtggctcatgcctacagtcccagcatttgggaggctgaggttggtggatcatttgaagtcaggagtttga

SEQ ID NO: 18014 - DNA, 118 bp, Homo sapiens
ttgtaaatgtctgttcatgtcctttgtccacttgttaatgggactttttatttttttactgttgagttgtttgagttccttgtacattctggatattcatctcttgtcagatggacag

SEQ ID NO: 18015 - DNA, 112 bp, Homo sapiens
ttctcagcctgacacacagctgagattccttaaaaatttatttatttatttatttatttatttatttatttatttatttagcgaaagtctcaccctgtcacccaggctggag

SEQ ID NO: 18016 - DNA, 112 bp, Homo sapiens
tagttttgaaggaaaagaaaagtttaaaaagatgtgtaaattgcatgtatatatacatatatacatacatgtaaattagtttcttatatttaacttctttagtttggaatta

SEQ ID NO: 18017 - DNA, 90 bp, Homo sapiens
cagaatacgtactgtctctctctgtgtctttgtccacctgcatttagagaaaaacaaaacactacaagggtcagaccatgctgtgtcctg

SEQ ID NO: 18018 - DNA, 112 bp, Homo sapiens
tttagtttttatatgcatttctctgaagattggtgacatggagcatatatatatatatacatgcctgctggccacttgtatatcttctctcctgagatgtctattatttagg

SEQ ID NO: 18019 - DNA, 80 bp, Homo sapiens
aaaggaccaagcaccttctcaacctgcaatgtgctcagtgtctgtaaatcacaagttaggtgatgaagggctggtagttt

SEQ ID NO: 18020 - DNA, 124 bp, Homo sapiens
gcgggaatggtggcatgcgactgagaccccagctacctgggaggctgaggttggaggatcatttggacccaggaggtggaggctgcagtgaaccatgattgtgccactgtactccagcctgggt

SEQ ID NO: 18021 - DNA, 83 bp, Homo sapiens
gagtaaaaaactgtgtgtgtgtgtgactgtgtgtgtacatatatacacacacatatctataaaatacacaaaaacacacactc

SEQ ID NO: 18022 - DNA, 64 bp, Homo sapiens
tcaggctctcactggctctgacactgggagagcccatcctggaagcagcaggtgggggcgctga

SEQ ID NO: 18023 - DNA, 59 bp, Homo sapiens
tgagaccagagtctcgctctgtcacccaggctggagtccagtggtgcgatcttggctca

SEQ ID NO: 18024 - DNA, 114 bp, Homo sapiens
ctgagtcttttaattggggcatttagcccgtttacatttaagattaatattatgtgtgaatttgatcttgtcattatgatgctagctggttgttttgcccattagttgatgcag

SEQ ID NO: 18025 - DNA, 78 bp, Homo sapiens
ctgtttcagctactccagaggctgaggtaggaggatctcttgagctccagaagtggagattatagtgagctgagatgg

SEQ ID NO: 18026 - DNA, 156 bp, Homo sapiens
ccagaggaggtgacttatgagctggaccttggagaataaatggagccaaaaaagcattctttttttttttttttttttgagatgagtctcactctgtcgcccaggctggagtgcagtggcgggatctcggctcactgcaagctccgcctcccgggt

SEQ ID NO: 18027 - DNA, 58 bp, Homo sapiens
tgagagggagtctcactctgtcacccaggctggagtgcactagtgcgaccttggctca

SEQ ID NO: 18028 - DNA, 116 bp, Homo sapiens
ggggccgtcagcaacagaatacgtttttcctttattgaatgaggagactgaagtcagactgaatccagccctgaatttaaatctcctttgccacttcagaggaaggtgcaggctct

SEQ ID NO: 18029 - DNA, 64 bp, Homo sapiens
ggccctcagtctccctgtctgtgaagtgggaacccgctcgaggacggcgcggaacccgggagcc

SEQ ID NO: 18030 - DNA, 69 bp, Homo sapiens
gtttgtttttgagacagagtctcactctgtcgcccaggctggagtgtatgatctcggctcactgcaagc

SEQ ID NO: 18031 - DNA, 71 bp, Homo sapiens
gaggaaggcaagaacgggaacagagagcatgcgagactaagctttctgtctctgtctgcctcagcctcctc

SEQ ID NO: 18032 - DNA, 76 bp, Homo sapiens
ggctcacaggacaggtcccaaggcagctttcctggaccctgagtaactccttgtctctctgcctctgtccttgacc

SEQ ID NO: 18033 - DNA, 87 bp, Homo sapiens
tgtggagctgggtgaggagaggtgtgatgacttgtgtctgtgttcatttatacatgcatagaagccacctctgcttccagagacgca

SEQ ID NO: 18034 - DNA, 75 bp, Homo sapiens
cagaagtggtcattctgaatctttaaaaaaatttttttaaatttattttttttttagagacaggatctcactctg

SEQ ID NO: 18035 - DNA, 58 bp, Homo sapiens; identical to SEQ ID NO: 1435

SEQ ID NO: 18036 - DNA, 58 bp, Homo sapiens; identical to SEQ ID NO: 637

SEQ ID NO: 18037 - DNA, 75 bp, Homo sapiens
gcgtctcactctgtcacacaggctggaatgcagtggtgcaaacacagctcattgcagcctcgacctcactgactc

SEQ ID NO: 18038 - DNA, 59 bp, Homo sapiens
gggtagttagaactgagtgaggttagccgggactaacctcactcagatccctcctcccc

SEQ ID NO: 18039 - DNA, 71 bp, Homo sapiens
cagcctgggagataagctgagccagtcagggagagcacctaagcctttcacactgtctcactctcttgctg

SEQ ID NO: 18040 - DNA, 58 bp, Homo sapiens; identical to SEQ ID NO: 2224

SEQ ID NO: 18041 - DNA, 56 bp, Homo sapiens; identical to SEQ ID NO: 335

SEQ ID NO: 18042 - DNA, 113 bp, Homo sapiens
ctgctgcatgccaagagtcaaatgtatatttgaaagagttgtgaatttcaagaaagatatttttgagtttttttttttttctttctgagacagggtcttgtactgtttcccag

SEQ ID NO: 18043 - DNA, 77 bp, Homo sapiens
ttgtttattttttgagaccagagtctcactctgtcgcccaggctagagtgcaatgacacaatctcggttcactgcaa

SEQ ID NO: 18044 - DNA, 64 bp, Homo sapiens
tgctgcatgcatatggtcccagctactcagtaggctgaggtaggaggatcatttgtgcccagga

SEQ ID NO: 18045 - DNA, 73 bp, Homo sapiens
attccagcctgggcaacagagtgagactctttctcaaaaaaaatcagactcactctgtcgcccaggctggagt

SEQ ID NO: 18046 - DNA, 108 bp, Homo sapiens
ccaggggactgggtctcagagcccagagcccagaacccagagcttgaacctgagaatttagagtgcagagcctggagttcctagccgggagaagatcccagaacctgg

SEQ ID NO: 18047 - DNA, 122 bp, Homo sapiens
ggttgcaagtcctcaaaagatgcttgtttaatccaggcaggtatagttgacagtccacagtgtggccacataagaaggtgattcccaggacggtgtcagggtcccgggagactcaagtgtct

SEQ ID NO: 18048 - DNA, 116 bp, Homo sapiens
ctgacccgcctgggcaacatagtgagacctcatctcaaaaaaattttttttaattaaaatttgtttttgcttttttagagacggggcctcgctctgtggctcaggctggcgtgcag

SEQ ID NO: 18049 - DNA, 95 bp, Homo sapiens; identical to SEQ ID NO: 68

SEQ ID NO: 18050 - DNA, 93 bp, Homo sapiens; identical to SEQ ID NO: 69

SEQ ID NO: 18051 - DNA, 99 bp, Homo sapiens
ggggcttaaagtcactggggtcactgggtaagggggcagtgggacacctgcatggaagtccctggctccctcactccttagtgggtgggcagggtctcc

SEQ ID NO: 18052 - DNA, 117 bp, Homo sapiens
gagctgggattacaggtgggggctaccatgcctggccaagatagaggctttttttttttttttttttgagagtctctctgtcacccaggctggagtgcagtggcgtgatctcggctc

SEQ ID NO: 18053 - DNA, 91 bp, Homo sapiens
ccagctcggcaaggataagataaaccaagagctctcagtcatggtctaagctggcactggcttttatttatttatttttttttcgaggtgg

SEQ ID NO: 18054 - DNA, 80 bp, Homo sapiens; identical to SEQ ID NO: 18019

SEQ ID NO: 18055 - DNA, 90 bp, Homo sapiens; identical to SEQ ID NO: 18017

SEQ ID NO: 18056 - DNA, 95 bp, Homo sapiens; identical to SEQ ID NO: 68

SEQ ID NO: 18057 - DNA, 93 bp, Homo sapiens; identical to SEQ ID NO: 69

SEQ ID NO: 18058 - DNA, 112 bp, Homo sapiens; identical to SEQ ID NO: 18016

SEQ ID NO: 18059 - DNA, 109 bp, Homo sapiens
gggaaataatggtgggggacaaaggttttgagtagatctttttctgatttttaaatcagattatttgtatttttgcttttgagtagcttcagttctttatatgttttgt

SEQ ID NO: 18060 - DNA, 112 bp, Homo sapiens; identical to SEQ ID NO: 18015

SEQ ID NO: 18061 - DNA, 87 bp, Homo sapiens
tcagggagccaggcgaaatggctcatgcctacagtcccagcatttgggaggctgaggttggtggatcatttgaagtcaggagtttga

SEQ ID NO: 18062 - DNA, 112 bp, Homo sapiens; identical to SEQ ID NO: 18016

SEQ ID NO: 18063 - DNA, 90 bp, Homo sapiens; identical to SEQ ID NO: 18017

SEQ ID NO: 18064 - DNA, 80 bp, Homo sapiens; identical to SEQ ID NO: 18019

SEQ ID NO: 18065 - DNA, 58 bp, Homo sapiens; identical to SEQ ID NO: 637

SEQ ID NO: 18066 - DNA, 58 bp, Homo sapiens; identical to SEQ ID NO: 1847

SEQ ID NO: 18067 - DNA, 102 bp, Homo sapiens
atatacatatatgtgtatatatatgtgtgtgtgtatatatatgtatatacatgtatatatatacgtatatatgtgtacatatatacgcatatatatgtatat

SEQ ID NO: 18068 - DNA, 70 bp, Homo sapiens
gtctgtggttaatgggctcagtgtgggtgcttctcactccgactctcacatggttgcttatggctatagc

SEQ ID NO: 18069 - DNA, 104 bp, Homo sapiens
tccacttcctgacatggtgcctagaattgatttgcatgtgtatatatatatatatatatatatatattttaagacaggatctcactctgtcacccaagctgtga

SEQ ID NO: 18070 - DNA, 73 bp, Homo sapiens
gaaaactaaagcagaaagggcttaaagaacttgtagtgtgggtttttttatttgtttgttttgttttgttttc

SEQ ID NO: 18071 - DNA, 76 bp, Homo sapiens
ccagctgctctgttaggcagatgtctgcaggctgagcctctcagtgtctggatatggagatgatggagtactttgg

SEQ ID NO: 18072 - DNA, 88 bp, Homo sapiens
tatatatacatacatatctatatacgtatatgtgtatacatacgtatatatgtatatatgcatgtgtatatgtgtgtgtgtatatata

SEQ ID NO: 18073 - DNA, 73 bp, Homo sapiens
gtgggtgaaagcaccccgggttagtgcaggagggagcaggccttcctcagaactgagggtgcacacaccacgc

SEQ ID NO: 18074 - DNA, 107 bp, Homo sapiens
gtgctgggattacaggtgtgagccacccacccagccagaatgcacttgtctgaacatctgtgtgtctctctgaatgtctgcgtgtctgaacatccgtctgtcagtac

SEQ ID NO: 18075 - DNA, 99 bp, Homo sapiens
catgtgtctaatcatctgtgtctgaacatgcatatttctgattcatgtgtctgaacacctgtctgtcagaatgtctgtccatctgtcagaatgcacttg

SEQ ID NO: 18076 - DNA, 70 bp, Homo sapiens
caggtatgatggcacacccctgtagtcccagctacttgaagagctgaggttgaaggatcatttgagcctg

SEQ ID NO: 18077 - DNA, 60 bp, Homo sapiens
tgagacagagtctcactctctcttgcccaggctggagtgcagtggtgtgatctctgctca

SEQ ID NO: 18078 - DNA, 120 bp, Homo sapiens
aagagccaaactctgtctcaaagaaaaaaaaaaatgtgtacaagtcacacagctggtcagtgactgtgtctgtgtgacctggacaaatttcttatcttgtctgtgactttgttttctctt

SEQ ID NO: 18079 - DNA, 115 bp, Homo sapiens
cataaccctgggtcaaagtcttctggggagagggggcagtgaccaagctcacaggctgtgttctgcaggacatctcctccaaacaaagatgtctcagagaaactagagcccagct

SEQ ID NO: 18080 - DNA, 108 bp, Homo sapiens
ctgagaccagggccttcccagcggtgggaatgggaggtggcctgtctctgtctctgcgtggagagacactgccacttctgttccctgggaagccagcaccattttcag

SEQ ID NO: 18081 - DNA, 125 bp, Homo sapiens
ccagggtgatgcctgcctgttcacgaggagcggcatgtggaagtggtgtctggctcgggtctcttcctctgtgtgtctcaccatcatccagtcctcgtggagatgctaaggaagagtgcttttgc

SEQ ID NO: 18082 - DNA, 98 bp, Homo sapiens
ccagtgtttttaatacagtcatgaatacgagtgtcttgtcttttttttttttttttgagacagagtctcactctgttgctcaggctggagtgcagtgg

SEQ ID NO: 18083 - DNA, 84 bp, Homo sapiens
tcctgtccatgttctgagttctgtttctgtcatttcagccgcttaggagcccttgctgagaaactagtgcagtcttttggagga

SEQ ID NO: 18084 - DNA, 77 bp, Homo sapiens
gacagacacagtgagagagagatacagaaagattgattatacagtttgttcttgatcctgttttaattgtgaatgtc

SEQ ID NO: 18085 - DNA, 102 bp, Homo sapiens
cacctgagcagacagcagatccacagccatcccttcctcctcagtcttcctgcccagggagagcagagtgtggacacggtgggtctgcagaggaaaaaggtg

SEQ ID NO: 18086 - DNA, 113 bp, Homo sapiens
tgcatgtagatatcctgttgtcattttgttgcataattttttaaggcattttttttattatactttaagttttagggtacatgtgcacaatgtgcaggttagttacatatgta

SEQ ID NO: 18087 - DNA, 79 bp, Homo sapiens
ggacgcctgtgcgagtagagagtgtgctctgtgacctttgaggagaaccagaatacctaccacgcacagatgcctgtcc

SEQ ID NO: 18088 - DNA, 118 bp, Homo sapiens
cagtgcccatatacagactggcataggcctggcgctgctggactctcagtgacagcctcacttctctggctggaggaggtccaaggcccaggagaacctgctgtgccctgggcagggg

SEQ ID NO: 18089 - DNA, 116 bp, Homo sapiens
ggtaaatgggaggcagggatgaatgccttggaagatcagagccgttgtggaagtaatatgtttatatatgcatttttttcttttttgagacagggtctcactcagtcacccaggct

SEQ ID NO: 18090 - DNA, 60 bp, Homo sapiens
gtgagacagagtctcactctgtcgcccaggctggagtacagtggtgtgatcttggctcac

SEQ ID NO: 18091 - DNA, 58 bp, Homo sapiens
tgagacagagtctcactctgtcgcccaggctggagtacagtggtgtgatcttggctca

SEQ ID NO: 18092 - DNA, 82 bp, Homo sapiens
aggggaggtcaacgggaacaaggtcatcccctccatttcttactaaccaagagagagtcgctctgtggctgtgtattcccct

SEQ ID NO: 18093 - DNA, 111 bp, Homo sapiens
tgtgagtctatggatgtgtgtgcatgtcacacgtgtgtgcatatgtgacatgcacactcaggcacacacatgcacacacacaaacgtgcacatgcacacacaggctctaca

SEQ ID NO: 18094 - DNA, 68 bp, Homo sapiens
cggaattaaaggagacggggcctgatgaggggctctgggcctctctgtgtccctgtctgctttgtctg

SEQ ID NO: 18095 - DNA, 58 bp, Homo sapiens
tgagtcagggtctgtctctgtctcccaggctggagtgcagtgacatgatctcggctca

SEQ ID NO: 18096 - DNA, 70 bp, Homo sapiens
gggctctggtgttcaggggtgggcagtggcagcagacatccttcactctgtgcctctgtcactggtgccc

SEQ ID NO: 18097 - DNA, 58 bp, Homo sapiens; identical to SEQ ID NO: 1725

SEQ ID NO: 18098 - DNA, 58 bp, Homo sapiens; identical to SEQ ID NO: 13985

SEQ ID NO: 18099 - DNA, 101 bp, Homo sapiens
tggtgctccatggctcacctgtgttgtcacgtgtcacattcactctcattctgaggcaggtgcattttgcaaaggaagacactgaggcatcaagcagtcca

SEQ ID NO: 18100 - DNA, 58 bp, Homo sapiens; identical to SEQ ID NO: 13985

SEQ ID NO: 18101 - DNA, 58 bp, Homo sapiens
tgagatggagactcactctgtcacccaggctggagtgcaatggtgagatctcggctca

SEQ ID NO: 18102 - DNA, 76 bp, Homo sapiens
gattaatatatatgtatatataacacgtatatttatatatgtataatatatatgtctatgtatatatgtatatatc

SEQ ID NO: 18103 - DNA, 58 bp, Homo sapiens; identical to SEQ ID NO: 315

SEQ ID NO: 18104 - DNA, 58 bp, Homo sapiens
gcagtgtctgactctgtcacccaggctggagtgcagtggcatgatctcagctcactgc

SEQ ID NO: 18105 - DNA, 117 bp, Homo sapiens
gacgtatgccaccacacccggttaatttatcttttttcctacacttgatctttgccaaaaggatgagatgtgataatgtagtagagacggggtttcaccgtgttggccaggttagtc

SEQ ID NO: 18106 - DNA, 58 bp, Homo sapiens
tgaggcacagtctcgctctgtcacctaggctggagtgcagtggtgtgatcttggctca

SEQ ID NO: 18107 - DNA, 57 bp, Homo sapiens
cagggtctcactctgtcacccatgctggagtacaatgggtgatgatcaaggctcatg

SEQ ID NO: 18108 - DNA, 75 bp, Homo sapiens
ggcacaggcagaatcagcttcagggtgtgacagccgctctgctgtcgccatcttgaaattcttaacagtctggcc

SEQ ID NO: 18109 - DNA, 96 bp, Homo sapiens
ccctcaccagccccgggcactgtccagtcagcctgaagtgactgtgcccaccaagtgccaggctgcagctggacccgggggtgctctggggtcagg

SEQ ID NO: 18110 - DNA, 87 bp, Homo sapiens
ggctgattcaaacaggctgctgtagtcccagccacttgggaggctgaggtggtaggatcacttgaggccaggagttcaaaatcggcc

SEQ ID NO: 18111 - DNA, 87 bp, Homo sapiens
caaagaagtgagtataaggccatcaaacagtgataggcagacgtgtgtgtatattgttcaggccaaagttgtaagcatgaatgtttg

SEQ ID NO: 18112 - DNA, 309 bp, Homo sapiens
tatgtatatatatatacatatatatatgtgtacatatatatgcatatatatatgtgtacatatatatgcatatatatatgtgtacatatatatgcatatatatgtgtacatatatatgcatatatatatgtgtacatatatatgcatatatatatgtgtacatatatatgcatatatatatgtgtacatatatatgcatatatatatgtgtatatatatatgtatatatatgtgtatatatatatgcatatatatgtgtatatatatatgtgtgtgtatatatatatatatatatgtatatatatcata

SEQ ID NO: 18113 - DNA, 115 bp, Homo sapiens
tctaaaaccgtttgtacctggtgtgattataaagcaatgagactgattgtcatatgtcgtttgtgggatccgtctcagttactttatagccatacctggtatcttataccacaga

SEQ ID NO: 18114 - DNA, 91 bp, Homo sapiens
ggagtttggggggttccaggagctggttagagccatcgtctcaccctcatccctacctggcaccctcagtccctggcaccccttgggcaac

SEQ ID NO: 18115 - DNA, 109 bp, Homo sapiens
gggccagtcaccagtcactgctctgtctgagcctcagtctctccctgtgtaagatgggtcttcatctatagcccagagaggggctgggggtagaggtgcagcatggcct

SEQ ID NO: 18116 - DNA, 118 bp, Homo sapiens
gaagagccccctccttcctacagactcggggtccagctgctgcatggcatgctctgtctgactcagtgtctgcctagctcacagctacgccgagacacgtgtgctgggtgggcccttt

SEQ ID NO: 18117 - DNA, 117 bp, Homo sapiens
gccgaggaccccttttatgtgatgactcacttctttcttgctgctctcaatattctctatttgttgttgtattttccagtttgattataatgtgtctcactgtgggtctctttgagt

SEQ ID NO: 18118 - DNA, 116 bp, Homo sapiens
gcttgtccgcagccccatcatctctcttgaagcattcagtcagtctcagtctctatgtggtggccaaggagtcccagacatctgagtggatgcttccagcatggcagacggagagc

SEQ ID NO: 18119 - DNA, 58 bp, Homo sapiens
tgagatagagtctcgctctgtcacccaggctggagtgcagtggtgtgatctcggctca

SEQ ID NO: 18120 - DNA, 88 bp, Homo sapiens
gaaaaggtggggcttgaaaatcagggaaatcgtgctattagcgttaaagcacttttttcctttctggctcactctctctccccttgtc

SEQ ID NO: 18121 - DNA, 92 bp, Homo sapiens
cacggtatgcacagccagggtttccagactgctctcctgctctcacagaactctgtctgctctctggactctgcccttgaaactgagacctg

SEQ ID NO: 18122 - DNA, 97 bp, Homo sapiens
cagacttgcaatgtggtgaagtcttcagatattccagttctctatgtaaacatgaaagaactcaaactggagagaaaccctatgactgtaaggcatg

SEQ ID NO: 18123 - DNA, 113 bp, Homo sapiens
agtggctccccgcatgccaacccttcccgagcttcacctcctctaatcctcatgacatcctgtgtgaagagactgtggttcccagggatagagatggcatcggaggctccact

SEQ ID NO: 18124 - DNA, 87 bp, Homo sapiens
tcacaaaatcacaagtgtttttgttctgcttcttaaagggacacacacgcgttgtctcctagggaaaggttgagctttggggtgtga

SEQ ID NO: 18125 - DNA, 67 bp, Homo sapiens
tttgaaactgagtctcgcactgtctcccaggctggagtgcagtgtagcgatcccggctcaccgcaag

SEQ ID NO: 18126 - DNA, 71 bp, Homo sapiens
gggtctcactctgtgtcacccaggctggagtgatgatgacttgctgcagccttgacctcccaggttcaccc

SEQ ID NO: 18127 - DNA, 79 bp, Homo sapiens
ggacccgcacggctgagcctgcaccatggtgggagagtcagatagggccgtcccgtgagaggagagtgtgacgaggtcc

SEQ ID NO: 18128 - DNA, 58 bp, Homo sapiens; identical to SEQ ID NO: 1265

SEQ ID NO: 18129 - DNA, 64 bp, Homo sapiens
ctgtcagggagggtgagagcacagagtggggttgaagccccccggtgtgccaccatcgagagag

SEQ ID NO: 18130 - DNA, 95 bp, Homo sapiens
atgaatggagatgttgagtggatatgaatatatatatatatatatatatatatatatatatatatatatatatatgtaattttttttccatctgt

SEQ ID NO: 18131 - DNA, 115 bp, Homo sapiens
ctgtcttatgtgtgttttactgcctgctctttctggttgttgcatgtagttagaaaagaagtgattttcttgaaatgcatggggctagaaagagagctggaacttaaagtggtgg

SEQ ID NO: 18132 - DNA, 58 bp, Homo sapiens
tgaaatggagtctcgctctgtcactcaggctggagtgcagtggcgcgatctcggctca

SEQ ID NO: 18133 - DNA, 119 bp, Homo sapiens
atatatatacacacgatatatatgtatcgtttatgtatatatctagatatatatgtatacatatctggatatatacatatacatatatgtatctagatgtatatgtatatatatagata

SEQ ID NO: 18134 - DNA, 58 bp, Homo sapiens
tatctatatatatacatatacatctagatacatatatgtatatgtatatatccagata

SEQ ID NO: 18135 - DNA, 98 bp, Homo sapiens
gttctagggattacagtatacatacttaacttttcacagtctgcttagaatcaatattttaggccaggcacagtggtgcatgcctgtaatcccagcac

SEQ ID NO: 18136 - DNA, 113 bp, Homo sapiens
tcccactccacctccaggtctgggctctggccacttaagcggaggcttcacggcagcgcctgagaggagacagagccctctcaaagcactggcgctggaggatgtgtgcgggg

SEQ ID NO: 18137 - DNA, 62 bp, Homo sapiens
tcctgacagagctgtgtgtggtgactgatcactcacacaacctacctgctcccgagttagga

SEQ ID NO: 18138 - DNA, 99 bp, Homo sapiens
ggaacaagttattgtctcacagttttggaggctagatgtctgagatcaaggtgtcagcaagtttggttccttctgaggctgtgagggagaatcggttcc

SEQ ID NO: 18139 - DNA, 135 bp, Homo sapiens
ggagctgtggctactggctggtacagtattaggtgtacctgaagtatttgctgatgcctgcctctctgcctctgaggtttttctggaacaaacgccactgtagtcagctggcagtgatgaagcccagacattcag

SEQ ID NO: 18140 - DNA, 95 bp, Homo sapiens; identical to SEQ ID NO: 68

SEQ ID NO: 18141 - DNA, 93 bp, Homo sapiens; identical to SEQ ID NO: 69

SEQ ID NO: 18142 - DNA, 79 bp, Homo sapiens
ttgctctcaggagtgcaactaggtgaaagaagagagttagcgcaagcctacactctccctgttgtccacttaaatgtaa

SEQ ID NO: 18143 - DNA, 58 bp, Homo sapiens
tgagagaaggtctcactctgtcacccacgctggagtgcagtggtgtgatcatagctca

SEQ ID NO: 18144 - DNA, 88 bp, Homo sapiens
ccatacgggctctttttaggttccatatgaaatttaaagtagttttttctagttctatgaggaaagttaatggtagcttgatgggagt

SEQ ID NO: 18145 - DNA, 73 bp, Homo sapiens
gtttgtttgagtcagagtctcactctgttgcccaggccggagtgcagtggggggatcttggctcactgcaagc

SEQ ID NO: 18146 - DNA, 106 bp, Homo sapiens
tgaatgatttaaatagttgttgaggtttgctctaagaaactcaggtaaaatgtttatattttacctaagtgagttaaaatcccagctccaatgcataaatgattta

SEQ ID NO: 18147 - DNA, 76 bp, Homo sapiens
gattctttgtgtctgcctgtctgcctctcatacttgggaggcagtgctttgccctgtgacctcatttctctggatc

SEQ ID NO: 18148 - DNA, 72 bp, Homo sapiens
ggtctgtgtgagcctcgctctctgagcctgaggggccactggaggctgagggtgccgtgggctccacagccc

SEQ ID NO: 18149 - DNA, 112 bp, Homo sapiens
tagccaggtgtggtggtgtgcacctatggtcccagctgcttgtgaggctgaggtggaaggatcacttgaaccaaggaggtggagattgtagtgagctatgatggcacctctg

SEQ ID NO: 18150 - DNA, 73 bp, Homo sapiens
tctgagcagaggagggcctggtctcactcaggtgttttaggtggcacccagacacactctgacttagctcaga

SEQ ID NO: 18151 - DNA, 86 bp, Homo sapiens; identical to SEQ ID NO: 2169

SEQ ID NO: 18152 - DNA, 66 bp, Homo sapiens; identical to SEQ ID NO: 474

SEQ ID NO: 18153 - DNA, 84 bp, Homo sapiens
gtcctgaacctttttgggaccaaggactggttttgtgggagacaatttttccaagggccagtggtagaaggatggtttcaggat

SEQ ID NO: 18154 - DNA, 136 bp, Homo sapiens; identical to SEQ ID NO: 3160

SEQ ID NO: 18155 - DNA, 184 bp, Homo sapiens; identical to SEQ ID NO: 3161

SEQ ID NO: 18156 - DNA, 99 bp, Homo sapiens; identical to SEQ ID NO: 3220

SEQ ID NO: 18157 - DNA, 94 bp, Homo sapiens; identical to SEQ ID NO: 3248

SEQ ID NO: 18158 - DNA, 112 bp, Homo sapiens; identical to SEQ ID NO: 3264

SEQ ID NO: 18159 - DNA, 108 bp, Homo sapiens
attaggggagggagactcatgaaactgaaaaggccagaggtaaaactgattttatgtgtagtttgataccagaattttcgtgatatcaagagaactctttctctagat

SEQ ID NO: 18160 - DNA, 106 bp, Homo sapiens
atatatgtacatatatatgtatgtggatacaagtatatatatttatacatatttacacacaagtgtatatgcaagtaagtatatatgtatatagacatatatatat

SEQ ID NO: 18161 - DNA, 95 bp, Homo sapiens; identical to SEQ ID NO: 580

SEQ ID NO: 18162 - DNA, 93 bp, Homo sapiens; identical to SEQ ID NO: 69

SEQ ID NO: 18163 - DNA, 77 bp, Homo sapiens
gctgggggcctgtggggtgacccaggctgcaacggtcacaatgagggcagcactggctgtcactgtctgtcccaagc

SEQ ID NO: 18164 - DNA, 92 bp, Homo sapiens
gaataacagacattccagagtccctaagttctgatctctttctctcagctcagagaaatcactgtgctttgtttggatgtgtcccttacttc

SEQ ID NO: 18165 - DNA, 172 bp, Homo sapiens
tatacatgtatatgtatgtgtatatacatatgtgtatgtatatatacatatatgtgtatgtatatatacatatatgtgtatgtattgtatatatataatttttgtatatatacacaaatgtgtattacatatatacacacgtgtatatatatacaaaaattatatatataca

SEQ ID NO: 18166 - DNA, 79 bp, Homo sapiens
tatacatatacatgtatatatgtgtatatacatatacatgtatatatgtgtatatatgtatatatgtgtatgtgtatat

SEQ ID NO: 18167 - DNA, 107 bp, Homo sapiens
cttacatctgtgatttcataaggggttgtaaaatgatattatccatcttattaggttgaatacttatatcaaaagaaaccttggtgctgaggtaaagtttctgtagg

SEQ ID NO: 18168 - DNA, 106 bp, Homo sapiens
ctggctttgttctttttgcttaggattgtcttggctatgtgggctcttttttggttccatatgaaatttaaagtagtttttttccaattcttttgaagaaagtcag

SEQ ID NO: 18169 - DNA, 121 bp, Homo sapiens
atgtattcatgtttacttactggagagttatttgatataattaagaatttatatatataatatatgcattatatatatggaatatatatattctctctctatatgtgtgtgagtgtatgtg

SEQ ID NO: 18170 - DNA, 75 bp, Homo sapiens
ttttttttttctgagacggtgtctcactctgtcgcccaggctggagtgcagtggcatgatctcggctcactgaaa

SEQ ID NO: 18171 - DNA, 107 bp, Homo sapiens
ctgagtggcttgtgcaggcagcaggggtggtgacagtagactgagtgggccaatacctaggctcccagatggtgcaagtgagtaggtgcctgcagtggcagtagcag

SEQ ID NO: 18172 - DNA, 138 bp, Homo sapiens
tatatatatatacgtatatatatatgtatatacgtatatatatatgtatatatgtatatatgtgtatatatatgtatatatgtatatatgtatatatatacacacacacacacatacatatatatatatatatatata

SEQ ID NO: 18173 - DNA, 90 bp, Homo sapiens
gtttttgtatctacttgtacattttctttctttatttttatttttttattttagatttagggggtatatgtccaagtttgttacatggac

SEQ ID NO: 18174 - DNA, 118 bp, Homo sapiens
atgggtcccacgtaagaccaaatagacagtggcagagttgagaataccaacacttttttttttttttttgatagggtcttgctctgtcacccaggctggagtgcagtggtgagatcat

SEQ ID NO: 18175 - DNA, 77 bp, Homo sapiens
ccttgccaaagttgcagctgagaaatgctttcaatgtgtttcaaaagcagttcaactatcttttgttttggtgtagg

SEQ ID NO: 18176 - DNA, 109 bp, Homo sapiens
gtgcaaacagatgtgcatatgtgtggatgcatgcacatgtgtgtgtccctgagtgcctgcatgtattcccacacgtgtgcctgtgtgctgcatgtgtgtgtatgagcat

SEQ ID NO: 18177 - DNA, 60 bp, Homo sapiens
ttgagacagagtctcactctgtcgcccaggctggagtacagtggtgcgatctcggctcaa

SEQ ID NO: 18178 - DNA, 58 bp, Homo sapiens
tgacacagagtctcactctgtcacccagcctggagtgcagtggtgcaatctctgttca

SEQ ID NO: 18179 - DNA, 105 bp, Homo sapiens
aagatgactaggtgaacattatatatatatggagatattatagatatatagatattcaatatggaggttgatatatagatatagtgcatatctataccttatctt

SEQ ID NO: 18180 - DNA, 72 bp, Homo sapiens
aaaaatgaattagcaagtgttacagcattttctattctctgaaatagttgtgtcatattgttgttcattttt

SEQ ID NO: 18181 - DNA, 97 bp, Homo sapiens
tataagctttacgtatacatatatacatatgcatatatacatatatacgtaaacatatatatgtatatatgtgtatatatacgtatatgtgcatata

SEQ ID NO: 18182 - DNA, 81 bp, Homo sapiens
acatatacgtatatatacacatatatacatatatatgtttacgtatatatgtatatatgcatatgtatatatgtatacgta

SEQ ID NO: 18183 - DNA, 72 bp, Homo sapiens
gtgtatgtgtatatatgtatgtgtgtatatatatatttctatataatacatatctatataatatatatatat

SEQ ID NO: 18184 - DNA, 84 bp, Homo sapiens
agcacaatgtctgtttttgttttttttctgagagggagtctcactctcactcaggctggagtactgtgatgcgatatcttggct

SEQ ID NO: 18185 - DNA, 87 bp, Homo sapiens
tttgaaagctctccatagtagtttgatttaccccaaaggaaaaccagttatgtttggttttctagatcaattgctaagaccattaaa

SEQ ID NO: 18186 - DNA, 89 bp, Homo sapiens
ctcagaggcacagtctctccatgagcaactgcacctaaaatactggtgccacttcttcagagagcacacaagtgctataaacatcagag

SEQ ID NO: 18187 - DNA, 106 bp, Homo sapiens
taaaaaggagacaataatagcagccctttcacagctttattatgagaattaaatgtgtttataattgtaaagagtatgttgcagggtgcattatcaatccatttta

SEQ ID NO: 18188 - DNA, 57 bp, Homo sapiens
gttgagatggagtctcactctgtcacccaggctggagtgcagtggggctctctcggc

SEQ ID NO: 18189 - DNA, 79 bp, Homo sapiens
tatgtatatatgtatatatgtcatatatgtatatatacatgtatatatgtacatatatgtatgtatatatgtatacata

SEQ ID NO: 18190 - DNA, 60 bp, Homo sapiens
gcatatatatatatgtgtgtgtgtatatatatgtgtatatatctatgtatgtgtgtgtgt

SEQ ID NO: 18191 - DNA, 62 bp, Homo sapiens
tatatacacacacacatatatggttataaagatatatatacatatatgtgtatgtgtgtgtg

SEQ ID NO: 18192 - DNA, 82 bp, Homo sapiens
actcctctctgctctctgtgtcactttgctgccttgatgggtcccgacgtggtttctcagttgatcagcttgcagggtcagt

SEQ ID NO: 18193 - DNA, 232 bp, Homo sapiens
gtgtgtgtgtgtatgcgtgtatatatatgttcatatatatatatatgtttatatatatgcgtgtatatatatgtttatatatatgcgtgtatatatatatgtttatatatatatgcgtgtatatatatatgtttatatatatatgcgtgtatatatatatgtttatatatatatgcgtgtatatatatgtttatatatatatgcgtgtatatatatgtttatatatatatgt

SEQ ID NO: 18194 - DNA, 107 bp, Homo sapiens
tatctcacattggtatactactaaatatcacattgaataaatatgagatatatacatatatatgtatatatccaatgtgatatatacatatatatcacagtggaata

SEQ ID NO: 18195 - DNA, 84 bp, Homo sapiens
tatatacacgtgtatatgtatacatatacacgtgtatatatatatacacatgtatatatatgtatacatatacacgtgtatata

SEQ ID NO: 18196 - DNA, 77 bp, Homo sapiens
tatgcttgcatttttaatttaattttattttattcttcatagagtgagatagatctattgtttaaaacgcgggtata

SEQ ID NO: 18197 - DNA, 116 bp, Homo sapiens
tcagggtaaaattaagcatgagatgccatctaaagagacaattttctgagtctctctctcagaaaatgatcatagtttagcatgacaattttatctttccagtttctatagtctga

SEQ ID NO: 18198 - DNA, 120 bp, Homo sapiens
atatgcgtgtatatgtgtgtgtacacagaaaagatatatagaggtatatctatgtataatatctatttatctctatatatatgtgtatatatctatatgtgtgtatatgtgtgtgctaca

SEQ ID NO: 18199 - DNA, 118 bp, Homo sapiens
agtgccactggtgagatatctagtgtcattcggatgtttatttctcagtagataatctgctttatttatttttgtttctatatagacttcattagaatttgtctttagttctggcatt

SEQ ID NO: 18200 - DNA, 103 bp, Homo sapiens
atgtatgcatacctatatgtatgtaaatattttatattatatataaaatatataaaatataaattttatatgtctgtgtgaatatgtgtgtgtgtgtatatat

SEQ ID NO: 18201 - DNA, 95 bp, Homo sapiens; identical to SEQ ID NO: 68

SEQ ID NO: 18202 - DNA, 93 bp, Homo sapiens; identical to SEQ ID NO: 69

SEQ ID NO: 18203 - DNA, 116 bp, Homo sapiens
atgcatatttattgagagaagtgatattgttctatgatttgactattactaaatttaaatgatttttctattattaagttaaaaggcatatcaattatttcattttcttcttgcat

SEQ ID NO: 18204 - DNA, 155 bp, Homo sapiens
tatggagatatatatatggagagagatatatatatatggagatatatatagggatatatatatatcagaatatatatatgtcagcatatatatatatcagaatatatatatatcagcatatatatatatatatatatatctctatcagaatatat

SEQ ID NO: 18205 - DNA, 111 bp, Homo sapiens
gcctaaaaattacatgaaagggtactctttgtgatgactgtatcaagatttatttttttcttgagtcctaaacttgggtccttcatttataatttatgtgactgacatagc

SEQ ID NO: 18206 - DNA, 76 bp, Homo sapiens
tatatatgtgtatatatacatatatacgcatacataggtatatgtgtgtgtgcatgtgtatatatatatatatata

SEQ ID NO: 18207 - DNA, 115 bp, Homo sapiens
gctggttggctctttgtgattgactgaggttcttttctttttctattcttcttttcttcttctttttttttttttttttttgagtttcactctgtcacccaggctggagtgcagt

SEQ ID NO: 18208 - DNA, 135 bp, Homo sapiens
tgtatcaaaaatatatatgtgtatgtatatatgtgtatgcatatgggtctaaatatgtatgtattcatatatatatatacacatatatacatgtttatatatatttaagaaatacttgcattaaatatcagattc

SEQ ID NO: 18209 - DNA, 107 bp, Homo sapiens
tttcactttaatctggataggcttgtaaccaatagaaacctgcagtagtgagtggatgacttctgaggttaggtcataaaaaataatatgcagcttatgagttggaa

SEQ ID NO: 18210 - DNA, 201 bp, Homo sapiens
atgtgcatgtgtgtatatatacatatatgtgtgtatatttgtatatatacatatatacatatatgtgtgtatatttgtatatatacatatatgtgtgtatatttgtatatatacatatatgtgtgtatatttgtatatatacatatatacatatgtatacacacatgtatgactgcacataggtttgtatatatacatata

SEQ ID NO: 18211 - DNA, 101 bp, Homo sapiens
ggggatctcctgacccccgggttgcaaagatcagtggaagaagcataagtccccgcggtctctcattcactctctgtttccctgggcaggagagcctcccc

SEQ ID NO: 18212 - DNA, 70 bp, Homo sapiens
cagaatatatatgtgtatatatacatatgactgtatacatatgcatatacatacatatataaaatctctg

SEQ ID NO: 18213 - DNA, 72 bp, Homo sapiens
tatgtatgtgtgtgtgtctatatatatccagcacaaattatatatttatatatatacatatatacatatata

SEQ ID NO: 18214 - DNA, 102 bp, Homo sapiens
aggctgacagcaaccatacctgaggggctgccaggggctcctcgtttgtgctcagtgtgtgcagcctggcagagcagggtactacctgggccacgggagagc

SEQ ID NO: 18215 - DNA, 102 bp, Homo sapiens
atgtgaatatgctacctgccatgttgaatgagattttgtagatgtgattaagtaccttgagatgaaattatcctggttattctgtttggcatatagtcgcat

SEQ ID NO: 18216 - DNA, 77 bp, Homo sapiens
tgatgcccagagattgttcatgcccagagatagttcactttctctaagtgtatctctagctctctctctctttatca

SEQ ID NO: 18217 - DNA, 104 bp, Homo sapiens
agaggcccccaaagatatccagctcttaatctctggagtttgtgaatatgttattgtgttacatcgcttaagggaattaagggttcagagggaatttggccttt

SEQ ID NO: 18218 - DNA, 62 bp, Homo sapiens
cagtgatgttttggttgccctggaatcagtgtcagctcagagccagtgtccagtagtcactg

SEQ ID NO: 18219 - DNA, 72 bp, Homo sapiens
tggacgatgtatgggggagcaggaggacaagctggaaatttctgagtgtctctgtgtctgtcatcacctcta

SEQ ID NO: 18220 - DNA, 80 bp, Homo sapiens
ggttataaatagagatatagatatatttgtgtgctgcatatgtatataaatatatgtgtatcagattctttttacctgcc

SEQ ID NO: 18221 - DNA, 70 bp, Homo sapiens
ttcaactaggtatatatgtatgtatatatgtgtacataaatatacatgtgtatgcttatgtataagtgaa

SEQ ID NO: 18222 - DNA, 106 bp, Homo sapiens
ctggggttttacaactacagactctgctgtatgagtcaaacttttatatttatttatataaatacgatgccatagatttaagttctgtcattttaaaacccaacag

SEQ ID NO: 18223 - DNA, 95 bp, Homo sapiens; identical to SEQ ID NO: 580

SEQ ID NO: 18224 - DNA, 93 bp, Homo sapiens; identical to SEQ ID NO: 69

SEQ ID NO: 18225 - DNA, 86 bp, Homo sapiens
gtatgtacgtatacatatatatacgtatatatacgtatatacttatatgtatgtatatatacgtatatgtatgtatatatacgtat

SEQ ID NO: 18226 - DNA, 101 bp, Homo sapiens
atgacttgtatagatcaagggtgcattgcattggaaagtttttataatattttaattttttccattttgctatttatttggcccttaattttacattttgt

SEQ ID NO: 18227 - DNA, 123 bp, Homo sapiens
tatatacatacgtgtatatataaaataaaaaatattttctgtatatgtatagaagcgtatgtgtatatatgtttttattcatgcacatacatataggtgtgtagtatttggaaatatgtatat

SEQ ID NO: 18228 - DNA, 119 bp, Homo sapiens
tgaattattctaaaccataactttgtagctacatgatttgggtgagatgattttttttttttgagaaggagtctcgctctgtcacccagactagagggcagtggtgtgatcttggctca

SEQ ID NO: 18229 - DNA, 117 bp, Homo sapiens
tgtacaaggcgccactgcttgataattgattgtgtgtataccccattcttttttttttttcatactttaagttttagggtacatgtgcacaatgtgcaggttagttacacatgtata

SEQ ID NO: 18230 - DNA, 105 bp, Homo sapiens
gtcatgcacgctggagtgcaaaggtgcaatctctgctcactgcaaccttctctgcctcctgggttcaagagattcttctgcctcagcctcccacgtagctaggac

SEQ ID NO: 18231 - DNA, 66 bp, Homo sapiens
atatctgtatctataatctatagtctatatatatatatagactacatagacaataggggtagatat

SEQ ID NO: 18232 - DNA, 116 bp, Homo sapiens
ttcttgcaggagtaagggtattgcattgtggtttcgatttgaatttccctgatcattagtgattttgatcatttttccatatttttgttggccatttgtatatcttcttttgagaa

SEQ ID NO: 18233 - DNA, 149 bp, Homo sapiens
acagatatacaactattatatatgtgtgtaaatatatatatctgtgtatatatgtgtatatatagatgtatatgtgtatatatgtatgtgcatatacatgtgtatatatgtgtgtgtatatatatgtgtgtgtatatgtgtgtgtatgt

SEQ ID NO: 18234 - DNA, 117 bp, Homo sapiens
ttgcacttccagtctccacaactgtgagaaatatctgttttttttgtttgtttgtttttgttttttttttgagacagagtctcattctgtcatccaggctggagtacagtggtgcga

SEQ ID NO: 18235 - DNA, 112 bp, Homo sapiens
ttctgtcacatactcatttttctctgtttttgaaaatgtagattatttgaaaacaactaagaaatatttatatttacaaaagagttgataaatgcacattgtatatgcagaa

SEQ ID NO: 18236 - DNA, 79 bp, Homo sapiens
gcagagggtgaaagaaccaaagaaatgactatgatttttatttatttttttatttttttgagttggagtctcgctctgt

SEQ ID NO: 18237 - DNA, 77 bp, Homo sapiens
acctacatatctaacatctatctgtgtctctgtgtgtgcagataaacaggaacatagatcatagtcatagattgggt

SEQ ID NO: 18238 - DNA, 86 bp, Homo sapiens
tgaatgctcagactgtatatatatgttacgtatgtgtgtgtatatatatatatatgtatacacatatatatacacaaatgaattta

SEQ ID NO: 18239 - DNA, 95 bp, Homo sapiens; identical to SEQ ID NO: 68

SEQ ID NO: 18240 - DNA, 93 bp, Homo sapiens; identical to SEQ ID NO: 69

SEQ ID NO: 18241 - DNA, 58 bp, Homo sapiens; identical to SEQ ID NO: 13297

SEQ ID NO: 18242 - DNA, 86 bp, Homo sapiens
acaaacatatatatgtatatatgtgtatatgtgtatatatacacacatacatgcacagatatatatgtatatatatgtatatatgt

SEQ ID NO: 18243 - DNA, 132 bp, Homo sapiens
tacacatatatatgtacacatatatatgtacacatatatatgtacacatatatatacacatatgtatatatgtatatgtgtacacatatatatacacatatgtatatatgtatatgtgtacacatatatata

SEQ ID NO: 18244 - DNA, 106 bp, Homo sapiens
tttgtgccttttcagcattatgccagcaaggctcaaaatctttttttttttttttttgagacggagtcttgctctgtcgcccaggctggagtaacaaggccccaaa

SEQ ID NO: 18245 - DNA, 73 bp, Homo sapiens
tgtctgcggcacttattatgactggggcttgtagaactgaaatttgccctgtgtgagtagtgtgtgagcagcg

SEQ ID NO: 18246 - DNA, 117 bp, Homo sapiens
gaactgaaagctgttctgagtaagtcagtgaatgagtggtgagtgaatgtgaaggcctaggactttttttttttttaacttttaacattttatgaaaacagagcatttgaacagttt

SEQ ID NO: 18247 - DNA, 95 bp, Homo sapiens; identical to SEQ ID NO: 68

SEQ ID NO: 18248 - DNA, 93 bp, Homo sapiens; identical to SEQ ID NO: 69

SEQ ID NO: 18249 - DNA, 107 bp, Homo sapiens
agcatctgttgttcctgacttttaatgatcatcattctaactggtgtgagactgtatctcattgtggttgtgatttgaatttctctaatgatcagtgatgatgagct

SEQ ID NO: 18250 - DNA, 69 bp, Homo sapiens
gtgggccctcggggaggctgccaggggaggggaagcccactgtccctctgtttctctgctggtttccct

SEQ ID NO: 18251 - DNA, 81 bp, Homo sapiens
ggaagcaccggctccgctgcagtggacacagccctgcccacaggctgcccctctctgtgtgtgacttggccactgtcttcc

SEQ ID NO: 18252 - DNA, 93 bp, Homo sapiens
tccaccatcatgggggaaaataaaatgaagatagaagaattgatttagtagtataattgattttattattttaggtctttaaaatgtggtgga

SEQ ID NO: 18253 - DNA, 120 bp, Homo sapiens
tatatacacacacatatatatgtgtgtatatatacgtatatatgtatatatacacacaaatgtgtgtgtacacacacatatatatgtatgtgtatatatatgtgtgtgtgtgtgtgtgtg

SEQ ID NO: 18254 - DNA, 80 bp, Homo sapiens
ctgggattacaggctcccatcaccactcctgcctaatttttatatttttagtagaggtggggtttcaccatgttaaccag

SEQ ID NO: 18255 - DNA, 76 bp, Homo sapiens
tgtgtgtctgtatgcatatatgcatatatatgcatatacatgtgtatatatgtatatatgcatatatatgcatgca

SEQ ID NO: 18256 - DNA, 74 bp, Homo sapiens
cacacatatatatgtgtgtatatatataatatggatatatttggtaggtatatagacacacatatatatgtatg

SEQ ID NO: 18257 - DNA, 146 bp, Homo sapiens
gcatatatgtgtatatatgtatatgtatatatacatatgtacatatacgtgtgtatatatgtatgtatacatatacgtatatatgtgtatgtatgtatatatttatgtatgtacatatgtatatatgtgtatgtctatatgtgtat

SEQ ID NO: 18258 - DNA, 83 bp, Homo sapiens
ccactaaatatctctgtgtctcaccctgtgtcagccttctgccttagaggagtagcataacaatgatagcaggatgtttttgg

SEQ ID NO: 18259 - DNA, 185 bp, Homo sapiens
gatatatatacatcctttatatatagatatatatcctttatatatacatatatatcctttatatatagatatatatcctatatatatgtgataggatatatatatatcctttatatatacatatatatcctttatatatagatatatatcctatatatatgtcctatatatcctatagcctatat

SEQ ID NO: 18260 - DNA, 92 bp, Homo sapiens
aattctgtttattatatgtcactcagtctgtggtattctgttttatagcaacagaaaaaaaacagattaaggccatatatatatataaaatt

SEQ ID NO: 18261 - DNA, 107 bp, Homo sapiens
tatgtgcgcatgcgtggatgtgtaccatgtggacgtgtgtgtgtgtctctgtgtatgtggatgtgtacattgtgtgtgtgtctctgtaatacacacagatatacaga

SEQ ID NO: 18262 - DNA, 136 bp, Homo sapiens
cacagcaaggccacccgggacacgggagagcaatgccaatgcaacggcattgtgtgtgtgtctctgtatgtgtatgtgtgtttatttttctctgtatatctgtgtgtattacagagacacacacacaatgtacaca

SEQ ID NO: 18263 - DNA, 115 bp, Homo sapiens
cctctgtgccagaatacaaaatttgtaactaaaccagattctttttgttttcagaaaaatacttttatttttgaaataaaatctgtcttttttagtttttgatttaaaacgtagg

SEQ ID NO: 18264 - DNA, 98 bp, Homo sapiens
ctagaggactgataggctggaaatagaatggttagggaaagcttcattgcaaaaatagcattttatttatttatttattttcaacttttagtttctgg

SEQ ID NO: 18265 - DNA, 115 bp, Homo sapiens
attgttccacgtgttcatgtgtgcaattcttctcagagaaaatgtactcttttcatatctagtgatattcatgatgtatatagcttgtgaatgatatatgaaaacagggttcaat

SEQ ID NO: 18266 - DNA, 105 bp, Homo sapiens
gtttctacttttgcttggctctcattctctctttgcctgcctccgtgtaagacatgcctttcaccttccgccatgattgtgaggcctcttcagttttgtggaaac

SEQ ID NO: 18267 - DNA, 110 bp, Homo sapiens
cttctgtgctcgaactgttttatctgtgttttactgtctggtttttctggctgcttgtagctagagaagagaagtgattttcttgaaatgcacgaggctaaaaagggcac

SEQ ID NO: 18268 - DNA, 125 bp, Homo sapiens
tatatatatatgcgtgtgtgtgtgtgtgtgtatatacacacatagtatgtgtatatatatatagtatgtgtatatgtatatacacatactatatatatacacatagtatgtgtatatatatacac

SEQ ID NO: 18269 - DNA, 142 bp, Homo sapiens
atatatactatgtatatatatactatgtgtatatatataatgtgtatatatatactatgtttatatatataatttgtatatatataatgtgtatatatatactatgtgtatatataatgtgtatatatatactatgtgtata

SEQ ID NO: 18270 - DNA, 95 bp, Homo sapiens
agaggtccttcatatcccttgtaagttggattcctaggtattttattttctttgaagcaattgtgaatgggagttcacttgtgatttggctctct

SEQ ID NO: 18271 - DNA, 70 bp, Homo sapiens
aggacagacttggcagtaggggccatcttccctgttttcataaggttgtctctctgtatgtgtctaacct

SEQ ID NO: 18272 - DNA, 136 bp, Homo sapiens
atatgtgtgtgtatgtgtgtatatatgtattatatgtgtgtgtatatatgtatatatatgatatatacattacgtatgatatacagatttgtatatatctatatatatacacacacatatagatacacacacatat

SEQ ID NO: 18273 - DNA, 72 bp, Homo sapiens
gtgtgtgtatatatgtatattatatataatgaatatatatgtgtgtgtatctatatgtgtgtgtatatatat

SEQ ID NO: 18274 - DNA, 118 bp, Homo sapiens
cccaggaaaaggaggggcccggctcttccccgctgcaaatggtgcaaacttgtgtggctccagccaggtatgtgtttctcccagtgggcagtctgtcaggggctctcccagtcagagg

SEQ ID NO: 18275 - DNA, 106 bp, Homo sapiens
agggcatttctgggatatcaatgtatagttttttttttaatttttgagcaggaccctaattgttttatattaaaaggtatttgtgcaatgaagaacctaatgtgtt

SEQ ID NO: 18276 - DNA, 96 bp, Homo sapiens
gcaagatataagaaatttatttatctatttattggtttgaggtagagtcttgctctgtcacccaaactggagtgcagtgggatgatcttggcttgc

SEQ ID NO: 18277 - DNA, 87 bp, Homo sapiens
ttgcagagatcttttgcttccttgattaaatttactactaggtattttattttatttgtagctattggaggtgaaattactttgtag

SEQ ID NO: 18278 - DNA, 382 bp, Homo sapiens
tgtgcatatatatgtatatgtatatatgtgtgtatatatatgtgtgtatatgtatatgtgtgtatatatgtatatatgtatgtatatatgtatatatgtatatatgtatgtatgtatatgtatatatgtgtgtatatatctgtatatgtatgcatatatgtatatatgtgtgtatatatgtatatacatctatatatgcatatatatgtagatgtatatatgtatgtatatgtatatgtgtatatgtatatgtgtgtatatatacatatatacacatatatatacatatatatgtatatatgtgtgtatatatacatatatacacacatatatacatatatatgtatatatgtgtgtatatatataataacacatatatata

SEQ ID NO: 18279 - DNA, 117 bp, Homo sapiens
ttatttacagtctatgtgtctttataggtgaggtatgttacttgtaggcaacagatcagtgggtcttgttttttcattcattcagccatactattggagactttggaatgtaaataa

SEQ ID NO: 18280 - DNA, 110 bp, Homo sapiens
gaagtgagactgcagtggaataagaagaaagtgtaggtgacgagttttttttttttgaattatctatacatatctttattaatcactattgttccagcagttttcaagtc

SEQ ID NO: 18281 - DNA, 95 bp, Homo sapiens; identical to SEQ ID NO: 580

SEQ ID NO: 18282 - DNA, 93 bp, Homo sapiens; identical to SEQ ID NO: 69

SEQ ID NO: 18283 - DNA, 85 bp, Homo sapiens
atttcagggtgaaaacagagctcttatcaattaaatttttttttttttttgagacagagtctcactctttcacccaggctggagt

SEQ ID NO: 18284 - DNA, 143 bp, Homo sapiens
gtatatgtgtgtatacatatatatatatgcatggaagtgtgtgtatatatatgcatggaagtgtgtatatatatatatatatgcatggaagtgtatatatatatatacacacacacatacatgtgtatatatataacttacat

SEQ ID NO: 18285 - DNA, 97 bp, Homo sapiens
gttatatatatacacatgtatgtgtgtgtgtatatatatatatacacttccatgcatatatatatatatatacacacttccatgcatatatatacac

SEQ ID NO: 18286 - DNA, 95 bp, Homo sapiens; identical to SEQ ID NO: 68

SEQ ID NO: 18287 - DNA, 93 bp, Homo sapiens; identical to SEQ ID NO: 69

SEQ ID NO: 18288 - DNA, 79 bp, Homo sapiens
gtttggggcactttactggtctcaatcggtgatataacacttcactgttgagagacaggagtagctggatttcctaggc

SEQ ID NO: 18289 - DNA, 177 bp, Homo sapiens
gtgtacatgtttatgttttgtgtatatatgtataaatataagtatatttgattatataaatatatataagactgtatatttaattatataaatatatataagactatatttatataagtatatgtaagactatatgtatttaattatgtaagtatatatgactatatatacttatat

SEQ ID NO: 18290 - DNA, 78 bp, Homo sapiens
tccaggtctacgcacatgcttttcttagttcctttttttttttttagatctgagtctcgctctgtcgcctaggctgga

SEQ ID NO: 18291 - DNA, 66 bp, Homo sapiens
ttgtgagttggattcctaggtattttattctttttgtagcaattgtgaatgggagttcactcataa

SEQ ID NO: 18292 - DNA, 122 bp, Homo sapiens
tgtatatataaatatatgcacatatataaacatatatacaaatatgtttatatatgtgcatttatttatagttatataaaaatgttataagtatttgtatatgtaaatgtataaacatcttg

SEQ ID NO: 18293 - DNA, 70 bp, Homo sapiens
ttctgcgagtgagagcagactaaagcctggtgaggtgatcacatttctctgtctgactcccattccagaa

SEQ ID NO: 18294 - DNA, 83 bp, Homo sapiens
ggccggatttctcatgaacggtttagcactatccccttgctgttgttcccctgatagtgtgttagttcttgtgagagctggtc

SEQ ID NO: 18295 - DNA, 116 bp, Homo sapiens
aactcctacgtatatatatacatatatatatgagagagttcatatatatatgagagtacttatatatatatataaagttcccatatatatatatatatatatatatatatggagtt

SEQ ID NO: 18296 - DNA, 91 bp, Homo sapiens
gtgtgtgtgtgtgtgtatacacacatctatatatatatatccattatatggatatagatgtgtatgtgtgtgtgtatatatatatatacac

SEQ ID NO: 18297 - DNA, 113 bp, Homo sapiens
tatactttaagttctagggtacatgtgcacaacgtgcaggtttgttacatatatatatatatgtgccatgttggtgtgctgcacccattaactcatcatttacattaggtata

SEQ ID NO: 18298 - DNA, 65 bp, Homo sapiens
ttatgtgtctcagtttctctctccagaggtctgtgacctcagagaagactcaaaatggcaggtga

SEQ ID NO: 18299 - DNA, 113 bp, Homo sapiens
atatatgttatataaaaataatgtatatgtatatacatattacttatatattatatgtatatgtatacgtattatttacatattatatgtatacatatacatatatacatata

SEQ ID NO: 18300 - DNA, 100 bp, Homo sapiens
atatacatacatatatgtatatgtgtacatacatgtatatgcatatacatatgtatatgtatatatgtatatgtgtacatatatgtatatgcatatatat

SEQ ID NO: 18301 - DNA, 165 bp, Homo sapiens
atacattcagcatatatatatatatatatacatacacactgtatatatatatatatgctgaatgtgtatatatatacatgtatattcagatatatatttatattatattacatatatattatatataatatatatatctgaatgtctatgtccctccaaaattca

SEQ ID NO: 18302 - DNA, 79 bp, Homo sapiens
tgggataaatgatgatgaaaatgcagtgttaattcattgtttttaatgagttttagaggtattttatctgcatgtctca

SEQ ID NO: 18303 - DNA, 65 bp, Homo sapiens
gctacaagttgggtgctgtagtctccagctattattgtattggggtctgtctctctctctgtagc

SEQ ID NO: 18304 - DNA, 93 bp, Homo sapiens
aagtaattaacacaaccatattgaatgaaaagacataaatacagcagtatataatgtcttctcgagtattttatggaacatatgtgggtgctt

SEQ ID NO: 18305 - DNA, 116 bp, Homo sapiens
gcctccagctttgttctttttgcttaggattgtcttggctgtgtgggctcttttctagttccatatgaaatgtaaagtagtttttttccgattctgtgaagaacgttaatggtagt

SEQ ID NO: 18306 - DNA, 115 bp, Homo sapiens
acacttatgtatgtatatcatgtgtatatattatatatgtatatattatgtatgtatatattacatacataatatatacatatataatatatgtatatatgtatatattttatgt

SEQ ID NO: 18307 - DNA, 151 bp, Homo sapiens
tatgtgtatatatacatatgtgtatatatacatcctgcttttgtgagatgtctatttcattatatatgcatatatactatatatgtgtatatatacatacattatacatgtgtatatatatgtatgtctgtgtatatatacatacattata

SEQ ID NO: 18308 - DNA, 119 bp, Homo sapiens
ttatataaaaagagtagtacatgtgacatcatgttaaaaactcagatctcaataagttttattttattttattttaagttttggggtacatgtgcagaatgtgcaggtttgttacgtag

SEQ ID NO: 18309 - DNA, 77 bp, Homo sapiens
tgtttttagacagaccctcactctgtcacccaggctggagtacagtggtgtgattttctcttgggggggttcaagca

SEQ ID NO: 18310 - DNA, 92 bp, Homo sapiens
tgggaaatgttctaagatcctccaactctttagacaagatccattagtcttctcaccctaagagatcatagagaggagagaagaaattccta

SEQ ID NO: 18311 - DNA, 70 bp, Homo sapiens
ttgttttgagaccgagtctcactctgtcacccagcctggagtgcagtggtgccatctcagctcactgcaa

SEQ ID NO: 18312 - DNA, 118 bp, Homo sapiens
ggcaggagcaacagtgactgattggttgaaacatgaggattaatgggtatttatatttcattaaattgtatgctcactggagaataatgtatcactcgcagatattgaaacatatgtc

SEQ ID NO: 18313 - DNA, 78 bp, Homo sapiens
tttccttgtatatgtcactgtcttacttggttctatagttgagctaaattccaaagcagtgaaaaattctacaggaag

SEQ ID NO: 18314 - DNA, 119 bp, Homo sapiens
gtctcagcctctcaagcagctgaaactacaggtgggcaccaccatgccaatctttttttaaactttttgtagaaatggggtctcactatgttgcccagtctggtcttgaatttctgtac

SEQ ID NO: 18315 - DNA, 77 bp, Homo sapiens
ccactgtggtctgagatgacgatttcaatttttttttttttttggaaataattgagactctatgacctagcatgtgg

SEQ ID NO: 18316 - DNA, 101 bp, Homo sapiens
tatatatatatatgtgtgtgtgtatatatatatgtgtatatatatatgtgtgtatatatatgtgtatatatatatgtacacacacacacatatatgtagca

SEQ ID NO: 18317 - DNA, 103 bp, Homo sapiens
catgtatatacatatatatacacatacatacatgtatatatatagatacatatatgtgtgtatatatgtatgtatatgtatacgtatatatatgtgtatactg

SEQ ID NO: 18318 - DNA, 111 bp, Homo sapiens
atggatgattgaataatgaaaatgtggtgcaagaatatatatatatgtatgtgtatatatatgtatgtgtgtatgtatacatggatgacatttattatattctgtgtgtgt

SEQ ID NO: 18319 - DNA, 86 bp, Homo sapiens
caatgtgtgtgcatatatatatgtatgtatagtatacaacatgatgttttaatacagtatatatgtgtatgtatgtatgtatagtg

SEQ ID NO: 18320 - DNA, 72 bp, Homo sapiens
agatgagatttgagtgaggacacagagacaaataatatcattccacccctggatcctcccaaaatctcatgt

SEQ ID NO: 18321 - DNA, 82 bp, Homo sapiens
tatgtatatgagtgtatatatgtatatatacgtatatgtatatacgtatatatatatgtgtgtgtgtatatttatatatatg

SEQ ID NO: 18322 - DNA, 75 bp, Homo sapiens
agaggagatagactgaaacaattgagttatgaaagaataaactgttcattactacagacattctctgtctctttt

SEQ ID NO: 18323 - DNA, 113 bp, Homo sapiens
caccaggcagaggtcatgatgtggtttgtgacctgggctggcagggccacacggtcactctgtgcctactgctgtcacacagaccaagtctaataccctggggctgcctgagg

SEQ ID NO: 18324 - DNA, 109 bp, Homo sapiens
tctgcaaaatttgagactaatgtgttaaaaataattattaatttatgtttctggacatacaatacataaagacataatttttgtaatatcaatagctgaaagaagtaga

SEQ ID NO: 18325 - DNA, 107 bp, Homo sapiens
gaaaattcataagctgtggtagacattctgtgcaatatatatgtatattataaatatatatttatttgtatttaatattgctgggaataaatatatgcggaaaattc

SEQ ID NO: 18326 - DNA, 71 bp, Homo sapiens
tgtatactctactaagtatatatatgtgtatgtatatatatatatagcacatgtatatctgtgtgtatata

SEQ ID NO: 18327 - DNA, 77 bp, Homo sapiens
cttgattgctagatatagtttacatatgtgagcatagtgattatatatacatatatgtaactttattagcaactgag

SEQ ID NO: 18328 - DNA, 115 bp, Homo sapiens
tcgggtcaatcaccccagcccacattgtaagtccctccttagtctcttttttttttttttttttttttgagacggagtcttgctctgtcacccaggctggagtgcagtggtgcga

SEQ ID NO: 18329 - DNA, 65 bp, Homo sapiens
tatacactatactatagtgtatactatacttatatatacatatatacactatattatagtgtata

SEQ ID NO: 18330 - DNA, 232 bp, Homo sapiens
gtatgtatataattatgtatacatgtatgtgtttgtttgtatatttacgtgtgtatctttgtgtgtgtgtatatgtatataattccaaaattccaaattaactacatatgtatatatatatatacagtgaacagtatatatgtagttaacagtatatatagtatatatatataacagtgtatatatagtgtatatatatacagttaacagtatatatatagttaacagtata

SEQ ID NO: 18331 - DNA, 87 bp, Homo sapiens
ttggattctaggctgtgctggttggaagtgtagttctgtcaactgaattttgagccaagtcatgattaatacagcatttgcatctgg

SEQ ID NO: 18332 - DNA, 117 bp, Homo sapiens
tttactgtgtgatcttaggtactgggcattgtgttgggtatttttgtttatatatacatttattcatttgaaaatactttgaggttgctgtcatttttatctctattccacagttga

SEQ ID NO: 18333 - DNA, 110 bp, Homo sapiens
tgcttaggattgtctttgctataagggctcttttttggttccatatgaaatttaaactagttttttctaattctgtgaagaaagtcaatggtggcttgatggggatagca

SEQ ID NO: 18334 - DNA, 73 bp, Homo sapiens
gtaccagaagaatgcgtgctatgaaatatatgtatacgaagtgtgtgtgtgtgtctgtatgtgtgtgtggtat

SEQ ID NO: 18335 - DNA, 95 bp, Homo sapiens
aagggtaactatatgaggtgatggatatgttaattaggttaagtgtgctcacttcataatttatatgtatatcaaaacatcatattgtacacctt

SEQ ID NO: 18336 - DNA, 95 bp, Homo sapiens; identical to SEQ ID NO: 580

SEQ ID NO: 18337 - DNA, 93 bp, Homo sapiens; identical to SEQ ID NO: 69

SEQ ID NO: 18338 - DNA, 80 bp, Homo sapiens
tcctatcagatgctagcactggacacttcaaagccatcaggacatccagaggtgctgtctgtgtgtctgcgtgtgaggga

SEQ ID NO: 18339 - DNA, 109 bp, Homo sapiens
tatataatactatatattaatatttgtatggtatatattattttatatttacataatatagtaatatatatattaatacactatagtatataatgtacactattatata

SEQ ID NO: 18340 - DNA, 119 bp, Homo sapiens
agacaataatgttttcattaactgttccatcaatctaagtaactgttagtaaggcaaacctatatttatgttttcaaaaggtatctaggttgttggttactgtgaagttattgttgttt

SEQ ID NO: 18341 - DNA, 114 bp, Homo sapiens
gtaaacttcttattgtctcaatttgtttttctggtaaatggggcttataatgatgacatatatatatatacatatatttatacagacacatataatgagaggtgataagagtac

SEQ ID NO: 18342 - DNA, 116 bp, Homo sapiens
ggaaaaatcttactgcaggctgtgtttacaagtatatactgtatatatttatatacacacatatatatgtatatatataatactttaaactaaatacgtcaagtggaggtttattt

SEQ ID NO: 18343 - DNA, 89 bp, Homo sapiens
attttagtcattctggtgggagcatttcaccatgaatttttttttttaatttagtcatggtgaaatgctcctaccagaatgactaaaat

SEQ ID NO: 18344 - DNA, 91 bp, Homo sapiens
cacgaagatgctgcccacgtctctgtctctgagaatctgcttctgaagaaagaacccagattccaggagtgagagtgagacctatgaagtg

SEQ ID NO: 18345 - DNA, 117 bp, Homo sapiens
gtatatatagatgtctatgagtatgtacatatgtgtgtgtatatatattatatatatatttatatatctcaattgctgtgcataccatatccttaatctcagaaaaattatgtatac

SEQ ID NO: 18346 - DNA, 107 bp, Homo sapiens
gtgttgggattacaggcgtgagccaccgcgccctgcctatttttgattttttgatgatggtcattcttgcaggaataaggtgttatcacattgtggttttgatttgc

SEQ ID NO: 18347 - DNA, 74 bp, Homo sapiens
gttttttttgaggtggagtctcactctgtcacccatggtggagtacagtagtgcggtcttagctcactacaaac

SEQ ID NO: 18348 - DNA, 72 bp, Homo sapiens
gcatatatatatatatatatggcatttatatataacgtttatatatataatgtgtatatataatgtgtgtgt

SEQ ID NO: 18349 - DNA, 76 bp, Homo sapiens
tgccactgcggggggatagaggggtggtagcaattcaagacttttttctacctcctcagtgtctctttcagtgaca

SEQ ID NO: 18350 - DNA, 117 bp, Homo sapiens
aaatgctactgatttttgtgtgttgattttgtatcctgtaactttactgaatttatttattagttctaaaagattttgtgaggcctttagggtgctctacatatagatatgccattt

SEQ ID NO: 18351 - DNA, 102 bp, Homo sapiens
atcaagaaattgcaaatcacatttgaatgttccatccaaagtatttcttttattattaatttaaaaggattctttgtggtaaatgtgccacaatatcttgat

SEQ ID NO: 18352 - DNA, 85 bp, Homo sapiens
atgatatggtgggaggtatatgggtttattccatggttttctattctgttccattggtctgtgtgtctctctgtagcaatatcat

SEQ ID NO: 18353 - DNA, 85 bp, Homo sapiens
gtatgtatgtatattatgtatatattgagacatttatatctatttaatagatctgtataatatatacatgtatgtatatgtgtat

SEQ ID NO: 18354 - DNA, 118 bp, Homo sapiens
tagtatatgtatatatatgtatacagtatactatatatagtatatagtatatataatatatatagtatatatgtatatatagtatacatgtattatactatatatagtatatatacta

SEQ ID NO: 18355 - DNA, 98 bp, Homo sapiens
caaggtcgaaaactgcacagaactgtgtgtgcacacgtgtgtggatgtatgcacacatgtctgaatgtgtgcccttgcaggtgtgagcatgcctctgt

SEQ ID NO: 18356 - DNA, 103 bp, Homo sapiens
taaacactgtacacaggctgcactaaatgtatgtattttttatttaaattttattgcattttaatttctaggatacatgtgcagaacatgcaggtttgttaca

SEQ ID NO: 18357 - DNA, 104 bp, Homo sapiens
ttgctctgacacccaggttgagtgtagtggtgtgatggttaatattaagtgttaacttgattggattgaagggtgcaaagtattgttcctgggtgtgtctgtga

SEQ ID NO: 18358 - DNA, 64 bp, Homo sapiens
ctggaaggcactcccagagcccctggaactctggtccaaggctctctgactgactccttcccag

SEQ ID NO: 18359 - DNA, 89 bp, Homo sapiens
gagagtgacagtggctcacttcaggtgatgaattatatttttattcacctaaaactatcatttgtttctgaaggttagacattattctc

SEQ ID NO: 18360 - DNA, 87 bp, Homo sapiens
aagaaggaggaaatactcatgacagttacagtcctcgtttcagcagctggtcatgtggttgtagctggtattgatggctgccttctt

SEQ ID NO: 18361 - DNA, 100 bp, Homo sapiens
tgccactcctccaaaccagagttggagtctatttctttttctcttttttttttttttgagagggagtctcgctctgtcaccaggctggagggcagtggca

SEQ ID NO: 18362 - DNA, 105 bp, Homo sapiens
atggatagatctatgtgtgtgtatatatatagatacatatatgtatggatagatacatgtatgtatatatgtatatatctatctagtcacattttctttatccat

SEQ ID NO: 18363 - DNA, 108 bp, Homo sapiens
gtaccacatagtctaggttattacagtttgggattaagtttagaaagtatgagtccttcagtattgattttcttcttaaagattgtttggctgttctgtgtcctttgc

SEQ ID NO: 18364 - DNA, 73 bp, Homo sapiens
tgggattacagacatgagccactaggcccatctttatttttatttttgagatggagtctcgctctgtctccca

SEQ ID NO: 18365 - DNA, 79 bp, Homo sapiens
ctgtaagtgaatgtttctgtgtgtgcttgtgcatgtatgacggtatgggcttacacagagccttaaatatataagacag

SEQ ID NO: 18366 - DNA, 62 bp, Homo sapiens
tgagacagggtctcactctttctgtcacctaagctggagtgtagtggtgagatctcagctca

SEQ ID NO: 18367 - DNA, 117 bp, Homo sapiens
aggtaagggcaaaagaaatgtatgtatttcatacatatatgtatacaaacacacacacacacacacacacacacatatatatatatatatatatatatacatctttctctctctctt

SEQ ID NO: 18368 - DNA, 111 bp, Homo sapiens
cagttgaagtcttgagtttggaggaggttcttcagaatgagtcagagacagacacacacctgcctcttgtttgaggtgacttgtcctatacttttctgggttgcttttctg

SEQ ID NO: 18369 - DNA, 76 bp, Homo sapiens
tatgtatatgtgtatgtttatgtgagatgatattgcacacatggatctaatcatcaaaaaacatgcatgtatcata

SEQ ID NO: 18370 - DNA, 95 bp, Homo sapiens; identical to SEQ ID NO: 68

SEQ ID NO: 18371 - DNA, 93 bp, Homo sapiens; identical to SEQ ID NO: 69

SEQ ID NO: 18372 - DNA, 78 bp, Homo sapiens
gtaatgaataaaatacataggtataactaatgtccatcatttaatggatattttgatatctaagtttttgttttctat

SEQ ID NO: 18373 - DNA, 69 bp, Homo sapiens
tgatctgagaatatgcttagtatgatttttttaatttagagagatttatgtccaagcatattcaggtca

SEQ ID NO: 18374 - DNA, 118 bp, Homo sapiens
tttggtctgggcatttgtcgaagttctgaggatcctgttacaaataacctcgtgcagctttctttgtatctttttgaaatatgatctttctatagttttcttctaacctctagccaaa

SEQ ID NO: 18375 - DNA, 73 bp, Homo sapiens
gccagttgtagtagtcgtgtactgggcaggtgagtgagctcacagccttctgggtagctgggatgatgtgggt

SEQ ID NO: 18376 - DNA, 112 bp, Homo sapiens
ttttctgcttttgtaaagtgtgatttattctgtgtctgcctgtctgcctctcaactcgggagaggacagtggtttgccctataacttcacttctctgaaggacttaagaaga

SEQ ID NO: 18377 - DNA, 104 bp, Homo sapiens
ggctatttgcattctttatggttccatatgaattttagaatttttttcttaatttataaaaaagatattggaattatgatagggattatactgaatatgtagtt

SEQ ID NO: 18378 - DNA, 110 bp, Homo sapiens
tacaaaatgaggcattgctaataatcatagtgctaataagagattattatatatgttaatattttctttcttgttctacataatgcttatatgagtgttttcaatttgtg

SEQ ID NO: 18379 - DNA, 74 bp, Homo sapiens
tgttattatagaagacgtggccagaaggagacaactagctggctgtctcagtgggtctctcttcttatttttca

SEQ ID NO: 18380 - DNA, 68 bp, Homo sapiens
agctatatatatgtatatgtgtatatgtatagctatatatatgtatatatatgtatatatgtatagct

SEQ ID NO: 18381 - DNA, 274 bp, Homo sapiens
tatatatctatatctatatctatatctatatatctatatcaatatctatatatatctctatatatatctatgtctatatctatatatatctagatatatatctatctatatatatctatgtctatatatatctatatttatctatatatatctatatctatatatatctatatctctatatctatatgtctatatatctatatagatatatatagatatatatagatctatagatagagatagagatatagatagagatatagatatatataga

SEQ ID NO: 18382 - DNA, 98 bp, Homo sapiens
atatatatctatatatatatctatatatatctatatatatctatatatctatatatatctatatatatctatatatctatatctatatatctatatat

SEQ ID NO: 18383 - DNA, 95 bp, Homo sapiens; identical to SEQ ID NO: 68

SEQ ID NO: 18384 - DNA, 93 bp, Homo sapiens; identical to SEQ ID NO: 69

SEQ ID NO: 18385 - DNA, 96 bp, Homo sapiens
tatatatatatctcacacaaaaatacatgtatatatgaatacatgtatgtgtgtatatatgtgtgtgtgtatatatgtatatgtgtgtatctatat

SEQ ID NO: 18386 - DNA, 62 bp, Homo sapiens
tcatatatgtctgtgagtatgtgtgtgtatatatatatatataattattcatatatatatga

SEQ ID NO: 18387 - DNA, 118 bp, Homo sapiens
tatataggtgttatatatatatatatcctacgtaattgtatactatgtactataattacttatatataattatggaatatatatatcctcatatacaatttatataaatatataatat

SEQ ID NO: 18388 - DNA, 79 bp, Homo sapiens
tatatatacatggtatatgtatgtatatatgtatgcataagtatgtatgcatatatgcatatctattaaggtatatgtg

SEQ ID NO: 18389 - DNA, 71 bp, Homo sapiens
gttgaaccatatgaaatgactgatttttaatgtttttaacatgtataaaaatcaatttcttgtggtttgat

SEQ ID NO: 18390 - DNA, 84 bp, Homo sapiens
gaggatgtctggaggtgggagagatgctaactgccccgttcttagtgcacgtaagactcacactcccacacatggtatttcctt

SEQ ID NO: 18391 - DNA, 133 bp, Homo sapiens
ctgggttgggggtaaatcagagctttttttattatttttatttttatttttagagggagtctcactgtgtcacccaggctggagtgcagtggtttgatctcggctcactgcaacctccaattcccaggttcat

SEQ ID NO: 18392 - DNA, 145 bp, Homo sapiens
ctgctgctgtggatgtagctggctctgtggctatggctggcactgtgactgtggctgtggctggcactgtggctctgactggccctgtggctgtggctgtgagtggcactgtggctgtggctatgactggtactgtgtcttggct

SEQ ID NO: 18393 - DNA, 73 bp, Homo sapiens
cattgtggctgtggctggcactgtggctatggctggcactgtgactgtggctgtggctggctctgtggctctg

SEQ ID NO: 18394 - DNA, 109 bp, Homo sapiens
tctgtggatcaggaatctctgtatgccttagctggcttctctgtttctgtctatcacaagactgtaatacaggtattagccaaggctggggtctcaactgaactctaga

SEQ ID NO: 18395 - DNA, 111 bp, Homo sapiens
agggtggatagaagggttgaagttttaaacaggaaggtgagacataaagttatctactgataatgatgttgtctaaatttcttgtgacttctctcatgattatccaatcct

SEQ ID NO: 18396 - DNA, 118 bp, Homo sapiens
cagtgaaattggtagcttgaaatcagccagagtgagagaacaccacaaatggtacaaatcacttctcgatttgttattatgttgactgtctacacttatgtctatatttaagtgataa

SEQ ID NO: 18397 - DNA, 103 bp, Homo sapiens
gccatgtggaactgtgagtccgttaaacctctttttctttataaattacccagtcttgggttgtctttatcagcagtatgagaacggactaatatacataggt

SEQ ID NO: 18398 - DNA, 148 bp, Homo sapiens
atatatatacaaacatatatatgggtgtgtatgtatacatatatatgtatatatatgggtgtgtgtgtgtatatatatacatatatatgggtgtgtatgcatacatatatatgtatatatatatgggtgtgtgtgtgtgtgtatatat

SEQ ID NO: 18399 - DNA, 86 bp, Homo sapiens
ggttgcccatttttatggctatttcttgattatatgctaaaatgggtagattattcgtgagttttctggaaaaggggtgggcgatt

SEQ ID NO: 18400 - DNA, 63 bp, Homo sapiens
gtgtgtgtgtgcatgcttgtatggtgtgtgtctgtgtatgtgtgagtgtctgtgtgtgcgcac

SEQ ID NO: 18401 - DNA, 114 bp, Homo sapiens
gatatgaattaaagggtaaatatagagtttaacagcatagatcttaaaatccattatcataaggtagaaggatgtataatttatcatgattaaaatatactaaatgttcatatc

SEQ ID NO: 18402 - DNA, 65 bp, Homo sapiens
gtttctctgtggccctgagcctagagccaattggagaatgagagttcagagtgacaagagtaaac

SEQ ID NO: 18403 - DNA, 78 bp, Homo sapiens
tgtgtgtgtgtatctctctgtatatatctagatatatatgtagatatatatagatagatatttagatatatatacata

SEQ ID NO: 18404 - DNA, 120 bp, Homo sapiens
ccttagctattcagtctctttttctgttccatttgaatcttaaaatgagtttttctaattctgagaaaaatattattggtagtctcataggaatagcattgaatctgtaaattgctttgg

SEQ ID NO: 18405 - DNA, 68 bp, Homo sapiens
gtgtgtgtgtgtgtgtgtgtacctaaatgtccatcagtggcaggctggatatatatataattatatat

SEQ ID NO: 18406 - DNA, 93 bp, Homo sapiens
cctgtctgactgcttgagctggaacatcattctttttttttttttttttttttttttttttttttgagacggagtctcgctctgtcgcccagg

SEQ ID NO: 18407 - DNA, 114 bp, Homo sapiens
ggaggaggctgaggatgaggaattagaagagctttcatcaatgtcactgtcctctgaggaggatgaggtagatgtttcttctctctctgatgaagaatcactggctgaactgtc

SEQ ID NO: 18408 - DNA, 80 bp, Homo sapiens
gaactacaggcatggaccaacatactctactaatattttaaaatttttgtgtagagatatggtctggctatgttgtagtc

SEQ ID NO: 18409 - DNA, 101 bp, Homo sapiens
atggctgtagagtttttctggaaaaggcttgaaggaagcttttgaatatatttttaaccaaactacagggtcgtttctcagaaggaattgttctcaatcat

SEQ ID NO: 18410 - DNA, 108 bp, Homo sapiens
tggaaaactttcagaatacaataatatctaaagttctttcaatatttaacattcttttatacaaataaatattggaaaatggaagcatagaattgatttagttttcca

SEQ ID NO: 18411 - DNA, 79 bp, Homo sapiens
gaggaaagtggggtctgtccaattcaagtgggggaccccttctcagacactgagaccctcacatttctctcagtcactc

SEQ ID NO: 18412 - DNA, 101 bp, Homo sapiens
taccattacttttgtctggcatatatatatatatatatatatatatatatatatatatatatatatataaaatatttacaccacaggggtaaaaaagggta

SEQ ID NO: 18413 - DNA, 80 bp, Homo sapiens
catggttgcacttattatatatgtctgcttctgatggggaagcatcagaagtattatatattttttttgaagtaatcatg

SEQ ID NO: 18414 - DNA, 68 bp, Homo sapiens
tttgtgtgtatatatatataatatatatatatcccagatgtttgtgtttatgtgtctatatgtacaaa

SEQ ID NO: 18415 - DNA, 94 bp, Homo sapiens
gctataaataccattggtgtgatctctctctgtaatgctggttatagtatcaatgtatgaggcaggtgaacaggctcatggtatcttgagaagc

SEQ ID NO: 18416 - DNA, 98 bp, Homo sapiens
gctggccgtctgctgtgctttgtttttgttttttaatggattattttattgagttgacacaatgacagaatgagatatttattacagtttttgctagt

SEQ ID NO: 18417 - DNA, 136 bp, Homo sapiens
acgtatatatgtgtatatatgtatatatgtgtatatacgtatatatgtgtatatgtgtgtatatatgtatatatgtatatacgtgtgtatatatgtgcatatacgtgtgtatatatgtgcatatacgtgtgtatat

SEQ ID NO: 18418 - DNA, 106 bp, Homo sapiens
tatatatacatgtgtgtatatatatgtatatatgtgtgtatatatgtatatatatgtgtatatatgtatatatgtgtatatatgtgtatatatgtatgtatgtgta

SEQ ID NO: 18419 - DNA, 108 bp, Homo sapiens
ggagagagacccttttgggaagtgggcactctgtgtgaagagggtgacctcggtggagaggtcccctagtatggaaaaagtcccctaaatccagagagggtcaccttc

SEQ ID NO: 18420 - DNA, 112 bp, Homo sapiens
attagaaaaaacatgtgatattgtaaatgtcatttatgtcagcagcaagttatttttttttctatttgcgcttatgtagggctttaatttatcatgtcatctaccatctggt

SEQ ID NO: 18421 - DNA, 77 bp, Homo sapiens
gctggaagataccatttggccctttctttctgcttcctggaatggaatgaaatgaagtttcaacatttgtcttaggc

SEQ ID NO: 18422 - DNA, 94 bp, Homo sapiens
agaatgcttccaaataaagttatctgattatttttgaaatatgtaagtaaaagaggtatttcccaaattcatttaaacatttggaagacatttt

SEQ ID NO: 18423 - DNA, 95 bp, Homo sapiens
gtgcattaaggattgtgtgtgtgtgtatatatatgtgtgtgtgtgtgtaaatatatatataatgtaatatatatatatctatacaatccttacat

SEQ ID NO: 18424 - DNA, 78 bp, Homo sapiens
gaatgaaacgctgaggccccaggggaaacgtgtgcttttgtgcgcatgcacacacgctttctctctctcaacccattc

SEQ ID NO: 18425 - DNA, 56 bp, Homo sapiens
tgtgtatatatatatatatgtataagtgtatatgtgcatatatgtgtgtgtgtata

SEQ ID NO: 18426 - DNA, 94 bp, Homo sapiens
taagagatacatatatatatgtatgtgtatatatatgtgtgtgtgtgtgtatatatatatatatatatatatatatatatatggagacctttta

SEQ ID NO: 18427 - DNA, 101 bp, Homo sapiens
aaggagttctttattcaggtaagtttgaaaaacataaggtcaaataaagtgaaacactttttttgttgttgtttttaactgcaagacttctaagactcttt

SEQ ID NO: 18428 - DNA, 88 bp, Homo sapiens
tgtaatggatcagtgtgattctgtggaatgccccagccacatgatggagacaggagagtaaacacagagttcacatagagctgaggca

SEQ ID NO: 18429 - DNA, 85 bp, Homo sapiens
tggtaccgtgtatggtctaagtgtgtacataagttttgaaaaattttaattttttataaaaaattgtacatattttatggtagta

SEQ ID NO: 18430 - DNA, 90 bp, Homo sapiens
ccagaaaataaattgacattagacagtctctcagtctcgcggaagtgttctgattattcaagactgcttttgacttattttatgacatgg

SEQ ID NO: 18431 - DNA, 79 bp, Homo sapiens
ctttcacagtgttgatgaaactaggggtcatcaggctagagacagaagccttgccagactcagtttgtctctgagaagg

SEQ ID NO: 18432 - DNA, 101 bp, Homo sapiens
catgcaggggcactttgcttgaatatagatatagatacagatatatctatagatagatagaatatatctatatctatattcaggcaaagtgtacccgcatg

SEQ ID NO: 18433 - DNA, 110 bp, Homo sapiens
gcgagaagaggctaggaaacacttgatttcaaaacctagttttatcatttattatttgtgtgaccttaggaaatttagttaatttttctagtctcagatttcttatatgc

SEQ ID NO: 18434 - DNA, 75 bp, Homo sapiens
gctttctgtgtctcactctgagatcaaaaggttgtatcataaatgaacaatctcagagctagagagactggatgt

SEQ ID NO: 18435 - DNA, 71 bp, Homo sapiens
gcttagggtgtgcttcagtctgagtgtggcttacattaatcacactgacactgacttactttattgacagc

SEQ ID NO: 18436 - DNA, 116 bp, Homo sapiens
gggtttgaggggaagggattgttgggggttgttttgaaacagggtctctctctgtcacccaggctggggtgcagtagcatgatcacggctcaccgcagcctcaacctcctgggctc

SEQ ID NO: 18437 - DNA, 114 bp, Homo sapiens
actcatctgtacttacttacacaccaaaagaaacagaattgggataactgaaccataggaagtttagtctttttcatgttgtttggacttttggtcatgttgtacttttttggt

SEQ ID NO: 18438 - DNA, 104 bp, Homo sapiens
gtttgccttagtattccatggcacataatatatgtatatggtttatatatgtatatacacatatatatgtatatggttttcctgagtagtattctatggcacat

SEQ ID NO: 18439 - DNA, 84 bp, Homo sapiens
tatatacatgcatgtagcatatgtatatttgtatggtgtatatatatatatagtatataggtatatatgttatgtatgtatgta

SEQ ID NO: 18440 - DNA, 80 bp, Homo sapiens
tgaggcggagtctcactctgtcacccaggctggagtgcaatggcgcaatcttggctcactgcaagtgattctctgcctca

SEQ ID NO: 18441 - DNA, 103 bp, Homo sapiens
tctatatacagacatatatctatatatagatatgtgtgtagatacagatatatgtgtataaagatatatgtatatataaagatatatgtctgtatatagatat

SEQ ID NO: 18442 - DNA, 67 bp, Homo sapiens
tgatagaggaaggagagctggggaaatgtgtttcttcttattccttcagctctctctctctctctca

SEQ ID NO: 18443 - DNA, 88 bp, Homo sapiens
agataaagcaatatatacacacataatatatatatgtgtaatacatacacacttgtaggtttaagtgtgcacacgtgcatgtgtatct

SEQ ID NO: 18444 - DNA, 111 bp, Homo sapiens
tatatatgtatgtatgtatatgtgcaaacctatatacacatgcatatgtgcatgcatgtatatatgtatgcatatgtgtcatgcatatgtatgtatatgtttatgtatata

SEQ ID NO: 18445 - DNA, 105 bp, Homo sapiens
tgcagactgaatatatatatatatatgtgcgtgtgtgtatgtgtgtatatgtatatatatgtgtgtgcatatatatatatgtgtgcatatatatatatatatata

SEQ ID NO: 18446 - DNA, 76 bp, Homo sapiens
tgttttgagatggggtctcactctctcactctgtcacccaggctggagtgcagtggcatgatcttggtttactgca

SEQ ID NO: 18447 - DNA, 91 bp, Homo sapiens
actggaggccacatttcagtatctttgcatttcattgaggctgcatggctagctctcacctaaggaatgtaaagaactaaggctgcagtgt

SEQ ID NO: 18448 - DNA, 72 bp, Homo sapiens
ctgggtgtggtggcacgtgcctgtagtctcagctactctggaggctgaggtaggaggatcacttgagcctgg

SEQ ID NO: 18449 - DNA, 73 bp, Homo sapiens
caatacctgtctctcagtctgagtccatgataatcaccaattttctaaggggactgaggtgaacaggtggatg

SEQ ID NO: 18450 - DNA, 125 bp, Homo sapiens
taaagatctttattttctttgcttccccaactagattgtgacttagcattatgggctatattttttttttatggtgttgcttagtagagtatttggtgtagagtaggcctttaagtattttctag

SEQ ID NO: 18451 - DNA, 92 bp, Homo sapiens
gggaacccatgttatcataaagacgaagtgttgtgtttctgttctggaagaatcagataacatcattaaattaatggctgacatgaaaacct

SEQ ID NO: 18452 - DNA, 56 bp, Homo sapiens
gagactgagtcaccctctgtcacccagcctggagtgcagtggcacaatctcagctc

SEQ ID NO: 18453 - DNA, 90 bp, Homo sapiens
tgggtatctcagggacacttggtgtttattttttattttatttatttatttatttattttttttgagacggagtctccctctgtcgccca

SEQ ID NO: 18454 - DNA, 61 bp, Homo sapiens
atttgagacagactctcattctgtcttgcccaggctggagtgcagtggtgtgatctcaggt

SEQ ID NO: 18455 - DNA, 58 bp, Homo sapiens; identical to SEQ ID NO: 315

SEQ ID NO: 18456 - DNA, 81 bp, Homo sapiens
gtgaacccaacccaggatgtatgtatgtatgtatgtatgtatgtatgcatgcatgcagttatttttgagatggagtctcgc

SEQ ID NO: 18457 - DNA, 68 bp, Homo sapiens
tgggaggagtcaggatttccatagaagtacatcacttctgaatttcctgaagtagctctaatggccca

SEQ ID NO: 18458 - DNA, 56 bp, Homo sapiens
gagacagagtctcactctgtcgcccaggctggagtgcagtggtgagatctcggctc

SEQ ID NO: 18459 - DNA, 58 bp, Homo sapiens
tgaggtggagtctcactctgtcacccaggctggagtgcagtggcgtgatatcggctca

SEQ ID NO: 18460 - DNA, 101 bp, Homo sapiens
acaatgcaaagaaatgaaatctatacgttatagaaaaattgtgctgagagacaggttcaatttttatttttgagactagtggatggtgtttgtttgtttgt

SEQ ID NO: 18461 - DNA, 87 bp, Homo sapiens
tgtggattggcatgtgtggccgcctgctgcgggttggtgccgagaatgaggcagtttctgcatcagcagctctggtctatataacag

SEQ ID NO: 18462 - DNA, 86 bp, Homo sapiens
catatattctggattgattgattgattgattgattgtttttttttgagacaaggtctccctctgtcacccaggctggagtgctgtg

SEQ ID NO: 18463 - DNA, 61 bp, Homo sapiens
ttgagtcagagtctcactgtgtcgcccagattggagtgcagtggcgtgatctctggctcaa

SEQ ID NO: 18464 - DNA, 117 bp, Homo sapiens
gccttgcttttcaattcttatttattggggttgcaatgtgatattttaataattctttttttttttttttttttgagatggaatctcgctctgttgcccaggctggagtgcagtggc

SEQ ID NO: 18465 - DNA, 60 bp, Homo sapiens
ctgagactgagtgtcactctatcacccaggctggagtgcagttggtgccatctcagctca

SEQ ID NO: 18466 - DNA, 112 bp, Homo sapiens
tttatggcagaaccactggaatagtgaacattttgacataagttaaatgtccatcgcaacagaactgattaagttgtttatctatactgtggaatacatttcagccactaaa

SEQ ID NO: 18467 - DNA, 118 bp, Homo sapiens
accgatggtgaatgcagcctttgaatttgggttcactctgtttttgttttgttttttatttttaattgtttttgagacagagtctcactctgtcattcaggttggagtgctgtggcgt

SEQ ID NO: 18468 - DNA, 93 bp, Homo sapiens
aaatcaaaacagcatggttttacaactgcctttgaaataaagagagtattagtttcagagacaatttgattttatttatgctagttatgattt

SEQ ID NO: 18469 - DNA, 102 bp, Homo sapiens
tgttagaattgacaacataaactacttttgctttgaaatgatgtatgcttcagtaaaatcatattcaaatttattgagtactgcatcttgttattcctgaca

SEQ ID NO: 18470 - DNA, 100 bp, Homo sapiens
ttgtgtgtgtgaggggtttggttttgttttgctttgtttttgagacagtcactctgtcacccaggctggagtgcagcagcacaatctcggctcactgcaa

SEQ ID NO: 18471 - DNA, 99 bp, Homo sapiens
ttggccaggcatggtggctcatgcctgtaattccagcactttgggaggctgaggtaggtggatcacttgaggtcaggagtttgagaccagcctggccaa

SEQ ID NO: 18472 - DNA, 77 bp, Homo sapiens
gggtcagcagtagtcattttcatgattagatgtagagtgagcatgcagcaagttgtgaatatgaatacaattgaaac

SEQ ID NO: 18473 - DNA, 108 bp, Homo sapiens
ttgtccctggttcctggcacagagctcctaaaacctaatttcttgagttaaaagtgatagtaggatcttttgttcaaatgagggactcttggcagggcccctagacag

SEQ ID NO: 18474 - DNA, 56 bp, Homo sapiens
gggtgggggaagatactttattttattttttgaaacaaggtctcactctgtcaccc

SEQ ID NO: 18475 - DNA, 70 bp, Homo sapiens
ggctgggtttagggagggacaggttcttttttatctttttgagatggagtctcactctgtcacctaggct

SEQ ID NO: 18476 - DNA, 64 bp, Homo sapiens
gaggggtgtgtgtgtgtgaacatgcaggtgtgtacacatgtgtgtgactgtgtgtgttcccttc

SEQ ID NO: 18477 - DNA, 120 bp, Homo sapiens
gttgtattttggaatggtatttatgtagagaagcaatgagttcttgtttatttattttgcaagaattctacttattaaatcctctgctctaatagtttttatatcatttcaaataacaat

SEQ ID NO: 18478 - DNA, 90 bp, Homo sapiens
gctgactgagaggaaaatctgtctcccacactgactcagtctaacatgagaaatagtagcagggacaaatttaagtctactcttaaaagc

SEQ ID NO: 18479 - DNA, 82 bp, Homo sapiens
agaagggaatttgatcagagctttccgagggcacctggcatctcccataggccatgactctgtgattctctgacttccctct

SEQ ID NO: 18480 - DNA, 95 bp, Homo sapiens; identical to SEQ ID NO: 68

SEQ ID NO: 18481 - DNA, 93 bp, Homo sapiens; identical to SEQ ID NO: 69

SEQ ID NO: 18482 - DNA, 105 bp, Homo sapiens
gtgtgtgtacatatatatgtgtgtgtgtggagatatatatatatatatatatatatatatatatatatatacagtttctttatccactcatctatagataggcac

SEQ ID NO: 18483 - DNA, 87 bp, Homo sapiens
gcaatggctcccagtgatgcaggggacccaccaagtcctccttggagtggctttggaggtcactctgtctttgtctacagctcctgc

SEQ ID NO: 18484 - DNA, 103 bp, Homo sapiens
gccttggtcaggtggccctttctgttcatggtgtgtctatggcttcctccctgtcaccctgtggtgcccggccacacctcccacagtcatcacaaccaaatgc

SEQ ID NO: 18485 - DNA, 95 bp, Homo sapiens; identical to SEQ ID NO: 68

SEQ ID NO: 18486 - DNA, 93 bp, Homo sapiens; identical to SEQ ID NO: 69

SEQ ID NO: 18487 - DNA, 97 bp, Homo sapiens
gcagcagaaaagtgttaggagggattcagtaggggcttttgagttcatttaacaagagagaactcactgtggaaattagtggatctgcctttgctgt

SEQ ID NO: 18488 - DNA, 113 bp, Homo sapiens
cattcttttttgtggctgaatagtattccattgtgtttatataccatattttctttatttatccattggtgaacacttaggttgattctatatcctggctactgtgaatagtg

SEQ ID NO: 18489 - DNA, 118 bp, Homo sapiens
caggcttctgcctctggatttgttcatgcgtataatctctcatcattttgttaagacaccttgattttttcttttaatggaagatgttgttcattgatcaaatgttggccagtgtgtg

SEQ ID NO: 18490 - DNA, 95 bp, Homo sapiens; identical to SEQ ID NO: 580

SEQ ID NO: 18491 - DNA, 93 bp, Homo sapiens; identical to SEQ ID NO: 69

SEQ ID NO: 18492 - DNA, 58 bp, Homo sapiens
tgagatggagtctcacactgtcactcaggctggagtgcagtggtgtgatcttggctca

SEQ ID NO: 18493 - DNA, 110 bp, Homo sapiens
ggcagtgaggacacattcattaagcacaactgggaagtcatgttgtattttttttaatcttcattgtccccccatcccaagctcttcataaatgtctttctcatcttgcc

SEQ ID NO: 18494 - DNA, 113 bp, Homo sapiens
ttgaagtgtattctagtatagagtaatacatagtagtatgtgagacaagtttttttattatcaaagaagcaagttacggatacataaagtggagactagaatgaagtttttga

SEQ ID NO: 18495 - DNA, 58 bp, Homo sapiens; identical to SEQ ID NO: 1673

SEQ ID NO: 18496 - DNA, 110 bp, Homo sapiens
ccatagattgatggcttcaacagctgaatttgtgttttttacagtttggagattagaagtctgagatcaaggtgtcagcagagttggcttcggaggcctttctcctttgg

SEQ ID NO: 18497 - DNA, 132 bp, Homo sapiens
gtgaatatgtactgtatatttatatagtgaataggtactatatatatatatatatatatacacacacacacacacatatatatacacatatttacctatatatatttatatgtagtacctattcactaagtg

SEQ ID NO: 18498 - DNA, 95 bp, Homo sapiens; identical to SEQ ID NO: 580

SEQ ID NO: 18499 - DNA, 93 bp, Homo sapiens; identical to SEQ ID NO: 69

SEQ ID NO: 18500 - DNA, 92 bp, Homo sapiens
gctgaggttgctgaggcagaacagttgtccagactagttgcttggggagcaaggttgtctggatggtgtaagtttaacttaatggctttggc

SEQ ID NO: 18501 - DNA, 68 bp, Homo sapiens
gcgtgtctgtgcctgtgtgtccgcctgtgcgtgtctgtgcctgtgttcatgtgtgtgcgcctgtgcgt

SEQ ID NO: 18502 - DNA, 93 bp, Homo sapiens
gtgtgtgtgtatgtgtgtgtgtgtgtgtgtgtgtgtatatatatatacacagtcatatatatatatatacacacacacatatatatatgtata

SEQ ID NO: 18503 - DNA, 80 bp, Homo sapiens
caggtgtctctcagtctgtccgtacagtctctcagtttccggaatttgtagagagtctggcttgggctgggatgtgcctg

SEQ ID NO: 18504 - DNA, 113 bp, Homo sapiens
gtctgtatccctcactcactctggaagcattggttattattttttttcttctttttttgagatgaagtttcactcttgttgcccaggctggagtgcaatggcacgatctcagc

SEQ ID NO: 18505 - DNA, 92 bp, Homo sapiens
gtgggacctatccatctgtgtgttgacaagccctccaggttgtcctgaagcatgataaagcttgactaccactggtgtagagatggtcccac

SEQ ID NO: 18506 - DNA, 98 bp, Homo sapiens
gaagagaaggagtccgtcactgactcattgactttttttgagacagggtctcactctgtcacccaggtcggagtgcagtggtttgatgatagctcatc

SEQ ID NO: 18507 - DNA, 61 bp, Homo sapiens
tgagctcctttccttatcaaagcactccaccaactcaagcagtgaggagagagtgggctca

SEQ ID NO: 18508 - DNA, 77 bp, Homo sapiens
ccagtacttgactagactgccaggatttgagttctctgtctctcaggattttgtggtcaggcagtgtaacatagtgg

SEQ ID NO: 18509 - DNA, 117 bp, Homo sapiens
ggatgcagagagacacagaaatagaccttcaaatagcttttggttattgctaatatatttttaaatgttcttcaagggctgcttgtcccagggataatttctgtcttggagttttcc

SEQ ID NO: 18510 - DNA, 62 bp, Homo sapiens
catgtatgtatgaatgtatgaatatatgtatgaactcatgtatatgcatgaatatatatatg

SEQ ID NO: 18511 - DNA, 86 bp, Homo sapiens
atatgtattgcatagcaatatatatatatgtattgcatagcaatatatatatatgtattgcatagcaatatatatatatgtattgc

SEQ ID NO: 18512 - DNA, 86 bp, Homo sapiens; identical to SEQ ID NO: 18511

SEQ ID NO: 18513 - DNA, 86 bp, Homo sapiens; identical to SEQ ID NO: 18511

SEQ ID NO: 18514 - DNA, 118 bp, Homo sapiens
ctggtattcacggttgagagacctgcagatggttcacgacacaagactctgtgcagacaacaatgtatgtctaagtctgtttttgtttgaattattttggcttttgtgtgtctgagag

SEQ ID NO: 18515 - DNA, 84 bp, Homo sapiens
aggctatacctagaagagaaaaaatgatttgtaaaagcagtggggctatttgcgattgctttttttttttcttaaatatcacct

SEQ ID NO: 18516 - DNA, 80 bp, Homo sapiens
gctttgtgtgctgtacagtgtgtgaatataatactattgtacaaatgtggaattatttcatatttttatagcaaactagc

SEQ ID NO: 18517 - DNA, 95 bp, Homo sapiens; identical to SEQ ID NO: 68

SEQ ID NO: 18518 - DNA, 93 bp, Homo sapiens; identical to SEQ ID NO: 69

SEQ ID NO: 18519 - DNA, 77 bp, Homo sapiens
tgatgcccagagattgttcatgcccagagatagttcactttctttaagtgtatctctagctctctctctctttatca

SEQ ID NO: 18520 - DNA, 116 bp, Homo sapiens
catagcaactggtatatagtaactaggtggcccgatggtcttcataataaagttatattttactttagtataaaataaaaggtcaaggcttgtaactgtgatgagactgcttcatg

SEQ ID NO: 18521 - DNA, 111 bp, Homo sapiens
cacacacacaaaaaaaaaaaaatatatatatatatatatatatatgtatatatacacgtatgtgtgtgtgtgtatatatatatacacacactatatatacgtgtatatata

SEQ ID NO: 18522 - DNA, 62 bp, Homo sapiens; identical to SEQ ID NO: 18218

SEQ ID NO: 18523 - DNA, 118 bp, Homo sapiens
gtaacattatcatactttgtcagtgggaatactatgtgtttataatattataatataatattagattagattaaatataatattctatctgtagagcaaggtttaagatatattttat

SEQ ID NO: 18524 - DNA, 108 bp, Homo sapiens
atacactacctcaattaccttaaaaatgtatatgcatatgtatatgtatgtatgtacatatataaatatatttgtaattatacatttgctaataatgaatatctgtat

SEQ ID NO: 18525 - DNA, 87 bp, Homo sapiens
acagtgaccttacttttccaattaagtggaccaaaaggaaattttcctttttttttttttcttttttgagacagagtctggctctgt

SEQ ID NO: 18526 - DNA, 91 bp, Homo sapiens
gggaatctgtatgagacagagagggagacatgagactggaagggaaaccagaagccagaattttttttttttttttaagacagagtctcat

SEQ ID NO: 18527 - DNA, 77 bp, Homo sapiens
cttggggtggggccatgggggtgggaagagaagacgtaagctggagaagactgccactctcagtggctcagcccagg

SEQ ID NO: 18528 - DNA, 139 bp, Homo sapiens
ctatgttgtttatatagatatgtgtgtgtatgtatgtagatgtagatgtgtatatatatatatatatatatatatatatatatagatgtgtatgtatgtatattgtatacatacatataaaatatgtacatatatttat

SEQ ID NO: 18529 - DNA, 105 bp, Homo sapiens
tacaagtcacactgaggcttctcaacacagagaagttactctccaggctctcaggacagagtgaggatagtggctatgagaaagtcaggaatagtttgccttgtg

SEQ ID NO: 18530 - DNA, 112 bp, Homo sapiens
tctagtgtggggttcagggattggcacactgtgaggggcggcaggaagtgggtactctagtgattttgctgacattcgtgggggcacagcccctgaagcacctgcactgtgg

SEQ ID NO: 18531 - DNA, 64 bp, Homo sapiens
gtgtgtatgtgtgtctatatatgtgtgtatatatgtatatatgtgtgtgtatatatgtacatat

SEQ ID NO: 18532 - DNA, 85 bp, Homo sapiens
gtgacaatttcttggttcagggatgattagacatatccaaagagtgggagactagtaatattctagacacatcaagaaatagcac

SEQ ID NO: 18533 - DNA, 58 bp, Homo sapiens; identical to SEQ ID NO: 4281

SEQ ID NO: 18534 - DNA, 91 bp, Homo sapiens
agtagatgctcagtaagaatgtgttgaatgaatgtatgtatgagtaaataacaaattgattaattaatattttatttatggagcttctact

SEQ ID NO: 18535 - DNA, 98 bp, Homo sapiens
ttctagtgcccacatccctaacccccattttgcattttgtgtatgtgtggagagagacagacagacagagagacaggcagggagactgagagccagaa

SEQ ID NO: 18536 - DNA, 103 bp, Homo sapiens
tagatgtttttgatcccaatctaatatacatatctctatatgtgcacagaagaaagactggaaatatatattgggagtagttgtttctgggaggatgattcta

SEQ ID NO: 18537 - DNA, 80 bp, Homo sapiens
ccacagtgggtagagcatggagatgggcatatcagggtatcgatttccctccctccctgactgcctcagagagtggtgct

SEQ ID NO: 18538 - DNA, 85 bp, Homo sapiens
ttgctctacttggaccaactccttctggctcacacttgacaagagtgtaagctcagagaggcaagaatgggtctgacttagacaa

SEQ ID NO: 18539 - DNA, 99 bp, Homo sapiens
tcctaggtattttattctctttgaagcaattgtgaatgggagttcactcatggtgtggctctctgtttgtctgttattagtgtataagaatgcctgtga

SEQ ID NO: 18540 - DNA, 112 bp, Homo sapiens
ttgtatatgcaattgtattgtatatgtatatttgcatgaattgtatatgtgtgtatatatatatttgtgagaattgtaacatatatttgcaaatatacaaacaaaaattgta

SEQ ID NO: 18541 - DNA, 127 bp, Homo sapiens
acacaagaagagtatgtatatatatgtgtgtatatatgtgtatatacatatatgtgtatgtatatgtgtgtgtatatatgtacatatatatgtacatatatacacacacatatacatacacatatat

SEQ ID NO: 18542 - DNA, 82 bp, Homo sapiens
atgtctgtatagtgtgtgcatatgtgtagtgtgggtattatgtgtatatgtgtgtatatatgagtgtatagtgtgtggacat

SEQ ID NO: 18543 - DNA, 110 bp, Homo sapiens
tgcttaggattctcttggctatacaggctcttttttggttccatatgaaatttaaagtagttttttctaattctgtgaagaaagtcaatggtagcttgatggggatagca

SEQ ID NO: 18544 - DNA, 84 bp, Homo sapiens
atacatgtacacatatatatgaatatatacatatatacatacacatatgtgtgtgtgtatgtatgtgtgtgtgtgtgcgtgtgt

SEQ ID NO: 18545 - DNA, 73 bp, Homo sapiens
gggtctcactctgtcactcagctagaaatgcagctgagtgatcagctcagtgcagcctcaacctcccagactc

SEQ ID NO: 18546 - DNA, 115 bp, Homo sapiens
gagttaatgtctacttgtctggcataagtatggctaccttgctctctttggttatcattttcatggaatatcttttgccatactttcactatcagtctatgtatatccttaagtc

SEQ ID NO: 18547 - DNA, 58 bp, Homo sapiens
tgagacagagtctcactctgtcgcccaggctggagtgcagtggcatgatctctgctca

SEQ ID NO: 18548 - DNA, 75 bp, Homo sapiens
tctctgtccatatatgtgtgtttaatctttatacacacacacacacacacacacacacacatatatagacagaga

SEQ ID NO: 18549 - DNA, 76 bp, Homo sapiens
ttgaacataataatgttcattatatataatgttcaataacattataatgaacattatgttcaataacattataatg

SEQ ID NO: 18550 - DNA, 85 bp, Homo sapiens
aatacatttgcttgaacataataatgttcattatatataatgttcaataacattataatgaacattatgttcaagcaaatgtatt

SEQ ID NO: 18551 - DNA, 95 bp, Homo sapiens
agatgtgggtgaaatgcgggtgattgtcaagaatctgtaatctctttaaatatgattattattttttgagacagtcttgctctgtcacccaggct

SEQ ID NO: 18552 - DNA, 75 bp, Homo sapiens
gtcttactgaggtcagagtagcgttgagattttttttttttttgagacagtctcgctctttcgcccaggcctgac

SEQ ID NO: 18553 - DNA, 78 bp, Homo sapiens
cagagattaagctagtgggtgggaggtggagcctgggatggaacacagggctctctctcacacacaggcctgttcctg

SEQ ID NO: 18554 - DNA, 85 bp, Homo sapiens
gctgaaggaaccaacatgagagtgctgagtgaggagaatggcaacctccctctgcttaaatctgttttgtgttgtggttctctgc

SEQ ID NO: 18555 - DNA, 115 bp, Homo sapiens
cagtgcccctttgggcagcgggagccagtgtggtgtccctgcagctcagtgtctccctctctggccttcccagcggacaaacagttcacagcagctccggctgcccactccactg

SEQ ID NO: 18556 - DNA, 92 bp, Homo sapiens
ctgtagcccagtatgtcatgctgtccctgaggtacaaaaccagggtgggctgcttccctgtgtgcctcagctgtggtgcaagtggggcacag

SEQ ID NO: 18557 - DNA, 110 bp, Homo sapiens
gtacctaatgcattctcatttggaatatgtgatctgtagaaatggaaatatttttatttattttactgtttttataggaggttcgtaaagtgaatgaaagcatcaagtat

SEQ ID NO: 18558 - DNA, 100 bp, Homo sapiens
gataatatgctatataatgtatacatgttgttttatattagctattatgttacataataacatatatatatataacacatatacactttaagcatttttc

SEQ ID NO: 18559 - DNA, 93 bp, Homo sapiens; identical to SEQ ID NO: 69

SEQ ID NO: 18560 - DNA, 95 bp, Homo sapiens; identical to SEQ ID NO: 68

SEQ ID NO: 18561 - DNA, 93 bp, Homo sapiens; identical to SEQ ID NO: 69

SEQ ID NO: 18562 - DNA, 98 bp, Homo sapiens
gtatttgctactttaccctcactgttgcgctgtctctctctctgtaggtaaggagaggatgtgttcacaacagctaagaaacaaacctgcatgcgtac

SEQ ID NO: 18563 - DNA, 90 bp, Homo sapiens
ccactgggttacacgggttaactgcctaactgtagttagaaagcactagaaagtaacagcaatttggggaggttaacctggcatctaggg

SEQ ID NO: 18564 - DNA, 65 bp, Homo sapiens
ctgtagtttgctgaacaggacaggggtgggtgggactggcccacttctcacacagtgagtcacag

SEQ ID NO: 18565 - DNA, 90 bp, Homo sapiens
gcctacttctgtcaattcgtgagtctcattctctgtccagttttgtgcccttcctggagaggagttgtgattatttggagaagaagaggc

SEQ ID NO: 18566 - DNA, 65 bp, Homo sapiens
gatctgaatttctctctttctctaaggagtcttggttcctttgagtggaggatgctatttagatt

SEQ ID NO: 18567 - DNA, 117 bp, Homo sapiens
atggtagttcttagttctttgagaaatcaccagactgcttttcacagtggctgaactaatttacagtcagaccagcagtgtataagcactcccttttctccacaaccttgctatcat

SEQ ID NO: 18568 - DNA, 114 bp, Homo sapiens
gaaaatactggttcattgagttatgcttgattttccaaatgttatcatatttttattatgatacacatcacatttgttaatatcaccactaacatcatcaaaataagttttttt

SEQ ID NO: 18569 - DNA, 80 bp, Homo sapiens
ggcagcctgatcactgtacatagaaagcaggttttttggcacatggtcaaagaaatttttcttatgaaatcatttctgcc

SEQ ID NO: 18570 - DNA, 102 bp, Homo sapiens
tctacagttggaatttattgacaatttttatggcataatatacatgatcaatctttataaatgtttaatgggctctagaaaggataatgtatttcctgtagg

SEQ ID NO: 18571 - DNA, 111 bp, Homo sapiens
tcgggaatgttcattatgtgcagtataaaagtatgtatttgtggtagtttcttgggaaatttttttgcttttatattttttttcttctattgcaatcttagtaacccttga

SEQ ID NO: 18572 - DNA, 115 bp, Homo sapiens
ctgtgtgtatgtgtgtgagtgccaggttgcaatacaaaatatatttattattgtagtttctggtaaaaaaaaaaatgtttgtaaacactggcataaacccccatttggttaatag

SEQ ID NO: 18573 - DNA, 57 bp, Homo sapiens
tgagacaggatctcactctgtctctgggcaggagtgcagtgtcgagatcatggctca

SEQ ID NO: 18574 - DNA, 64 bp, Homo sapiens
agtttcagcagcaacacagtgcttggctaggcactctataaatgtgtgttgaatgactgacact

SEQ ID NO: 18575 - DNA, 89 bp, Homo sapiens
cggaaagctggtcacttctctcacagggatatcagaatatttttaaatgaactcaggtcaccttgaaaaaggactagttttaaaatacg

SEQ ID NO: 18576 - DNA, 71 bp, Homo sapiens
gccccccaaatgatacgttcacattttaacccctgagatctgtgacagtgaccttatttggaaaagggggt

SEQ ID NO: 18577 - DNA, 106 bp, Homo sapiens
aatcatttcactggcaccttaggtacagaatcttgtctcattaatttttaaaaattaatttttgaaatctttccataatacctagcacaatgctggtcatatggtt

SEQ ID NO: 18578 - DNA, 60 bp, Homo sapiens
tgtgtgtgtatatatatacatatacacacacacagacacatgcatatatatacacacaca

SEQ ID NO: 18579 - DNA, 58 bp, Homo sapiens
tgagacagagtctcgcactgtcacccaggctggagtgcagtggcatgatctcggctca

SEQ ID NO: 18580 - DNA, 128 bp, Homo sapiens
ggagagaggggtgatgtaagaagctcaagagatacataggtgaaatttggaaagagaagatagagaacacccaagtcatgttttacgtacctctcttttgagtcctttcccctcccctgcttattcca

SEQ ID NO: 18581 - DNA, 100 bp, Homo sapiens
gcaatttaagtactttgtagtaaaattgtttgaaagtattggtaaattactggtttataagatatttttaaacatatatatttttgttttattaatttgc

SEQ ID NO: 18582 - DNA, 56 bp, Homo sapiens
gaggcagagtctcgctctgtcacccaggctggagtgcagtggcgagatcttggctc

SEQ ID NO: 18583 - DNA, 156 bp, Homo sapiens
cttgctttggaaccagatgaagctgacttcggctcatggctctgtcagtcagtaactgtgcgatcttaggcaagttgctcagtctctctgagcctcatatctttatttgtaaagtgggcatagtattacctgctttatgatgtgtattcagagagg

SEQ ID NO: 18584 - DNA, 99 bp, Homo sapiens
tttaattttattgaactgtatactttaaaaaggatggatatagtatgtaaattatgtctcaacctgatttaaaaacaaaaacttcaatagatggttaaa

SEQ ID NO: 18585 - DNA, 124 bp, Homo sapiens
cttgggtgtaggtgggttccatttgaagattttttttttttttttgagacggagtctcgctctgtcactcaggctgcagtgcagtggcgccatctcggctcactgcaacctctgcctcctgggt

SEQ ID NO: 18586 - DNA, 83 bp, Homo sapiens
atctatgtatttcattgtttttgtaaatacctttgtgtctagatacacaaacttgggttatgagaattctgaattttatgggt

SEQ ID NO: 18587 - DNA, 56 bp, Homo sapiens
tgtgcttgtggtaccagctactcaggaggctgaggtggtaggatcacttgagtcca

SEQ ID NO: 18588 - DNA, 59 bp, Homo sapiens
tgagccaagtgtctcgctctgtctcccaagctggagtgcagtggtgcaatatcggctca

SEQ ID NO: 18589 - DNA, 95 bp, Homo sapiens; identical to SEQ ID NO: 68

SEQ ID NO: 18590 - DNA, 93 bp, Homo sapiens; identical to SEQ ID NO: 69

SEQ ID NO: 18591 - DNA, 117 bp, Homo sapiens
tccagctttgttctttttgcttaggattgccttggctatgtgggctctttttttggttccatatgaaatgtaaagtagttttctctaattctgtgaagaaagtcaatggtagcttga

SEQ ID NO: 18592 - DNA, 73 bp, Homo sapiens
gccttgaaggtattagagctcaatttttttttttttttttttttgagatggagtctggctctgtcccccaggc

SEQ ID NO: 18593 - DNA, 104 bp, Homo sapiens
attatacatatatgtatatatgtatatatgtttatatatttatatatacatttttatatatgtttacctatagtatatattatatgtgtacatgtatatgtagt

SEQ ID NO: 18594 - DNA, 92 bp, Homo sapiens
gtagcctactgagttgaaaaaagtttcttgtttatttgaagatttctaatactagcttctaggtcctccgtttcaccctcaaggagggctgc

SEQ ID NO: 18595 - DNA, 86 bp, Homo sapiens
gtatatatattcgtatctatatatatacagtatatatattcgtatctatatatatacagtatatatatttgtatctatatatatac

SEQ ID NO: 18596 - DNA, 68 bp, Homo sapiens
ctgggatagggtctgggaaaatggtcttttttttttttttttgccaaaatattcccagattattctag

SEQ ID NO: 18597 - DNA, 67 bp, Homo sapiens
gttgtgtgggtgagattctgggatgtggcagctggattctttgctcagagtctcacctgatgttagc

SEQ ID NO: 18598 - DNA, 76 bp, Homo sapiens
acatgtgtgtgcatgtgcatgtgtgcgtgtgtgtgcatgtgtgcatgtgtgtgcatgtgcatgtgtgcatgtgtgt

SEQ ID NO: 18599 - DNA, 75 bp, Homo sapiens
tgtgtctgtctgtgtgtgtgcgtgtatatatataatatgtatatataaacatgccagctataggattgtgataca

SEQ ID NO: 18600 - DNA, 115 bp, Homo sapiens
ctgggatttgaacccatgtctggctctgaaactcccccttgtccaggacatcatgccaggagggagtcaggacagggggaggtcaagaaggcacagaggtaggagagaatcgcag

SEQ ID NO: 18601 - DNA, 74 bp, Homo sapiens
tatatatatatatgtatgtgtgtgtatatatatatgtgtgtgtatatatatatacacgtgtgtgtgtgtgtgtg

SEQ ID NO: 18602 - DNA, 112 bp, Homo sapiens
gttggtctggaggctatttgttagctttctttatagccatagatttttattttttaagcagtgtagaaaagatctgaagaggcaagttctgagtaagccttcaggctgtaac

SEQ ID NO: 18603 - DNA, 91 bp, Homo sapiens
agccagagggaggggggaggattgcctgtacaatgagatttgaaagtctttttttttttttgagatggggtctcactctgtcacccaggct

SEQ ID NO: 18604 - DNA, 115 bp, Homo sapiens
actccagcctgggccacagaatgagaccatgtttttatttatttatttttatttatatttatttttatttttattttttttgagacggagtcttctctgtctcccaggctggagt

SEQ ID NO: 18605 - DNA, 117 bp, Homo sapiens
tcccttcatttccatgtgtcctatttgttgttgccaacagggtgtgtcagtgggtctgactatctcccccaactgcctcattcctgccaatccagaccccaagtcaacactcaggga

SEQ ID NO: 18606 - DNA, 96 bp, Homo sapiens
ggttaaagaaaagttgtgtgtatgtatatgtatatgtgtgtatatatgtatacatatgtatatatgaatatacacatatgtatacctatgcatata

SEQ ID NO: 18607 - DNA, 92 bp, Homo sapiens
tttgtagtatgtatacctctcgctcactctgtcttacttgctaaaatctaagcacagtgcaaccagactgagaggtcaaaccatataataag

SEQ ID NO: 18608 - DNA, 119 bp, Homo sapiens
gctaatgatatttgtatattgattctgtatcctgcaactttactgaatttgttgatcagttctaatagtttcttggtgaagtctttaagttttaacaaatataagataatatcatctgc

SEQ ID NO: 18609 - DNA, 87 bp, Homo sapiens
tgctcagtaattagtatgtgagagtaatacattattttttatttttttgagatggggttttgctcttgttgcccaggctggagtgca

SEQ ID NO: 18610 - DNA, 188 bp, Homo sapiens
gcaatgtgtgtgtgtatatatgtatatatatgtatatatgtgtatatatgtatatatgtatatatgtgtatatatgtatatatgtgtatatatgtatatatgtatatatgtgtatatatgtatatgtgtatatatgtatgtgtgtatatatgtgtgtatatgtgtgtatatatttatatataaatata

SEQ ID NO: 18611 - DNA, 95 bp, Homo sapiens
gctacaggtcaagtctgatatgtcaaatctgtatttgaacttctgtgaagttcagtatagtcagtatttttgctatatatgatgttgctggtggt

SEQ ID NO: 18612 - DNA, 74 bp, Homo sapiens
gcgtgtgtctgtgtctgtctatgttttcgtgtttgttgggagtgacacgaaggctgagggaaaaaataaagcat

SEQ ID NO: 18613 - DNA, 102 bp, Homo sapiens
actctggatctctcattgactagaagctgccacatgcctttttttattttttattttttatttttttgagacaaggtcttgctctgtcacccaggctagagt

SEQ ID NO: 18614 - DNA, 77 bp, Homo sapiens
tatatgtgtgtatatatatgtacatatatattatatacatcctataatatatctgtgtgtgtgtgtatgtacgtgta

SEQ ID NO: 18615 - DNA, 58 bp, Homo sapiens
tgagacggagtctcgctctgtcgctcaggctggagtccagtggcgcgatcttggctca

SEQ ID NO: 18616 - DNA, 76 bp, Homo sapiens
ggtagaatacaaagagaacttgctgtttcataaacttagtatgagtttgcatgtctctctctgtatgtgtgttact

SEQ ID NO: 18617 - DNA, 91 bp, Homo sapiens
tcatattgtatcatgagtttatagtgtatgtatattttacatacatatttttaaatttttacatacactataaactcatactacaatgcga

SEQ ID NO: 18618 - DNA, 75 bp, Homo sapiens
gtgatggagttctcgtgagagctggttgtttagaagtatgtagtacttctcccttcactctctgtctcctgccac

SEQ ID NO: 18619 - DNA, 158 bp, Homo sapiens
tatgcatgtatacacatgtatgtgtatatacacacatatatgtgtatatatgtatatatgtatatatatatgtgtgtatatatgtatatatgtacatatatgtgtgtatatatatacgtatatatatacgtgtatatatacatatatatatgtatata

SEQ ID NO: 18620 - DNA, 106 bp, Homo sapiens
gtatgcaaatatatgtatttgtatatgtacatgtgtatttatcagctgagaaatatggcattagatgattatatatatatatatatatacacatatatatgcatac

SEQ ID NO: 18621 - DNA, 58 bp, Homo sapiens; identical to SEQ ID NO: 3380

SEQ ID NO: 18622 - DNA, 58 bp, Homo sapiens; identical to SEQ ID NO: 637

SEQ ID NO: 18623 - DNA, 61 bp, Homo sapiens
ctacaagttattcaacttctattaattctataattgaatagaagtttgatttaacttgtgg

SEQ ID NO: 18624 - DNA, 114 bp, Homo sapiens
catattaatacttttgggggacattaggaaatgtggagtaaataaaggagaaggaaaaatgttaataattttatttaaaaatagttttctaattatcttgcattcgtaaatgtg

SEQ ID NO: 18625 - DNA, 115 bp, Homo sapiens
ttttagcaatgaaaggcattagttgaaatttttaaacagaattataattttatataattataattttattcactgttaatgaaaactttttgatttctgtaatgttaggttaaaa

SEQ ID NO: 18626 - DNA, 73 bp, Homo sapiens
ggctgaggacaagtgcagggagccctctgccagactgaatggagaaccagtgctcctgcattcagtccctgtc

SEQ ID NO: 18627 - DNA, 95 bp, Homo sapiens; identical to SEQ ID NO: 68

SEQ ID NO: 18628 - DNA, 93 bp, Homo sapiens; identical to SEQ ID NO: 69

SEQ ID NO: 18629 - DNA, 69 bp, Homo sapiens
cacacacacatatatatataaaatatacatatatataatatacatatattgtatatgtgtgtgtgtgcg

SEQ ID NO: 18630 - DNA, 122 bp, Homo sapiens
tacatagtgtatgtgtgtgtgtgtgtgtgtgtgtgtgtatatacatatatatatatatacatgtgtactttatatatataaatgtggtgtatatatatatacacacacacatacatatatat

SEQ ID NO: 18631 - DNA, 95 bp, Homo sapiens
tagaggtaggagttttaaatggtaaagtggaaacagaggcatcaattttatttcctttttttttcttttgagatggagtctggctctgttgccca

SEQ ID NO: 18632 - DNA, 88 bp, Homo sapiens
agaagtagcaaattctcatgacagctacaatcctcatttctgcagctggtcatgtggttgtagctggtattgataactaccttcttct

SEQ ID NO: 18633 - DNA, 85 bp, Homo sapiens
gtatgtttgtttgttgagacagggtctcacactgtcacccaggctggagtgcaatggtgtgatcttgactcactgtaacctctgc

SEQ ID NO: 18634 - DNA, 195 bp, Homo sapiens
gtgtgtatatatatatgtatatatatgtatgtatatatgtatatatgtatgtatatatatgtacatatatatgtatatatgtacatatatatgtatatatgtacatatatatgtatatatatgtatgtgtatatatatatgtgtgtgtgtatatatatatatatacacacacacacatatatatgccaaatatat

SEQ ID NO: 18635 - DNA, 113 bp, Homo sapiens
tttgttgtttcaagctgctaagtttgtaattttttacacagtaattgatgatatgtattactaattatatatatgtaacaaatatatacttacagcacaattcaaactgcaaa

SEQ ID NO: 18636 - DNA, 71 bp, Homo sapiens
gcccagcaaggggagagtgtgtctgtcaacagagagatgacagatgaaaaccatctcactagctgtggggc

SEQ ID NO: 18637 - DNA, 102 bp, Homo sapiens
attgaatcatctagttaacaagagaatacatcagaatttttttgattcatctattcatgtttctaataagctgatctctcttgtaaacatagttaaatcagt

SEQ ID NO: 18638 - DNA, 103 bp, Homo sapiens
gtaggatgtaagctgtgggcttatcatatatggcttttattataatgatttttattaaaattttttatgagtctattgagatgatcatatggttttgtccttc

SEQ ID NO: 18639 - DNA, 99 bp, Homo sapiens
gaagatattgttacggttttttttttttttttttttttttggaacttgcttgggctgcatgtgtttcctggaagcagaggtataagattgtgtatcttc

SEQ ID NO: 18640 - DNA, 108 bp, Homo sapiens
tatatgtatatgtgtattatatatgtatatgtacatatacatatatgtatatatatacagctatatgtatatgtgtattatatatgtatattatatatgtgtgtatat

SEQ ID NO: 18641 - DNA, 120 bp, Homo sapiens
ccaggatgtccttggtgatagcaagcgtggctggatgtgaactgagggggcagcaggattttttttttttttttttgctctaacctttgtgagatctagctgagtgccagaggcagagga

SEQ ID NO: 18642 - DNA, 95 bp, Homo sapiens; identical to SEQ ID NO: 580

SEQ ID NO: 18643 - DNA, 93 bp, Homo sapiens; identical to SEQ ID NO: 69

SEQ ID NO: 18644 - DNA, 133 bp, Homo sapiens
gctccgttgaacatttgagaagcctgaaggtggagattgtgctgaggggagctttccaccctgtttttttttttttttttctggagtacagtggtgtgatctcagctcactgcaaactctgcctcctgggttc

SEQ ID NO: 18645 - DNA, 97 bp, Homo sapiens
tgcattacaataaatctggatgatctaaacttgtcattttaagccataattatagctcagagatgacactgaagaaacagttaaaagattgggtgca

SEQ ID NO: 18646 - DNA, 177 bp, Homo sapiens
catatatatatatacacacacacatatatatgtacacatacatatatatatacacatacatatatatacatatatatacatatatacatttatacatacacatatatatggaaaacagtgtgtatatatatatatatacacacacacacatatatatatctacacacgcacaccatg

SEQ ID NO: 18647 - DNA, 200 bp, Homo sapiens
gtgtgcgtgtgtagatatatatatgtgtgtgtgtgtatatatatatatatacacactgttttccatatatatgtgtatgtataaatgtatatatgtatatatatgtatatatatgtatgtgtatatatatatgtatgtgtacatatatatgtgtgtgtgtatatatatatatgtgtgtgtgtatatatgtatctatgcac

SEQ ID NO: 18648 - DNA, 95 bp, Homo sapiens; identical to SEQ ID NO: 68

SEQ ID NO: 18649 - DNA, 93 bp, Homo sapiens; identical to SEQ ID NO: 69

SEQ ID NO: 18650 - DNA, 89 bp, Homo sapiens
ccagtaagacactctctgagtcctgaccctgtgaagagtctgaggtctctgatattcgcaaagtcctcagtgaggtggtgtcttcctgg

SEQ ID NO: 18651 - DNA, 66 bp, Homo sapiens
ttttttttgtagagacagggtctctcactgtgttgcccagacaggtcttgaactctgcaagtgaga

SEQ ID NO: 18652 - DNA, 88 bp, Homo sapiens
tgtaggctttcagttgacaggtctgctgttagcctgatggggatccctttgtaggtgacctgcactgtctctctgtctgcctttaaca

SEQ ID NO: 18653 - DNA, 79 bp, Homo sapiens
ttgggaagcttagtttggctgaatatgaaattcttggttgaagatttttttctttatgatgttgaacataggcccccaa

SEQ ID NO: 18654 - DNA, 78 bp, Homo sapiens
atatatatatatatacacatatatatgtatgtgtatatatatgtaagtgtatgtatgtatgtgtgtgtatatatatgt

SEQ ID NO: 18655 - DNA, 110 bp, Homo sapiens
cctgggtgacaaagcgagactccatcttttaaaaaaaaaaaaaagactacaggttatttttatactttttttttttttctttttgagacagggtctcactgtcactcagg

SEQ ID NO: 18656 - DNA, 95 bp, Homo sapiens; identical to SEQ ID NO: 68

SEQ ID NO: 18657 - DNA, 93 bp, Homo sapiens; identical to SEQ ID NO: 69

SEQ ID NO: 18658 - DNA, 57 bp, Homo sapiens
tgtatgtgtgtctgtctgtccgtgtgtgtgtgcacgcgtgcacgcatctactataca

SEQ ID NO: 18659 - DNA, 60 bp, Homo sapiens
tatagatatgtatgcatacagatacatatatgtacgtgtgtctgtgtatgtctgtttgta

SEQ ID NO: 18660 - DNA, 75 bp, Homo sapiens
ttcaccctccacaatgattgtaagtttcctgaggcctctcagccatgcttcatttacagcatgtggaactgtgag

SEQ ID NO: 18661 - DNA, 68 bp, Homo sapiens
tgtggttgctaatgttccagcagacttatcagtctgctgcctaatattcacagaacatagtttccaca

SEQ ID NO: 18662 - DNA, 61 bp, Homo sapiens
tgcaagaaccagaaaactgattctgtgggcctgaagtccactctgtctgtttttgtctgca

SEQ ID NO: 18663 - DNA, 98 bp, Homo sapiens
catatgtgtatacatatgtatatacacacatacacatatataggacatatatgtgtgtgtgtgtgtgtgtgtgtatatatatatatatatatatgacc

SEQ ID NO: 18664 - DNA, 60 bp, Homo sapiens
tgtatacatatgtgtatacatatatatgtatacatatatttgtatacatatgtgtataca

SEQ ID NO: 18665 - DNA, 92 bp, Homo sapiens
tatcagtgagtgtaatatctttttctatttgaaagaatattagattgtacttttgaggagaatgagaacattcattacaaagttaaatgata

SEQ ID NO: 18666 - DNA, 122 bp, Homo sapiens
ctcttggtggtcatcgtcccccctggataaggatattctcccaatcacgtgtcactatgtctgtctggctaacatctccaccaatgggaagattctatcactctctctgggtacctcatgtc

SEQ ID NO: 18667 - DNA, 95 bp, Homo sapiens; identical to SEQ ID NO: 68

SEQ ID NO: 18668 - DNA, 93 bp, Homo sapiens; identical to SEQ ID NO: 69

SEQ ID NO: 18669 - DNA, 89 bp, Homo sapiens
agaatagaatagtgggtcatttttgtggtgtaagacagtattaatattttattttcaggcatgattacaaagacttcatattcttttct

SEQ ID NO: 18670 - DNA, 93 bp, Homo sapiens
tcaggaggagcttctctgaaatgtatatttttcttttcagtgatcttccacaaaggagatatattaaagatacttttcagaagcccttgttgg

SEQ ID NO: 18671 - DNA, 104 bp, Homo sapiens
tagtgtttggaggggaaatttcaaatttctctttgtatttcattaaataacgatttaagtaaatataaagtcatgtcagtttggatactttacaccaaaaacta

SEQ ID NO: 18672 - DNA, 111 bp, Homo sapiens
gggatgttagtatgttttttgtgtttttttgtctgtttgtttttttgagacggagtctcactctgtctccaggctggagtgcagtggcgcgatctcagtttactgcaacct

SEQ ID NO: 18673 - DNA, 74 bp, Homo sapiens
agactcctaggagaatagggaaaagatacaggtattttcctaatgaagattttctttttcttttttaggagttt

SEQ ID NO: 18674 - DNA, 64 bp, Homo sapiens
aggattctctgagcttcttgtatctggatgtctagatatttagcaggaccagagaagttttcct

SEQ ID NO: 18675 - DNA, 82 bp, Homo sapiens
ctggtggctcaaattctgtgttctgccatgagacccacaggtgtgggtctctcagcctgactggcttgcaccggagttccag

SEQ ID NO: 18676 - DNA, 101 bp, Homo sapiens
tggctcattcaaggtgatagcatttacatttgagagagaaagatgacaaaaacagttacttattatttatttagctaaatggttaactttgagtgaaacca

SEQ ID NO: 18677 - DNA, 116 bp, Homo sapiens
tgaaaagtgtctgttcatgtcctttatccacatattaaggagatgtttgtttttttttttttgtaaatatgcttaagtttcttaaagatgctggatattagacctttgtcagatgc

SEQ ID NO: 18678 - DNA, 89 bp, Homo sapiens
caatgaattctcctagtttttgtttattttagaaagtctttatttttctatttgaaagatattattactagggatagaattctgggttg

SEQ ID NO: 18679 - DNA, 89 bp, Homo sapiens
gtatgccatcccattttctagttatttatagaaggaaggataatctgaccctaattaatctgtcatagctggaaattcaattggcttat

SEQ ID NO: 18680 - DNA, 80 bp, Homo sapiens
tgcatatgcatatatatgtatatacatatagatatacatatatgtatatctatacatatctacatacatatacatatgta

SEQ ID NO: 18681 - DNA, 76 bp, Homo sapiens
catatgtatatgtatgtagatatgtatagatatacatatatgtatatctatatgtatatacatatatatgcatatg

SEQ ID NO: 18682 - DNA, 91 bp, Homo sapiens
cagatcagcaaaagagaagaatgagagctgagcaaagggggaagccccttataaaaccatcagatctcatgaatacttattcactatcatg

SEQ ID NO: 18683 - DNA, 87 bp, Homo sapiens
tcaattttgttattggacatctgcatattatatatgtatatgtgtatgtgtatatatatatctgcaaaagttttgtgcaaaaactga

SEQ ID NO: 18684 - DNA, 120 bp, Homo sapiens
gagatatctcttatgaaaatgttcttgctatattttcttttagaatctactgaaattgtttttttttctcgtcttctttacagaaaaaaagggaggatatttaaataaggtttagagttc

SEQ ID NO: 18685 - DNA, 77 bp, Homo sapiens
tcagaataatgtgggtgcttgtaggttggggaaggaatggcaggccttctctctctgtcagtatcttcaggccctga

SEQ ID NO: 18686 - DNA, 83 bp, Homo sapiens
ctttctcatattggggcttgggattttgagatcttatttccttttttggcttcttgagatctgaaattgttgttcagagaagg

SEQ ID NO: 18687 - DNA, 109 bp, Homo sapiens
actgatttttgtatgttgactttgtatcctgcagctttactgaatttgtttatctgttctagcaattttttgttgaagtctttagggttttctatatataaaatcatgt

SEQ ID NO: 18688 - DNA, 79 bp, Homo sapiens
ataagcacacaccatttcttacattcagaaacaaaagtataacgtgtgtgtgtgtgtgtgtgtgtgtgtgtgtgtgtgt

SEQ ID NO: 18689 - DNA, 95 bp, Homo sapiens; identical to SEQ ID NO: 68

SEQ ID NO: 18690 - DNA, 93 bp, Homo sapiens; identical to SEQ ID NO: 69

SEQ ID NO: 18691 - DNA, 105 bp, Homo sapiens
tgatagaaattgaatatgtagattgctttgggtagtatagtcattttgatgatattgattcttcctatccatgagcatggaatgctttttcatttgtttgtgtca

SEQ ID NO: 18692 - DNA, 85 bp, Homo sapiens
taagcgagccacagtccctctctggctttctggaagagcacagttagtaactgggaaagtgaggtaaggactagggctctgctta

SEQ ID NO: 18693 - DNA, 60 bp, Homo sapiens
gataaaacagccaagagggactcaaaggtttgagctctctgtttccctctggtctttgtc

SEQ ID NO: 18694 - DNA, 86 bp, Homo sapiens
aggtcttgtgaatgcagcttcttctgattttcatcttctcttaggtctgaagatgaggcttcagttgctgttaatgtttaagattt

SEQ ID NO: 18695 - DNA, 73 bp, Homo sapiens
gggaggggcagaggggcacttatggaaatatgaatgatttttttttttgagacagagtctctctctgtcgccc

SEQ ID NO: 18696 - DNA, 83 bp, Homo sapiens
ggacgcttagagagatttgtggggttcaaggttattatatttataaagatctacccaaatttacccctttgatttcagagtcc

SEQ ID NO: 18697 - DNA, 94 bp, Homo sapiens
acgtctgtcactgtaattactgcaatatttcaaatttaaatttaaatttttaaattatgtcttataatgatctgtgatcagtgatctttgatgt

SEQ ID NO: 18698 - DNA, 114 bp, Homo sapiens
gatccgcccgccttggcctcccaaagtgctgggattacaggcatgaattttttttttttttttttgagatgttgtctggctctgttgcccaggctggagtgcagcggcgccatc

SEQ ID NO: 18699 - DNA, 99 bp, Homo sapiens
gccttataattttatgctgggttactgtggaaccaaatatcatagaaggatgtgtgatatttttatgtttttcaagaaggtagtatagatttaaaaggt

SEQ ID NO: 18700 - DNA, 155 bp, Homo sapiens
atactgtatatagagagagcttatatatataatgtatatatagagagatttgtatatatatatataaactctctctatatgtatacactatatatatatagcttaactatatatgtatatgtgtatatatatatactgtatatagagagagctta

SEQ ID NO: 18701 - DNA, 85 bp, Homo sapiens
tgaggaagggactccctattcaataaatagtgctgggataactggctagccatatacagaacattgaaactagaccccttcttta

SEQ ID NO: 18702 - DNA, 116 bp, Homo sapiens
cctaaaagtgggcaatgacttttctatcagttggcaatggctttttttttttttttttttttttttttagctttctgtctgtttctgatgggtgcttctgtttctggctaccctgg

SEQ ID NO: 18703 - DNA, 69 bp, Homo sapiens
gggatattaggcaaaggccagttttggtggcattttaacctatggagactcagtgcctctgtgtgtccc

SEQ ID NO: 18704 - DNA, 109 bp, Homo sapiens
gattatatagctatatatacattatacattatatttaatatataatgtatatatataagtatatgtattattatatatatttataatgtgtatatatatagttgttgtt

SEQ ID NO: 18705 - DNA, 75 bp, Homo sapiens
ggctgagttctcactctgggggttaatagaagagcctggctccctcagtttctctctcttgattcctctctcacc

SEQ ID NO: 18706 - DNA, 83 bp, Homo sapiens
gaagatcacccagaactagttagtaacagagtcaggattttgacctaagctctctgactcttactcactgtgtctttttcttt

SEQ ID NO: 18707 - DNA, 92 bp, Homo sapiens
aggctaccagggtaaggtagtattctgaaattgtcttctcagtctttctctctctggacttattcttttggggttttgcttatctggagctt

SEQ ID NO: 18708 - DNA, 118 bp, Homo sapiens
atatatatatattttcatatattaatatattcagtcttaatacaagattatatattatataatatattcatccatattaagccagataaataagttatatgtgtgtatatgtatgtat

SEQ ID NO: 18709 - DNA, 78 bp, Homo sapiens
atcttgggtggttcaccattttgaactggcaggatggcaggatatatagagtggcagttgtggtggagaaaacaggat

SEQ ID NO: 18710 - DNA, 116 bp, Homo sapiens
ttgatggcaattttgtcagggaagatcttttgaggatttttaggtaatcttgctgtataatttagctacattcttattttcccataaaccttccacaaagacctaacaaccttcaa

SEQ ID NO: 18711 - DNA, 123 bp, Homo sapiens
ggagctggcctgaatatacacagttgcatgcataatgttaatgtcttttatttatttgtttattttatactttaagttctagggtacatgtgcacaatgtgcaggtttgttacatatgtatat

SEQ ID NO: 18712 - DNA, 95 bp, Homo sapiens; identical to SEQ ID NO: 580

SEQ ID NO: 18713 - DNA, 93 bp, Homo sapiens; identical to SEQ ID NO: 69

SEQ ID NO: 18714 - DNA, 97 bp, Homo sapiens
aggtgacttgtttactgttcttttttgaaataaaacatcactgaatttcatgttgtgattctatttaggagaagcaggatcagtaaaagcagcactt

SEQ ID NO: 18715 - DNA, 58 bp, Homo sapiens; identical to SEQ ID NO: 1673

SEQ ID NO: 18716 - DNA, 120 bp, Homo sapiens
caagaccttgtcaattctttgtatttagaaattttcccatatttttaatattgtatgtatttattataatttaatgcaacaggaaaattgaatagacacaggctttatgactcagtcttg

SEQ ID NO: 18717 - DNA, 77 bp, Homo sapiens
cataagaccattccagagaccttaattgattgtatttttcatagttttagtcagtttctcttgtgagtgagtctgtg

SEQ ID NO: 18718 - DNA, 95 bp, Homo sapiens; identical to SEQ ID NO: 68

SEQ ID NO: 18719 - DNA, 93 bp, Homo sapiens; identical to SEQ ID NO: 69

SEQ ID NO: 18720 - DNA, 82 bp, Homo sapiens
tggggtgagagaaaatagtgtggaaaggacagggatataagctatgtgtgtctgaatatataatgttttatagattacctta

SEQ ID NO: 18721 - DNA, 114 bp, Homo sapiens
ccataatttgaatgtatgtagttgattcttaattttttctttttgattaaaaaatacaataattaaaaggttttttttgtaaaagtttcaaatctgcatcagattcgaaagggg

SEQ ID NO: 18722 - DNA, 119 bp, Homo sapiens
gcattttctttatatatatatatatatatatatatatatatatatatatatatatatcagaatatatatatatatcagaatatatatatatgtgtgtgtgtatatatctctatatatgc

SEQ ID NO: 18723 - DNA, 59 bp, Homo sapiens
tatgtatattatatatatacacacacctatgtgttgtatgtatgtatatgttatgcata

SEQ ID NO: 18724 - DNA, 64 bp, Homo sapiens
aactgtgtgcagtgcatctagaatgagacttttataattttcattttgagcaagcacactagtt

SEQ ID NO: 18725 - DNA, 81 bp, Homo sapiens
gtccacactatttaaattattgttattattactgttattgttttggcagagaccaaataactgaattcaagtaggtgtgat

SEQ ID NO: 18726 - DNA, 94 bp, Homo sapiens
tttttgtattatgagtgcatgtgtaaatatctgtttatatattgctatattgcaccattgatttataatacataagcactcataaatttaaaaa

SEQ ID NO: 18727 - DNA, 72 bp, Homo sapiens
ctgggtgtggtagcatgtgcttgtagtcccagtttctcaggaggctgaggtaggaggatcacttgaacccag

SEQ ID NO: 18728 - DNA, 121 bp, Homo sapiens
cgttttcttcatttctgatgatagcaattatgtctgtgcttttgatgacttctcttaatgttctttattttaagcagtagatatttcttcattttgtaatttttaggaaaaggattgggga

SEQ ID NO: 18729 - DNA, 109 bp, Homo sapiens
gtatattgaaagtattttctaagtttgcgtttttgtgtgttttatattatgttgtgcttttgttatagtgtccttattacaaagaaatttgaatgtatttacagtgtac

SEQ ID NO: 18730 - DNA, 95 bp, Homo sapiens; identical to SEQ ID NO: 68

SEQ ID NO: 18731 - DNA, 93 bp, Homo sapiens; identical to SEQ ID NO: 69

SEQ ID NO: 18732 - DNA, 89 bp, Homo sapiens
catctgttatcttgtatactatgggtcaggaacctgggcagtacctcactgggtttctctctctgagtttcccacaaggccacagactg

SEQ ID NO: 18733 - DNA, 90 bp, Homo sapiens
tgtttgaccaagaatatttatagttatttcttgattatatgctaaacaaggggtgaattattcatgagttttctgggaaagggttggaca

SEQ ID NO: 18734 - DNA, 62 bp, Homo sapiens
ggcggctggggttcagggttcaattcctggcttagggaatgagtcctttaccttctgtctgc

SEQ ID NO: 18735 - DNA, 101 bp, Homo sapiens
tactcattgtgactggttgtcctgctttcctcaggttttctttcgccatctgtgacagcttcttgatctgtccccaggtggatggctgtgttgaatgggtg

SEQ ID NO: 18736 - DNA, 74 bp, Homo sapiens
ctaagctggaggacaactgagtactatttttttttttttttggagagggagtctcactctgtcacccaggctgg

SEQ ID NO: 18737 - DNA, 58 bp, Homo sapiens
tgagactgagtctcgctctgtcacccaggctggagtgcagtggcgctatcttggctca

SEQ ID NO: 18738 - DNA, 113 bp, Homo sapiens
tgtgttacttatacatatgttatttatacctataaatacatgcttatatttatgtgtatttataggcataaatgttatttatatgtataaataatatgtgtctgaataacata

SEQ ID NO: 18739 - DNA, 94 bp, Homo sapiens
gtgaggtatagaaaataatggcagaggaagaattcaggattctggttccccaatcctggctattattattttgctctttatctttttaccttgt

SEQ ID NO: 18740 - DNA, 75 bp, Homo sapiens
gtactaacaataaaacatctactgggcattacatgtaataatgcatgtaaagtacttagttcattattgcagtac

SEQ ID NO: 18741 - DNA, 104 bp, Homo sapiens
tatgccaaactaaaatggtagctattggtgtgtgtgtgtatatatatatatatatatatacatatatatatatatatatatagtcaccatttttgtttgacatg

SEQ ID NO: 18742 - DNA, 85 bp, Homo sapiens
gccttgtctcagatgagagtttggactgtggacttttgggttaatgctgaaaggtgttaagactttggggaactgttgggagggc

SEQ ID NO: 18743 - DNA, 107 bp, Homo sapiens
gttttttgttttgtggtgtacgtgtggtgtgagcgtggtattttgtctcgaagcagcatgggtcaggcacaaataagcccaccccactaggaactatgttgaaaaat

SEQ ID NO: 18744 - DNA, 64 bp, Homo sapiens
ctctgagacaaggtttcactctctctcccagacgggagtgcagtggtaccatcttggttcaggg

SEQ ID NO: 18745 - DNA, 120 bp, Homo sapiens
attttgggggtgttatggtgatattatggacatttttattttaagaatatttatattttagtgatgcatactgaaattttatctttgaaataatatgtctgcaatttttctcaaaataat

SEQ ID NO: 18746 - DNA, 97 bp, Homo sapiens
tacttctcctgttacggttatacacaggatttatatacctataatgtttatttataattgtaaattagggaaaataagtgtattttatagagaagtg

SEQ ID NO: 18747 - DNA, 104 bp, Homo sapiens; identical to SEQ ID NO: 2711

SEQ ID NO: 18748 - DNA, 64 bp, Homo sapiens
tctctctctctgggtgtgtgtgtgtgcacgcgcatgtgtgtataaatataaataggcagatagg

SEQ ID NO: 18749 - DNA, 128 bp, Homo sapiens
atatataatatgtatcataaaatatgatcttatatataatatgtatcataaaatattatattatatatattgtatatcataaaatattatattatatatattgtatatcataaaatattatattatat

SEQ ID NO: 18750 - DNA, 109 bp, Homo sapiens
attggggtgagggcatgaggaagagttggggagagagacagagagagactgagagatacagatttcttttcaaggcccagattattctctctcaggcatatctctcaat

SEQ ID NO: 18751 - DNA, 74 bp, Homo sapiens
gagagatatgcctgagagagaataatctgggccttgaaaagaaatctgtatctctcagtctctctctgtctctc

SEQ ID NO: 18752 - DNA, 95 bp, Homo sapiens; identical to SEQ ID NO: 68

SEQ ID NO: 18753 - DNA, 93 bp, Homo sapiens; identical to SEQ ID NO: 69

SEQ ID NO: 18754 - DNA, 93 bp, Homo sapiens
ataatctggcaaatacctacaaattttttacttcagtcatttggtagcttttagtcaaatctgtctggaagatttgtgcttaagctaggttat

SEQ ID NO: 18755 - DNA, 118 bp, Homo sapiens
gtttctgtatacactcactttgttatactgtctaaaacaaaaatcgtttgttctttttctatttttcactaggtttaatgcaaaggaaaatgttttaaggtataaaagtgagagaaat

SEQ ID NO: 18756 - DNA, 64 bp, Homo sapiens
tatacacacatgccatatatatatgtatatataacatgtatatatatatatgtatgtgtgtgta

SEQ ID NO: 18757 - DNA, 95 bp, Homo sapiens; identical to SEQ ID NO: 580

SEQ ID NO: 18758 - DNA, 93 bp, Homo sapiens; identical to SEQ ID NO: 69

SEQ ID NO: 18759 - DNA, 153 bp, Homo sapiens
atgtatttgattgtgtatgcttattttatgtatatatgtacttatatgtatatatgtgtgcttgttacgtatgcattatattatatatatatatatatatatatatatatatatatgcttatataaaagtaaatgaatgacatcaaaaataca

SEQ ID NO: 18760 - DNA, 93 bp, Homo sapiens
actatgaacattgggtgatcatgatatgtcaatgtaggttcatcaattttaataaatgtacctatattgtactggaggttgtacatgtgtagt

SEQ ID NO: 18761 - DNA, 167 bp, Homo sapiens
tgattcagagttttgaggcctatttatcagaaaagaaaaactgtattttgtttatttatttatttatttatttatttattttttttttgagacggagtctcactctgtcacccaggttggagtgcagtggtgcgatctcggctcactgcaaccttccacctcctggg

SEQ ID NO: 18762 - DNA, 104 bp, Homo sapiens
gctctatagccttgccagcatctagcattgtcagattttgtttttatttttttttttttgagatggagtctcgctctgtcacccaggctggagtgcagtggtgc

SEQ ID NO: 18763 - DNA, 108 bp, Homo sapiens
tggaagaggcccttcacaccccttgtgagctggattcctaggtattttattttctttgtagcaattgtgcatgggagttcactcatggtttggctctctgtttgtcta

SEQ ID NO: 18764 - DNA, 104 bp, Homo sapiens
tggatatatgggctcttttttggttccatatgaaatttaaagtagttttttctaattctgtgaagaaagtcaatggtatcttgatgggcatagtattgaatcca

SEQ ID NO: 18765 - DNA, 95 bp, Homo sapiens; identical to SEQ ID NO: 68

SEQ ID NO: 18766 - DNA, 93 bp, Homo sapiens; identical to SEQ ID NO: 69

SEQ ID NO: 18767 - DNA, 115 bp, Homo sapiens
gcctatggtggaaaaggaaatatcttgagagaagaactagagagaagctttatgagaaactgcttcatgatgtgtgcattcatctcacagagtaaaacctttcttttgattgagc

SEQ ID NO: 18768 - DNA, 69 bp, Homo sapiens
gcttttgaagaaaccgctttgtgatgtgtgcattcttctcacagagttaagcgtttcttttcattgagc

SEQ ID NO: 18769 - DNA, 69 bp, Homo sapiens
gctttgtgagaaactgcttcatgatgtgtgcattcaactcacagagagaaaagtttctcttgacagagc

SEQ ID NO: 18770 - DNA, 73 bp, Homo sapiens
agtgtgtccctttggctgattgagttgctcaagtcatcctctctgttattctgtcagttattgaaaacacgct

SEQ ID NO: 18771 - DNA, 112 bp, Homo sapiens
ctgatttttatatgttgattttgtatcctgtaactttactgaatttgtttatcagttcaaacaggtttttttttttacagtcttcaggtttttctaaatataagatatttag

SEQ ID NO: 18772 - DNA, 100 bp, Homo sapiens
gttttctgagaaactgctttgtgatgtgtgcattcttctcacagagttaaacttttcttttgaatgaacactttgtaaacactgtttttgtagaatttgc

SEQ ID NO: 18773 - DNA, 86 bp, Homo sapiens
gcaaaaaaccagaaggatcctttctgagaagctggatagtgatgtgtgcattcttctcagagagttaaacaggtctttggttgagc

SEQ ID NO: 18774 - DNA, 95 bp, Homo sapiens; identical to SEQ ID NO: 68

SEQ ID NO: 18775 - DNA, 93 bp, Homo sapiens; identical to SEQ ID NO: 69

SEQ ID NO: 18776 - DNA, 63 bp, Homo sapiens
ctgtgcgtgtgtgtgcatcagcatgtgtacactggatacctgcatgggtacacgcacctacag

SEQ ID NO: 18777 - DNA, 92 bp, Homo sapiens
ttccattggcaaggcaagggttgaaatgtttggaaatgtatgtgggcacatctctctttagaccagttttctctctcaaatattcaatggga

SEQ ID NO: 18778 - DNA, 134 bp, Homo sapiens
aggagcctgtacaggaaaacacagggtgacatcagcctgtttttttttgttttgtttttttaattttttttattttattattattatactttaagttttagggtacatgtgcactatgtgcaggttagttacct

SEQ ID NO: 18779 - DNA, 96 bp, Homo sapiens
tgcatacattatatacatatattatatacatatatattgcatgtatatgttatacatgtaatacatgtgtatgtaatatatgtatatgtatatgta

SEQ ID NO: 18780 - DNA, 93 bp, Homo sapiens
ccatcttcccatggccttatcctcactgtgtttctgtgttcaaatctccatcaactttctcttacaaggacacaagtccttgggtttcgggtc

SEQ ID NO: 18781 - DNA, 114 bp, Homo sapiens
gacctctgttcatgaccacctcactcaacatccagacaccaaatctttaggagagtgactgagcacactacgtgccgaagagcaggaggctggaggaggctggacatcactgtc

SEQ ID NO: 18782 - DNA, 71 bp, Homo sapiens
gtgcttctctgtgtgtctctgtgtttaaatatccgctttttgtaaagacaccagacatatcagattagggc

SEQ ID NO: 18783 - DNA, 114 bp, Homo sapiens
ctgtctggcactccctagtgagatgaacccagtatttcagatggaaatgcagaaatcacctgtcttctgtgtcagtcatgctgggagctgtagactggagctgttgctattcag

SEQ ID NO: 18784 - DNA, 105 bp, Homo sapiens
ttctagataagaactatttatccactgattgtgaaatggcaaggtctgaaaagtactttatcattatttattgttagtgagataaaaaaattcgtactgtttgaa

SEQ ID NO: 18785 - DNA, 71 bp, Homo sapiens
tatatatatatatgcagtgtatatatatatatgtactgtatatatatatctgcactatatatatatgtgtg

SEQ ID NO: 18786 - DNA, 111 bp, Homo sapiens
acacagtgactctgtctcaaaaaataataataataatttaatggaactacataatatatattgttttacaacttgatttttttttttttttgagatggagttttgctgtgt

SEQ ID NO: 18787 - DNA, 104 bp, Homo sapiens
gtagtattccattgtgtgtgtatgtgtatatatatatatatacacatatgtgtatgtatactatatatgtatagatatatgtatgtatgtatatgtgtgtatat

SEQ ID NO: 18788 - DNA, 103 bp, Homo sapiens
ggccaagcttaatagtcctaatgtatacttttttccttttaaaaccaatgagtatttttatgtttaaagtctgcaaggtgacaagaaggatactgaagctgtc

SEQ ID NO: 18789 - DNA, 90 bp, Homo sapiens
tttgctggctggctcactgtactcactgtggactttgttgggtggtgtctcggtagagggtagggtagaaaacaaactgtcagctacagg

SEQ ID NO: 18790 - DNA, 78 bp, Homo sapiens
cacaatggcctatgtgtatatccttgtcaaatgcatagtgctgttagacattttttgatttacataaatgctatcgtg

SEQ ID NO: 18791 - DNA, 69 bp, Homo sapiens
ggaggctgcagggtgagcttggagtgactggaggctgcctgtggccacgttcacactctctgcctctgt

SEQ ID NO: 18792 - DNA, 97 bp, Homo sapiens
ctggttatagaattaaaatgacctcagtggaagctgacacaacacagaggtgagaattttttgtgttctgtcattggtgtccagtgatcagtaccag

SEQ ID NO: 18793 - DNA, 95 bp, Homo sapiens
gtgtctgtgtgttcgtctgtgtgtgtgtgtgtgtatttgtgtgtatttttttgagacattctcactctgtcacccagactagagtgcaatagcat

SEQ ID NO: 18794 - DNA, 125 bp, Homo sapiens
tatatatactatatacatatatatgtatatatgtgtatctatacatacatatatatgtatatatgtgtatatatacatttgtacatatatgtgtatatatacatttgtacatatatgtgtatata

SEQ ID NO: 18795 - DNA, 111 bp, Homo sapiens
gcaaaattgctgcctgataattattcccatggggtgaagtaatctcgggaagagaactgagagagaagacagtattactcatgaaatgtgttggtcatgtggctaaaaagc

SEQ ID NO: 18796 - DNA, 102 bp, Homo sapiens
aagatagtctgaaatagtttcagcaaaagaccttaggatgtatacattagaaatatatacacctgtggttcatgattatgaaattattttgaaggtagtttt

SEQ ID NO: 18797 - DNA, 74 bp, Homo sapiens
atatatgtatattgcatatatattgtatgttgtatacagacacaatattgcatatatatactatatatatatat

SEQ ID NO: 18798 - DNA, 102 bp, Homo sapiens
atactgtatatagaacacagataaaaatgatgtaagaatttttcataatagcagctgagattttttgtatcattttatttctagttctgtagcactctgtat

SEQ ID NO: 18799 - DNA, 95 bp, Homo sapiens; identical to SEQ ID NO: 68

SEQ ID NO: 18800 - DNA, 93 bp, Homo sapiens; identical to SEQ ID NO: 69

SEQ ID NO: 18801 - DNA, 95 bp, Homo sapiens; identical to SEQ ID NO: 68

SEQ ID NO: 18802 - DNA, 93 bp, Homo sapiens; identical to SEQ ID NO: 69

SEQ ID NO: 18803 - DNA, 99 bp, Homo sapiens
taagtttatgatccatcgatcctttgtgtgtgcgattcttgtgattatgtcccttgctcctaatcagaacacacaagaacaaagagaagggagtactta

SEQ ID NO: 18804 - DNA, 97 bp, Homo sapiens
tctttctctgtcaacacaaatagttctatctcattatttttaatgactgtatattcattaaataaatgaccaatattgtgttgatggacatttagga

SEQ ID NO: 18805 - DNA, 74 bp, Homo sapiens
ggaacaggcctagagaagagagtatgctctgcaattcccagactagtcggtgtatgcattttcttgcctcttct

SEQ ID NO: 18806 - DNA, 114 bp, Homo sapiens
taggcgtgaggggtgggattcccagtagaggcagcaaaaataagcctaaatttttttaaaaatatatcattgttgtctagctttaatttttgaaatccaaatttttattgtcta

SEQ ID NO: 18807 - DNA, 151 bp, Homo sapiens
tatatatatgtcatatatatacatatacatatatatgtatatatgtcatatatatacatatacatatatatgtatatatgtatatatctgtctgacatacatatgtatatatatgtctgtcatatatatgtatatatgtgtgtgtgtgtgt

SEQ ID NO: 18808 - DNA, 70 bp, Homo sapiens
cacatacacacatctatgatatacatatacatatacattatatatgtatatatgtaggtatgtgtgtgtg

SEQ ID NO: 18809 - DNA, 58 bp, Homo sapiens
tgagacagagtctcactctgtcacccagactggagtgcagcagtgttattttggctca

SEQ ID NO: 18810 - DNA, 75 bp, Homo sapiens
acccttgtctgaagaaagtttgctcacccaaagtcatgccccctcctctgtgggtagactgcattcaacactggt

SEQ ID NO: 18811 - DNA, 109 bp, Homo sapiens
gaggctgaactgaacttaatgtataagtattaatagttatgtttatttttattattcactgagaggttactatgcttgaataagtgtgccctaactttatttcagcaac

SEQ ID NO: 18812 - DNA, 132 bp, Homo sapiens
aatgatttcttagtacttaatattctcttgctttgctcccgtgtgtgtgtgtgtctgagtgtgttgagtgcaaggagtacgttctacattctatttctttgttttttcatacatctttagcacaggaaacat

SEQ ID NO: 18813 - DNA, 119 bp, Homo sapiens
tccatttagttatcttttgtaaaaaaaaaatgtattgtgcatgtgtatgtgtgagagacagagagagagtttttcacaaatggaaaatgaagatacaatttggatatgggagaaatgga

SEQ ID NO: 18814 - DNA, 61 bp, Homo sapiens
gtgccatgttcctggcaaggaggggggcatgctggctctgtctctctttctctcatggtac

SEQ ID NO: 18815 - DNA, 70 bp, Homo sapiens
actgcatttctctgagactcttgagttaaattcatatatttagtttttcagtctcagattgataagtagt

SEQ ID NO: 18816 - DNA, 93 bp, Homo sapiens
cagcatattttatgtgtttttaaagctaattatgttaaaaattatttaaattttttttggaggatagttttgtcaatatagaattctttgctg

SEQ ID NO: 18817 - DNA, 66 bp, Homo sapiens
tatatacacatatatagttgtgcatatatatctatatatgtatatgtatttatatatgtgtatatg

SEQ ID NO: 18818 - DNA, 100 bp, Homo sapiens
gtatatatgtatatacatgtatatatatgtgtgtgtacatatatgtgtacatatatatatatatatatatatatatatatatatatatatatatatatat

SEQ ID NO: 18819 - DNA, 69 bp, Homo sapiens
cagagagaaaaagagagagagaatgttccccatattccctagggtgttctcaaattttttttttttttg

SEQ ID NO: 18820 - DNA, 95 bp, Homo sapiens; identical to SEQ ID NO: 68

SEQ ID NO: 18821 - DNA, 93 bp, Homo sapiens; identical to SEQ ID NO: 69

SEQ ID NO: 18822 - DNA, 99 bp, Homo sapiens
gggcatttgagtcttttctctttttttatttttgatcagtccaggtaaagtttttttcaattatattgatctttcaaagagcctgggctcaagtgatcc

SEQ ID NO: 18823 - DNA, 112 bp, Homo sapiens
tgctactgatttttatacattgattttttatcctgcaacttttctgaatttgtttatcagttttctggtgaagtttttaggtttgtttaactataagatcatgtcatctgca

SEQ ID NO: 18824 - DNA, 103 bp, Homo sapiens
tagactagagatttacttcaccagaattgtacaaaaaggagtccagataatattcagattaaattttctatatttttctcctcttggagaaatctcaagttta

SEQ ID NO: 18825 - DNA, 131 bp, Homo sapiens
atgtatacatgcatgtatatatgtgtatatgtatgcctacatgtatacatgtatgcatacatgtgtatatatgtatatatgtgtatacatgtatgtatatgtaagtgtatgtgtgcatgtatgtgtatgta

SEQ ID NO: 18826 - DNA, 66 bp, Homo sapiens
ccctgggatggaaagaagattgtaatggatattcacgttacaatgtttcaacactctttcctgggg

SEQ ID NO: 18827 - DNA, 65 bp, Homo sapiens
atatatatgtatgtgtatatatatatatgtatgtgtatatatatatatatatatatacacacaca

SEQ ID NO: 18828 - DNA, 106 bp, Homo sapiens
agattggtaacttgaggtggcaaagagtggtgactgctggcaaaatgtatgaatatatgtattatagtagcaattatacttgcttatttcaatgtttttgaagtct

SEQ ID NO: 18829 - DNA, 113 bp, Homo sapiens
tttgttgtgaagtttacccaaagggaagatctgacaggatgtctagtgttttactaactacctccattagtcattgttgctgctaggtcaagcaatgtgggttttgtgggaaa

SEQ ID NO: 18830 - DNA, 64 bp, Homo sapiens
gcgtgagtgtgtgtctgtctatctgtgtttgctgcatactgtagataataggcacctcaagagc

SEQ ID NO: 18831 - DNA, 93 bp, Homo sapiens
tagatacactatatatataatatatatatctatatattagatatgctatatatagtgtatctatatactatatatagtgtgtgtatatagata

SEQ ID NO: 18832 - DNA, 88 bp, Homo sapiens
cactgaaagcacagtgaactcagagaccagttctatagagttcctcaaggttatcttcatgactgctaatatcattgttataacagtg

SEQ ID NO: 18833 - DNA, 62 bp, Homo sapiens
ggtgtggtggtgcatgcctgcccagctactcgggaggctgaggtagcaggatcacttgagcc

SEQ ID NO: 18834 - DNA, 106 bp, Homo sapiens
cttttaggcaaaacatattgtcggtttaatttatgtttttaaatacttactgaaagtatttagaaatatactttgtaaattgggaatattttcttatgtttatcag

SEQ ID NO: 18835 - DNA, 58 bp, Homo sapiens; identical to SEQ ID NO: 1215

SEQ ID NO: 18836 - DNA, 63 bp, Homo sapiens
tatacacatatatgcacacacgtatttatttattttagatacgtgtgcatatatatgtgtgtg

SEQ ID NO: 18837 - DNA, 60 bp, Homo sapiens
gtaggctgtaccatctaagtttgtgtgatagtcacactctctgatgttcatgcagttgac

SEQ ID NO: 18838 - DNA, 61 bp, Homo sapiens
tgggaaagaaggacacgtggttgaccaccccatcagtcagcctctctccctctgcaaccca

SEQ ID NO: 18839 - DNA, 112 bp, Homo sapiens
ggattgtcttggctatatgggctctgttttggttccatatgaaatttaaagtagttttttctaattttgtgaaaaaagtcaatggtatcttgatggggatagcattaaatct

SEQ ID NO: 18840 - DNA, 95 bp, Homo sapiens; identical to SEQ ID NO: 580

SEQ ID NO: 18841 - DNA, 93 bp, Homo sapiens; identical to SEQ ID NO: 69

SEQ ID NO: 18842 - DNA, 79 bp, Homo sapiens
ttcctgtatatatgtgcatgtatgtttgtatgtatgtatgcatacatcttatatgtgtgtatttgtatccttacaagag

SEQ ID NO: 18843 - DNA, 133 bp, Homo sapiens
gggaactagtgtggatgaggttccagaaagatggctgcaaacaacctcagggcatctacagcctgcctctgtctgtcactgggtcctggatgtgtgggtgtgtctgcctggtgtagaaagctagaggcaaggc

SEQ ID NO: 18844 - DNA, 69 bp, Homo sapiens
gattaacatttgagtcagtgggctgggagaggcagacacactctcagtctgggtgggcacaatgtaatc

SEQ ID NO: 18845 - DNA, 113 bp, Homo sapiens
gttgttgtcgttgttgttgttttgtttttgcatcgctgttgtctgttataccagcctacgagttcacacaagagtgtcagcagagggtacctttacaattcacaggctaagac

SEQ ID NO: 18846 - DNA, 77 bp, Homo sapiens
ttcttcattcagtccactgttgattggcatctaggttgattccttgtctttgctattgtaaatagtactgagaagaa

SEQ ID NO: 18847 - DNA, 104 bp, Homo sapiens
ctagctttgttctttttgcttaggattgtcttggctatgtgggctcctttttggttccatatgaaatttaaagtagttttttcgaattctgtgaagaaagccag

SEQ ID NO: 18848 - DNA, 113 bp, Homo sapiens
tactttttgacgctgttaagtaccactgtgctcaaagatacacattatatatttagatattcagataagtgtggcttagcacagtaaactatgacatagtctttttcagagta

SEQ ID NO: 18849 - DNA, 151 bp, Homo sapiens
caggagaggagaatggtttcaaattcttgagtaaagaaatatgtttctttctatttatttatttattattttttgagactgagtctcaccctgtcacccaggctggagtgtagtggtatgatctcagctcactgcaacctccaccttgtga

SEQ ID NO: 18850 - DNA, 102 bp, Homo sapiens
gtatgttctagtccccatgctgagtgcttgaaatgtatttttttattattattatactaagttttagggtacatgtgcacaatgtgcaggttagttacatat

SEQ ID NO: 18851 - DNA, 106 bp, Homo sapiens
gcaggccttgctgagttccttttattttattattattttttttttgagacagagtctcgctctgttgctcaggctagagtgcagtggagtgatcttggctcactgc

SEQ ID NO: 18852 - DNA, 76 bp, Homo sapiens
ggagaagaaagtgagcacaggcagtgcctgggcagctaagtggttgtaagtgcctgggagtgtcaattaagtctcc

SEQ ID NO: 18853 - DNA, 62 bp, Homo sapiens
tcattgctaatgattctgtgtatctctgtcatttcagagatacccagagtggtttctattga

SEQ ID NO: 18854 - DNA, 105 bp, Homo sapiens
gatgtccttggtgttggacagtcttgggctttgtattgcaggttattattattttttatttagctggcggttattcagagccaagtctggtgaatattttgaatc

SEQ ID NO: 18855 - DNA, 72 bp, Homo sapiens
taggagtgacgagatagaattttctgagttttttgtttgttttgagataggctctctgtctctgtcaccctg

SEQ ID NO: 18856 - DNA, 58 bp, Homo sapiens
tgagacagagtctcactctgtcacttagactggagtgcagtgatgagatcttggctca

SEQ ID NO: 18857 - DNA, 113 bp, Homo sapiens
gttgaacagaaaaagaaagggtctgtcccaagtaaaaactttggtttatttttttataacattggttttctcaggaattacagaaaatctattctttgcctcttttgttcagc

SEQ ID NO: 18858 - DNA, 108 bp, Homo sapiens
tctcttgacagttaaccaataaaattaagaatgtaaaaatatattttgatttaatatttttaaacattttatggttttgcttgtttgtttgtttgttttgttttgaga

SEQ ID NO: 18859 - DNA, 72 bp, Homo sapiens
tatttatatgtatgtataggtgcatgtatggatataaatatatacctttgtttatatatatatatataaata

SEQ ID NO: 18860 - DNA, 140 bp, Homo sapiens
ctgtgggaaaacatgtaaggtagttagaacatgttgtggtgggaaaggttgcaatttttttggcttttttttttttacttatactttaagttttagggtacatgtgcagtttttaagagtaatcagggcaggtcttactg

SEQ ID NO: 18861 - DNA, 72 bp, Homo sapiens
tcagagcaggaagagagagggccagtgtggggaggcctgccagaaacatcacatctctctgtcactgtctga

SEQ ID NO: 18862 - DNA, 107 bp, Homo sapiens
gtctacaactgtgagtggctggccaaaattaatctaggtatggatagaaggagaagtgtctggaagtctagagtatttttgagtgtgtcaatgatggttgcatggcc

SEQ ID NO: 18863 - DNA, 58 bp, Homo sapiens; identical to SEQ ID NO: 7309

SEQ ID NO: 18864 - DNA, 97 bp, Homo sapiens
gttttcatgtttcagccccttcactgactctctgtgactctctaaggcctcatttagagatgaacctttgagttggtgaacgagaagcctgaacagc

SEQ ID NO: 18865 - DNA, 84 bp, Homo sapiens
ctaggctgaatgatagctctgctttaatttaattaatttatttttattttttgagatggagtctcgctctgtcactcaggctag

SEQ ID NO: 18866 - DNA, 83 bp, Homo sapiens
gctggttgggagagtgtcactgactgagaaacatgacagattgcctcctgtcactgtctcctgagtcagagtttgtccttggc

SEQ ID NO: 18867 - DNA, 86 bp, Homo sapiens
tgtatatatggtatatatgtatgtgtatatataggtatatatatgtatgtgtatatatagtgtatatatgtatatattggtctgta

SEQ ID NO: 18868 - DNA, 95 bp, Homo sapiens; identical to SEQ ID NO: 68

SEQ ID NO: 18869 - DNA, 93 bp, Homo sapiens; identical to SEQ ID NO: 69

SEQ ID NO: 18870 - DNA, 110 bp, Homo sapiens
tagcctgtgtaggcaatttatgacatttaagacatccttttattattattattattattattattattatactttaagttttagggtacatgtgcacaatgtgcaggtta

SEQ ID NO: 18871 - DNA, 66 bp, Homo sapiens
gttctgagacagcgtctcactctgtcacccaggctggagtgcagtagtgtgatcttggctcactgc

SEQ ID NO: 18872 - DNA, 74 bp, Homo sapiens
gagagagagagagagagagataaagagagagacagaagcaagcagttctctttatttctgacttgaaaacactc

SEQ ID NO: 18873 - DNA, 116 bp, Homo sapiens
ggatacagaaagcttatgaagtatggctggtcctatgggaactggagaagtgacaactcctgtctctccctctgtggcccaatgaccatatgactgttagcttctttatgccaggc

SEQ ID NO: 18874 - DNA, 94 bp, Homo sapiens
cacctcacttgtcaaaagagatatagactcactgtcacttagtaaataacaacccagtaaagtgggtaattcttggtctgtcacaaatgagctg

SEQ ID NO: 18875 - DNA, 112 bp, Homo sapiens
ctctgaaggcagaccatccgagtgggaatcctgagtacacaacttactaacagtacaaactgagcacaatgtttaaatctctggacttctatttcccaagatgcaaaaagag

SEQ ID NO: 18876 - DNA, 115 bp, Homo sapiens
tattggtttgaatatgtattatccatgtatatatgtgtgtgtatatgtgtatatatatgtgtgtatgtgtatatacatatataatatatgtatatattgaaatttgtattacata

SEQ ID NO: 18877 - DNA, 111 bp, Homo sapiens
tagtttactgcttttccttactttacaggatctccaggtgtttgttttttatatttcattcagagtttatatttatcatggggacggaatgtattgtaggggtttaaacta

SEQ ID NO: 18878 - DNA, 72 bp, Homo sapiens
gggtctccatttgatttgataaaacatttctactagctggagatgttttattaatattttatatgctgttcc

SEQ ID NO: 18879 - DNA, 87 bp, Homo sapiens
tgtattatagaaagataactctggcagcagtctggagatgaatcagagagagatgagactgaggcaagatatttatttgtaattaca

SEQ ID NO: 18880 - DNA, 114 bp, Homo sapiens
gagcggctggggaatgttaggacctctctctctctgttagagcttctccatgtggtctctccatgtgggctggtttgggcttcttcacagtatggcagcagcctcaggatgctt

SEQ ID NO: 18881 - DNA, 118 bp, Homo sapiens
cttaattagaatgtactcataagaagaaccacatttttttatttttatgttttaattttttaaagtttttatattatagtagagatggggtcttgctatgttgtccaggctggtctag

SEQ ID NO: 18882 - DNA, 110 bp, Homo sapiens
tgtggctgacatggttttattataaaaagttcttcgttatcttttcttttttattttaaaattaggataaaagggagaaaaagcagttgggatataggatataagtgaca

SEQ ID NO: 18883 - DNA, 106 bp, Homo sapiens
ctgtcacagtctcatgtttaagtatttttgttattatctttcgtaatcatgctgaatgccatggtagcatttatctgttcttatacttaaaccgggatgctaacgg

SEQ ID NO: 18884 - DNA, 70 bp, Homo sapiens
gctatctggtgactgggatacctggaacagctgggtgctggccaggtgtctctctctctctccaagtggc

SEQ ID NO: 18885 - DNA, 84 bp, Homo sapiens
tatacagtctgtgtcagtgtttatctccatgtgattgttattaactattatatggggaataagagacaacctaagcctcgtata

SEQ ID NO: 18886 - DNA, 115 bp, Homo sapiens
cataatttctttattccactttgatcatttatttggtattacagacagtgcttataaaaatttttttatgtctgtctggataaccatgtgattatatccagaggagaaattcatg

SEQ ID NO: 18887 - DNA, 97 bp, Homo sapiens
ggatgacacagctggaaaggcatccacagccatgaaaacgggccttgctggctcactcggtctctggatgaatcctcccatacaaacagcagaatct

SEQ ID NO: 18888 - DNA, 58 bp, Homo sapiens; identical to SEQ ID NO: 2442

SEQ ID NO: 18889 - DNA, 58 bp, Homo sapiens; identical to SEQ ID NO: 13590

SEQ ID NO: 18890 - DNA, 63 bp, Homo sapiens
agtcttgggtagaaggttctaaagttgactgctttgacaacttttagaccctatcactggact

SEQ ID NO: 18891 - DNA, 76 bp, Homo sapiens
actcacacactgtcccactcactccctgtctccatggctcagagataagggcagtgcgtgtacagtgcatgtgtgt

SEQ ID NO: 18892 - DNA, 58 bp, Homo sapiens; identical to SEQ ID NO: 1868

SEQ ID NO: 18893 - DNA, 77 bp, Homo sapiens
gtttttctgagacggagtcttgtctcactctgtcacacaggccagagtgcagtggcatgatctcagctcactcaaac

SEQ ID NO: 18894 - DNA, 57 bp, Homo sapiens
tgagacaggtctcactctgtcacccaggctggagtgcagtggtgtgatcatggctca

SEQ ID NO: 18895 - DNA, 58 bp, Homo sapiens; identical to SEQ ID NO: 7346

SEQ ID NO: 18896 - DNA, 100 bp, Homo sapiens
aactgttctgagcacagtgctggagttacatgtattttttatttacaaaaatgtaatcacactatgtatagtcataagtcacttaatgccagggatagtt

SEQ ID NO: 18897 - DNA, 113 bp, Homo sapiens
gttcacagtagggtttgcgctcctatgagaattgaatgctgcagctgatctgacaagaggcagagctcagtggtaatgctcactcccccactgctcacctcctactgtgcagc

SEQ ID NO: 18898 - DNA, 56 bp, Homo sapiens
gagacatggtctcactctgtcacccaggctggagtgcagtggcatgatcatggctt

SEQ ID NO: 18899 - DNA, 109 bp, Homo sapiens
tttcagatgcctcattcatcgggctcattcaatatgctctttttgttgtacaggttacataggcatctcagaggagatatttagttggatgaataaatggatctagaaa

SEQ ID NO: 18900 - DNA, 81 bp, Homo sapiens
gagcctgagtgcctgagttcagatcctgactccagtactaaactgcttgatctctgctctaaaccaacccaactgaggctc

SEQ ID NO: 18901 - DNA, 120 bp, Homo sapiens
ggcctagaatagggagtatagcttagtgcctaaaaacttggactgtgaagagagacaggtctgggttccaatctcaaccacataggcaagttatttaaactctataaaccttagtttccc

SEQ ID NO: 18902 - DNA, 73 bp, Homo sapiens
cctgtctggctgagtggctggctttcgcccctcagagctgatggcaaggaccaggcaatggagacggattagg

SEQ ID NO: 18903 - DNA, 103 bp, Homo sapiens
tcaaggtatgtgtagcaggatgatgttgtaaatattattcctatttttatatagaaattttaggggtaaaaatccaaatataaggtccaaatgtatggtttga

SEQ ID NO: 18904 - DNA, 73 bp, Homo sapiens
aaaaagcaatctgccagtgcattaatttggagaaactatgtatttctattttaaaactggaaaattgcttttt

SEQ ID NO: 18905 - DNA, 72 bp, Homo sapiens
gtctcagcagaagaattacactacagagtactacaggtgttaacccctctgtctcagtgtctgcttccagac

SEQ ID NO: 18906 - DNA, 116 bp, Homo sapiens
catttttatgtatcttatatgtatatatatgtgcatctcattaatatatatgtatattagtatacatatgtagtttattaatgaataaacccatatgtagacattggggtaaaatg

SEQ ID NO: 18907 - DNA, 119 bp, Homo sapiens
tcaagcttacaaatatttattatggaatacttgcaggagtgctggggctagaatttggtttctgcatgttctttccagacaacatacttcccaggtgttttcagatgttctaagtcaga

SEQ ID NO: 18908 - DNA, 90 bp, Homo sapiens
cagcatgacagttacgaacatgggtttggagtcacaattgagtgatctcataatttatcattccaaccacaatgcttgcataatgtgctg

SEQ ID NO: 18909 - DNA, 112 bp, Homo sapiens
tgtgtgtgtattcaatgctattagaaaggggagctctattttatttatttatttatttacttttccaagatggagtcttgctctgtcacccaggctggagtgcagtggcgca

SEQ ID NO: 18910 - DNA, 79 bp, Homo sapiens
atttttagaaacagggtctcactctgtcacccaggctggagagcagtagcctgttcatggctccctgtgacctcaaagt

SEQ ID NO: 18911 - DNA, 76 bp, Homo sapiens
gcattatgaaatgtactttatttattttttcgagatggggtctcactctgtcaccaaagttggagtgcagtggtgc

SEQ ID NO: 18912 - DNA, 67 bp, Homo sapiens
tggagaaagttccatgcgctattgaatagagtgtatattctgtggttgttggatggaatgttctgta

SEQ ID NO: 18913 - DNA, 68 bp, Homo sapiens
gcagaggtcagagggaggaacgtgaggccagggtattgattcccctggctccctctctgtcaggttgc

SEQ ID NO: 18914 - DNA, 58 bp, Homo sapiens
gggtgagtgtagggtgcacttttttttttttttgagacagagtcttgctctctcaccc

SEQ ID NO: 18915 - DNA, 70 bp, Homo sapiens
caaggtagaacaggaggtggagtcaggatctctgtcatcaggtctctctctctcacccagtcacaccttg

SEQ ID NO: 18916 - DNA, 115 bp, Homo sapiens
ggcctttggtagaggaaggtggctggatagggaggaagcagaaggaatacatatcctgacctctcactctgtctgtcctccagtctcctgtgtttggccacatcatccagcagtc

SEQ ID NO: 18917 - DNA, 123 bp, Homo sapiens
ttttcaccctactttttccagaggcaaaattatatatatatatatatatatatatatatatatatatatatatatatatatatatatatatatgtagaattcccctgcagtggtgaaagtagg

SEQ ID NO: 18918 - DNA, 95 bp, Homo sapiens; identical to SEQ ID NO: 580

SEQ ID NO: 18919 - DNA, 93 bp, Homo sapiens; identical to SEQ ID NO: 69

SEQ ID NO: 18920 - DNA, 100 bp, Homo sapiens
gggttcacagcaaactaggcttttgtagtaggttggattgttggccccatttctttcccaccctgtgtatccaggcctgttccatgtgactttacagccc

SEQ ID NO: 18921 - DNA, 115 bp, Homo sapiens
tttgttcctgtagcactttacctaaacaaatatatatttctttctttctttttttttttttttttttttgagatggagtgtcgctttgttgcccaggctggagtgcagtggcgag

SEQ ID NO: 18922 - DNA, 100 bp, Homo sapiens
gaaatttagataagcaacaagtaattttttgtatatgtatgtcctaaatgttgcatgagacagagttacactaaaaatttttgttgttttgctaaagttc

SEQ ID NO: 18923 - DNA, 95 bp, Homo sapiens; identical to SEQ ID NO: 6311

SEQ ID NO: 18924 - DNA, 74 bp, Homo sapiens
ggcagcacatgtccatagcagcagacgctctgtaggagaggagacactgggtgtgttctgctgcttgacaagcc

SEQ ID NO: 18925 - DNA, 130 bp, Homo sapiens
cagggagagttcctcagatgtgtctctccctggggcccagctctctaagggatctctcgctctctctctctggggctgttgagctgcttgatgagatgtcagcctttaactcgacgggaatcatgagaga

SEQ ID NO: 18926 - DNA, 79 bp, Homo sapiens
tctctcacattcacagtctccctattatgtgcagcctgtgaagaatgaaaaatgccctgggggatggaggatggagaga

SEQ ID NO: 18927 - DNA, 104 bp, Homo sapiens
atgtgctcttagcattgactatattggagcctaagtatttttatttatttccagaaaaataaaagaacatacatgtgcttcaggtcatgttcaacactgcccat

SEQ ID NO: 18928 - DNA, 86 bp, Homo sapiens
gagagacgtaaagaaaagctttgtcaagggaagttaccgagcatcagcgactgactgaattcttttaaagtttttaataccctttc

SEQ ID NO: 18929 - DNA, 72 bp, Homo sapiens
ctggaagcggcctgtggcagcacaaggtgggtctccacacgacgctctccctgtgtgtgcgtctgtctccag

SEQ ID NO: 18930 - DNA, 99 bp, Homo sapiens
cttgcagggcaccagctggtagggaggtggtggacggtgtccaggaaggctgttgtaagtccctgtcactgtcactttgcactgccactagccttttag

SEQ ID NO: 18931 - DNA, 74 bp, Homo sapiens
tctgggtgtcgtggtgtgcgcctgtaatctcagctactcaagaggctgaggtagaagaatctcatgaacccagg

SEQ ID NO: 18932 - DNA, 66 bp, Homo sapiens
caacagatgagagagacctgtctggagagcatttcaacagaaaccagaagtctcacttggctggtg

SEQ ID NO: 18933 - DNA, 57 bp, Homo sapiens
gggctgggggggctggcggccaagagtgactcaccatccctgtctctctctcagcct

SEQ ID NO: 18934 - DNA, 94 bp, Homo sapiens
gcgatatgcggtaggatactctctcactgagccacagctcccaatcagccacgtgatcaagagggtagacaaacgacaccctacagtgtactgt

SEQ ID NO: 18935 - DNA, 96 bp, Homo sapiens
tcctcaaggaactggaggaagtggaaaagaaagttgtgattttaaaaataataattttaggttttttttttttttactatactttaagttttaggg

SEQ ID NO: 18936 - DNA, 80 bp, Homo sapiens
ctaagaacagggtggattggaagttggctgagtcttaatcaaactacagcccagctgggatcacactcagtctctgatag

SEQ ID NO: 18937 - DNA, 106 bp, Homo sapiens
ggaagagtgctccgagtctcagattgtaatatcctttttttgagacagagtctcgctctgtcacccaggctggagtgcaatggcatgatcttggttcactgtaacc

SEQ ID NO: 18938 - DNA, 110 bp, Homo sapiens
ttgtatccttcgcccactttttgatggggttgtttgttttttcttgtaaatttgtttgagttcattgtagattctggatattagccctttgtcagatgagtaggttgcaa

SEQ ID NO: 18939 - DNA, 66 bp, Homo sapiens
acaaaatgggttatctgaggccatattagaggtgatctacctctgatactctctctctctttttgt

SEQ ID NO: 18940 - DNA, 95 bp, Homo sapiens; identical to SEQ ID NO: 68

SEQ ID NO: 18941 - DNA, 93 bp, Homo sapiens; identical to SEQ ID NO: 69

SEQ ID NO: 18942 - DNA, 66 bp, Homo sapiens
gcctcctagctgctgtgagggaaggggaggggctggtgtgctactctcagtctctgcctgggaggc

SEQ ID NO: 18943 - DNA, 74 bp, Homo sapiens
ctcaaggcattttgttgttgactttctggagggccaaagaacaataacaactgcttattatgagatgttttgag

SEQ ID NO: 18944 - DNA, 128 bp, Homo sapiens
ttgttcttttggcttaggattgacttggcaatgtgggctcttttttggttgcatatgaaatttaaagtagttttttccaattctgtgaagaaagtcatgggtagcttgatggggatggcattgaatct

SEQ ID NO: 18945 - DNA, 216 bp, Homo sapiens
atacttatatataatgtattacatgttatcgtatacttatatataatgtattacatgttatatacttatatataatgtattatatgttatatacttatatataatgtattatatgttatatacttatatataatgtactatattatattatatacttatatataatgtactatattatattatatacttatatataatgtactatatattgttata

SEQ ID NO: 18946 - DNA, 81 bp, Homo sapiens
ggtaatgtgacattttcatcacattgtatcaagggtacatatatcgacatgacttttgatattgatgttggtcacctggct

SEQ ID NO: 18947 - DNA, 110 bp, Homo sapiens
gtaatatgacattattatgtatattccctgaaaagacattttgtaccaagactgttccgtctcagtcccagtcagtgtctctcagagagtctattatgcctggtaattac

SEQ ID NO: 18948 - DNA, 79 bp, Homo sapiens
gcaggaactcactctctcagccactgtttaggtcatttctagtttcctggagcagataggtccagattcaaatccctgc

SEQ ID NO: 18949 - DNA, 114 bp, Homo sapiens
atggcaactgactggcaagctcagccagtggaatgtgaatgcaaacaatagagtgataagactgtgtacagagcagcatactaaggctgcttctgcccaggtacagtggcacat

SEQ ID NO: 18950 - DNA, 106 bp, Homo sapiens
gaaggggttcttggcttgatacagtttctagatggatgaaatagcacccccttgcccagtttatttctatttatattattatttctaatttggctgagcacttttc

SEQ ID NO: 18951 - DNA, 85 bp, Homo sapiens
ctgattttgagcccagtaggtcataaggccttggtcactcccactccatctctgctttgactctctctgtgtggcttatctgcag

SEQ ID NO: 18952 - DNA, 89 bp, Homo sapiens
ggagtattaatgtaggctctgtctgagatgtttcctgactttctgtttcctgcagaatcttttttttttttgagatggagtctcactct

SEQ ID NO: 18953 - DNA, 116 bp, Homo sapiens
ctaggtgtcacttccgtgttgaattccagccttctctcttaggtgatctatttttattttacaagttagaaatataagtgcagagaagttaaaacagcaaatctgtggcttccaag

SEQ ID NO: 18954 - DNA, 116 bp, Homo sapiens
ttggtactctttcaggtgagctctgtgggctaccaccagaaagtcctagccaaccaagctctcactgggtcactctgtgctagctagactacatagcctcctaaaaaagcacgcag

SEQ ID NO: 18955 - DNA, 85 bp, Homo sapiens
gctcgatcattttatgtctttttaatagtctgtggccagccaccaccttgacgattaagatagagtgagttcagtgtgatcacgc

SEQ ID NO: 18956 - DNA, 88 bp, Homo sapiens
gtcactgacaacaaagtaaaagtcagcagttttggaaaatacatattttttttttcctagctgaggatgggttaccttcattagtgac

SEQ ID NO: 18957 - DNA, 89 bp, Homo sapiens
gttttgtctttttgagaagcatagctttttcactggaatttagtgtgaaattccaattttcaaagcatgctgagaaaagagggtaattc

SEQ ID NO: 18958 - DNA, 77 bp, Homo sapiens
gcgtgtctatatgtatgtatgtatgcacacatgtatacatgtatgtatgtatgcacatatgtatgtatgtgagagat

SEQ ID NO: 18959 - DNA, 85 bp, Homo sapiens
gtatgtatatgtatgcatgtacttcatatgtgtgtatgtatatatatacatacacatatgtatgtatacgtgtatctatacatac

SEQ ID NO: 18960 - DNA, 63 bp, Homo sapiens
cagggcctaggagagctgagccgcactggggagcttgtggtcttcagactctctctctctctg

SEQ ID NO: 18961 - DNA, 216 bp, Homo sapiens
tatgtacatgtatatatacacatatatacatatatacacatatatattaccttagttttgtctatatatatgtctatatatatatctctctatatatatatatgtctatatatatctatatgtgtctatatatatatgtctctctctacacatatatgtctctatatatatatatacacacacacatatatatatatatatatatatatatacaca

SEQ ID NO: 18962 - DNA, 91 bp, Homo sapiens
agacaaaactaaggtaatatatatgtgtatatatgtatatatgtgtatatatacatgtacatacatatacatatttcccttagttctgtct

SEQ ID NO: 18963 - DNA, 115 bp, Homo sapiens
ctatacactcgggtttacttttctttcattttcttcttctgaattcttttttttaacttttaagttcaggggtacatgtgcaggtttgttatataggtaaacttgggtcacaggg

SEQ ID NO: 18964 - DNA, 116 bp, Homo sapiens
aggctttttttttttttttgctgaaattgcttttacttgatttcttttgaagagttgatctcaatttttaaaattgtcatttaaatgctaagttctgtattaggagaaaataatct

SEQ ID NO: 18965 - DNA, 73 bp, Homo sapiens
tgctatggatgggttactgaaggacctcagagccacactcacactgtcccttctagtaacttctctatgtgca

SEQ ID NO: 18966 - DNA, 84 bp, Homo sapiens
gagaatataggccaacagctgagagtgcacactcgggctttgaatccagtctaccactcaccagcgcacagcctcagaaggctc

SEQ ID NO: 18967 - DNA, 91 bp, Homo sapiens
ggcagatatagagacatagtatcaagctaacctttttatttatttatttatttatttatttatttattttgaggctgggtctcgctctgtc

SEQ ID NO: 18968 - DNA, 82 bp, Homo sapiens
caccataatgtgagaagtgactgtgtttagactttcatattcttaaaaagtcagttacccagtgatttctatatggaaggtg

SEQ ID NO: 18969 - DNA, 76 bp, Homo sapiens
aacctaaaactccagagtctgaaactcacacagtttcttctctgttctgaggcttcatgcagctggacaggaggtt

SEQ ID NO: 18970 - DNA, 106 bp, Homo sapiens
agtggaaatggcagagataattccaagagccaattttttattttaatgtgtttttcatatgtacattttaatgggagcttttatgatattatttttcagccacact

SEQ ID NO: 18971 - DNA, 86 bp, Homo sapiens
gtatgtgtgtgtatatatatatgtgtgtgtgtatttatatctatatacatatatatgtagagtgagagagagacagagacagagac

SEQ ID NO: 18972 - DNA, 74 bp, Homo sapiens
acaaatggggtctgtctctctctctgtcttgagctacctggagcttggggaggggtgacactagcacccttgtg

SEQ ID NO: 18973 - DNA, 82 bp, Homo sapiens
gaacttggaagggggtgagagggagcagtcttggtttaaataccacaggcttgcctttcttattgaattttcataaatgttc

SEQ ID NO: 18974 - DNA, 116 bp, Homo sapiens
gaaatgttcactgatgcaaaatgaatttggaatcaagaataaattgtattgtaattagaatcaaaagaaatatgcaatggtattcatgagtctaaaaattttgcctttgacatttt

SEQ ID NO: 18975 - DNA, 114 bp, Homo sapiens
tagacattttaaatgatccaaaattgtgttcatcctgagatatgagtgtgcagaatattgagcacagcttatgtaatcactgagttcatgccttgaagatacgttcagaatcta

SEQ ID NO: 18976 - DNA, 78 bp, Homo sapiens
gagagttagctgagcataaacaaagagcagaaaacctgattggaaaaagggcccattgtctgtgactttcagtctctc

SEQ ID NO: 18977 - DNA, 95 bp, Homo sapiens; identical to SEQ ID NO: 580

SEQ ID NO: 18978 - DNA, 93 bp, Homo sapiens; identical to SEQ ID NO: 69

SEQ ID NO: 18979 - DNA, 111 bp, Homo sapiens
tgagggtttacagaagatactgcctttgaggagcatggattttgacagatgacagtgatacaggtcaaaatgcatgtttactttaggggtaggatggagtaggggtcagcc

SEQ ID NO: 18980 - DNA, 111 bp, Homo sapiens
catgaggtggagtacaacttaaagttgccttctttcatcctatatatttttgtttattcttaatgtatcgtgaacttcagtagagagcaaacaagttgtctttataatttg

SEQ ID NO: 18981 - DNA, 90 bp, Homo sapiens
tgcatgcagtttcaaggcgatcacagagtccctggggtccatggtctccaggcaaaaaattctctgcctgtgtgtctctctgtacatgta

SEQ ID NO: 18982 - DNA, 109 bp, Homo sapiens
tgcagaaagcttagaataactggaatttcttatcagtggagagcaaagatgtgaggggtgaattactaatgatcttcatgtgtgtgaggtggcatgatactaggtggca

SEQ ID NO: 18983 - DNA, 123 bp, Homo sapiens
ttcctatttggccatcttggaagcgacctttgttttttttttttttgagacagagtctcgctctgtcacccagattggagtgcagtggtgcgatctcagctcactgcaacctctgcctctcag

SEQ ID NO: 18984 - DNA, 58 bp, Homo sapiens; identical to SEQ ID NO: 637

SEQ ID NO: 18985 - DNA, 86 bp, Homo sapiens
acgtcagaaatggtaacacgtttatagtcagcacataggtttccctcagggatttgtctgaaggataacatgcatctagatgatgt

SEQ ID NO: 18986 - DNA, 63 bp, Homo sapiens
atatatatatatatatatatatatatatatatatatatgtatgtatgtatgtatgtatgtata

SEQ ID NO: 18987 - DNA, 58 bp, Homo sapiens
tgaggtggagtctcactctgtcacccaggctggagtgcagtggtgtgatctcggctca

SEQ ID NO: 18988 - DNA, 85 bp, Homo sapiens
cggaggttattttattgagacaaggtctcactctgtcaccctagttggagtagagtggcatgatcctggctcactgcaacctttg

SEQ ID NO: 18989 - DNA, 84 bp, Homo sapiens
gatcaaacaggtatgataaagatgctgctaacgatggaatttaaaaactttattgagctctctttgtataacatacctttgatt

SEQ ID NO: 18990 - DNA, 115 bp, Homo sapiens
agcctcccaaagtgcttggattacaggcatgagccaccacgccctgcggcaaaatttttttttaattagctgggcatgatggtgtgtacctgcagtcccagctacttgggaggtt

SEQ ID NO: 18991 - DNA, 111 bp, Homo sapiens
gccaccgtgcccagtctgtgttcatagagttctacaatcacaccacagtcaatttttttttcttttttttggtgtcagggtcttgctctgttcaggttggagtgcagtagt

SEQ ID NO: 18992 - DNA, 58 bp, Homo sapiens; identical to SEQ ID NO: 2224

SEQ ID NO: 18993 - DNA, 56 bp, Homo sapiens; identical to SEQ ID NO: 335

SEQ ID NO: 18994 - DNA, 107 bp, Homo sapiens
ttgatctccaggtgtgaccaggcagtaagctaataaggaaggatgactgaatgtatgaataatcagtcacctcactgccagcttaaccagaaagacacagagatggg

SEQ ID NO: 18995 - DNA, 105 bp, Homo sapiens
gatgcaggagaggcaattctcagggaaagatgcatggattgggcacacatcctcaaaacatgtcttttttttttttttttttttgagacggagtctcactctatc

SEQ ID NO: 18996 - DNA, 72 bp, Homo sapiens
atgtatatatgtgtgtgtatatgtatatatgtgtgtatatatatgtgtgtgtgtgtgtatatatatatatat

SEQ ID NO: 18997 - DNA, 101 bp, Homo sapiens
ggagtccaatagggattacttttgagcgatgggattgggaagaataatttttattttattcttctctttccaaagtctctatagtgaacatgttttacttc

SEQ ID NO: 18998 - DNA, 58 bp, Homo sapiens; identical to SEQ ID NO: 47

SEQ ID NO: 18999 - DNA, 79 bp, Homo sapiens
ctattgtctttctctgtgagtctcagcctcattcataccaatgttgctttgaggatggctgggtgcagggaggcactgg

SEQ ID NO: 19000 - DNA, 116 bp, Homo sapiens
catatagtatagtactgcactatatgtattgtgtgtgtgtgagtatgtatattatatacatatatattttatatatacacacacataagtatatactatagtatactaaagttatg

SEQ ID NO: 19001 - DNA, 74 bp, Homo sapiens
ccataggaaaagtgcagtatctgggccggagtgtgcatggttcctcaggctcagtctctcacggcttcccttgg

SEQ ID NO: 19002 - DNA, 85 bp, Homo sapiens
agctaaagaggcccactgtcccactgtcagaggcatttgaaccagagcaactccatcttgactgggggctgggtaaaaagaggct

SEQ ID NO: 19003 - DNA, 118 bp, Homo sapiens
ggaacctaaatagtgtggagcaaatggtctctcttggaaatttggaattggaatgaatagtttattcagttttatgccatatttgaactgaggacaattaaactctggggctgtggcc

SEQ ID NO: 19004 - DNA, 115 bp, Homo sapiens
gggctgaatataatgttttatatcatgattgtgctgatggttaaatgactatatatttttgtcaaactcatcaaatggtacactcaccactagagattttattatataaacttcc

SEQ ID NO: 19005 - DNA, 92 bp, Homo sapiens
atgcgggctcttttttggttccatatgaaatttaaagtagtttttttccaattctgtgaagaaagtcaatggtagcttgatggagatagcat

SEQ ID NO: 19006 - DNA, 116 bp, Homo sapiens
gacgggtttaatgccccataattatgaaggaaggtcagtctctgccagtctgactcagagggcttactgagtcatcctgtttgtcctctctgctgctatttatgggcttcccagtt

SEQ ID NO: 19007 - DNA, 100 bp, Homo sapiens
aactgggaaagaaactttttgctcagtgggattgttgatgaatttaaatattaacatgttacatttaccattgacatttacctagtgaaacacaccagtt

SEQ ID NO: 19008 - DNA, 114 bp, Homo sapiens
ttcactaggttgaagttcactagaagggaaggcagggattgccttataggtctggtctccctctgactctgtccggtcctgtcctctgtggttgaatttggccaagatggtgag

SEQ ID NO: 19009 - DNA, 119 bp, Homo sapiens
cagcatgataccctgtttaaaaaaaaaaaattaacatgacacaaaaccctgtgtgtgatttgttattgttgttgttgttgggttttttggttttgtttttttgagacggtctcactctg

SEQ ID NO: 19010 - DNA, 64 bp, Homo sapiens
tgtctctctctctctcttttgagacatagtctcactgtgtcgcccaggctggagtgcagtggca

SEQ ID NO: 19011 - DNA, 77 bp, Homo sapiens
cagaaggctgaggttggaggatcatttgagcgcaggaggatgaggctgcagtgaactgagaaaacctcactccactg

SEQ ID NO: 19012 - DNA, 76 bp, Homo sapiens
gagtctcactctgtcacccaggctggaactgcagtggcatgatcatggctcacagcagccttgacctcttaggctc

SEQ ID NO: 19013 - DNA, 89 bp, Homo sapiens
ttgcatttccctgatgactagtgatgttgaccttttttttgtttgtttttgagacagagtctcactctgtcacccaggctggagtgcag

SEQ ID NO: 19014 - DNA, 69 bp, Homo sapiens
tgagtcagaagcaatgaaacaaggcacatctgggccagcagcaggtgtactatacattcttctctctca

SEQ ID NO: 19015 - DNA, 94 bp, Homo sapiens
ggctgttttaggcttgaaggctgggtttaagggggaaggggagtggggccttggctgcctcctgtctctgtcagtaatttaagccaggaaagtc

SEQ ID NO: 19016 - DNA, 89 bp, Homo sapiens
caggcatgcactatcacagccagctaattttcatagttttagtagagatggggtttcactatgttggccaggctggtctcgagctcctg

SEQ ID NO: 19017 - DNA, 95 bp, Homo sapiens; identical to SEQ ID NO: 68

SEQ ID NO: 19018 - DNA, 93 bp, Homo sapiens; identical to SEQ ID NO: 69

SEQ ID NO: 19019 - DNA, 115 bp, Homo sapiens
tcaaatggattaggaagatttatacaaagtactgttaaaacaggaagagaagcatgcataatatctttttatttctgtaaaaccaatagtgtgtaagttgtatgtgtgtgtgtga

SEQ ID NO: 19020 - DNA, 108 bp, Homo sapiens
catacatatatagagaagcatacatatatacacatacaaatatatacatatacacatatgtgtatatatatgtatgtgtatatatatagatacatataaaatgctgtg

SEQ ID NO: 19021 - DNA, 90 bp, Homo sapiens
tagcaaatctttgacaagtgatttacaagaaataatacaaaatgaagccatatctaatattgagtgtatttcactatggaggtttagcta

SEQ ID NO: 19022 - DNA, 110 bp, Homo sapiens
agaagtacgttagttccacccagaaaggcagagacacagatggttgcattcttttgaatttctcataagtctttctgaaggaggcaatcagaatatgcatctatctctgt

SEQ ID NO: 19023 - DNA, 79 bp, Homo sapiens
tgtggcatccctgcatcgagcaagtctatgagagccatttttctaacaatatgtgcttgctttgtgtctctgtgtcaca

SEQ ID NO: 19024 - DNA, 101 bp, Homo sapiens
ctatgtggtataggactctgtgtgtgcacatgtatgcatatacatatatatataagttagaagtatatatggcagggaacagatttatgttaaggaaatgg

SEQ ID NO: 19025 - DNA, 116 bp, Homo sapiens
gacagtgtatgtatttatctatctatctatctatctatctatctatctatctatctatctatctatctatctatatagctagctagctagctagatatgtgcatgtgtgttctgtt

SEQ ID NO: 19026 - DNA, 114 bp, Homo sapiens
tgcatatagaatatacataatgcatattatatgtgaatatttataagtgtttatatattaattatatttgtatatacatatatacatataatatacatactgtatatgatagta

SEQ ID NO: 19027 - DNA, 116 bp, Homo sapiens
accaatttgataagtgactgttttattttgagtatttctatattataattttattttttatttcatcagtataggattcagataaaaggagctcaccttattattaacaaaatggt

SEQ ID NO: 19028 - DNA, 95 bp, Homo sapiens; identical to SEQ ID NO: 580

SEQ ID NO: 19029 - DNA, 93 bp, Homo sapiens; identical to SEQ ID NO: 69

SEQ ID NO: 19030 - DNA, 123 bp, Homo sapiens
aggcttggctatgtgacacaggagttgccaaggttattggaagtttgtacaaattgtttttattattattattatactttaagttttagggtacatgtgcacaatgtgcagcttagttacata

SEQ ID NO: 19031 - DNA, 72 bp, Homo sapiens
ccactgatctgacaggagacagagctcaggtggtaatggtttatcatctgcagctcaactcctgctgtgtgg

SEQ ID NO: 19032 - DNA, 79 bp, Homo sapiens
ttgtttgtcctctcttgctggaggtgtgtcactatgtcactgagatacctacaaatatctttgcaaccaggactttcaa

SEQ ID NO: 19033 - DNA, 105 bp, Homo sapiens
atatatatacatatatgtatagatgtatatatacgtatgtatgtgtatatatatatacacatacatacgtatatatacatctatacatatatataatatatatat

SEQ ID NO: 19034 - DNA, 109 bp, Homo sapiens
tctgatagggctggtgctcttgtaagcagaggaagagctctctctgttccctgtgaggacacagggagaaagtggccatctgcaacccaagaaatgagcctttgccagg

SEQ ID NO: 19035 - DNA, 91 bp, Homo sapiens
tgacatgaagcagcatttctaaagtgtttaaaattattcttatgaaattgaataaaagtttctttgtatattttatatgctttttatgtca

SEQ ID NO: 19036 - DNA, 79 bp, Homo sapiens
tatgcattatatatatatgtatatacacatgcatgtatatatatgcatgtatatatatgtgtgtgtatacatatgcatg

SEQ ID NO: 19037 - DNA, 110 bp, Homo sapiens
gtataaaaactctgtctgctttattttgcaaaatttacatatgcatgcaatgtaaagttgtctgtaattttctgaagcccacccatagagcacagacagaaagcctctac

SEQ ID NO: 19038 - DNA, 117 bp, Homo sapiens
tctcaaacacatgcctatatccctttatgagcagccagacacccaccttaggtgacagaaaagagtgaggagccaggggaatggtatagaggaagaagttgcatctaaatgttgggg

SEQ ID NO: 19039 - DNA, 95 bp, Homo sapiens; identical to SEQ ID NO: 68

SEQ ID NO: 19040 - DNA, 93 bp, Homo sapiens; identical to SEQ ID NO: 69

SEQ ID NO: 19041 - DNA, 96 bp, Homo sapiens
catggctggggcctgagctgagaacagtggagcagagtctggaagaaatggggcttctcatattctctctgtgtctttttgtagtcccttctcatg

SEQ ID NO: 19042 - DNA, 114 bp, Homo sapiens
tagtggtttcatagtttgaagtcttaaatttaagtctttaatatatcttaattttatttttgtatatggtgatagatagggctcaagcttaattcttctacatatggatatcta

SEQ ID NO: 19043 - DNA, 108 bp, Homo sapiens
ttgcactactaagtaaggggaacattcccatttaagtgttctgaacaaatgtaacatgtatctcagtctctgtgtatccccaaagcatgagtagtttattatgggcaa

SEQ ID NO: 19044 - DNA, 95 bp, Homo sapiens; identical to SEQ ID NO: 68

SEQ ID NO: 19045 - DNA, 93 bp, Homo sapiens; identical to SEQ ID NO: 69

SEQ ID NO: 19046 - DNA, 145 bp, Homo sapiens
tataggtgtgtgtgtatatatataattgtatatgtatatgtgtgtaggtatatgtatacatatatgtatatatacatagaattgcatatcaattatatgtatacaagattattgtatatgtataggtacaattatatgtatatat

SEQ ID NO: 19047 - DNA, 142 bp, Homo sapiens
gggtgggccgaggggagggggtggccaggggttggtgcaggaacccctctagctcctggctctgactctctctcttcatggctcatctctctctctgagttctgcaccagtttgtggctggctgctactcagtggcccaggt

SEQ ID NO: 19048 - DNA, 95 bp, Homo sapiens; identical to SEQ ID NO: 68

SEQ ID NO: 19049 - DNA, 93 bp, Homo sapiens; identical to SEQ ID NO: 69

SEQ ID NO: 19050 - DNA, 93 bp, Homo sapiens
gatggatgagaaggcagtgaggcatgaggacagcatagactttgacaacatgctgatttgaccctggctctgtcactcactcactgtcccatc

SEQ ID NO: 19051 - DNA, 62 bp, Homo sapiens
agtgagccgagatcgtgccactgtactccagcctaggtgacagtgagactctctctctctct

SEQ ID NO: 19052 - DNA, 76 bp, Homo sapiens
gaggctgaggtaggaggatcacttgagtgtaggagttcattacagaggggtatgattgcactccagcctgagtgtc

SEQ ID NO: 19053 - DNA, 69 bp, Homo sapiens
ctgtcacactgtctctctaaaatgataattggtcacagccagtgccagggagaagcagtttctgaacag

SEQ ID NO: 19054 - DNA, 91 bp, Homo sapiens
agataagccatagttatgtaatgacctcaggatagtagttgcttgcttgcattctctcactggctctctgtcgcatgcacttgcgctgtct

SEQ ID NO: 19055 - DNA, 117 bp, Homo sapiens
aaatttgtcaggatgtatgatgtattattaaaatattgcctcatttaatatgaaagtattttgcttttaatttaaggagggcagtctataattttctcatatatctttaccaggttt

SEQ ID NO: 19056 - DNA, 64 bp, Homo sapiens
tatatatttagtgctttctatatgcatatatatatatgttataggtagaagcactatatatata

SEQ ID NO: 19057 - DNA, 96 bp, Homo sapiens
tggtgtgtccatatatatatatataaggcagtttgtttatatccatatatattaatatatatgtctatctatataaacatatatatggcagcacca

SEQ ID NO: 19058 - DNA, 109 bp, Homo sapiens
aggtagtatgtgtgtgtgtatgtatgtgtttatatatctgtatctatatctatctatatctactattgcataaatatatctctccacatgcttatctccatatctatct

SEQ ID NO: 19059 - DNA, 102 bp, Homo sapiens
agaagaggagctaagttgaaacttgtatagttttatgaaaaacagaagcaaaccacactgtttttatttttaaaaaatttaagaaggcaaagcatttcttct

SEQ ID NO: 19060 - DNA, 104 bp, Homo sapiens
cttattatgtgttatgaactgtattaagctatatatgtatatatatgactatatattccaacacattatgttacttaatgcatataatgattccgcaagatagg

SEQ ID NO: 19061 - DNA, 72 bp, Homo sapiens
ggtgaaagtgggcatctttgtcttgtttcagttcttttttttttttgagacagagtttttgctcctgttgcc

SEQ ID NO: 19062 - DNA, 96 bp, Homo sapiens
aagttgagtgtttggtgggtttttttggggggggggttgtttttacaatataaatttttgtttacaatataaataaatgcagcattcattctactt

SEQ ID NO: 19063 - DNA, 95 bp, Homo sapiens; identical to SEQ ID NO: 68

SEQ ID NO: 19064 - DNA, 93 bp, Homo sapiens; identical to SEQ ID NO: 69

SEQ ID NO: 19065 - DNA, 83 bp, Homo sapiens
tggaggatcacaaaaggcccaaggacgactgtctctcccaatatgtatctgtctccatgtgtgcctgtgtgtgtgtgtgtcca

SEQ ID NO: 19066 - DNA, 95 bp, Homo sapiens; identical to SEQ ID NO: 68

SEQ ID NO: 19067 - DNA, 93 bp, Homo sapiens; identical to SEQ ID NO: 69

SEQ ID NO: 19068 - DNA, 118 bp, Homo sapiens
ttattgagtggcagaagattgtgaacagttcatatatatatatatatatatatatatatatatatatatatatatatatatatatatggtgttaataagacttttgaaattgcagtaa

SEQ ID NO: 19069 - DNA, 94 bp, Homo sapiens
tgggattaagtatatgtatatttttgggggcaggggggcggggggacagagtctctctctgtcacccaggctgtagttcagtggcgtgatctca

SEQ ID NO: 19070 - DNA, 83 bp, Homo sapiens
gtaactctatgtcgcagcagtttcattcctggatatatacccaggaggaatgaaaacatgtatgtatccaaacgaaaagttac

SEQ ID NO: 19071 - DNA, 73 bp, Homo sapiens
tcttgaggttctttatagtaattggaccccgaaaggcaggggtccctttttttttttttaaataattttaaga

SEQ ID NO: 19072 - DNA, 99 bp, Homo sapiens
tgcaggccaaatctgcccagctgcctctttttttttgagacagagtctcactctgtcgctcaggctagagtgcagtagcatgatctcggcttaactgca

SEQ ID NO: 19073 - DNA, 63 bp, Homo sapiens
tgtgcgtgcatgtgtctgtgtgtgcgcatgtatgtatacacacacacacacacacacatacat

SEQ ID NO: 19074 - DNA, 99 bp, Homo sapiens
gtaatgtcctttaagtgttgtgaaatttttatctttatagttagagtagcagtcttgtatgagttctctaagataatgatgtttcatagggtacattat

SEQ ID NO: 19075 - DNA, 106 bp, Homo sapiens
taggcaaatgttttaaaatcgcattacagttgtgatattgttgtagatattttgaaatgtcattgatattcattattgtcagattaggagagtgttagacctgcct

SEQ ID NO: 19076 - DNA, 93 bp, Homo sapiens
tgaggctgagtctaaatagaagtgaatattttaatttcataacagaaaactgggagatgagcaaaaagtaattttctccaagacccaatctca

SEQ ID NO: 19077 - DNA, 67 bp, Homo sapiens
ttccgagacaggatctcactctgtcactcaaatgggagtgcagtggtgtgatcatggcttactggaa

SEQ ID NO: 19078 - DNA, 84 bp, Homo sapiens
agtgctgggattacatgcgtgagccaccacatccagccatattttttaatttttgcaatggagtctcactctgtcacccaggct

SEQ ID NO: 19079 - DNA, 85 bp, Homo sapiens
ttcttgttgagtactaagaagcagactcaaagcacagttttttttgtttgtttgtttgagtctcgctctgttgcccaggctggaa

SEQ ID NO: 19080 - DNA, 66 bp, Homo sapiens
tgacttgtgtttaagtttaatctgtctatatatatatatagacaggaactgtgggcatgtgggtga

SEQ ID NO: 19081 - DNA, 77 bp, Homo sapiens
tatctatatttatatgttaacagtaaatctgattggcatgccttttatatatgactgttaactatggtcattagatg

SEQ ID NO: 19082 - DNA, 74 bp, Homo sapiens
tatatgtaatatagtatatgtatatgtatatgtatgtatatacatatagtgtatgtatatgtaatattacatat

SEQ ID NO: 19083 - DNA, 126 bp, Homo sapiens
gtatgtgtacatatatgtgtgtgtatatacgtatatatgtgtatgtgtatgtatatatatgtgtatatacacatatatacacacatatatatacatatatacacacatatatacatacatacatat

SEQ ID NO: 19084 - DNA, 109 bp, Homo sapiens
ttccaagggctttaattcctttcatataaaatttcacacactctgagtatgtctgatatataactgcatacaaatagagagagagagtatgttggagtgggaaaaggag

SEQ ID NO: 19085 - DNA, 99 bp, Homo sapiens
ggcttgcttgctctttctctccttcaccatgtctgtctatttctctctcacacaagagaaatgagatttatcagaaccagattaagggtcaggcacacc

SEQ ID NO: 19086 - DNA, 87 bp, Homo sapiens
gcacctgccaggtctgtgctcagagtcactcagtgtgggaactgtcatcactgtgattcctgattgtgcacctgccaggtttggtgc

SEQ ID NO: 19087 - DNA, 87 bp, Homo sapiens
agcccagatgaaagtatgattagggactggctgacccgggtcagactgcctgagtccatccaagtcctggtcctgcacttctcggct

SEQ ID NO: 19088 - DNA, 95 bp, Homo sapiens; identical to SEQ ID NO: 68

SEQ ID NO: 19089 - DNA, 93 bp, Homo sapiens; identical to SEQ ID NO: 69

SEQ ID NO: 19090 - DNA, 99 bp, Homo sapiens
ccattctgtcttatggctgcatagtattccatggtgtgtgtgtgtatatatatatatcacattttctttatccacttggtttatgagcattaaggttgg

SEQ ID NO: 19091 - DNA, 76 bp, Homo sapiens
attggtcaccctaatattccttcccacctaggtcagatcctgacttgagtgaagaatgtcaggaaaggataccaat

SEQ ID NO: 19092 - DNA, 80 bp, Homo sapiens
gaccacatgctgtatgattttatttctataaaatgtccagaatgggcaaattcatagagacaaaaagtagactagtggtt

SEQ ID NO: 19093 - DNA, 98 bp, Homo sapiens
ttcaagaacatgcagcaagttagtcagtctgtctcacttagtgaggactttctgtgtgtcagaacttgctgttctgaacacgtcttttaaaaagggag

SEQ ID NO: 19094 - DNA, 117 bp, Homo sapiens
cttaggtgtatatttaacggtagcagagaaagacagtaatggcttggtgactttttttttcttaaatgagattattctgttttgtctttggcattcctattgagttttttacccaag

SEQ ID NO: 19095 - DNA, 68 bp, Homo sapiens
tatgggggtcagaaaacagtgtggtcaaagggaagtttgaccatacctgtgtatgcctgtcttgcata

SEQ ID NO: 19096 - DNA, 101 bp, Homo sapiens
acacatctatgtatacatatatgtgtatatatgtatgtatatatatacacatatacatgtgtatatatgcatgtgtatatatgtatacatacatatataca

SEQ ID NO: 19097 - DNA, 80 bp, Homo sapiens
tatatatgtgtgtatatgtgtatatatatgtatatacatatatatgtgtatatacgtatatgtatatatatacgcaaata

SEQ ID NO: 19098 - DNA, 119 bp, Homo sapiens
cctgctcgtgtatttattcaaacctctcctttcagttgctcacatcaccactgtctcccactctctgacattgccgtggtggagtataggggaaaaaattggaactggatgacataggt

SEQ ID NO: 19099 - DNA, 68 bp, Homo sapiens
tgtgtgtgttgagagtctcgctctgtcacccaggctggagtgcagtggtgtgatcttggctcactgca

SEQ ID NO: 19100 - DNA, 94 bp, Homo sapiens
tgtatttttcacctaacatatatttatttattgtctgtcttcccctatcagagtgtaggctccaagaaggcaagtgtgttgtgtgttgtttata

SEQ ID NO: 19101 - DNA, 60 bp, Homo sapiens
ttgagacagactctcaccctgtcacccaggctggagtgcaatggtgtgatctcagctcag

SEQ ID NO: 19102 - DNA, 69 bp, Homo sapiens
caaagtctggctgtgtctctcccacatcatcaataactattagaatgggcctggcctggcttggctttg

SEQ ID NO: 19103 - DNA, 151 bp, Homo sapiens
gtatggtagtgtatatatatatatatatacgtatatatatatatacacgtatatatatatatatatacgtatatatatatatgtgtgtgtatatatatatatacatatatatatatatatgctatatgtataaccacactatatgtgtgtg

SEQ ID NO: 19104 - DNA, 101 bp, Homo sapiens
gccagcatgcatctcttcccctgtcctttgattagacagaagagagccagcagaagacagccaagatgctacatgaagtcagagagggaaggagcatgggt

SEQ ID NO: 19105 - DNA, 78 bp, Homo sapiens
tgtatgtgtgtatttatatatgtgtatatatgtgtgtgtacatatatgtgtgtgtatatataaaaaatatatatatat

SEQ ID NO: 19106 - DNA, 107 bp, Homo sapiens
cagtctggaacacagtgagaactctgcctataaaaatatttttttaattactatttttgtaatttatttttttttagagacacgggctcactctgtcactcaggctg

SEQ ID NO: 19107 - DNA, 92 bp, Homo sapiens
ccaaaagacaactgcaaaaaaatattgcaacatttcagcagagattttctctggggggtgaaattatgaatatttttattgatctcttttgg

SEQ ID NO: 19108 - DNA, 88 bp, Homo sapiens
ttcatttcaccatcatttctgaagaacagacttgcagttatactattgttggctgccaggttttttttttttctttgattactttgaa

SEQ ID NO: 19109 - DNA, 76 bp, Homo sapiens
atgtgcctgtgtgtatatttgtatattatataaacatcatctcatacaccatatataagtatatacatacatacat

SEQ ID NO: 19110 - DNA, 94 bp, Homo sapiens
gtaatctctgttatttctctgaagataatatttctttattttcagctatctggtgaaagtggtgattgtggtagtagaggaaacatgaatttat

SEQ ID NO: 19111 - DNA, 68 bp, Homo sapiens
catctgtcagtctgagtgactggtcttataaagtgacctttgagaccagtcattcagactgacagatg

SEQ ID NO: 19112 - DNA, 131 bp, Homo sapiens
agatatgtggagtgattggtgctggcataaagtcagctctatgactcaattcattccctcactctgtgcctctgtgatcccctttgctgccactagtgatccaaatcagaatgcaggcaggtagcggaatg

SEQ ID NO: 19113 - DNA, 86 bp, Homo sapiens
tgagcacaaagtgaattcttattctctaattactactgcagagatctataaatttttattagataagaattcatttttgtagttca

SEQ ID NO: 19114 - DNA, 95 bp, Homo sapiens; identical to SEQ ID NO: 68

SEQ ID NO: 19115 - DNA, 93 bp, Homo sapiens; identical to SEQ ID NO: 69

SEQ ID NO: 19116 - DNA, 62 bp, Homo sapiens
tgtgtgtgtgtgtgtgtgtatacgtattatatatatatatacatggtatacatgcacacacg

SEQ ID NO: 19117 - DNA, 70 bp, Homo sapiens
tgacaaggccagtctcactctctccctgcaggcagcctgcaggtgggactcagaccttgcccccaggtta

SEQ ID NO: 19118 - DNA, 72 bp, Homo sapiens
ggcacaaaggcctgtggggaatgttctgaggcagcacagagcagcagaatgttcataactatggctagttcc

SEQ ID NO: 19119 - DNA, 89 bp, Homo sapiens
atatcacacgtgtatatatgtgtatatatacatacatatcacacgtgtatatatgtgtgtatatatacatacatatcacacgtgtatat

SEQ ID NO: 19120 - DNA, 146 bp, Homo sapiens
atatgtgtgtgtatatatacatatatatatgtgatatatatgtatatatgtatatgtgtatatatgtatatatgtatatatgtgtatatatgtatatgtatgtatatatacacacatatatacacgtgtgatatgtatgtatatat

SEQ ID NO: 19121 - DNA, 78 bp, Homo sapiens
actcacaggttacgccacaaagactgattacttgtgactcacactcagtgaaagctcttagggtgaactctcatgagt

SEQ ID NO: 19122 - DNA, 95 bp, Homo sapiens; identical to SEQ ID NO: 68

SEQ ID NO: 19123 - DNA, 93 bp, Homo sapiens; identical to SEQ ID NO: 69

SEQ ID NO: 19124 - DNA, 114 bp, Homo sapiens
gcaaatactgctaattgattcctttttatggctgagtagtattccattgtatatatatatataccacttgttgactgatgggcatttgggttggttccacgattttgcagttgt

SEQ ID NO: 19125 - DNA, 93 bp, Homo sapiens
gatgcaggctcttttttggttccatatgaaatttaaagtagttttttccaattctgtgaagaaagtcattggtagcctgatggggatggcatt

SEQ ID NO: 19126 - DNA, 82 bp, Homo sapiens
tatatacacacatatatgtacatgaatctgtaaatacacagatattgtgtgagcatgtgtgtgtgtgtgtgtgtgtgtgtat

SEQ ID NO: 19127 - DNA, 95 bp, Homo sapiens; identical to SEQ ID NO: 68

SEQ ID NO: 19128 - DNA, 93 bp, Homo sapiens; identical to SEQ ID NO: 69

SEQ ID NO: 19129 - DNA, 56 bp, Homo sapiens
tgagtctgaatctcactgtcacccaggctggagtgcagtggtacaatcttggctca

SEQ ID NO: 19130 - DNA, 85 bp, Homo sapiens
ggaacatgatgacttttagaggctagacaccagagaggcaatccctgtctgaagtgacagagaactaaaggtctctacaaattct

SEQ ID NO: 19131 - DNA, 86 bp, Homo sapiens
atatatgtacatatatagatatatatatgtattctacatacatatatatgtagtgtatgtgtgtgtgtgcgtgtgtgtatatatat

SEQ ID NO: 19132 - DNA, 168 bp, Homo sapiens
gaatacatatatatatctatatatgtacatatatatctatatgtatacatatatctatatatgtatacatatagatacatagctatatagatacatatctaatgtatacatgtatacacatgtacctacatgtatacacatgtatctgcatgtatacacatgtataca

SEQ ID NO: 19133 - DNA, 58 bp, Homo sapiens
tgagactgagtctcactctgtcgcccaggctggagtgcagcgatgccatctcagctca

SEQ ID NO: 19134 - DNA, 70 bp, Homo sapiens
tgccttaaagggtggcggtggcacgtgtggaccttgctttctgagtttcactctccgagtcccagaggta

SEQ ID NO: 19135 - DNA, 84 bp, Homo sapiens
ggaatgaacaagggcagtttggaggttaaaggcaagatggagtcagttaggtctgatctctttcactgtcacaattttctcacc

SEQ ID NO: 19136 - DNA, 114 bp, Homo sapiens
ggctattgtgggtcttttgtgattccatatgaattttagaatcattttttctatatctgtaaaaaaatctcactgggatattgatgggaatagcactgaatgtgcagattagtt

SEQ ID NO: 19137 - DNA, 77 bp, Homo sapiens
catatatatatatgtgcatgtatatatatgtatatatgtgtgtatatatatatatgtatatgtgtgtgtgtatgtat

SEQ ID NO: 19138 - DNA, 83 bp, Homo sapiens
gattttatattctgcaactttactgaatttatcagatctaagagctttttggtggagtcttcagtttttctagatgtaagatc

SEQ ID NO: 19139 - DNA, 57 bp, Homo sapiens
tgagacagagtctcgctctgtcacccaggtggagtgcagtggtgtgatctcggctca

SEQ ID NO: 19140 - DNA, 105 bp, Homo sapiens
tataagaaatattttataaagttttctagtggtgatgtcaataaaattagaatctttttgaatttagactgatgtcacccagtgcttaagtaagtgtatctgatg

SEQ ID NO: 19141 - DNA, 90 bp, Homo sapiens
gagatatggccttttctttagtaatgtagcagtttatatgttctagattacattatagactactgctacttgaagggacagccaggtttt

SEQ ID NO: 19142 - DNA, 106 bp, Homo sapiens
gaggaagaaaggaagacaggaatcagtttctaggctagtcagtttttttttgtaatcttacaacttttcactgtgtttgatgcacttcttgcttttctatattctc

SEQ ID NO: 19143 - DNA, 109 bp, Homo sapiens
ccacatttaaggagattcatatgttttaaattttggtcacaaagtgaaactttattattattactttgtgtattgcactatttgaaataatgcaaattcacaggagtgg

SEQ ID NO: 19144 - DNA, 104 bp, Homo sapiens
gatgaagtcgattaagttagatctctttcactgtctcagtcacaattgtgcaaaggtggtttcagacatgagaaagggaactgacttctttgggagagcacatc

SEQ ID NO: 19145 - DNA, 103 bp, Homo sapiens
ttgagatggagtctcacactgtcgcccaggctagagggcagtggtgcggtctcagctcactgcagtctctgtctcctgggttcaagcaattctcctgcctcgg

SEQ ID NO: 19146 - DNA, 111 bp, Homo sapiens
caaagtgctgggattacaggcgtgagccattgtgcccggcctaccctaggtcttaagaatagaactatgtagctgggtgcagtggcttacatctgtaatcccagcactttg

SEQ ID NO: 19147 - DNA, 84 bp, Homo sapiens
tacatgtgtagctctgtgatcataagaaaaaaatgataatacattcttctattttttttttttgagtcggagtcttgctctgtg

SEQ ID NO: 19148 - DNA, 89 bp, Homo sapiens
acagagtgagaccccatctcaaagaaaaaacactggaaatttactgccttttttttttttttcttttttcagacggagtctcactctgt

SEQ ID NO: 19149 - DNA, 63 bp, Homo sapiens
ggcgtgagccaccgtgcccggccaattctttttttttttaagacagggtctggctctgttgcc

SEQ ID NO: 19150 - DNA, 120 bp, Homo sapiens
gccattgcactccagcgtgggtgacgagagtgaaactctgtctcaaaatttaaaaaaaaaaaatttttttttttttgagacaaggtatcactgtcaccctaactggaatacagtggtgca

SEQ ID NO: 19151 - DNA, 69 bp, Homo sapiens
ggagtcttgctgtgtcactgtcacccaggctggagtgcagtggcgcgatctcagctcattgcaagctct

SEQ ID NO: 19152 - DNA, 84 bp, Homo sapiens
gttgttgttgttgttttgagacactgtctcactccctcgcctgggctggagtgcagtagtgtgatctcggcccactgcaacctc

SEQ ID NO: 19153 - DNA, 78 bp, Homo sapiens
gagaactgagaagtttaggagctgacttggcttcagggttccctttcagtctgtttctctcatcttcactgcttctca

SEQ ID NO: 19154 - DNA, 110 bp, Homo sapiens
tgcatatcctttgcccactttttgatggggttctttgtttttttcttgtaaatttgtttaagttccttgtagattctggatattagaccttgtcagatggatagattgca

SEQ ID NO: 19155 - DNA, 100 bp, Homo sapiens
ccagcctgggcaacattgagagacctcatttctgtttatttatttgtatttatatttatatattttttaagacagagtctcgctctgtcacccaggctgg

SEQ ID NO: 19156 - DNA, 76 bp, Homo sapiens
cctgcatgtgcatgcgtgtgtgtgcacatggtgcgtacatgagtgtctgtgtgtgtgtgtgcatgtgtgtgcatgg

SEQ ID NO: 19157 - DNA, 70 bp, Homo sapiens
ggatggaggtgtgatgaggacatttatttgtgcatgaatgaatgaatgacagagtctcgctctctcaccc

SEQ ID NO: 19158 - DNA, 76 bp, Homo sapiens
atcactctgtctctcaggctggagtgcaatggcacaatcaactcactgcagccttgaattcctgggcacaagtgat

SEQ ID NO: 19159 - DNA, 58 bp, Homo sapiens; identical to SEQ ID NO: 315

SEQ ID NO: 19160 - DNA, 58 bp, Homo sapiens; identical to SEQ ID NO: 1673

SEQ ID NO: 19161 - DNA, 91 bp, Homo sapiens
cagtctgcagaactgtgagaaatatctgtttttttttgtttgtttgtttttgttttttttgagacagagtctcattctgtcatccaggctg

SEQ ID NO: 19162 - DNA, 81 bp, Homo sapiens
ccgtgcctggctgatactagcattcttttttattttttattatttttttaagatagagtcttgctctgttgcccaggctgg

SEQ ID NO: 19163 - DNA, 112 bp, Homo sapiens
tttgtgagtgtgaactatatagctgtccctaaaacataattgagaacagaaaggttttatttttaattatataattttcttgcccaagttatatggattcataggttacaga

SEQ ID NO: 19164 - DNA, 95 bp, Homo sapiens; identical to SEQ ID NO: 68

SEQ ID NO: 19165 - DNA, 93 bp, Homo sapiens; identical to SEQ ID NO: 69

SEQ ID NO: 19166 - DNA, 80 bp, Homo sapiens
atacatgtatatatatatatcatgcacacacatttaaatataatgtaaatgtgtgtgtgtgtgtgtgtgtgtgtgtgtat

SEQ ID NO: 19167 - DNA, 110 bp, Homo sapiens
cagagctctgtttgataccgggagacttaatgcagtaaaagtgacagaaagtgcaactgatagtaggatgaaaattataatcttcaaggattattgagccatgagatctg

SEQ ID NO: 19168 - DNA, 119 bp, Homo sapiens
tgcaaatgtagcagaagacagcaaagggttctggatatgccaattattatttatttatttttattatactttaagttctagggtacatgtgcacaatgtgcaggtttgttacatatgta

SEQ ID NO: 19169 - DNA, 110 bp, Homo sapiens
agaggcaatgataggattttctgtactttatccacatgtttatatatatacatatatatatgttttcatataacctttcataaggatagaaaagaactatgaatgtttct

SEQ ID NO: 19170 - DNA, 110 bp, Homo sapiens; identical to SEQ ID NO: 19169

SEQ ID NO: 19171 - DNA, 119 bp, Homo sapiens; identical to SEQ ID NO: 19168

SEQ ID NO: 19172 - DNA, 110 bp, Homo sapiens; identical to SEQ ID NO: 19167

SEQ ID NO: 19173 - DNA, 80 bp, Homo sapiens; identical to SEQ ID NO: 19166

SEQ ID NO: 19174 - DNA, 95 bp, Homo sapiens; identical to SEQ ID NO: 68

SEQ ID NO: 19175 - DNA, 93 bp, Homo sapiens; identical to SEQ ID NO: 69

SEQ ID NO: 19176 - DNA, 92 bp, Homo sapiens
actgcttgacacctgattgtgtgtataccccccccttttttttttatatacttttaagttttagggtacatgtgcacaatgtgcaggttagt

SEQ ID NO: 19177 - DNA, 112 bp, Homo sapiens; identical to SEQ ID NO: 19163

SEQ ID NO: 19178 - DNA, 72 bp, Homo sapiens
agctgaggtaggtgatcatgcaccagctgggggaaagaaggccctggctctgtctctttcacaatctctgct

SEQ ID NO: 19179 - DNA, 81 bp, Homo sapiens; identical to SEQ ID NO: 19162

SEQ ID NO: 19180 - DNA, 62 bp, Homo sapiens
ccaaagagcatgggtgcatatgatgggcagagctggctccgtgcctgcatccctgcctgagg

SEQ ID NO: 19181 - DNA, 101 bp, Homo sapiens
caaagtgctaggattacaggcatgagtcaccacgcctggttcacaatttctttttgtttttaccaaaggcaggtatattcctgaaattttttgtttttttg

SEQ ID NO: 19182 - DNA, 96 bp, Homo sapiens
tataaaactatcatttccagtgattctctctgtcagtgtcatcaggtaaggcacttaggttgtggctctctgcaagagaaatgtaaatggtttata

SEQ ID NO: 19183 - DNA, 87 bp, Homo sapiens
tttgacccagagtctcactgtgtcacccaggctggagtgcagtggcacgatctcagctttctgcagcgtctgcttcctgggttcaag

SEQ ID NO: 19184 - DNA, 58 bp, Homo sapiens; identical to SEQ ID NO: 1673

SEQ ID NO: 19185 - DNA, 81 bp, Homo sapiens; identical to SEQ ID NO: 19162

SEQ ID NO: 19186 - DNA, 81 bp, Homo sapiens; identical to SEQ ID NO: 19162

SEQ ID NO: 19187 - DNA, 112 bp, Homo sapiens; identical to SEQ ID NO: 19163

SEQ ID NO: 19188 - DNA, 80 bp, Homo sapiens; identical to SEQ ID NO: 19166

SEQ ID NO: 19189 - DNA, 105 bp, Homo sapiens
tctaaaccataactttgtagctacatgatttgggtgagatgattttttttttttttttgagaaggactctcgctctgtcacccagactagagggcagtggtgtga

SEQ ID NO: 19190 - DNA, 115 bp, Homo sapiens
tgcaaatgtagcagaagacagcaaagggttctggatatgccaattattatttatttttattatactttaagttctagggtacatgtgcacaatgtgcaggtttgttacatatgta

SEQ ID NO: 19191 - DNA, 110 bp, Homo sapiens; identical to SEQ ID NO: 19169

SEQ ID NO: 19192 - DNA, 110 bp, Homo sapiens
agaggcaatgataggattttctgtactttatccacatgtttatatatacacatatatatatgttttcatataacctttcataaggatagaaaagaactatgaatgtttct

SEQ ID NO: 19193 - DNA, 80 bp, Homo sapiens; identical to SEQ ID NO: 19166

SEQ ID NO: 19194 - DNA, 70 bp, Homo sapiens; identical to SEQ ID NO: 19157

SEQ ID NO: 19195 - DNA, 76 bp, Homo sapiens; identical to SEQ ID NO: 19158

SEQ ID NO: 19196 - DNA, 58 bp, Homo sapiens; identical to SEQ ID NO: 315

SEQ ID NO: 19197 - DNA, 58 bp, Homo sapiens; identical to SEQ ID NO: 1673

SEQ ID NO: 19198 - DNA, 91 bp, Homo sapiens; identical to SEQ ID NO: 19161

SEQ ID NO: 19199 - DNA, 81 bp, Homo sapiens; identical to SEQ ID NO: 19162

SEQ ID NO: 19200 - DNA, 76 bp, Homo sapiens
ctgggcaacctagtaagaccccaactctataaaaaggagttttttttttttgagacagtctcactctgtcacccag

SEQ ID NO: 19201 - DNA, 91 bp, Homo sapiens; identical to SEQ ID NO: 19161

SEQ ID NO: 19202 - DNA, 81 bp, Homo sapiens; identical to SEQ ID NO: 19162

SEQ ID NO: 19203 - DNA, 76 bp, Homo sapiens; identical to SEQ ID NO: 19200

SEQ ID NO: 19204 - DNA, 112 bp, Homo sapiens; identical to SEQ ID NO: 19163

SEQ ID NO: 19205 - DNA, 80 bp, Homo sapiens; identical to SEQ ID NO: 19166

SEQ ID NO: 19206 - DNA, 110 bp, Homo sapiens; identical to SEQ ID NO: 19167

SEQ ID NO: 19207 - DNA, 119 bp, Homo sapiens; identical to SEQ ID NO: 19168

SEQ ID NO: 19208 - DNA, 110 bp, Homo sapiens; identical to SEQ ID NO: 19192

SEQ ID NO: 19209 - DNA, 110 bp, Homo sapiens; identical to SEQ ID NO: 19169

SEQ ID NO: 19210 - DNA, 115 bp, Homo sapiens; identical to SEQ ID NO: 19190

SEQ ID NO: 19211 - DNA, 106 bp, Homo sapiens
tctaaaccataactttgtagctacatgatttgggtgagatgatttttttttttttttttgagaaggactctcgctctgtcacccagactagagggcagtggtgtga

SEQ ID NO: 19212 - DNA, 110 bp, Homo sapiens; identical to SEQ ID NO: 19167

SEQ ID NO: 19213 - DNA, 80 bp, Homo sapiens; identical to SEQ ID NO: 19166

SEQ ID NO: 19214 - DNA, 113 bp, Homo sapiens
tatatatacacacacacatatacatgtatatatacatacatacatatatatattttatatatatatatatatatatatatatattttgtgtgtgtgtgtgtgtgtgtgtgatg

SEQ ID NO: 19215 - DNA, 95 bp, Homo sapiens; identical to SEQ ID NO: 68

SEQ ID NO: 19216 - DNA, 93 bp, Homo sapiens; identical to SEQ ID NO: 69

SEQ ID NO: 19217 - DNA, 92 bp, Homo sapiens; identical to SEQ ID NO: 19176

SEQ ID NO: 19218 - DNA, 112 bp, Homo sapiens; identical to SEQ ID NO: 19163

SEQ ID NO: 19219 - DNA, 95 bp, Homo sapiens; identical to SEQ ID NO: 68

SEQ ID NO: 19220 - DNA, 93 bp, Homo sapiens; identical to SEQ ID NO: 69

SEQ ID NO: 19221 - DNA, 101 bp, Homo sapiens; identical to SEQ ID NO: 19181

SEQ ID NO: 19222 - DNA, 96 bp, Homo sapiens; identical to SEQ ID NO: 19182

SEQ ID NO: 19223 - DNA, 87 bp, Homo sapiens; identical to SEQ ID NO: 19183

SEQ ID NO: 19224 - DNA, 58 bp, Homo sapiens; identical to SEQ ID NO: 1673

SEQ ID NO: 19225 - DNA, 58 bp, Homo sapiens; identical to SEQ ID NO: 315

SEQ ID NO: 19226 - DNA, 76 bp, Homo sapiens; identical to SEQ ID NO: 19158

SEQ ID NO: 19227 - DNA, 70 bp, Homo sapiens; identical to SEQ ID NO: 19157

SEQ ID NO: 19228 - DNA, 96 bp, Homo sapiens; identical to SEQ ID NO: 19182

SEQ ID NO: 19229 - DNA, 87 bp, Homo sapiens; identical to SEQ ID NO: 19183

SEQ ID NO: 19230 - DNA, 58 bp, Homo sapiens; identical to SEQ ID NO: 1673

SEQ ID NO: 19231 - DNA, 81 bp, Homo sapiens; identical to SEQ ID NO: 19162

SEQ ID NO: 19232 - DNA, 76 bp, Homo sapiens; identical to SEQ ID NO: 19200

SEQ ID NO: 19233 - DNA, 91 bp, Homo sapiens; identical to SEQ ID NO: 19161

SEQ ID NO: 19234 - DNA, 81 bp, Homo sapiens; identical to SEQ ID NO: 19162

SEQ ID NO: 19235 - DNA, 57 bp, Homo sapiens
tgagacgagtctcgctctgtcacccaggcaggagtacagtagcgtgatcttggctca

SEQ ID NO: 19236 - DNA, 91 bp, Homo sapiens; identical to SEQ ID NO: 19161

SEQ ID NO: 19237 - DNA, 112 bp, Homo sapiens; identical to SEQ ID NO: 19163

SEQ ID NO: 19238 - DNA, 92 bp, Homo sapiens; identical to SEQ ID NO: 19176

SEQ ID NO: 19239 - DNA, 95 bp, Homo sapiens; identical to SEQ ID NO: 68

SEQ ID NO: 19240 - DNA, 93 bp, Homo sapiens; identical to SEQ ID NO: 69

SEQ ID NO: 19241 - DNA, 113 bp, Homo sapiens; identical to SEQ ID NO: 19214

SEQ ID NO: 19242 - DNA, 110 bp, Homo sapiens; identical to SEQ ID NO: 19167

SEQ ID NO: 19243 - DNA, 153 bp, Homo sapiens
tctaaaccataactttgtagctacatgatttgggtgagatgattttttttttttttttttttttttgagaaggactctcgctctgtcacccagactagagggcagtggtgtgatcttggctcactgcaacctcctcctcatgggttcaagtga

SEQ ID NO: 19244 - DNA, 119 bp, Homo sapiens; identical to SEQ ID NO: 19168

SEQ ID NO: 19245 - DNA, 110 bp, Homo sapiens; identical to SEQ ID NO: 19169

SEQ ID NO: 19246 - DNA, 143 bp, Homo sapiens
tatatatatatacatatatgtgtgtgtgtgtatatatatatatatacacacacacacacccacacacaaacatatatatgtatatatctgtgtatatgtgtatatatacacacatacatgcacagatatatatgtatatatgt

SEQ ID NO: 19247 - DNA, 126 bp, Homo sapiens
acatatacatatatagtgtatatatacacatatatatgtacacatatatatatacacatatgtatatatgtatatgtgtatatatacactatatatgtatatgtatgtgtgtgtgtgtgtgtaaac

SEQ ID NO: 19248 - DNA, 108 bp, Homo sapiens
atacatatacatatatagtgtatatatacacatatacatatatacatatgtgtatatatatatgtgtacatatatatgtgtatatatacactatatatgtatatgtgt

SEQ ID NO: 19249 - DNA, 89 bp, Homo sapiens
tagtacaaattctgtttatgctgtgataggaaggtgaaacatttatttatttttggaacatcttcctctattggcctgaactggtgctg

SEQ ID NO: 19250 - DNA, 76 bp, Homo sapiens
gtagtttctttttttgagaccgagtctcactctgtcacccaggctggagtgcagtggtgcgatcttggctcactgc

SEQ ID NO: 19251 - DNA, 58 bp, Homo sapiens
tgagaccgagtctcactctgtcacccaggctggagtgcagtggtgcgatcttggctca

SEQ ID NO: 19252 - DNA, 73 bp, Homo sapiens
gagcccagcaggtaagaggctgcagtgagccaggacagaggctgcagtgagccgtaatcatgcccatgtactc

SEQ ID NO: 19253 - DNA, 66 bp, Homo sapiens
ggaggacatgagtgagtgtttcttttttttttttttttttttgagacggagtctcactctgtcacc

SEQ ID NO: 19254 - DNA, 103 bp, Homo sapiens
tagaggttgctgaaggttggggtggctgtggcaatttcttaaaagaagacaacaatgaagtctgccacactgactgactcttgcttttatgaaatattctctg

SEQ ID NO: 19255 - DNA, 132 bp, Homo sapiens
ttttaaaaattagcctggtatggtggcacacaccggtggtcccagttacttggaaggctgaggtagaaggatcacttgagccttgcatgttgaggctgcagtgaactgtgatcatgctactgtactccagcc

SEQ ID NO: 19256 - DNA, 113 bp, Homo sapiens
accaacagtgtatacgcgtccccttttctctgcaaccttgccagcatctgttatttttttgactttttaataatagccattctgactggtgtgagatggtgtctcattgtggt

SEQ ID NO: 19257 - DNA, 115 bp, Homo sapiens
gatctgtgaaactttgaacttgggaaatatgatttagggtatctggcagaagaaatttcttttttttttttattatactttaagttttagggtacatgtgcatattgtgcaggtt

SEQ ID NO: 19258 - DNA, 83 bp, Homo sapiens
catgattgccatagccatacttagcagctggcagagtccccacactggctccctgactggtaggatgagggttattatggtgg

SEQ ID NO: 19259 - DNA, 88 bp, Homo sapiens
ggctagagtcagaagagagtaaggactcagcatatattagttatagctaatgtttgtggcaggttgtattttcccccaaatggctacc

SEQ ID NO: 19260 - DNA, 82 bp, Homo sapiens
acaatacactacgactctgactctctgaggcccttccaggagatgggctgaggatccgcagcgtcagagaaagctgtattgt

SEQ ID NO: 19261 - DNA, 73 bp, Homo sapiens
ttgttaaaaatagcacctacaatataccaggcattatagggtgcttggtgagtgaggacactgtgaagaacaa

SEQ ID NO: 19262 - DNA, 117 bp, Homo sapiens
tgtttcagcatttgtaaaccaaagaaccagcttgaaacatctggatatttgtaattaagtttatagttttaaaagtgttttcacgcaactgtttggcaagcttacatttctgaaata

SEQ ID NO: 19263 - DNA, 83 bp, Homo sapiens
tttggtcttgctctgtgtccctgtgtgggtcagaggaaacactgcttcccatattgtgcacggcaacagaagctggaaccaga

SEQ ID NO: 19264 - DNA, 100 bp, Homo sapiens
actgagtgacacactctttgctttttatatctgaagagccagatcgcctttgctatttattctatttataaaacttgcttctagtgaagtcacttttagt

SEQ ID NO: 19265 - DNA, 103 bp, Homo sapiens
tagacaaagaacacaactgacttcattctgactgcctcccttatgtaccatgaaagtaagagagagagagagagagagagcagcagagcttacagtctgtcta

SEQ ID NO: 19266 - DNA, 115 bp, Homo sapiens
gttctcttgaaagttgctacattggtgtgattataatgctgatcaggaaacgtatgtatgtatgtatgtatgtatgttgagacggagtctcgttttgttgcccaggctggagtgc

SEQ ID NO: 19267 - DNA, 77 bp, Homo sapiens
gaagacagtgatcctgaccctgtgcaggcctaagctaaggtctgtgtttgtgtattaagtttttagttattgttttt

SEQ ID NO: 19268 - DNA, 64 bp, Homo sapiens
actcacactcacactcttcctcacgtctatagcaacagatgtcagatgggagtgtgcattgagt

SEQ ID NO: 19269 - DNA, 107 bp, Homo sapiens
gttccaaataggtgcttatactgtagctttgaatagccctgacacaaaacagtgaatacaaacactccaatttgcccagcacagctctaggggctaccatgtggaac

SEQ ID NO: 19270 - DNA, 104 bp, Homo sapiens
gtgctgcagttttgctgttttaaagggaagctccccaagaatggacagtcccccatgctgacacaactttgtgaggtttctgctgaggacaggaagctgagtgc

SEQ ID NO: 19271 - DNA, 103 bp, Homo sapiens
ccagcctggtcaacatagcaagacccgtctctacaggagaaaaataagaaaattaatttaattttttttttttgatggagtctcactctgtcacccaggctgg

SEQ ID NO: 19272 - DNA, 58 bp, Homo sapiens; identical to SEQ ID NO: 315

SEQ ID NO: 19273 - DNA, 73 bp, Homo sapiens
gtggagggttggctagggagtcaagagatctaggcccccttctgagtcctgagactctctcacagtgtggccc

SEQ ID NO: 19274 - DNA, 103 bp, Homo sapiens
attgctccttgattcctgacccatagacactgtgtgagataatagatgcttttttttgttttaagccactaagttttggggggtaatttttttatgtagcaat

SEQ ID NO: 19275 - DNA, 92 bp, Homo sapiens
ggaaagtagtttttaaatgatgacatacaaggttttatagtgctgtgatgacctgaatgaagtttgtgtgcagagaaactgctctttttgcc

SEQ ID NO: 19276 - DNA, 94 bp, Homo sapiens
tgtaatctgtaatcttatcagtgtatttccaaagcctttttttttttttttttgagatggctggagtgcagtggtgcaatctcagtccactgca

SEQ ID NO: 19277 - DNA, 68 bp, Homo sapiens
gctgcagccttagtcttggcccccacacaagcaagccttggtggttcagagaggacagagggtggagc

SEQ ID NO: 19278 - DNA, 58 bp, Homo sapiens; identical to SEQ ID NO: 6359

SEQ ID NO: 19279 - DNA, 74 bp, Homo sapiens
gttgttgtttttgccagagtctcaccctgtctcccaggctggagtgcagtggtgtgatttcagctcactgcaac

SEQ ID NO: 19280 - DNA, 80 bp, Homo sapiens
ctacagtccttcagagtgaattttttttttttttttttttttttttgagatggagtctcactctgtggcccaggctggag

SEQ ID NO: 19281 - DNA, 58 bp, Homo sapiens
tgaggtagggtctcactctgtcactcagggtggagtgcagtggtgtgatcacagctca

SEQ ID NO: 19282 - DNA, 124 bp, Homo sapiens
cttttctgtgctttttgttttattttaaagaagggttgcttatatttcttgattaaatgtatttctttatgtgtaattaaagaagacatcaaatggagctccctttggttacagtgagagagta

SEQ ID NO: 19283 - DNA, 70 bp, Homo sapiens
gtatttatatgtatatgtatatgtatgtatatatctatgtgtatatatatgtatatgtgtgtatacacac

SEQ ID NO: 19284 - DNA, 76 bp, Homo sapiens
cttttctgattttgttgatcatctcaggattgccaggtagtggtggccactgacagggtcctacagtgcagagaag

SEQ ID NO: 19285 - DNA, 92 bp, Homo sapiens
agcagtaaatttgttctgtgcttctgtgcctctgtctcccatggggaagtcatggggagtggtagggtgggtggcaggatttgggtatttct

SEQ ID NO: 19286 - DNA, 71 bp, Homo sapiens
atgagtatatacacacacacatatagttgtatatatattatatgtatacatatgtgtgtatatgtatctat

SEQ ID NO: 19287 - DNA, 72 bp, Homo sapiens
catgtgtggctcccattatatttctactggacagcactggtctgtctctgtgactcagatgggacaacactg

SEQ ID NO: 19288 - DNA, 87 bp, Homo sapiens
ccatccatcagccggctgactcagtctctctttctccaaacataaatgctctggggaggaagattagctcagctggtctataaatgg

SEQ ID NO: 19289 - DNA, 82 bp, Homo sapiens
gtgttatttagggctggtttactttcctgatggtggaatgctgtgatccacttacagaagagagtaaacacactccaagcac

SEQ ID NO: 19290 - DNA, 110 bp, Homo sapiens
ttactgtcaagttgtcattttctccaattgccttgaaggtttgtttctttttaaaattcagtgtaaccttacaggaggcaataagggctggcgaaacgcggtggcagtgg

SEQ ID NO: 19291 - DNA, 93 bp, Homo sapiens
accagcctgggccactcagctaattttcttagtttttgtagagagagggtcaggctacaaaaaataagaaaattagttgagtgtgatggcggt

SEQ ID NO: 19292 - DNA, 124 bp, Homo sapiens
atgtatatatgtgtatatatgtatatatatgtgtatatatgtattatatgtgtatatatatgtatatgtgtatatatatgtgtatatgtatatatacacacacacacatatacaaacatatata

SEQ ID NO: 19293 - DNA, 109 bp, Homo sapiens
ccaaataattggttactggaggataagtgcatacctgtttataagatttatttcatattttgatagcaaactatttatagggcaaccttaggataaccttgtattctgg

SEQ ID NO: 19294 - DNA, 67 bp, Homo sapiens
tgtttttgagacagtctcactctgtcacccaggctggggtgcagtggtgtgatcacagctctctgca

SEQ ID NO: 19295 - DNA, 98 bp, Homo sapiens
ccagtctctagagattcacattattgagacccttcctttgcatattgaccttttttttttttttttgagacagggtctcactctgtcactcaggctgg

SEQ ID NO: 19296 - DNA, 100 bp, Homo sapiens
tgtagtcctacattacaagcaaaggaagacttctggtagaagaaaccacttatttttcattattagaaattatctattgtatacttgtactcaaactgca

SEQ ID NO: 19297 - DNA, 93 bp, Homo sapiens
tctgtagactggtcagaaccactccgtggttggtggtctcttaggcaaaaaaggaggggcagcatcaggtagttggttgatatcagtggtgga

SEQ ID NO: 19298 - DNA, 66 bp, Homo sapiens
actgatcacgtggtccatccccgggaggcactaaagaatatcaccgggtgttgaaatgtgtccagt

SEQ ID NO: 19299 - DNA, 100 bp, Homo sapiens
gtggtgaggagaatttttatttctgtgtgagaaaatactgattttttataataatatacaaaatgagtatcatatcatcatgatatcctatccatatcat

SEQ ID NO: 19300 - DNA, 81 bp, Homo sapiens
tgcccccacaaatgtcagaaaaacaccctgatggtagtgttcatagcagcctctgtgcctctctggcatacatggtgggta

SEQ ID NO: 19301 - DNA, 133 bp, Homo sapiens
tatatacatactatatatagatatatactatatacatactatatatagtatatatctatatatctatatatgtatatatatctatatatctatatatagtatatatagatagatagtatatctacatagtata

SEQ ID NO: 19302 - DNA, 123 bp, Homo sapiens
tatcgtatatatggtacatatagatgtatacgatatatactatagattgtatatatagatatatactatatatagatagatgtgtagtatatatagatatatactatatacatactatatata

SEQ ID NO: 19303 - DNA, 81 bp, Homo sapiens
ctcctccagagtctctccctgtcacttctcctcctagtaaagatacacagaggagagggagaagctaagatggggaggcac

SEQ ID NO: 19304 - DNA, 95 bp, Homo sapiens; identical to SEQ ID NO: 580

SEQ ID NO: 19305 - DNA, 93 bp, Homo sapiens; identical to SEQ ID NO: 69

SEQ ID NO: 19306 - DNA, 92 bp, Homo sapiens
ggtacgtacggagtatatggaacagtgcctggtagggaataagtcccgtaaaagttaatcattttatatacatcaaataagtctgttctacc

SEQ ID NO: 19307 - DNA, 89 bp, Homo sapiens
atgtatgcacataaacttgtgtaagtatattatctataattgtatatagattgtgtatattatacatatttgtgtttgtgtgagtgtgt

SEQ ID NO: 19308 - DNA, 87 bp, Homo sapiens
tgggactacaggcgtgcaccaccacacctggctactgtttgtatttttagtagagacagtttcaccatgttggtcaggctggtctca

SEQ ID NO: 19309 - DNA, 96 bp, Homo sapiens
gataggctgttccttccaaagcttagagattaagcatatatatatatatatatatatacataattttttttttttgagacggagtctcgctctgtc

SEQ ID NO: 19310 - DNA, 79 bp, Homo sapiens
gggacaggcattccctggcctgcgaggaggcttcgttccctaggacagccaccctctggggtctgcctttgcctgcccc

SEQ ID NO: 19311 - DNA, 67 bp, Homo sapiens
ccccagctgcctctctgagtcactgcccagctgagccccatgaaaaagcagcagagacagaatgggg

SEQ ID NO: 19312 - DNA, 104 bp, Homo sapiens
attttgaaggtatgtcattccactcactgggtgtaattctgtctctttttctgtcatttaagaaaacacactggaatacatgagtttatgaatgactttgaaat

SEQ ID NO: 19313 - DNA, 112 bp, Homo sapiens
tatacattagggttgtgaggttgtaggctgaatgaagattggaagaaacttgttgattattattaaatgcctctcaatatttcagaagacattcccccaccctgaaagtata

SEQ ID NO: 19314 - DNA, 89 bp, Homo sapiens
atgcgagtgtgtgtgtgtgtgcgcacatgtgtgtgtgtgtgcacgcgcacgtgcgcacatgcacatgtgtgttgtgtatacagagagac

SEQ ID NO: 19315 - DNA, 78 bp, Homo sapiens
gccaccatttagcaaatatgtgatcctgggcaaagtatttattctctcagactcagtttctcatcagtaaaatggggc

SEQ ID NO: 19316 - DNA, 78 bp, Homo sapiens; identical to SEQ ID NO: 19315

SEQ ID NO: 19317 - DNA, 58 bp, Homo sapiens; identical to SEQ ID NO: 9719

SEQ ID NO: 19318 - DNA, 70 bp, Homo sapiens
gacccctagatagcgcctctgtctctctcaccctttggctgcagacagggtgagttttgtcatgggagtc

SEQ ID NO: 19319 - DNA, 116 bp, Homo sapiens
tcatgaatgctcatttttagcttgtacataaatatgtatatactcatatataaacgtatatttatatataaacatgtatatattgagacaatgtcttgctctgttgagcaggctgg

SEQ ID NO: 19320 - DNA, 94 bp, Homo sapiens
tcctcaccaacatttgctatcactctttttaattataagcattcttttgggtgtgaaattgaatctgtgattttaatttgcattttcctgagga

SEQ ID NO: 19321 - DNA, 58 bp, Homo sapiens; identical to SEQ ID NO: 2758

SEQ ID NO: 19322 - DNA, 115 bp, Homo sapiens
ctgttcagaatttttgcatctatattaatatgggacattaggctataggtttcttataatattttggtttaattttcgtatgagtaatagtggccttgtagaatgagctgggaag

SEQ ID NO: 19323 - DNA, 85 bp, Homo sapiens
ccagtaacatgttttaagtggagtgaattagatcttctgacaggggaaggggattgaactcttcagtctgaaataccagtactgg

SEQ ID NO: 19324 - DNA, 95 bp, Homo sapiens; identical to SEQ ID NO: 68

SEQ ID NO: 19325 - DNA, 93 bp, Homo sapiens; identical to SEQ ID NO: 69

SEQ ID NO: 19326 - DNA, 106 bp, Homo sapiens
tgcagatgaagcttacagatagcagggttcagacagagcagattataaatttttttaaacagacttaagatctgtgttgatgttaacactggatggcttttcctca

SEQ ID NO: 19327 - DNA, 75 bp, Homo sapiens
tgtcagtgacaggagagtctgagctggatgttgggcatactccactggtatatgggttcttcctgccacttgata

SEQ ID NO: 19328 - DNA, 70 bp, Homo sapiens
tatatgtatttatatctgtatgtatgtgtatttatatctgtatgtatgtgtatttgtatagatgtgtatg

SEQ ID NO: 19329 - DNA, 65 bp, Homo sapiens
tgtggactctatgcctgatacatcatacctgcaaacaggcttgctgaggtagtaggttggtccca

SEQ ID NO: 19330 - DNA, 82 bp, Homo sapiens
gattctcctgtctcagctgggattacaggcacacgctatcacacccagctaatttttgtatttttagtagagacagggtttc

SEQ ID NO: 19331 - DNA, 96 bp, Homo sapiens
tttcaggaattagaccacagaggctataaaatgtcaatggatatattttctataacacattgtatataattttgtttcctaatattaatcttgaaa

SEQ ID NO: 19332 - DNA, 82 bp, Homo sapiens
taaatctcttagaagcatcgtaggttagacttgagagtctctctatgtctggggcactgacaagatgtagtttctagatttg

SEQ ID NO: 19333 - DNA, 103 bp, Homo sapiens
gtatgttaattttgtatcctgacactttactgaatttgtttatcagttcttaacagcttttggtggagtctttaggggttttgtaaatataagattatgttgc

SEQ ID NO: 19334 - DNA, 83 bp, Homo sapiens
agacatgttctacttattaccttatttcagagtatatatgtttttcaaacataactagtaaggtggtaaccgagactatgttt

SEQ ID NO: 19335 - DNA, 76 bp, Homo sapiens
catagtttagagacacatgaatataggagatgaatatatatatatatgctttccatgtatattcatgtgagctatg

SEQ ID NO: 19336 - DNA, 95 bp, Homo sapiens; identical to SEQ ID NO: 68

SEQ ID NO: 19337 - DNA, 93 bp, Homo sapiens; identical to SEQ ID NO: 69

SEQ ID NO: 19338 - DNA, 95 bp, Homo sapiens; identical to SEQ ID NO: 68

SEQ ID NO: 19339 - DNA, 93 bp, Homo sapiens; identical to SEQ ID NO: 69

SEQ ID NO: 19340 - DNA, 95 bp, Homo sapiens; identical to SEQ ID NO: 68

SEQ ID NO: 19341 - DNA, 93 bp, Homo sapiens; identical to SEQ ID NO: 69

SEQ ID NO: 19342 - DNA, 98 bp, Homo sapiens
ggattctatctcataagacaggacaaggaaggtttgctcattattgttttttgtttttttaaagaccgagtcttggtctgtcacccagactggagtgc

SEQ ID NO: 19343 - DNA, 95 bp, Homo sapiens; identical to SEQ ID NO: 580

SEQ ID NO: 19344 - DNA, 93 bp, Homo sapiens; identical to SEQ ID NO: 69

SEQ ID NO: 19345 - DNA, 109 bp, Homo sapiens
agatggtatctcattgtggttttgatttgcatttctctaatgatcagtgatgttgaactttttttatatgattgttggccatgtgtatgtcttcttttgagaagtgtct

SEQ ID NO: 19346 - DNA, 69 bp, Homo sapiens
atatatatctatatatatatctgatggttttgcatatatgtatccatatatatatatatgtgtgtatat

SEQ ID NO: 19347 - DNA, 82 bp, Homo sapiens
cggagccctagtaacagggacaggtctgtgctgtgtgacactgtctcacacattgcaggatgtttactagctgtggcctctg

SEQ ID NO: 19348 - DNA, 85 bp, Homo sapiens
ccagatacagttctaagcactttataagagttaattcattttattttcatgagaactctatgaagaaaggactgttattatcttg

SEQ ID NO: 19349 - DNA, 58 bp, Homo sapiens
tgagacagggtctcactctgtcacccagggtagggtgcagtggtgcgatctcagctca

SEQ ID NO: 19350 - DNA, 74 bp, Homo sapiens
ggcctgagccaccgcgcccagacttgtttttgttttgttttgttgagatggagtctcactctgtcgctcaggct

SEQ ID NO: 19351 - DNA, 115 bp, Homo sapiens
ggaaattagttgggtcatatttgtttttttgataccagactatcatattttttttttcagagagaaaaaatgaatttcatattaagtcagaaaagactgaatgcaattgttttct

SEQ ID NO: 19352 - DNA, 121 bp, Homo sapiens
ctgggccacacagcttacaagtggagaacttaggtgtgagctcaggtctgtgtgagtctagagactgagctcccaactcctggcagtgctgctccacctttaccagctccagagtgtgccc

SEQ ID NO: 19353 - DNA, 116 bp, Homo sapiens
tgggctcaagtaatcctcctgtgttggcctcccaatgtgctgggatgacaggtgtcagtcaccacaccctgccacacatattggttttcatacacagttcctggctcataactccc

SEQ ID NO: 19354 - DNA, 86 bp, Homo sapiens
actctgtttcaaggtcttggtcagttttagagtaattagcctcaaaaattaggttttggattttttttttttttttgagacggagt

SEQ ID NO: 19355 - DNA, 130 bp, Homo sapiens
atatagtgtgtatatgcatatatgtatatatgtgtatatatacatgtatatatacatatatgtttatatatgtatatatcaaatgtatatatatcaaatgtttatatacatatatacatatatatgtata

SEQ ID NO: 19356 - DNA, 147 bp, Homo sapiens
gcctgggtgatagagtgggaccctgtctcactcaagaactttaaaactggattagttttgtctatttttattttttatctttatttttgagagatggggtctcgctctgtcacccaggctggagtgcagcagcgtgacctcagctca

SEQ ID NO: 19357 - DNA, 82 bp, Homo sapiens
atatatctggtttagatggatcaacagagttattacttttccctgtgttactcagtctgtcctattctaatcctagatttat

SEQ ID NO: 19358 - DNA, 77 bp, Homo sapiens
aagaagaaacagagtttgggagtgtcctatgagtctgttactcataagaatagcgtccctttctctctctctctctt

SEQ ID NO: 19359 - DNA, 103 bp, Homo sapiens
ccagccaagccactcctgctttctgactctgaaaatatgtgagatcataaatgtatcttttttttttttttgagacagagtctcgctctgttgcccaggctgg

SEQ ID NO: 19360 - DNA, 61 bp, Homo sapiens
tgaggttccaggtgtcagtggaagatgccaagttgtgctctccctctgccccagatcctca

SEQ ID NO: 19361 - DNA, 110 bp, Homo sapiens
tttgctgagttgtaggagtttcttatatattttggatattaaccacttatcagatacatggttggtaagtattttctcccattatgtaggttacctttgcaccctgttga

SEQ ID NO: 19362 - DNA, 131 bp, Homo sapiens
tacacgcatatatatatacacacacatatacatgcatatatacacacgtgtatatatgtgtgtatatatatgtgtatatatatgtgtgtgtgtatatatatatatatatgcgtgtatatatatatatatgt

SEQ ID NO: 19363 - DNA, 74 bp, Homo sapiens
ttgttttgtttttgagacagtctccctctgtcaccccggctggagtgcagtggagtgatctcagctcactgcaa

SEQ ID NO: 19364 - DNA, 111 bp, Homo sapiens
aggggaaagagagatcatcctaggctggggtaatcaagggaggcttaaggaagtaggtagtatttaacctgtggctttcctgctagttaaggagacatgctgaattcttct

SEQ ID NO: 19365 - DNA, 110 bp, Homo sapiens
tgtctcttcttggctgtttgactttgggcttgttactcagcctctctctgtgacaaagttgcctacctcagaggtttgcgagcttggtgtgggataaccaacataaggtg

SEQ ID NO: 19366 - DNA, 76 bp, Homo sapiens
gtgggtgactgactcagtggctgtgagtggggatgctggtacctcccataaaaacagagacagggtgggcaagaac

SEQ ID NO: 19367 - DNA, 58 bp, Homo sapiens
gcatgtatataaatgtgtgtatatctatatatatagatacgcacatacatatatatgt

SEQ ID NO: 19368 - DNA, 95 bp, Homo sapiens; identical to SEQ ID NO: 68

SEQ ID NO: 19369 - DNA, 93 bp, Homo sapiens; identical to SEQ ID NO: 69

SEQ ID NO: 19370 - DNA, 115 bp, Homo sapiens
gtcagattatggatgtccttgaatgtaaggctgaggagtttggactttattttttaaatagtaggaactcattaaaaaggtttttagatggtagggaaaaccccatgtaaaagac

SEQ ID NO: 19371 - DNA, 100 bp, Homo sapiens
gttttgatttgcatctctatgatgatcagtaatgtcaagcagcttttcatatgcctgtttgccatttgtatgtcttcttttgagaaatgtctattcgaat

SEQ ID NO: 19372 - DNA, 96 bp, Homo sapiens
catctgttatacaaagttaaaatttatcaaaacatataaacacagaacatgcatagcataatttgtggttgagaaatgtaaacaagtgtaaagatg

SEQ ID NO: 19373 - DNA, 118 bp, Homo sapiens
ttgtgatgttgacttaagatctaatgagatggtggagtctctgtctgcctgagtccctgagtgactaggatacttagagcctcctaaccaatctgctttgggtgtgtcgtatgaataa

SEQ ID NO: 19374 - DNA, 93 bp, Homo sapiens
ggaccatatttcaacatgagatttggaggagacacacacatccaaactatattagtgtctcattttatttatttatttattgagatggagtct

SEQ ID NO: 19375 - DNA, 109 bp, Homo sapiens
gtgtcctgtccagtcagcagttctaagactctatttcttgattttttttattttttgtttttcagagacagggtcttgctctgtcacccagtctggagtgcagtggcat

SEQ ID NO: 19376 - DNA, 95 bp, Homo sapiens; identical to SEQ ID NO: 68

SEQ ID NO: 19377 - DNA, 93 bp, Homo sapiens; identical to SEQ ID NO: 69

SEQ ID NO: 19378 - DNA, 73 bp, Homo sapiens
tggcagttttggagctcagtttctgaagtgtttttttttttttttttttttgagacagagtttccctctgtca

SEQ ID NO: 19379 - DNA, 115 bp, Homo sapiens
ttaagagtgggtagatgggagataaaattttgagactttcagtgtcactctcacacttgattgatattttacctgggctcttggattagtattctcttaggccttgtgcatttga

SEQ ID NO: 19380 - DNA, 149 bp, Homo sapiens
tgtgtgtatatatatatgtgtgtgtgtatatatatacatacatatgtatatatatacacacacacatatatatatacacacatatatatatgtatatatatatacacacatatatatatgtatatatatatatatatatatatatatat

SEQ ID NO: 19381 - DNA, 158 bp, Homo sapiens
atatatatatatatatatatatatatatacatatatatatgtgtgtatatatatatacatatatatatgtgtgtatatatatatgtgtgtgtgtatatatatacatatgtatgtatatatatacacacacacatatatatatacacacatatattgtg

SEQ ID NO: 19382 - DNA, 79 bp, Homo sapiens
tttggtatatagtatggctgctgatttgtgtacattaatgttgtacacaaatgttttagtttcctgaaactttgctgaa

SEQ ID NO: 19383 - DNA, 82 bp, Homo sapiens
gcatttttatatagtagcagctttagattactcttatcagttgtagtattcttcatcaagctgtctactttgtgccatgtgc

SEQ ID NO: 19384 - DNA, 116 bp, Homo sapiens
actgggggactggcaggactatggaaatgcttttcttcccacctaagggatttgattaaaagtatttgatatcccattatttgattccagggcagtattttaaaaatttacctaag

SEQ ID NO: 19385 - DNA, 94 bp, Homo sapiens
ctttggtttgggaggtcagcaatgtgagagactcctttttaaaattttttttttattttgagacaagagtctcactctgtcacccaggctgaag

SEQ ID NO: 19386 - DNA, 87 bp, Homo sapiens
ctgtagatattctcattggaggcaggcctgtgccggggaggggcatttatttctactcccaggcactgtctgcctgagtggaagcag

SEQ ID NO: 19387 - DNA, 68 bp, Homo sapiens
cctcagtctctctgtgtgactcagaactgctggctgtcagagcaggaaggacctcagagagactctgg

SEQ ID NO: 19388 - DNA, 113 bp, Homo sapiens
accattaaacaacaatgcaggacacatggtgtgatagaagattgaggttttaaaattttattatttttttgagacagagtctcgctctgtcacccaggctggagtgcagtggt

SEQ ID NO: 19389 - DNA, 116 bp, Homo sapiens
tcggggagtatttacaagccaattttttctttttaccctgtctgtctcactgcttgtccaacttttccaaaattaggtgaggccactggggtgagagggatagagtgaagctcaga

SEQ ID NO: 19390 - DNA, 116 bp, Homo sapiens
ggaaattagggaaatgctttagtgggagtgcttctgtgtgcggggaggtgtaagtgcaacatgaactgaatctcactccacccagtacaggatgtgcccggagagcatgctgagct

SEQ ID NO: 19391 - DNA, 93 bp, Homo sapiens
agatgagaaacaagcctctgttttcacagccaccttatatgttgaccagatgagatgggcggtggtcccctgattgtaattgtttcagcattt

SEQ ID NO: 19392 - DNA, 59 bp, Homo sapiens
tatgtatgtgtgtgtgtgtgtgtatatatatatatatatatatatatatacatatgtat

SEQ ID NO: 19393 - DNA, 119 bp, Homo sapiens
tatgtattcgtgtatatatattcgtatatattcgtttatatattcgtatatatattcgtatatattcatatatatattcgtatataatatatatattcatatatgtatattcatatata

SEQ ID NO: 19394 - DNA, 85 bp, Homo sapiens
cgtatgtatattcatgtatattcgtatgtatattcatatgtatattcgtatatatgtatattcatatgtatattcatatatgtat

SEQ ID NO: 19395 - DNA, 88 bp, Homo sapiens
tatatatgtgaatctatatgtgaatatatatatgaatatatatgtgaatatatatgaatatatatgtgaatatatatgaatatatatg

SEQ ID NO: 19396 - DNA, 82 bp, Homo sapiens
gtgtgtgtgtgtgtgtgtgtgtgtgtgttttaatgcagggaaggctgctctataaacatgacaaatgtatggcatcattcat

SEQ ID NO: 19397 - DNA, 66 bp, Homo sapiens
atagatatatctgtgggttttttgttttgttttttttataaaaagcctccagtgggatatatctat

SEQ ID NO: 19398 - DNA, 84 bp, Homo sapiens
aggctggagtacagtggtatgatctcagccgtgaacactgcagcctctgcctccagggttcaagttattcctgtgcctcagctt

SEQ ID NO: 19399 - DNA, 58 bp, Homo sapiens
tgcggtgtcactctgtcacacgggctggagtgcagtggtgcgatctcagttcactgca

SEQ ID NO: 19400 - DNA, 90 bp, Homo sapiens
aatacagtggtactttgttttatgaatattttataaacggatacttaatagattatctaagtgtaagactgtgagtgatcccgctgtgtt

SEQ ID NO: 19401 - DNA, 76 bp, Homo sapiens
gtttgtttgttttgagacagagtctcactgtctcccaggctggagtgcagtgctgcgatctcagctcactgcaaac

SEQ ID NO: 19402 - DNA, 76 bp, Homo sapiens
ggaggctgaggttggaggatcatttgagcctgagagattgaggctttggtgaactgcgattgtgccactgcactcc

SEQ ID NO: 19403 - DNA, 121 bp, Homo sapiens
atacatgtgtgtacatgtgtgtatgtatatatgtgtgtacatgtatgtacagatatgtatatttgtatatgttgtacatatgtttgtgtgtgggcatatgtgtaatatgtgtacctgtgtg

SEQ ID NO: 19404 - DNA, 82 bp, Homo sapiens
gttgagttggagtctcactctgtcacccagactggagtgcagtggggcgatctcagctcactgtagcctctgcctcctgggt

SEQ ID NO: 19405 - DNA, 188 bp, Homo sapiens
gcgtatatatatatgtgtgtgtgtgtatatatatataatatgtgtgtatatatatatgtgtgtatatatgtatatatatacacacatatacatatacacacatacgtatatgtatatatgtacatatacgtatatatacatatatgtatatatgtacatatacgtatatatacatatatgtatatatg

SEQ ID NO: 19406 - DNA, 119 bp, Homo sapiens
tatatgtacatatatacatatacgtatgtgtgtatatgtatatgtgtgtatatatatacatatatacacacatatatatatacacacatattatatatatatacacacacacacatata

SEQ ID NO: 19407 - DNA, 102 bp, Homo sapiens
ctcatggtggaaggtgaagggaaagcaagagccttcttcatgtgctggcaggagagagaagagtgagtggaggaacttgccaaacacttataaaaccatgag

SEQ ID NO: 19408 - DNA, 61 bp, Homo sapiens
ctgagacaaccaattatattagaagcaagttaggtacttgcttctttggtaatgttaacag

SEQ ID NO: 19409 - DNA, 83 bp, Homo sapiens
caaagtgataggattacaggtgtgagccaccatggccagcctgtaatctccttttcttttcttttttttttttttttcctttg

SEQ ID NO: 19410 - DNA, 68 bp, Homo sapiens
cactctgaggctctctctcactgcccaggtgggcatgaggtctctgtgttcccagagccttgactgtg

SEQ ID NO: 19411 - DNA, 95 bp, Homo sapiens; identical to SEQ ID NO: 68

SEQ ID NO: 19412 - DNA, 93 bp, Homo sapiens; identical to SEQ ID NO: 69

SEQ ID NO: 19413 - DNA, 90 bp, Homo sapiens
gatcctgatttaattgatctggagatgggctcaaacatttatgtttttagaaatctctctagatgatttttttttttttgagacagagtc

SEQ ID NO: 19414 - DNA, 109 bp, Homo sapiens
agtattgggattacaggcatgagctgctgcacctggcttattattattattattattattattattattattattatttgagacagtatctcactctgtcaccctggct

SEQ ID NO: 19415 - DNA, 116 bp, Homo sapiens
gattgttgtcatgattaaatgagttgacacaggttaagcacatttcatttaatttttatttttaaaggagttgaggtcttgttctgtggcccaggctgaagtagagtggcgcgatc

SEQ ID NO: 19416 - DNA, 91 bp, Homo sapiens
tgtgttcatgtggtcttctctctgtgtgtgtctgtgccaattttcctcttcttatagagacacccttattggattaagacctaccctcaca

SEQ ID NO: 19417 - DNA, 107 bp, Homo sapiens
atgtatatatgtgtgtatatgtatatatatacgtgtatatatacgtgtatatatatacacacgtgtatatatatatatgtatgtatgtatatatataaaaatcacat

SEQ ID NO: 19418 - DNA, 116 bp, Homo sapiens
gtagcatatgtacttcattcctttaagtggctagataatattctgttgtatgaatataacattttattttacttttatttatttatttcttttgagatggagtttcactctgttac

SEQ ID NO: 19419 - DNA, 79 bp, Homo sapiens
aggctgaggtaggaggatggattgagcccagaagattgaggttacattgagctgagattgcatcactgcacttcagcct

SEQ ID NO: 19420 - DNA, 75 bp, Homo sapiens
cagcctgtagctgttcaagagcaccagacttttttttttttttttgagacagagtcttgctctgtcaccaggctg

SEQ ID NO: 19421 - DNA, 75 bp, Homo sapiens
tgccttttgtttgagacagtgtctcactctgtccccccaggttggagtgcggtagcacgatctcagctcactgca

SEQ ID NO: 19422 - DNA, 58 bp, Homo sapiens; identical to SEQ ID NO: 6359

SEQ ID NO: 19423 - DNA, 102 bp, Homo sapiens
gattgagaggttggatggttgctgtgtttgtgtggaaagaggtagacatgggagacttctcattttgttctgtactaagaaaaattattctgccttgggatc

SEQ ID NO: 19424 - DNA, 100 bp, Homo sapiens
ggtggtgtatgcctgtaatcccagtgactcaagaggttgaggtggaaggatggcttgagcctaagagtttgagtctgcagtgagctatgatcacaccact

SEQ ID NO: 19425 - DNA, 114 bp, Homo sapiens
tatatatatatatatatatataacatatatatataaaacatatatatgttatatgtggatacatatatatgtatttatatgtgtgtgtgtatatatacttatttatttattttg

SEQ ID NO: 19426 - DNA, 58 bp, Homo sapiens; identical to SEQ ID NO: 7432

SEQ ID NO: 19427 - DNA, 88 bp, Homo sapiens
ccttagtctggtttttatagtgcaactaagtttcttttttttctaagagacagggtcttgctctttcaccctagccggagtgcaatgg

SEQ ID NO: 19428 - DNA, 112 bp, Homo sapiens
gcactcttggtcttttgggagcaatgaagttcgctgtgaggaagccaactctgaagaaactgagcagtggttagaatcatatgcattttgtacatcttggagataatcttgt

SEQ ID NO: 19429 - DNA, 87 bp, Homo sapiens
cactcaatcagttcttaggggaaagtgagagataattttttttttgtttttgagacaaggtctcactctgttgcccaggctggagtg

SEQ ID NO: 19430 - DNA, 79 bp, Homo sapiens
ccatgctcctttacttcagggccgatgcagcccatggactctgctgtgtgtgtgtctgtgtgtgaggctctgtgcatgg

SEQ ID NO: 19431 - DNA, 148 bp, Homo sapiens
cagggccaagagaaaggcaaaaatagttgtaacttttttaagattgagtttttgagtagtttttttattgtttttgtttttttttttttttgagccggagtcttgctctgtcactcaggctggagtgcaggggcatgatctcagctca

SEQ ID NO: 19432 - DNA, 95 bp, Homo sapiens
caaagcattcactctcattgcatttatgtatgtatatattgagtagttctttgctttgcatcatgaatgatactgcagtggagatgaacactatg

SEQ ID NO: 19433 - DNA, 117 bp, Homo sapiens
gcttccagggaggcctcaggaaacttataatcatggtggaaggagaaggggaaataggcatatcttttttttttttttttttttttttgagacggagtctcgctctgtctcccaggc

SEQ ID NO: 19434 - DNA, 58 bp, Homo sapiens
tgagacagggtctcactctgtcacccaggctggagtgcagtcgtgcgatctctgctca

SEQ ID NO: 19435 - DNA, 126 bp, Homo sapiens
tgtttatatagataaacatgtatatgtttatatagataaacatgtatatgtttatatagataaacatgtatatgtttatatagataaacatgtatatgtttagatagataaacatgtatatgttta

SEQ ID NO: 19436 - DNA, 111 bp, Homo sapiens
taaacatactgtttatctatctaaacatatacatgtttatctatctaaacatatacatgtttatctatataaacatatacatgtttatctatataaacatatacatgttta

SEQ ID NO: 19437 - DNA, 91 bp, Homo sapiens
atgtgtatgtatatttatctaaacatatacatgtgtatgtatatttatcaaacatatacatgtgtatgtatatttatctaaacatatacat

SEQ ID NO: 19438 - DNA, 74 bp, Homo sapiens
tatataaacatatacatgtgcatgtatatttatctatataaacatatacatgtgcatgtatatttatctatata

SEQ ID NO: 19439 - DNA, 74 bp, Homo sapiens; identical to SEQ ID NO: 19438

SEQ ID NO: 19440 - DNA, 74 bp, Homo sapiens; identical to SEQ ID NO: 19438

SEQ ID NO: 19441 - DNA, 74 bp, Homo sapiens; identical to SEQ ID NO: 19438

SEQ ID NO: 19442 - DNA, 74 bp, Homo sapiens; identical to SEQ ID NO: 19438

SEQ ID NO: 19443 - DNA, 74 bp, Homo sapiens; identical to SEQ ID NO: 19438

SEQ ID NO: 19444 - DNA, 116 bp, Homo sapiens
atatacatgcacatgtatatgtttatatagatatacatgcacatgtatatgtttatatagataaatatacatgcacatgtatatgtttatataaatatgcacatgtatatgtttat

SEQ ID NO: 19445 - DNA, 72 bp, Homo sapiens
ttatataaacatatacatgtgcatgtatatttatctatataaacatatacatgtgcatgtatatctatataa

SEQ ID NO: 19446 - DNA, 88 bp, Homo sapiens
ctggcccagaatttatttttatacatgatatgagttaggaatctaatttcatatctttctatatggataatcaattgttttgtaccag

SEQ ID NO: 19447 - DNA, 58 bp, Homo sapiens; identical to SEQ ID NO: 2263

SEQ ID NO: 19448 - DNA, 113 bp, Homo sapiens
ttttcactaagcttagctgtggcccatttatagcagcataaaaattgaaaggcttttttaaaatttttattttagcataggagaaatgccaccatttaagccatttttgaaaa

SEQ ID NO: 19449 - DNA, 99 bp, Homo sapiens
ccacagtcctgcttattccgtatgacagttatgtagtcattttcttcaaatgaagtaaaaatcctcaggtcaataatcatatgaggccaggcattgtgg

SEQ ID NO: 19450 - DNA, 95 bp, Homo sapiens
gctttttcaaaccatttcattagtcataatttttagttaatttacctggatttcctgcttagattagctacattaatgaagttgactggaattgc

SEQ ID NO: 19451 - DNA, 112 bp, Homo sapiens
cagctgtgcgcgggagcgactggctcaagcagctgagacagaagagacagcgtaagagagctgctgatgaaagagctgctaatgagacagctgctgatgagagcgcccgctg

SEQ ID NO: 19452 - DNA, 117 bp, Homo sapiens
ggcatatttcttagcatttgcatcttttgaaatgacaaaattttgtttctgcttttttttttttttaagagtttaaagttgttacttttgaaaatgccatcttgttttagctgtgct

SEQ ID NO: 19453 - DNA, 110 bp, Homo sapiens
cacagtgctcattctctgtttctagcattattgcttcattatttcattaaaaagtattagagatgtacagtaatgatcaataaatatagttaccattaatgctgactgtg

SEQ ID NO: 19454 - DNA, 108 bp, Homo sapiens
ggattgacttggctatatgcgctcctttttggttccatatgaaatttaaagtagttttttctaattctgtgaagtcaatggtagcttgatggggatagcattgaatct

SEQ ID NO: 19455 - DNA, 117 bp, Homo sapiens
ttgccctaaaagatagtgttgttaaggcatattcacagatggatcattatatgattataatactgatttatttatttagcaaatgcctacataatactgtgcattgaacactggtaa

SEQ ID NO: 19456 - DNA, 101 bp, Homo sapiens
tctgatctccgtttcctcacctatagagtggagatgataaaactatattttattgattctaagatgcacagtttttcaattttaatctcttggaaatcaga

SEQ ID NO: 19457 - DNA, 136 bp, Homo sapiens
ataggttttatatatatatgtatatgtataaaatatatatgtatatgtatatgtacatgtatatgcatatgtatatatgtgtatatatgtatacatatatacgtatatatacacgtatatatacgtgtatatatac

SEQ ID NO: 19458 - DNA, 72 bp, Homo sapiens
tgtgtgtgtatatatatgtgtgtatgtgtatatatatacatacacacatatatacatatatatacacacaca

SEQ ID NO: 19459 - DNA, 83 bp, Homo sapiens
tggctactttttttttttttttttttgagacggtgtctcgctctgtcgcccaggctggagtgcagtggcgcaatctcgggtca

SEQ ID NO: 19460 - DNA, 119 bp, Homo sapiens
tacacataatgtagaagaattaagcttgatatgccaaaaaaatcttaaaattattttttactataatctgattttgtggttggtacattttatattacagatcttttactttcagtgta

SEQ ID NO: 19461 - DNA, 64 bp, Homo sapiens
ctccactctgcctgtctgtgtggatgctaacagaaattaaaattcctgggcaaggatagtggag

SEQ ID NO: 19462 - DNA, 62 bp, Homo sapiens
gcttcaggagtgtgactttctttctttttttttttttttgagatggagtctcactctgtcgc

SEQ ID NO: 19463 - DNA, 59 bp, Homo sapiens
catatatatatatatatatatatatatgatcatatgtatatatgtatgtgatatatatg

SEQ ID NO: 19464 - DNA, 200 bp, Homo sapiens
tatgtatatatacatatatagtatatatacatacatgtatatagtatatatgtatatatgtactatatatatacatatataaaatatacactatatatattgtgtgtatatatgtgtatattgtatgtgtatatatatatcatatcatgataggcactggcattttagtgcctatcatgaacttcaggcttttgtatcca

SEQ ID NO: 19465 - DNA, 58 bp, Homo sapiens
tgagactgagtctcgctctgtcactcaggctggggtacagtggtgctatctcagctca

SEQ ID NO: 19466 - DNA, 111 bp, Homo sapiens
tgctgaggattgtcttggctatgagggctctttttttggttccatatgaaatttaaagtagttttttctaagtctgtgaagaaagtcactggtagcttgatgggaatagca

SEQ ID NO: 19467 - DNA, 103 bp, Homo sapiens
ggttaagtgaaacaaatatggcaaaatcttggtaattgttgattccaatttataggtatgtgaaggttaattgtactatttttgcatatatttgaaattttcc

SEQ ID NO: 19468 - DNA, 73 bp, Homo sapiens
attggagcatcacatctggagaccatgactgcagtgcacttgtgtctctgtcagcatgtgagttgtttgcaat

SEQ ID NO: 19469 - DNA, 95 bp, Homo sapiens; identical to SEQ ID NO: 68

SEQ ID NO: 19470 - DNA, 93 bp, Homo sapiens; identical to SEQ ID NO: 69

SEQ ID NO: 19471 - DNA, 101 bp, Homo sapiens
atatatagtgatgaaagaagacttatggactgttaattcaagatttattatttcttactttgaaggttttgtttgtttagtcagtttttttcatggtgtat

SEQ ID NO: 19472 - DNA, 95 bp, Homo sapiens; identical to SEQ ID NO: 68

SEQ ID NO: 19473 - DNA, 93 bp, Homo sapiens; identical to SEQ ID NO: 69

SEQ ID NO: 19474 - DNA, 117 bp, Homo sapiens
tgggtaaggaaagggggaaggaatatggcctcatttttatatttcaagcttctcagagccaggtttgatgtgattctttggctgaaaaagatgcctatgttcccaaatccccactca

SEQ ID NO: 19475 - DNA, 71 bp, Homo sapiens
tgcatttagtatataagtacatctatgtacgtgtgtttatacatatatatatgtatatgtggctatatgca

SEQ ID NO: 19476 - DNA, 112 bp, Homo sapiens
gaaggggggatacaaaaatataggaccatgtgaatactgaatgtttgattatattaatgaattgatgtttggggagtttacagaatgtactgtatttacatgtaacaatttt

SEQ ID NO: 19477 - DNA, 95 bp, Homo sapiens; identical to SEQ ID NO: 68

SEQ ID NO: 19478 - DNA, 93 bp, Homo sapiens; identical to SEQ ID NO: 69

SEQ ID NO: 19479 - DNA, 119 bp, Homo sapiens
tttgttagagcagcacaaatggactaagatagcacttcattgtgttctatgattctttttgaattttagatgtgatttgctatgttgttcagaatttttgcatccatgttcctgagaga

SEQ ID NO: 19480 - DNA, 124 bp, Homo sapiens
tggtcatccatctgcagtatatctagagaacctgggagggtccctggatgggcatgactgaaggatgtcagcacagatcactttatagaagggccccctcttactagggtctaagacagtactg

SEQ ID NO: 19481 - DNA, 105 bp, Homo sapiens
attcacacattcaactagttacctagattcactgtttgaatgtttaagagacatgtcaataatttattgtgtattatcaaatagctagaagaatggattttgaat

SEQ ID NO: 19482 - DNA, 113 bp, Homo sapiens
gcttttttgaatgaagtttctagaaacatttacagacaagtttttatgagaacatgtttttatttcttttgagtaactatctctgagtggaattgctgggtcgtgtggtaagc

SEQ ID NO: 19483 - DNA, 95 bp, Homo sapiens; identical to SEQ ID NO: 68

SEQ ID NO: 19484 - DNA, 93 bp, Homo sapiens; identical to SEQ ID NO: 69

SEQ ID NO: 19485 - DNA, 73 bp, Homo sapiens
ttgtttttttgagatggagtctctctcagtcacccaggctggggtgcaatgacatgatttcagctcactgcaa

SEQ ID NO: 19486 - DNA, 120 bp, Homo sapiens
gagttcaagactagactggacaacatagtgagatcccatctttacaaaaaataatataaataattttttaagttagccaggcatagtggctcacacctgtagtcccagttgctcaagaat

SEQ ID NO: 19487 - DNA, 119 bp, Homo sapiens
gggagtgtggagttatgtaattaggccagaaagataagcagtgttttaattttttttgttttttgaattccgtttttagtccttcattggtttattagctataactctttgttattttt

SEQ ID NO: 19488 - DNA, 110 bp, Homo sapiens
tgtttatatgtatatatgcatatatagatacatatgtgtgtatataagtatattatatataatatacacactcatatagatacatatacccctatatatacatatacaca

SEQ ID NO: 19489 - DNA, 77 bp, Homo sapiens
tctggatattttgtatttctgatgtttcactgggcagtcttgtaccttggccaaagtggaatatttatgcaggcaga

SEQ ID NO: 19490 - DNA, 81 bp, Homo sapiens
gactgttgggcacactgactcatgcctgtaatccagtgctttgggagactgaggtaggaggttcttgtgagcctaagtgtc

SEQ ID NO: 19491 - DNA, 91 bp, Homo sapiens
caccaagattgatatggaattttataggatactacatcttaatcaacttagatgctggtgttatatatttttttatttttttaacttgctg

SEQ ID NO: 19492 - DNA, 162 bp, Homo sapiens
tatatatatatacacgtatacatacatatatatgtatgtatacgtatatattatatatgtatatgcatatatgtatgtatatgtacatattatatatacgtatacatatgtatacatatatgtatatacgtatgtatacgtatatataatatatatatatat

SEQ ID NO: 19493 - DNA, 76 bp, Homo sapiens
tatatctgtatctatatatatatacacacatacacacatatgtatgtttatgtgtatatgtatatatacacatatg

SEQ ID NO: 19494 - DNA, 82 bp, Homo sapiens
tcatttatttattgagtcggggtctcactctgtcacacagcccgaagtggagtggcaagatcatggctcactgcagccttga

SEQ ID NO: 19495 - DNA, 58 bp, Homo sapiens; identical to SEQ ID NO: 285

SEQ ID NO: 19496 - DNA, 95 bp, Homo sapiens; identical to SEQ ID NO: 68

SEQ ID NO: 19497 - DNA, 93 bp, Homo sapiens; identical to SEQ ID NO: 69

SEQ ID NO: 19498 - DNA, 72 bp, Homo sapiens
gcttttgaaagggaggtttgaaggtaacgtgaaggcacaaccacacgcactcagactctcctatttctttgc

SEQ ID NO: 19499 - DNA, 119 bp, Homo sapiens
ctctgtctctaggattcagcaaaaacactcagattgaataaaacaactgtggatcatttttatatgtgttttatttttattctgaagatctgagaatttgttcaaattgggtttgggga

SEQ ID NO: 19500 - DNA, 113 bp, Homo sapiens
tctgatggtttggagctagtttatattactcagcacaaatattgaaaataatgatttcagagtattttaaattttcatgtttctgtagtttatatagtgctaaatgtatctga

SEQ ID NO: 19501 - DNA, 95 bp, Homo sapiens; identical to SEQ ID NO: 68

SEQ ID NO: 19502 - DNA, 93 bp, Homo sapiens; identical to SEQ ID NO: 69

SEQ ID NO: 19503 - DNA, 90 bp, Homo sapiens
aagcatatattttatattgcaatattgcttggataagtgtattttcattgagtttatacttattctttgtatattgtttcagacttgctt

SEQ ID NO: 19504 - DNA, 114 bp, Homo sapiens
ggctttctggagagctgagctcaaaaaacccaagatgtgtatttgattttgtgacctagatgttaaaatctacactgctttactatatttgatctgagaatagcattctttgct

SEQ ID NO: 19505 - DNA, 86 bp, Homo sapiens
gagtcacatgaactaaaaggcattaaagtttttatttttctgacaaaatatttgacttaagtgcttttttttttttcttcggagtc

SEQ ID NO: 19506 - DNA, 83 bp, Homo sapiens
tggtcaataggcaatacatgatctagtaaatggagtcatatttatctggatggatttttatttttatgtagctctattgtcca

SEQ ID NO: 19507 - DNA, 78 bp, Homo sapiens
aggttctcatatttgtttctatattcaatctattgcaatatgttgttttggttgcaatataggaagaaaatgtagctt

SEQ ID NO: 19508 - DNA, 84 bp, Homo sapiens
gttctgggaaatgtgaggaatttactctgtgagttccagccacatgggacttcttgaagggtacttcattctttttttccatgc

SEQ ID NO: 19509 - DNA, 96 bp, Homo sapiens
aatgcatcgtttggaaataagcagacttagatattcaggagattttaatcattttatatgatatatcttaaattgaaatatttccaaatgagaatt

SEQ ID NO: 19510 - DNA, 93 bp, Homo sapiens
gggagatccttgctttttatatatttccaaagcattgccatcacatataaagtgagggctttagttttatattttaaaaagtgaaagttttcc

SEQ ID NO: 19511 - DNA, 113 bp, Homo sapiens
ttggaaatgactagatctcattcttttttatggctgaatagtactctgttgtgtgtatgtatcacattttctttatctgttcatctgtggatgaacatgtaggttgcttccaa

SEQ ID NO: 19512 - DNA, 88 bp, Homo sapiens
atgactcatgtattaaagtatgtatgtgtgtatatgcatgtgtacatatattataaagtatgcgtgtgcatatatacatacttaagta

SEQ ID NO: 19513 - DNA, 58 bp, Homo sapiens; identical to SEQ ID NO: 315

SEQ ID NO: 19514 - DNA, 111 bp, Homo sapiens
ttcatgtcctttgccaacatcttaatggggttatttgtctttttcttgttgagctgtttgagttccttgtagattggtgacattagccctttgttggatgcatattttgaa

SEQ ID NO: 19515 - DNA, 93 bp, Homo sapiens
tgtatatgtgaatgtatgtgtacatatatatgtgtacacatatacatgtatatgtgaatatatatgtgtgtgtgctataaggattttgtgcac

SEQ ID NO: 19516 - DNA, 63 bp, Homo sapiens
cctgagacagggtctcactttctcactcaggctggagtgcagtggcatgatcttgactcatgg

SEQ ID NO: 19517 - DNA, 136 bp, Homo sapiens
atatacatatacacacacatatatatatatacatatatacgtgtatatatgtatatatatgtatacatatatacacgtatatatatgtatacatatatatgtgtgtgtatatgtatatatatggtgtatatatata

SEQ ID NO: 19518 - DNA, 58 bp, Homo sapiens; identical to SEQ ID NO: 10913

SEQ ID NO: 19519 - DNA, 136 bp, Homo sapiens
tatatgtgtatatatgtgtgtatatatgtgtgtatatatgtgtatatatgtgtatataatgtgtatacatatatatgtgtatatatgtgtgtatatatgtatatgtgtgtatatatatgtgtatatatactcatta

SEQ ID NO: 19520 - DNA, 87 bp, Homo sapiens
agtgtgttcaggtagctgctttgtgaggacaacagggagacattgtcatttcagtcctgcctactagcttctgactctgaacgtgct

SEQ ID NO: 19521 - DNA, 115 bp, Homo sapiens
gaagtgttccctcttcaatgcaaccacgccaatatctactgtcttttgatttttttattatgggcattcttccaggagtaaggtagtattgcactgtggttttgatttgcatttt

SEQ ID NO: 19522 - DNA, 83 bp, Homo sapiens
tgaaatggagtctgtctctgtcacccaggctggagtgcagtggcgtgatctcggctcactgcaacctctgcctcccaggttca

SEQ ID NO: 19523 - DNA, 70 bp, Homo sapiens
ttgctttcaattttacaggctcataggcagatgggacttgccttgtctcagatgagactgttgactgtgg

SEQ ID NO: 19524 - DNA, 83 bp, Homo sapiens
agatggatgacagataaatggttgcattcttttgagtttctgattagcctttccaaaggaggcaattagttgtgcatctatct

SEQ ID NO: 19525 - DNA, 112 bp, Homo sapiens
atgttaaccacaaatcttatattctgtttttttgttgaaatttatccaagttttaaactttatttgtataaatttttgactgagatattaatgtgggagtctgccttaatat

SEQ ID NO: 19526 - DNA, 95 bp, Homo sapiens; identical to SEQ ID NO: 68

SEQ ID NO: 19527 - DNA, 93 bp, Homo sapiens; identical to SEQ ID NO: 69

SEQ ID NO: 19528 - DNA, 104 bp, Homo sapiens
ttctcacttctaactatttatctatctaatatatgcgtgtatgtatacatatatatttatacatatatgtgtgtatatatagagagagagtgtaaaagcgggag

SEQ ID NO: 19529 - DNA, 114 bp, Homo sapiens
ctttgaatcatggactcatatattcaattctgtttgggacacagcattatagcattatataaatgtctttagtttgtgtactgaaacctgtagaacatcaatccatcttcgcag

SEQ ID NO: 19530 - DNA, 82 bp, Homo sapiens
gaatgtgtattctgtggttgttggatgaaatgttctgcatatatctgttaagtccatttgttccaacgtatagtttaaattc

SEQ ID NO: 19531 - DNA, 78 bp, Homo sapiens
tgggtggacttgctgggtagctagacccagaagagagacaacaatcactgcagtttggctcacaggaaatcacatcca

SEQ ID NO: 19532 - DNA, 80 bp, Homo sapiens
atagttacatatacatgtacacaagcatatatattacatatatatgtacatatatgtttatatatatgtacacaaactgt

SEQ ID NO: 19533 - DNA, 105 bp, Homo sapiens
agagtttattcttctttgcatcctcaccagcatgttatttttttgtttatttatttttataatagccattataactagggtgagatgacatctgatttagatttt

SEQ ID NO: 19534 - DNA, 137 bp, Homo sapiens
acatatatatatatacacacatatatatacacatatatatacacatatatatgtatatatgtgtatatatatgtgtatatatgtatatgtatatatgtatatgtatatgtgtatatatatgtatatgtatatatatg

SEQ ID NO: 19535 - DNA, 118 bp, Homo sapiens
tctgggatcatctggataaagccatacttttatagttttatttataaaactataaaaccatatatatattttatttataaaactataaaagttcatggtatttcagatatttgcttga

SEQ ID NO: 19536 - DNA, 95 bp, Homo sapiens; identical to SEQ ID NO: 68

SEQ ID NO: 19537 - DNA, 93 bp, Homo sapiens; identical to SEQ ID NO: 69

SEQ ID NO: 19538 - DNA, 95 bp, Homo sapiens; identical to SEQ ID NO: 68

SEQ ID NO: 19539 - DNA, 93 bp, Homo sapiens; identical to SEQ ID NO: 69

SEQ ID NO: 19540 - DNA, 76 bp, Homo sapiens
agtgaacactgtctcgtgtgggtattattgagtacaaaaatttgtatatatatattttttgagacagagtctcgct

SEQ ID NO: 19541 - DNA, 107 bp, Homo sapiens
tgtggactcccttccgtgagcaacagtgactaacagtgatggacacaaggcgtgtcttagtctgtcagtgttactacaaagaaacacttgagcctgggtaatttata

SEQ ID NO: 19542 - DNA, 116 bp, Homo sapiens
tgcatttatggtgatgtatggatcatgctggcattggtattttaatggttctcattttcattatttgaacttttataaaacatgatcatgatcacaatattcaaattatgaaagta

SEQ ID NO: 19543 - DNA, 116 bp, Homo sapiens
ttttggagaatgattttttcataaaaaagatttcaggagatcctttagttgtatatatttacattataaatgcttataacaatgtcccagagaggttatgtggcatgccttcaaag

SEQ ID NO: 19544 - DNA, 109 bp, Homo sapiens
ttacataaattatagttatccttacaataaaataacatgtatctttttttaaaaaaggagaaagtatatgttgtgatatggagagtttttggcataatctattaagtga

SEQ ID NO: 19545 - DNA, 87 bp, Homo sapiens
ggaatatagtatagacaagattgtttcaatttttaataagcctagcagaaatatactatgacattttcttgttttctactaaattcc

SEQ ID NO: 19546 - DNA, 88 bp, Homo sapiens
gtatctatcatctctgtgtgtgtgtatatatatatatacacacatatatgtatatatgtatatatacatgcaaagattgatatattgc

SEQ ID NO: 19547 - DNA, 97 bp, Homo sapiens
tatatgtatatgtatagacctgatgtacatatgtatatgtgtaatctaatgtatatatgtatatgtatattacctgatgtatatatgtatacgtata

SEQ ID NO: 19548 - DNA, 56 bp, Homo sapiens
atatatatatacacacacatatatatacatatatatatgtgtgtgtatatctatat

SEQ ID NO: 19549 - DNA, 78 bp, Homo sapiens
gtatgtgcatgtgtgtgtgtatatatatatatattcctcacattatatatttatatatatattcctcacagtatatat

SEQ ID NO: 19550 - DNA, 164 bp, Homo sapiens
tgtatatactatatatatactgtatatatatactgtgaggtatatatatatataggaacatatatatatatataggaacatatatatatataggaacatatatatatatatataggaatatatatatatatatatatatatatatatatatatatatattctcc

SEQ ID NO: 19551 - DNA, 95 bp, Homo sapiens; identical to SEQ ID NO: 68

SEQ ID NO: 19552 - DNA, 93 bp, Homo sapiens; identical to SEQ ID NO: 69

SEQ ID NO: 19553 - DNA, 67 bp, Homo sapiens
atgtataaaattactctgactaaaatttttttcattaataaaactcaatcagagtaattttgtacat

SEQ ID NO: 19554 - DNA, 103 bp, Homo sapiens
gctagaagttgtcatattgagaaaatttaagaaaactttaattttcctttaatttaaaatttttaacttaaagttttctttaattttctcatccaattgtagt

SEQ ID NO: 19555 - DNA, 104 bp, Homo sapiens
agagattgcttgaaactgaagacacagaggatagggagcgggtggaagacttttcactatatttattattatattttgtgacttctgaactaggagtaattact

SEQ ID NO: 19556 - DNA, 121 bp, Homo sapiens
ttcagttcagggcaccaccactacagaacacccattctgtcaggcattgtgccagctgctgagagagtgcacagtgaggaataagaagctgactgttctcaaggagttcatgcctggtggg

SEQ ID NO: 19557 - DNA, 107 bp, Homo sapiens
cagatgattgtttgtattttatagcaagacagtattttaaaattaaagtatatacattattttttagacatactgctattgcacacttaacatactacagtatgctg

SEQ ID NO: 19558 - DNA, 120 bp, Homo sapiens
ctggttagggtaacatttagagttgaaagctgatttatctttggaactatgaaatttatttattttatggttgattgatgtattttgatctgcctttcatatggaattctttacttggat

SEQ ID NO: 19559 - DNA, 61 bp, Homo sapiens
atatagatagtgtatatatgtgtgtatatatatatacacatacacacacatatatctgtat

SEQ ID NO: 19560 - DNA, 58 bp, Homo sapiens; identical to SEQ ID NO: 47

SEQ ID NO: 19561 - DNA, 119 bp, Homo sapiens
tgggggctgggctctcagaatggcaccatgctgcagctgcctaggattcagggtgtgtgggacctggcatgagtgccttctctggagcaatgctgtcatgtggtctccagacagatcct

SEQ ID NO: 19562 - DNA, 58 bp, Homo sapiens; identical to SEQ ID NO: 2626

SEQ ID NO: 19563 - DNA, 95 bp, Homo sapiens; identical to SEQ ID NO: 68

SEQ ID NO: 19564 - DNA, 93 bp, Homo sapiens; identical to SEQ ID NO: 69

SEQ ID NO: 19565 - DNA, 77 bp, Homo sapiens
tttttgtatgatatatgtgtgtgtgtgtgtgtgtgtgtgtgtgcgcgcgcgcgtgtatgtgtgtgtgtgtagaaaga

SEQ ID NO: 19566 - DNA, 77 bp, Homo sapiens
ctttggccaactgatgaatgggatatgtgtatatgggtgggtatgtgtgctgtgctgtgtcagtgtgtgtgttgagg

SEQ ID NO: 19567 - DNA, 105 bp, Homo sapiens
cctagtacagagcagctctccacatagatcaacaaattttattttttcatcacgtaagtgttcaataaactttgtgtcctccttaacatgatgctgttctggtgg

SEQ ID NO: 19568 - DNA, 80 bp, Homo sapiens
tctgagacttctattttagtatgaatatttgtataatgttatcacattgcaaagctcaactctagtgtagcaagttcaga

SEQ ID NO: 19569 - DNA, 75 bp, Homo sapiens
ttgttttgttttgagattgagtctcactctgtcgcccaggctggagtgcagtggcccgatctcagctcgctgcaa

SEQ ID NO: 19570 - DNA, 73 bp, Homo sapiens
tttggtttggtttggttttggggagggttattttttgtttgagatggagtctcactctgtcacccaggctgga

SEQ ID NO: 19571 - DNA, 58 bp, Homo sapiens; identical to SEQ ID NO: 1673

SEQ ID NO: 19572 - DNA, 110 bp, Homo sapiens
tgcttaggattgtcttggctatttggactcttttttggttccatatgaaatttaaagtagttttttctaattctgtgaggaatgtcaatcatggcttgatggggatagca

SEQ ID NO: 19573 - DNA, 78 bp, Homo sapiens
cctaggcaacacagggagaccccatctctacaaatattattattatttttgagacagagtctcactctgtcacccagg

SEQ ID NO: 19574 - DNA, 115 bp, Homo sapiens
tcagcctcccaagtagctggcattacaggtgcgtgccaccacgtccagctaatttttgtatttttcatggagatggggtttcaccatgttggccaggctggtctcgaactcctga

SEQ ID NO: 19575 - DNA, 79 bp, Homo sapiens
ctgagtgacaaatgccaatcccaaaaggttacatactatttgattccattttgaggcaggttatcattctgtcacccag

SEQ ID NO: 19576 - DNA, 79 bp, Homo sapiens
gtgcagatggactctgaacacagaatgcacacagtagacccgagagcaccttgtgttcattctgtttcacatcccgtat

SEQ ID NO: 19577 - DNA, 86 bp, Homo sapiens
agttgtgcagattccctcagtgttctgggtgaggtaagaggcagccttcttggcaacatctcaaaaggatagggaagctgaatgct

SEQ ID NO: 19578 - DNA, 92 bp, Homo sapiens
gatgggattttcttcataggtgactgtacacttatctttgatttctcccataggggaaagagagaacaaagtgagcattcagcttccctatc

SEQ ID NO: 19579 - DNA, 86 bp, Homo sapiens
tttaattgacagtatgaatgtatatatatgtgtgtgtgtgtgtgtatatatatatatatataacatctcactgtttttcttttaaa

SEQ ID NO: 19580 - DNA, 91 bp, Homo sapiens
ggaggtccttggctggtacagcatagctggactgtcagacactgacagactgaaaagctacaaatctgcaatgaaccaacaatagggctcc

SEQ ID NO: 19581 - DNA, 88 bp, Homo sapiens
gtcgcatgacctctctgagctgtacctatttaatttttaattgttgtgggtatatagtaggtgtatagatttatggagtacatgagat

SEQ ID NO: 19582 - DNA, 116 bp, Homo sapiens
tggcattaagtattaagagacctggtttggggtacagcagatgtgttttgtctttttctaaatgtgatgttgagaaaatcaccggtcctttctgcaccctgtctctttattgttag

SEQ ID NO: 19583 - DNA, 65 bp, Homo sapiens
agcagcaggcagaactgtggagaggggcctttcacagtcccagtctcacacttcactctagctct

SEQ ID NO: 19584 - DNA, 78 bp, Homo sapiens
ctggcgggaggcattggtaatgattttttctttttcttttttttttgagacagagtctcactctgtcacccaggctgg

SEQ ID NO: 19585 - DNA, 87 bp, Homo sapiens
ttgcacaagaacccccctctccttcccccagagagagagagacagagaaggacagagagagaaagagagggagagatacttgtgcag

SEQ ID NO: 19586 - DNA, 95 bp, Homo sapiens; identical to SEQ ID NO: 68

SEQ ID NO: 19587 - DNA, 93 bp, Homo sapiens; identical to SEQ ID NO: 69

SEQ ID NO: 19588 - DNA, 89 bp, Homo sapiens
gctcctgacctgagggttgcaaagatctatgagagaagcatggttttttggggttgctcactcatactcactgcatccctggtgggggc

SEQ ID NO: 19589 - DNA, 83 bp, Homo sapiens
aggtcattggtgactttgccaacgcattgttcactggccaaatatagttgtacaagctgttgactgaacaaagacaccaacct

SEQ ID NO: 19590 - DNA, 107 bp, Homo sapiens
gcaaatgtgggtgtaggacagttatgaaattacctgtagcctctttttttttttttttttttttttttaggcttaatgtgttttcatagtaaacttacaggaacagc

SEQ ID NO: 19591 - DNA, 58 bp, Homo sapiens; identical to SEQ ID NO: 2221

SEQ ID NO: 19592 - DNA, 95 bp, Homo sapiens; identical to SEQ ID NO: 68

SEQ ID NO: 19593 - DNA, 93 bp, Homo sapiens; identical to SEQ ID NO: 69

SEQ ID NO: 19594 - DNA, 106 bp, Homo sapiens
cctgtgtgggaagcgagttgttatctttggttatctagctgtatgagtgtattggtcttcataaagctagataaccgaaagtaaaaactccttcaagatcgccggg

SEQ ID NO: 19595 - DNA, 105 bp, Homo sapiens
ggcgatcttgaaggagtttttactttcggttatctagctttatgaagaccaatacactcatacagctagataaccaaagataacaactcgcttcccacacaggcc

SEQ ID NO: 19596 - DNA, 73 bp, Homo sapiens
gtcttgctttctgaagttctgtgtgaggaggaaagcaagggttgtacactgaacttagtaaggagggcaaagc

SEQ ID NO: 19597 - DNA, 88 bp, Homo sapiens
aataaatgtagtgatatatggacattaaatgcatatatgtatatatatacacacatatatgtagtatgtatatgtagcagcctttatt

SEQ ID NO: 19598 - DNA, 118 bp, Homo sapiens
gtggattctggattctgagaagtttttgactctgatatgaccaaatgttttgaatagaattttctttaacgtaattatgtgttttcatgcagtctgcaatcccagagctggaagagac

SEQ ID NO: 19599 - DNA, 116 bp, Homo sapiens
gtggcaggaatggcagtttgcagactgattattttgattatttgaatttattattattattattattatactttttaagttttagagtacatgtgcacaatgtgcaggtttgttac

SEQ ID NO: 19600 - DNA, 112 bp, Homo sapiens
gcatgtgtgtgtaaatatgtgtgttatacatgaaactgtgcatatatatagatatacatatattatatatagattatatgtacatacatacatacacacaacctctccctgc

SEQ ID NO: 19601 - DNA, 75 bp, Homo sapiens
gttgttgtttgagacagtctcactctgtcatccaggctggagtgcagtggtgcgatcttggctcactacaacctc

SEQ ID NO: 19602 - DNA, 84 bp, Homo sapiens
tagattcaagacagtctgctgacgtggcagtcctgatcctctcattacactcataactgaacttcaagggaactcctgagtctg

SEQ ID NO: 19603 - DNA, 102 bp, Homo sapiens
tggtttatgggactgaatgatttgcatgatacattccatattctaagaatattttattcttgaaattgatatctataagtcagtaggcttccaaaaaatcca

SEQ ID NO: 19604 - DNA, 115 bp, Homo sapiens
aaatatttggctatatttctgggttctccattcagttccattggcctactgtttatttttatattagtaccatgctgttttggtaactacgaccttgtagtatagtttgaagttt

SEQ ID NO: 19605 - DNA, 95 bp, Homo sapiens
gtatatgtataaacatccatgtatacatttataaattatgcatataaatatatgcataaatatatatttatgtatgcatatgtgtatacataggc

SEQ ID NO: 19606 - DNA, 103 bp, Homo sapiens
aaaccattagaattcatttagagtgtgcatgagttgagattttctgcactcagaatctagggctctctcatctagttatttgagaagtgattattgttggttt

SEQ ID NO: 19607 - DNA, 116 bp, Homo sapiens
taagtatctgagccagagatagagaagttggtggggtatgactatatatcagagttaagtctctctctctgatctatctttctagctaactgtatctgtgcctctccgatctctta

SEQ ID NO: 19608 - DNA, 94 bp, Homo sapiens
tatgtatacatatatgtatatatacacatacatatatatactatatatgtatatatgtatatgtatatgtatatatatgtatttaactaacata

SEQ ID NO: 19609 - DNA, 105 bp, Homo sapiens
agaaaaaaatctggcaactttctgatctcccctcctcctgagtatttcattatgtttatgagactacttctgcagtatgggtaaagcgggtgtagaatagtttct

SEQ ID NO: 19610 - DNA, 95 bp, Homo sapiens
ggaatgtgctgagtctcacctgaagccatcaagtctcactgactcacccaatgcccttgatgtagtagccgggtgatatggtttggctgtgttcc

SEQ ID NO: 19611 - DNA, 88 bp, Homo sapiens
ttattccattgtggtcagacaagatgcttgatattatttcaatttcttttgaatgtttcaggacttgttttgtgtcctaatgatatgg

SEQ ID NO: 19612 - DNA, 79 bp, Homo sapiens; identical to SEQ ID NO: 19430

SEQ ID NO: 19613 - DNA, 90 bp, Homo sapiens
agaacaagttcttgctgattttttttaaatcataatttttctattcctgatagagaaagcaagaaaaagaaggagttagctttttgtttt

SEQ ID NO: 19614 - DNA, 116 bp, Homo sapiens
gcatcatgataagcaaaattgttcagacagttgagtcaggttaagatgaataatattatgtcattaatttatattatcaaccttttaatttcatgaagtaagttgacaaatgatgc

SEQ ID NO: 19615 - DNA, 113 bp, Homo sapiens
tattatggccattcttataggagtgagatggtatcatattgtggttgtgatttgcatttccctgataattagtgatgttgaacatttttccatatgcttgttggccatttgtg

SEQ ID NO: 19616 - DNA, 114 bp, Homo sapiens
tggattttcttggctatatggtctcatttttggttccatatgaaatttaaagtagttttttctaattctgcgaagagagtcaatggtagcttgatgggaatagcattgaatcta

SEQ ID NO: 19617 - DNA, 62 bp, Homo sapiens
gctattgctctgtgcctcacttctgctccaggtgatgctaaggttggtgagccagggttggt

SEQ ID NO: 19618 - DNA, 119 bp, Homo sapiens
agtgtaaaagtgttcccttttcaccatatccacaccaacatctattattttttgattttttaattatggtcaatgttgcaggagtaaggtggtattgcattgtggttttgatttgcatt

SEQ ID NO: 19619 - DNA, 75 bp, Homo sapiens
gagagtgagtgtgtgcatgaggaactgtcaaacacttatcaaaccatcagatctcatgagaacacactcactatc

SEQ ID NO: 19620 - DNA, 67 bp, Homo sapiens
acagaatctctgtctctctgttctgagccacctagagctgggggtggagtgacatgagcccctctgt

SEQ ID NO: 19621 - DNA, 101 bp, Homo sapiens
ggaaaaacaagaaaagttaattcagagaactgtgtgggcagaggagagttctgctactgattcatacttgagtttttcaaaaaagacaattttgatgttct

SEQ ID NO: 19622 - DNA, 123 bp, Homo sapiens
tatatgatggaatgtgtatatatgtatatatgcgcatatatatacatatatacacattccctcatatatatgcacatatatatacatataatgtgtatatatgtatatacatgtgtatatata

SEQ ID NO: 19623 - DNA, 84 bp, Homo sapiens
acatatatgtttatatctgtatacatatatatgtgtgtgtgtgtgtatatatatatctgtatacatatatatgtatatgtatat

SEQ ID NO: 19624 - DNA, 102 bp, Homo sapiens
cagtctcaagactagataagacttgataatccagtctcaagactagataagacttgagaatcttaagttttttttttttctgagactgattctcactctgtc

SEQ ID NO: 19625 - DNA, 100 bp, Homo sapiens
gagccaggcattatgctaagagtgaaacagtatagagtgagcaatgtagtctagaactcaggcatccttacttttagtacagtgcaatttgtgttggttt

SEQ ID NO: 19626 - DNA, 112 bp, Homo sapiens
tgaagccattctttttccacctcggtgacccagtgactttcttttttttttttttttttttttttgagagagagtctcgctctgtcgcccaggctggagtgcagtggctgcg

SEQ ID NO: 19627 - DNA, 93 bp, Homo sapiens; identical to SEQ ID NO: 69

SEQ ID NO: 19628 - DNA, 92 bp, Homo sapiens
tcaccctatttgtctgtcctagtgtctagtgatttagttctttacagtagcccttaagtctctgtttcctaaagcacacaggtggtaagtga

SEQ ID NO: 19629 - DNA, 70 bp, Homo sapiens
ttgttttgagatggagtctcactctgtcacccaggctggagtgcagtagtgcgatctcagctcactgcaa

SEQ ID NO: 19630 - DNA, 95 bp, Homo sapiens; identical to SEQ ID NO: 68

SEQ ID NO: 19631 - DNA, 93 bp, Homo sapiens; identical to SEQ ID NO: 69

SEQ ID NO: 19632 - DNA, 76 bp, Homo sapiens
caattattatcctgttttgtaacttctatttattttaaataaaactggggcgggggttcagaaaagggtaagattg

SEQ ID NO: 19633 - DNA, 94 bp, Homo sapiens
gagctggttgattaaattcagcatctcatctcataaaatggggtttaaaaatgtatctattttatacaggtgggactagggattaaatgagttc

SEQ ID NO: 19634 - DNA, 117 bp, Homo sapiens
gatcatggtggattggctttttgatgtgctgttgaatatggtttgtaagtattttattgaggatttttgcatcgatgtttatcaaggatactgtgctgaagtttttcttttgttgtt

SEQ ID NO: 19635 - DNA, 60 bp, Homo sapiens; identical to SEQ ID NO: 11153

SEQ ID NO: 19636 - DNA, 95 bp, Homo sapiens
cagtgacgatgttatcttagctgtcttttttttttttgacagggtctcgctctgtcaccctgtctgaagtgcagtggtgtaatttcggctcactg

SEQ ID NO: 19637 - DNA, 114 bp, Homo sapiens
aagctatgggaattatgagccaggaactgtggattaaaatcaatatatgtatatattatatcacaagtataattgcatgtccttttctgaaatctattatttttcctagagttt

SEQ ID NO: 19638 - DNA, 88 bp, Homo sapiens
ggctgatgagcttagctgttgatagaagttagtgaccaatctcccatcaacttccccaagcagctcataagagataagtcactaagtc

SEQ ID NO: 19639 - DNA, 58 bp, Homo sapiens
tgagacagagtctcactctgtcacccaggctggagtgcagtggcgtgattttggctca

SEQ ID NO: 19640 - DNA, 67 bp, Homo sapiens
gtagtcccagctacttgggaggctgaggtgggaggatggtttgagcctgtgagatggtggaggttgc

SEQ ID NO: 19641 - DNA, 113 bp, Homo sapiens
ataacatcagtgccttatagttcattgatagccatagtctggattttactttatttttctttaaagtgtctgactggaatggataatatatatttatcttaggcatatgttgt

SEQ ID NO: 19642 - DNA, 114 bp, Homo sapiens
cctgagtttatatatatatgtatatacatatatatgtgtatatatatatgtgtgtgtgtgtgtgtatatatatgtgtgtgtgtatatatatataattatactttaatttctagg

SEQ ID NO: 19643 - DNA, 107 bp, Homo sapiens
aagatgtagccagctgcattgttggaaagacgatgtcttcgtttatttatttttttttagatggagtctcgctctgtcgccaggctagagtgcagtggcacaatctt

SEQ ID NO: 19644 - DNA, 82 bp, Homo sapiens
gtccagtttgttttatgatttttgtttactaaagagaaagaaaaagagctctctatactttctggacagaaacatcctggac

SEQ ID NO: 19645 - DNA, 85 bp, Homo sapiens
ccacagaaccgcccagacttctgacactctcaggacccctgcctgtttagttaacagaggattttggtgatatttctgttattgg

SEQ ID NO: 19646 - DNA, 95 bp, Homo sapiens; identical to SEQ ID NO: 68

SEQ ID NO: 19647 - DNA, 93 bp, Homo sapiens; identical to SEQ ID NO: 69

SEQ ID NO: 19648 - DNA, 95 bp, Homo sapiens; identical to SEQ ID NO: 68

SEQ ID NO: 19649 - DNA, 93 bp, Homo sapiens; identical to SEQ ID NO: 69

SEQ ID NO: 19650 - DNA, 116 bp, Homo sapiens
gggatattgaactactgggtgctagctttgttcttaagtataagttccagaaagttttatttactttttgaactctttactaggatgaaagtatcacagtgcttttttggtctgcc

SEQ ID NO: 19651 - DNA, 66 bp, Homo sapiens
gcacacacatacatacatacacattatacacacactcatgtgtgtctctgtgtgtattttctgtgc

SEQ ID NO: 19652 - DNA, 94 bp, Homo sapiens
gctgggtgaaatagtaggtctgttttacgccccttgaaaaatctccacactggttttcacagtggctgaactaatttacgttcccaccaacagt

SEQ ID NO: 19653 - DNA, 92 bp, Homo sapiens
atatacatatatgtatatctgcatgtgcatgtgtgtatatatgtacatatatgtatagacatagatacacatgtatacatatatacatatat

SEQ ID NO: 19654 - DNA, 237 bp, Homo sapiens
tatgtatatgtgtatatatacatatatacgtatacatacatatgtatatatacatatatacatacatatatacacgtatatatacatatatacatacatatatacacgtatatatacatatatacatatatacatacatatatacatatatacatacatatatacacgtatatatatacatatatatgtatatatatgtatatatatacgtgtatatatgtatgtgtatatatatgt

SEQ ID NO: 19655 - DNA, 94 bp, Homo sapiens
atatatatacacatacatatatacacgtatatatatacatatatatacatatatatgtatatatatacgtgtatatatgtatgtatatatgtat

SEQ ID NO: 19656 - DNA, 150 bp, Homo sapiens
atatatacatatatatgtatatatgtgtgtgtatatatatacatatatatgtatatgtgtgtatatatatacatatatatgtatatgtgtgtatatgtatatatatacacatatacatatatacatatatacatacatatacatatgtat

SEQ ID NO: 19657 - DNA, 115 bp, Homo sapiens
ctgtattgatcctagtatgtagcagggctatattatgaaaggtgagttaacatgaatttttcttttaatgttaagaatggtgcccttcacattacaagctattccaaagttgcag

SEQ ID NO: 19658 - DNA, 110 bp, Homo sapiens
tcactgagtgatttaatccctctaccaggaaaaagcatgtacatttttttaataatatggaagctttgtacagagtagagttttccgtaggatgagctataaaccaatga

SEQ ID NO: 19659 - DNA, 60 bp, Homo sapiens
ttgagactgagtctcgctctgtcacccaggttggagtgcagcggcgagatctctgctcaa

SEQ ID NO: 19660 - DNA, 94 bp, Homo sapiens
ctgtgtgtatatctatgtatgtatgtatgtatctatctatctatcgatctatcgtagctctgtgtgtgtgtgtgtgcgtgtgtgtatgaaatag

SEQ ID NO: 19661 - DNA, 101 bp, Homo sapiens
tacatgtttctatagggtataatgtgttatgtattatatatttgatataaatcattataaatatgtttatgtacatatatgttatatatattcattatgta

SEQ ID NO: 19662 - DNA, 84 bp, Homo sapiens
tgtttgtttgtttgtttagaaatctaccagtaaaagggagctcacagattagagagtggtgggacataagcaaacatgttagca

SEQ ID NO: 19663 - DNA, 112 bp, Homo sapiens
tgtgagaacatggggcatatagcctgggtatagtagaaggcacagtgacattctctctctgtagttatcacagccttctccctgtgttctttgactgccaatgttccctgca

SEQ ID NO: 19664 - DNA, 92 bp, Homo sapiens
aatggttgaatagtttccatatatatatatagatatggaatatataatattccatatctatatatatatatatcacattttcttcattcatt

SEQ ID NO: 19665 - DNA, 75 bp, Homo sapiens
gaaaatgtgatatatatatatatagatatggaatattatatattccatatctatatatatatatggaaactattc

SEQ ID NO: 19666 - DNA, 86 bp, Homo sapiens
gttagtacagaccctattgtactgacatctctattgcaatcatcaggaacaatgagagacattagactgtggactttgaaactgac

SEQ ID NO: 19667 - DNA, 74 bp, Homo sapiens
ttcagaaaacacacatagaggcagcttctagcagaatgattcataagcaaggcctgtgtccctgtgtgtctggg

SEQ ID NO: 19668 - DNA, 95 bp, Homo sapiens; identical to SEQ ID NO: 580

SEQ ID NO: 19669 - DNA, 93 bp, Homo sapiens; identical to SEQ ID NO: 69

SEQ ID NO: 19670 - DNA, 93 bp, Homo sapiens
ggttttacctgatgcctgacaacctttctgtattgtcatatatatttatataacactgtaattaagagtatagggttgtggagctagcagacc

SEQ ID NO: 19671 - DNA, 77 bp, Homo sapiens
gatacatagatagatagataatagatagattttaatagatggatgcgcacatttgtgtctgtgtatatgtgtgtatc

SEQ ID NO: 19672 - DNA, 110 bp, Homo sapiens
acagaactattttaattattagttatatatatatatagttatatatatatataagttatatatatatataattatatataagcagcatggtaataggaaagggaacatgt

SEQ ID NO: 19673 - DNA, 63 bp, Homo sapiens
gagacagagtctctcactgtcacccgggctggagtctggagtgcagtgacacgatctcggctc

SEQ ID NO: 19674 - DNA, 101 bp, Homo sapiens
gctgtatatagtgtgtatttttttccatgtgtttttttggttttgttttttctaagacatgatcttgctctgaaaccaaggctagagtgcagtgggacagc

SEQ ID NO: 19675 - DNA, 58 bp, Homo sapiens
tgagacggagtctcacactgtcacccaggctggagtgcagtggtgagatttcgactca

SEQ ID NO: 19676 - DNA, 113 bp, Homo sapiens
ccctagcattggtttaaaggtacattacagtatatagatggtttcgatattttgttcctttttttattaaatattgtgtctgttattccttgtggttatcagtaaacataggg

SEQ ID NO: 19677 - DNA, 107 bp, Homo sapiens
ctatgggaaatttgtattctcccaaatatgtggacagttaatggccagataaatattcacaatcacactgtctgtaaaatggggtaagactagtatcatctcattgg

SEQ ID NO: 19678 - DNA, 117 bp, Homo sapiens
tagtatatatgtatatatagtgtataaatgtatacgctatatatagtgtatatatatgtatgtatatacactatatatagcgtatacttttatatacatatatatatatatatagtg

SEQ ID NO: 19679 - DNA, 95 bp, Homo sapiens; identical to SEQ ID NO: 68

SEQ ID NO: 19680 - DNA, 93 bp, Homo sapiens; identical to SEQ ID NO: 69

SEQ ID NO: 19681 - DNA, 109 bp, Homo sapiens
atacattccacagagacccttcatattctgagtatttatatatagattatctcattagatagaacaattcctttttaagtacacaggttggtagctgagggattatgta

SEQ ID NO: 19682 - DNA, 100 bp, Homo sapiens
gtagaaagagatttctatggcttatgatatagagtgacaccagtgataccactgagtgaaatcactgatgtcatgtttttctgtaaaatttaacttctac

SEQ ID NO: 19683 - DNA, 95 bp, Homo sapiens
tttgtgaaaatgtttataggcactaggtttttgaaatctaacattaagtgtgggtttcgattgctaagaagtatgtagactacattattcgcaaa

SEQ ID NO: 19684 - DNA, 67 bp, Homo sapiens
ggccacccatctgtctctgtcagggccaccaccaggccgcagagggacagtctggatctgatgggcc

SEQ ID NO: 19685 - DNA, 98 bp, Homo sapiens
atatatattatatatgcaatatatatattgtgtgtatatatatacacatatacatatgtgtgttcatatatatatatatgtatatatgcaaactatga

SEQ ID NO: 19686 - DNA, 105 bp, Homo sapiens
gatgtgcttagggaatttttcggtttagatttctatgtatatatgttgaatatatatgtctccacatatgaagaaatctaaacactaaagattcatatgtgtgtt

SEQ ID NO: 19687 - DNA, 58 bp, Homo sapiens
tgagacaggatctctctctgtcacccaggctggagtgcagtgacaggatcgtggctca

SEQ ID NO: 19688 - DNA, 88 bp, Homo sapiens
atgcctggccttcagttttctttttaagagcagctgttaatgtacttgtttttctatatttgaaaagagaattcagataggccaacat

SEQ ID NO: 19689 - DNA, 94 bp, Homo sapiens
agtgaaactctgtctcattcataaagaaataaatgggaatttaaaagtaattccttttttttttttttttttttttttgtgacggagttttact

SEQ ID NO: 19690 - DNA, 83 bp, Homo sapiens
ttgtgtatatgtatgcagtgtatatgtatacacatgtatttatttctatatatctgtatacatatagacacacatatacatga

SEQ ID NO: 19691 - DNA, 111 bp, Homo sapiens
aggcaatttaaaagttttaaacattattttttgttgttgagaagagtctcactctgtcccccaggctggaggctactggtttatgataaaatgttcactggatttctgtct

SEQ ID NO: 19692 - DNA, 116 bp, Homo sapiens
ttctagtatcttttccacttattaatctttgtgttactgttaatcatgtggttactatgtgtcaaacactgtgtcagatgatgggattcaatgaagaagtcaggcctgatctggaa

SEQ ID NO: 19693 - DNA, 112 bp, Homo sapiens
gccagggcatggtggtgcacacctgtagtcccagctgctcgggaggctgaggtaggaggatcacttgagcccaggagattgaaactgcagtgagccatgatcataccactgc

SEQ ID NO: 19694 - DNA, 82 bp, Homo sapiens
acatgagaacatgaacttgacttacagggtgaaaatggcttttctctccctcactctgtaagccaagttcatgttctcatgt

SEQ ID NO: 19695 - DNA, 85 bp, Homo sapiens
caagtgtgagacactgtgcttgttctatttatgtattcctaaatgattaggaaaaatagataattagtaactgttatctcaattg

SEQ ID NO: 19696 - DNA, 110 bp, Homo sapiens
cgacttcgattttaccagcacctttatatcttctggtggaagctctctttatttatataaaaagacctcccaagcagcagagcctaaagtcactgggacccttctgttga

SEQ ID NO: 19697 - DNA, 58 bp, Homo sapiens; identical to SEQ ID NO: 10482

SEQ ID NO: 19698 - DNA, 72 bp, Homo sapiens
ctgggcgaggtggcacatgcttatagtctcagctacttgggtggctgaggtaggaggatctcttgagcccag

SEQ ID NO: 19699 - DNA, 90 bp, Homo sapiens
gcgacagagcaagactctgtctcaaaaaaaaaatgtaggtatatatatatttttattttttatatttgagacagtgtctcactctgttgc

SEQ ID NO: 19700 - DNA, 84 bp, Homo sapiens
gatatgcatttacatatatatttatgtgtgtgtgcatatatgtatatatacacacacatatatatgtatataggtatgtaagtc

SEQ ID NO: 19701 - DNA, 69 bp, Homo sapiens
tgtggtggtgcattcctatacttccagctactcagggggctgaggtaggaggatcatttgagccctgca

SEQ ID NO: 19702 - DNA, 116 bp, Homo sapiens
aagggggtacataatatagctgtgtgtactgtgtttgcagtacattgtttaattgtgtcttaattaattttctattaaatgtaaactagtgtatgtcatgtgttatataccttctt

SEQ ID NO: 19703 - DNA, 78 bp, Homo sapiens
gtgtttcactggggacaatgttgttgatttcgagtatgtgttgacagttgtctggcaggagaaaccccagagtaacat

SEQ ID NO: 19704 - DNA, 107 bp, Homo sapiens
ctttgcaggtctcagtgcaaaattgaaatgtggatgttctttttcattattaagaatttcaagatggtgccagttgagctttacagcaagcatgaaactctgctaag

SEQ ID NO: 19705 - DNA, 115 bp, Homo sapiens
atatatatatacatacacacacgtatatatacatgtgcgtatatatacatgtatatatacagaatatatatatgtgtgtatatatacatgtatatatacagaatatatatatata

SEQ ID NO: 19706 - DNA, 116 bp, Homo sapiens
atttctatgaatgtgtatgtatgtgtatgtatgtatgtgtatgtatatacatatgtatatatatgtgtatatatacatatatacacacacacatataattgagatcacattatata

SEQ ID NO: 19707 - DNA, 60 bp, Homo sapiens
atatatgtgtgtaaatatatatatgtgtgtgtatatatatatatatatatatatatatat

SEQ ID NO: 19708 - DNA, 106 bp, Homo sapiens
ttggactctaaggacaagtctcaaacaggcactcatctttgccactcagtcactgttttagcatcttatgggatgtctctgcttccttgagtatgtatttatccag

SEQ ID NO: 19709 - DNA, 82 bp, Homo sapiens
agtttgcaggaattcatgtttgggtgagaagtgaagaaagtttatttttattacccaggtctgtgataatcctgttagtgct

SEQ ID NO: 19710 - DNA, 99 bp, Homo sapiens
catgttctctttccctttcctgttggccagaacacatgatgtgacagtcacacactgtggcagtgactcaggttcaaccatgcagatgaggacagcatg

SEQ ID NO: 19711 - DNA, 97 bp, Homo sapiens
ctgatgctgagccctagaaaactctttttgatgatctgaaggtctacctgattgggaaggatagattgttcacatgaagatgtgggcttgggagcag

SEQ ID NO: 19712 - DNA, 75 bp, Homo sapiens
atatatatgtgtgtatatatacatgtatgtatatagttgtgtgtatatgtatatgtatatatacagtgtatatat

SEQ ID NO: 19713 - DNA, 157 bp, Homo sapiens
cttaaggcaggctgacaggaggtgggtacagtgggggagataagacctgtgttgttttttgtttttttttttgagacaccgtctcactctgtcacccaggctggagtgcaatggcgtgatcttggctcactgcatcctccgcctcccgagatgaagt

SEQ ID NO: 19714 - DNA, 77 bp, Homo sapiens
ttttgtgctctcattggggatctgactgatcccaggtctccaaggcctgcgacagacagatgtgtgtgtgcataaga

SEQ ID NO: 19715 - DNA, 93 bp, Homo sapiens
ccttctccttgtcttctgtcagttttgtgaaatttctcgttaaacacatctattttttttttttaatttccagggcctgggggtgggagaagg

SEQ ID NO: 19716 - DNA, 66 bp, Homo sapiens
ggatgtatgcgtgtatgtatgtgtatatacggatgtatatatgtatatatgtgcatgtgtataacc

SEQ ID NO: 19717 - DNA, 93 bp, Homo sapiens
gctagaaatagctagggttctactggggagaggatttaattgggaatatgctcttggaacttctgaatttgaagaagtgtggttgttgaaagc

SEQ ID NO: 19718 - DNA, 88 bp, Homo sapiens
ctggcagccactcccagagcccctggaactctggcccaaggctctctgactgactccttcccagatttactcggcttagcggctgaag

SEQ ID NO: 19719 - DNA, 112 bp, Homo sapiens
ttcgcttaggataatggcctccagctgcaaccatgttgtttcaaaggatatgatttcattctttttatatggctgcacagtagtccatggagcttaccatcttgaactagaa

SEQ ID NO: 19720 - DNA, 90 bp, Homo sapiens
ccagatacagagtgacattacacaatattttttaaaatttattattattattattttagagatagcatattactctgtcactcaggctgg

SEQ ID NO: 19721 - DNA, 95 bp, Homo sapiens; identical to SEQ ID NO: 68

SEQ ID NO: 19722 - DNA, 93 bp, Homo sapiens; identical to SEQ ID NO: 69

SEQ ID NO: 19723 - DNA, 86 bp, Homo sapiens
tgtatgtgtgtgtgtgtgtgcatatatatatatatttacacatatatatgcacacacatatatatgcacacacacatatatttaca

SEQ ID NO: 19724 - DNA, 102 bp, Homo sapiens
ccaagtagtttccaattcaaataaaatcaggtctgtgttattaacggtaatgatgatgatgatgatgtatgtgtgaggggtgggtgtgatgctgctgattgg

SEQ ID NO: 19725 - DNA, 95 bp, Homo sapiens; identical to SEQ ID NO: 68

SEQ ID NO: 19726 - DNA, 93 bp, Homo sapiens; identical to SEQ ID NO: 69

SEQ ID NO: 19727 - DNA, 63 bp, Homo sapiens
aggacagctggagctgagggctttagtggaggtattctctgtctctgtcagccctgctgtcct

SEQ ID NO: 19728 - DNA, 105 bp, Homo sapiens
gtgatttttgtatgttgcttttgtgacctgctactttactcaatttgtttattagttctaacagttttttagtggagttttagggttttctacatataagatcat

SEQ ID NO: 19729 - DNA, 100 bp, Homo sapiens
tgtacctgtatatgtgtgtgtatatgtatatgtgtgtgtgtatgtatacacatatatatatatatacacatatatatatacacacacatatacatataca

SEQ ID NO: 19730 - DNA, 73 bp, Homo sapiens; identical to SEQ ID NO: 15185

SEQ ID NO: 19731 - DNA, 58 bp, Homo sapiens; identical to SEQ ID NO: 1215

SEQ ID NO: 19732 - DNA, 120 bp, Homo sapiens
ggccccagtgtgtggtgttccccaccctgtgtccaagtgttctcgtatttttttttttttttttttgagatggagtctcgctctgtcaccaggctggaatgcagtggcacgatctcggct

SEQ ID NO: 19733 - DNA, 143 bp, Homo sapiens
tatatgtatatatatacactgtatatatatgtgtagatatatatatacagtgtatatatatatactgtatatatatgtgtgtagatatatatacacagtgtatatatatatatatatatacttactatgtgtgtgtatatgtg

SEQ ID NO: 19734 - DNA, 93 bp, Homo sapiens
cacattatataacacacagaatgtagcaaatatttatatacattaaaatgtgtgtgtatagtatataaatatgtgtgttcttgtgtgtatata

SEQ ID NO: 19735 - DNA, 114 bp, Homo sapiens
gagccattttctacaaggactatgtcttctttggctttgtataaagttgctaataatctttatttgttaatctgaatgacatactctgcttactctttgtatatttttgtgctt

SEQ ID NO: 19736 - DNA, 112 bp, Homo sapiens
taaatttctccaggggtcagagagaagtatagagtagatattttaaatagccagctggtgttctgaatctggcctacagttatattttgtttggcctgcatggtgtttttta

SEQ ID NO: 19737 - DNA, 105 bp, Homo sapiens
tatgtgtatatatatatatgtacatgtgtatatatgtatatatatatgtacaggtgtatatatgtatatatatacatacgtacatatgtgtgtatatatatatat

SEQ ID NO: 19738 - DNA, 84 bp, Homo sapiens
gacataggtatagttccagtatgttactacagcacctacaaaacagtactgtgttagcacactgatatggtttggatctgtgtc

SEQ ID NO: 19739 - DNA, 95 bp, Homo sapiens; identical to SEQ ID NO: 68

SEQ ID NO: 19740 - DNA, 93 bp, Homo sapiens; identical to SEQ ID NO: 69

SEQ ID NO: 19741 - DNA, 120 bp, Homo sapiens
ggtgttcaaagtccccagggggctgaagtggcatggtgttggtgtgtcagtgagaggtgacagcgtgctggcagccctcccctgctcccgacgtctcctcggcctctgtgcccactctgg

SEQ ID NO: 19742 - DNA, 112 bp, Homo sapiens
accttttcccagccttcaagagaatggagtttgaggtgttggagcagaatttccttggagacagtagagggagtgctcccaaatttcccaccccattgtggtgctagaggtt

SEQ ID NO: 19743 - DNA, 105 bp, Homo sapiens
cttctctgttggtgtcatcatcttcagtcagtggagactgtgcagaacccctgggattagggactgaaagagccaatgtcagaatagagagtgggacagagtaag

SEQ ID NO: 19744 - DNA, 63 bp, Homo sapiens
gcccttcagggagcctagacctaggagctccctgagcctggtctgtgactctctctttggggc

SEQ ID NO: 19745 - DNA, 95 bp, Homo sapiens; identical to SEQ ID NO: 580

SEQ ID NO: 19746 - DNA, 93 bp, Homo sapiens; identical to SEQ ID NO: 69

SEQ ID NO: 19747 - DNA, 94 bp, Homo sapiens
cagcgcttgctctactatgcttttctaatcctggactgctttgattgtttatatttcttgtctggtctttgggagcatgtgtttgcaacctctg

SEQ ID NO: 19748 - DNA, 95 bp, Homo sapiens; identical to SEQ ID NO: 68

SEQ ID NO: 19749 - DNA, 93 bp, Homo sapiens; identical to SEQ ID NO: 69

SEQ ID NO: 19750 - DNA, 88 bp, Homo sapiens
gagagcataagaatagacttccccagatgccataaaggttatttttacttttagaacctctggggactgatgctatagttaggttttc

SEQ ID NO: 19751 - DNA, 109 bp, Homo sapiens
tattggtgtgaatatatttgtatgtgatacaaagagagaagtgtctgagcattcaggtagagaaatatgctaatctctgtgattacatatttgttgtatttcttgagta

SEQ ID NO: 19752 - DNA, 121 bp, Homo sapiens
catatgtatatgtatatataacatatgacatatgtatatgtatatataacatatgacatatgtatatgtatatataacatatgacatatgtatatgtgtatatataacatatgacatatgt

SEQ ID NO: 19753 - DNA, 189 bp, Homo sapiens
atacatatatatgtatatacatgtatatatatacatatatacgtatatatatgtatacatgtatacatatacatatacatacgtatacatgtatatatatgtatatacgtatatatgtatatatatacatgtatacgtatatacatgtatatatacacatatatgtatatacatgtatatatgtatata

SEQ ID NO: 19754 - DNA, 70 bp, Homo sapiens
gtatgtatatgtatatgtatacatgtatacatatatatacgtatatatgtatatatatacatgtatatac

SEQ ID NO: 19755 - DNA, 86 bp, Homo sapiens
atatatatgtagagagactactatatacatatatatatagtagagagactactatatatatagtagagagactgctatatatatat

SEQ ID NO: 19756 - DNA, 89 bp, Homo sapiens
ggacttccccaggcaaaggcaggcacacacaggcacacaggcagctgggccaactgttctgggtgtcccctgcctgctgcctgctgtcc

SEQ ID NO: 19757 - DNA, 110 bp, Homo sapiens
atatgtatatatgtgtgtgtgtgtatatatgtgtgtatatatatgtgtgtgtatatatgtatacatatacatatgtatatacacatatatacacacacatatatacatat

SEQ ID NO: 19758 - DNA, 102 bp, Homo sapiens
tatatatatatatgtgtatatatatatatatgtgtatatatatatgtgtgtatatatatatatatatatatatacacacatatatatatatatatacataca

SEQ ID NO: 19759 - DNA, 106 bp, Homo sapiens
tactacatatgtatacatgtagtatatactctttatacatagtgtgtatatatatatacattatgtattatactatatattatacatagtatacatatatatagta

SEQ ID NO: 19760 - DNA, 111 bp, Homo sapiens
tatagtatatctgtgttctttctcagtgtcagtaaacggtttctgtctcacacacacatatacgcagacatgattttgaagtacttattgccataagaaacaattgctgta

SEQ ID NO: 19761 - DNA, 58 bp, Homo sapiens
tggtgtgtgtgtgtgtgtgcacgcgcgtgtgtgtgtatgtttatatatatgcatgcca

SEQ ID NO: 19762 - DNA, 62 bp, Homo sapiens
tctttgaatatatatgtttatatgtgtatatatgtatatacacatatacatatagtcaaaga

SEQ ID NO: 19763 - DNA, 70 bp, Homo sapiens
gtggaagacagacaatagtcactgcaggccttcggtgagacccagtactgtgctgacttctgtctgaccc

SEQ ID NO: 19764 - DNA, 78 bp, Homo sapiens
tacatatatttgatgtatcgatatattgatatatggtatatcgatatcatatatcaatatatattgatatattgtgta

SEQ ID NO: 19765 - DNA, 95 bp, Homo sapiens; identical to SEQ ID NO: 68

SEQ ID NO: 19766 - DNA, 93 bp, Homo sapiens; identical to SEQ ID NO: 69

SEQ ID NO: 19767 - DNA, 169 bp, Homo sapiens
catgtgtgtgtttgtgtgtgtgtatgtgtgtatattccacacaccatggaataatgtgattatatatattatatatacacacacatatgtgtgtatatatacataaatgtatatatatacacacatggtgtgtatgtgtgtgtatgtgtatatatatatgtatacatat

SEQ ID NO: 19768 - DNA, 61 bp, Homo sapiens
atacacaccatgtgtgtatatatatacatttatgtatatatacacacatatgtgtgtgtat

SEQ ID NO: 19769 - DNA, 109 bp, Homo sapiens
tatgatactcattgtgctagcatttgatttggactcttaattatacacttgtgatttttttttaagttcaagggtacatgtgcaggtttggtatataagtaaactcatg

SEQ ID NO: 19770 - DNA, 79 bp, Homo sapiens
actctatttttcctggcattagtttcatgtttatggttacttctttatatatgtattagttccaggtgtttgatagtgt

SEQ ID NO: 19771 - DNA, 112 bp, Homo sapiens
tattttattgaggatttttgcattgatgttcatcaggtatactggcctgaattttttttttttaaatctctgccaggttttggtatcaggatgatgttggcctcataaaatg

SEQ ID NO: 19772 - DNA, 100 bp, Homo sapiens
atggcatgcttattagaggtacctgggggaagaagagcagaattttttttttttttaagtctcgctctgtcaccccagactagagtgcagtggcatgatc

SEQ ID NO: 19773 - DNA, 67 bp, Homo sapiens
tatatgtatgtgtgtgtgtatatatatatatgttatatgtgtatgtatgtatgtatgtgtagacaca

SEQ ID NO: 19774 - DNA, 98 bp, Homo sapiens
gagtgagtagcttaatgagaacctttttaattttatgtaatataaattataatttctttttgtagttaatatgaaaaggttgagtaggttattcattt

SEQ ID NO: 19775 - DNA, 88 bp, Homo sapiens
ttatgtaatcctcacagaaattagtgtgctctcaaagagctctatgtctctgccagtagctctttagatagtgtttttgtgaccataa

SEQ ID NO: 19776 - DNA, 108 bp, Homo sapiens
tgcagaggtggggtttcactatgttgcctagtgcagtatatttattttaaaataaggaacttgaagcatagaagtgaaagagattacccctaaaattacaaatctgta

SEQ ID NO: 19777 - DNA, 101 bp, Homo sapiens
tgtacttgtctttgagatcaagtgtttttgttgttttgagatggggtttcactctgtctcccaggctggagtgcagtggtatgatcttggctcactgcaac

SEQ ID NO: 19778 - DNA, 80 bp, Homo sapiens
gctctagtaaggccaagatgatactgttggtctgcaggtattaatgtcaactcagaccctgtgtctgtcttctctgaagt

SEQ ID NO: 19779 - DNA, 113 bp, Homo sapiens
tgtttgcaccactgctctccggcctgggtgacaaagtgagaccttgtttctttttatataaacagagtgtcactctattgcccaggctcatcttgaactcctgggctcaagca

SEQ ID NO: 19780 - DNA, 61 bp, Homo sapiens
caaggtctcactctgtcacccaggctggactgcactggtgtgatcatagttcagtgccttg

SEQ ID NO: 19781 - DNA, 91 bp, Homo sapiens
gctccagcagtggcctagcatcccttaagtctgcatttttttttttttttttttttgagatggagtcttgctctgtcacccaggctggagt

SEQ ID NO: 19782 - DNA, 99 bp, Homo sapiens
ctaaatctcatttagatgtagtactttatatatttttagtgactggaaataccttatttttgtctaaaaaatttcagagtattattattaagtgtttag

SEQ ID NO: 19783 - DNA, 58 bp, Homo sapiens
tgagacagagtctcgctctgtcacccaggctggagtgcagtggcaggatcttggctca

SEQ ID NO: 19784 - DNA, 58 bp, Homo sapiens
tgagacagagtctcactctgtcactcaggctggagtgcagtggtgtgatctctgctca

SEQ ID NO: 19785 - DNA, 77 bp, Homo sapiens
gcaagacttcttgtatatgtatatgtatacatgtgtgtgctttatacacagatgcatatgtatacagaagtaaatgc

SEQ ID NO: 19786 - DNA, 105 bp, Homo sapiens
actatgttgaatagcagtggtgagaatggcattcttgtcttgttccaggtcttaagagtgatgctttcaactttccccccattcactgtaatgttcgctttgagt

SEQ ID NO: 19787 - DNA, 81 bp, Homo sapiens
atgtaatgacacagatgctgaaaaacatatatattcatatatatttaatatatatgtgtgtgtatgcatgtgtgtgtatat

SEQ ID NO: 19788 - DNA, 72 bp, Homo sapiens
tatatgtgtatgtatgtataccatatatgtgtatgtatgtataccatatatgtgtatgtatatatatgtata

SEQ ID NO: 19789 - DNA, 140 bp, Homo sapiens
ataccatatatatacgtatatatatgtataccatatatatacgtatatatatggtataccatatatatgtatatatatggtataccatatatatgtatatatatgtataccatatatatgtgtatatatgtataccatat

SEQ ID NO: 19790 - DNA, 95 bp, Homo sapiens; identical to SEQ ID NO: 580

SEQ ID NO: 19791 - DNA, 93 bp, Homo sapiens; identical to SEQ ID NO: 69

SEQ ID NO: 19792 - DNA, 100 bp, Homo sapiens
atttacatgagttctagtcaggttttgtagtcagatcaatgacagactgtttatcttcagaaatttttgattttaaaatttttatagggattgtgtagat

SEQ ID NO: 19793 - DNA, 95 bp, Homo sapiens; identical to SEQ ID NO: 68

SEQ ID NO: 19794 - DNA, 93 bp, Homo sapiens; identical to SEQ ID NO: 69

SEQ ID NO: 19795 - DNA, 95 bp, Homo sapiens; identical to SEQ ID NO: 68

SEQ ID NO: 19796 - DNA, 93 bp, Homo sapiens; identical to SEQ ID NO: 69

SEQ ID NO: 19797 - DNA, 95 bp, Homo sapiens; identical to SEQ ID NO: 68

SEQ ID NO: 19798 - DNA, 93 bp, Homo sapiens; identical to SEQ ID NO: 69

SEQ ID NO: 19799 - DNA, 95 bp, Homo sapiens; identical to SEQ ID NO: 68

SEQ ID NO: 19800 - DNA, 93 bp, Homo sapiens; identical to SEQ ID NO: 69

SEQ ID NO: 19801 - DNA, 111 bp, Homo sapiens
tgttttaaggaaaatctgcccctttttcattaatatatgtatatgtaatttgagataaaatttcaatgattatttttagatacatgaaaatttgggcattgcctcttaaca

SEQ ID NO: 19802 - DNA, 113 bp, Homo sapiens
gaaagggccttccatgttgctacaatgagccagcctttctctttttttttttttttttttttttttttttgagacaggctctggctctgttgcccaggctggagtgcagtggc

SEQ ID NO: 19803 - DNA, 100 bp, Homo sapiens; identical to SEQ ID NO: 19792

SEQ ID NO: 19804 - DNA, 62 bp, Homo sapiens
tatatgtatatatatgtacatatgtacatatatatgtatatatgtacatatatatgcatgta

SEQ ID NO: 19805 - DNA, 107 bp, Homo sapiens
tcagtggaaaggcacacacagaatattgcactgtctgtgataaaatatttttgagagcattgtagacagtgtgatttaagattggtgggctggggcagatctgttga

SEQ ID NO: 19806 - DNA, 58 bp, Homo sapiens
tgagatggagtctcactctgtcacccaggctggagtgcagtggcgggatttcgtctca

SEQ ID NO: 19807 - DNA, 95 bp, Homo sapiens; identical to SEQ ID NO: 580

SEQ ID NO: 19808 - DNA, 93 bp, Homo sapiens; identical to SEQ ID NO: 69

SEQ ID NO: 19809 - DNA, 105 bp, Homo sapiens
gcctacttgatcatggtggattagttttctgatatgctgctggattcagtttgtcagtatatttttttgagaatttttacatggatgttcatcaagtttattggc

SEQ ID NO: 19810 - DNA, 131 bp, Homo sapiens
gtgcatatgtgtatgtgtatatatgtgtgcaggtatatatgtaacatatatatatatatatatatatatatatatatatattcacttctgtattacctgtattgcatgaaaaaataacctagatgtatata

SEQ ID NO: 19811 - DNA, 107 bp, Homo sapiens
tgagaggcatgagattggataacggtaaagtcagaggtatccatgttttttttctttaaaacggagtttctctgtcacccaggttgaagtgcaataacatgatctca

SEQ ID NO: 19812 - DNA, 81 bp, Homo sapiens; identical to SEQ ID NO: 19787

SEQ ID NO: 19813 - DNA, 117 bp, Homo sapiens
agagagcaatagacaaaagcatctgtatctttcatgacagtagaaagtgaacacagagacgttaatcattattatagtccctcaaaaggtactgctttttcattccaaaatatctct

SEQ ID NO: 19814 - DNA, 118 bp, Homo sapiens
gattacaggcatgagccactgtgcctggctgatactagcattcttttttttttttttttttaaagatagagtcttgctctgttgcccaggctggagtgcagtggcacagtctcagctc

SEQ ID NO: 19815 - DNA, 91 bp, Homo sapiens
gataatgctctaaatggtatctttgagtacaagatatctatagaagttataaaattacttaactatgataagtccatttggagtatcagtc

SEQ ID NO: 19816 - DNA, 130 bp, Homo sapiens
gcatataatatatatacacatatatatatttgtgtatatgtatgggtgtgtgtatatatatgtatgtgtatatatatgcgtatatatatatatatgcatatatatgtgtatacatatatataacattttc

SEQ ID NO: 19817 - DNA, 102 bp, Homo sapiens
tatgtaaatatatatctacatatacttatgtaaatatatatctacatatacttatgtaaatatatatctacatatacttatgtaaatatatgtatctacata

SEQ ID NO: 19818 - DNA, 58 bp, Homo sapiens
tgaatatatgtagctacatatatttacatatatgaatatatgtagctacatatattta

SEQ ID NO: 19819 - DNA, 115 bp, Homo sapiens
tctgcgagctggacacccaggaaagccggtggtgtagtctgaaggctggagagccagagagctgacagtgtagattgcactctaagctgaagtcctgagaacaagaagcatgaga

SEQ ID NO: 19820 - DNA, 58 bp, Homo sapiens
tgagaaagagtctcgctctgtcacccaggctggagtgcagtggtgtgatctcggctca

SEQ ID NO: 19821 - DNA, 76 bp, Homo sapiens
gagagaggtaggtgtgtgtatgcatgtgtgtgtgtttctggctctctctctgtatatatctacctgtatctgtctc

SEQ ID NO: 19822 - DNA, 72 bp, Homo sapiens
tatagagtttatatgtacatatacatatatatgtgtgtgtatatatatatgtgtgtgtgtgtgtcttttata

SEQ ID NO: 19823 - DNA, 118 bp, Homo sapiens
ttggctttgacatatatatttggtcagggacctagacctatggatggtttttttatctttagtagatgggctcagaggttgctgttaccattttaaaagccagagaaaaggggaagag

SEQ ID NO: 19824 - DNA, 115 bp, Homo sapiens
gctactgattttcatatgttgattttgcattcaacaactttactgaatttgtttatcagttctaagagttttttgttgaagtctttaggttatcctatatgtaagattatgtcgt

SEQ ID NO: 19825 - DNA, 64 bp, Homo sapiens
tcagtctcaattacttgacattcatgcaggtatgtatgtatgtatgtatgtattttgagacgga

SEQ ID NO: 19826 - DNA, 116 bp, Homo sapiens
atcacctgggaccttttacacagtaccaatgttgggagccccaaggctgaaaattctgattttgttgttctggaaaggatccaacatcagtattatttacaagttcccaaggtgat

SEQ ID NO: 19827 - DNA, 145 bp, Homo sapiens
tatatatatacatatgtgtgtgtatgtatatatgtgtgtacatatgtatatatacatatatgtgtatatatgtgtgtacatatgtatatatacatatatgtatatatatgtgtgtctgtgtgtacatgtgtgtgtgtgtatatat

SEQ ID NO: 19828 - DNA, 69 bp, Homo sapiens
tatatatacatatatgtatatatacatatgtacacacatatatacacatatatgtatatatacatatgt

SEQ ID NO: 19829 - DNA, 60 bp, Homo sapiens
gttgttgagacggtgtctcactctgtcacatgggctgaggtagagtggcacaatcatagc

SEQ ID NO: 19830 - DNA, 65 bp, Homo sapiens
gctgaaagtggagtgttgaagtctccagctattattttactggggtcagtctctctctctttagc

SEQ ID NO: 19831 - DNA, 68 bp, Homo sapiens
tgaattgtataccattatatatatatataattccacataatattatatatataatggtatactattca

SEQ ID NO: 19832 - DNA, 92 bp, Homo sapiens
cttttttctgccttgatgcaatggttcacacctataatttcagcactttgggaggctgaggtaggaggatcacttgaggccagaagtttgag

SEQ ID NO: 19833 - DNA, 116 bp, Homo sapiens
gttatttctcacatttctggagggtggaaagttcatgatcaaggcagattaggtgtctgttgagagtgtgctgtctggtttataattgatgccttcttcctgtgtccttacatgac

SEQ ID NO: 19834 - DNA, 121 bp, Homo sapiens
tatgcacgtatgcatatatattaaactaatatatataaattatgttcatatatgtatgtatgtatgtgtatatgtatatgtgtgtatgtgtgtgtatatataaagatttataccaaaggca

SEQ ID NO: 19835 - DNA, 83 bp, Homo sapiens
catgtgtaaaggagagaaaacagtgaggaaattggcaaaagagagaagtcagaaatcactcctaatttcctcttgaacatatg

SEQ ID NO: 19836 - DNA, 117 bp, Homo sapiens
tatacttaagggtccatgtatatatattatacttatggatatatatacatgtatattatacatgtatatatattatatacttaggggtccatgtatatacttaagggtccatgtata

SEQ ID NO: 19837 - DNA, 58 bp, Homo sapiens; identical to SEQ ID NO: 7346

SEQ ID NO: 19838 - DNA, 58 bp, Homo sapiens
tgagacaaggtctgcctctgtcactcaggctggactgcagtggcgctatcttggctca

SEQ ID NO: 19839 - DNA, 95 bp, Homo sapiens; identical to SEQ ID NO: 580

SEQ ID NO: 19840 - DNA, 93 bp, Homo sapiens; identical to SEQ ID NO: 69

SEQ ID NO: 19841 - DNA, 58 bp, Homo sapiens; identical to SEQ ID NO: 3380

SEQ ID NO: 19842 - DNA, 85 bp, Homo sapiens
ttcttggtttgcctgtggtttttctctcagcgagtcagtggcactcactgcctggctgagggtgggcagatgcaacttccgagga

SEQ ID NO: 19843 - DNA, 77 bp, Homo sapiens
atggtaggtatgtatgaatatatacatatgtgtgtacgtgagtgggtaaatgagtgtgtgtatgcaggcactatcat

SEQ ID NO: 19844 - DNA, 112 bp, Homo sapiens
gttcccagaggttctagcttcaactatctggtgtgaagattctcacacacagtcaggctcaggaaccacaggctgtgtgtcatatttttttacactgaactggcttctgaac

SEQ ID NO: 19845 - DNA, 117 bp, Homo sapiens
acatgtgtatatgtatgtatgtgtgtgtatatctatatgtgtgtatatatacatatatatgtatatgtgtatatacatatataagcatatatatgtatatgtgtatatacatatata

SEQ ID NO: 19846 - DNA, 80 bp, Homo sapiens
atgggaggcagtggtcaggagaggaggttcactggagtgagtcaggagacctggattctccttgagactctgtcacctat

SEQ ID NO: 19847 - DNA, 132 bp, Homo sapiens
ttctctcatatttcagcatattaaatttagtgggggtggaaatgggatggctgaaagtgagagaagagacagtggtgtgaaggcagcttaagtgtcttgttcaggggcttctgtaaatgtgacttcagtaaa

SEQ ID NO: 19848 - DNA, 95 bp, Homo sapiens; identical to SEQ ID NO: 68

SEQ ID NO: 19849 - DNA, 93 bp, Homo sapiens; identical to SEQ ID NO: 69

SEQ ID NO: 19850 - DNA, 116 bp, Homo sapiens
tcttgctgaaatcataagctttagggaatgtaattgaacaattgagtatttaaatttatgtaaatatctgaggtttagtggggtattcttaatggctataaagatttcttcttgga

SEQ ID NO: 19851 - DNA, 140 bp, Homo sapiens
ggtacaattaacagagctcattcaggtttctccagttacacttgtactcgtgagtgtgcgtgtgtgtgtgcctgcgtgtgtgtatccgtgtgtgtgtgctcatagacctatgcagtctgatcacatgtgtagcttagctt

SEQ ID NO: 19852 - DNA, 68 bp, Homo sapiens
tgttttgagacatggtatccctctgtcactcagcctatagtgcagtagtgcaatcatggctcactgca

SEQ ID NO: 19853 - DNA, 76 bp, Homo sapiens
agtccaggtactgtctctgtctgccactttatgctacttcaacataaggcagaaagtgacaaagtgatccaggatt

SEQ ID NO: 19854 - DNA, 87 bp, Homo sapiens
gagctgcagacacacagggggttatctgcctttctccccatgccatctgctgctggtatggcacgctctctgagtgtcttttagttt

SEQ ID NO: 19855 - DNA, 120 bp, Homo sapiens
gcaagtttattaagaaagaaaaggaataaaagaatgactactccataggatgagcagacaagtctttttgatctactgagtttccagtctttcttctctttcgcatgtgagatactatgt

SEQ ID NO: 19856 - DNA, 98 bp, Homo sapiens
gttaatgtgtgtgtgtatgttatatgtatatatatgtgtttacatatctaaacataattatctttatatgcatatatacataatatacacacacagac

SEQ ID NO: 19857 - DNA, 193 bp, Homo sapiens
atacacatatatatgtatatatatctatatatacatatatatgtatatatatctatatatacatatttatatacatatttatatatgtgtgtgtatatatatactttatatatatactttatatatatactttatatactttatactttatatatatactttatatatactttatatatatactttatatata

SEQ ID NO: 19858 - DNA, 112 bp, Homo sapiens
tgagatgggaagtggcttgaagcccaggagtttgagacagcagtgagacagcagtgagctatgatcacactactacactctagcctgggtgacagaggaaggctcaatctca

SEQ ID NO: 19859 - DNA, 100 bp, Homo sapiens
aactgccctgcctagaacctacagtacagtgttgaatagaagtggtgagcgcagacttattttttcttatttctaatcttagtgggttaagtatccagtt

SEQ ID NO: 19860 - DNA, 107 bp, Homo sapiens
cctttgtttgatttttttttcccagtaatgtattattgttaatattgagtgtaaacttgattggattgaaggatgcaaaatactgttcctgggtgtgtctgtgaggg

SEQ ID NO: 19861 - DNA, 70 bp, Homo sapiens
atacatatatatatatgtgtatatatatacacatatatgtgtatatatatacacatatatatgtgtttat

SEQ ID NO: 19862 - DNA, 111 bp, Homo sapiens
tgtagttattgtagaagcaagtttgttgttgagagagtggatttgttataaaaacaagttaagctctctctctctctcaacatgtcatgccttttatcatgttatgatgca

SEQ ID NO: 19863 - DNA, 108 bp, Homo sapiens
actttcagtagtgctaacaaagatgatattgttttgtatttttgctttaaaaaattaagcaacccatacctatatatatattcataattgccttagacagttgaaggt

SEQ ID NO: 19864 - DNA, 91 bp, Homo sapiens
atggatttggatataccaagccaggggggcggcagatgtctcaccgactctctgtaaacactctggtcatattgacctatcatctgtccat

SEQ ID NO: 19865 - DNA, 95 bp, Homo sapiens; identical to SEQ ID NO: 580

SEQ ID NO: 19866 - DNA, 93 bp, Homo sapiens; identical to SEQ ID NO: 69

SEQ ID NO: 19867 - DNA, 78 bp, Homo sapiens
gtgtgtgcgtgtgtgtgtgtatatatatgtgtgtgtatatatgtgtatatatgtatatatgtgtgtatatatatatgt

SEQ ID NO: 19868 - DNA, 95 bp, Homo sapiens; identical to SEQ ID NO: 68

SEQ ID NO: 19869 - DNA, 93 bp, Homo sapiens; identical to SEQ ID NO: 69

SEQ ID NO: 19870 - DNA, 58 bp, Homo sapiens; identical to SEQ ID NO: 884

SEQ ID NO: 19871 - DNA, 56 bp, Homo sapiens; identical to SEQ ID NO: 885

SEQ ID NO: 19872 - DNA, 138 bp, Homo sapiens
atatatctatatataaaatatatttaaaggccctaaaactttatatttacatatatatgtgtgtgtatatatatgtgtgtgtatatatatttaaagaccatatatatatatgtatatatagagagagtcttcttggat

SEQ ID NO: 19873 - DNA, 93 bp, Homo sapiens
aggtgtgagccactgtgcttggcctctctaacttcatttcttaccaatctcaccctctctcacaatggtctagttacattggctcttactcct

SEQ ID NO: 19874 - DNA, 109 bp, Homo sapiens
gcataatagatattggggagctcactggccgggagccttaagaggagagcagctatctcagtctttctcacttaatcttggcttcacgtcagaagctgtgcagcagtgc

SEQ ID NO: 19875 - DNA, 79 bp, Homo sapiens
gcagcctccaatggtgcactgattgagaggctttgatgtaactgacattcactgactcagtctgtgttctaggcactgc

SEQ ID NO: 19876 - DNA, 80 bp, Homo sapiens
tgcatatatatatatgtgtgtttgaatgtatatatgtgtgtatacatatatatatattacatgtatgtatgtattaggta

SEQ ID NO: 19877 - DNA, 119 bp, Homo sapiens
attctgtcataactgatgtctttgtgtgggtggtatttgggataatcaaggactagagattttgttcatatttggggtgatgtcataacagctgcccgaccagattgagatgagagaat

SEQ ID NO: 19878 - DNA, 61 bp, Homo sapiens
gagaagtctgggtagagactgacatagaaggaatctttgttgtctgacacctggtgcttcc

SEQ ID NO: 19879 - DNA, 109 bp, Homo sapiens
catatacaaacatatatcatgcacgcacacatatacataatgtatgtatgtatatgtatgtatgtatataccagaggggtatgtgtgtatgtatgcatatgtgtatatg

SEQ ID NO: 19880 - DNA, 81 bp, Homo sapiens
tttttgacaggaaaaatatatacgtatacatatttgtatatatatgcatgtatatatgtatgtatgtatgatcttcaaaaa

SEQ ID NO: 19881 - DNA, 58 bp, Homo sapiens; identical to SEQ ID NO: 1101

SEQ ID NO: 19882 - DNA, 56 bp, Homo sapiens; identical to SEQ ID NO: 1102

SEQ ID NO: 19883 - DNA, 92 bp, Homo sapiens
cagactacagccatgcaccaccacatctggccaatttttctattttttttttttttagagatgtgttctgataatgttgcacaggctagctg

SEQ ID NO: 19884 - DNA, 141 bp, Homo sapiens
atatatattgtatcatatatatgtgtgtatgtgtatatatataactatataaaactatattatatataactataaatatatttatatataactatattatgtataactatatataactataactatatatgtgtgtatata

SEQ ID NO: 19885 - DNA, 177 bp, Homo sapiens
ttatatcatacacaaaatcatgtacctaattatacatatatgtgttagcattgttttattatatatcatgtatctataatcttatatatgatgttatatgtgtaatgatatagtatgtatatattatacattaatgaaatataattatgtatatattatatatctacatttaaagtc

SEQ ID NO: 19886 - DNA, 105 bp, Homo sapiens
gtgggcaggtggagtcaggtagtttttaggccatttatttgtaaacagttattttatctatgtgtctatctgtctgtctgtctgtctatctatctatctgtctat

SEQ ID NO: 19887 - DNA, 104 bp, Homo sapiens
atgtcacttacctctattctaaatccatattccacagaccattttttttcttttaagaaacaggatgtctctttgtcacctaggttggagtgcagtggtggcat

SEQ ID NO: 19888 - DNA, 223 bp, Homo sapiens
catttataatgtatgtatttgtatataatgtatattaatgtatatatctgtatataatgtatatatttatatacacatttgtatatatgtatgtatatacattgtatgtaatgtatatatagatatatacatttgtttataatgtatatattcatatttgtatacaatgtatattaatatatgtgtgtataatatatatcaatgtacctatttatattaaata

SEQ ID NO: 19889 - DNA, 106 bp, Homo sapiens
gtaaattgttacaaaaactttagtgtactcataaaacattttttgaatttaagattgaaaagagaaggttagctgggttatactgtgtgtttttcaacactgatac

SEQ ID NO: 19890 - DNA, 115 bp, Homo sapiens
gaatcaatgttcaaacaacatttgcatatctcatcttgtgatctgaaaagtagtatgatttgtctatttttttgtatcaagaatgggtttctggtatagaattgtcattgtattt

SEQ ID NO: 19891 - DNA, 87 bp, Homo sapiens
tgtgacaaaccttggaagaactcaaagtattaattaaaatttttttttaatattattatactttaagttttagggtacatgtgcaca

SEQ ID NO: 19892 - DNA, 79 bp, Homo sapiens
aaatatatgtagtatatatgagtgtaaacatacatataaatatgtgtatgtatatatatgcatatatacatatatgttt

SEQ ID NO: 19893 - DNA, 69 bp, Homo sapiens
tgtgtatatatatagtgtatatgtatgtgtgtgtatatatacatatatatacatatacacacatacaca

SEQ ID NO: 19894 - DNA, 107 bp, Homo sapiens
aattaatatgggaatacagatacctctttgagattctggttgtagtttctttgcatatatactcagaagcagaattgttagataatacagtagtcctatttttaatt

SEQ ID NO: 19895 - DNA, 95 bp, Homo sapiens; identical to SEQ ID NO: 68

SEQ ID NO: 19896 - DNA, 93 bp, Homo sapiens; identical to SEQ ID NO: 69

SEQ ID NO: 19897 - DNA, 81 bp, Homo sapiens
actcaggtagagtgtattagattccattagttgaggagacatagctgagagtccagagaaattaatacagctagatagagt

SEQ ID NO: 19898 - DNA, 82 bp, Homo sapiens
gggtgagctttgagagagagcacagatcgggggctgtgtgagtggctgtggctcctgcatgcttcttttcgagcaaagacct

SEQ ID NO: 19899 - DNA, 115 bp, Homo sapiens
ccagtctgattggttgcaggagggtgcccatagaggtaattttatttttcatttgcaatgcagacaaagtagggggattgcaaagcaagtagcctctgatccttttgttacttgg

SEQ ID NO: 19900 - DNA, 127 bp, Homo sapiens
tatatgtatacatatacacatatgtatatatatgcatatgtatatatgtatacatatatgtatatatgtgtatatatgtatatatatgtgtgtttatatatatacatatatatgtgtatatatatat

SEQ ID NO: 19901 - DNA, 64 bp, Homo sapiens
tatgtatatgtatatatgtacataatatatatgtgtatatatgtatatgtatatatgtacgtgt

SEQ ID NO: 19902 - DNA, 110 bp, Homo sapiens
ttgtattttgactttgcatcctggaactttactgaatttgttgatcagttccaatagatttttttggtttagatttttttggttgagtcttcagatgtttccaaatataa

SEQ ID NO: 19903 - DNA, 86 bp, Homo sapiens
atttatacatatttaattttgttgtatattttatacatatattctaaattgtgtgtatgtatatatgtatacatgtatgtacaaat

SEQ ID NO: 19904 - DNA, 95 bp, Homo sapiens; identical to SEQ ID NO: 68

SEQ ID NO: 19905 - DNA, 93 bp, Homo sapiens; identical to SEQ ID NO: 69

SEQ ID NO: 19906 - DNA, 110 bp, Homo sapiens
ccttacaataatctctaagtgttcaagtgaaagtcagactcactcactttaaatcaaaaggtagaaatgattaagtttagtgaggaaagcatgtcagcacctgagatagg

SEQ ID NO: 19907 - DNA, 105 bp, Homo sapiens
gctgattcaaatttggtcatagtcatgcattatttttaatgttttatgtttatctcacatcaatattaatatatgagcatatgatctgataagagatgggttggt

SEQ ID NO: 19908 - DNA, 116 bp, Homo sapiens
gtgacatacattttcccaaacccttagtgtcatagagagcacagagtgaaccttaaagtatgtaaatttttaaaaaatcagtgaggatactagggatttcagaatggatatgaaac

SEQ ID NO: 19909 - DNA, 188 bp, Homo sapiens
atatgtatatatgcatatgtatatatgtatatgtatatatacacatgtatatatgtgtatatgtatatacacgtgtatatatatgtatatacacatatgtgtatatatgtatatgtatatacacatatgtgtatatatgtatatgtatatacgcatatgtatatatgtatatgtatatacgcatatgt

SEQ ID NO: 19910 - DNA, 148 bp, Homo sapiens
tatacatatatacatatgcatatatacatatacatatatacatatatgtgtgtgtatatatgtgtatatatgtgtgtatatatgtgtgtatatatgtgtatatatgtgtgtatatatatacatatatataagctcaaatgtgttgtat

SEQ ID NO: 19911 - DNA, 87 bp, Homo sapiens
tgggatattttaatgagcctattatgtataaatctatcttgttctttaatggtaatataatattttggctacacagtagatatccca

SEQ ID NO: 19912 - DNA, 82 bp, Homo sapiens
tttgctggcttcaggtgagactcagcacattcctggctgtagtggctatgagttgagactctttcttcctgagaaaagcaaa

SEQ ID NO: 19913 - DNA, 103 bp, Homo sapiens
tatatatgtctatgtatatatatgtgtgtgtatatacgtgtgtatatatataaatatatacacaaatgtgtgtgtgtgtatatatatatatatatatatatat

SEQ ID NO: 19914 - DNA, 79 bp, Homo sapiens
taggaatgaggttcttgtttccttactggcagtgagcagtgcattgttgtcagcaactggagagagtactcatggccta

SEQ ID NO: 19915 - DNA, 93 bp, Homo sapiens; identical to SEQ ID NO: 69

SEQ ID NO: 19916 - DNA, 95 bp, Homo sapiens; identical to SEQ ID NO: 68

SEQ ID NO: 19917 - DNA, 93 bp, Homo sapiens; identical to SEQ ID NO: 69

SEQ ID NO: 19918 - DNA, 85 bp, Homo sapiens
gtgctggtatcagattttcattttataaatagtacttggtttgcagtgcagggtatacattgaagaggtaatcagttaccagtgt

SEQ ID NO: 19919 - DNA, 95 bp, Homo sapiens
atgttatggattgtatctgcttggctatttaaaagggtgagttttttttttttttgtctttgcaaatctcttagcagattgcttgtgatacacat

SEQ ID NO: 19920 - DNA, 98 bp, Homo sapiens
tctgctttgactactatagtttttaacatactgtgtggcatataattgtatttattatttcttgtcctacgtctttgttgctaggagttggttgtaga

SEQ ID NO: 19921 - DNA, 58 bp, Homo sapiens; identical to SEQ ID NO: 1847

SEQ ID NO: 19922 - DNA, 78 bp, Homo sapiens
acttggcttatagacacatcactccagtctctgccttcatgttcatgtgtcatgctctctgtgtgtctatttccaagt

SEQ ID NO: 19923 - DNA, 76 bp, Homo sapiens
ggaggctgaggtggaaggatggcttcagtccagaaggtcaagactgcagtgagccatgatcataccactgcactcc

SEQ ID NO: 19924 - DNA, 109 bp, Homo sapiens
cacatagattcatgaattttcatatgttagacatgagagattctgaactggtagacagcatagaatcattttttttttaacttttattttcagttcaggagtacatgtg

SEQ ID NO: 19925 - DNA, 103 bp, Homo sapiens
tcccaccccagtgtgcccagtatgcagcacatggagtcaaaggagattattctccaatgttaagtgataatgttgttttccccattgggttttagatttggga

SEQ ID NO: 19926 - DNA, 90 bp, Homo sapiens
tgatccaagtgtgtggatactacttggaaagtcacattatttgaatatattcatttggtactgagcctagcagtgtgcgcattcttttca

SEQ ID NO: 19927 - DNA, 116 bp, Homo sapiens
ttgaggtatgcctgtatgtgcagactacacttggaacagcttagataaaaattagactgaagtgagactggagctgttgcccaaggaataggggttgtagtacaagtctagctgga

SEQ ID NO: 19928 - DNA, 97 bp, Homo sapiens
ccattgctctatatgtctatttttgtaccggtaccatgttgtttgtatactatagccttgtagtatagacggaagtctggtaatgtaatgcttctgg

SEQ ID NO: 19929 - DNA, 195 bp, Homo sapiens
cctccagctacatccgtgttttggggaaggatatgatttcattctttttttttggctgtgtagtattccatgtgggggagatatatatctatatatatggatatatatacatatatacaaaaaatatactttatacatatattttttatatatatggatatatatatccatatatatataacctaagtgttcatc

SEQ ID NO: 19930 - DNA, 74 bp, Homo sapiens
tctttctgctctgtctctgagttcattcatttatttaaatcactgaatattgaaagctcagtcaggcaccaaga

SEQ ID NO: 19931 - DNA, 95 bp, Homo sapiens; identical to SEQ ID NO: 68

SEQ ID NO: 19932 - DNA, 93 bp, Homo sapiens; identical to SEQ ID NO: 69

SEQ ID NO: 19933 - DNA, 68 bp, Homo sapiens
tttatatgtgtgtgtatgtatatgtgtttaatatacattttatatatatatatatatatatatataga

SEQ ID NO: 19934 - DNA, 95 bp, Homo sapiens; identical to SEQ ID NO: 68

SEQ ID NO: 19935 - DNA, 93 bp, Homo sapiens; identical to SEQ ID NO: 69

SEQ ID NO: 19936 - DNA, 109 bp, Homo sapiens
aggaaatggatagcagacactcactgtaaaaattttattcattttttggtgttaattagtgctaacacataagtgagtataattcttataactgtctgggctcaatcct

SEQ ID NO: 19937 - DNA, 111 bp, Homo sapiens
tgtacatagatgttatactgtagtttaaaatgggtattatttttaatttaaaaaaattattatgtttgatccatggttggttggatctgtaggttctgcatcttgggtaca

SEQ ID NO: 19938 - DNA, 113 bp, Homo sapiens
agcagcagtgtaaaagtgttctcttttcaccacattcacaccaacagctattattttttgattttctaattatggccgttcttgtaagagtaaggtggttttacattgtggtt

SEQ ID NO: 19939 - DNA, 100 bp, Homo sapiens
agatatttaattttgatgtaagtagaatttgtgggtcaaaaatatgtacatttatatttttgacagatattcccaaatttccttgtataaagattgttct

SEQ ID NO: 19940 - DNA, 134 bp, Homo sapiens
gtatacatatatgtgtatatatattcgtatacatacatgtatatatattcgtatacatatatgtgtatatatattcgtatacatgtatgtgtatatattcgtatacatatatatgtgtatatatattcgtatac

SEQ ID NO: 19941 - DNA, 116 bp, Homo sapiens
tacatacacacatatatatgtatatgaatatatacacacatatatatgtatatgaatatatacacacatatatatgtatatgaatatgtacacacatatatgtatatgaatatgta

SEQ ID NO: 19942 - DNA, 116 bp, Homo sapiens
gtgtttttcatttatattctgagccccttatctttataatagaaactggaatggtaaaaattattattttttcaatgaaagggtaggtgcaaagatttttattgtgtgaagaatat

SEQ ID NO: 19943 - DNA, 117 bp, Homo sapiens
tgatacaatttaaaactctcaggtagtgttgtttcttcaagagcctttatgtatttattttaacttaataaatgctcagagtacattttcatctatctaagttttaacctttgggca

SEQ ID NO: 19944 - DNA, 58 bp, Homo sapiens; identical to SEQ ID NO: 1409

SEQ ID NO: 19945 - DNA, 115 bp, Homo sapiens
tggaagtggtgtcaaaggcctatagtcccagctgctctggagggtgaggtaggaggatctcttgagccttagagttcaaggttgcaatgagctatgagcatgccactgaactcta

SEQ ID NO: 19946 - DNA, 113 bp, Homo sapiens
tagacaatatatcttgcacatggtcaaatgataaatcgaggagtggaattattttttttaattttaattttaattttgagttctgaggttcatgtgcaggatgtgcaggtttg

SEQ ID NO: 19947 - DNA, 66 bp, Homo sapiens; identical to SEQ ID NO: 8248

SEQ ID NO: 19948 - DNA, 79 bp, Homo sapiens
tagagatggaggtttctagtgcagggcgccaagctagtaaggaatgaagtctgggtgcaaacacaaatctccaaagctg

SEQ ID NO: 19949 - DNA, 67 bp, Homo sapiens
actcatacatgtatggtatgtatatgtgtgtatatatatgtgtgtgtacatatgtatgtgtgtgtgt

SEQ ID NO: 19950 - DNA, 87 bp, Homo sapiens
ctctccactcccagacccaatccctctgtctcagtcagcccagtgttgaacaatcaaggtaatctatggcagggatgaagtggggag

SEQ ID NO: 19951 - DNA, 101 bp, Homo sapiens
gattatttatggatcatatgtatatatacatggattatatatatgtgtatttcatatatatatgtgtataatcctctttacaaattctctaatacataatt

SEQ ID NO: 19952 - DNA, 112 bp, Homo sapiens
ggtggtattgccaagtagttaagagtatggcaatagagttagaataccggggttcaaatcctgactctgtcactcactagccagatgactttaaaccagttacttaacctcc

SEQ ID NO: 19953 - DNA, 95 bp, Homo sapiens
ttcctaaattagactgaatcatatgaaattactgaaatatgattttttacatataaaattggcactttcatgtggttcatcctaatagcatggaa

SEQ ID NO: 19954 - DNA, 77 bp, Homo sapiens
tgggtttgaatggatcagctttcagagaacagtgacatcagagaatgattctccacttctgaagccctgtgagccca

SEQ ID NO: 19955 - DNA, 86 bp, Homo sapiens
agctgaggaagaaatttctcctgggtggctgaggtgtcaggctcctgggtagaccagcccctctgctgtgctcattctctccatcc

SEQ ID NO: 19956 - DNA, 95 bp, Homo sapiens
ttcagtgtttgttggaggaggagttgtgctaaaaatctggatgaaccatgtgtatccttttctagaatttttttttaaccataagcatgttggaa

SEQ ID NO: 19957 - DNA, 110 bp, Homo sapiens
aattgttttgtattcctctggagtagcatgtacattgttcacacccaacatggatatggattgaataaacaacatgctgtggttgcattttccagatttgctatttaatt

SEQ ID NO: 19958 - DNA, 93 bp, Homo sapiens
agaggtagcctcagaggtacgaagtctcccagtgggtcagttcagtatcactctgtgagtgattctgggaggcttgctcctttagctctccct

SEQ ID NO: 19959 - DNA, 58 bp, Homo sapiens
tgagacagagtctcactctgtcgctcaggctggagtatagtggtgtgatctcagctca

SEQ ID NO: 19960 - DNA, 58 bp, Homo sapiens; identical to SEQ ID NO: 315

SEQ ID NO: 19961 - DNA, 120 bp, Homo sapiens
gctgggggtaaatgcatatgagtggggctccggggtcacatggtgagtatatatttaactttacaagaagctggcaaactgttttccaaagtggttgcactgttttgcattcccaccagc

SEQ ID NO: 19962 - DNA, 86 bp, Homo sapiens
atatatatatacatatatgtgtgtatatatatgtatatacatatatgtgtgtatatatatgtatatacatatatgtgtgtatatat

SEQ ID NO: 19963 - DNA, 103 bp, Homo sapiens
tgtgtgtatatatgtatatacatatatgtgtgtgtatatatgtatatacatatatgtgtgtgtgtatatatgccatatatatatatatatatatatatatata

SEQ ID NO: 19964 - DNA, 101 bp, Homo sapiens
cagataggacaatcaaatattagtttttcctctttgtacttgaatattacaatatttttcaagtggaggtggatagtaatatgacatatatgtgccgactg

SEQ ID NO: 19965 - DNA, 104 bp, Homo sapiens
tattttggaggagaggacctagagataatgtgtggctctctgtctgtctggggacaagggtagggactgggatatatggtgaagtggctaactcttccagatta

SEQ ID NO: 19966 - DNA, 78 bp, Homo sapiens
cgctctgttcatgagccaagcttgatggggcaggaaattcccagcacctccgtcactcagtgagtgaggcctagagtg

SEQ ID NO: 19967 - DNA, 82 bp, Homo sapiens
ttccagaaatgccctgctagcttgtgccagtctgtgtgcgtgtgtggagactcagcacacttatgggtgtggggccctggga

SEQ ID NO: 19968 - DNA, 104 bp, Homo sapiens
ccccctggaaggggcgacctgttttccgggtttgggcttttggaatcagagcagagagagcccactaagcccctacatattgtctcaacttccgggactttggg

SEQ ID NO: 19969 - DNA, 84 bp, Homo sapiens
ggttgaccaggtccctgcctgtgtgcctgacatcctttctcaaggaacatgcacacccatgtctattggcacggacttgtaact

SEQ ID NO: 19970 - DNA, 87 bp, Homo sapiens
tccattttgaccaacactgtttaattcctgcttttttttttttttttttttttgagacggagtttcatgcttgtggcccaaggtgga

SEQ ID NO: 19971 - DNA, 56 bp, Homo sapiens
gagacagagtctcgctctgtcaccccagctggagtgcagtggcgagatctctgctc

SEQ ID NO: 19972 - DNA, 98 bp, Homo sapiens
ggtgagaacacgtgatgtttgtcttactgtggctggtttatttcactcaacatagtgacctctgtttccatccatgttgcaattgacatgatctcatt

SEQ ID NO: 19973 - DNA, 106 bp, Homo sapiens
gtagaccccagtgtctgtcgtttcctttggttttcttgagacggagtctcactctgtcacccaggctgtagcacagtggtgcgatctcggctactgcaaattctgc

SEQ ID NO: 19974 - DNA, 86 bp, Homo sapiens
acatagtgagaccctgtctctatttatgtttttttttttttggttttgtttcgttttgctttttttgagacagagtctcactctgt

SEQ ID NO: 19975 - DNA, 68 bp, Homo sapiens
gggggaccggcgcttagtaagtgaggaccaacaccggtgctcacttactctgagtctctgagttctct

SEQ ID NO: 19976 - DNA, 81 bp, Homo sapiens
atggatggttctatttatatctataatgtaaagatatgcatattgatatatatgtttgtatatatagatagacacattcat

SEQ ID NO: 19977 - DNA, 117 bp, Homo sapiens
acttctggggtttttcttttttgaaattgcacaagtcagggcagtgtctttggttatcaaactctaaacatggaaatgccctagagacggtgtatttcaaaagagcacaaagtaagt

SEQ ID NO: 19978 - DNA, 104 bp, Homo sapiens
cagtctgtagccctgctttttaaatttttttaaatatagaaattaaattttagtcagaccctgtcttttaaaaaaaaataactgagcatggtggtacatgtctg

SEQ ID NO: 19979 - DNA, 77 bp, Homo sapiens
gggagtgttatctcatcaggtagaatgatgaggactcttgagtcaacaatctctgctcacaggagatttttattcct

SEQ ID NO: 19980 - DNA, 103 bp, Homo sapiens
caaagcttatatatatgtgtgtgtgtatatatatatatgtgtgtgtgtgtgtatatatatatgtgtgtgtgtatatatatatgtgtgtatatatatgtgtgtg

SEQ ID NO: 19981 - DNA, 62 bp, Homo sapiens
gcatagtagtaagtctgtgtctgtatacatgtgtgtacatgcagtgatgccagtacctgtgc

SEQ ID NO: 19982 - DNA, 92 bp, Homo sapiens
gtttaggtctgttagctttttatttctttaaatgcacatgcgtaattcatgccgtgtacattttcatttaaacagaatggctgtatctagac

SEQ ID NO: 19983 - DNA, 69 bp, Homo sapiens
gagatgggctctcgctctgtcgctcaggcttaagtgcagcggtgcgattatagctcagtgcaggctctc

SEQ ID NO: 19984 - DNA, 58 bp, Homo sapiens; identical to SEQ ID NO: 879

SEQ ID NO: 19985 - DNA, 125 bp, Homo sapiens
ggatatatatatatatatgtgtgtgtgtatatatatatgtgtgtatatatatatatacatatatacacacacgtatatatgtgtatatatacacatatgtgtgtatacacacatacatgcatatg

SEQ ID NO: 19986 - DNA, 79 bp, Homo sapiens
caattgtatcctgagtgtgggttcatgtatcgaccatcatagtcaagatacagagcagttccatcaccaggagaatttg

SEQ ID NO: 19987 - DNA, 115 bp, Homo sapiens
ggaactctgagttgaagaattctatatccaaacttgatattctaggtccctctgaatatatatttttcaaggcaagaggatagagtatgttctatattatggtttcttagctgga

SEQ ID NO: 19988 - DNA, 78 bp, Homo sapiens
gctcccattccaactgtctctctatctgacccataggacttcaggtcaacagtagacaccacaggggcaatgatgggc

SEQ ID NO: 19989 - DNA, 58 bp, Homo sapiens
tgagatggagtctcactctgtcacccaggttggagtgcagtggtgcgatctcggctca

SEQ ID NO: 19990 - DNA, 104 bp, Homo sapiens
gcactcagggtcacaagggaggacccagattctgcctcagaactttgttattattattattatttttgagacggagtcttgttctgtcgcccaggctggagtgc

SEQ ID NO: 19991 - DNA, 116 bp, Homo sapiens
atgccgagttagcaggtgtaagccactgtgccccgccaaaaaatttagtttttttaaagtaagtattttaggctttgtgggccacagaaggtctctggctgtgtgtgtgtgtgcat

SEQ ID NO: 19992 - DNA, 58 bp, Homo sapiens; identical to SEQ ID NO: 1435

SEQ ID NO: 19993 - DNA, 59 bp, Homo sapiens
ggcttcatgcttacagagtttctttctttttttttgagagagagtctcactctgtggcc

SEQ ID NO: 19994 - DNA, 118 bp, Homo sapiens
gggtcaagattctactcaggtctgctgacttcacaatgtgtattctcttttgttatttgttttttttaagagacagggtttcactatgttggccaggctggcctcgaactcctgtcct

SEQ ID NO: 19995 - DNA, 80 bp, Homo sapiens
atagaattatctatacattctatatatagatatctgtatctatatagttatatctatatattgatatatatacattctat

SEQ ID NO: 19996 - DNA, 58 bp, Homo sapiens
tgagatagagtctccctctgtcacccaggctggagtgcaatggtgtgatctctgctca

SEQ ID NO: 19997 - DNA, 90 bp, Homo sapiens
ttgtggggcaagataacttctgtccttctgtccatttattttcttttcttttttttttttttttttcagagacggagtcttgctctgtag

SEQ ID NO: 19998 - DNA, 112 bp, Homo sapiens
tgggggcagatcccttatggcttggtgctgtcttcacaatagtgagtgaggtcttgggagatctggtagtttaaaagtgtgtggcacctccttcccgttgctcctgctttca

SEQ ID NO: 19999 - DNA, 149 bp, Homo sapiens
atatatatacacatgtatatatatttttatatatatatatatatataaaatgtatgtatatatgtgtgtgtatatatatgtatacatatatacgtatatatgtatacatatatatacgtatatatatgtgtgtgtgtgtgtgtatatat

SEQ ID NO: 20000 - DNA, 114 bp, Homo sapiens
ttggcaaaactaatcatcctttctggagcaaaatatcgattaatttttttgaattacaataaaataagattgactaatgggttaggaagattaggaagatgaagaaattgctgg

SEQ ID NO: 20001 - DNA, 91 bp, Homo sapiens
cagatgtgtaacaccacactgggctaatagattaatttttttttaagagatgagatcttgctgtgttgcccaggctggtcttaaactcctg

SEQ ID NO: 20002 - DNA, 60 bp, Homo sapiens
gaaataagtaaaattacattgttatttttctaaataataatgtttcattttactggtttc

SEQ ID NO: 20003 - DNA, 95 bp, Homo sapiens; identical to SEQ ID NO: 580

SEQ ID NO: 20004 - DNA, 93 bp, Homo sapiens; identical to SEQ ID NO: 69

SEQ ID NO: 20005 - DNA, 125 bp, Homo sapiens
gagggatgtgggcaggggtgctcagtgttttgaaggctttggggtctgctctgcctgtagacagtcacctcacagcatgagctgagggcctcagactgacccacctgagcacttgctcccagccc

SEQ ID NO: 20006 - DNA, 108 bp, Homo sapiens
ctagtatctgcctggctaattcaaacctatggatccccaataatgtctttttctttctttcttttttttaagacagggtctggctctgttgtccaggctggagtatag

SEQ ID NO: 20007 - DNA, 84 bp, Homo sapiens
gtaaaatgaaaagaagctcctctaatataggccctgtagtgataaactctcagtttttgttgtttagaagtatctttattttac

SEQ ID NO: 20008 - DNA, 83 bp, Homo sapiens
ggcctcccaaaatgctgggattagagacgtgagccacctcgcctggactaatttttctatttttagtagagatgggttttgcc

SEQ ID NO: 20009 - DNA, 110 bp, Homo sapiens
ggaggctctgtatgtttgtaattttggtctatattgctagatatttatttctctatagaaagaatgaatgtctaaatatgcctaatacctctcagcatgtcagacatttt

SEQ ID NO: 20010 - DNA, 92 bp, Homo sapiens
ctgtcatgcatatgtacacatatacatatgtcatacatatatacatacacacatatgtatacatatgtatatatgtatctgtgttaactcag

SEQ ID NO: 20011 - DNA, 97 bp, Homo sapiens
cagcttgggtgacagagcgaggtgcttaataattagtaatttattttaatttaactttaattttttttgagacagagtctcgctctgtcaccctctg

SEQ ID NO: 20012 - DNA, 118 bp, Homo sapiens
ggagcttgcttctgctggtgcccggagcggccggctggatcctgcactcactcgctcacaggctcccacccacaaggggttgaatgtggtgggccgagcaagtgttccctccggttgg

SEQ ID NO: 20013 - DNA, 113 bp, Homo sapiens
gttaagaactggatttgggaggccaaggtgggtggatcacttgaggtcagaagtttgagaccagtctgaccaacatagtgaaaccccatctctactaaatatgcaaaattagc

SEQ ID NO: 20014 - DNA, 80 bp, Homo sapiens
gtgtgtctgtgtatgtgtgtgtatatatatatacacatatatatgtgtgtgtgtatatatatatgtatatacacacacac

SEQ ID NO: 20015 - DNA, 117 bp, Homo sapiens
cactctggttgatattcaaggccttgaattactcttatttatttatttatttatttatttatttatttatttatttatttatttttgagacagagtcttgctctgtcgcccaggctg

SEQ ID NO: 20016 - DNA, 105 bp, Homo sapiens
agatcatttatgcctcctctcccatcacacatgatcagcccatttcagtctctgtttctgtccctgtgtttgtggaatagctctccctgaggctgccagtgacct

SEQ ID NO: 20017 - DNA, 81 bp, Homo sapiens
gcagaggaggaagcagctctgcttggagaggggaagaatttttttttttttttttttttttgagacagagtctcgctctgt

SEQ ID NO: 20018 - DNA, 96 bp, Homo sapiens
ctggtgttcaagcatttgaaaaggactttctctgtcagtgtttttgcggaagccaaatttgacagtgatcctaaactccaaattaaataatatcag

SEQ ID NO: 20019 - DNA, 79 bp, Homo sapiens
ggattacaggcgtgagctactgcacccagccccagattgatctggctggctggctggctggctggctggctatctatct

SEQ ID NO: 20020 - DNA, 116 bp, Homo sapiens
ggggttaggaacactcccaggaaatgttacctctgctcattttaagctgcctgtggatgactgtactctgtgagcagcaaaccatgagcaaatgttgggagagtgtttctggccct

SEQ ID NO: 20021 - DNA, 95 bp, Homo sapiens
tctatgttgctccttcctgagagaagatagtttcctctggttttgtctagaccacaagtggcttcagagaaacaggcttctaggtatagcatgga

SEQ ID NO: 20022 - DNA, 82 bp, Homo sapiens
ttagctgtttctctagacacaagctcatcagatcctttcaaacagctataaactaaggagttttctgaagaaagacagctga

SEQ ID NO: 20023 - DNA, 92 bp, Homo sapiens
gatcattcaaggaaatgtggagtccggcttcaggtttaaatatttaaatattcaaggaatcctagcaggttccaaatctagctgaatgtatc

SEQ ID NO: 20024 - DNA, 123 bp, Homo sapiens
tgtacatatatgaatatatgtacatatatgaatatatgtatacatatatgaatatatgtatatatatgaatatgtgtatatatacatatatatgtgtatatatattcatatatatatatatat

SEQ ID NO: 20025 - DNA, 73 bp, Homo sapiens
ttgtttttttgagacaaggtctcactctgtcacccaggctggagtgcagtgttgtgatcttggctcactgcaa

SEQ ID NO: 20026 - DNA, 70 bp, Homo sapiens
tctagatctagagatatctctatctctatagatatctctctatatatatatagatatctctagatctaga

SEQ ID NO: 20027 - DNA, 76 bp, Homo sapiens
tgtggtctctctctctctcaaaatacctcattatactgtactgttggtaagtgaaagtgaggaaagtgaaaccata

SEQ ID NO: 20028 - DNA, 92 bp, Homo sapiens
tgctcctccctttggcatgactgacactttcacaaattaggtcctctccagttcactgcatagtctctctctgtcatccaagggcttctgca

SEQ ID NO: 20029 - DNA, 73 bp, Homo sapiens
gggatgctcagtctgtaagaggaggagtcaggtttaaaacccaggctgtgagactcaagagtctgtgctttcc

SEQ ID NO: 20030 - DNA, 73 bp, Homo sapiens
cagtagcttggaatcatgttgccatctgtgtaagccacgctgagactctgagtggctcacatgcccatctctg

SEQ ID NO: 20031 - DNA, 114 bp, Homo sapiens
tatgtttgggacctttgaacctctctaatctagtcttgttctgtactgagagagctcagtggataaagcctctttctacgtattagctatatggttcagtcatttacagtcatg

SEQ ID NO: 20032 - DNA, 101 bp, Homo sapiens
ctctttccaatgtttttctacctctgttttgagtttttttttcatttgaagcttggaaaacagaaaagaggcaaaaaaggtacatatagcaatgtcaaggg

SEQ ID NO: 20033 - DNA, 95 bp, Homo sapiens; identical to SEQ ID NO: 68

SEQ ID NO: 20034 - DNA, 93 bp, Homo sapiens; identical to SEQ ID NO: 69

SEQ ID NO: 20035 - DNA, 82 bp, Homo sapiens
ttaatgagaggttgagatcacacttgtaacttagggttactgttttctgaggggtgctctgtgtaactcacttactgattaa

SEQ ID NO: 20036 - DNA, 104 bp, Homo sapiens
agagttacttgggaagctgaaccaaagatttttgctgctatgttgactcacagtagaatgtgagcagacaagacactgtagatgagccactcctgaggagctct

SEQ ID NO: 20037 - DNA, 88 bp, Homo sapiens
ttcatgaggactgctttcactctctccatctctggctctgaggaggctgggagcagaaaggaagcaaggctctttggaagcaagatgg

SEQ ID NO: 20038 - DNA, 86 bp, Homo sapiens
tgtaggtaaagaagggacccactctgtctgagtaactgactgcggagcccagcccagacagacacacatcccaagtctctgcttca

SEQ ID NO: 20039 - DNA, 58 bp, Homo sapiens; identical to SEQ ID NO: 2221

SEQ ID NO: 20040 - DNA, 116 bp, Homo sapiens
gcaactccttatctagatagaaaatttgtggcttttgggtatgtatattgtagatctatttatataatattcacacctgtaaaaatgtcatttaaaaatatttggataagtattgt

SEQ ID NO: 20041 - DNA, 95 bp, Homo sapiens
ggagctttgcaggggacagagaagaccctgagctcaggagaacgaagtgccatcttgagcctgtttccatcctgtgcctctctacctcaagctct

SEQ ID NO: 20042 - DNA, 81 bp, Homo sapiens
gtcaggattggggcagcagctggaggatgggggtgggcaaaaaggagtctctctcagcctcagtgagcaccgtggcctggc

SEQ ID NO: 20043 - DNA, 102 bp, Homo sapiens
tttctttggataccagaatccctttagaaattaattgatttgccttttacataaaaaagttttatttatttatgtttttgacgggtcaggtctctctaggaa

SEQ ID NO: 20044 - DNA, 83 bp, Homo sapiens
tgatattgtacagtgcaactgcaactgcaactgcaggcacaaagcattgcagaagcggggccaaagtaattgttgctttgtca

SEQ ID NO: 20045 - DNA, 58 bp, Homo sapiens
tgagccagagtctcgctctgtcacccaggctggagtgcagtggtgcgatctcagctca

SEQ ID NO: 20046 - DNA, 111 bp, Homo sapiens
ggcttaaaaagtctttctctcaatcaggcatttatatatatattaagtgtctgagaggatagattattattatatctaaatgtctgattgagaggattgattgattatatc

SEQ ID NO: 20047 - DNA, 101 bp, Homo sapiens
ggataatacaataatatattaatattaaattgcatattatattgtatattaatataatatatgcatagtatgctatatatgtatatatgtgtattatagac

SEQ ID NO: 20048 - DNA, 71 bp, Homo sapiens
tctgagaaatgtgtcataaggtgattttgttgttgtgcaaacagcatagagtgtacttacacaaacttaga

SEQ ID NO: 20049 - DNA, 72 bp, Homo sapiens
ctgggtgtggtggtgcacacctctagtcccagctacttgggaggctgaggtatgaggatcacttgaccccag

SEQ ID NO: 20050 - DNA, 58 bp, Homo sapiens
tgagatggagtctcactctgtcacccaggctggagtgcagtggtgtaatcttggctca

SEQ ID NO: 20051 - DNA, 159 bp, Homo sapiens
gtatatatatgtgtatatatgtgtatatatatgtatatatatgtatatatgtataggtatatatgtatatgtatgtatacatatgtgtatatatgtatatatatatacacgtatatatgtatgtatatatgtatatatatacctatacatatatatata

SEQ ID NO: 20052 - DNA, 112 bp, Homo sapiens
tggtgtcttggctatgagggctcttttttggttccatatgaaatttaaagtagttttttctaattctgcaaagaaagtcaatggtagcttgatgagaatagcattgaatcta

SEQ ID NO: 20053 - DNA, 66 bp, Homo sapiens
ttgagattgtctcactctgtcaccctggagtgcagtggtggctggagtgcagtggcccaatctcga

SEQ ID NO: 20054 - DNA, 103 bp, Homo sapiens
agatggcattttcaggatgccccataatgtgcacacatgtgtgcacacacgagtgtgtgtgtgtgtgcatgtgcttgtgtagtgtattaagactatgaaatct

SEQ ID NO: 20055 - DNA, 104 bp, Homo sapiens
aatgtgtatgcatgtgtgtagatgagatatggtgtatatatatatacacacacactatatatatatagttatgctttatacctacttatatatgtatatgtatt

SEQ ID NO: 20056 - DNA, 84 bp, Homo sapiens
gccaattatcccagcacaatttgttgagtagagtgtcatttccccactttatatttttgttagctttgtcgaagatcaattggc

SEQ ID NO: 20057 - DNA, 86 bp, Homo sapiens
tatatatatacacatacacatatatatgtatatatacacatacacatatatgtatatatatgaaaatgtgatatatatatatatat

SEQ ID NO: 20058 - DNA, 111 bp, Homo sapiens
tggcataatatttgcatataacctatgcacatcttcctgtatacttcatttttttttttattgttatactttaagttctagggtacatgtgcacaatgtgcaggtttgtta

SEQ ID NO: 20059 - DNA, 116 bp, Homo sapiens
tctgcatgtgtcagtgtgagttaaagggagagaaagagacagacagagacagagacagagagaatgtatgtatttgctggttcgttttctttttgtttagtttttctgtacaaaga

SEQ ID NO: 20060 - DNA, 58 bp, Homo sapiens
tgagtcggagtctcgctctgtcacccaggctggagtacaatggcatgatctcggctca

SEQ ID NO: 20061 - DNA, 95 bp, Homo sapiens; identical to SEQ ID NO: 68

SEQ ID NO: 20062 - DNA, 93 bp, Homo sapiens; identical to SEQ ID NO: 69

SEQ ID NO: 20063 - DNA, 72 bp, Homo sapiens
ccaggtgtggtcacatgcacctgtagtcccagctacttgggaggctgaggtagtaggatcacttgagcctgg

SEQ ID NO: 20064 - DNA, 68 bp, Homo sapiens
ctggggtggcatagtttgtggggtacacagaggtctgtgatacactcactctaacttctccttctcag

SEQ ID NO: 20065 - DNA, 101 bp, Homo sapiens
gtgttgtcagccagctatctacttgtgccccaggcaagcaattcacctgaacaggggcatacttgtctgggtcctggagccttagtaagtgcaatcaacat

SEQ ID NO: 20066 - DNA, 86 bp, Homo sapiens
tcctcattgactatgtctgtctctctcttcccgcagcttggccttggactcaggcacagtcacaggaagtgtgaagcagagcgtag

SEQ ID NO: 20067 - DNA, 94 bp, Homo sapiens
ggtcctaagtcatggtgagctagtatctttcttatttatttatttatttatttatttatttgagacagggtctgactccatcatcacccaggct

SEQ ID NO: 20068 - DNA, 107 bp, Homo sapiens
gccactttattttgttaaatctctgtgttcaaaacttataacattctgtaagtttctggtagaatgttctatggtaaagaaagagactcatttcagtctttggtggt

SEQ ID NO: 20069 - DNA, 120 bp, Homo sapiens
gcagaggtttgtagttctccttgaagaggtcctcacatcccttgttagctgtattcctagatattttattatctttgtagtgattgtgaatgagagttccttcatgatttggctctttgc

SEQ ID NO: 20070 - DNA, 91 bp, Homo sapiens
tagctcaggtaaaaatggtggctttacatttgttttaattgattaattaatttttttgagacagagtctcactgtgtcacccaggctggag

SEQ ID NO: 20071 - DNA, 58 bp, Homo sapiens; identical to SEQ ID NO: 8973

SEQ ID NO: 20072 - DNA, 95 bp, Homo sapiens
cacctcaccggcttaccacttttttatgaaatgttaagaagagagtagatcctaaaagttcccaccagcaaaaaaattggtaaatatgtgaggtg

SEQ ID NO: 20073 - DNA, 89 bp, Homo sapiens
ctccctttgtttatgggacagggctcaataatggggaagatcagggtcccacacactttctcagagcttaaactaagaggggaggggag

SEQ ID NO: 20074 - DNA, 100 bp, Homo sapiens
tgtttcttgcagtgtttttcatgtaaagggagttacatttttattttaaatggtgggctgaaaaaatatggtgaatgtactaaactctgaacaggagaca

SEQ ID NO: 20075 - DNA, 61 bp, Homo sapiens
tgagatggagtcccactcactctgtcgccaggctggagtgcagtggcagaatcttggctca

SEQ ID NO: 20076 - DNA, 162 bp, Homo sapiens
acatatacacatatatacacatacatatacacatatatatacacatatatacatatatatacatatatagtatatatacgtatatatatatgtgtgtgtatatatatatacgtatatatatatacgtgtatatatatatatgtgtgtatatatatatagaca

SEQ ID NO: 20077 - DNA, 132 bp, Homo sapiens
atatatatatatacacgtatatatatatacgtatatatatatacacacacatatatatatacgtatatatactatatatgtatatatatgtatatatgtgtatatatatgtgtatatgtatgtgtatatatg

SEQ ID NO: 20078 - DNA, 86 bp, Homo sapiens
tttaaccagttactctgttgattgatgcttatttataactttttattattataaatagcactgtgatcaacagatgtccagttaaa

SEQ ID NO: 20079 - DNA, 96 bp, Homo sapiens
gctcactgcaacctccacctcccgggttcaagcgatttttttttttttttttttaatgagacagggtctctgttgcccaggctggagtgcagtagt

SEQ ID NO: 20080 - DNA, 93 bp, Homo sapiens
ggtgggtgttttgttttgtttttgttttttttctgagatggagtctcgctctgtcacccaggatggagtgcagtggcatgatcttggctcact

SEQ ID NO: 20081 - DNA, 68 bp, Homo sapiens
gggtaaaagagcaaggctttttttcttttttttttttttttttgagacagagtctcactctgttgctc

SEQ ID NO: 20082 - DNA, 92 bp, Homo sapiens
aggttttcttctgccatctgtgacagcttcttgatctgtccccaggtgggtggctgtgttcgatgggtgttgctcatgacagttggggtcct

SEQ ID NO: 20083 - DNA, 82 bp, Homo sapiens
ctgggattacaggtgtgtgcctccatgtctggctaattttttttattttttgtaggtacatgggtctcgctctgttgcccag

SEQ ID NO: 20084 - DNA, 119 bp, Homo sapiens
ctgctgttaagtggcaggactggtggtgatgttagtgagattttgcagcggttattaaggattttttttttttttttgagatggagtctcactctgtcacccaggctggagtgcagtgg

SEQ ID NO: 20085 - DNA, 71 bp, Homo sapiens
ttgtttttgagatggagtctcactctgtcacccaggctggagagtgatggcacaatcttggctcactgcaa

SEQ ID NO: 20086 - DNA, 74 bp, Homo sapiens
gttgttttttgagacagagtctcgctctgtcgctcaggctggagtgcagtggcgcgatttcagttcactgcaac

SEQ ID NO: 20087 - DNA, 56 bp, Homo sapiens
gagacagggtctcactctgtcacccaggctggagtgcagcggtatgatcatggctc

SEQ ID NO: 20088 - DNA, 103 bp, Homo sapiens
agtacttttcaatgcataaagcactacagatctgtccacactgttgtgagtgagcaggttggcacggtgcctgtgtgcgggcgtgtgtgttgactcacgtgct

SEQ ID NO: 20089 - DNA, 58 bp, Homo sapiens
tgagacggagtctcactctgtcacccaggctggagtgcagtagtgcgatctcggctca

SEQ ID NO: 20090 - DNA, 108 bp, Homo sapiens
ccttggaaccagaaggtgtgtggtctgagaacgataaatgggctgctctctgcctctctcacagcagttctgcccctccttgggaccactcgttttctgcattcctgg

SEQ ID NO: 20091 - DNA, 108 bp, Homo sapiens
ttttaaagtagaaacagcagtatatgtttctgaggaaagtggtagatttgtatttgttttattattatgccttatacatgcataattgatgttctttatattttaaaa

SEQ ID NO: 20092 - DNA, 118 bp, Homo sapiens
gggaggtgagttggagtgggtaggcaaataggtgaaaagtgtgagtagtaagtgaggtgaccagaggatgaccatataaataaccatgctgacatggtttggctgtgttcccacccaa

SEQ ID NO: 20093 - DNA, 92 bp, Homo sapiens
gataagtgtgaggattgaatttttacggatgcgcttaaaatccagtggacaagccattgttgagtgaagattcagtcctcatctctcttatt

SEQ ID NO: 20094 - DNA, 180 bp, Homo sapiens
tgtatatttagtggggggaaatatatatatatatatatatacgtatatatatatatatgtatatatatatatgtatatatatatatatgtgtatatatatatatatgtgtatatatatatatatgtgtatatatatatatatgtgtatatatatataaaagaatcacccatatatatata

SEQ ID NO: 20095 - DNA, 92 bp, Homo sapiens
tttatttgaaagtaaagatgtaaacataatgcaaagatataaacatggtttgtattatatctttatagtttatatctttactaacaagtaaa

SEQ ID NO: 20096 - DNA, 84 bp, Homo sapiens
gcctttttgccacgacacagactcactcagtgattcgggctttcattagaggtttattagtgatggttgtggaaaatggtaggc

SEQ ID NO: 20097 - DNA, 95 bp, Homo sapiens
ctgacatacttaaggaactttactctttgttagcaatcattgttaatatttattgaatggtgactacgtgggaaatgctgttccaagtgtgatag

SEQ ID NO: 20098 - DNA, 90 bp, Homo sapiens
gtggtgcatgcctgtagtcctagcccctagagaggctgaggtggaaggatggcttgagcccaggagtttgaggttacagtgatgagctat

SEQ ID NO: 20099 - DNA, 99 bp, Homo sapiens
gaaggcagattaatttgtaatccctttgttccttttttatgattgtttctggtcatcttcagagaacacagagaggggcacatcaagataatctcgttc

SEQ ID NO: 20100 - DNA, 121 bp, Homo sapiens
ttccatacttctaaggaacttattttaaaaagcaagaaaggggcagcaaagtcacagaacaatgaaaggacacaatggccaccttcacttttgttgagactggagagatgggagtcgtaga

SEQ ID NO: 20101 - DNA, 112 bp, Homo sapiens
gtaaatagcatagtaaatgctcattcaatagttgtttaatgaattaagtaattatattgtttgtataattttgaggaactagaaagatgagtgaggcgatttcaatgtgtac

SEQ ID NO: 20102 - DNA, 113 bp, Homo sapiens
tcctaattgcgacaggatgacatcaggagagcaacatgatctcatagagattcttttaaatatatgaatttttaactttagagacagggtctcactgtgtcacccaggctgga

SEQ ID NO: 20103 - DNA, 116 bp, Homo sapiens
ctttttctttttgaaataaattgaagctttgtggcaactctgcattgagcaagtctgtgctcactttgtgtctctgtgtcagcagtttttagcaataaattattttttaatcaaag

SEQ ID NO: 20104 - DNA, 72 bp, Homo sapiens
tggagtggctggcatgtgaggctctaccttgcttggctcttaagcagaactgtctctcagtctgattctcta

SEQ ID NO: 20105 - DNA, 58 bp, Homo sapiens
tgagacggagtctcgctctgtcgctcaggctggagtgcagtggcatgatcttggctca

SEQ ID NO: 20106 - DNA, 178 bp, Homo sapiens
tatacttgtatatatacgtatatatgtatatatacacgtatatatgtatatatacacgtatatatttatatatacacgtatatatgtatatatacacgtatatgtatatatgtatatatgtatgtgtatgtatatatgtatatatatgtatgtgtatatatatgtatatatatgttac

SEQ ID NO: 20107 - DNA, 117 bp, Homo sapiens
agctaacatgcctttttatgaagagaaaagtcagccaggcaaagagaagtgagtgacctccaacatcccctgaatttttacagccctggctctacttcctggagaggcagtatggct

SEQ ID NO: 20108 - DNA, 96 bp, Homo sapiens
gagagaatgtatgattggaagtagaatgaatagtaataacttctgaatatgttccatatttttgtacgctctgcagtctccagtttcagttttctt

SEQ ID NO: 20109 - DNA, 58 bp, Homo sapiens
agctcttttttgggggagtggggggatacggtctcactctcactctgtcacccaggct

SEQ ID NO: 20110 - DNA, 73 bp, Homo sapiens
agttgggaccctccctccatgcgtggctgctcctctatggttccactactgtctgtgtctgagtgttctggct

SEQ ID NO: 20111 - DNA, 91 bp, Homo sapiens
actgtttgtgacatgtaactggagccatctgaaagctaattggatgtatggtttagcagctcagtagagactttgggagtgatatagcagt

SEQ ID NO: 20112 - DNA, 95 bp, Homo sapiens; identical to SEQ ID NO: 68

SEQ ID NO: 20113 - DNA, 93 bp, Homo sapiens; identical to SEQ ID NO: 69

SEQ ID NO: 20114 - DNA, 91 bp, Homo sapiens
gaattgatcattggattgttaaccagaggtcactggtgactgataaatttcagtggagtgatcaaggtgaaagcaagattggagagtgttc

SEQ ID NO: 20115 - DNA, 116 bp, Homo sapiens
gggaactctggaagtttttttgggtacaggacccaggtctgtcaaacactgattctcactggctcagcacactccagtccctgcctccttgtgtccctgcctgctcctgctgtctt

SEQ ID NO: 20116 - DNA, 95 bp, Homo sapiens; identical to SEQ ID NO: 68

SEQ ID NO: 20117 - DNA, 93 bp, Homo sapiens; identical to SEQ ID NO: 69

SEQ ID NO: 20118 - DNA, 95 bp, Homo sapiens; identical to SEQ ID NO: 68

SEQ ID NO: 20119 - DNA, 93 bp, Homo sapiens; identical to SEQ ID NO: 69

SEQ ID NO: 20120 - DNA, 81 bp, Homo sapiens
gcaaaattatatatatgtgtgtatatatatacatatgtatatataatacacgtgttagtatgcatacatatatttccttgc

SEQ ID NO: 20121 - DNA, 100 bp, Homo sapiens
atacaactttgcaggaaaaaaacagtatttatttcaattttatggtgaaaatttctgtttgtccattattaagatttatggtgattttcctgttctgtat

SEQ ID NO: 20122 - DNA, 60 bp, Homo sapiens
tgtttatctgcctctttgtctgtctctgaaagacagagacagagacggagacagaaagca

SEQ ID NO: 20123 - DNA, 81 bp, Homo sapiens
tctctatatatatatatgaatccttcttatatatatgataagccttcttatatatattttatgtgtgtgtatatatagaga

SEQ ID NO: 20124 - DNA, 115 bp, Homo sapiens
agagaccaacatggtcaatggatgtttaattctgataaggtttcaatttatgaatatatacataattctttggtttgagattttatttacctcttattgttcttcatggtacttt

SEQ ID NO: 20125 - DNA, 95 bp, Homo sapiens; identical to SEQ ID NO: 68

SEQ ID NO: 20126 - DNA, 93 bp, Homo sapiens; identical to SEQ ID NO: 69

SEQ ID NO: 20127 - DNA, 114 bp, Homo sapiens
ggtagggaaggtaatttgccttcgtgaggttaacatcaagtgtttttatttatttcctgacagtaattagaagatgggatgaatagtttttataaggtatttgtgtttctagct

SEQ ID NO: 20128 - DNA, 76 bp, Homo sapiens
gtatatgtatgtatacatatatgcatatgtatatgtatgtatacatatatgcatatgtatatgtatatatatcaca

SEQ ID NO: 20129 - DNA, 94 bp, Homo sapiens
atatatacacatatatatgtatatatgtatatatacacatacatatatacatgtatatgtatgtatacatatatgcatatgtatatgtatgtat

SEQ ID NO: 20130 - DNA, 112 bp, Homo sapiens
tatatatatatatatatatatatatatatatacacacacacacacacacacacacactcacatatacatatatgtgtgtgtatatatatgcatatatatacatatgtgtgtg

SEQ ID NO: 20131 - DNA, 96 bp, Homo sapiens
gtggcttatttgtccccctgttgaattcagtgaaggcagtgtgcacagacaagacacaggctttgagaggacaaaagatggggttcagtcacctac

SEQ ID NO: 20132 - DNA, 83 bp, Homo sapiens
tgtgtgattttttttttttttgagatggagtctagctctgtcacccaggctggagtgccatagtatgatctcagctcactgca

SEQ ID NO: 20133 - DNA, 123 bp, Homo sapiens
ggtcttggagaacagctggacagggaaggggcttggctgttctgctggctgctcagggtcctggcttctgtggccctccattcttcattgtagaaggcatcggagcctttggcctgacacgtc

SEQ ID NO: 20134 - DNA, 115 bp, Homo sapiens
cttttgaaaagtgtctgtttatgttctttgcccactttttatagggttgttttttttttcttgtaaatttgtttaagttccttatagatgctgaatattagaccgttgtcgaagg

SEQ ID NO: 20135 - DNA, 113 bp, Homo sapiens
atataagtataccttgttttattcacgttgtcttattgcacttcacagatatattatttttattttaagatcaaggttacaagtgcaggtttgttacataggtaaacttgtgt

SEQ ID NO: 20136 - DNA, 111 bp, Homo sapiens
tgaatattgaaccaaccttgcatacttagaataaattccacttggtcatggtgtataattctttttatatgctattggatttaatttgtagtatcttgtgggaaatattta

SEQ ID NO: 20137 - DNA, 82 bp, Homo sapiens
gtgcatgtatatgtgtatatatatgtgtgtgtgtgtgtatatatacacacatatacatatatatgtgtatcaagacatacat

SEQ ID NO: 20138 - DNA, 98 bp, Homo sapiens
tgcttatttgctacaagagaataaatacaactgtttgagaaaaatttttatttttccatcagtttatctgtttagtcactctctgtagaagctgagca

SEQ ID NO: 20139 - DNA, 105 bp, Homo sapiens
tgtgatgggaaagagggattcaaaggaatttggaaggaacataatggaggaacaaggatgaatagttcaattagatcctggcaaaggaatagctctttggttaca

SEQ ID NO: 20140 - DNA, 107 bp, Homo sapiens
cagcaaaagaaactgttgtcagagtgaacaggaaacctacggagtggtagaaactttttttgttttttctttgagactgtctcactctgtcacccaggctggagtgc

SEQ ID NO: 20141 - DNA, 133 bp, Homo sapiens
actcttgaaacacccagtgggaaatttagaggagtctgtgatacgtgggggagtattggagctttgcatttctgtgttttcttacttcctttagagctcacagggatttcctaagcagtctcttctgtgccca

SEQ ID NO: 20142 - DNA, 113 bp, Homo sapiens
ggcctcccaaagtgctgggattacaggagtgagtcacctcatctggccccttttttttatttttaattttttttagagatggggtctcactttgttgcccaggctggaacgct

SEQ ID NO: 20143 - DNA, 119 bp, Homo sapiens
gcactccagcctgggcaagaagagcaaaactccatctcaaaaaaaaaaaaaaaaaaagcaaatttgatttttttttttttttgagacagagtctcgctctgtcgcccaggctggagtgc

SEQ ID NO: 20144 - DNA, 58 bp, Homo sapiens
tgagacagagtctcactctgttacccacgctggagtgcagtggtgcgatctcggctca

SEQ ID NO: 20145 - DNA, 84 bp, Homo sapiens
gcaacagagtgagagcttgtctctattatttatttatttatttgtttgtttattattttttgagacagagtctcactctgtcgc

SEQ ID NO: 20146 - DNA, 76 bp, Homo sapiens
atatagatttatccgtgtgtgtgtatatatacatatatacatctgtatgtgtatatatacatatatacatctgtat

SEQ ID NO: 20147 - DNA, 68 bp, Homo sapiens
atacagatgtatatatgtatatatacacatacagatgtatatatgtatatatacacatacagatgtat

SEQ ID NO: 20148 - DNA, 124 bp, Homo sapiens
atacagatgtatatatgtatatatacacatagagatgtatatatgtatatatacacatacagatgtatatatgtatatatacacatacagatgtatatatgtatatatacacatagagatgtat

SEQ ID NO: 20149 - DNA, 114 bp, Homo sapiens
catgcatcacacttatttttaccactctttagtcttctctaatctggagcagtccctcagtctctccctgtggtgtaagatcatgatgagttagagtataggtggccgtgcgtg

SEQ ID NO: 20150 - DNA, 76 bp, Homo sapiens
tatgtatatatgtgtgtgtatacatatatgtatatacatgtgcatgtgtgtgtgtgtatatatatatatatgtatg

SEQ ID NO: 20151 - DNA, 84 bp, Homo sapiens
tcccacctcagcctccagagtagctgggattacaggcacctgccatcatgcccggctaatttttgtatttttgtagagatgggg

SEQ ID NO: 20152 - DNA, 72 bp, Homo sapiens
gggaagaccaagctcgccgacctctaagatcctgtccactctgagagtctgtgagtctgtatttctgctccc

SEQ ID NO: 20153 - DNA, 70 bp, Homo sapiens
agcctccccagagcctggattaattatatttctaatttattagaaatataatttctgttcatccagggct

SEQ ID NO: 20154 - DNA, 114 bp, Homo sapiens
cattgaggtgagagaaagtcagactggggaaagggtaaagctgaaaagtcatattgatgttcattctttgccaaatgcaccactcccttcctgttgtagcttcctaatgcagcc

SEQ ID NO: 20155 - DNA, 119 bp, Homo sapiens
atgttttcatgcatttattggccgtgagtgtatctagtgtatctttttttttttttttttttttttttttttctgatgcagggtctctttctctcacccaagctggagtgcagtggcat

SEQ ID NO: 20156 - DNA, 58 bp, Homo sapiens
tgagacggagtctcactctatcactcaggctggagtgcagtggcgtgatctcggctca

SEQ ID NO: 20157 - DNA, 116 bp, Homo sapiens
gtagccagtgtccttacacattctgcgatctttcgggataattgttatcttcaaatttttgtaattattttgtaatattggtgctttggaagaatgaagaaataaggaaggtgatc

SEQ ID NO: 20158 - DNA, 81 bp, Homo sapiens
aatgtgaaggttttaagagagagacttgagtgtgagttaaattcacatgaaagtctttaatatttttttaaaaagaatatt

SEQ ID NO: 20159 - DNA, 114 bp, Homo sapiens
agtctaaatcattaaataaatcatactattaaaggctatttagttgaagatctggattccagtctcacactgcctctgactttggggtgaatttagacaagatgacatggcttt

SEQ ID NO: 20160 - DNA, 93 bp, Homo sapiens
tgtgtgtgtgtattatatatatgtatatgtgtatatagatgtatatgtatatatgtataggtgtgtatatatatgtatacatgtatatatatg

SEQ ID NO: 20161 - DNA, 87 bp, Homo sapiens
tatcatagttatgtagagttgcttatggaatgtaaaataattagccatattataacattcataggaaattctcttgtaactcagata

SEQ ID NO: 20162 - DNA, 60 bp, Homo sapiens
catgaatggcttggtgttgccctcatggtaatgagtgagttctcactctgtgagttcatg

SEQ ID NO: 20163 - DNA, 116 bp, Homo sapiens
taaaattgaaaatggtttgttttctagatgtaggtatctttttatgctttttttcttgcaacaacagtatttttatctatatctcgagttttacaataaatcacaaatcagtttta

SEQ ID NO: 20164 - DNA, 119 bp, Homo sapiens
aggctgatatatatgagttgcttcaccagggttatcttgctttctggtttcttactggtgacagttgagagaaagcactggcaggagatcccagggtagagaaagttattggttttcct

SEQ ID NO: 20165 - DNA, 118 bp, Homo sapiens
gtctgggattgtaaagtaaagaagcaccagcacctcctttgaattgttttgttttatttttccaattcagcaaacatttcctggtcatctgcccttttagagctttgccacttagccc

SEQ ID NO: 20166 - DNA, 101 bp, Homo sapiens
aataaagtatagttaagccattatatatacgtgtatataaatgtatatgtgtatagtttatgtgtatatgtttatgtatctatatcttcactgtctctatt

SEQ ID NO: 20167 - DNA, 125 bp, Homo sapiens
catatatatatatgtgtatatatatatatgtgtgtgtgtgtgtgtatatatatgtgtgtgtgtatatatatatatacatatatatgtgtatatatatatacatatatatatatatgtatatatat

SEQ ID NO: 20168 - DNA, 66 bp, Homo sapiens
tttacttctgcagaagtgtgctgctcccatgtctgactgctgagagagcacactgagctgggtagg

SEQ ID NO: 20169 - DNA, 103 bp, Homo sapiens
ctgctggagaagctgaaggtctgtttgtgggagaagtttctgacttgacctggagctgagtcaagttagagagctgagtgaaatacaggggtagaagaagcag

SEQ ID NO: 20170 - DNA, 118 bp, Homo sapiens
aataaactgtttttataattttcctggtttgggctttattattgctaattttgccattttatatctttgtgttatctgtgataaaagctatgtaaccaggatgcatttcactgttatt

SEQ ID NO: 20171 - DNA, 113 bp, Homo sapiens
gcaattgctttgctgtatggtaattgcatgtttagttttttaattttagtttttagttagaaactacctgtattgtgactataatattttacatttccatcagcagtgtatgt

SEQ ID NO: 20172 - DNA, 109 bp, Homo sapiens
tgcttaggattgtcttggctatacgggctctttttggttccatatgaaatttaaagtagatttttctaattctgtgaagaatgtcagtggtagtttgatgggaacagca

SEQ ID NO: 20173 - DNA, 96 bp, Homo sapiens
tccctgtaacttactgtggatagtaaaatttttttatttccttacgttattatacatatgactaagagtaaaatactatccatcctctaataggga

SEQ ID NO: 20174 - DNA, 113 bp, Homo sapiens
atcatttcttgccggaattgtagctatgtttgtgcatctggtaatgctcataaattttattattgtttattgctattttgtaaaacaccctacttaaccctctaggaaaaggt

SEQ ID NO: 20175 - DNA, 100 bp, Homo sapiens
ttgcagttatttattttgtgtttctaaatgtatatatatatatacacacagatatatatatatatatataaagtagcgatcagcacattaaagtatgtaa

SEQ ID NO: 20176 - DNA, 89 bp, Homo sapiens
tatatagtatatctatagcatatatatagtatatatatagtatatatatactatatatatacacactatatatatagagatagtatata

SEQ ID NO: 20177 - DNA, 88 bp, Homo sapiens
gtaccacatcgagggccttggtgagcctctgagatttgctgacttcagatgagactcagcacattaccagctgtggtggctatggtgc

SEQ ID NO: 20178 - DNA, 121 bp, Homo sapiens
tgtgtgtatgctactgtgatacacacatacacatgtgcatacatatgtgtgtatatatatgtatctgcatatatatgtgtgtgtttctgtgtgtgggggtgtgtgtgcataaaatatacac

SEQ ID NO: 20179 - DNA, 89 bp, Homo sapiens
tatctttgcttctgcttcacagtaactctggacaatttatctttaaattagtctcagttttacagagaagagtgacaggtcagagggta

SEQ ID NO: 20180 - DNA, 62 bp, Homo sapiens
tgagacggagactcactcagtctgtttcccaggctggactgcagtggcacaatcttggctca

SEQ ID NO: 20181 - DNA, 56 bp, Homo sapiens
gagtcatagtctcactctgtcgcccaggctggagtgcagtggtgcgatcttggctc

SEQ ID NO: 20182 - DNA, 109 bp, Homo sapiens
tgcttaggattgtcttggctatacgggctcttttttggttccatatgaaatttaaagaagttttttctgaatcatgaagaaagtcagtggtagcttgatgagaatagca

SEQ ID NO: 20183 - DNA, 56 bp, Homo sapiens
tgtgcatctgcatgtatatgtgtgtgtacagatgcaaacacagacacacgtgcaca

SEQ ID NO: 20184 - DNA, 75 bp, Homo sapiens
catacatgacacagagacacacacacatatatgtgaatgagtggatggatgtgtgtgtgtgtttgtgtgtgtgtg

SEQ ID NO: 20185 - DNA, 57 bp, Homo sapiens
tgagcagagtctcactctgtcacccaggcgggagtgcagtggtgtgatcttggctca

SEQ ID NO: 20186 - DNA, 107 bp, Homo sapiens
ttggatctcatgcaacatttcatcatggcaagaagtttgttggacaacattattctagacatacagcatcttcaagtggtggaaaaaggtgtagttgctggaactaa

SEQ ID NO: 20187 - DNA, 114 bp, Homo sapiens
gagtttacaaagtgattaagtcatgggggcactttcttcatggattgtcattatcacagaagtgagttatctcaggagtttggccctctttttctctgtttcatgctctcactc

SEQ ID NO: 20188 - DNA, 108 bp, Homo sapiens
aattttgtttgttcctgtcaacatttgaggatagggtctctgtctttcagtctctgtgggaggatagaattctaccctcgataattgccacttagcagatgtgtgatt

SEQ ID NO: 20189 - DNA, 117 bp, Homo sapiens
ggagcacaagtgggttttggttacatggatgaaatatacatataaatatacatatatatatatatacatatatatatgagattttagtgcacccatcaccggatatgtatgtgtacc

SEQ ID NO: 20190 - DNA, 82 bp, Homo sapiens
gagactacattatatacatgtggaattcttttttttttttttaatagagtcagggtctcactatgttgcccagtctggtctc

SEQ ID NO: 20191 - DNA, 117 bp, Homo sapiens
gttttctggctcgtaatctggtgatatttagctacttagatactgtttagatattcagattctcagtgagtgactcacaagattatgtctgcgaactgtggctagatttcattttga

SEQ ID NO: 20192 - DNA, 68 bp, Homo sapiens
gtgtgtgtgtacatatacgtatgtatataaagtgtatatatatataaactgtatgtgtacacacacac

SEQ ID NO: 20193 - DNA, 104 bp, Homo sapiens
gcttaaatgttaacaacctattgtctgattttttttttttatggaattttaggcactgttgccaaccctcgtggaaaagatctgtttgtgttagctattcaggc

SEQ ID NO: 20194 - DNA, 77 bp, Homo sapiens
ttttcagagaaaaagttggcttttttttttcagaattctattgttcttatattgaaaaggttttttttttttgaaaa

SEQ ID NO: 20195 - DNA, 90 bp, Homo sapiens
aggatcagttgaggaggcagctgatgttacagaagagctgaccctcactcactgtcactgaggcagctaagcttgactcccttgcttttt

SEQ ID NO: 20196 - DNA, 86 bp, Homo sapiens
cctaggcttgtgtgtgttggggtggggggaggttatttatttttttatttttagaaagagtcccactctgactcccaggctggagg

SEQ ID NO: 20197 - DNA, 108 bp, Homo sapiens
tctcttgtctgattgctctggctgggacttgaagtactatgttgaatagaagtcatgagagtaggcatctgtagacttccagtactatgttagataacagtggtgaga

SEQ ID NO: 20198 - DNA, 60 bp, Homo sapiens
aagattcattgctatggaatgaatcttgctaacaggattcattgatatggaatgagtctt

SEQ ID NO: 20199 - DNA, 110 bp, Homo sapiens
tcttttgggtttaccatgaagaattaggtttctattaagcatattcaagttgaaatttcatttattttatgtcttttattgatcacattctgactggtaaacttcagtga

SEQ ID NO: 20200 - DNA, 104 bp, Homo sapiens
cgagtagctgggactacaggcgtgcaccaccatgcccagctaatctttgtatttttaataaagatggggtttcaccatgttggcctgatggtctcgatctcttg

SEQ ID NO: 20201 - DNA, 106 bp, Homo sapiens
tttatatattatagatgcaacttatgtgatatacatttagtaaatattttctattcttttatttttattatctatgttatattatataaggtatataatatataaa

SEQ ID NO: 20202 - DNA, 63 bp, Homo sapiens
tgaggcagagtctcgctctgtcgctcaggctggagtgcagcagggcgatctcggctcactgcc

SEQ ID NO: 20203 - DNA, 89 bp, Homo sapiens
ggtgggctgcacccactctccttcactcactgtctgacaagccccagtgagatgaacccggtacctcagttggaaatgcagaaatcacc

SEQ ID NO: 20204 - DNA, 95 bp, Homo sapiens; identical to SEQ ID NO: 68

SEQ ID NO: 20205 - DNA, 93 bp, Homo sapiens; identical to SEQ ID NO: 69

SEQ ID NO: 20206 - DNA, 101 bp, Homo sapiens
ttatatggtcatatttagctgttttgttttttgaattatctggacaactgacaaatttccactctgattcactgtgacaatagactgcataggtcatataa

SEQ ID NO: 20207 - DNA, 73 bp, Homo sapiens
ggggtgctcctggcactcagtggatagaggatagggatgttctaaacatcctacagtgcacaggacagtcccc

SEQ ID NO: 20208 - DNA, 80 bp, Homo sapiens
tggatgtgtatatatatgtgtatgcacgtggatgcatgtagatagatatttatgtatatatccatatatatacacacaca

SEQ ID NO: 20209 - DNA, 125 bp, Homo sapiens
gaagttgcattctattaaatgtcacaggcatatatagcactagaaaacatgacctgtgtttttttttttgtttttttttggtgagaaaatgtctgaaaatactgagttgtgtgatttctaaggtt

SEQ ID NO: 20210 - DNA, 80 bp, Homo sapiens
gtctgtcaggaggtgtgaggggggaactttaaagtcctttttgaatttttgagattctgtaattctgtctcctactgaca

SEQ ID NO: 20211 - DNA, 117 bp, Homo sapiens
tcaggagtcatatttgtcatacagttgtacttaaaatgttgttttattttatttctttcaagaatagagttgagggaattagaggcattggtagtacattgagatgtttcttggatt

SEQ ID NO: 20212 - DNA, 115 bp, Homo sapiens
tcatttattagctgtcagatttcactggctcttgggtccaaatgttatatattcttttttttaaattcgatgcctttaggagtcattttgttgtcatctcagtgctttaatgaat

SEQ ID NO: 20213 - DNA, 68 bp, Homo sapiens
tcctgaagtgttgggattacaggcatgagccactgctcctggcctgtatttgtatttgtatttctaga

SEQ ID NO: 20214 - DNA, 111 bp, Homo sapiens
cagatttgtaataattttggtcagggtttaacacagaattttgagagcagtgagttatgccttatcttcaaaataaaggtaagaccagaacgaagtgataatacatttctg

SEQ ID NO: 20215 - DNA, 75 bp, Homo sapiens
atgccaaactctgtttcagcttctgcttttggacaacccaacatgcaacagaagcaagttgaaagcagaaagcat

SEQ ID NO: 20216 - DNA, 119 bp, Homo sapiens
tgcttaggattgtcttggctatacaggctctttttttggttccatatgaaatttaaagtagttttttctaatttggtgaagaaagtgaatggtagcctgatggggatagcattcaatct

SEQ ID NO: 20217 - DNA, 69 bp, Homo sapiens
tgtgacagagagggaacaggtggtacttcaatttggctggtcaggcctctctctctctctctgatgaca

SEQ ID NO: 20218 - DNA, 161 bp, Homo sapiens
tatgtatgtgcatatgtatatatgtacatatatgtatatatacatatgtatatatgtatatatgtacatatatgtatatgtacatatgtatatatgtacatatatgtatatatacatatgtacatatgtacatatgtacatatatgtatatatacatatgt

SEQ ID NO: 20219 - DNA, 68 bp, Homo sapiens
gtgtgtgtgcgtgtgtgtgtgtgtgtgttttaggagagggccaggcacggtgacttacgccaagccgc

SEQ ID NO: 20220 - DNA, 105 bp, Homo sapiens
tgtgtgcacaaatgtatgaatgtgtgtgagagtgcaagagtatggatgtgtgcatgtgcatgtgtgtgcacaaatgtgtgtgagaatatgccgaagtgtatatgt

SEQ ID NO: 20221 - DNA, 132 bp, Homo sapiens
gtatatatatactatgtatatatagtatatatatttactatgtatatatatatagtatatatatttactatgtatatatatacatagtatatatatcctatgtgtatatatatacatagaatatatgtatac

SEQ ID NO: 20222 - DNA, 65 bp, Homo sapiens
ttgaggtagagcctcactctgtctcccaggctggagttcagtggtgtgatcttggctcactgcaa

SEQ ID NO: 20223 - DNA, 75 bp, Homo sapiens
ggcatagtggtgtgagcctgtagttccagttacttgggaggctaaggtaggaggatctattgagctcaggaggtc

SEQ ID NO: 20224 - DNA, 70 bp, Homo sapiens
tgtttacacacctgtgtgtgtatatgtatgtgtatgtatgtttatccacacatatacacattgttaagca

SEQ ID NO: 20225 - DNA, 75 bp, Homo sapiens
tcccagtttagcttctgatttcactgtggcatttaaggcactcagtgtctcagtgtttcccaggtaaatgacgga

SEQ ID NO: 20226 - DNA, 63 bp, Homo sapiens
ctgagaaatgaaggcttattggattctggtctcctaaacagaagaatgtgagctttccatcag

SEQ ID NO: 20227 - DNA, 117 bp, Homo sapiens
tcattagagcatgttttgggaagactgaggattcagagttaaatctcaagattaaacgtctttttatatgttttttaatacttggcggcttagagttcacagtttccatgctaatgg

SEQ ID NO: 20228 - DNA, 93 bp, Homo sapiens; identical to SEQ ID NO: 69

SEQ ID NO: 20229 - DNA, 113 bp, Homo sapiens
ggaatgaaattaaagggtgggaaggaaaggttttcacatatgatcagagaacagagataccactgtgtggtcaccaacaaactttgtccccttcttcctctccctctctctcc

SEQ ID NO: 20230 - DNA, 109 bp, Homo sapiens
ctgttttcttgaaatgttggtacttttaagaagcgatgtaaaaattatttgaatcagatgtatttattttgttttagataatagacagccaacaagatgagattgacag

SEQ ID NO: 20231 - DNA, 115 bp, Homo sapiens
gtaaacatttgcctatggttctatgtggacgtgtttttagttttatttgagtatttatttttattatttatttatttagagaaaacagtctgtactgtcgcccaggctggagtgc

SEQ ID NO: 20232 - DNA, 75 bp, Homo sapiens
tctccattcctggcatttattttattttttcctttctttctaaatccgagagaggaaatggagtaccactggagg

SEQ ID NO: 20233 - DNA, 115 bp, Homo sapiens
ttggccagaaaactgaatgtttgagagtaggttctttggtttaaataaagcaacaatattttattatttgttgcttctttttatgtttggtgctttcattttctctccaatattt

SEQ ID NO: 20234 - DNA, 115 bp, Homo sapiens
ttgcggcaccgagcacttgtttctaacactggttttttgtttgagtttttttgagacaaagtctcactctgtcacccaggctggtgtgcaatggtgtgatcttggctcactgtag

SEQ ID NO: 20235 - DNA, 99 bp, Homo sapiens
gagctctgttcttggtcaagtaatttaacctctttgtactttagttctttatttatagatggtagcaggtcagaggttatacaaagaacttttttgctt

SEQ ID NO: 20236 - DNA, 80 bp, Homo sapiens
tttccaaacagttataatcagccactggttgaattcacagttggttgaattcatggttggttgaatctgcagatgtgaaa

SEQ ID NO: 20237 - DNA, 88 bp, Homo sapiens
gtgcttaatgttttattttataaattgtttaatgctgcaagcattgaggataaagcaatgatttatatagtagcagcatttgttgcac

SEQ ID NO: 20238 - DNA, 58 bp, Homo sapiens; identical to SEQ ID NO: 9211

SEQ ID NO: 20239 - DNA, 85 bp, Homo sapiens
tccagctctctgggcatcctttagcacagtcttttttttttttttttttttttttttgagacgaagttgtgttgcccaggctgga

SEQ ID NO: 20240 - DNA, 58 bp, Homo sapiens; identical to SEQ ID NO: 303

SEQ ID NO: 20241 - DNA, 70 bp, Homo sapiens
catggtgttccctctgtctgtgtgtgtcctgatttccagcaccttgggaggccaaggcaggtgggtcatg

SEQ ID NO: 20242 - DNA, 114 bp, Homo sapiens
actgagataaatgtttgttgtttcttttaagagatgaaagaaaatgctgctaaatgtatttgcatattttaattattttttacatagaaaaaagactgaatatgaaaactaggt

SEQ ID NO: 20243 - DNA, 105 bp, Homo sapiens
atctttccaaccttatcaagactcctccaaatttaattatatatttactgacaatcaggagtgagtgaggtaaggcaatggaggttctagatataaagaaaagat

SEQ ID NO: 20244 - DNA, 114 bp, Homo sapiens
actccatctcaaaaaaaaaaaaaaaaaacccacacacaaaaaaacaataaagtaggtttttatatgtctttattttgtttgtttgtttatttatttattttttagagatagagt

SEQ ID NO: 20245 - DNA, 118 bp, Homo sapiens
tatagacattagatgaggacatggggcacacatctatctaccacatgccgccacagctgaaatgtgtctgtgtgtctcagagaaatggctgcctcctgtcttgcatagcaagcatgta

SEQ ID NO: 20246 - DNA, 83 bp, Homo sapiens
gacaggaggcagccatttctctgagacacacagacacatttcagctgtggcggcatgtggtagatagatgtgtgccccatgtc

SEQ ID NO: 20247 - DNA, 97 bp, Homo sapiens
tactggcctcccttgaaataagcataagaaattggaattcaaaatatactattttgaaatatatttaactttactgtttatttccaactgccaagta

SEQ ID NO: 20248 - DNA, 129 bp, Homo sapiens
caagtccctgctttcagttcttttgtgtatataggtagaagttgaattgatgggccgtatgctaattctatgtttaatttttctaggaacatagacagatacttttattagtttcttgtttactgtata

SEQ ID NO: 20249 - DNA, 100 bp, Homo sapiens
ttctccagatttctttatccctggctttctttcctccccacatatctgagtgttgtgtgacagcaggcccagaagtcagaagtaactggacactgatgaa

SEQ ID NO: 20250 - DNA, 118 bp, Homo sapiens
tgtgtgtgtgtatatatatatgtatatatgtgtgtatacatgtatatatgtgtatatatgtgtgtatatatgtatatatgtgtatatatatgtgtgtgtgtgtatatatatatatata

SEQ ID NO: 20251 - DNA, 90 bp, Homo sapiens
gagtgagaacatgtgtttggttttctgtcctcctgttacttatttataatttaattctattgtggtcagaaaacctactttgtgtaactt

SEQ ID NO: 20252 - DNA, 94 bp, Homo sapiens
tgaaaatagggtgaaatttttgattgagctagttggttgatttcttgcttgctaaagatttgactgattgcttaagtttcctgacttattttta

SEQ ID NO: 20253 - DNA, 105 bp, Homo sapiens
cttttgttaactggatggagtttgtctgcctgactctctctaacatcaggatgagttcactgctgacaagctgccttgcccgtcaatcaaggagatttcctggtg

SEQ ID NO: 20254 - DNA, 60 bp, Homo sapiens
gatttggaagcttatctgtagaacttaagacattattttttttggataagctttctggtc

SEQ ID NO: 20255 - DNA, 86 bp, Homo sapiens
accaattgaagtgaaaaagtgcctgaggttttcaacagagctgtggttataggttgaaaacatcagacttgtcactgttaaaaggt

SEQ ID NO: 20256 - DNA, 110 bp, Homo sapiens
ctgtatcacattttggtaattcttgcactatttcaaaattttaattgttattaaacaataacaatggtaatctgtaatcagtgatctttgttataatgatctgtgatcag

SEQ ID NO: 20257 - DNA, 77 bp, Homo sapiens
acagatttttctctatgctcccactggccttgtgatgtaactttcagaggacagtgtgagcagatagaattgcatgt

SEQ ID NO: 20258 - DNA, 81 bp, Homo sapiens
ttgctgcatgacttgtcatatacttgatataaattatgcaattttatataagttatattaagtttgccaagtcattatcaa

SEQ ID NO: 20259 - DNA, 67 bp, Homo sapiens
atgcatactcaagtctgtgtcctctgaggagaaatatcagaggctacacgctacaaggtaaatgtat

SEQ ID NO: 20260 - DNA, 80 bp, Homo sapiens
gctctggaagctgggaagtataagatcaaggcaccagcagattctatgtctaatgagagcctgctttgtggtttatagac

SEQ ID NO: 20261 - DNA, 100 bp, Homo sapiens
tatatatatacgtgtgtgtgtgtgtatatatatatgtatatgtgtgtgtatacatatatatatacatatatatacacacacacatatacatatatatata

SEQ ID NO: 20262 - DNA, 88 bp, Homo sapiens
tgtatatatgtgtgtgtgtgtatacatatatatatgtatatgtatgcacatacatatatatatgtatacacacacacacatatgtata

SEQ ID NO: 20263 - DNA, 97 bp, Homo sapiens
tacttctcaaattttgtttttatagcctgtaggataaagaaaataatatatttttttcatgtaatcacagtgctttagaaggatatttgggaaagta

SEQ ID NO: 20264 - DNA, 62 bp, Homo sapiens
tgctctgtctggctgagtgggagccacaagttagtcttgcctcctattcatcctctcccgca

SEQ ID NO: 20265 - DNA, 100 bp, Homo sapiens
ctgtgtctgagagtctgtcccagaagaaatggtggagcggcccaagtcaaaaaacttttatatttctattattccaagttgggattctcaggtatggcac

SEQ ID NO: 20266 - DNA, 97 bp, Homo sapiens
gagccaccacgcctggcctactgtcgtactttttttaggattttattggtttattttattttaagttcccgggtacatgtgcaggatgtgcaggttt

SEQ ID NO: 20267 - DNA, 90 bp, Homo sapiens
tatatatgtgcatatatatgtgtgtgtatatatgtgtgtatatatatacacacacacatacacatatatacacacatatatacacgtgta

SEQ ID NO: 20268 - DNA, 72 bp, Homo sapiens
gctatatatatatatatatatatatatatatatatatatatatatgctgtgtgtgtatatatatatatatgc

SEQ ID NO: 20269 - DNA, 75 bp, Homo sapiens
caccaatgtcacaaacacagacaccctcactgtcacattgggaatggtgtatgaggcatgggtgcttgtgggaca

SEQ ID NO: 20270 - DNA, 88 bp, Homo sapiens
tatgtatatatatatgtgtatgtgtgtatgtgtatacatatatacacatgtaaatatatgtgtatatatgtgtatagatgtatatgtg

SEQ ID NO: 20271 - DNA, 58 bp, Homo sapiens; identical to SEQ ID NO: 2051

SEQ ID NO: 20272 - DNA, 125 bp, Homo sapiens
tatatacgtatatacttatatgtgtatatatacgtatatatgtatatatgtgtatacgtatatatacgtatatatatgtgtatatatatgtatatatgtatacgtgtatacgtatatatgtatat

SEQ ID NO: 20273 - DNA, 120 bp, Homo sapiens
atatatacatatatgtgtatatatacatatcacatatatacatatatgtatatatatacatatatatacatatatgtatatatacgtatatgtatatatgtgtgtatatatatatatatg

SEQ ID NO: 20274 - DNA, 93 bp, Homo sapiens
ttcctgaacttagagggaaaatgtttaaccttttgtcatagagaacaatgatagctgtaggtttttgaaggtgctctttttcaaggtgaggaa

SEQ ID NO: 20275 - DNA, 93 bp, Homo sapiens
taagttctagggtacatgtgcacaacgtgcaggttttttatatatgtatacatgtgccatgttgatgttctgcacctgttaacttgtcattta

SEQ ID NO: 20276 - DNA, 153 bp, Homo sapiens
tatatgcatttgtatatatgtgtatatatctgtgtatacatatatacaggtgtacataggtatatctttatatatacatgtatatacacatatatacacatgtatatacacatatatacatataatatgtatgtatatatactatatatatgt

SEQ ID NO: 20277 - DNA, 104 bp, Homo sapiens
attgatgtcctatgaatacacacattataattatgtgaaattctttcttttttagaaaatcattgtattttttatttaatggtggctttcaggggcaaagcagt

SEQ ID NO: 20278 - DNA, 91 bp, Homo sapiens
tcagctgagcttgttgaaagatattttggtctgttctctgtgtctcttcactttctttggaccagaagctaccaggtacatgttcttctga

SEQ ID NO: 20279 - DNA, 95 bp, Homo sapiens; identical to SEQ ID NO: 68

SEQ ID NO: 20280 - DNA, 93 bp, Homo sapiens; identical to SEQ ID NO: 69

SEQ ID NO: 20281 - DNA, 95 bp, Homo sapiens; identical to SEQ ID NO: 68

SEQ ID NO: 20282 - DNA, 93 bp, Homo sapiens; identical to SEQ ID NO: 69

SEQ ID NO: 20283 - DNA, 80 bp, Homo sapiens
aaatattcataaacacaggctaatatttaggtttgtgtacacacatgtttgtaaatgtctgtgtgtgtgtgtgtgtgttt

SEQ ID NO: 20284 - DNA, 95 bp, Homo sapiens; identical to SEQ ID NO: 580

SEQ ID NO: 20285 - DNA, 93 bp, Homo sapiens; identical to SEQ ID NO: 69

SEQ ID NO: 20286 - DNA, 95 bp, Homo sapiens; identical to SEQ ID NO: 68

SEQ ID NO: 20287 - DNA, 93 bp, Homo sapiens; identical to SEQ ID NO: 69

SEQ ID NO: 20288 - DNA, 109 bp, Homo sapiens
ataagaactcaagtatataaagatgaccccaacttaagaaaattgaaattattgtttgtacatttcagtttttcaagttgggatcatctttatatatttgaattcttat

SEQ ID NO: 20289 - DNA, 114 bp, Homo sapiens
tgtagagtttgtgctgagaaatctttgttgcttttatctttctcctttcaaaattatttttttgtttttgacttctgagagttaaatcataatgtcttggtaaagatctctata

SEQ ID NO: 20290 - DNA, 58 bp, Homo sapiens
atgtagagataaatgtgtataggtatatatatatgtatatacacatatatctctacat

SEQ ID NO: 20291 - DNA, 114 bp, Homo sapiens
tacaaaaatacgaactatatctataaatatatatttaaatatattatatatagatctgtatatttatatatatttaaatatctatatatagaaatatagatacttatttttgtg

SEQ ID NO: 20292 - DNA, 80 bp, Homo sapiens
gcaattcactaatgatatatgatgttaagcatattttcatgtgcttatttgccatctgtatatctttatttttgagatgc

SEQ ID NO: 20293 - DNA, 117 bp, Homo sapiens
tatctgtataaatgcctcaaacctgtggtttggctactccttttttttttttattatactttaagttttagggtacatgtgcacaacgtgcaggtttgttacatatgtatacatgtg

SEQ ID NO: 20294 - DNA, 58 bp, Homo sapiens
tgagatggagtctcactctgtcacccaggctggagtgcagtggtgtgatcacagctca

SEQ ID NO: 20295 - DNA, 200 bp, Homo sapiens
atatatatatatatatacacatatatatatgtatatatatgtatgtatatatatgtatgtatatatatatgtgtatatatgtatatatatgtatgtatatatgtatatatatacgtatatatgtatatatgtgtatatatatacgtatgtatatgtgtatatatatatgtgtatatatatgtgtatatatatgtaagaca

SEQ ID NO: 20296 - DNA, 95 bp, Homo sapiens; identical to SEQ ID NO: 68

SEQ ID NO: 20297 - DNA, 93 bp, Homo sapiens; identical to SEQ ID NO: 69

SEQ ID NO: 20298 - DNA, 94 bp, Homo sapiens
gttgggataattcatgaaaaagaggcactatcttcacctactatttggttacccagtggtagagttctgatatggtttagctctttgtccctac

SEQ ID NO: 20299 - DNA, 81 bp, Homo sapiens
ctcaggatgtggctctctgtttgtctgttattggtgtataggaatgcctgtgatttttacacgttgattttgtatcctgag

SEQ ID NO: 20300 - DNA, 106 bp, Homo sapiens
ctaaactgtacagtgtgatttatgtggagtacctggttttctttctttctttttttttttattatactttaagttttagggtacatgtgcacaacgtgcaggttag

SEQ ID NO: 20301 - DNA, 77 bp, Homo sapiens
agtgtatatgtatgtatgtgtgtgtctatatatatgatgtgtgtgtgtgtgtatatatatatgtgtgtgtgtgtgtt

SEQ ID NO: 20302 - DNA, 84 bp, Homo sapiens
tgtatatgtatgtgtatgtacatatatatgtatttgtatgtgtatgtacatatatatgtatgtgtatgtacacatacgtatata

SEQ ID NO: 20303 - DNA, 81 bp, Homo sapiens
acatataggtatatgtatatatatatgtgtgtatatatacacttgtgtgtatatatacacttgtgtgtatatatctacttg

SEQ ID NO: 20304 - DNA, 81 bp, Homo sapiens
ccagtcatatagtcatttactatcattatcaagcattatgtattgtacataattgcatgttctgtatttgtatatgactgg

SEQ ID NO: 20305 - DNA, 72 bp, Homo sapiens
tccagatgtttgcgagtgatttcttttttttttttttttgagatggagcttcactctgtcacccaggctgga

SEQ ID NO: 20306 - DNA, 101 bp, Homo sapiens
tgaggccagattattgcttgaaccctggaggcagaggtagtagtgagtggagattgcgccattacactctggcctgggcaacagagcaagactctgtctca

SEQ ID NO: 20307 - DNA, 154 bp, Homo sapiens
gttttatatatatatgtgtatatatatgtatatatatgtgcatatatatgtgtatatgtatatatgcacatatatatgtgtatatatgtatatatgtgcatatatatgtatatatgtatatatgtgcatatatatgtatatatgtatatatata

SEQ ID NO: 20308 - DNA, 89 bp, Homo sapiens
acttcctcattaatagattaaaaaagacatttcctcttgtattttaataatttaaggaggattaaatctgtttagtgtaatatggaagt

SEQ ID NO: 20309 - DNA, 157 bp, Homo sapiens
atatatatatatcctctctatatatctatatctatatatgtaccttctatatatattcatatatagaacatcctttatatatattcatatatatatagaacatcctttatatatattaaggatgcttcaacatccttaatatatatatatgacgttc

SEQ ID NO: 20310 - DNA, 70 bp, Homo sapiens
atatatgtgtatatatacacatatatatatacatatacgtatatgtatatgtatatgtatatacatatat

SEQ ID NO: 20311 - DNA, 111 bp, Homo sapiens
tgcttttatcaaattgctcatattctaccttccttatgtgtgtgtgtgtgtatatatatatatatacacacacacatatttgtgattcataactgttccatttctatagca

SEQ ID NO: 20312 - DNA, 66 bp, Homo sapiens
tgagatggagtctcacactgtcactcaggctggagtgcagtggagtgcaggctggagcttagctca

SEQ ID NO: 20313 - DNA, 112 bp, Homo sapiens
tgtttgatatcttcagatgctgagatggtgtttgggtttcaaactttttgttaaggatcaacacttgaaaaaggaaggaggaagaagcagaactgggcaaggaagacaaaca

SEQ ID NO: 20314 - DNA, 88 bp, Homo sapiens
ggactggaatagaagaaataggggagctggctagaaccagggtgacatgtcactctgccactctctctggggattttcatttgtgttt

SEQ ID NO: 20315 - DNA, 118 bp, Homo sapiens
gaagacttgtttgattccacataggggagcttggcagaacaggcagatgattgtgtgcacaggccacagaaattgcgcagtctgtcctaactcttttgctttggggttctttaacttc

SEQ ID NO: 20316 - DNA, 116 bp, Homo sapiens
tgttctttttgcttcagattgtcttggctatacaggctcttttttggttccatatgaaatttaaagtagtttttcctaattctgtgaagaaagtcaatggtagcttgatgggaata

SEQ ID NO: 20317 - DNA, 78 bp, Homo sapiens
cagtcaggtggtttctctccctgtgtggctgagtctggtgcttttatgggctcagaataggggagtgggtgctgattg

SEQ ID NO: 20318 - DNA, 89 bp, Homo sapiens
tgttgctgccattttcttttcacacatactcagtcactctatgaagtgtaaacagatgctgggggactgagttctgggatttgataaca

SEQ ID NO: 20319 - DNA, 58 bp, Homo sapiens; identical to SEQ ID NO: 14682

SEQ ID NO: 20320 - DNA, 96 bp, Homo sapiens
gtactttatattttgtctgtgtatatatatatatgtgtacatgtatttgttgtataagaaaatatatgtagtatatagtttacattatatatgaac

SEQ ID NO: 20321 - DNA, 105 bp, Homo sapiens
agagtagaaccctaatctcacaggactgtggctttaaaagaagagaaagaaaggtcactctttctctctctccaccatctgagaacacagtgagaaggtaactct

SEQ ID NO: 20322 - DNA, 58 bp, Homo sapiens; identical to SEQ ID NO: 1745

SEQ ID NO: 20323 - DNA, 82 bp, Homo sapiens
tggtgcctgtagtcccagctacaccagaggatcacttcagcccagtagtttgagatcacagtgagctatgatcacaccacca

SEQ ID NO: 20324 - DNA, 200 bp, Homo sapiens
tatattatatatacatgtacatgtatatatgtatatattatatatacatgtacatgtatatatgtatatattatatatacatgtacatgtatatatgtatatattatatatacatatacatatgtgtatatatacatatatatgtgtatatatacatatatacacatacacgtatatatgtatattatatatacatatat

SEQ ID NO: 20325 - DNA, 95 bp, Homo sapiens
tatgtatatatgtatatatacacgtatatctgtatatataatatatatgtatataatatatgtatatatgtatatatgtatatatacacgtatat

SEQ ID NO: 20326 - DNA, 95 bp, Homo sapiens; identical to SEQ ID NO: 68

SEQ ID NO: 20327 - DNA, 93 bp, Homo sapiens; identical to SEQ ID NO: 69

SEQ ID NO: 20328 - DNA, 79 bp, Homo sapiens
tgggtctctcagctgtgtgtctcagtgcctgttctggtggaggtggcagggggtgcaatggactccatgagagttctta

SEQ ID NO: 20329 - DNA, 92 bp, Homo sapiens
cttctgagaggagacttaactgttgcattttatttctttataaaggagactttaagcagacattataaaataaaatgagtcaattttgggag

SEQ ID NO: 20330 - DNA, 86 bp, Homo sapiens
tgtgtatatatagcttttacatatatacatatatacatatatgtatatatatgtgtgtgtatgtatatatgtaaaagctctacata

SEQ ID NO: 20331 - DNA, 113 bp, Homo sapiens
gtgtttgaattaagaaaatggacctgttgtggggaggaaacagtttgcaaaacttctgtttgtttataattatgcttctaacatactaacatcctctttttcttagcaggctc

SEQ ID NO: 20332 - DNA, 95 bp, Homo sapiens
ttctgcatccacttattatcacagtagtgttttacatgattaatgggctaatcatgttctaatgaaacttacactttagaacgtggattccagaa

SEQ ID NO: 20333 - DNA, 90 bp, Homo sapiens
attcattaagtgcaaatggattgtcatcttcatcctcatcatcttcatgctgagtagcccgaggagggatggtcttgctgtcttgggagt

SEQ ID NO: 20334 - DNA, 58 bp, Homo sapiens; identical to SEQ ID NO: 315

SEQ ID NO: 20335 - DNA, 68 bp, Homo sapiens
ttgttttttgtttttgttttggtgacagagtcttgctctgtcacccaggcttgagtgcagtggtgcga

SEQ ID NO: 20336 - DNA, 102 bp, Homo sapiens
gattctcagaagaagatgaggagctcagtttagaacgtgtcaatgtttctatttatttacatattgattacttacagtgctcttccttccctcatgtagatc

SEQ ID NO: 20337 - DNA, 114 bp, Homo sapiens
ctttgtcacagactacatatatatatatatatatacacatatatatacacacacacacacacacacacatgtatgtgcataatttatgtatatgtatgcatataattttaaaag

SEQ ID NO: 20338 - DNA, 100 bp, Homo sapiens
tacatgtattatatagtgctataatatatagttatatatcatacatagttatacaaatatatattatttttatattatataacacttttaaatacatgta

SEQ ID NO: 20339 - DNA, 106 bp, Homo sapiens
gtttgtacctgtgtatgtgtgtggcagggcatggcttatcatgcatatatatgtatgtatatatgtatctatagtgggcaaattaaaatatataacatatataaac

SEQ ID NO: 20340 - DNA, 116 bp, Homo sapiens
acccagtaattgtgtggactagaaggtggtggagtgagtagtgacctctgaagagtgtgacctctcaagccaactgcttgagctccaattctgcctctgctactttgtgactgtgt

SEQ ID NO: 20341 - DNA, 95 bp, Homo sapiens; identical to SEQ ID NO: 68

SEQ ID NO: 20342 - DNA, 93 bp, Homo sapiens; identical to SEQ ID NO: 69

SEQ ID NO: 20343 - DNA, 79 bp, Homo sapiens
tgagatggagtctcactctgtcacccaggctggagtgcagtggtgcgatctaggctcattacaagctccacctcccggg

SEQ ID NO: 20344 - DNA, 104 bp, Homo sapiens
tttgaaactaaacaagtatcattctttttccgaatccttttacagcattatgtatatgtatattttgctagtggtggtggtaggagtgggttttggggctcaga

SEQ ID NO: 20345 - DNA, 77 bp, Homo sapiens
taagtactggctccagtagttgcataatgggctcagtgaaggatgtaagaaagtatgtagtactgaggcagaacttg

SEQ ID NO: 20346 - DNA, 95 bp, Homo sapiens; identical to SEQ ID NO: 68

SEQ ID NO: 20347 - DNA, 93 bp, Homo sapiens; identical to SEQ ID NO: 69

SEQ ID NO: 20348 - DNA, 95 bp, Homo sapiens; identical to SEQ ID NO: 68

SEQ ID NO: 20349 - DNA, 93 bp, Homo sapiens; identical to SEQ ID NO: 69

SEQ ID NO: 20350 - DNA, 114 bp, Homo sapiens
cagttaatattatgctttctgtctttgtgaacggacatgtgtgagttcatgtatgtatgtatgcatgtgtgcatatgtttagattcttgaatttttaggtggttagatatgctg

SEQ ID NO: 20351 - DNA, 115 bp, Homo sapiens
atcggactcacccggcagccactcccagagcccctggaactctggcccaaggctctctgactgactccttcccagatcttcttggcttagcggctgaagactgacactgcccgat

SEQ ID NO: 20352 - DNA, 81 bp, Homo sapiens; identical to SEQ ID NO: 7982

SEQ ID NO: 20353 - DNA, 99 bp, Homo sapiens
tctaattttatgctgtattcagttattgattttatttctatgatgagaaagaaatgtcatgatgataagtaggtggaattatagaaaaatagagttgga

SEQ ID NO: 20354 - DNA, 106 bp, Homo sapiens
gggagtggactaccacctgaatgtacccctgcagaatgttgcatcaattcaaactaaagatgtatttcacagtcattacagaagtccaaggaggtattccaggttc

SEQ ID NO: 20355 - DNA, 58 bp, Homo sapiens; identical to SEQ ID NO: 1215

SEQ ID NO: 20356 - DNA, 91 bp, Homo sapiens
tttttttcaaatttattttggcaagtctagattctttgtatttctatctgaatcttaggatcagcttgtcaatttatttccctggaaaagg

SEQ ID NO: 20357 - DNA, 190 bp, Homo sapiens
atatatatatatacacacacacacatatatacgtatatatatatgtgtatatatatacacacacatatatatgtatatatgtgtgtatatatacatatatgtatatgtgtgtatatatacatatatgtatatgtgtgtatatatacatatatgtatatgtgtgtatatatacatatatgtatatatgtgt

SEQ ID NO: 20358 - DNA, 139 bp, Homo sapiens
tatatatatatatatacacacacacatatgtatatatatacacacatatgtatatataggtatgtatgtatatatatgtgtatatatgtatatatgtatatatgtgtatatatatgtatatatgtatatatatatatat

SEQ ID NO: 20359 - DNA, 86 bp, Homo sapiens
atgactgtgtgtgtgtgtgtgtatctatatatatacatatacacacatacacatacacatatatatatatacacacacaggcacac

SEQ ID NO: 20360 - DNA, 182 bp, Homo sapiens
tatataagtgtatatacatatatacgcatatacgtgtatatacgtatatatacgtatatgtgtatatatatacatatatatgtatatatgtgtgtgtctatatatacacatatatgtatatatatgtgtatatatatatatatacacatatatgtatatatatgtgtatatatatatatata

SEQ ID NO: 20361 - DNA, 59 bp, Homo sapiens
tgagatggagtctcgctctgtcgctcaggctggagtgcagtggcgcaatctcaagctca

SEQ ID NO: 20362 - DNA, 116 bp, Homo sapiens
tacatcagatctagggctagacactgtacgctttgtgaagatgtaatttttcttttatattgcattttctaactttagttatagttatatacaagcctaaatcatagcatggggta

SEQ ID NO: 20363 - DNA, 93 bp, Homo sapiens
cattaatgtaaatgaaagttaaactaatggggaggattgtttctttttttaaagctatgatttccttctggtagttactattgtatgttaatg

SEQ ID NO: 20364 - DNA, 94 bp, Homo sapiens
aggggaaatgtggggttggagctcccacacagagtgctcactggggccctgcctagtggagctgtgagaagagagtcaccaacctccagaccct

SEQ ID NO: 20365 - DNA, 96 bp, Homo sapiens
aaagaacatagtcaagatgtattataatacagtttttaaaaaattagggtcatgtaaatttgaagattttcatataatacgtctgatactctcttt

SEQ ID NO: 20366 - DNA, 69 bp, Homo sapiens
agaacttagagattaaagagagcacagtagagcagagctcaagctctcggagtcatactaacaggttct

SEQ ID NO: 20367 - DNA, 109 bp, Homo sapiens
accttttctatggatgaatcttctctggactagtgtgtgtaaatttcaaatcagagcgatttactagtttcattttttccagcagtttgtgttctttcactcccttggt

SEQ ID NO: 20368 - DNA, 86 bp, Homo sapiens
catgtgtgcttatacatgtgtatatttctatgtaaatatatatatttacatatgtaactatatgcatctatattcagctaaatatg

SEQ ID NO: 20369 - DNA, 95 bp, Homo sapiens; identical to SEQ ID NO: 68

SEQ ID NO: 20370 - DNA, 93 bp, Homo sapiens; identical to SEQ ID NO: 69

SEQ ID NO: 20371 - DNA, 87 bp, Homo sapiens
ggaggtatgtagctatgtagcttttttatttttgtagctatcttatttaggaataaaagggaaagaaggtttgcctgatgtactttc

SEQ ID NO: 20372 - DNA, 95 bp, Homo sapiens; identical to SEQ ID NO: 68

SEQ ID NO: 20373 - DNA, 93 bp, Homo sapiens; identical to SEQ ID NO: 69

SEQ ID NO: 20374 - DNA, 128 bp, Homo sapiens
tgtctatgttctttctatcatgtctagtgtacatgtgtatatatatatatgtgtgtatatatatatacacacacatacacacacacatatatgtacacacacacttatatatatcacatttaggacat

SEQ ID NO: 20375 - DNA, 82 bp, Homo sapiens
ggccaagaaactgtagggagaatggtatctgacagctaatcaagtgctctcaacagcctggctctctcagcttctctcagtc

SEQ ID NO: 20376 - DNA, 85 bp, Homo sapiens
gacatatatacacacatgaattaatatatttgtttttcatatatttttaaaatatatgcatatatttttcatctgtatgtgtgtt

SEQ ID NO: 20377 - DNA, 100 bp, Homo sapiens
gtgtcttgccttttgaaaaggataaagttttggcattagtactgtaaatttgtgattatataacaatcaagtactgccaatgtccctgagataagatgac

SEQ ID NO: 20378 - DNA, 110 bp, Homo sapiens
tgtgttggctatgtgggctcttttttggttccatatgaaatttaaagtagtttttttctaattctgtggagaaagtcagtggtagcttaataggaatagcattgaatata

SEQ ID NO: 20379 - DNA, 95 bp, Homo sapiens; identical to SEQ ID NO: 68

SEQ ID NO: 20380 - DNA, 93 bp, Homo sapiens; identical to SEQ ID NO: 69

SEQ ID NO: 20381 - DNA, 79 bp, Homo sapiens
cacgatgtacagtctcaggcactttctcactgtttaataaaaaggtaattgggtgaagagccgtgagaaaatactagtg

SEQ ID NO: 20382 - DNA, 95 bp, Homo sapiens; identical to SEQ ID NO: 68

SEQ ID NO: 20383 - DNA, 93 bp, Homo sapiens; identical to SEQ ID NO: 69

SEQ ID NO: 20384 - DNA, 85 bp, Homo sapiens
gtgcacttttaagataaagctggagagaaaaatactaagaactgttaagaaatcactgtctttttctctttgagtttagtggcac

SEQ ID NO: 20385 - DNA, 89 bp, Homo sapiens
catggatagttgtttggtctggtttggtagtatgtttgcaggtttgacattttgtacatatttttaaaactagatagctaattataatg

SEQ ID NO: 20386 - DNA, 68 bp, Homo sapiens
tctgtgaaatgtgaggctgagtgcccatcggcctcccaagggtattctgtgtctgactctatcacaga

SEQ ID NO: 20387 - DNA, 58 bp, Homo sapiens; identical to SEQ ID NO: 2595

SEQ ID NO: 20388 - DNA, 99 bp, Homo sapiens
tgtcattaaggtaggatataggaagttcagttcaactcttgtcagtaatgagacaggacagaatgaaaatgttttctaagatcatttccaatgtgaaca

SEQ ID NO: 20389 - DNA, 103 bp, Homo sapiens
ggtagccaccccatggtatgaagagtggcaacacgtctggtctaagtcgggaaactgacaccctcagtgtcaccatcatttcaactcaaggggtccattcacc

SEQ ID NO: 20390 - DNA, 92 bp, Homo sapiens
gtgctgggattacaggcatgagccaccgtgcctggctgtgatgtaaatatttttatatttgccaaggcctaggcttcactctgatctgaaac

SEQ ID NO: 20391 - DNA, 115 bp, Homo sapiens
tcgggagtacatgtgcaggtttgttatataggtaaatttatgtcatgagaatttgttgtgcagattatttcatcaccaggtactaagcctagttcccattagttatttctcctga

SEQ ID NO: 20392 - DNA, 90 bp, Homo sapiens
tggacactggagacccaaatcttgaactgactctgttgctagctgctctggttctggacaagtcatttagttgttctgtgtctatgtcta

SEQ ID NO: 20393 - DNA, 97 bp, Homo sapiens
tcacctggcagccacttccagagcccctggaactctggcccaaggctctctgactgactccttcccagatcttcttggcttagtggctgaagactga

SEQ ID NO: 20394 - DNA, 79 bp, Homo sapiens
ctgtaagaaggagctttctcttcttttataggcatgtatgtatgtatgtgtgtgtaggtagctcattatgaacttacgg

SEQ ID NO: 20395 - DNA, 73 bp, Homo sapiens
ggtttcctgtgtctgtttctgtctctctgacccgaaacgcactttcggttatagacagacaaggcgctcaacc

SEQ ID NO: 20396 - DNA, 66 bp, Homo sapiens
gcccggcgggtagaatgttgaccctgggaaagaggaaactcattcctcactctctgtgtgccaggc

SEQ ID NO: 20397 - DNA, 103 bp, Homo sapiens
acattttgttctttcgctggctgtattacctgaaggaagccacagtctctgtctgggtctcatttttttttatctagtaaagttaacagggagaacaaggtgt

SEQ ID NO: 20398 - DNA, 60 bp, Homo sapiens
gcctgtgagatgaggccagtctgatctgagcacccctctgtctgtcagcctctctcaggc

SEQ ID NO: 20399 - DNA, 70 bp, Homo sapiens
cacccaaatctcattttgtagttcccataattaccacgtgttgtgggagggacctggtgggaaatgattg

SEQ ID NO: 20400 - DNA, 91 bp, Homo sapiens
gctcttgttggtctatagaaatgctagtgatttttgtacattgatattgtatcctgaaactttactgaatttgtttatcagctgaaggagc

SEQ ID NO: 20401 - DNA, 107 bp, Homo sapiens
ttgagctggtcatcactaattttcatataaaatccacttttcatcacatgtcacaatctggttgagaaatggtttgttgtgtagaataagagaagatgacacttcaa

SEQ ID NO: 20402 - DNA, 112 bp, Homo sapiens
ggattggcttggctatctgggctcttttttggttccatatgaaatttaaagaagttttttctaattctgtgaagaaagtcaatggtagcttgatggggatagcattggatct

SEQ ID NO: 20403 - DNA, 96 bp, Homo sapiens
tctggttttactcccagtctggtgggtgtgaattgcagtatcacaaaacttcactgtgatttgtatttgtacttctctgattaatgatgaagctga

SEQ ID NO: 20404 - DNA, 145 bp, Homo sapiens
ttcaagagtggggttagatagtggaaagatgtttatttactttcagtttccttccaggctttgaatgtatatatttctttacttatgccacttaatgagacatttattctattccagaatacataaatgtctcattaagtgacat

SEQ ID NO: 20405 - DNA, 120 bp, Homo sapiens
tcaaatttatatccctgggaatttccaagaaccatggtgtgtgtctatatgtatgtgtgtctatgtgtaggaagaagacaggtggtaaggagataagagagatgggcagagatgattagg

SEQ ID NO: 20406 - DNA, 121 bp, Homo sapiens
gcctacggattcattcttcacttttgttccagtttgcttttctttatttgaattttatgattttttttcttcaacctttattttaagttctggggtacatgtgctggatgtgcaggtttgt

SEQ ID NO: 20407 - DNA, 99 bp, Homo sapiens
catgtggttttcgtcatgggttctgtttatgtgatgggttatgtttattgatttgtgtacgtggaaccagccttctatcccagggatgaagccaacttg

SEQ ID NO: 20408 - DNA, 162 bp, Homo sapiens
gatatatatgtgtatacatgtgtatatatatgtgtgtgtatatatgtgtgtatatatgtatacatatatgtgtgtatacatggatttgtgtttatatattatatatatgtatgtatatatatatatttacatgaaatttgtgggaaaagatacaccgctgta

SEQ ID NO: 20409 - DNA, 72 bp, Homo sapiens
aggaagataaaaaatctttatttgtatttcttcccatattaagaaatcggacaaacagctttttatcttcct

SEQ ID NO: 20410 - DNA, 74 bp, Homo sapiens
gctgttgttgttgtgacagtctcactctgtcacccaggctgggttacagtggtatgatcatagctcactgcagc

SEQ ID NO: 20411 - DNA, 105 bp, Homo sapiens
tatgtatatacagctgttatatacatctatatatgtattttaacatacacatgtatgcatgtgtgtgcacgtgtgtgtgtgtaaactagcacttatatatacata

SEQ ID NO: 20412 - DNA, 73 bp, Homo sapiens
tggctgcatagtattccatgcatatggaatataaaagtattccatgcatatggaatataaagtatatgtgcca

SEQ ID NO: 20413 - DNA, 76 bp, Homo sapiens
ctgggcgggtgggccttactactgctccattttttttttttttttttttgagatggagtctcgctctgttgcccag

SEQ ID NO: 20414 - DNA, 78 bp, Homo sapiens
tagtttgcgtgacttagttatgtatgtgtgcatgttcatatgtatgtatgtatatattcatgtctgtgtctgtctcta

SEQ ID NO: 20415 - DNA, 116 bp, Homo sapiens
ggactcccaaagtgctgagattacaggcgtgagtcactgtgactggactaggtaatacattttttatctttagttgctttgaagaattattttaatctttagtgattttgcagttc

SEQ ID NO: 20416 - DNA, 82 bp, Homo sapiens
ttccttctcttttttcctgctaaataatgccattttttttcacaatggcagcttgaggtggaaggatgcaatagaggatgaa

SEQ ID NO: 20417 - DNA, 90 bp, Homo sapiens
ggtctcaggtctaagttttatgatattatttcgatagaagaaagtttatggtttgtataaaagtgtatcttgaagatctgggtatgagcc

SEQ ID NO: 20418 - DNA, 80 bp, Homo sapiens
ctatccaggtcatcttcaccttgatctgcagcagggtcctaattgggagctgagaacacagagaggagaaatgtaaatag

SEQ ID NO: 20419 - DNA, 119 bp, Homo sapiens
ttgatgcctacagctttgttctttttgcttaggactgtcttggctccatatgaaatgtaaagtagttttttctaattctgtgaagaaagtcaatggtagcttgatgaggatagcattga

SEQ ID NO: 20420 - DNA, 95 bp, Homo sapiens; identical to SEQ ID NO: 68

SEQ ID NO: 20421 - DNA, 93 bp, Homo sapiens; identical to SEQ ID NO: 69

SEQ ID NO: 20422 - DNA, 99 bp, Homo sapiens
ggagacatgggagtatttaaaagcatgtattgaacatgtgcagagtgccaatcactagacacagatgattcaaagctgaataagatggctcctgtccac

SEQ ID NO: 20423 - DNA, 75 bp, Homo sapiens
tatacatgtgcatatatatacatatttatgtattgtatgtatgtatctatatatgtgtgtgtgtgtgtgtgtgtg

SEQ ID NO: 20424 - DNA, 75 bp, Homo sapiens
aggagtgaagctgtgagtagaaagtgaggacctaagagggcctcttcctctcatgtctcctggggttactaagct

SEQ ID NO: 20425 - DNA, 58 bp, Homo sapiens
gagaccgagtctcgctctgtcacccaggctggagtgcagtggcgggatttcggctctc

SEQ ID NO: 20426 - DNA, 119 bp, Homo sapiens
agcaggaagcagtgaggatctgtctttatccttatccttgtttttttaatttaatttaatttaatttaattttttattatactttaagttttagggtacatgtgctcattgtgcaggtt

SEQ ID NO: 20427 - DNA, 58 bp, Homo sapiens; identical to SEQ ID NO: 4048

SEQ ID NO: 20428 - DNA, 68 bp, Homo sapiens
cctgcatcagtacttgtgattctccctgcgggctgatgcagagtgaatctctcactgaggaacccagg

SEQ ID NO: 20429 - DNA, 95 bp, Homo sapiens; identical to SEQ ID NO: 68

SEQ ID NO: 20430 - DNA, 93 bp, Homo sapiens; identical to SEQ ID NO: 69

SEQ ID NO: 20431 - DNA, 115 bp, Homo sapiens
ggacaaatttttgtgagtattgttcctcaataaattacctttgtggagttttatttcattatagatttctagaagtgtttaatttgaaaagtgaaggataaattccaaaattgct

SEQ ID NO: 20432 - DNA, 111 bp, Homo sapiens
tcaggtaaacagtaaaaacaagtatttggggtaacttgtgaataaatgatttttttttgtttgaaaaattgacataagctgctgagaggtttttgcttgttaattccatga

SEQ ID NO: 20433 - DNA, 108 bp, Homo sapiens
gggaatgtagttgcatttaaaggggaaaagcagagaaatgtgagtctagaccattttatttcagaactacacatcctatgcaatcatcttttgaaccagcaatctctc

SEQ ID NO: 20434 - DNA, 115 bp, Homo sapiens
tttcctatgatacgctctgtaaattgctggctgtggcgacttgatgttatggatctttcagtctctgagtttctgtctgcattttttgcctttgagagcagtatgctcttggaaa

SEQ ID NO: 20435 - DNA, 123 bp, Homo sapiens
ccagctttgctctttttgcttaggattgttttggctatgtaggttctattttggttccatatgaaatttaaagtagttttttctaattctgtgaagaaaatccatggtagcttgatgggagta

SEQ ID NO: 20436 - DNA, 94 bp, Homo sapiens
gctcccaggaatgaacaaggacagcttggaggttagaagcaagatggagttagtcaaatctctttcactgtctcagttacaattttgcaatagc

SEQ ID NO: 20437 - DNA, 104 bp, Homo sapiens
gtaactattggatctaaaatgaagcccatcattttctatgtatatatgtataccaaattagtagttaaggatgctatacatgagtcattttggaatttagttat

SEQ ID NO: 20438 - DNA, 81 bp, Homo sapiens
tgtatgtgtatatacacacatatagatgtacatgtatgtactgcatatgtgtatatgtatatgtgtgtatctatacacaca

SEQ ID NO: 20439 - DNA, 58 bp, Homo sapiens
tgagacggagtctcactctgtcacccaggctggagtacagtggtgcgatctcggctca

SEQ ID NO: 20440 - DNA, 105 bp, Homo sapiens
ggcacaggtccaaatacacatccttccttgataataataagtctttatttttataaagctgtatattttgtaagtcaaatatctgtgtctttctaaatatgtgcc

SEQ ID NO: 20441 - DNA, 113 bp, Homo sapiens
gctaagtgtataaatggcaaaaagacactctaggaagtataggataaaggtggaatgatttttattattatactttaagttctggggtacttgtgcagaatgtgcagttttgt

SEQ ID NO: 20442 - DNA, 77 bp, Homo sapiens
gcagcctttattgagttcttaatgaggtaataggcaagtgcatattatgatgttaagtattcaataaagacaaatgc

SEQ ID NO: 20443 - DNA, 112 bp, Homo sapiens
tgtcaagtgggttattaagggtgacttttcagtttggtgtaaatatttttcatttgaaaaataatattgatttgaccagtattctattccggtactctaatctttttgtaca

SEQ ID NO: 20444 - DNA, 81 bp, Homo sapiens
caggtggcacatacatatgcatgtatgtatgtgcatatatgtacattatatatgtgtgtgtgcatgtgcatattaaacttg

SEQ ID NO: 20445 - DNA, 111 bp, Homo sapiens
gggggtggggtgtgtatgttgaaatctgggaggtaaggacatattgtaattttttttaaattttattttattattatactttaagttttagggtacatgtgcacaatgtgc

SEQ ID NO: 20446 - DNA, 89 bp, Homo sapiens
gaaacagtgtttagtcttcagagaggtgagagaaagcactcatgtatgttattcttttagtcatctctttttataatagatactatttt

SEQ ID NO: 20447 - DNA, 74 bp, Homo sapiens
attatggagacaggatctctctcgctgtgtcacccaggctgtagtgcagtggtgtgatcttggctcactgtagt

SEQ ID NO: 20448 - DNA, 63 bp, Homo sapiens
ccccgggaggcagagcttgcagtgagtgagtagagaccgcgccactgcactccagcctgggcg

SEQ ID NO: 20449 - DNA, 124 bp, Homo sapiens
tatatgtgtgtatatgtacatatcatgtatatgtgtgtctagatacatatgtatatatgtgtgtatatgtatatgtgtatagacatgtgtgtataggtatatgtgtatagatatgtgtgtatat

SEQ ID NO: 20450 - DNA, 98 bp, Homo sapiens
tgtatatatcattacatatatgtatatatcattatgtatatatgcatgtttatcatcatatatgtgtatagatatacatgtaagtgtgtatgtatata

SEQ ID NO: 20451 - DNA, 116 bp, Homo sapiens
ccagcctgggcgttagagagagactccgtctcaccaagaagaaaaaaaaaaatttaaacctaaaactttcttttttttttttttgagaaagagtctccccctgtcacccaggttgg

SEQ ID NO: 20452 - DNA, 84 bp, Homo sapiens
aaagagaggttgaggagaataatttctccccgaggaaacagatcggaacccaaaaggagcttttttttttctctttttcttttt

SEQ ID NO: 20453 - DNA, 102 bp, Homo sapiens
actcacagtcagaaatatttcacttgctttttttttttctttcagaggcaatgtgagccttcagtgattgaataaaaatttggcaaagtgtgacttaagagt

SEQ ID NO: 20454 - DNA, 95 bp, Homo sapiens; identical to SEQ ID NO: 68

SEQ ID NO: 20455 - DNA, 93 bp, Homo sapiens; identical to SEQ ID NO: 69

SEQ ID NO: 20456 - DNA, 83 bp, Homo sapiens
ctctctctctgtgtatatatacacacacactctctctgtgtatttatatgtgcgtgtatgtatatatacaaacagagagacag

SEQ ID NO: 20457 - DNA, 71 bp, Homo sapiens
catggacttgtgtgtgtgtgtgtgtgtgtgtgtgtgaatgtatgtctatatatatatgtatggtgtttgtg

SEQ ID NO: 20458 - DNA, 117 bp, Homo sapiens
cacagagctcagctgtgagtaatatttatatggttttaacaatgttagcattatatatttattttaagtatatgttgcaggatgtaggcagaaatgtgtgagggtcagatgagagtg

SEQ ID NO: 20459 - DNA, 88 bp, Homo sapiens
tgccttcctgtgcctggtacctgaaagacctagtgaagactgaaagaaaagtttttattttcttacatagtgaaagcactttgaagca

SEQ ID NO: 20460 - DNA, 95 bp, Homo sapiens; identical to SEQ ID NO: 68

SEQ ID NO: 20461 - DNA, 93 bp, Homo sapiens; identical to SEQ ID NO: 69

SEQ ID NO: 20462 - DNA, 84 bp, Homo sapiens
cactctcttgatagctctcacatggctttaaacatatgtttttgtatatttatccagtttgtctagttgttgtcattgagagtg

SEQ ID NO: 20463 - DNA, 76 bp, Homo sapiens
ggggatttgagctagaaagaactctgaccttactcttttttttttttttttgagacagagtctcgctctgtcaccc

SEQ ID NO: 20464 - DNA, 66 bp, Homo sapiens
acatgtatatatatacatatatgtatatgtgtacacatatacacgtatatgtatatgtgtacatgt

SEQ ID NO: 20465 - DNA, 93 bp, Homo sapiens
atttagatgtagtaagagaaatgtctgcagtgcttgttgttagtatagtactgactacaggaaataaactttctcctattgcttagaataagt

SEQ ID NO: 20466 - DNA, 83 bp, Homo sapiens
ataggatctggaactatatatatgtatataaacataaaactgtatgtttatatatgtctataaagagtgaaacagacttctat

SEQ ID NO: 20467 - DNA, 83 bp, Homo sapiens
tttggggagctgagacctatggactccctgagccagggctgtgagaccctctttcagactctgtggttcctggcatctccaag

SEQ ID NO: 20468 - DNA, 106 bp, Homo sapiens
gcacttaataggctcaataggtcctgcagctgctgccacactctgtatctgtgacagctaagcagctgccataactgctttggaacctgaatgagatagaaaccgc

SEQ ID NO: 20469 - DNA, 58 bp, Homo sapiens
tgagtcagagtctcactctgtctcccaggctggagtacagtggtgtgattttggctca

SEQ ID NO: 20470 - DNA, 162 bp, Homo sapiens
tggagcccaggagtttgagataagcctgggcaacgtagtgaggcctcatctttctctctgtctgtctgtctctctctctctctatatatatatatatgtgtgtgtgcgtgtgtgtgtatgtatatgtgtgtgtgtatatatatgtatatgtacatatatgta

SEQ ID NO: 20471 - DNA, 111 bp, Homo sapiens
gtcttctattaagcttgacattaaaggcagtttcaaaaatataaaacagtgctactcatctcactatttttatttgaaaaatggcctttttaatgttatctatgtgaagat

SEQ ID NO: 20472 - DNA, 59 bp, Homo sapiens
aacagaccaggggaggggcagggatgccaggaagggtgtctcagtctgtctgtgctgtt

SEQ ID NO: 20473 - DNA, 113 bp, Homo sapiens
gggaggacttgcagaggggcataagggggctggggtaagttgagcgagacatgaagctcagtttttttttgtttgttttttgttttcagatactgagtctcgctgtgtcaccc

SEQ ID NO: 20474 - DNA, 84 bp, Homo sapiens
ttcggtctggttttacgtgaatttttgttgttgtctcactgaatttgtgtgtgatttttaaacaaagaacaccctttgactgaa

SEQ ID NO: 20475 - DNA, 87 bp, Homo sapiens
gtatgtatatagacagaatatatacacatacacgtgtatgtacagaatatatgtatgtatatgtatatgttatctgtatatatactg

SEQ ID NO: 20476 - DNA, 84 bp, Homo sapiens
gctgatgaaatatttacatgtgtacattttatatgtatatgtgtgtgtatatatatatattgtgtgtacatgtattcattcagc

SEQ ID NO: 20477 - DNA, 83 bp, Homo sapiens
ttagtggtagtccaggaacaagaaaaagttgcgaaatttctttgatttttaaaatgcagttgttttatagggctcaccactgg

SEQ ID NO: 20478 - DNA, 87 bp, Homo sapiens
tgagcagatgtattgcttggaatgactgatggccttttctgagatgagtgagtgtagtaagctgatttcatgactgtgcttctgcca

SEQ ID NO: 20479 - DNA, 89 bp, Homo sapiens
gtgttcattgtattctgagtgtcaggggaagcctctggaaagttaagacaagggaatgctttgatatgatgtatgttttaaatgaccac

SEQ ID NO: 20480 - DNA, 58 bp, Homo sapiens; identical to SEQ ID NO: 20050

SEQ ID NO: 20481 - DNA, 78 bp, Homo sapiens
ggagtctcactctgacacccaggctggagtctagtggtgtgatctgcaaactctgcctttgggttcaagcgattctcc

SEQ ID NO: 20482 - DNA, 66 bp, Homo sapiens
cgggggccagagcacatgcacttggagaaagtgtttttcatactttttgtggtggcttcaccctcg

SEQ ID NO: 20483 - DNA, 75 bp, Homo sapiens
gtgtgtgtgtgtgtatatatatatatgtatatctgtacatatacatatatatgtgtgtgtatgtatatatatatg

SEQ ID NO: 20484 - DNA, 91 bp, Homo sapiens
tagctggctttcattcattatatatttgtgtttgacacaaatttattattactttgctaaacacaaatatataataaatgaaaaccagctg

SEQ ID NO: 20485 - DNA, 94 bp, Homo sapiens
caaaaaaacccaagtgaggctgtgcactcctgtcctgtagccagaggctgaggtagtaggatcatttgagccccaagagtttgaggtttcagtg

SEQ ID NO: 20486 - DNA, 72 bp, Homo sapiens
agtatggtaatcacgggagtttaccacacacacacaatggcaacagccatgtgtcactctctctgccatact

SEQ ID NO: 20487 - DNA, 58 bp, Homo sapiens; identical to SEQ ID NO: 7309

SEQ ID NO: 20488 - DNA, 81 bp, Homo sapiens
gaaggaggtgtgataggtaatagattctaaattattacaagccttttgaaatgtgttgccaaattatccaccaaaaacttc

SEQ ID NO: 20489 - DNA, 91 bp, Homo sapiens
agccaaaggtgtggcacaggttgtactgtctcctcatcatttcttttttgttttgtttcttgagacagagtctggctgtgttgcccaggct

SEQ ID NO: 20490 - DNA, 85 bp, Homo sapiens
tttgtttgagatggagtctcgctctgactcccaggctggagtgcagtggtgcgatctcggctcattacaagttctgcctcctggg

SEQ ID NO: 20491 - DNA, 114 bp, Homo sapiens
agggtctatctttaggtcctttgttttgaaataggattatattactctagcagcattagtaaagggatttgatggcaaaacatgaggaaccaaggcaagattttgatagagctt

SEQ ID NO: 20492 - DNA, 64 bp, Homo sapiens
aggcaacgtggggattcctgagacctctgaggtatccagcagagatttcagagtgatgttgcct

SEQ ID NO: 20493 - DNA, 83 bp, Homo sapiens
gtctggcatgagagccaggagcctgcattttattttattttattttattttttaagatggagttttgctcttgtctcccaggc

SEQ ID NO: 20494 - DNA, 117 bp, Homo sapiens
agactgttcaactcacctggcagccactcccagagcccctggaactctggcccaaggctctctgactgactccttcccagatcttctgggcttagcggctgaagattgacaccgcct

SEQ ID NO: 20495 - DNA, 61 bp, Homo sapiens
tgttgttgttgttgttttgagacagagtctcactctgtcaccaggccagagtgcaatggca

SEQ ID NO: 20496 - DNA, 122 bp, Homo sapiens
tcggactgttcaactcacctggcagccactcccagagcccctggaactctggcccaaggctctctgactgactccttcccagatcttctgggcttagcggctgaagactgactgcccgatcc

SEQ ID NO: 20497 - DNA, 120 bp, Homo sapiens
gcaccctcctgtcagtcctgggtctgggaaaatgcctatagcttaaagtggtgtctttctgtctcattgtcttctggcctctctccaagtgagatccagggcttgggaaaaataaggtgt

SEQ ID NO: 20498 - DNA, 59 bp, Homo sapiens
tgagacagggtctcactctgtcacccaggctggagtggcagtggcacgatctgggctca

SEQ ID NO: 20499 - DNA, 81 bp, Homo sapiens
tggatgtgtagagtcagagcacagatgggcatactctcaaaccttaataactgtgccacattgccctttgagtttattcta

SEQ ID NO: 20500 - DNA, 117 bp, Homo sapiens
gcaactcattaaaagtcagtttcaaaatgtgatagctttcaaagaacctttttatatattttctgaggtctctctgaaaggattcctttcttcatgaatattgctattaaggagggc

SEQ ID NO: 20501 - DNA, 58 bp, Homo sapiens
tgagactgagtctcactctgtcgcccaggctggagtgcagtggtgtgatcttggctca

SEQ ID NO: 20502 - DNA, 95 bp, Homo sapiens; identical to SEQ ID NO: 68

SEQ ID NO: 20503 - DNA, 93 bp, Homo sapiens; identical to SEQ ID NO: 69

SEQ ID NO: 20504 - DNA, 121 bp, Homo sapiens
ggcaactttgtggagatgatggtgaggcaagacagatttttaccttcttcctgactctcagactcactgaagaaatgtggggaacatgtcatcttattacttatctgtttgttccactagg

SEQ ID NO: 20505 - DNA, 111 bp, Homo sapiens; identical to SEQ ID NO: 13350

SEQ ID NO: 20506 - DNA, 81 bp, Homo sapiens; identical to SEQ ID NO: 7982

SEQ ID NO: 20507 - DNA, 85 bp, Homo sapiens
ccattatatctctaatttctgactttctcactgagaatttcagtactcatgaatgctggggatagagttagaacattcatgatgg

SEQ ID NO: 20508 - DNA, 83 bp, Homo sapiens
aacatataaaatgatcaatacttgaggtgatgtccaacacttggggtgtctgtcacctcgagtatttatcattttatatgttg

SEQ ID NO: 20509 - DNA, 58 bp, Homo sapiens
acatatatgtgtgtatatatgtatacatatatgtatacatagatatgtatatgtgtgt

SEQ ID NO: 20510 - DNA, 84 bp, Homo sapiens
tgtgtgtgtatgtgtatatatatatgtgtgtgtgtgtgtatatacacacatatatatacatatatatgtgtatatatatgtata

SEQ ID NO: 20511 - DNA, 119 bp, Homo sapiens
gacgtagagtcccctgcctcatggaattactgtgataatttttttttttttttttttttttttttagtatttattgatcattcttgggtgtttctcggagagggggatttggcagggtc

SEQ ID NO: 20512 - DNA, 99 bp, Homo sapiens
ctgaggtagagaggggacttataagaaatataatggattattattattattattattattattattattattttgagacaggatctctctgtcacccag

SEQ ID NO: 20513 - DNA, 123 bp, Homo sapiens
gtgttagtgagttctcatgagatctggttgtttgaaagtgtgtggcacatgcgccctcactctctctctctggctctgccatggtaagacgtgcttgcttctctttcaccttccaacatgatt

SEQ ID NO: 20514 - DNA, 58 bp, Homo sapiens
tgagccggagtctcgctctgtcacccaggctggagtgcagtggcgcgatctctgctca

SEQ ID NO: 20515 - DNA, 133 bp, Homo sapiens
gtatatatatatatgtatatatatatatatgtatatatatatatgtatatatatatatatgtatatatatatatgtatatatatatatatgtatatatatgtgtatatatatatacatgtatatatatatatg

SEQ ID NO: 20516 - DNA, 80 bp, Homo sapiens
gcttaggtaatgctgggagaatgcatgagacagaaaaattttgttttctttttgagacagtctccctctgtcacccaggc

SEQ ID NO: 20517 - DNA, 86 bp, Homo sapiens
tatatatatatacacacacacacagacatgcacacacatatatgtatgtatgtgtatatatatgtgtgtgtgtgtatatatatata

SEQ ID NO: 20518 - DNA, 117 bp, Homo sapiens
attttatatatatatctcattggactaagtgtattgccagccatttaattaggaatatatttgactatatttttaatggctttctgcaacatatttccactctaaatatattaaaat

SEQ ID NO: 20519 - DNA, 80 bp, Homo sapiens
tgggtgtttctgtgtgtgtcttgatatctgcagtcatgaccagggtttgtgtttttgtgtcaagcagcatttgatatcca

SEQ ID NO: 20520 - DNA, 77 bp, Homo sapiens
tcaagaaaaatgtcttactctctttgtgatacactcttatatcacagaggctggtaatttatttgtttatctcttgg

SEQ ID NO: 20521 - DNA, 84 bp, Homo sapiens
cagagtgctctacactagtgtgcttcagagattacacagagttctcatgaagcttaattacattggtggataataggtgttttg

SEQ ID NO: 20522 - DNA, 58 bp, Homo sapiens; identical to SEQ ID NO: 1673

SEQ ID NO: 20523 - DNA, 109 bp, Homo sapiens
tatatataagatttcatatatatgtatatatgtgtatgcagagtatatatatgtgtgtgtgtatatatattatatatatattctgtacaaatacacactaacacacata

SEQ ID NO: 20524 - DNA, 95 bp, Homo sapiens; identical to SEQ ID NO: 68

SEQ ID NO: 20525 - DNA, 93 bp, Homo sapiens; identical to SEQ ID NO: 69

SEQ ID NO: 20526 - DNA, 89 bp, Homo sapiens
aattgaggacctatggagagataaggtgtggtttgattaagcacaaagcaatcagacaaacacactctctgatatacggttaagtggtt

SEQ ID NO: 20527 - DNA, 120 bp, Homo sapiens
ctcacatatcctttgcatgttttgtgggaggtataattgtagcaaatatgggaaatattctattttattttgaaagcaaccttcaaaggaatttattaaatgccagggtcaagatgtgag

SEQ ID NO: 20528 - DNA, 60 bp, Homo sapiens
gtggcatgagctgggcagtgccagtggcttgggctgtgacactgtctggcacacagctgc

SEQ ID NO: 20529 - DNA, 115 bp, Homo sapiens
tgtttttctcatggagctaagtatatacgtctgtatatgtatatgtgtgtatatatatatatacacacaactatatatctaatagacagtaaatgctttgtgaatgaagaaaata

SEQ ID NO: 20530 - DNA, 110 bp, Homo sapiens
ttttcttcattcacaaagcatttactgtctattagatatatagttgtgtgtatatatatatatacacacatatacatatacagacgtatatacttagctccatgagaaaa

SEQ ID NO: 20531 - DNA, 92 bp, Homo sapiens
tatcctggacggcaagcttttcaatattatagattcctgagccccagcgtcagagattttgttgtacagtcatgtttagaaccactaggata

SEQ ID NO: 20532 - DNA, 114 bp, Homo sapiens
gctgtttgtgttaagaaggaacctatggctacatccgagctcattggaaaagtaatgttatcaatttggtgtgatttgccatggacttggtaaggaagaagggtagcaccaagc

SEQ ID NO: 20533 - DNA, 107 bp, Homo sapiens
tccatcttactgatctttatcacttgacctgtaaaatattttgttgttgtcattgaatctatcaactagcaagacaggtgtgttaaatttcccactgtgatggtgga

SEQ ID NO: 20534 - DNA, 118 bp, Homo sapiens
agaccctggatcaaaaaataaatggttctcttttggtaactaaacaacatccgacacttaaaattttttttgttgttgtttgtttcagggactcagaatcatgaaccacagtttgcag

SEQ ID NO: 20535 - DNA, 118 bp, Homo sapiens
tgagccggtaactatgactaaggaaagcagcaggttttaagtcctcctttgcctgtctcccactctgagaatgaaggaaagccaagacaccctgagctgtccatccacagtgggctca

SEQ ID NO: 20536 - DNA, 95 bp, Homo sapiens; identical to SEQ ID NO: 68

SEQ ID NO: 20537 - DNA, 93 bp, Homo sapiens; identical to SEQ ID NO: 69

SEQ ID NO: 20538 - DNA, 117 bp, Homo sapiens
ttcacatgtcctggattctttgttgaaaattaagtatatatgtatacatatacacactttatatatatgtgtacatatatatatatataatatgtagaagttaatgggaaagaagag

SEQ ID NO: 20539 - DNA, 106 bp, Homo sapiens
gccattttacaatcaatttggagtaaaatctaatttttataagtttatttttccaataggactaattatgaaagtgcttgatttttccagctttgcctagaagggt

SEQ ID NO: 20540 - DNA, 90 bp, Homo sapiens
ccagggatgtcttatttatttatttttttcaaagtgtagaaaaggaactttaagccttgagagtgtaaatgtattggcacagtatcctgg

SEQ ID NO: 20541 - DNA, 64 bp, Homo sapiens
ctgttgtcccagtgagaaaacaggagagcttagtagtctccctgtgactgtcactgaaacacag

SEQ ID NO: 20542 - DNA, 84 bp, Homo sapiens
ggtttgcagatgagagtcatcagaatcttgaggatcctgcttcttgtgatgcatcttggcaagttgatggcttttactggatcc

SEQ ID NO: 20543 - DNA, 58 bp, Homo sapiens; identical to SEQ ID NO: 2221

SEQ ID NO: 20544 - DNA, 100 bp, Homo sapiens
atgcgtgtatgtgtgtatatgtatgtgtgtgtgtatatctatatatacacatatatatgtgtatatatatatatacgcatacatggaatactacccagcc

SEQ ID NO: 20545 - DNA, 107 bp, Homo sapiens
ttgagttgtaggagtaaggaatgagtattgggcctagtgtgtatatttgtctatttattggaaaatacgttttggattgtatttattttttatttactgtgatttgg

SEQ ID NO: 20546 - DNA, 95 bp, Homo sapiens
gagagagttttcaatgttcagtgcctcatgtgcaaacaacaattttccaaatcatatatatatatatgagacatgggacagggtcttgctctgtc

SEQ ID NO: 20547 - DNA, 90 bp, Homo sapiens
tatatatattctctctatatatatactctctatatatatacagagagagaaagagatagagtttatatatatacatagagagtatatata

SEQ ID NO: 20548 - DNA, 58 bp, Homo sapiens
tgagacagtctgtcactccatcacccaggctggagtgtggtggcgtgatctctgctca

SEQ ID NO: 20549 - DNA, 67 bp, Homo sapiens
gtcttttactcaaagggcatcatagcacgtttcttccaggattgttatgatgtttgaatgagaagat

SEQ ID NO: 20550 - DNA, 117 bp, Homo sapiens
gctcagtttggttttgatttccatttcacaactctgatatagtgcgtttgttactcagctatgtaactttatatttgaatatccattaattgactttgacatcaccccaagctttgc

SEQ ID NO: 20551 - DNA, 60 bp, Homo sapiens
gttctgaactgggtgctgcccaggtggcagaagtcagtgagcatatccaggtgacagtgc

SEQ ID NO: 20552 - DNA, 89 bp, Homo sapiens
cccccttttccctgacatgtcttaccgacagttatatatatttctatatgtattcattactgcagcagacctttaggaagagaaagagg

SEQ ID NO: 20553 - DNA, 113 bp, Homo sapiens
aggaataaaaattatagtggacttgcccttaaaaccagtataagctggaagagaatagattgaaatattctttttgtttgtttggttggtttgttgttgttgttgttgttttt

SEQ ID NO: 20554 - DNA, 84 bp, Homo sapiens
ctcaggtttgcctgccttcctctattacacacaccctcagagtttgagcttgcaatgagtaaagtagaagaagatgaacctgag

SEQ ID NO: 20555 - DNA, 74 bp, Homo sapiens
gtttggggagtgcagtatcacagtcagcagtctttaatagaaagtggaacctgtggctctctgtggctctcagc

SEQ ID NO: 20556 - DNA, 101 bp, Homo sapiens
tggttggagttgtctgcatgagtaattttcatgggatcggccatgtaaaatagtttgtttttaaaggttccaagaataacatgctagagtcctctgtgcca

SEQ ID NO: 20557 - DNA, 102 bp, Homo sapiens
cacatgactcagcatatgttcagttcatacctacttttatttttctttgttcaccaagaagagtcacaaaagagatgaatcaactgtaagtgcaggagtgtg

SEQ ID NO: 20558 - DNA, 98 bp, Homo sapiens
ccggactgagagcccagcgtcagaagagtgtgtgctgatgccttttctcaggaatggtgcacaagtctttgctgaactctctgcattctcttggctgg

SEQ ID NO: 20559 - DNA, 65 bp, Homo sapiens
tgtatatataatatatacatactatatatactatatatatatagtatatatgtataacatataca

SEQ ID NO: 20560 - DNA, 68 bp, Homo sapiens
ggaggcagagtctcgctctgtcacccaggctggagtgctggagtgcagtggtgagatctcagcttact

SEQ ID NO: 20561 - DNA, 99 bp, Homo sapiens
atcagtacttcgtcactgaaccttggtttctttatctataaaatgttaacagtgggtgttcattttacagggtgatgggtgatgacgattagagatgat

SEQ ID NO: 20562 - DNA, 96 bp, Homo sapiens
ggtgggtgtgatatcttttaatctaatgagctatataactgcattttctttttgttgttgttgttgttttttgagatggagtctcactctgtcacc

SEQ ID NO: 20563 - DNA, 120 bp, Homo sapiens
tgtttagaattgtcttggctgtacgggctctttttttggttccatatgaaatttaaagtagttttttctaattctatgaagaaagtcagtggtagcttgatggggatagcattgaatcta

SEQ ID NO: 20564 - DNA, 57 bp, Homo sapiens
ctgagacaaagtctcactctgtcacccaggctggagtgtgcagtggtgagatctcag

SEQ ID NO: 20565 - DNA, 101 bp, Homo sapiens
ccattgtacagctgttgaggtccctgctgatagacttttttttttttttttttttttttgagacagagtctctctctgttgcccaggctggagtgcggtgg

SEQ ID NO: 20566 - DNA, 101 bp, Homo sapiens
tgactataggcgtttgccaccatgcccgactaatttttgtatttttaagacatacggagtttcactacgttaaccaggctggtcttgaactcctgacttca

SEQ ID NO: 20567 - DNA, 58 bp, Homo sapiens
tgagacaggatctcgctctgtcactcaggctggagtgcagtggcgtgatcatagctca

SEQ ID NO: 20568 - DNA, 94 bp, Homo sapiens
cttctgtgttaattgtggtgtgagaacacagtgaaaacatggttggaaagtttttcccaaacatgtagatactgcatttttttgccaactgaag

SEQ ID NO: 20569 - DNA, 92 bp, Homo sapiens
accaaatggacagaaatgttaatgtgtacatatgtatgtatgttaatatatacatatatgtgtatgtggtacatgtatgctgccaccttggt

SEQ ID NO: 20570 - DNA, 68 bp, Homo sapiens
cagtgaggatgtgtgttcaggggtggacattccctctctcactctttgggcactaagtttttcagctg

SEQ ID NO: 20571 - DNA, 117 bp, Homo sapiens
cccagagtcagggcatattatactaataaattatcccttgaagtatgtttttttctaattgtaaaggaacaaatactaatcatggagaattataaataactgatatctctggttggg

SEQ ID NO: 20572 - DNA, 68 bp, Homo sapiens
gctattgtgtgtatctatagatatatctatatctatagatatggatatatgtaggtgtgtgtgtgtgc

SEQ ID NO: 20573 - DNA, 87 bp, Homo sapiens
ccacagattttcaatggagatgaagcagctttctaatggaggaagatgccctccagtagtttcatagctaaagaggagaagacatgg

SEQ ID NO: 20574 - DNA, 194 bp, Homo sapiens
tatatacatacatatatatatacacacacacacacacatacacatatatgtgtatatatatttatacatatatgtgtgtatatatacatatatgtgtgtatatatatacatatatgtggatatatatttatacatatatgtgtgtatatatgtttatacatatatgtgtgtgtatatatatatatatacacaca

SEQ ID NO: 20575 - DNA, 95 bp, Homo sapiens; identical to SEQ ID NO: 68

SEQ ID NO: 20576 - DNA, 93 bp, Homo sapiens; identical to SEQ ID NO: 69

SEQ ID NO: 20577 - DNA, 110 bp, Homo sapiens
tgcttaggattgtcttgactatatgggctctgttttggttccatatgaaatttaaagtagttttttctaattctctgaacaatgtcaatgatagtttaacaagaatagca

SEQ ID NO: 20578 - DNA, 60 bp, Homo sapiens
tatgtgtgtgtatatgtatatatatacatatatgtatgtatgtacatatacacatatata

SEQ ID NO: 20579 - DNA, 70 bp, Homo sapiens
ggctcacaccctctgtcactgcagccaccacttttactcaggtgaggcttgacagtcccttgtctcagct

SEQ ID NO: 20580 - DNA, 80 bp, Homo sapiens
aggctggagtatagtggcgtgatcttgagaggtgacaacgtgctaacagccctcactcgctctcagtgccttctcggcct

SEQ ID NO: 20581 - DNA, 127 bp, Homo sapiens
gggctagatgcccagtcctgccactcgcttgctttgtggccctgggcaaattcgctgcctctctgagcctctgtcacttcccctgaaagacccagctaggggacacctcctcagggggcggaagccc

SEQ ID NO: 20582 - DNA, 116 bp, Homo sapiens
tttcagtaagtttcttatatttttctagggtatgatagggatattaaatacacataaatttatttatatttttattctagtataaaatgctaaaaatgtgagtgtatctgctgaaa

SEQ ID NO: 20583 - DNA, 131 bp, Homo sapiens
ttagttgtaccaatcttcgtattttctgtgaatggtgtcttgagaatgcctcacaattttctatacatccttctctgcatttggtatattttgtgtgactagctgcaaactcaatgctatttacaagaagt

SEQ ID NO: 20584 - DNA, 106 bp, Homo sapiens
tttgttcttgtaggatgatatatcatcaatgcctttgacaaactcttttaatatatactgttaggtaatgaagttggtattattttcctcattttataggttagaa

SEQ ID NO: 20585 - DNA, 114 bp, Homo sapiens
atatgtacatatacacgtatatacacatatatatgtacatatatatgtacgtatatatatgtatatacgtatatatgtacatatatacatatatatatatataatgtgtgtgtg

SEQ ID NO: 20586 - DNA, 82 bp, Homo sapiens
tcctgaagcaggagaaagctgatgacgtctgttgtggtttgctgactcccagcaggcttcattctgcaggcttgactcagga

SEQ ID NO: 20587 - DNA, 117 bp, Homo sapiens
ttcttacgaaaaggggctagcaatggagggttatcagagtagtctttaccttgttatgtaaacaaaattgcagcagcaactccgctgtctctgacctcgattcttgggtctgaagaa

SEQ ID NO: 20588 - DNA, 58 bp, Homo sapiens
tgagacagggtctcgctctgtcactcaggttggagtgcagagttctgatcaaggctca

SEQ ID NO: 20589 - DNA, 106 bp, Homo sapiens
gcttgatattttaaatcatcttatgtaatatgtatttatgcatatatgtatatatacttatacatatatgtgtatacatatacttttagaagaatttcttttgagt

SEQ ID NO: 20590 - DNA, 80 bp, Homo sapiens
gtgacagactgagaccctgtctctaaataaataaataaataacaacaacaacaaaaggaggctaggtatctcagagtcac

SEQ ID NO: 20591 - DNA, 87 bp, Homo sapiens
tatttggggtgggggtgggggtggggggcggcgcagtgacttgcttcgactttgtcagcttccagggttcattccactgcccaaata

SEQ ID NO: 20592 - DNA, 110 bp, Homo sapiens
gctgttggtgtatggaaatgctactgatttttgtatgtttgattttgtatcctgcaactttactaaatttgtttatcagttataatagtattttggtaacgtctttaggc

SEQ ID NO: 20593 - DNA, 72 bp, Homo sapiens
caggaggctgaggtaggaggatcacttgagcccagaaggttgaggctgcagtgagtcatgattgtgccactg

SEQ ID NO: 20594 - DNA, 120 bp, Homo sapiens
tcttggactgatcatttctagctggaatatgtactttccaacaaagaagacactgagctcaagtcaagttcttgctatttttccttgtttgtgatataacagttgtgattctttctatga

SEQ ID NO: 20595 - DNA, 97 bp, Homo sapiens
agggaagggagcagtggtgagtactgagtgagcagaaggctctatagaaaagcaaatggccactactggcttagtgccaatatgctatatcttcctt

SEQ ID NO: 20596 - DNA, 77 bp, Homo sapiens
ggtattgctatggcaacagtaaattgacatggcacactggtgggcatgtcattttgttgttgacagctgcttctgct

SEQ ID NO: 20597 - DNA, 56 bp, Homo sapiens
tggtctcaagcgatcctcccacctcaacctcctgagtcgctgagtcgctgggacta

SEQ ID NO: 20598 - DNA, 95 bp, Homo sapiens; identical to SEQ ID NO: 68

SEQ ID NO: 20599 - DNA, 93 bp, Homo sapiens; identical to SEQ ID NO: 69

SEQ ID NO: 20600 - DNA, 73 bp, Homo sapiens
aggttttttttttttgtttctttgtttttttaaacagagtctcactctgtttcaaaaaacagtgacgtgatct

SEQ ID NO: 20601 - DNA, 67 bp, Homo sapiens
tctgtaaccaactgtttgtttatttttcaatcggttttgggggaacaggtggtgtttggttacatga

SEQ ID NO: 20602 - DNA, 65 bp, Homo sapiens
ggggaagggcttttatacagaatccccacactgcagaagcagtcactgtgtgtgtcccagtctcc

SEQ ID NO: 20603 - DNA, 117 bp, Homo sapiens
gtatcacaactctaagttactcattcacctgaaggtaaccttttttttttttcatgcaaggtttaggaagtgagggggtggccaaatgaggaagatatgtatgtgtgacgagagagt

SEQ ID NO: 20604 - DNA, 100 bp, Homo sapiens
ggatggaacattttatattttatatatatatatatacacacacacatacatatatatgtatatatatgtgtgtgtatgtatatatctgttatgtccattt

SEQ ID NO: 20605 - DNA, 111 bp, Homo sapiens
agggcttcaaaaaagagaggcatctcatttaataattttgtgattttttttagcttagtgggtgatgaaagtgaagaaaattctccagaggatgtttcttgttgatgtttt

SEQ ID NO: 20606 - DNA, 105 bp, Homo sapiens
ttaagagcatttttttaagtgtaggtttgctagcaacacattatgtttttcttttatctgaaaatgtgtttgtttcacttttattcttaagaatatttctcttga

SEQ ID NO: 20607 - DNA, 106 bp, Homo sapiens
gtgtgaggaagtttccttctgtttcaagcttgctgagtcatgatttttcatgattttttttaaatcgtgaaagggtgatgagttttgtgaaattctttttctatgc

SEQ ID NO: 20608 - DNA, 76 bp, Homo sapiens
ctggttgcttaggctagggcttccattactatgctgaataggagtggtaaatgtgggcattcttgtcttgttccag

SEQ ID NO: 20609 - DNA, 86 bp, Homo sapiens
agtaacaactactgttttcttatccacttgtttaaaattgtatttctttgatagcaaagaggaatgattttgaggggtatgttgct

SEQ ID NO: 20610 - DNA, 72 bp, Homo sapiens
ggaggttgaaaggtctcagaaacagtctctctgaccctctcccatcctcctgtttctcgcctctctttctcc

SEQ ID NO: 20611 - DNA, 109 bp, Homo sapiens
cataattgacacataaggacagcttctggagtactggttgttttctgtttcttttttcttttttagagatgcagtctcactctgtcgcccgggcttgagtgcaatggtg

SEQ ID NO: 20612 - DNA, 72 bp, Homo sapiens
ttactatgtatacatatataaggatatacatgtctacatacatgtataagaatatatatgtatatgtagtaa

SEQ ID NO: 20613 - DNA, 100 bp, Homo sapiens
tatatatatgtgtgtgtgtgtgtatatatgtgtgtgtgtatatatatatatatacacatacacatacatatatatatacacatacacatacatatatata

SEQ ID NO: 20614 - DNA, 104 bp, Homo sapiens
agcctgtgtgtgtgtatatatgtgtgtgtatatatatatatacacacatacacatacatatatatatatacacatacacatacatatatatatacacacatact

SEQ ID NO: 20615 - DNA, 76 bp, Homo sapiens
tatatatgtatgtgtatgtgtatatatatatatgtatgtgtatgtgtgtatatatatatatacacacacatatata

SEQ ID NO: 20616 - DNA, 83 bp, Homo sapiens
gcaagaatctcttgtttcctcttcttcttcaacaagtgattgtccaacatgtcattgaagagtgagaggaaacacagctttgc

SEQ ID NO: 20617 - DNA, 82 bp, Homo sapiens
cagtgtcaccctgtgtctgtctccaggggtggacattcacatagagagagaaattatcatggcttagactgggggaagagtg

SEQ ID NO: 20618 - DNA, 152 bp, Homo sapiens
tctgtttgtctgagctgatacctgttttttttaattttcaaattcttaaaagttttattatttttttagagacaaggtctcactctgtcacccaggctggagtatggtggtgtgatcatggcacactgtggccttcaccgacccttctgctt

SEQ ID NO: 20619 - DNA, 84 bp, Homo sapiens
ctgaggttgaagttttcttattcttttttttgagacggagtctcactctgtcgctcaggctggagtgcagtggcgcaatctcgg

SEQ ID NO: 20620 - DNA, 80 bp, Homo sapiens
atatatatatacatatattttatataatatatgtatgtgtacagacacatacatatatgtgtgtatgtgtatatgtgtgt

SEQ ID NO: 20621 - DNA, 105 bp, Homo sapiens
atttgttataataaattatgaatatataaaatcacagataatatataataatataattattatataacaaattttatatatgagtcatagtttattataagaaat

SEQ ID NO: 20622 - DNA, 56 bp, Homo sapiens
tgagacagtctcactctgtcgcccaggctggagtgcagaggcgtgatctgggctca

SEQ ID NO: 20623 - DNA, 120 bp, Homo sapiens
ctgacgccccgacgctgatgccaacccaagggctgctgctgactgtgtctctgggtccctctccatgaagtccatgacccaccagtagtagtttcatctgtgcgtaaatgtcttagaggg

SEQ ID NO: 20624 - DNA, 60 bp, Homo sapiens
ggcccaggagaacaaaaggcagagaaaaggagaattctctgtgtctctgtctctggagct

SEQ ID NO: 20625 - DNA, 58 bp, Homo sapiens
tgagactgagtctcaccctgtcacccaggctggagtgcaatggtgtgatctcagctca

SEQ ID NO: 20626 - DNA, 86 bp, Homo sapiens
agccaggcctggtggcacatgcctgtggtcccagctacttgggaggctgaggtaggaggatcacttgggcccaggaggtcgaggct

SEQ ID NO: 20627 - DNA, 109 bp, Homo sapiens
ccagcctgggcaacacagtaagaccttatctctattcaaaaaaaaagaaaaagtaataaatgcataatttattttatttttttgagactcactctgtcgctcaggctgg

SEQ ID NO: 20628 - DNA, 118 bp, Homo sapiens
agctagtctgtgcatcctaagtccacagaacatagcattcctcctcctgactgcactgtcagtcactttaatccgactcttgctaatatactctgtcttatgactgccacactgcgct

SEQ ID NO: 20629 - DNA, 115 bp, Homo sapiens
tgtgtcctcacacagagtggagagacggaggaaacaagctctctagagtctcttcttttttttttttttgagacggagtcttgctctgtcgcccaggctggagtgctggggcgcg

SEQ ID NO: 20630 - DNA, 58 bp, Homo sapiens; identical to SEQ ID NO: 1409

SEQ ID NO: 20631 - DNA, 100 bp, Homo sapiens
aaagggattttttggtattgaaatggagtgccctgaaattgttgaagattatttatagtattccatttacatattctcagtgatttaaaaactgctcttt

SEQ ID NO: 20632 - DNA, 120 bp, Homo sapiens
acctccttgacagtaagtatacttttcttgttgacaataaaatgattaattaagtattgcaggtatctttttaatttttaatttttgtgggtgcatagtaagtgtatatgtttatgaggt

SEQ ID NO: 20633 - DNA, 56 bp, Homo sapiens
cttctgtctgtctgtgtctgtctgtttgggagaccccggggcgctgtagacagagg

SEQ ID NO: 20634 - DNA, 58 bp, Homo sapiens; identical to SEQ ID NO: 1673

SEQ ID NO: 20635 - DNA, 112 bp, Homo sapiens
ggattgattctcatgagtgggattgctgggtcaaagcatatatgtaattttaactttaatagaagtatgcagattgctttgcaaaaagaacaataccgcacttctaggttcc

SEQ ID NO: 20636 - DNA, 73 bp, Homo sapiens
ccaggaatggtggtgcatgcctgtagtcccacctactctggaggctgaggtaggaggatcacttgagtcctgg

SEQ ID NO: 20637 - DNA, 97 bp, Homo sapiens
actggggtgagaagagactgtctttgggacaaagctaagtttatttttgtttaaactgaaaagctaaattctttagagagtttttctttaaaaatgt

SEQ ID NO: 20638 - DNA, 70 bp, Homo sapiens
tatatatgtgagtgtatatgtatgtatatatgtgtacctgtatgtattaatatgcacacatagggatata

SEQ ID NO: 20639 - DNA, 79 bp, Homo sapiens
aggctatcagaagtgttttatttgtttagataacaatgacagtgagactgattatgagcagtaaaatatttattggcct

SEQ ID NO: 20640 - DNA, 80 bp, Homo sapiens
taataaatatagtatcatgactgtggtggctggcgctattggcacagtgactcactgtgaatgctattattaacaccaca

SEQ ID NO: 20641 - DNA, 58 bp, Homo sapiens
tgagactgagtctcactctgtcatccaggctggagtgcagtggtgcgatctcggctta

SEQ ID NO: 20642 - DNA, 107 bp, Homo sapiens
gttgcttttagttagtgtgctctggaattcttcaaaccttcctgagtagagagtgagctgtaaacagaggaaagagtggatctttcagaatacttccagaagaaaac

SEQ ID NO: 20643 - DNA, 89 bp, Homo sapiens
cctcagtgtcagagacactctgagcaagttgttttgtatttatttatttatttatttatttgagacagagtctcgttctgtcattcagg

SEQ ID NO: 20644 - DNA, 65 bp, Homo sapiens
gggttgagtggggtgagaacttgcttttttttttttttttgagacggagtctcactctgtcaccc

SEQ ID NO: 20645 - DNA, 88 bp, Homo sapiens
gagagagcgagactctgtctcaaaaaaaaaaaaaaaaaatggaaatcaggattttttttttttttttgagacagagtctcactctctc

SEQ ID NO: 20646 - DNA, 84 bp, Homo sapiens
gagagtgagactctgtctcaaaaaaaaaaaaaaaatcctgatttccattttttttttttttttttgagacagagtctcgctctc

SEQ ID NO: 20647 - DNA, 101 bp, Homo sapiens
ccactgctagacaggtatgtgagaaaatatattgaacactgaaaaacaatattttctttttttttttttgagatggagtctcactctgtcgcccaggctgg

SEQ ID NO: 20648 - DNA, 120 bp, Homo sapiens
aaagtgctgggattacaggcgtgagccactgcgcccggccaagataattttttcttttgaaagagagctttattattcttggccaggcactgtggctcacgcctgtattcccagcacttt

SEQ ID NO: 20649 - DNA, 58 bp, Homo sapiens; identical to SEQ ID NO: 315

SEQ ID NO: 20650 - DNA, 84 bp, Homo sapiens
agtctgatatagtttggagacttgtccccgcccaaatcttttttttttttttttgagccagagtctcaccctgtcgctcaggct

SEQ ID NO: 20651 - DNA, 66 bp, Homo sapiens
gaacaatctccagcttgtgctgtaacacagactgtgtggacagaagtcaggctccacagactgttt

SEQ ID NO: 20652 - DNA, 87 bp, Homo sapiens
gggtgtagctctacagctctgactgctgaccttgttttagcaaaatgcacatcagtgtcacactcagtctttgtggccaggtcacct

SEQ ID NO: 20653 - DNA, 80 bp, Homo sapiens
ctgtttctctcttaggtcagtctcccactttctctcactgttgtggctgaaaaagagtcacttacttatgaggtaaatgg

SEQ ID NO: 20654 - DNA, 97 bp, Homo sapiens
ttgcactgtgacagaaaagagaagtcctcagattattcaccgtatgactctgactgagtcacttgattttcctgaacctcagttctgcccactgtaa

SEQ ID NO: 20655 - DNA, 58 bp, Homo sapiens; identical to SEQ ID NO: 3380

SEQ ID NO: 20656 - DNA, 71 bp, Homo sapiens
actttatatatatatgtgtatatatatatacacacacacacatatatatacacacatatatatgtgtatgt

SEQ ID NO: 20657 - DNA, 56 bp, Homo sapiens
atatatatgtgtgtatatatatgtgtgtgtgtgtatatatatatacacatatatat

SEQ ID NO: 20658 - DNA, 120 bp, Homo sapiens
atttgattctcagcttggttgctgttggtgtatagcagagctactgatttgtacattaattttgtattctgaaactttgctgaattcgcttaccagttctaggagttttttggatgagtc

SEQ ID NO: 20659 - DNA, 113 bp, Homo sapiens
ttttggaatcttacatgccctacgtcgtggagcacagtgtatttatatttgtatcatttccatttaataggtaaagaaactgaagcccagagaggtaagtaacttttccagag

SEQ ID NO: 20660 - DNA, 113 bp, Homo sapiens
gagtttgaggatcctgttcaccatatcttggcccttacaatgtgaggctattagccaacttcttttttattttattttaagttctggggtacatgtgcaggatgtgcaggttt

SEQ ID NO: 20661 - DNA, 110 bp, Homo sapiens
ctgcgtcaactctaattgccctgtgtgtttgtattacctacaaatattctctcattgtatttgtgtgtgactacaatacacctaaaccactaagcttcctagaggacagg

SEQ ID NO: 20662 - DNA, 103 bp, Homo sapiens
atgtgtgtgtgtgtgtgtgtatgtatatacacatatatgtgtatatatataatatatgtgtgtatatatatacacatatgtgtgtgtatatatatatacctat

SEQ ID NO: 20663 - DNA, 117 bp, Homo sapiens
ttgtgtctctgtgtcacattttggtaattctctaaatatttcaaatgttttcattattaatatatctattatggtgatctttgatgtttctattgtaattgctttggggcaccacaa

SEQ ID NO: 20664 - DNA, 85 bp, Homo sapiens
tcaaaatttatcttatctttgtggaatggattgaagagagaagatagcctccttcacttctataagcaattatgggactgtttgg

SEQ ID NO: 20665 - DNA, 60 bp, Homo sapiens
tacatatgtatagtacatatgtatatgtatatttagtacgtatgtatatgtatatgtgta

SEQ ID NO: 20666 - DNA, 86 bp, Homo sapiens
ctgtaggaacatttggatcagggtcaggcctgtcttctagagatggatctgaagactcatgtctctctctgtcccaaacatggcag

SEQ ID NO: 20667 - DNA, 110 bp, Homo sapiens
aatatttcttctttcatatatataattaaaatacccatgtttttcataatattttgttattaatttctttgaaggacataaatgggtatatgtgtgtctctgtgtgtgtt

SEQ ID NO: 20668 - DNA, 115 bp, Homo sapiens
tgtcagttataaaaaatttttgatggagtcattggttatatatatatatatatatatatatatatatatatatatatatataaattatgtcatctgaaaggagggacaattgaca

SEQ ID NO: 20669 - DNA, 77 bp, Homo sapiens
ggaatggtaagggcaaggtcagagcacaatggcgtttccttgagaacgtggctgtctctcttattgtctcttcctcc

SEQ ID NO: 20670 - DNA, 86 bp, Homo sapiens
cctcagacatttatacagattttaaaaatctgtatatttttatatacagagagtttatttttacctatctggtggtcctctgaagg

SEQ ID NO: 20671 - DNA, 104 bp, Homo sapiens
gacaaggtgtgttgtttctaccacatattccaatccactgaaaggcaattttttttattatactttaagttctggggtacatgtgcagaatgtgcagttttgtt

SEQ ID NO: 20672 - DNA, 62 bp, Homo sapiens
taaatgtgtgcacacacatttatatgtatgtatatatacatacatatctatgcatatattta

SEQ ID NO: 20673 - DNA, 57 bp, Homo sapiens
cgtttcagaggtgtcagaccacacagggacacctgccttggtccttcacccttagcg

SEQ ID NO: 20674 - DNA, 85 bp, Homo sapiens
gtcaatatatatgtgtatttgaatatgtgtgtgtacaaacacacacatataaacattatctaatcattctatatatgtacatgat

SEQ ID NO: 20675 - DNA, 74 bp, Homo sapiens
tgcaattcttttgagacagtgtctggctctgtcactcaggctggagtgcaggggcacaatctcagttcactgca

SEQ ID NO: 20676 - DNA, 95 bp, Homo sapiens; identical to SEQ ID NO: 68

SEQ ID NO: 20677 - DNA, 93 bp, Homo sapiens; identical to SEQ ID NO: 69

SEQ ID NO: 20678 - DNA, 94 bp, Homo sapiens
atctggtgtggtgatctggtgagtttcagttctttgatacttttttttgagtggactggaagtactctcctgaggacggagctcagataaaaca

SEQ ID NO: 20679 - DNA, 92 bp, Homo sapiens
agacttacatacatggactaaaatgtaagagaatactactgttcagtaggcagtggtagaactttgaagcagaatagttcacaggtgagttt

SEQ ID NO: 20680 - DNA, 97 bp, Homo sapiens
agctaatttatgagaataatagtaggtaattatttatttgtatagtcttatccccagatgacttataaaaggatgaaagactgttcattggttagtt

SEQ ID NO: 20681 - DNA, 75 bp, Homo sapiens
gttccagggacagaagtgtgtgaaaagatgaaggggatttaaccttttaagtttattgcttctaatccttgaagc

SEQ ID NO: 20682 - DNA, 98 bp, Homo sapiens
ggataagtgattctgttgaccactaaagattagtgaatgatgaaggaatgaatgatgcttttatcatttattttattttagagacaggatcctcatac

SEQ ID NO: 20683 - DNA, 100 bp, Homo sapiens
gtggatgtgctggagtggaatgaagggaggataacttcaaatgacagttgccacaggtgattaattttttttttgtcttttacacatttactctgcctac

SEQ ID NO: 20684 - DNA, 109 bp, Homo sapiens
actttgagtcatagtgatttttacctcctaacataaagctaatttttactggatttcttctgataatgatggttaagtgtgcaagagatggtatcagtctattcagcgt

SEQ ID NO: 20685 - DNA, 109 bp, Homo sapiens
atatataatgtatatgtgtatatgtatatataataaatataatgtatatatgtatatgtgtatattatatataatatatatatgcacattatatatacatagatataca

SEQ ID NO: 20686 - DNA, 64 bp, Homo sapiens
ttgagatcggttctcactctgtcactcaggcaggagtgcagtggtgtgatcacagctccctcaa

SEQ ID NO: 20687 - DNA, 157 bp, Homo sapiens
gatatatattctctatatctctatagatatagagaatatatattctctatatatctctatagatatagagaatatatattctctatatatctctatagatatagaaaatatatattctctatatatctctatagatatagagaatatatattctcta

SEQ ID NO: 20688 - DNA, 118 bp, Homo sapiens
tgatataggcaaatttgataacctcagagtatagcaggatttcttttaaagtttttaaacttataaaccatgaaggaaaagatgaatgcatttgactgcatcaaatttgaagtcttca

SEQ ID NO: 20689 - DNA, 91 bp, Homo sapiens
tgaaaaatgaggctggagaagaaggcaaggtccaggtgagcaagaagcttgtatggatgctatgaaggttgagctttagcttgtatgtgca

SEQ ID NO: 20690 - DNA, 83 bp, Homo sapiens
catgaccagatctcacagtaactcactctctccaggacaacaccaaggggggtagtgttaaaccatgagaaaccactgccatg

SEQ ID NO: 20691 - DNA, 114 bp, Homo sapiens
tttgtgtgcctgtatatatttgttttgtggaaatggcccagatttatttttatttttctgattttagttttcttgctaacttcacattaaacaaataaattagttaagtgcgaa

SEQ ID NO: 20692 - DNA, 112 bp, Homo sapiens
gctgaatgtattctcgaagtagaggaaaagatgaataaatttaatgttaaatattatttatttatttatttatttatttatttatttatttatttattttttgagacagagt

SEQ ID NO: 20693 - DNA, 72 bp, Homo sapiens
ctgagcctggtggtgcacaactatagtcccaaatacttgggagggtgaggtagtaggatcacttgagcccag

SEQ ID NO: 20694 - DNA, 90 bp, Homo sapiens
tcagtggtattcatgacaggcaaagcacatttgaggcaaaagtatatatatatatgactttcaactggtgggcctgatcagagcaggtga

SEQ ID NO: 20695 - DNA, 70 bp, Homo sapiens
gaggcagagtctcgctctgtcacccaggctggagtgcagtggcgtgatctccaaacaattctcatgcctc

SEQ ID NO: 20696 - DNA, 103 bp, Homo sapiens
gttttcagaatgctacagacaggctgagatcaggcaccctctctctctgggtcctccagattccaggggccacatcatgttctgcaagtatttctctaaaaac

SEQ ID NO: 20697 - DNA, 65 bp, Homo sapiens
tttaatttcacaggctcataggcagaagggacttggcttgtctcagatgagactgtgaacttgga

SEQ ID NO: 20698 - DNA, 71 bp, Homo sapiens
ctcacactcactcagactgggacaatatagacgcatcagttgacctattatgtatgtctttgtgatgtgag

SEQ ID NO: 20699 - DNA, 75 bp, Homo sapiens
tgggatagacaatttccctctggccaggactagtctaaatgctctctctgtggacactggctgagttctgaccca

SEQ ID NO: 20700 - DNA, 116 bp, Homo sapiens
tactatatatgagagagatatatatgatatatatatgagagatatatatatatgagatatctatctatctatctacctatctatctatctatctgtctatcatctatctatatgtg

SEQ ID NO: 20701 - DNA, 76 bp, Homo sapiens
tatgcatatacgtgtatatatatgcatatacgtgtatatatatgcatatatatgtgtatatatatgtgtgtgtata

SEQ ID NO: 20702 - DNA, 100 bp, Homo sapiens
atgtatatatgcatatatatatgcgtatatatatgcatatatatgtgtatatatatgcatatatatgtgtatatatgcatatatatgtgtatatatatgc

SEQ ID NO: 20703 - DNA, 93 bp, Homo sapiens
atatatacatatatacacatatatatacatgtatatatatatacgtatatatatatacgtgtatatatatatgtgtatatatatatatatata

SEQ ID NO: 20704 - DNA, 74 bp, Homo sapiens
actactaagttactgaatatacatattagtgtgtatatacatgtatatatgtatattgaggaacttctttgtag

SEQ ID NO: 20705 - DNA, 86 bp, Homo sapiens
acgtgcatgtatgaatgtatgtatgtgtatgcatgcgtgctttttctgtgtgcatacatatattaatattacatatatatgtgtgt

SEQ ID NO: 20706 - DNA, 73 bp, Homo sapiens
agggacaggtcagagaggtgagaatggaagccagacttctgagttcacattttgttgatttgactttggactt

SEQ ID NO: 20707 - DNA, 103 bp, Homo sapiens
tgatataccttcattaaacaataatatagaggaattttgtcagatatgcatattttatgtatataaatacataaagtacatttatatgttttgggtgctatca

SEQ ID NO: 20708 - DNA, 95 bp, Homo sapiens; identical to SEQ ID NO: 68

SEQ ID NO: 20709 - DNA, 93 bp, Homo sapiens; identical to SEQ ID NO: 69

SEQ ID NO: 20710 - DNA, 70 bp, Homo sapiens
gattttttatctttgttattaagatgggattgtaatttttttttatcttactgacttgagatactgaatc

SEQ ID NO: 20711 - DNA, 114 bp, Homo sapiens
catatgagtagatacaaaatatagatatagatatagatatctctatatcgatatagatatatcgatatatatatatatctgattttatggtcataattttcttctaaaaatatg

SEQ ID NO: 20712 - DNA, 71 bp, Homo sapiens
tgtgtacatgcacaaacacacacacacacaattcaagtgtatgtgtatttatatgtatgtgtatgtactca

SEQ ID NO: 20713 - DNA, 57 bp, Homo sapiens
gcaatatagagtgacttgtggagtggcttcagcctctgtgcctgtgactctgactgc

SEQ ID NO: 20714 - DNA, 118 bp, Homo sapiens
gctgttatatcagtttacagaatcagcagcaatatgtgaaaattcttgttttttaatatccttaccaatatttggcattactttctattttctgccattctgtatagtgtgttgtggt

SEQ ID NO: 20715 - DNA, 114 bp, Homo sapiens
acataactctttgatatacttatttcaattactatatatatatatatatatatatatatatatatatatatatatgtatccagtagtgggattactggtagttatactgttagt

SEQ ID NO: 20716 - DNA, 91 bp, Homo sapiens
gggccaaattgtagtttagcgttctctagaattcagaagccaattttaattacactgaaacgttgagcttgaagcttgtagactttggctc

SEQ ID NO: 20717 - DNA, 79 bp, Homo sapiens
ctttgatagtcaggtgtggtttgctggtgaaggagctatgatgtgtgcttccaggattcatcacagttgggtgtctgag

SEQ ID NO: 20718 - DNA, 105 bp, Homo sapiens
gtgctgtggtctgagagtgtagttggtataattttgtttttttaatttttttgaatttgctcaggattgtttttatggccaattgtgtggtcagttttagagtat

SEQ ID NO: 20719 - DNA, 107 bp, Homo sapiens
aaatgtaattttttataatgtagtatgtaataatttatatgtaatataaataaatatataaatttatttttaatgtatataaatatatattgtaagaatatatattt

SEQ ID NO: 20720 - DNA, 97 bp, Homo sapiens
tcatctggcagccactcccagagcccctggaactctggcccaaggctctctgactgactccttcccagatcttcttggcttagcggctgaagactga

SEQ ID NO: 20721 - DNA, 81 bp, Homo sapiens; identical to SEQ ID NO: 7982

SEQ ID NO: 20722 - DNA, 114 bp, Homo sapiens
ggatgaacgacagtaacagtgacagtgaaggtgacagcagcagccggcgcgcactgtcgctctgtgtctggctgcatgcgactctcacatggcatctttccgaatcttcagaac

SEQ ID NO: 20723 - DNA, 114 bp, Homo sapiens
tgccacctgagaaaaaacatgagtggatctcacagatatggtgtcgagtgaaagaacctagacacaagagtgtatgctgaatgattccatttatacgatgctcaataggaggca

SEQ ID NO: 20724 - DNA, 106 bp, Homo sapiens
atgtcccccaatgataatatcttgcaaaactataataatgtaccataaccagaatattggcattggtacaattcactggtttattcaggctttgtcagttttacat

SEQ ID NO: 20725 - DNA, 84 bp, Homo sapiens
gctgtcttgttagggtcagttttgggatttttttttttttttttttttttgatggaagtctcactgtcacccaggctggagagt

SEQ ID NO: 20726 - DNA, 56 bp, Homo sapiens
tgagacagtttcactctgtcacccaggctggagtacagtgctgtgatcctggctca

SEQ ID NO: 20727 - DNA, 78 bp, Homo sapiens
ctgtgtgtctgtctgtctctctctgggccatttttctgtgcttctcaatgcagagggcaaaagacagcttctactcag

SEQ ID NO: 20728 - DNA, 58 bp, Homo sapiens
gtttttctgtgtgtgtgtgtgtatatatatatatatgtatatacacatacacaaaaat

SEQ ID NO: 20729 - DNA, 78 bp, Homo sapiens
tagagacagtgaaaaacagccccctgccaggcagtgtcactgtgtgtggcggtgccagggcgcctgagtctgtctctg

SEQ ID NO: 20730 - DNA, 114 bp, Homo sapiens
atgtgtacttcatgagcttgttagtgcacaggttggactacatggtgaagatggccaataagactagtttatatgttgttcaaagcattaacaatggtaaaagtgataatatat

SEQ ID NO: 20731 - DNA, 120 bp, Homo sapiens
gtgaagccaaggtgtcagcagggttagctcttctgagggctgtgaggggaaatctgttctgtgcctctctcccagcctctggccatggtttgcaatcctagttgttcctgggctcctcat

SEQ ID NO: 20732 - DNA, 66 bp, Homo sapiens
catttttgttttgttttttttcgagacagggtctttccctgtcactcagagtgcagtgcagtagtg

SEQ ID NO: 20733 - DNA, 65 bp, Homo sapiens
ttccagagcctaggctgaaggagcagttcctgtctgtgcctctgtcagcctcatggcagagggaa

SEQ ID NO: 20734 - DNA, 113 bp, Homo sapiens
tgaaatatcacttttattatatagtaaagctcatatatatcaaggtctattttttattatgaataactccttgacctattgatttttatctctattagtgtcagagtatttta

SEQ ID NO: 20735 - DNA, 110 bp, Homo sapiens
gggcaactaactcctgggtcatgtcagggtactgggttgcagtgactcaatgtctctccctctctccagtctgcccagcaaaaggatttggccttcggacttacctgctt

SEQ ID NO: 20736 - DNA, 94 bp, Homo sapiens
gagggtaattgatgggacttagggagacgaagaactgatcaaggtgctatggtttgaatgtgtgtgtctctctaactttcatatgttgcaactc

SEQ ID NO: 20737 - DNA, 56 bp, Homo sapiens
gcctgcacatagccaagttagagtctgcctgactctatctcaatctattctcaggc

SEQ ID NO: 20738 - DNA, 97 bp, Homo sapiens
tttaataaagagaggatcagaagatattaagtgtgtgtgtatatatatatatatatatatatatatttttttttttttttttttttttttttttgag

SEQ ID NO: 20739 - DNA, 109 bp, Homo sapiens
tgggctctgtgctcctgcctgtgctcccggctcacttgcgtcagtcatgctctctcagactgtaatggcatcaaagtttggaaattcctgggcagatacaaaatgttca

SEQ ID NO: 20740 - DNA, 58 bp, Homo sapiens; identical to SEQ ID NO: 315

SEQ ID NO: 20741 - DNA, 68 bp, Homo sapiens
gcaatagctccagtttgtgataaagatgacaatttttttttatttgagacagagtctggttctgttgc

SEQ ID NO: 20742 - DNA, 77 bp, Homo sapiens
cactcagtatagctgagtgactttgggcaagctaggcaaccactctttgtctcagtccctcatctataaaatgagtg

SEQ ID NO: 20743 - DNA, 66 bp, Homo sapiens
gaggcgaagtctctctctgtcacccaggctggagtgcagtggcgtgatctcggcaagctccgcctc

SEQ ID NO: 20744 - DNA, 111 bp, Homo sapiens
agagtcaccactgatttttatgttgattttgtatcttgtaactttactgaatttgtttatcagatctaagagtttctagatataaaatcatgtcatctgcagtttgtcttt

SEQ ID NO: 20745 - DNA, 131 bp, Homo sapiens
tcatgaacaaatcactgtggacaggcggcaggtagagtgtggtgattggattatcttagattacatgcttcactctcaagcctgggggatggagttggctgaatgaaaacaatatagactaagagttggtg

SEQ ID NO: 20746 - DNA, 76 bp, Homo sapiens
aagtctgtggaagacgttttgcagcagatgttctggtaaacataaagacattttgtagatgtgtttcattggactt

SEQ ID NO: 20747 - DNA, 95 bp, Homo sapiens
gctgcacggtactgggactggtaatgagcatggtgtgtgttgtgtctgtgcacactcagagccacacacatagtgcgtccactcacacgtgctgc

SEQ ID NO: 20748 - DNA, 84 bp, Homo sapiens
tctgcaggcagaggctgaagaattgtgtgccgcccatttatgtgtataactgtgtgtgtgtgtgtgtcagagaacctgggcaga

SEQ ID NO: 20749 - DNA, 92 bp, Homo sapiens
acagttctggaggggagaagtctgagatcatggtgccagcatgggcaggttttggtgaggaacctcctccaactgtctactgctggctctcc

SEQ ID NO: 20750 - DNA, 72 bp, Homo sapiens
tgttcatattctcagatgacacagtgcagaacatgtggacatcccatgcactgtgaagtcttaaaatttaca

SEQ ID NO: 20751 - DNA, 118 bp, Homo sapiens
tgcttaggattgtcttggctatacgggctcttttttggttccatatgaaatttaaagtagtttcttctaattctgtgaagaaagtcaatggtagcttgatggggatagcattgaatct

SEQ ID NO: 20752 - DNA, 86 bp, Homo sapiens
ggaacatgaatctctctgtgtgtgtgaatgtagtacccaaagaaagacagtggctgtgtatcgttcatggggatgaggttctttct

SEQ ID NO: 20753 - DNA, 98 bp, Homo sapiens
tatgtgtatatgcatacatacacatatgtatagatacatatatgtgcatatgtatgcatatgtgtatatacatatgtatatgtatgcatatgtacata

SEQ ID NO: 20754 - DNA, 114 bp, Homo sapiens
gggctcccaatgattctacattatggtgagttgtacaattatttcattatatgttacaatgtaataataatagaaataaagtgcacaataaatgtaatgcacctgaatcatccc

SEQ ID NO: 20755 - DNA, 59 bp, Homo sapiens
tacacacacatacatatatatacgcatgtatatatgtgtgtactttaatgaagtgtgta

SEQ ID NO: 20756 - DNA, 104 bp, Homo sapiens
ggtatgtgtccattaaataactgactgataatgggaaagactttttttttttttgagacggagttttgctcatgtcacccaggctggattgcagtggcacaatc

SEQ ID NO: 20757 - DNA, 58 bp, Homo sapiens
tgaggcagagtctcgctctgtctcccaggctggagtgcagtggcgtggtctcggctca

SEQ ID NO: 20758 - DNA, 76 bp, Homo sapiens
tgcttgtaataaaataactttgggcatattgtggtaattatttaattatcatttgcttggagttagaggctcagca

SEQ ID NO: 20759 - DNA, 58 bp, Homo sapiens
tgagatggagtctcattctgtcactcaggctggagtgcagtggtgcgatcttggctca

SEQ ID NO: 20760 - DNA, 89 bp, Homo sapiens
tcagcctgggcaacatagtgaggcctctgtctctacaaaaaactttttttttttttttgagacagagtgtcgctctgtcaccaggctgg

SEQ ID NO: 20761 - DNA, 86 bp, Homo sapiens
taagattgagagtgtgtgcctgtgacacagcctcaggaggtcctgatgatatgttcccaaggtggtcagagcacagtttggtttta

SEQ ID NO: 20762 - DNA, 83 bp, Homo sapiens
gcgaatgagaatttctacttgacatcatgttttggttatttaattagaacatttttgacaagtttataggtcttctatagcgc

SEQ ID NO: 20763 - DNA, 118 bp, Homo sapiens
atatatgtgtatgtatatatacatgtgtgttacacaggtgtgtatacgtgtgtgtgtgtatgtatatatatatatatatatatatatatatatatatatatatatatatatatatata

SEQ ID NO: 20764 - DNA, 101 bp, Homo sapiens
ctttactgtaaagtgttataaatctgtcacccgtggatgtccttaaatcttttttgggaagctatttatatttttacttggtgtcatttcttgcagtaaag

SEQ ID NO: 20765 - DNA, 82 bp, Homo sapiens
gtgttttgaaaatatatatgtttgcatacatgcattagaacacattttaatgcgtgtatatatatttaattttacaaaatac

SEQ ID NO: 20766 - DNA, 94 bp, Homo sapiens
gggtacaggtgattttagttacaaggatgaattgtatagcggtgaagtctgagattttagtgcacccatcacttgagtactgtacattgtaccc

SEQ ID NO: 20767 - DNA, 117 bp, Homo sapiens
ccaaaatccaaatcaaatcagtaaatatgggagcagtaaacattccttttttttttttttttttgagatggagtcttactctgtcacccaggctggagtgaagtggcataatcttgg

SEQ ID NO: 20768 - DNA, 69 bp, Homo sapiens
atcataaagtatgtttggtggggggtgcttgtgcatgtgcgtgcctgcctgcctgcatctgtatgtggt

SEQ ID NO: 20769 - DNA, 107 bp, Homo sapiens
gctgtgagcagttctaggaaattcagcattctagccagagagaagagtcagggcaaatcccttggcatgggaaggattttgagtgttggaggactagcaagagaagc

SEQ ID NO: 20770 - DNA, 92 bp, Homo sapiens
tttggagagagaatggccccatagacactttcacagcagtctcacaacttccacattctctgtctatctctctggtgccttctgtggccaaa

SEQ ID NO: 20771 - DNA, 86 bp, Homo sapiens
ggaggctgaaatctgagatcaaggtgtcagcaggtttggtttcttctgaggctcctgcccttggcttgcagatgtctgtgttctcc

SEQ ID NO: 20772 - DNA, 69 bp, Homo sapiens
catccctcccttcctccctacccaactctgctatatggaccagagtcagaggagagtgaagacaggatg

SEQ ID NO: 20773 - DNA, 95 bp, Homo sapiens; identical to SEQ ID NO: 68

SEQ ID NO: 20774 - DNA, 93 bp, Homo sapiens; identical to SEQ ID NO: 69

SEQ ID NO: 20775 - DNA, 123 bp, Homo sapiens
tcccttcaagtaagaacacagaccagtaaagaagctaccaacttgctgcctgacactctgtgtatttgggggaatttctgctctttggactggttaagaatgcaaaggatgggcagcagtagg

SEQ ID NO: 20776 - DNA, 101 bp, Homo sapiens
gacacaggccttcatcctgagcactgaagcctcagtctgactctttgttagagtttcctttcagtcactgggaaagcaaagtagaggactaggcctttgtc

SEQ ID NO: 20777 - DNA, 118 bp, Homo sapiens
ggagaattgtgggaagccatggctgcagggttttggagtctttacactgtctctctgtctcagtcctactctaccctagggctcctcctttcctgcgactggcagccttcatcttttc

SEQ ID NO: 20778 - DNA, 68 bp, Homo sapiens
gcctgccatcatgcccggctaacttttgtatttttagtagacacagtgcttcttcatgttggtcaggc

SEQ ID NO: 20779 - DNA, 61 bp, Homo sapiens
gagactcagtctcgctctgtcgcccagcccaggctgaagtgcagtggtgcagtctcagctc

SEQ ID NO: 20780 - DNA, 75 bp, Homo sapiens
gatcctatgttaagataaagtgagtcggaggatgtcagcctgctttcttctgttctcagtctgtaaccagagatc

SEQ ID NO: 20781 - DNA, 112 bp, Homo sapiens
tattcatagtaatatatattcattgtgtatatgtatatatatacactactcataatatatatatatacatatatatatcttatagtaaattatttagcatcattcatgagta

SEQ ID NO: 20782 - DNA, 99 bp, Homo sapiens
agtgcttattaaaaatgtgtaaaatggttaagccatccaaatgaagtattccttcatttgtcattggttttcatgctcaatactcgtgtctttagcatt

SEQ ID NO: 20783 - DNA, 58 bp, Homo sapiens; identical to SEQ ID NO: 2595

SEQ ID NO: 20784 - DNA, 95 bp, Homo sapiens; identical to SEQ ID NO: 68

SEQ ID NO: 20785 - DNA, 93 bp, Homo sapiens; identical to SEQ ID NO: 69

SEQ ID NO: 20786 - DNA, 90 bp, Homo sapiens
gtgtttttttctgcatttgctgagaagtgttttacttgtgattatgtgattgattttagagtaagatatttggcaatgagaagaatgtat

SEQ ID NO: 20787 - DNA, 97 bp, Homo sapiens
atataaaaaacaccaatttgtgtgtgtgtgtatatacatatatatgtgtatatatatgtgtgtgtgtatatatatatatatgatcggtgttctatat

SEQ ID NO: 20788 - DNA, 95 bp, Homo sapiens; identical to SEQ ID NO: 580

SEQ ID NO: 20789 - DNA, 93 bp, Homo sapiens; identical to SEQ ID NO: 69

SEQ ID NO: 20790 - DNA, 95 bp, Homo sapiens; identical to SEQ ID NO: 580

SEQ ID NO: 20791 - DNA, 93 bp, Homo sapiens; identical to SEQ ID NO: 69

SEQ ID NO: 20792 - DNA, 105 bp, Homo sapiens
ctggctccatcgtctcctctgctgggacaactgaggagtgcttcacactggctctctgagtttatctagtggggttaagctccagttgtccacagtggtagttgg

SEQ ID NO: 20793 - DNA, 69 bp, Homo sapiens
cacttcccatgaatggggcttgcaggactcggggttgctctgggtgagtctgtgagtgagtggtgagtg

SEQ ID NO: 20794 - DNA, 98 bp, Homo sapiens
gccatggatgggattattatagacagaagtagaagcatgtatacatacctggagaggagataatagtgctagaggagcttcaagtaacccagtatggt

SEQ ID NO: 20795 - DNA, 95 bp, Homo sapiens; identical to SEQ ID NO: 68

SEQ ID NO: 20796 - DNA, 93 bp, Homo sapiens; identical to SEQ ID NO: 69

SEQ ID NO: 20797 - DNA, 81 bp, Homo sapiens
ttcctatctcaatttttatgttttgtagcacattctttggtttgaccaatgctatagtcattgaggagtagagatagtgga

SEQ ID NO: 20798 - DNA, 58 bp, Homo sapiens; identical to SEQ ID NO: 7074

SEQ ID NO: 20799 - DNA, 119 bp, Homo sapiens
tgttccttttgcttgggattgtcttggctatacaggctcttttttggttccatatgaaatttaaagtagttttttctaattctgtgaagaaagtcaatggtagcttgatgggaatagca

SEQ ID NO: 20800 - DNA, 123 bp, Homo sapiens
tgtggtgtgtgcagtaacgggctgataagctggctctctgacaaaccacacacacacatacacacactcatgcacacatgcacaccttgatttgtagcatttgttgagttcatggtgtacgtg

SEQ ID NO: 20801 - DNA, 95 bp, Homo sapiens; identical to SEQ ID NO: 68

SEQ ID NO: 20802 - DNA, 93 bp, Homo sapiens; identical to SEQ ID NO: 69

SEQ ID NO: 20803 - DNA, 110 bp, Homo sapiens
tctattgtctttaccccatttcatgtatacacacatgtaatgtatgtatgtatgtacatatgcatgtatgtatgtgtgtgtgcacatcctggaggcctcctgcatctaga

SEQ ID NO: 20804 - DNA, 95 bp, Homo sapiens; identical to SEQ ID NO: 68

SEQ ID NO: 20805 - DNA, 93 bp, Homo sapiens; identical to SEQ ID NO: 69

SEQ ID NO: 20806 - DNA, 111 bp, Homo sapiens
atgagactatggcactccataaagcattgctggtgttcttttttattttctttatttcttctaaaaagaaacaaacaggatacaggtacagaatgtgcaggcttgttacat

SEQ ID NO: 20807 - DNA, 108 bp, Homo sapiens
ggctgagtagtattccacagtgtgtgtgtatatatgtatatatgtatacgtgtgtgtgtgtatatatgtatatatatataccacattttctttatctactttttggtt

SEQ ID NO: 20808 - DNA, 86 bp, Homo sapiens
ggctttacaagaagatagataagattatggctatgggggcacaagctcaaaagaataagattgtttttcattttgaaaaatgagcc

SEQ ID NO: 20809 - DNA, 84 bp, Homo sapiens
tagtgtgtgtgtatatatatatatagtgtgtatatatatatatagtgtgtgtgtgtgtatatatatagtgtgtatatatatata

SEQ ID NO: 20810 - DNA, 83 bp, Homo sapiens
tgatgccaagtctcactctgtcacccaggatggagtgcagtggcgtgatcttggctcactgcaacctccgcctcccaagtgca

SEQ ID NO: 20811 - DNA, 110 bp, Homo sapiens
tggccaagaatctgaattttattctgggagccttatgaatttttttgttttgttttttgtttttgacatggagtctcactctatcgctcaggctggagtgcagtggcgca

SEQ ID NO: 20812 - DNA, 116 bp, Homo sapiens
tcatgcaaaagctgcagaactgtgaagaggagctgaaagcatgtggtatgtttaaatatgctagagcaatatgctgaccagcgaggtttgtttattaaaattcttatgcggggtga

SEQ ID NO: 20813 - DNA, 104 bp, Homo sapiens
gtgttctgtctatgtgtgtttctctctgtccaaacttgcttttttttttttttctaataagggcactagttatattggattagggaccagcttcatgatctcac

SEQ ID NO: 20814 - DNA, 117 bp, Homo sapiens
tgctatgtgtgaaaatagagacttacaaagcaggtgtattagagtaccgtttttcatcttgtcaaaggaatcatctttgcatttgctcctcttctctattctgtatcataatctgta

SEQ ID NO: 20815 - DNA, 64 bp, Homo sapiens
ctgggttaagtcaaaccctcatgtctggttccacgagaatgtgcatgagcagctgacagcctag

SEQ ID NO: 20816 - DNA, 67 bp, Homo sapiens
gcatgggttggcatttagcaaaacttttttttttttttgagactaagtctcgctctgtcacccaggc

SEQ ID NO: 20817 - DNA, 68 bp, Homo sapiens
tgttttgagatggagtctcactttgtcactcaggctggagtgcaatggtgcgatctcggctcgctgca

SEQ ID NO: 20818 - DNA, 95 bp, Homo sapiens; identical to SEQ ID NO: 6311

SEQ ID NO: 20819 - DNA, 115 bp, Homo sapiens
tttcaacaatattgtcagtctttgcatgttgaatatgggttgcaaactagaaatcatgaaactttttatttatttcttatataaacacgcagaggggaaatagacgtgggtggga

SEQ ID NO: 20820 - DNA, 108 bp, Homo sapiens
ggtttagtactttcactctactcccatatcagtcaaaatatttatttaatagttcatgtaaaatagtgaagttttaggtgatgtgatgggtacagtaaaatataagct

SEQ ID NO: 20821 - DNA, 113 bp, Homo sapiens
cctatctgtggatttgtctgtgttttcattccatcttaaaatgcaagagctatacaagtatatatatgtatatgtatctttaagataaataatattgccctttgacagatgag

SEQ ID NO: 20822 - DNA, 58 bp, Homo sapiens; identical to SEQ ID NO: 1725

SEQ ID NO: 20823 - DNA, 80 bp, Homo sapiens
gatttgataagctatgctcgtggtccaacacattagaacaatgagtgaagactctgagcataaagtcatgcaatcagatt

SEQ ID NO: 20824 - DNA, 74 bp, Homo sapiens
gtttgtttcgagacagagtctcgctctgtcacccaggctggagtgcagagacgtgacctcagctcactgcaagc

SEQ ID NO: 20825 - DNA, 107 bp, Homo sapiens
accagactagattttataagagtacaaaatgcagaggagtgcatataaatatgtggatgtgtgtgtgcatgtgcttgtagggtgcatagaataaaaactggaagggt

SEQ ID NO: 20826 - DNA, 101 bp, Homo sapiens
aatacttttatgtatggatgcataaactttatatataagtatacattgccgttagaggcttatagatttcatttatgtgtcttagttacaaaaattgtatt

SEQ ID NO: 20827 - DNA, 99 bp, Homo sapiens
ttcactttcagcctgaggtagtcacatttttttctttttaagtccaaagagaatttggatagaaatcagaaaagatttaatgatttagctgactttgag

SEQ ID NO: 20828 - DNA, 111 bp, Homo sapiens
ccacattttcctgacactttttaccactttcaccctggatttgatctgtgtgtgtgtgtgtcaccacccaaatctcatgttgaattgtaatccccatatgttgaaggatgg

SEQ ID NO: 20829 - DNA, 95 bp, Homo sapiens; identical to SEQ ID NO: 68

SEQ ID NO: 20830 - DNA, 93 bp, Homo sapiens; identical to SEQ ID NO: 69

SEQ ID NO: 20831 - DNA, 83 bp, Homo sapiens
gctagagacttaggttagggagttaaatgaaatcctgggctataaagcgcttaccactagtccctgacactgagtccctgagt

SEQ ID NO: 20832 - DNA, 132 bp, Homo sapiens
tgtttatgtatttctgtgtgtatgtatttatatactgtgtgtgtgtatatatatatgtgtgtgtgtatatattcgaactcctgacctcaggagtatatatatatatatatatatatacacacacacacacag

SEQ ID NO: 20833 - DNA, 114 bp, Homo sapiens
gagtttcctcccacccccatataacatagaaatgatgattattcttattatttcattttttaaagcctgaattttgagtgggtaaagataatcatcaggtagttggttggtttc

SEQ ID NO: 20834 - DNA, 79 bp, Homo sapiens
aggagttggtacagagaactcagagtgatgatgaaactaaactgttagtttgtctgaaattttctctgaaattgctcct

SEQ ID NO: 20835 - DNA, 93 bp, Homo sapiens
aacatatatataagcaaatacatatatatatatatatatatatatatatatatatatatatatatatatatatatatatttgttgttgttgtt

SEQ ID NO: 20836 - DNA, 98 bp, Homo sapiens
gccactgtactccagcctgagcaacagagtgagactctctctctcaaaaaaaaaaaagagatttggggtttctgctttacctcagaataaatcagagc

SEQ ID NO: 20837 - DNA, 96 bp, Homo sapiens
gagggagaaagagtggatctcaggaattttcagtttattttattttattttatttacttttacttatttttttgagacagtctcactctgtcgttc

SEQ ID NO: 20838 - DNA, 58 bp, Homo sapiens; identical to SEQ ID NO: 1725

SEQ ID NO: 20839 - DNA, 83 bp, Homo sapiens
ttggggttcgttttttggtttttgttttttcagatagggtctctctctttcacccaggctggagtgcagtcgcacgatctcag

SEQ ID NO: 20840 - DNA, 88 bp, Homo sapiens
ctttagaatatatgtgtgtgtatgtatatgtatatgtgtgtgtatgtatatatatatacaaatacatatacatattggggaaagaaag

SEQ ID NO: 20841 - DNA, 113 bp, Homo sapiens
ctgtcagagtcttgtgggtgaggtggactaagaggcaggtacaatcatgtgataaccaccatgaggtagatggtagataagtgaagcacctctctctacattcagatggagag

SEQ ID NO: 20842 - DNA, 83 bp, Homo sapiens
gaagttttccactaacaatttccacgaatggaagagctctgattctcttattctgcctggaatttttcttgctggggagcttt

SEQ ID NO: 20843 - DNA, 120 bp, Homo sapiens
gagaggagttaccagaagtcagcaaactcctatttttttttttgtttttgtttttcaataacaggacaaacaccaaagaaaaatggccagtggtgtttttgcatcttaattcagctcttc

SEQ ID NO: 20844 - DNA, 112 bp, Homo sapiens
tgtctctgaaaaataaaaatgttgcctcaactgcataagtgattttgtttatgaaaacatgtgagacatttgtgggggaccccaggaaatatttggatggaatttagaggtg

SEQ ID NO: 20845 - DNA, 117 bp, Homo sapiens
ctcaggcacatgctctttgttatatggctaggtgctggtcagtatatattttttaaaacaagaatgtataattgctgaatgtaccttaatttgaaaatgttgtttttttccctgtag

SEQ ID NO: 20846 - DNA, 70 bp, Homo sapiens
ttgtcttgagacaaggtctcgctctgtcactcaggctagagtgcagtggtgtgatcctggttcactgcag

SEQ ID NO: 20847 - DNA, 109 bp, Homo sapiens
ctgcaaacatgacttaaatgcatgtttaatccagaggaaatatagcttcaaattttttaattttaagtatttcagggccctaaacataaaaatgcattgtcatttacag

SEQ ID NO: 20848 - DNA, 56 bp, Homo sapiens
gagacagggtcacactctgtcacccaggctggagtgcagtggtatgatcttggctc

SEQ ID NO: 20849 - DNA, 57 bp, Homo sapiens
tgaaacggagtctcactctgtcactcagctggagtgcagtggtgtgatcttggctca

SEQ ID NO: 20850 - DNA, 58 bp, Homo sapiens; identical to SEQ ID NO: 1911

SEQ ID NO: 20851 - DNA, 87 bp, Homo sapiens
cggacactggctgatggacactggctgactgaaacactgggtggctgacactgggtgacacactggctgactgacactgcctgactg

SEQ ID NO: 20852 - DNA, 62 bp, Homo sapiens
gagtgacagagtgagactctgtcttttttttttttttaagacggagtctcgctctgctgccc

SEQ ID NO: 20853 - DNA, 88 bp, Homo sapiens
tggggactttcagttgctcaatgtggctgtggagctgcagaagcaatcacgctgctttcacagtgagctcactgaggccttcacccca

SEQ ID NO: 20854 - DNA, 90 bp, Homo sapiens
gtagttaatattttttggtccttacaatgtaaggtgggttcttttatccccctttcacacaacaaagtgagaacaaaaattgttacttgc

SEQ ID NO: 20855 - DNA, 110 bp, Homo sapiens
gtttctctctgtggttatgacattaactagattcatatttcagttaaagtgtttcttttctttcttttttttgagacggagttttgctcttgttgcccaggctggagtgc

SEQ ID NO: 20856 - DNA, 83 bp, Homo sapiens
ctggctgtgttgcttcttactgttttttattttcaagattttggggggaagggcatgtttatccaagaggagacactttacag

SEQ ID NO: 20857 - DNA, 58 bp, Homo sapiens
tgagtcggagtctctctctgtcacccaggctggagtgcagtggcatgatcttggctca

SEQ ID NO: 20858 - DNA, 84 bp, Homo sapiens
ggagtctcactctgtcacttaggctggagtgcagtggtgtgatctcggcttactcctccacctcctgggttcaagtgattctcc

SEQ ID NO: 20859 - DNA, 97 bp, Homo sapiens
gcttttctgtaaaaaggagggtcagactgtctgtgtcaggttgttctgaggattaaaagagatgacataggtagagagacacctcaatgtgcagtgc

SEQ ID NO: 20860 - DNA, 58 bp, Homo sapiens; identical to SEQ ID NO: 17746

SEQ ID NO: 20861 - DNA, 87 bp, Homo sapiens
gtgcgcaatatgaatattaggagtaaggaagtaagtaagagtccctgatgtgaaagagcttactcactctctctgtcatgtgagcac

SEQ ID NO: 20862 - DNA, 58 bp, Homo sapiens; identical to SEQ ID NO: 20857

SEQ ID NO: 20863 - DNA, 84 bp, Homo sapiens; identical to SEQ ID NO: 20858

SEQ ID NO: 20864 - DNA, 120 bp, Homo sapiens
gtggaggagaaaaggggaagtgattgtttaagggcttctaaagtactgataatctagttctttaactgaatgttggatatgaggattcattaaaaaattattttaaaaatgtttttggcc

SEQ ID NO: 20865 - DNA, 119 bp, Homo sapiens
agataggccattgcactgtagcctgggtgacaagacaagaccctgtctctcttttttttttttttctttgagacagagtcttactctgtcacccaggctggagtgcagtggcatgatct

SEQ ID NO: 20866 - DNA, 72 bp, Homo sapiens
gcagacagagtctcgctcactcagtgctcaatggtgcccaggctggagtgcagtggcgtgatctcggctagc

SEQ ID NO: 20867 - DNA, 58 bp, Homo sapiens; identical to SEQ ID NO: 9046

SEQ ID NO: 20868 - DNA, 100 bp, Homo sapiens
gctcactttggcaatgtcagtttcttccaggtaagtagtgagaacacagagaaaagactttgtttctttgctgctgggatattttggtctgtgtttgggc

SEQ ID NO: 20869 - DNA, 90 bp, Homo sapiens
agttaccatctaaagtgtagtgaacaaatggacaggaaagaggccgctgccccactcactgcctctcatttattcactcacagggtaagt

SEQ ID NO: 20870 - DNA, 88 bp, Homo sapiens
cccaggctggcatgcagtggaatgatcataattcactgtagccttgacctcctgggctgacccaggctggcatgcagtggtatgatca

SEQ ID NO: 20871 - DNA, 87 bp, Homo sapiens
agtacaagggaagtagagagaaatttcatcaaagggcccagaaaactttttttttttttgagacggtctcgctctgtctcccaggct

SEQ ID NO: 20872 - DNA, 104 bp, Homo sapiens
ctgtgaaagaggcttcatgcagcattccatttcaccttcctctgatctgtgtgaggacactgtgttctggagggtgcagcaaggaggcatcatcttggaagcag

SEQ ID NO: 20873 - DNA, 104 bp, Homo sapiens
acagatttaaggcaatctcagtcaaaaccccaacagggaaatttacaagctgattctaaaattcctttttttttttttttttttgagatggagtctcactctgt

SEQ ID NO: 20874 - DNA, 102 bp, Homo sapiens
tgtgttcattcttacttctgccagccacaaaattgagactttttttttttgagatagagtctcactcagtcgcccaggctgaagtgcaatggtgtgatctca

SEQ ID NO: 20875 - DNA, 77 bp, Homo sapiens
ggaacagtgacaggttgagaattggggacacatctagcacacaccatgtggtaccaggttctcttcttagtacttct

SEQ ID NO: 20876 - DNA, 127 bp, Homo sapiens
atatatgtatatatatgtgtatatatatgtatatatatgtatatatatgtatatatgtatatatgtatatatgtgtatatatatgtatatatctgtatatatatatatgtgtgtatatatatatatg

SEQ ID NO: 20877 - DNA, 100 bp, Homo sapiens
ggctggcctcgaactcctgacctcaagtgatctgcccacctcagctgtagtgtttttgtttttgttttttttcttgagatggagtctcgctctgtcaccc

SEQ ID NO: 20878 - DNA, 83 bp, Homo sapiens
ctggtggtgcacagggtgtcagaacagtgtcagcagggccagcgggggaaagtgctgacaactgtaggcccaggcaggaccgg

SEQ ID NO: 20879 - DNA, 64 bp, Homo sapiens
cattgaaactgatttttttcatagtcggccggaaagcaagactatttgatgttcagtttggatg

SEQ ID NO: 20880 - DNA, 90 bp, Homo sapiens
caggtgcccgccaccacgcttggctaattctttgtatttttagtagagacgagatttcaccatgttgaccaggctggtcttgaactcctg

SEQ ID NO: 20881 - DNA, 58 bp, Homo sapiens
tgagacggaatctcactctgtcgcacaggttggagtgcagtggcgggatctcggctca

SEQ ID NO: 20882 - DNA, 112 bp, Homo sapiens
cgtggtctcccggggttagtcttgctgctgggggaacaggtgtgccttccatctctcactctcagacacatgaagggcctgactgcccagcaaagaaatgactgagcacatg

SEQ ID NO: 20883 - DNA, 73 bp, Homo sapiens
gaggagggaaaaaggatttgaagaaatcactatatcattaaagaggtgatttttttttttttttttttttttt

SEQ ID NO: 20884 - DNA, 125 bp, Homo sapiens
tcagggcacagaacagcaaaaaagggttgacaatggaatgatgcttttttttttttttttttttttttgagatggagtctcactctgttgcccaggctggactgcaatggtgtgatctctgctca

SEQ ID NO: 20885 - DNA, 92 bp, Homo sapiens
ggcacgtcctcaaccttggcaaaataaacctctaaatggactgagatctgtctcagacactttttggtttataggcagtagagggaagtggc

SEQ ID NO: 20886 - DNA, 114 bp, Homo sapiens
gcacaggttttctgtggaaaggaatatatttcctttataatgtctgtaatttctatatatattaggataggtaaatataaaaagtctttaaagaagttaaaatcgaatttgtgt

SEQ ID NO: 20887 - DNA, 104 bp, Homo sapiens
agtgctgccagctactgttttaaaagcacaaaacatagaggtacatttctaaaaattgaatgtgattatgttgttctttctttcagatcggttgtgtaagcatt

SEQ ID NO: 20888 - DNA, 58 bp, Homo sapiens
tgagatggagtctcactctgtctcccaggctggagtgcagtggcaggatctcaactca

SEQ ID NO: 20889 - DNA, 66 bp, Homo sapiens
tcctctttgctcttgtgtctgtttaacagatttttatgttaacaggcactctgtttgccactagga

SEQ ID NO: 20890 - DNA, 82 bp, Homo sapiens
gagtctcactgtcactcaggctggaatgcagaggcaggatctcagctcactgcaacttccatctcctgggttcaagagattc

SEQ ID NO: 20891 - DNA, 91 bp, Homo sapiens
gatgaggagttgatttttaaggatgagaaaagattgggattttcctctttttttttttttttttttttttgagactgagtctcactctgtc

SEQ ID NO: 20892 - DNA, 63 bp, Homo sapiens
tctggaagacagtttggcggcttcttttttttttttaaactgagtctcactctgtcgtccagg

SEQ ID NO: 20893 - DNA, 130 bp, Homo sapiens
tgtgtgtgtgtgtgtgtgtttatatacacactatatatatatgtatatatacacataatgtatctatatatgtgtgtgtgtatatatatatatttatacaaaataaatatatgtgtgtatatatatatat

SEQ ID NO: 20894 - DNA, 113 bp, Homo sapiens
gcatatatatttatatatgtatatatatatgtgtgtgtatatatgtgtatatatatacacacatatatacatgtatatatatatatacacacacatatacatgtatatatata

SEQ ID NO: 20895 - DNA, 139 bp, Homo sapiens
acgtgtgtgtgtgtgtgtgtgtgtgtgtgtgtgtgtatatatatatacatgtatatgtgtgtgtatatatatatatacatgtatatatgtgtgtatatatatacacatatatacacacacatatatatatacatatata

SEQ ID NO: 20896 - DNA, 82 bp, Homo sapiens
ggtctcactgtgtcactcaggctggagtgcagtgatgcaatcatagctcactgcagcttcaaactccttggctcaagggatc

SEQ ID NO: 20897 - DNA, 58 bp, Homo sapiens; identical to SEQ ID NO: 9336

SEQ ID NO: 20898 - DNA, 94 bp, Homo sapiens
ggagtgcagttgctgggtcatgtggtagttgcatttttagttttttaagaaactgctaactcttttccagagtggctgtaccattttacattcc

SEQ ID NO: 20899 - DNA, 112 bp, Homo sapiens
ctagtggcagtaaggaaccacagaaggattttatttatttattttatttttatttttatttttattttttattttttttagatggagtctctctgtgtcacccaggctagag

SEQ ID NO: 20900 - DNA, 62 bp, Homo sapiens
ggggcaggggcaggggcaggggtatgtgtgtgtgtgtgtctgcctgtctgtctgtctgtctc

SEQ ID NO: 20901 - DNA, 80 bp, Homo sapiens
cagatagggtgaccaaccattctggggttttgtttgtttgtttgtttttcagacacagtctcagtctgtcacccaggctg

SEQ ID NO: 20902 - DNA, 103 bp, Homo sapiens
gctgtgtaataagccaccccaaactgcagggcctaaaacagtcattctctttgtctgacaggttctgtgggtcagattttggttgggacttggcaaggacagc

SEQ ID NO: 20903 - DNA, 59 bp, Homo sapiens
tgagatgggagtctcgctctgtcactcaggctggagtgcagtggtgccacctcagctca

SEQ ID NO: 20904 - DNA, 58 bp, Homo sapiens; identical to SEQ ID NO: 605

SEQ ID NO: 20905 - DNA, 80 bp, Homo sapiens
cagccaggtgataaaatgagaccctgtctctctttttttttttttttttgagatggagtctcactctgtcacccaggctg

SEQ ID NO: 20906 - DNA, 82 bp, Homo sapiens
ggcatagttccctgttgtatttttattttatgtatgctgattttaaaaagtagagatgatgcagggcgcggtggctcatgcc

SEQ ID NO: 20907 - DNA, 108 bp, Homo sapiens
gcataggattttcttggctatacgggcttttttttggttccatatgaaatttaaagtagttttttctaattctatgaagaaagtcaatggtagcctgatggggatagc

SEQ ID NO: 20908 - DNA, 62 bp, Homo sapiens
gtgcagctctcagtgaaagcctgagagccctcaggaggctctcagagtctgagtccaatgcc

SEQ ID NO: 20909 - DNA, 95 bp, Homo sapiens; identical to SEQ ID NO: 68

SEQ ID NO: 20910 - DNA, 93 bp, Homo sapiens; identical to SEQ ID NO: 69

SEQ ID NO: 20911 - DNA, 112 bp, Homo sapiens
gagatttagggcataatcctcaaagacaggctaatataatctattttttgattaaaaaaaggaacttttggtttaaagtaagatgttcagctgctcttagagtttatttctc

SEQ ID NO: 20912 - DNA, 95 bp, Homo sapiens; identical to SEQ ID NO: 68

SEQ ID NO: 20913 - DNA, 93 bp, Homo sapiens; identical to SEQ ID NO: 69

SEQ ID NO: 20914 - DNA, 79 bp, Homo sapiens
tgagatggagtctcactctgtcacccaggttggagtgcagtggtgcgatctccactcactgcaagctctgcctcctggg

SEQ ID NO: 20915 - DNA, 119 bp, Homo sapiens
tgtttcttgaagctcttgcatataagtactgatttggaagtgcactttaatttttttcttttgattagagtaaaatctgaaaagtgcaatgatttggcactgtgcagcaataggtagca

SEQ ID NO: 20916 - DNA, 68 bp, Homo sapiens
taaccagctcctgcgatgacattaatctgttcactagggcagagtgctcacagtgcagttgctgcttg

SEQ ID NO: 20917 - DNA, 120 bp, Homo sapiens
tggcttgcttttagtgattgtgtgattttgttttattttatttatttatttatttatttatttatttatttatttatttatttttgagacagagtctcactctatcacccaggctagagt

SEQ ID NO: 20918 - DNA, 116 bp, Homo sapiens
ggaatgaaagtgatgtattcgtgaagtagagtctggggcaagattcattttttattgattaaagaagttagttttactcttagtgtagaccatttcatttgttcagtttatatttt

SEQ ID NO: 20919 - DNA, 95 bp, Homo sapiens
gaaatatagatacaatatatatagatatataagcatatatgtgtaagtacgtatatacatatttatgtgtgtttgtatatacgtgtttcagtgtt

SEQ ID NO: 20920 - DNA, 59 bp, Homo sapiens
gtattcattgagtccgtatttaggcactgttcttagtgcttgtgatatgtagtgaatac

SEQ ID NO: 20921 - DNA, 63 bp, Homo sapiens
ttgagagagtctcgctctgtcacccaggctagagcacagtggcacgatcgtggctcactgcaa

SEQ ID NO: 20922 - DNA, 108 bp, Homo sapiens
tccacatgctgaaaatgttattgctgagacttaatcagaatatgtgggaaatattttttttaaacttttgtactaagcagcttttgtatgcagtgttgactccgtggg

SEQ ID NO: 20923 - DNA, 138 bp, Homo sapiens
aaaagaaaatatagaattagccataatgaaaatattgtgtgttgtttctattttttcttttcttttttttttttgagatggagtctcactctgtcactcaggctggagtgcagtagtgcgatctcggctcactgcagc

SEQ ID NO: 20924 - DNA, 88 bp, Homo sapiens
gcagaagtccaattaatgacactgtagtcagactggagaaaaacattaactctgagctcaacttgaatgcaatggtgttggactaggc

SEQ ID NO: 20925 - DNA, 58 bp, Homo sapiens; identical to SEQ ID NO: 1265

SEQ ID NO: 20926 - DNA, 118 bp, Homo sapiens
ggccttgaagaaagtgcttgtatctattcagaatgtgacatcattttatgtttttataacacaaaggcagactggaatagaagtaaaagattttgggaagagttggagaagcggggtt

SEQ ID NO: 20927 - DNA, 160 bp, Homo sapiens
atatatatatatagatatactatctatctatacatatatgtatatatagatagatatactatctatctatacatgcatgtatagatagatatactatctatatatacatatatgtatatgtatatagatatactttctatatagatataaatatgtatat

SEQ ID NO: 20928 - DNA, 81 bp, Homo sapiens
tatctatctatacatgcatgtatagatagatagtatatctatctatatatacatatatgtatagatagatagtatatctat

SEQ ID NO: 20929 - DNA, 119 bp, Homo sapiens
cctctagacacccgggttcctgtctagcatccaggaagaatcagattacatgaatggattgaagggtggtgtatgtggaggattttattgggtgatggaagtggctctcggtgggacgg

SEQ ID NO: 20930 - DNA, 58 bp, Homo sapiens
tgagactgagtctcactctgtcacccaggcaggagtgcagtggtgcgatctcggctca

SEQ ID NO: 20931 - DNA, 76 bp, Homo sapiens
ggaggctagaagtctgagatcaaggtgtcagcaggattggtttcttctgaggcctctcttctgggcctgtgtcttc

SEQ ID NO: 20932 - DNA, 93 bp, Homo sapiens
gtgttatgtgtgtgtatgtgtgtgtatatacaggtatatatgtatgtgtatgtatatatgtgtatgtatatgtacatatacatatgtatatat

SEQ ID NO: 20933 - DNA, 85 bp, Homo sapiens
caagtagctgggaccacactcgcaggagccatcacacccggctaatttttgaaagtttttgtagtggcaaggtctcactacgttg

SEQ ID NO: 20934 - DNA, 76 bp, Homo sapiens
atgtgacatatatagatatgtatagatccatttattgatatgtgtgtatatatatctatgtatctgtatctcatat

SEQ ID NO: 20935 - DNA, 83 bp, Homo sapiens
agcttgggcagcatagagaaagtctgactctaaaacttttttattttttttttgagacaggatctcactctgtcacccaagct

SEQ ID NO: 20936 - DNA, 69 bp, Homo sapiens
aatcatttcatctgaggcaccagagcatacatggtttcctctgtgcctgtcaccctcagagagctgatt

SEQ ID NO: 20937 - DNA, 110 bp, Homo sapiens
aggactacatatgtatgccaccatgcctggttaaattttttattttctgtaaagatggaggctcactgtgttaccaggctggtctcaaactcttggcctcaagtggtcct

SEQ ID NO: 20938 - DNA, 118 bp, Homo sapiens
tgtatgtgtatatatgtatatgtgtatatgtatatacatacacacatatacgtctatgtatgtgtatatgtatatgtgtatatatatatgtatatacacacacacacacacacacaca

SEQ ID NO: 20939 - DNA, 88 bp, Homo sapiens
catggcatcatgtcattctgtgtttttttagtattttttcattttttctgtttagaaaaatacaagaatcagatgatcatgattcatg

SEQ ID NO: 20940 - DNA, 92 bp, Homo sapiens
gctatacgggctcttttttggttccatatgaaatttaaagtagtttttcctaattctgtgaagaaagtcaatggcagctagatggggatagc

SEQ ID NO: 20941 - DNA, 118 bp, Homo sapiens
agcttatttgtcctttaaatggatttgaaaccatatatatatatatatatatatatatatatatatatatatatataaatgccttagataaatttatattataatctcacctacagct

SEQ ID NO: 20942 - DNA, 76 bp, Homo sapiens
ggaggctgaggtaggaggatcacttgaacctgggaggcagaggttgtggtgagctgagattgtgccattgcactcc

SEQ ID NO: 20943 - DNA, 166 bp, Homo sapiens
actttgggaaccactgtttcagagaagataagttgtttttttaaaatttatttatatttttatgaatgtagttttattagagacaaggtctcactctgtcactcaggctggagtgcagtggtgttatcatactcactgcagccttgaactcctgggcccaagtgat

SEQ ID NO: 20944 - DNA, 66 bp, Homo sapiens
taggcactgacatggaaaaggtatgtataaatgaagaatctcatgccttttttttttttttgcctg

SEQ ID NO: 20945 - DNA, 96 bp, Homo sapiens
tcctggttcttggggttgaatctagtttagtatttgtccagaatttatttttgtttcttagtactatcattaacggttgcactcaagtaagcaggg

SEQ ID NO: 20946 - DNA, 83 bp, Homo sapiens
ggttcgcatttgtagtcctagctactttgaaggctgaggtgggaggatggtttgagcctgggaggtgggggttgcagtgagct

SEQ ID NO: 20947 - DNA, 97 bp, Homo sapiens
caaaaagtgctatcacaagaaaggatggtgtgtgtgcatgtgcatgtgtgtgtactgcatttgcatagataattattggagtttgatagacagtttg

SEQ ID NO: 20948 - DNA, 105 bp, Homo sapiens
tggaatagttttgtgcaggattgctttcagtgtggtagagttcagctgggaaaccaactggtccaggatgtttttttgttggtaggtttttcattactgattcca

SEQ ID NO: 20949 - DNA, 68 bp, Homo sapiens
ggaaaagagtgaagatggtctgattatttatttatttatttattgagacagagtctcactctgtcgcc

SEQ ID NO: 20950 - DNA, 103 bp, Homo sapiens
gtagcatgtatatagtattatgtattataagtaacctagagattatttaaagtagacagaagattgtgtgtaggttatatgcaaatactatgccattttctat

SEQ ID NO: 20951 - DNA, 114 bp, Homo sapiens
ctttatcaactctgtcatctctcatttctgtttctctcaaatttacaggatgtaaacaaacttcactctgaaagaacagaaactgaaaaggcctgtgacaaagcttgaggacag

SEQ ID NO: 20952 - DNA, 111 bp, Homo sapiens
ggtatagacattgagatggtgcagttccttatagccagaactgagagggcacagacttccagtgagacttcccagagctatgctgtgtgcaaacatctattcaataatatc

SEQ ID NO: 20953 - DNA, 84 bp, Homo sapiens
tgcagggggaaggaattcttgagtttttgttgttcctactgctgtggatgatgaactcgacaccaaaggagattgtccccctca

SEQ ID NO: 20954 - DNA, 97 bp, Homo sapiens
cacctgtctatgtcaactctgtcaggctcactctttccttatctggactttttcagttaagattcttaggattgaaagcaacagaatatgttttgtg

SEQ ID NO: 20955 - DNA, 117 bp, Homo sapiens
atatgtagaaagaaaaggagactcaaattttcattttcaaaatgggataaattttaatatatttgcatgccaaggaactttgtcttttgataatttgatcactgtgtgtctacatgt

SEQ ID NO: 20956 - DNA, 78 bp, Homo sapiens
gtatatatatgtatatatgtatatatatgtatatatgtatatatgtatatatatatgtatatatgtatatatgtgtac

SEQ ID NO: 20957 - DNA, 106 bp, Homo sapiens
ttgtaatgcttgtaatttgtcgtgtgccggagtaattgaaacaaatatgtaatatactacatattttacttatttattgttccccactataatgcaagctctatga

SEQ ID NO: 20958 - DNA, 93 bp, Homo sapiens
gcctgttttcaggagacagaaatgttgggctctatctgctttttttttttttttttttttttttgagaaggagtctcgctctgtcacccaggc

SEQ ID NO: 20959 - DNA, 90 bp, Homo sapiens
tatttacatatacacacatatatatacacatatataacatgttatatatatgtgtgtgtgtgtatatatatatgtgtgtgtatatatata

SEQ ID NO: 20960 - DNA, 97 bp, Homo sapiens; identical to SEQ ID NO: 1307

SEQ ID NO: 20961 - DNA, 88 bp, Homo sapiens; identical to SEQ ID NO: 1308

SEQ ID NO: 20962 - DNA, 81 bp, Homo sapiens; identical to SEQ ID NO: 1309

SEQ ID NO: 20963 - DNA, 77 bp, Homo sapiens; identical to SEQ ID NO: 1310

SEQ ID NO: 20964 - DNA, 73 bp, Homo sapiens
aaacatttactatgtatgtgtgtttccatatgtttactatatatatatgtgtttccatatgtagtaaatgttt

SEQ ID NO: 20965 - DNA, 96 bp, Homo sapiens
attttttttaaaagaccaatggtatatgtgtgtacatctatgtatgtgtatgtatatatatatatgcgcattggtacatagaaaaaatacactcca

SEQ ID NO: 20966 - DNA, 114 bp, Homo sapiens
agagctcagaatctacaaatttcctggggaccatattgatttggaagaaggtcaactgttctgaattagttgcaatgattctgagggtttttgaagaagatcctagtttgctct

SEQ ID NO: 20967 - DNA, 67 bp, Homo sapiens
gttgcacagatggttcacagaaggcagtgagctaagagttctatgcttgatgttggctattggtttc

SEQ ID NO: 20968 - DNA, 99 bp, Homo sapiens
gcccatatatgtgaaaacagtagcacatttggggttttaaagcttccgaaagaatagggcagagatgagactgagcagaagctaaggattttacacggc

SEQ ID NO: 20969 - DNA, 91 bp, Homo sapiens
cacaaaaaattagccgggtgtggtggtgcgtgcctgtagtcccagttactcaggaggctgaggtagaagaatcacttgaacccaggaggtg

SEQ ID NO: 20970 - DNA, 58 bp, Homo sapiens
tgagacagggtctcactctgtcagccaggctggagcgcagtggtgtgatctcggctca

SEQ ID NO: 20971 - DNA, 213 bp, Homo sapiens
atatgtatacaagtatacatgtatacatatatgtgtatatgtgtgtatatgtatatatgtgtatatatagtgcgtttgtgtatatatgtgtgtatgtatatatgtgtatgtatatatatgtgtatgtatatatgtgtatatatgtatgtgtgtatatgtgtatatatgtatatatatgtgtgtgtgtaaatatatatatacatatttaccatg

SEQ ID NO: 20972 - DNA, 127 bp, Homo sapiens
tttggacatttcattcaagagggaatagactaagtgatctgcttcataaatctagcagcttatgtattgtgtcttgttctttccaaagaattatgagtgagttgagggacggggaggagacactggg

SEQ ID NO: 20973 - DNA, 120 bp, Homo sapiens
ggttagatccaggggcatataggatattattgggggcattttctctctctctttctcaaatggatttattctcagaaaactgatgagaaaaatgactgccagcattgccaaggtttatct

SEQ ID NO: 20974 - DNA, 94 bp, Homo sapiens
acatgtatgcatatttatatgtatgtatctaagtatatatatcatatgtattatgcatgtatatatgatatataatatgcatatgtatccatgt

SEQ ID NO: 20975 - DNA, 72 bp, Homo sapiens
tacgtgtatgtatatgtgtgtatatgtatgtatatgtgtgtatatatatgtatgtatatgtaggtatatgtg

SEQ ID NO: 20976 - DNA, 97 bp, Homo sapiens
acccaacatatatatatatatatatgtatgtatgtatgtgtgtgcgcgcgtgcgcaggcatgtgtatatatgtatgtgtgtatatatgtgtgtgtgt

SEQ ID NO: 20977 - DNA, 86 bp, Homo sapiens
tatatacatatgtgtctgtgtatataagtatatatacatatatgtgtatatgtgtgtatatgtgtatatacatatatgtgtatatg

SEQ ID NO: 20978 - DNA, 149 bp, Homo sapiens
tatatgtgtatatacacatatatctgtatgtgtatatgtgtatatacacacatatatctatatgtatatgtgtatatacacacatatatctatatgtatatgtgtatatacacacatatatctatatgtatgtgtataaacacacatat

SEQ ID NO: 20979 - DNA, 182 bp, Homo sapiens
atatacacatacatatatctatatgtatatatacacatatacacatatatctatgtatgtgtgtatatacacatatatctatatgtatgtgtatacacatatatctatatgtatgtgtatatatacacatatatctatatgtatgtgtatatatacacatatatctatatgtatgtgtatat

SEQ ID NO: 20980 - DNA, 128 bp, Homo sapiens
tagatatatgtatgtgtatatatacatatagatatatgtatgtgtatatatacatatatatacatatagatatatgtgtatatatacacatgtgtatatatacacatacatatagatatatgtgtata

SEQ ID NO: 20981 - DNA, 118 bp, Homo sapiens
gtatatatacacatatatctatatgtatgtgtatatatacacatgtgtatatatacacatatatctatatgtatatatatgtatatatacacatacatatatctatatgtatatatac

SEQ ID NO: 20982 - DNA, 113 bp, Homo sapiens
tatatatacatatgtgtgtatacacatgtgtatatatacatatatgtgtgtatatatatgtgtatatatacatgtgtgtatgtgtatatatacgtgtgtatgtgtatgtatac

SEQ ID NO: 20983 - DNA, 58 bp, Homo sapiens
tgagacagagtctcactctgtcgcccaggctggagtgcagtggtgcgatctcgtctta

SEQ ID NO: 20984 - DNA, 78 bp, Homo sapiens
attcactgtcactctctgagattcatctttcttttgcccagcccagataggtgagttgaatggggatgtggcgggaat

SEQ ID NO: 20985 - DNA, 58 bp, Homo sapiens; identical to SEQ ID NO: 20439

SEQ ID NO: 20986 - DNA, 63 bp, Homo sapiens
gtcagctgactgttttctgatctctgctgagaaatctcaagtgagagagaagagatggctggc

SEQ ID NO: 20987 - DNA, 82 bp, Homo sapiens
gcctcatcctcctgagtagctgggactacaggtacgcaccactgtgcccagctaatttttatatttttagtagaaatgaggt

SEQ ID NO: 20988 - DNA, 71 bp, Homo sapiens
gttgtttgagacagggtctcactctgtcacccaggctggagtacaatggtgtgatcatggctcattgcagc

SEQ ID NO: 20989 - DNA, 79 bp, Homo sapiens
gggtgctgtctgtgttctatgtcttaagcaggtgatggtgattgaggctgttcactttgagacaacagactgagcattt

SEQ ID NO: 20990 - DNA, 85 bp, Homo sapiens
gaactcctgggcccaagcggtcctttcaccttggcatcccaagtgctgggatgacagatgtgagccaccacgcctgggggatttc

SEQ ID NO: 20991 - DNA, 109 bp, Homo sapiens
tgtagtgtcattagggtatgcatttctttttttgggggggttgagggagacaagagtctcgctctgtcacccgggctggagtgtggtggtgcaatctcagctcactgca

SEQ ID NO: 20992 - DNA, 81 bp, Homo sapiens
agtggctccctgtctcactcagagtaaaagcccaagatgttttgtttgtttgtttttgagacagggttttgctttgtcact

SEQ ID NO: 20993 - DNA, 110 bp, Homo sapiens
attacctgaatttggaaactagtgttagtaaatatcttttttatattctactgctgaaaaagtaattaaaatatgccattagtggttaaattatttgtatttcaggtagt

SEQ ID NO: 20994 - DNA, 106 bp, Homo sapiens
tgaaaatcatacttaatttcacttgaggcatcaatgatcttttttttttttttttttttgagacaggtctcactgttgcccaggctggagtacagtggcatgatca

SEQ ID NO: 20995 - DNA, 112 bp, Homo sapiens
aaaaatacatgtgtgtgtgtgtatatatatatacatatatatatatatatatacgtatatatatatatatatatatacgtatatatatatatatatatatatattttttttt

SEQ ID NO: 20996 - DNA, 110 bp, Homo sapiens
taaggagatgaaaattgtatatattttatggtgtacaacgtactgtttatacatatatatacatacattgtggagcggctaaataatatatgcattacctcaaatactta

SEQ ID NO: 20997 - DNA, 62 bp, Homo sapiens
ggtaggtggtgagaggtagacaggggaagtaggactgtctgtcactctctcctcccggtacc

SEQ ID NO: 20998 - DNA, 205 bp, Homo sapiens
tatgtgtgtgtatatatatgtgtgtatatatatgtgtgtatatatatgtatatatatacatgtgtatatatgtgtgtatatatatgtatatatatacatgtgtatatgtatatgtgtgtatatatgtgtgtatatatatgtgtatatatgtgtgcatatatgtgtgtgtgtgtatatatatatgtatatatacatatatatatat

SEQ ID NO: 20999 - DNA, 92 bp, Homo sapiens
gcatgcacatttttttcatatttatatgtgagtgtgtatacataaatatatacttatattacctatagatatttctcctgttcagtggatgt

SEQ ID NO: 21000 - DNA, 66 bp, Homo sapiens
tgagatggagtctcactctgttgctctgtcgcccaggctggagtgcagtggtgcgatctcggctca

SEQ ID NO: 21001 - DNA, 104 bp, Homo sapiens
tcagcatgtataatgtacagtactctagaataatgctttccaatttcttaagaagttatatatcattatttcttttagaattatttcatatataattatgctga

SEQ ID NO: 21002 - DNA, 87 bp, Homo sapiens
tgaaagaaggaaggtaaaagaactttctcagggcaactggctctaatagtagcctttatgattttttttttttttttttttggttca

SEQ ID NO: 21003 - DNA, 87 bp, Homo sapiens
ctctctcatgacagtagcagtggggtgagacagatgactcggagctttcatacatcaagattttccccattagctatttatagggag

SEQ ID NO: 21004 - DNA, 107 bp, Homo sapiens
gtgtgtatgtgtgtgtgtgcttatatttacctatatatgtgtatatatataattatatgtgtatacatatacatggtcatgatgaagaatatatacatggtctatac

SEQ ID NO: 21005 - DNA, 99 bp, Homo sapiens
tagctacaatgaactgaggcttttgggcaatatctctacaagattttatttctatttagatgtggaatgacttggaaatgttacagttgtttttggctg

SEQ ID NO: 21006 - DNA, 68 bp, Homo sapiens
gtgagctgttctgttagtgatgaaattgtatctagtataaattctcagcacaatggatacagttctgc

SEQ ID NO: 21007 - DNA, 95 bp, Homo sapiens; identical to SEQ ID NO: 68

SEQ ID NO: 21008 - DNA, 93 bp, Homo sapiens; identical to SEQ ID NO: 69

SEQ ID NO: 21009 - DNA, 118 bp, Homo sapiens
ggacagcagcggctggggagccggggccaggggcttccttgcaattccaatgatttttattattatcactcgcaaaggacaaacgcggccaaggccgggcctcacagtggctgtgctg

SEQ ID NO: 21010 - DNA, 95 bp, Homo sapiens; identical to SEQ ID NO: 580

SEQ ID NO: 21011 - DNA, 93 bp, Homo sapiens; identical to SEQ ID NO: 69

SEQ ID NO: 21012 - DNA, 104 bp, Homo sapiens
gcaaaagctgtcttttatttatttcacagtcagtatactgagagcacagaatgaaaatttcagttgtacagatctgcctgtgtttagaagtgtttttaaaaagc

SEQ ID NO: 21013 - DNA, 89 bp, Homo sapiens
taccatatatatatatatatatgtgtgtgtgtatatacatgtatatatatgtatatatatgtgtgtatatacacacatatatgtatgta

SEQ ID NO: 21014 - DNA, 167 bp, Homo sapiens
acatgtatatgtatataatatgcatatattatacatgtatgtgtatatatatatatataactgtatatatatatatatataactgtatatatatatatatatatatatataactgtatatatatatatatatatatatatataactgtatatatatatagctgaaca

SEQ ID NO: 21015 - DNA, 112 bp, Homo sapiens
tgaaagcatggagaggctagtgcctgcggggacaggatctcggcttctctctctcactccgtgtgtgctctctagagcttgcgtggctctcatgacctgagcacagatgagt

SEQ ID NO: 21016 - DNA, 76 bp, Homo sapiens
tctgtttccagcatccaatcatctctctctctctgaagtttcccgaaacttaaggagtagtggtgatggcaacaga

SEQ ID NO: 21017 - DNA, 70 bp, Homo sapiens
gagaaatttgggactggctgggagagggagacaaggaatcactctggctgtcagtcacttctcagtgctt

SEQ ID NO: 21018 - DNA, 95 bp, Homo sapiens; identical to SEQ ID NO: 68

SEQ ID NO: 21019 - DNA, 93 bp, Homo sapiens; identical to SEQ ID NO: 69

SEQ ID NO: 21020 - DNA, 117 bp, Homo sapiens
ctgtgtcttttaattgtggcatttagcccacttacatttaaagctaatattgttatgtgtgaatttgatcttgtcattatgatgttaactggttattttgcctgttagttgatgcag

SEQ ID NO: 21021 - DNA, 148 bp, Homo sapiens
atatatatatatgtatgtatatacatacgtatgtgtgtatatatatatgtatatacatacgtatgtgtatatatatatgtatatacatacgtatgtgtatatatatgtatatacatacgtatgtatatacatacacacacacacacac

SEQ ID NO: 21022 - DNA, 114 bp, Homo sapiens
tggagtggtggctcacgtctgtaattccagcactttgggaggctgaggtaggaggatcacttgagcccagtagttccagaccaacctgggcaacatggcaagaccccgtctcta

SEQ ID NO: 21023 - DNA, 71 bp, Homo sapiens
cttggcctctctctgtgtgtgccagagcccccctgcaagcactaggggctgcttctagaaaggggacccag

SEQ ID NO: 21024 - DNA, 123 bp, Homo sapiens
gaatgatgggtggttttgtcttatgaaatatagttattgacttttctgttattgttgttcaaatttatgacaaaaggaacaaaaaagcttagctgatttcggccggtaagtttaatgactact

SEQ ID NO: 21025 - DNA, 104 bp, Homo sapiens
atagtatttccttttaatgtgtggtttgcatttcaaattattttttgcttttttttaggtatgaggatacatgggctgcacttcacagaagagccaaagactgt

SEQ ID NO: 21026 - DNA, 73 bp, Homo sapiens
ggaagagagacactctcagttgtggggtgtctctccctgactcagcccccacctcactgagggtcttccatcc

SEQ ID NO: 21027 - DNA, 81 bp, Homo sapiens
tacagtttcccagtggcactcatcatcttcacctggaatgttcctggtattttcagaagtgagagaactctgggaattgtg

SEQ ID NO: 21028 - DNA, 83 bp, Homo sapiens
agtgtcacagtgtgcactcaccgagcctcatagtgccccagcgtgcactcacctagcctcatcatagtgtcccagtgtgcact

SEQ ID NO: 21029 - DNA, 79 bp, Homo sapiens
cagatctgatggttttaaaagcgggagtttccctgcataaactctctctctttgtctgacgccatccatgtaagatgtg

SEQ ID NO: 21030 - DNA, 104 bp, Homo sapiens
aagaaccaggagattgactaatacaaaaatactctggagaaaagatcattatttttataatatcgttctcttgtattattgaatttctcatgtgcctccatctt

SEQ ID NO: 21031 - DNA, 56 bp, Homo sapiens
tgagagagtctcgctctgtcacccaggctggagtgcagtggtgtgatctcggctca

SEQ ID NO: 21032 - DNA, 79 bp, Homo sapiens
gttgtctctctttctgagtcattcgctcctactaggctgaaatgtgaccaagttctgacctatgctcgtagagagcaac

SEQ ID NO: 21033 - DNA, 58 bp, Homo sapiens; identical to SEQ ID NO: 884

SEQ ID NO: 21034 - DNA, 56 bp, Homo sapiens; identical to SEQ ID NO: 885

SEQ ID NO: 21035 - DNA, 233 bp, Homo sapiens
tgtgtgtgtatatataaatatatgtatatatacacatatacatatatatgtatatatacgtatatatatgtatatgtgtatacatatatatgtatatatacgtatatatgtgtgtatatatacgtatatatgtgtgtatatatacgtataatgtatatatacgtatatatatgtgtatatatatgtatatatatatacacatatatatatacgtatatatacatatatatata

SEQ ID NO: 21036 - DNA, 58 bp, Homo sapiens; identical to SEQ ID NO: 1101

SEQ ID NO: 21037 - DNA, 56 bp, Homo sapiens; identical to SEQ ID NO: 1102

SEQ ID NO: 21038 - DNA, 73 bp, Homo sapiens
gtgagcctctccatagggctgggattttgttttttgttttttgtttttttgagacagagtctcaccctgtcac

SEQ ID NO: 21039 - DNA, 111 bp, Homo sapiens
ccacaattcatgctttgtgtcgtttttatttgcagtggccctttcagcctctcacgcactctgactaggccatggaggtccatgcagaatggattgcacctgccggtgtgg

SEQ ID NO: 21040 - DNA, 56 bp, Homo sapiens
gaaacggagtctcgctctgtctcccacgctggagtgcagtggcgcgataccggctc

SEQ ID NO: 21041 - DNA, 58 bp, Homo sapiens
tgagatggggtctcactctgtcacccacgctggagtgcaatggtgtgatcttggctca

SEQ ID NO: 21042 - DNA, 92 bp, Homo sapiens
actagcattatgtaacaaattacctttgcattttctaacaacctttactttatatattttgatgcaatgttatttggtgcataaatgttggt

SEQ ID NO: 21043 - DNA, 76 bp, Homo sapiens
gtgttggttccctcttaagggaaggttgttcagtgaatgcaaagaagtttcttttaccaaagagaggaatctttac

SEQ ID NO: 21044 - DNA, 76 bp, Homo sapiens
gtgaccttgactgtctcctccagctccaccctcgaacatatttttctgtgagtctgtgagagtcagtcagaagtac

SEQ ID NO: 21045 - DNA, 74 bp, Homo sapiens
gtacttctgactgactctcacagactcacagaaaaatatgttcgagggtggagctggaggagacagtcaaggtc

SEQ ID NO: 21046 - DNA, 95 bp, Homo sapiens
gcattagagatgcccaactgcatgcttgtctgcctcctgcaatacagccagctgcacggatccaggggcatggggtgctcaaccatgtcagatgc

SEQ ID NO: 21047 - DNA, 70 bp, Homo sapiens
tgtttcccacgctcacttgctcacacactccctctcacgaggagtggccagcagcaggctgaaggaaaca

SEQ ID NO: 21048 - DNA, 58 bp, Homo sapiens
tgagacagagtctcgctctgtcgctcaggctggagtgcagtggcgtgatattggctca

SEQ ID NO: 21049 - DNA, 69 bp, Homo sapiens
cgacgagaaacaaccacaggtgtggaggggcaggccaccccttcaatcctgttaatttttttttttttg

SEQ ID NO: 21050 - DNA, 83 bp, Homo sapiens
ccttctgtggggctcgggatgccagctgattggacaagccttgtggcttctctcaggcactgactctgagttctgtatgaggg

SEQ ID NO: 21051 - DNA, 200 bp, Homo sapiens
tgttggatttggtttgctaatatcttgttaaggactttattcataaggtattttggtttatcattttctttttttctaataatgtctctgacaggttttggtatcagggctaggatagccacatagaatgaattgagaaatatgcttttcttttctttttttttttttcgagatggagtcttgctctgtcagccaggctg

SEQ ID NO: 21052 - DNA, 122 bp, Homo sapiens
gaaatacattgtgaaactgcatactgtggtgactcattccttacttgcctacagtctctcagtcttactcagatgctgtttccagaggtctaccacagcctcccagcccctatttcactctg

SEQ ID NO: 21053 - DNA, 79 bp, Homo sapiens
tgttgagcattgatatgaggtctgtttcagggctctctatcctgttctgtcagtctgtatgtctaatcttctgccagca

SEQ ID NO: 21054 - DNA, 105 bp, Homo sapiens
cattctccctcctcgatcttggcactgccacagttctcactctctccttccacaggagctctgtgtgagcatgcgagtgtgcgtgtgcatgacagcaggtgagtg

SEQ ID NO: 21055 - DNA, 96 bp, Homo sapiens
gggaggcgggagtttgtgtgtctggaaatgtgtgggtttttttttttttttttttttttttttttttttttgggacggagtctcgctctgtctccc

SEQ ID NO: 21056 - DNA, 89 bp, Homo sapiens
gtcacagtctgtttcaacaatggaggttgtttgtttttatttaaatgatgtgaataaagaaaggaatctttgaaaactaaggctggagc

SEQ ID NO: 21057 - DNA, 77 bp, Homo sapiens
gactgagcagccagaaggtcctggaggccttgaggaaaggtttcagaagagtgggaggacacagcctggctggagtc

SEQ ID NO: 21058 - DNA, 115 bp, Homo sapiens
atcacagttctagaaagaaaggcccagctctaaagaaataccaggttcaaacagccagccagcctgtctcagtccctctcaagttctttgggcttatttagcagcaaatggtggt

SEQ ID NO: 21059 - DNA, 69 bp, Homo sapiens
ggtccccctgccacagtcggcctcctgtgctcagatccgtgtctgacacgctcacgtgtggaacagacc

SEQ ID NO: 21060 - DNA, 71 bp, Homo sapiens
gctataacagggaggacaggatgttataggggatgcagattatgtttttcacatcttcctccaatgtatgt

SEQ ID NO: 21061 - DNA, 79 bp, Homo sapiens
acaacacacatatatgtgtacatatacatttacacatatttgtgtatgtatgtatatctatatatatatgtgtgtatgt

SEQ ID NO: 21062 - DNA, 58 bp, Homo sapiens; identical to SEQ ID NO: 285

SEQ ID NO: 21063 - DNA, 60 bp, Homo sapiens
gacagagcaagacctcgtctcaaaaagatttttttttttgaggtggagtctcactctgtc

SEQ ID NO: 21064 - DNA, 91 bp, Homo sapiens
gcagtgtgatctcattgggatagggagtagaactctttttttttttttttttttttgagacagtcttgctctgttgcccgggttggagtgc

SEQ ID NO: 21065 - DNA, 84 bp, Homo sapiens
atgatgtcaagccaggagggcaggaaaggagcgctctcttgtgcgcgtgctcactcgctctctgtctctctgtcacatacacat

SEQ ID NO: 21066 - DNA, 67 bp, Homo sapiens
ggtgggcactcactaagtgtctctggtaccggggccggtgatgggcactcagttagcgtctctggcc

SEQ ID NO: 21067 - DNA, 116 bp, Homo sapiens
tacttaagtatatgtgtcactataacaaagtacctgagactgggtacttataaagaacaaaaatttttttttttttttttttgagacagtctcgctctgttcaccaggctggagtg

SEQ ID NO: 21068 - DNA, 112 bp, Homo sapiens
gttatctcaaaagaaaatcagtgggcataggcatttggagtgttgtgaattttgcagttcaagagtactgttgatgttgttgaccccattgatgtgagttctatggaaaaac

SEQ ID NO: 21069 - DNA, 67 bp, Homo sapiens
tcaacgtgtttgtcacggtccctctgtcagtagatcatgcaagggggacagagcggcaagttgttga

SEQ ID NO: 21070 - DNA, 91 bp, Homo sapiens
acccgcctcggcctcccaaagtgctgggattacaggcgtgagccaccgcgcccggcctcagtattttttttttaaagagctcaggtttggt

SEQ ID NO: 21071 - DNA, 87 bp, Homo sapiens
aaaaaaaaaaaaaaggaattgataaagataatgtttgtatgatttttatttaaaacattattggttctttttttttttttttttttt

SEQ ID NO: 21072 - DNA, 95 bp, Homo sapiens; identical to SEQ ID NO: 68

SEQ ID NO: 21073 - DNA, 93 bp, Homo sapiens; identical to SEQ ID NO: 69

SEQ ID NO: 21074 - DNA, 91 bp, Homo sapiens
agactctgtctcaaaaaaaaaaaaaaaaaaaaagcagggggatgaagttaaactgtagagtttttctttttttttttttgagatggagtct

SEQ ID NO: 21075 - DNA, 80 bp, Homo sapiens
tgagagagatgtgactgtgatctgagtcatatatgattacaacgtctgtttctcagattatagattaacttactttctta

SEQ ID NO: 21076 - DNA, 111 bp, Homo sapiens
gcttgccaagacttcctctgggtgcctatgactggatgtctaatgagtggtcagcctcactgagagactgactattattgtatgtctttctcctcctctcagaatgtcagc

SEQ ID NO: 21077 - DNA, 98 bp, Homo sapiens
ccactcagaatcatttcccatagagtactgttattggtgtagggcaatgtttagtgtcttagctataagcaatatataattgaaataactttgaatgg

SEQ ID NO: 21078 - DNA, 87 bp, Homo sapiens
ggtggtgcctccttagacccctgggaagacctgggtaccctcctctaagcctgcccagcaccctctctgtctctaacacctgtctcc

SEQ ID NO: 21079 - DNA, 95 bp, Homo sapiens
catggccaccccaggtgaccaagacgccattccatctgacctgctccctgggcctgtctttctgtctgggtgtctggttttcctgctgtgctttg

SEQ ID NO: 21080 - DNA, 131 bp, Homo sapiens
tttgccaacagggaggaggctgtcgctattgccaccacttctttaccacgatggctctctgtttccctctggtggtagatccatgccctgcagtggatgtttctacgattcccacaaggttaaatttgagc

SEQ ID NO: 21081 - DNA, 116 bp, Homo sapiens
ggcccaatcatgtattattcacttaaaagtatgacttatctgtatgaattaataaatttattatcaaaaaaaggttgaaatatagcaatgtggttgctttgtgagatggtttggct

SEQ ID NO: 21082 - DNA, 104 bp, Homo sapiens
agatggggccataggatgtcccagtaggaggagatagggggagagattctctctctctatctaatctttatatctatctatctgtttatctatcttatctatct

SEQ ID NO: 21083 - DNA, 69 bp, Homo sapiens
atacagatttatatatccatatatatgacatataagtatgtatgtatatatgtatatgtatgtgtgtat

SEQ ID NO: 21084 - DNA, 94 bp, Homo sapiens
ctcacactctctaagtgtctgaaaatgctcaaaatattgaaagatggagaaatatacttgagaatctttttatttactttaaaatgagtgtggg

SEQ ID NO: 21085 - DNA, 163 bp, Homo sapiens
tatatatatatatataaaacatatatgtgtatatatgcgtatatatgtatatatgcgtatatatgtatatatgtgtatatatgtatatatgtgtatatatgtatatatgtgtgtatatatacatatacacatatacgtatatatgtatacatgtatacgtata

SEQ ID NO: 21086 - DNA, 93 bp, Homo sapiens
gtttgaattgtttttcggtatcttcatttaaaatattttaattttaaaacaaaatattttaatttagggtcaatttggaaatcaggctcaaac

SEQ ID NO: 21087 - DNA, 89 bp, Homo sapiens
cactagatggacagtaaagaagaatgggcatcacttccaggttccagtgttctggttttgtctgtttgtttcttttaaatcctactgtg

SEQ ID NO: 21088 - DNA, 119 bp, Homo sapiens
gcctcctgagtagctcagactataggcatgtgccactgtgcctggctaattaaaaatatatatattttgtagacacagagtttcatcatgtttctcaggctgatctcaaactcccaggc

SEQ ID NO: 21089 - DNA, 72 bp, Homo sapiens
tatatagatatacatatgtatagatatatagatatacatatatgtatatctatacatatgtatagatatata

SEQ ID NO: 21090 - DNA, 77 bp, Homo sapiens
atacatatatgtatatattttgtatatgtatacgtacatataaaaatatctgtaagtatgtgtgtatatgtatatat

SEQ ID NO: 21091 - DNA, 117 bp, Homo sapiens
gcagtttagaagtattacctgatcaccacatccaggccaacatctattgtttttgattttttgattatgaccattcttgcaggagtaaggtggtatcacattgtggttttgatttgc

SEQ ID NO: 21092 - DNA, 84 bp, Homo sapiens
tatatatatgatgcaatatatatatgatggaatatatatgatactatatatatgatggaatatatatgatgcaatatatatatg

SEQ ID NO: 21093 - DNA, 70 bp, Homo sapiens
attccatcatatacatatatatattccatcatatacatacacatatatatatgtatgtatatgatggaat

SEQ ID NO: 21094 - DNA, 114 bp, Homo sapiens
gggctacgtgttggggtgaaaaaggaaattcaggctgggaccaggttatagatactcttatttttttaatttattatttatttatttttgagacacagcctcgctctgtcgctc

SEQ ID NO: 21095 - DNA, 58 bp, Homo sapiens
tgagacagggtctgcctctgtctctcaggctagagtacagaggcacgaacttggctca

SEQ ID NO: 21096 - DNA, 72 bp, Homo sapiens
tacattcaacatgtaaaaacacataataacttctgtacatgatagagctgtgtgtgtgtgtgtgtgtgtgtg

SEQ ID NO: 21097 - DNA, 108 bp, Homo sapiens
aacttattttaaaaaacatcccatatagattttggaatatctcttcaggttacatgaaaatactgttgagattttgttctggaattatatagaatgtatagatcagtt

SEQ ID NO: 21098 - DNA, 81 bp, Homo sapiens
gcctagggcacttataatgaatggagcctgcaggactggaagcggctctgggtgagtcagtgagtgagtggacctaaaggc

SEQ ID NO: 21099 - DNA, 95 bp, Homo sapiens; identical to SEQ ID NO: 580

SEQ ID NO: 21100 - DNA, 93 bp, Homo sapiens; identical to SEQ ID NO: 69

SEQ ID NO: 21101 - DNA, 58 bp, Homo sapiens
tgagacagagtctcccactgtcacccaggctggagtgcagtggcgcgatcttggctca

SEQ ID NO: 21102 - DNA, 74 bp, Homo sapiens
ttccatcatcctcctcaggggatacaatattgatttttatatactatctctgctgaggcaagggtgggagggaa

SEQ ID NO: 21103 - DNA, 119 bp, Homo sapiens
gtctggagtctagatgtctgaaatcagggtgttggcagggccacactccctctgtcaccggcaggggagaatccttccttgtgtcctctggctctggtgtcttactggcagaccttggc

SEQ ID NO: 21104 - DNA, 143 bp, Homo sapiens
gtatgtatatatatacatatatatgttcatataagttagtattcatatatatgttcatatatatatgttcatacagactagtattcatatatatatacatatatatatacacacacatatatatatatatatatatgttctag

SEQ ID NO: 21105 - DNA, 70 bp, Homo sapiens
gcgcatgtgactctccctgtgtcagggcatacgcatccctttccaccgaggatcaatgtgccctatggga

SEQ ID NO: 21106 - DNA, 58 bp, Homo sapiens; identical to SEQ ID NO: 2257

SEQ ID NO: 21107 - DNA, 76 bp, Homo sapiens
atatatgtgtgtatttatatatgcacacatatgtatacatatatatgtgtgtatatatattcatacttatatatat

SEQ ID NO: 21108 - DNA, 135 bp, Homo sapiens
gctgaataatattccattgtgtgtgtgtgtctgtatataagacacagacacacacacacacaatgtgtatatgtgagtgtatatatatatataatataaaaatgtgtgtataacacagacacacacatatggata

SEQ ID NO: 21109 - DNA, 94 bp, Homo sapiens
tagaaagtaattttgaactgtttcatatcagttatttgtagataaaaagcattttataattttttagagagatagttcttcaaattatttttta

SEQ ID NO: 21110 - DNA, 99 bp, Homo sapiens
tgtgacgctgtggtctgaatgtgtccctcaaaattcacgtcttacaaactattttttttttttttgagaccgggtctcactctatggcccaggctggca

SEQ ID NO: 21111 - DNA, 104 bp, Homo sapiens
aggggaacaaatggacagaagaattagtggaactgattagtttttatgttttcataaatggctacttaggatgagctgttatttgattttgtaatgttttctct

SEQ ID NO: 21112 - DNA, 74 bp, Homo sapiens
agccccttcactgtctgtgtgtgttatctcagtgcatctgcctggttggtcctgactgtcgcagtgctggtgct

SEQ ID NO: 21113 - DNA, 85 bp, Homo sapiens
gcttgcatgtgcggtgtgaatgtattttatttcattttttattattattattttttgagatggagtctcactctgtcacccaggc

SEQ ID NO: 21114 - DNA, 59 bp, Homo sapiens
gtatgtgtgtgtgtgtatatatagatatatatatacactctctctatatatacacatat

SEQ ID NO: 21115 - DNA, 91 bp, Homo sapiens
ggttgtaagtaagtgaattccgcatgtgacgagcctcactcactgtgtggctacagtgtgtgtacaatacatgtgggttctctcttcaccc

SEQ ID NO: 21116 - DNA, 92 bp, Homo sapiens
tgtcaaggttgaggatgtgtgcctgtgacacagcctcaggaggtcctgacaacatgtgcccaggtggtcaaagcacagcttggttttataca

SEQ ID NO: 21117 - DNA, 81 bp, Homo sapiens
gaaaggagacagttgactgagatttaaaagatgtttataattttaaatgtctttttaccctctagcagttggtctctattt

SEQ ID NO: 21118 - DNA, 116 bp, Homo sapiens
ctgaatctttccatcttgaagaggccctaggggaacacaatcagtggatttttcaatggattcaccactagcatccttcagaaaagggcagccttgcatatgggtgaggaattgag

SEQ ID NO: 21119 - DNA, 83 bp, Homo sapiens
gctctgggtgagtcagtgagtgagtggagagtgagtgtgaaggccgaggatatgactttccgctcaacaccgttcacttaggc

SEQ ID NO: 21120 - DNA, 85 bp, Homo sapiens
gcctcacagagttcacagtcagctgtgtcctgatcatatgatggatgtgaggttccatgggagcacagtgttgaacctgggaggt

SEQ ID NO: 21121 - DNA, 71 bp, Homo sapiens
gtgtggtcttggaggcattagatgactttttttttttttttttgaaacggcgtctggctctgttgccaggc

SEQ ID NO: 21122 - DNA, 89 bp, Homo sapiens
ttgagacatagtctcgctctgtcgctctggctggagtgcagcggcgcatgatctcggctcactgcaacctctgtctcctgggttcaagc

SEQ ID NO: 21123 - DNA, 76 bp, Homo sapiens
tgccgtgagcccgggactaatgagtcattgttcttctgagaagcccgttggcgtcagcttcctttcagctgcggca

SEQ ID NO: 21124 - DNA, 102 bp, Homo sapiens
taaattcctttataggactccagatttgaaaatttatgtatttattttggtgaaaacagttatatgaagattttctgctttggttgcttatggaagtattta

SEQ ID NO: 21125 - DNA, 74 bp, Homo sapiens
ggcctgagagccttccatgtctcggcagcagggactctctgactcagagaattgatggctaatctcagtttgcc

SEQ ID NO: 21126 - DNA, 135 bp, Homo sapiens
gagcaaggcatggggccggagcaagggtcctggcagcccacgttgctgccacagcctttggctggctggctgtttgccggtgcttgtggctattgtaacatagttggatgcattggtagtttagtggtcattcag

SEQ ID NO: 21127 - DNA, 115 bp, Homo sapiens
cagtgagagtggtgactgcgtgtgcgtgcgtggcggaggaggtggtgtatcagtgacagtagtcactgcgttcatacgcgtggaggaggcgaaacgtcagtgacagggctcattg

SEQ ID NO: 21128 - DNA, 124 bp, Homo sapiens
tgactatggtgtgccactcagctccaaaggaacaagggtagaagctctggtctgagagctgacagggtgaggacagctgcagtcagagccagacgaggtgtcagcatgggcccagtccctcatc

SEQ ID NO: 21129 - DNA, 67 bp, Homo sapiens
tgtttagagacatgtgcacctgcacacacatgcatgtgcgtgtgtgtgtctgtccttccctcaaata

SEQ ID NO: 21130 - DNA, 72 bp, Homo sapiens
tatacatatatatctatatagatatatacatatatacatatatgtgtatatatctatgtatgtgtgtgtata

SEQ ID NO: 21131 - DNA, 143 bp, Homo sapiens
tgtatatatgtatatatctatatagatatatatgtatatctatagatatatctatataggtatatgtatatatgtatatatagatatatatgtctatatctagattctagatatgcacatatatatctatatagatatatatg

SEQ ID NO: 21132 - DNA, 134 bp, Homo sapiens
tatacatagatatatatgtctgtgcatatctagattctagatatagacatatatatctatatagatatatatgtgcatatctagaatctagatatagacatatatatctatatatacatatatacatataccta

SEQ ID NO: 21133 - DNA, 78 bp, Homo sapiens
tatatatgtatatatctatatgtatgtatctatatatctacgtatatatctatatctatatatctatgtatgtatgta

SEQ ID NO: 21134 - DNA, 84 bp, Homo sapiens
catattttattattatttttatggtgacacggagtctctgtcgttcaggctggagtgcagtggttgctcatattttaaaatatg

SEQ ID NO: 21135 - DNA, 256 bp, Homo sapiens
atatatataatatatatatacacaatatataagagatattttatatacatatatatctatatatgtatatatagatatatatgtatatgtatatatgtatatatgtatatgtatatatgatatatgtatatatgtatatatgtgtatatatgtatatgtatacgtatatatgtatatatgtgtatatatgtatatgtatacgtatatatgtatatatatgtatacatatatatgtgtatatatatgtatgtatatc

SEQ ID NO: 21136 - DNA, 76 bp, Homo sapiens
tcgctctgtcactcagtctggagtgcagtggtgtgatcgtggctcactgcaacttccatcacctgggttcaagcga

SEQ ID NO: 21137 - DNA, 77 bp, Homo sapiens
tacatgttggacactatcactgtctctatcccttggcctagatagcagctaaacagccgatagctgagccaacagtg

SEQ ID NO: 21138 - DNA, 58 bp, Homo sapiens; identical to SEQ ID NO: 1763

SEQ ID NO: 21139 - DNA, 123 bp, Homo sapiens
cgtgtatgtatgtggtgtgtttatgcatgtgtggtgtgtggcatgctgtgtgcgtgcatgcctgtgtgcgtgcatgcctgagtgtgtgtggtatgtgcatgtatatgtgagtgtgtggcatgc

SEQ ID NO: 21140 - DNA, 88 bp, Homo sapiens; identical to SEQ ID NO: 3816

SEQ ID NO: 21141 - DNA, 107 bp, Homo sapiens
gggcaggtaaaaacacagtaaatatgattgcttcttttgtataaatgtgtgtgtgtgtgcatgtgcatatgggagggtgattaatttatatcgatcttacactggcc

SEQ ID NO: 21142 - DNA, 81 bp, Homo sapiens
gtgtatatgtatttatgtatgtgtgtgtatcatgtatatatatgtgtgtgtgtgtgtatatatatataaacttatgtttgc

SEQ ID NO: 21143 - DNA, 111 bp, Homo sapiens
gagaactctctttatattatattacattattatttatattattattctttctctctagaagagagagaatgatgagaaattgctcagtgtttacctttgtggagagggctc

SEQ ID NO: 21144 - DNA, 111 bp, Homo sapiens
atggtcgtgtgggggagatgggcttcagtttcactagagacttagatgatgtgtaccatcctggtttgtcgagatggctctgggttagacatgctgccctggcaaaatcat

SEQ ID NO: 21145 - DNA, 58 bp, Homo sapiens
tgagactgggtctcactctgtcacccaggctggagtgcagtggtgcgatcacagctca

SEQ ID NO: 21146 - DNA, 95 bp, Homo sapiens; identical to SEQ ID NO: 68

SEQ ID NO: 21147 - DNA, 93 bp, Homo sapiens; identical to SEQ ID NO: 69

SEQ ID NO: 21148 - DNA, 86 bp, Homo sapiens
agctgtctgctagtcactcactgtgtccccgcactcctcagtcatttgggtggtcaatgggactcagcaccgtggggcagggggct

SEQ ID NO: 21149 - DNA, 106 bp, Homo sapiens
ataaattgaccgtatacatatggaatagaatagacggtccagaagtagactgaacagtctgagctgtacttctttatcttttgccaacctcaaactgcaactttat

SEQ ID NO: 21150 - DNA, 95 bp, Homo sapiens; identical to SEQ ID NO: 68

SEQ ID NO: 21151 - DNA, 93 bp, Homo sapiens; identical to SEQ ID NO: 69

SEQ ID NO: 21152 - DNA, 72 bp, Homo sapiens
ttgtatatatataacacgtataactatgttgtatatatataacatgtataactacgttttatatatatataa

SEQ ID NO: 21153 - DNA, 79 bp, Homo sapiens
ttcactgtgagaagagagacaccatttccacaaattgtctaatgagaatctggagaatgaccctcttattctctgtgga

SEQ ID NO: 21154 - DNA, 56 bp, Homo sapiens; identical to SEQ ID NO: 3386

SEQ ID NO: 21155 - DNA, 107 bp, Homo sapiens
actgctaaggacccgcagattctcttcctcttgggactcacacactgactcatctcccgatcttttggtgctcagcaaagtggaggcttctgttttggacttagagt

SEQ ID NO: 21156 - DNA, 81 bp, Homo sapiens
gtaactgagggaggaaacataagatcctctctgagtggaaagtctctagcagtgactatctctgagtccttctccagtccc

SEQ ID NO: 21157 - DNA, 104 bp, Homo sapiens
gtagtgtatttggaaatcaggcagtgtggtgactccagctttgttcttttttttttttttttttttttttttgagatggagtctcactctgttgcccaggctac

SEQ ID NO: 21158 - DNA, 116 bp, Homo sapiens
gtggtggtggtggtggttttgtcttttttagaggcagaaggcagaggtctcactctgtcacccaggctggagtgctgtggcacgattattgctcactgcagcctctaactcctggg

SEQ ID NO: 21159 - DNA, 101 bp, Homo sapiens
tcaccaggcatagtggtgtgcccctgtggtcccagctacttgggaggctgaggtaggaggatcacttgaacctaggaggcagaggccgtagtgagctgtga

SEQ ID NO: 21160 - DNA, 104 bp, Homo sapiens
acagagttgtccatgtatatatagacatgtgtgtatatatatatatgtgtgtgcgtatatatataatgtgtatatctatatgtgtgtatatactgattgcctgt

SEQ ID NO: 21161 - DNA, 109 bp, Homo sapiens
gctcagtctcctttgggtgccattccctcctccactgtctctcagtcagtgcggccgtacctgtgccgagactcagtggagcgagagggaccttgtcagggaaggatgc

SEQ ID NO: 21162 - DNA, 115 bp, Homo sapiens
gttagtccagtaactcaagactttacattcttttgtctttatttgtttattttaattaaacatataaaggttaataaacagacaaagtccagagttagtaggttggtattataac

SEQ ID NO: 21163 - DNA, 90 bp, Homo sapiens
agtgatattccctcggctttcacaggcctgcagcctctgtctcactctcttggaaggctgccctgagagcgccacggagagcactaggcc

SEQ ID NO: 21164 - DNA, 149 bp, Homo sapiens
gaggtggctgacaggtggatgaatggcctgcagctggtgtcacctgttatgcccagccttatgattatatatgtatatattaattatgtattatgtatgaatatgtaacataacatgtatacatataatatgtatacataatatgtcat

SEQ ID NO: 21165 - DNA, 58 bp, Homo sapiens
tgagaccgagtctcgctctgtctcccaggctggagtgcagtggcgcgatcttggctca

SEQ ID NO: 21166 - DNA, 72 bp, Homo sapiens
gaggcttgtgaacatccagactggtgtggggcaccgccagagtgtctgactcactgggtctgggaggggccc

SEQ ID NO: 21167 - DNA, 101 bp, Homo sapiens
caccgctggcttccctggatggtggtgagaacagagtgaggtcatgggtgtgcagcatgtcccaagctgctcttgtcctaggaatgccgccagcatgggtg

SEQ ID NO: 21168 - DNA, 88 bp, Homo sapiens
aggatctgctgtctctctgtctgtgtcctaacctcctcttcctataaggattccagttggattggactagggacctcacgtaggacct

SEQ ID NO: 21169 - DNA, 67 bp, Homo sapiens
ggtgaccagtgtctttgtgtctgaccctctgtagacgaagtgtcagcacacctgaacgatgcacacc

SEQ ID NO: 21170 - DNA, 92 bp, Homo sapiens
atatgataggacttcagtgtctctgtgtcttagttttcccatttgtgaaggggaaggaggaaatgaaattaattgtcaagtacctactgtgt

SEQ ID NO: 21171 - DNA, 122 bp, Homo sapiens
cctgagccactcctgttgccctctggctggtgtgatgactctagctggtatgataactctggcaggtatgatgaccctggagggtgtgatgaccccatctagtgtgatgactctggctggca

SEQ ID NO: 21172 - DNA, 74 bp, Homo sapiens
ggagttgattttctctctctcagtgacttaggaatcaaatttccttcgttgagaaagcaatagagtttcctgcc

SEQ ID NO: 21173 - DNA, 76 bp, Homo sapiens
gttggatttcatttttcgccgtcccccctccacggtgactgtttcactgtctggatggctctgattttagtctgat

SEQ ID NO: 21174 - DNA, 116 bp, Homo sapiens
agattattacaaagtaaaagtgcatgcgtgggcatcaccatgaagcttgaaaactctttaaagagttttgaatctctggttttgaaagctagcacaacactgcaaaacaaatgtct

SEQ ID NO: 21175 - DNA, 112 bp, Homo sapiens
caagtctgaagggcttttgggtgcatgaataaacaggccagcaagtagttatttttattctatatgtacatcttgtgctccacactcaacagtgacgtcagccttcttgctt

SEQ ID NO: 21176 - DNA, 128 bp, Homo sapiens
atatatgtaaatctttgtattagtcagggttctctagagggacagaactaatggaatagatatatatatatatatatatatatatatatatgtagatatagatatagatatatatatatatatatata

SEQ ID NO: 21177 - DNA, 100 bp, Homo sapiens
gcatgccttcaccatggtgggcatgatggttaatactgagtgtcaacttgattggattgaaggatgcaaagtattattcttggttgtgtctgtgagggtg

SEQ ID NO: 21178 - DNA, 78 bp, Homo sapiens
gtggaaggtgatgttctactaaattaacagggagggttactggatgtttcttattaaatttagtagcagttgatccat

SEQ ID NO: 21179 - DNA, 95 bp, Homo sapiens; identical to SEQ ID NO: 68

SEQ ID NO: 21180 - DNA, 93 bp, Homo sapiens; identical to SEQ ID NO: 69

SEQ ID NO: 21181 - DNA, 59 bp, Homo sapiens
aattgaaaagttagaatgatagtgtgtcagaaggcacattatgtttttctttttcaatt

SEQ ID NO: 21182 - DNA, 63 bp, Homo sapiens
gagcagatccttgaaactgtcatgcattgaaaccccctctctgcctgtcagtctcatctgctt

SEQ ID NO: 21183 - DNA, 82 bp, Homo sapiens
gataatcctatggctatttgtaacattatttttgaacattaatattgagttaaaatagatagttgaagtagcctggaagatc

SEQ ID NO: 21184 - DNA, 92 bp, Homo sapiens
ttgaatatgtatgtgtgtatgtatatataactttatatatataaactttgtatgtatgtatgtgtgtatatatatacacacacatatggcag

SEQ ID NO: 21185 - DNA, 81 bp, Homo sapiens
ttgttgccttttttcacttatgtagtggtttatgccaaaaatgatatatttaactatatatgtagttgttgagggtaataa

SEQ ID NO: 21186 - DNA, 97 bp, Homo sapiens; identical to SEQ ID NO: 1307

SEQ ID NO: 21187 - DNA, 88 bp, Homo sapiens; identical to SEQ ID NO: 1308

SEQ ID NO: 21188 - DNA, 81 bp, Homo sapiens; identical to SEQ ID NO: 1309

SEQ ID NO: 21189 - DNA, 77 bp, Homo sapiens; identical to SEQ ID NO: 1310

SEQ ID NO: 21190 - DNA, 95 bp, Homo sapiens
cattgtttgtcttttgttttcatgggtcttctgtgactgttagttgtttttttaaattaaagtcctgaaggtcactgactctgacaaaataagtg

SEQ ID NO: 21191 - DNA, 58 bp, Homo sapiens
gcttatgtgtctgtatgtgtgtgtgtatatatatatatgcatatatttatatataagt

SEQ ID NO: 21192 - DNA, 64 bp, Homo sapiens
tcagtggactgggagagacagacccactctcaatttgggtgggcaccatctaatcagctgctgg

SEQ ID NO: 21193 - DNA, 73 bp, Homo sapiens
ggtgtgatcataatgtgtcttggtgtatttgtcttttttttttgagacagagtctcactctgtcattcatgct

SEQ ID NO: 21194 - DNA, 112 bp, Homo sapiens
gtgagtgtgcatacaagtacatgtgcaggcgttgatatgcatacatgtgtgcaggcgtgagtgtgtacacagtgtgcaggggccatgactgtgcatgtatatgtacactgca

SEQ ID NO: 21195 - DNA, 159 bp, Homo sapiens
tatacatatacatatacatatatatgtgtatatgtacatatatacacacgtatatatgtatatgtatatgtgtacatatatacgcatgtatatatgtatatgtatatatatgcatgtatatatacacgcatgtatatatgtatatatacatatatacat

SEQ ID NO: 21196 - DNA, 128 bp, Homo sapiens
tatatatgcatacatatatgtgtgatatatatatatgcatacatatatgtgtgatatatatgcatatatatatgcatatttatacatatgtgtaatatatatgcatgcatatatatgcatatatacat

SEQ ID NO: 21197 - DNA, 223 bp, Homo sapiens
tatatgtgcatacatatataatatatatgtatatatgtaatatatatgcatatatatgtatatatgttatatgcatatatgtatatatgtaatatatatatatatgtatacatatatgtatatatatgcatatatatgtatacatatatgtatatatatgcatatatatacatatgttatatatgcatatatatgtatacatatatatgtaatatatatgcat

SEQ ID NO: 21198 - DNA, 77 bp, Homo sapiens
tatataacatatgtatatatatgcatatatatacatatatgtatacatatatatgcatatatatacatatatgtata

SEQ ID NO: 21199 - DNA, 69 bp, Homo sapiens
ctaggttgctgtgaggttctttttctttttcttttttttttggagacagagtctcactctgtcacccag

SEQ ID NO: 21200 - DNA, 89 bp, Homo sapiens
gttgtatcacctggactgtttttatggtgcatatattttgtgatatacaattgctgagtggaatgtagtttggaaaatggtgatataac

SEQ ID NO: 21201 - DNA, 95 bp, Homo sapiens; identical to SEQ ID NO: 5211

SEQ ID NO: 21202 - DNA, 77 bp, Homo sapiens
gctatcttaaataacagatttggcaatggggcttggtatttaatgcaggtccaagtcattttgttcaactgagaagt

SEQ ID NO: 21203 - DNA, 101 bp, Homo sapiens
tgttacatatatgcatgtgtgtatgtacattatatatatgaaaattatatatattcaaattatatatacatatatacatacagattttatatatgtattca

SEQ ID NO: 21204 - DNA, 95 bp, Homo sapiens
gaggtggtagtggcttaaagacacaaagggatgaaaacataatatatttagattatagtttgttttttttttttgagacggagtctcactgtgtc

SEQ ID NO: 21205 - DNA, 119 bp, Homo sapiens
ggatctatgaaggtggtggagaaggcatcagaaggagcttcagtctctctgggagcctctcttgtctcgtccagtagagctgaaccttccagatgatgctgcactatcgcacttactcc

SEQ ID NO: 21206 - DNA, 95 bp, Homo sapiens; identical to SEQ ID NO: 580

SEQ ID NO: 21207 - DNA, 93 bp, Homo sapiens; identical to SEQ ID NO: 69

SEQ ID NO: 21208 - DNA, 58 bp, Homo sapiens
ggctccagttatagatggcagatcatgagactcctcagcctctgtgactgtgtgagcc

SEQ ID NO: 21209 - DNA, 109 bp, Homo sapiens
gtatgtgatagagccagggtttgaatgcatgcagactggtccccgtgctcgctaagtgtgctggcttctctctgacatcgttcttccctaaggtcctaaggttgcctac

SEQ ID NO: 21210 - DNA, 106 bp, Homo sapiens
taaatcgctagaaatggaaagtctcaggattgatgctgtgactgttagagaataatatttacagtagtttgacagcagtgtttagttaattccaactcgtggttta

SEQ ID NO: 21211 - DNA, 86 bp, Homo sapiens
ctgtagtgcattttgagttgttgggctcaggaaaaactgattataataagttgtctatgaatatgataattcatttgtgctagaag

SEQ ID NO: 21212 - DNA, 60 bp, Homo sapiens
ttgagttggagtctcactctgtcacccaggctggagtgcagtggcgggatctcggctcaa

SEQ ID NO: 21213 - DNA, 58 bp, Homo sapiens; identical to SEQ ID NO: 8468

SEQ ID NO: 21214 - DNA, 116 bp, Homo sapiens
tggccaaatgcatacaaatgtgtctaattgttgagtgtcattccttttttttttctttcagtttgatcttctgttggtctgatatgcaagttgtcacgtaaaggctgttttgtcca

SEQ ID NO: 21215 - DNA, 90 bp, Homo sapiens
gcttctcttctcagggcacttggttccctggctcactctctccttctaatgcttttgtttgtctccaggatgccactctgtttggctggc

SEQ ID NO: 21216 - DNA, 89 bp, Homo sapiens
ggaaggaatggaaaccttcagtgaaatgttggctggcagcagaggtggctgaaaggccatggtttgctataagaaagtcccagtcctcc

SEQ ID NO: 21217 - DNA, 63 bp, Homo sapiens
cagagagaggacagtcaggcgacaacagacacagaggttggttgttgatggggttctctgctg

SEQ ID NO: 21218 - DNA, 58 bp, Homo sapiens
tatatatatgtatatatatgtatgtgtatatatatgtacatatatgtatatgtatatg

SEQ ID NO: 21219 - DNA, 87 bp, Homo sapiens
agtctgagtagtttatcctgatgcactttcttattgaataatttctctttcactgtgtctgtgcattggctttaaactttagactca

SEQ ID NO: 21220 - DNA, 64 bp, Homo sapiens
atatccatatatatgtatccatatatatgtatccttatatatatatatccatatatatggatat

SEQ ID NO: 21221 - DNA, 104 bp, Homo sapiens
ctttgggcagaaacatgttttaatttctttagaagtggaactgctgggctgtgtaaataatgtatgtttaattttaaaataaattgatacactgttttccaaag

SEQ ID NO: 21222 - DNA, 115 bp, Homo sapiens
gctatatgggcttttttggttccatatgaattgcaaagtagttttttctaattatatgaagaatgtcaatggtaatttaatgggactagcattgaatctataaatttctttgggc

SEQ ID NO: 21223 - DNA, 90 bp, Homo sapiens
ggagggagggagggacagtgacagcagctgcatgtgaaggtttgggaggtgaacgcatttgcagctggtgctctgcagggcctacatgct

SEQ ID NO: 21224 - DNA, 91 bp, Homo sapiens
tctgacatctttgaaaacaagtctgattttgtatttctttctcccagtttgaggaggaaaagaacccggacttgtagattgtagaggtgtt

SEQ ID NO: 21225 - DNA, 82 bp, Homo sapiens
gtatatgtttgtatgtacatgcatgtgtgcacaagcttatgtgtgtttgtgtagacatgtgtttgtgcatgtgcatgtgtgc

SEQ ID NO: 21226 - DNA, 202 bp, Homo sapiens
tatatatctttatatttatatatagatatatagatctatatagatctatatatctttatatttatatatagatatatagatctatatagatctatatatctatatagatatatagatatatatatctatatagatctatatatctatatagatctatatatctgtatatctatatagatctatatatatctatatatctata

SEQ ID NO: 21227 - DNA, 159 bp, Homo sapiens
atatctatatatgtatatatctatgtatatatctctgtatttatatatatctatatatatctatatatttatatatatctatatgtccatatatctatatatttatatatatctatatatttatatatatgtatatatatctatatatagatatatata

SEQ ID NO: 21228 - DNA, 80 bp, Homo sapiens
gtcttatctgtgttttactgtctgctctttctgactgcttgttgttagaagagaagtgatttccttgaaatgcatgaggc

SEQ ID NO: 21229 - DNA, 69 bp, Homo sapiens
gccttcaatagagtcaggtgacagggaggtatgcttcctcagtgcctcccttagtctctccagaaaggc

SEQ ID NO: 21230 - DNA, 111 bp, Homo sapiens
agattgctgtggctattcagactctcctttggttccatatgaattctaagattttttttctaattctgtgaaaaatgacattggtaatttggtaggcattgcattgaatct

SEQ ID NO: 21231 - DNA, 132 bp, Homo sapiens
ccaaagtgctgggattacagtcgtgagccaccgcgcccagcctgtttgtttgtttgtttgtttgttttttaattggccaggcatggtgagatgtgcttatagtccagctactctggaggctgaggcgggagg

SEQ ID NO: 21232 - DNA, 77 bp, Homo sapiens
aaggaatcagactagaatcagagctgagaagttccttttgttgctcttagcacttaatttgattttattttggcctt

SEQ ID NO: 21233 - DNA, 99 bp, Homo sapiens
cgcctcaaaataccatgtgtttctgatgtatattattattttctgtctcctgccactagaatgtaagctgcaagatcaggaatctgtggcttagaggtg

SEQ ID NO: 21234 - DNA, 67 bp, Homo sapiens
ggggcccaggtggtgaccgtggtgtatggccctgcaacccagctcactgtcagtgtcactgtgccct

SEQ ID NO: 21235 - DNA, 95 bp, Homo sapiens; identical to SEQ ID NO: 580

SEQ ID NO: 21236 - DNA, 93 bp, Homo sapiens; identical to SEQ ID NO: 69

SEQ ID NO: 21237 - DNA, 113 bp, Homo sapiens
aaagttcaatgagaggtgtaggcattatatagagcattatatatttatctgtatatgttaggtatcatatatttatgtgttttatatctcctattgttttgtccattaatttt

SEQ ID NO: 21238 - DNA, 75 bp, Homo sapiens
gtctgtatgtatgtctgtgtgtatgtgtgtctgaactttgtgaaaagaggcaatcacatcaggacagttgcaggc

SEQ ID NO: 21239 - DNA, 113 bp, Homo sapiens
accaacagtgtaaaagtgttcccttttcactgcatccatgctaacatctattattttttgattttttaaattatgggcattattgcaggagtgagatgatattgcattgtggt

SEQ ID NO: 21240 - DNA, 94 bp, Homo sapiens
cctgagatgcatgtggagagaagagtgtgatgtcaggattcgaggccatggcaaggtcttggattatatccttttttcctggaagccttttggg

SEQ ID NO: 21241 - DNA, 58 bp, Homo sapiens; identical to SEQ ID NO: 637

SEQ ID NO: 21242 - DNA, 85 bp, Homo sapiens
tgagactgagtctcactctgtcgcccaggctggagtgcagtggtgcgatctcggctcactgcaacctctgtctcctgggttcaag

SEQ ID NO: 21243 - DNA, 58 bp, Homo sapiens
tgagactgagtctcactctgtcgcccaggctggagtgcagtggtgcgatctcggctca

SEQ ID NO: 21244 - DNA, 113 bp, Homo sapiens
ggattgctttagctactcaggctcctttaggttccatatgaattttaggatagtttttttctaattctgtgaaaaaatgatgttggcagtttgataagaatagcattaagtct

SEQ ID NO: 21245 - DNA, 79 bp, Homo sapiens
ggtgctgaatgaacagtccagtatggatctgtacggaggctgtaccaaggattggtgtctgtttatttttatttgtgct

SEQ ID NO: 21246 - DNA, 63 bp, Homo sapiens
gcctcaggctgagtcacacagtccctcaggcctggagtgctctctgactctcacctgtgtggc

SEQ ID NO: 21247 - DNA, 69 bp, Homo sapiens
atgacaattcagtgtttgatgttgtgaggaactgccatattgttttcacagcagctgcactttttgcat

SEQ ID NO: 21248 - DNA, 105 bp, Homo sapiens
ggcagcagtctggggcctgattccctccccgacactcactgcctcaccctccctgaggtagaaggtggctggactgaaggctacaggctcagtgaagagtgggtc

SEQ ID NO: 21249 - DNA, 99 bp, Homo sapiens
gaatgcctctcttcttctcccaatgatcacacttcctcttcagcaagggcacaaaactggatggagaatgagtttgactaactgacagaagtaggcttc

SEQ ID NO: 21250 - DNA, 99 bp, Homo sapiens
acttagtcataggcgtgcatgcctgagaaatgtcatagtgcatacagggcttggtactctctgtggtttcaggcatctactgggggtcttggactgtgt

SEQ ID NO: 21251 - DNA, 68 bp, Homo sapiens
tcctctgtgtctctgtgtctagttcctctaagaagaggaacttcatgccactggtgtccacagaagga

SEQ ID NO: 21252 - DNA, 113 bp, Homo sapiens
acacacacacaatgagcctatattttatatatatgcatgtccatatatacatgtatctatttatattcatgtatacatatgcatatgtatacgatttttcatacatgttatgt

SEQ ID NO: 21253 - DNA, 100 bp, Homo sapiens
ttgttattcacatacagtgagagagatgactgagtccagtttgttttatatttttgaactctgaaatcatgtcagcttccttgcagtataactttgacaa

SEQ ID NO: 21254 - DNA, 96 bp, Homo sapiens
cagcctcagttccgtgtctgaagaccgtgtgccaccctccctgactctgaagagccttgcaccaggttcacaggctcctggagacactgaagtctg

SEQ ID NO: 21255 - DNA, 96 bp, Homo sapiens; identical to SEQ ID NO: 21254

SEQ ID NO: 21256 - DNA, 88 bp, Homo sapiens
gcaggtcaggcagagagtggacgggcagctgctgggccactgtctccaccgttctctggctatctctgtctctctctctctgactttc

SEQ ID NO: 21257 - DNA, 111 bp, Homo sapiens
gattaatattaacgccagtcttctgaaaaagaaaagtatttataggtctgtattttatttttgtttaaaagacctaaaactttgactgtcagctggtccatgtagaaggtc

SEQ ID NO: 21258 - DNA, 72 bp, Homo sapiens
acatgtgtgtatatgtatatgtgtatatataaatgaatatatgtgtgtgcatatgtgtgtatatgtatatgt

SEQ ID NO: 21259 - DNA, 186 bp, Homo sapiens
tgtatgtgtgtatatataaatgagtacatgtgtgtatataaatatatgtgtgtatgtatatgtgtgtgtatgtatatctgtgtatacatgtaaatgaatatatgtgtgtatatataaatgaatatatgtatgtgtgtatataaattaatacatatgtgtgtgcatatgtatgtgtgtgtatgttta

SEQ ID NO: 21260 - DNA, 80 bp, Homo sapiens
gtagaacgggaagttgctctgggtgagtcagtgagtgtgtggagcgtgaatctgaaggcccaggtcgtgaccataactac

SEQ ID NO: 21261 - DNA, 92 bp, Homo sapiens
gacctgactcataccccgaaggagccatgcggtgctgggcctgacagggaagtcggctcactctgtctctcacgtgatatggtcattgtcct

SEQ ID NO: 21262 - DNA, 85 bp, Homo sapiens
cttgttgacacggtctctgtctttgtgcatggccgtgagaagtctctctcggtcacatgaggacaattagccttgcttcagcaag

SEQ ID NO: 21263 - DNA, 61 bp, Homo sapiens
gggagactgagaataaaagattgttggacttgccctgagactctgattctctgtgtctgcc

SEQ ID NO: 21264 - DNA, 79 bp, Homo sapiens
agcggggcaccaggtggacgacccagtcaggcatcccctgcaggtaacaggtctgggtctctcactctctcccaaagct

SEQ ID NO: 21265 - DNA, 79 bp, Homo sapiens
catgatgaaggggtggagggtctctctgggtctctctgataaagggcactaatcccattcctgaggccccacccccatg

SEQ ID NO: 21266 - DNA, 106 bp, Homo sapiens
ctattaaagtctctatcacgagggttaaatgaatgactattacttccacaatgacttgtgattctgtttttatcaaatgtttcaacacttttggtatctttgatgg

SEQ ID NO: 21267 - DNA, 70 bp, Homo sapiens
gacaggaagatactcagcacacagcctccgtagagggccagagccactccgaagttggtgctctcttgtc

SEQ ID NO: 21268 - DNA, 58 bp, Homo sapiens; identical to SEQ ID NO: 20050

SEQ ID NO: 21269 - DNA, 99 bp, Homo sapiens
tgctactcctggcccgtgtcttttgatttctatatgaattttagtatcagcttgtcaatttcagcaaagaagtcatctgggatttggatgggaattgca

SEQ ID NO: 21270 - DNA, 56 bp, Homo sapiens
acagggagaagacataactgataaagggctcacctccagtctgtctctctctctgt

SEQ ID NO: 21271 - DNA, 114 bp, Homo sapiens
ttggtatgtaagcagggagaggaccaaaataaggagcctggggtggggggtggatacttacagtctgtgtctcagggaatttcctgaggcctcctttctgcttggtttccccaa

SEQ ID NO: 21272 - DNA, 56 bp, Homo sapiens
ccagacagtcagctgtgaggcctcgctctgaggcctgtctgcggctgtctctctgg

SEQ ID NO: 21273 - DNA, 94 bp, Homo sapiens
gggagcattcacaggtgtgtgccacggggcctctcccacactgtcagcctcagagatgccccagaggccagcagctctggaactgagtgtgcct

SEQ ID NO: 21274 - DNA, 69 bp, Homo sapiens
gcaccagcagaagctctctcaggctcacagatggggcctccaaagtgagaaccaggagagcggctgtgt

SEQ ID NO: 21275 - DNA, 56 bp, Homo sapiens
ggtccctctgtgtctgtgtgtccagcctgggaggaggcgcagaggctggagtagcc

SEQ ID NO: 21276 - DNA, 83 bp, Homo sapiens
cctctgtgtcatatgtagattcacctcctccagcaggtaccttccttaagggcagggcctgagtctctcacacacagtctcgg

SEQ ID NO: 21277 - DNA, 113 bp, Homo sapiens
tgtgatatgtctggttgtaggtctccttgcattgcatttatactacttggagttggttgagcttcttggatgtttagattaatgcttttttattgaatttgggatggtgtcca

SEQ ID NO: 21278 - DNA, 76 bp, Homo sapiens
gtgcatacacatatctcagtatagatatgtacgtatatgtgtgtgtgtgtgtgtgtgtgtgtgtgtgtgtgtgtat

SEQ ID NO: 21279 - DNA, 75 bp, Homo sapiens
atagtgtattctgtctttcactttgattatcttaattattgtgtatagttcaaaggaaggatagaatttcactgt

SEQ ID NO: 21280 - DNA, 89 bp, Homo sapiens
gtaggccacactctctctctctacatataaagtatatatatgtgtgtgtgtatatatatataattgtgctaagacgttgaggtggctac

SEQ ID NO: 21281 - DNA, 79 bp, Homo sapiens
cagtggtggcgcctgggagctcggctgcaaactcacacttgtctcctgcccacccccagtctctcactgcctctcactg

SEQ ID NO: 21282 - DNA, 93 bp, Homo sapiens
gtgggaattttagtttatctgtgagcactgtctctcaggggctgagaatgagcccagcaatgggaaccatcgcatgcaggaacacacacccgc

SEQ ID NO: 21283 - DNA, 92 bp, Homo sapiens
gtgtgtgtgtgtggtgtgtgtgcatgtgtgcacatgcctgtggctgcgtgtggtgggcagtgtgtgcatgtgcatgtggtgtgtgcacgcat

SEQ ID NO: 21284 - DNA, 101 bp, Homo sapiens
gtgcttgtgttaagtgtgtttgtgcatttatgtgtgtgtgtatgtgcatgtttatatgtgcatccacatgtatgtttgtgtgtttttatttggctatgtgt

SEQ ID NO: 21285 - DNA, 84 bp, Homo sapiens
gtgtgtatgtatgtatgtatacatctatatattagtatgcaatatgaaacaggtgtgtatgtaacctaaaatatacatacatat

SEQ ID NO: 21286 - DNA, 88 bp, Homo sapiens
cacaccatgtgtgtgggtgcatatgtgcatgtatatgccttgtgtgtgcatgttgtgtgagagcatgtgcatgtgcataccatgtgtg

SEQ ID NO: 21287 - DNA, 76 bp, Homo sapiens
actggtgatcatgttgtgaatttgttgtttcctgcactgttaggtaggaaacacagggataaacatttctgcctgt

SEQ ID NO: 21288 - DNA, 108 bp, Homo sapiens
ctctctgctttctgcctgggagttttgtctgggacgcctgtgtctgccccactcactgtgtggtgcaagctccatttccagtgaggacaaccgtggctgccgagagca

SEQ ID NO: 21289 - DNA, 100 bp, Homo sapiens
aagtatgtctcatcgttctggagataggaattccaagatcaagctgttagcaagttggtacccactaagagcctggtttccatttctaagatggcatctt

SEQ ID NO: 21290 - DNA, 82 bp, Homo sapiens
aattgtggagagggatagtggtggtgactgtagaatgtgatgaatatatttaacaccactcactatagacttaagaatggtt

SEQ ID NO: 21291 - DNA, 95 bp, Homo sapiens; identical to SEQ ID NO: 68

SEQ ID NO: 21292 - DNA, 93 bp, Homo sapiens; identical to SEQ ID NO: 69

SEQ ID NO: 21293 - DNA, 58 bp, Homo sapiens
tgagacagagtctcactctgtcacccaggctggagtgcagtggtgtgattttggctca

SEQ ID NO: 21294 - DNA, 114 bp, Homo sapiens
gtgttcatatgtatatgcgtgaatatgtgtgtatatgcgtgaatacgtgtgtatatgtatgaatgcatgtgtgggtatgtatatgcatgcatgcatgtgtgtgcgtctgtatat

SEQ ID NO: 21295 - DNA, 92 bp, Homo sapiens
gcacagcccccctctgtcaccctctgtgggtgtgcaaagcctcaggaaggcgacacccacacccgcataggtgcaggtgtgggaggcctagc

SEQ ID NO: 21296 - DNA, 112 bp, Homo sapiens
gttacttgaagttgcatggcatggtttgtgtctggatgaaaaccgagactgcgtttcactcgactgtagtgagggtgatctccaggcatctcacccctgcgtgggcacagac

SEQ ID NO: 21297 - DNA, 135 bp, Homo sapiens
tttcctttatgtggcataggcaaagtttttgatacttaccatccacatgcagaatttgggatgagtgagagatcacagggtgcaagtctcagtacaggaaatgttacttcaacctgctctccttttcccagagca

SEQ ID NO: 21298 - DNA, 89 bp, Homo sapiens
aatgtttcttttcagacttttaaaggtgtcagactctcaatctctcctagattctggaaaggcctggaaaaggaagacctggatgcatt

SEQ ID NO: 21299 - DNA, 76 bp, Homo sapiens
taatctgtgtgtgcgtgtgcatgtgcatgcatgctcgtgtgtgtgtgtacacctatatgcctattaaatatataca

SEQ ID NO: 21300 - DNA, 117 bp, Homo sapiens
tgctgacgattgtcttggctatacgggcatttttttggttccatatgaaatttaaagtagttttttctaattctatgaagaaagtcagtggcagcttgatggggatagcattgaatc

SEQ ID NO: 21301 - DNA, 90 bp, Homo sapiens
actttaacagcagttttcttcaaacacagccatgtaagttcaagtttttaatttactttaaaatggttgttgagaaaattgtgctttagt

SEQ ID NO: 21302 - DNA, 65 bp, Homo sapiens
cagagtctcgctcactcagtgctcaatgttgcccaggctggagtgcagtggtgtgatcttggctc

SEQ ID NO: 21303 - DNA, 99 bp, Homo sapiens
attctcctccttcgtgactttgcagaaggagagattcttttatcacagtaactgttgagaagaatgaattctccctcttcaatacatgtggagaagaat

SEQ ID NO: 21304 - DNA, 120 bp, Homo sapiens
cagtgtctcagggcctgctctgctccttcccaagtgtgagcacagagagcccacactggcccccaggacctgcccccaccgtgctccccgaggacaccgaaggtccaccaccgggaccag

SEQ ID NO: 21305 - DNA, 108 bp, Homo sapiens
taaaatctggaaaccatttcattcatcgttggctaatttcaattcaattgcaacttgaatgtaaattattggaactggctactaatgaagaattgaagacgaattttg

SEQ ID NO: 21306 - DNA, 69 bp, Homo sapiens
ttgtttgtggcagagtctcactgtgtctccaatgccggagtgcagtggtgcgatctcagctcaccgcaa

SEQ ID NO: 21307 - DNA, 117 bp, Homo sapiens
cctggagtcacctgggccctggtcagcaatgcagagcctcggtctcaaccgggagtttctgaatcagcatctgcatcttagcgaaaccccaggcgacccacacatacattcaggtga

SEQ ID NO: 21308 - DNA, 66 bp, Homo sapiens
gacctgtctgcccaggaagcctgaggctcacgctctctggctttttacagaacaagtttgcaggtc

SEQ ID NO: 21309 - DNA, 61 bp, Homo sapiens
gctgcttcacttttccatgtgtctgcctggccatcagtagagacagaacagtgactgcagc

SEQ ID NO: 21310 - DNA, 173 bp, Homo sapiens
atgcttcaggagtcagagccgccccacagcactggtacgtgtgtctgtgtgtgtgtgtgcgcgtctgtgtctgtgtgtctgcgtgtgtatgtgtgtgcatatgcttcaggagtcagatccacccccacagtgctggtacgtgtgtctgtgtgtgtgtgtgtacgtgtgtgtgt

SEQ ID NO: 21311 - DNA, 61 bp, Homo sapiens
ctgcggtggatttgggaaaaccaggttgactttgcctgcgtccctgtgtccctgagttcag

SEQ ID NO: 21312 - DNA, 117 bp, Homo sapiens
gcgtttcctcaaggttctttggtggtggtttcagtctctggctgagagaactgactgcgcaggcttagtcctcattagtccaagacccaaagcttccaggatgcagacgggagctgc

SEQ ID NO: 21313 - DNA, 115 bp, Homo sapiens
tttttgcttacggttgtcttggctatacgggctttttggttccatatgaaatttaaagtagttttttctaattctatgaagaaagtcaatgttagcttggtgggaatagcattga

SEQ ID NO: 21314 - DNA, 107 bp, Homo sapiens
tccttcacttcccttgttagctgtattactaggtattttattctttttgtagcaattgtgaatgggagtttatttgtgatttgctttcctgttgttggtgtatagga

SEQ ID NO: 21315 - DNA, 90 bp, Homo sapiens
ctttgttttgggggtctcaatctctgtctatctatagttggtggcagaaagtcaaaagatggagaaaaggattgggaacagtagaaaaag

SEQ ID NO: 21316 - DNA, 114 bp, Homo sapiens
cctctggagctgaatgaacggtacagcacaggcgctgcctgggaccctgaatgccgtccagaggggctgctgtctcaggatcccacagctgcaggtctgggcccggctcaaagg

SEQ ID NO: 21317 - DNA, 72 bp, Homo sapiens
tggtgtgtgtgtcagtcagtcaggctgtaaatggtgtgggtgtcagtcaggctgtaaatggtgtgggtgtca

SEQ ID NO: 21318 - DNA, 68 bp, Homo sapiens
tgtgcagatgagtgtgcccgtgtacaaatatgtgtgcatgcctgtgtgtgtgcatgttcttctgcaca

SEQ ID NO: 21319 - DNA, 127 bp, Homo sapiens
ccattaaattactcactgtgactggttgtcctgctttcctcaggttttcttctgccaactgtgacagcttcttgatctgtccccaagtgggtggctgtgtttgatgggtgttgctcgtgacagttgg

SEQ ID NO: 21320 - DNA, 136 bp, Homo sapiens; identical to SEQ ID NO: 3160

SEQ ID NO: 21321 - DNA, 184 bp, Homo sapiens; identical to SEQ ID NO: 3161

SEQ ID NO: 21322 - DNA, 99 bp, Homo sapiens; identical to SEQ ID NO: 3220

SEQ ID NO: 21323 - DNA, 83 bp, Homo sapiens
aagaaaggggagtgggcacgaaatactacagaacctgcagggaatgaagtccctctgtctgtgtgtgcctatatcaataactt

SEQ ID NO: 21324 - DNA, 112 bp, Homo sapiens; identical to SEQ ID NO: 2168

SEQ ID NO: 21325 - DNA, 168 bp, Homo sapiens
acggggtgtgtgctgtgtgagaacgtgtgtgtagtgttcacatgtcctctgtgcgtgagtccctgtgtgtgatgttgtgttctcggtgtgagttcatgggtgtgacggggtgtgctgtgtgagaacgtgtgtgtagtgtccacatgtcctctgtgcgtgagtccctgt

SEQ ID NO: 21326 - DNA, 82 bp, Homo sapiens
catttgaataggtatacatatatgtacatatatacctatatgcgtaaataagtgtgtgtatatgtatatatattcaattgct

SEQ ID NO: 21327 - DNA, 110 bp, Homo sapiens
tgcttaggattgtctcagctatatgggctcttttttggttccatatgaaatttaaagtagttttttctaattctgtgaagaaagtcaatggtagcttgatgggaatagca

SEQ ID NO: 21328 - DNA, 115 bp, Homo sapiens
cttgggattgctttggctattcaggctcttttttggttccatatgaattttagaatagtttttttctagttctatggaatttaggatactttttctagttgatagttgtgatagg

SEQ ID NO: 21329 - DNA, 65 bp, Homo sapiens
ttgagatggagtctcactctgtcacccaggctggagtggagtggcacgatctgggctcactacaa

SEQ ID NO: 21330 - DNA, 66 bp, Homo sapiens
ggactgactcactctccctctggtcccaaggtaaaataaaatgccaggaaggggtgtgattggttc

SEQ ID NO: 21331 - DNA, 58 bp, Homo sapiens
tgagacagagtctcgctctgtcacccaggctggagtgcaatgatgcgatctctgctca

SEQ ID NO: 21332 - DNA, 105 bp, Homo sapiens
tgggagcatggtatggaggcaggaaaacaacagcttttttcatttatttttgaggtgatttctgtagttttcttggggttattttctagacagatgtgacttcta

SEQ ID NO: 21333 - DNA, 60 bp, Homo sapiens
ttgagacaggctctcactctgtcacccaggatggagtgcagtggtgtgatcatggctcaa

SEQ ID NO: 21334 - DNA, 94 bp, Homo sapiens
atatacactgatttaaatatatatatacttatatatgaacatatatatgttaatatacatatacatatgtatgtgtatatatatgtgtgtgtgt

SEQ ID NO: 21335 - DNA, 58 bp, Homo sapiens
tgagacagggtctcgctctgtcactcaggctagagggcagtggcgcaatctcggctca

SEQ ID NO: 21336 - DNA, 119 bp, Homo sapiens
ggcagcaagagcgaagctccgtctcaaaaaaaaaaaaaaaaaaaaggaaaagaattgctgtttctatttttatttatttatttttaattttttttcgaaatggagtctcactctgtcgc

SEQ ID NO: 21337 - DNA, 97 bp, Homo sapiens
catcatggtcgctcagggacatggtgaatcatactcttttttttttttttttttgagatagagtatggttctgttgcccaggctggagtgcgtggtg

SEQ ID NO: 21338 - DNA, 76 bp, Homo sapiens
ggtgactcatgtttgtaatcccagcactttgggaagctgaggtagaaggatcacttgaagccaggagttcgagacc

SEQ ID NO: 21339 - DNA, 109 bp, Homo sapiens
ttggtcagaaaatagcagcagggtgagctacaacaggagtcttcaatttttttacttgtatataccctaaaagaattttgtaaaagcctcttgcacatttttagattgg

SEQ ID NO: 21340 - DNA, 84 bp, Homo sapiens
gggtctcactctgtcactcaggctggaaggcagtgacacaatcttggctcgctacagcctcgacctcctgggctcaagtgatcc

SEQ ID NO: 21341 - DNA, 111 bp, Homo sapiens
gatgatccagggtctatgtatatttattacatgtatgtatatatgtatatatatatgcatgtgtatatatgtacatacatacatatagatgtgcttgtactagtgtttttc

SEQ ID NO: 21342 - DNA, 75 bp, Homo sapiens
gctttgaaaatagcgtgttgtgttgttttgttttgttttgctttgagacagggtctcactctctgttttccaggc

SEQ ID NO: 21343 - DNA, 101 bp, Homo sapiens
tgcatctattgatttcagggctcgctagtctgcttcatttatctgtttttgtatatcactaacaatatagcactttacaatgagtcaatatcaggcatgca

SEQ ID NO: 21344 - DNA, 58 bp, Homo sapiens; identical to SEQ ID NO: 2540

SEQ ID NO: 21345 - DNA, 74 bp, Homo sapiens
tatgtgtatatatatgggtgtgcatatgtatatgtgtaaatatatgggtgtgcgtatgtatatatatatatatg

SEQ ID NO: 21346 - DNA, 58 bp, Homo sapiens; identical to SEQ ID NO: 2248

SEQ ID NO: 21347 - DNA, 64 bp, Homo sapiens
gtggcttgtcaggatagttgtgaggattgagatatcattctcataccgactaaatataggtcac

SEQ ID NO: 21348 - DNA, 115 bp, Homo sapiens
gctatagtgctttagctagcctgtcacctatatcaagtatgtctttgtttttaagtctttttttgtttttctgagctggagtctcgctgtgtcacccaggctggagtgcaatggc

SEQ ID NO: 21349 - DNA, 58 bp, Homo sapiens; identical to SEQ ID NO: 502

SEQ ID NO: 21350 - DNA, 81 bp, Homo sapiens
gggaggaggcatgaagctaggatgagacagcggaaaatagattaattttgtttatcatatttggcaacttgtcttgatctt

SEQ ID NO: 21351 - DNA, 64 bp, Homo sapiens
tgagatggagtgtggctctcactctgtcacccaggctgcagtgcagtgacacgatcttggctca

SEQ ID NO: 21352 - DNA, 111 bp, Homo sapiens
ggaccagatagttattctactataatcttcaatgtgcattttctacaagatctatgttttatatatatatgctcatcactgataaatggtacaaagagaatctgggtatcc

SEQ ID NO: 21353 - DNA, 84 bp, Homo sapiens
ttggccttttcattgatttctgtttatgaagtttttgcctagggggcctctttttttaattataaaaatgaaatgtagggccag

SEQ ID NO: 21354 - DNA, 90 bp, Homo sapiens
gatgtaaggctaaactgttttgaaaaagaaatgtttagtaaacttttatttatttatttatttatttatttttgagacagagtcttactc

SEQ ID NO: 21355 - DNA, 116 bp, Homo sapiens
actccagcctgggtgacagagtgaaactgtgtctcaatctgtcaaactgtgtcataatcttttttttttttttttttttttgaaacagagtttcactctttcgcccaggttggagt

SEQ ID NO: 21356 - DNA, 58 bp, Homo sapiens; identical to SEQ ID NO: 2263

SEQ ID NO: 21357 - DNA, 82 bp, Homo sapiens
agtctcactgtgtcactcaggctggagtgcagtggtgcgatcttggctcactgcagccttcacttcctgggttcaagagatt

SEQ ID NO: 21358 - DNA, 70 bp, Homo sapiens
ttttttggagtcagggtctctctctgtcccctaggctggagtgcagtggcacaatcttggctcactgaaa

SEQ ID NO: 21359 - DNA, 58 bp, Homo sapiens
tgagatggagtctcactctgtctcccagcctggggtacagtagtgtgatcttggctca

SEQ ID NO: 21360 - DNA, 98 bp, Homo sapiens
ggagtgggccctgggagtgggtagagagagggtagaggcctgggaacaggcacattctttttttttttttttttttttttgagacagggtctcactct

SEQ ID NO: 21361 - DNA, 60 bp, Homo sapiens
gtgagacagggtctcactctgtcaccccggctggagtgcagtggcatgatcttggctcac

SEQ ID NO: 21362 - DNA, 89 bp, Homo sapiens
gtttatactggcagatacccacgtggctcttgtctgatcgggtccagtttatgcctgtctgactgtcactctgctgctgggagcctgac

SEQ ID NO: 21363 - DNA, 95 bp, Homo sapiens
gtccaaccttttctactttttcagagttcagttctcttaaatctaagagattctcttttgtaatgtagctcaagaggaagtttaagggttaggtc

SEQ ID NO: 21364 - DNA, 102 bp, Homo sapiens
cagactttaatgtttctctttactgattttgttctctcttagccacctcttggcttttgaggggaatgaacactgaatccaagatgagacttttaaaatctg

SEQ ID NO: 21365 - DNA, 83 bp, Homo sapiens
ggttcttttggggatagttcattgttagtatgtagaaatactactgatttttatatattgattttgtatcctgcaattttact

SEQ ID NO: 21366 - DNA, 89 bp, Homo sapiens
cttgcctctggagagtctcattcactgtgtctgatggtgcccaagtatctgtatttttacaaagtgcctcaggggactctaatgcgggg

SEQ ID NO: 21367 - DNA, 109 bp, Homo sapiens
ggggcgactagggccttgttagtgagagaatgtcagactgctccccagctatcacagtctctctcttctctctcagtcatcccttcctataaatcacaactcaccagtc

SEQ ID NO: 21368 - DNA, 95 bp, Homo sapiens; identical to SEQ ID NO: 68

SEQ ID NO: 21369 - DNA, 93 bp, Homo sapiens; identical to SEQ ID NO: 69

SEQ ID NO: 21370 - DNA, 110 bp, Homo sapiens
tgttagatgtgagtgactctttgggagtccctcaaatgtgcagttagtgttagaagtgagagtggtcttgagggctcccgaactgtgttgtactcacataagaaataata

SEQ ID NO: 21371 - DNA, 114 bp, Homo sapiens
gaggaaggaatagtggctgaaaatgtactgtgagaagcttataaaaattgtcttccttatgattttttatttctaactacagttctacatcttcagtaccaccttcctttttcc

SEQ ID NO: 21372 - DNA, 103 bp, Homo sapiens
tgtgaagccagcagtgacaggctgttttgtgtatgtacttttctcccccactttttttttttttattaaggaagcacaagatgcaagctgtttgctgaaaaca

SEQ ID NO: 21373 - DNA, 89 bp, Homo sapiens
caggagtagtggcttgtatctgtaatctcaacattttgggaggctgaggtggaaggatcacttgatgccagaagtttgagaccagcctg

SEQ ID NO: 21374 - DNA, 89 bp, Homo sapiens
agtattccattatatatatatgtatatctggtatgtgcatataggtacatatgtgtatatatggatatactttgtgtggatatatgtgt

SEQ ID NO: 21375 - DNA, 81 bp, Homo sapiens
atgtacatatatacacatatatacactcaccagatatataccgaagtgcatatatgtgtatgtatatgtatatatgtacat

SEQ ID NO: 21376 - DNA, 161 bp, Homo sapiens
tatacaatctatatatatacatatacgtatatacacacatatacgtatatgtgtatatatgtatgtatatatgtatatgtatatgtgtatatagattgtatatataatatataataaatatatagattgtatatatatacatatacatatacatatataca

SEQ ID NO: 21377 - DNA, 92 bp, Homo sapiens
tagttttatacaatctatatatacatatatgtatatgtgtatatacatatatgtgtatatacgtatatgtatatatagattgtataaaacta

SEQ ID NO: 21378 - DNA, 111 bp, Homo sapiens
tgtttgtattaaactgtttgaagtattatgagggatattaaaatgtccgtgacacagtccgtgtcacagaggagatttttctttcaatggagaagacattctatacaaata

SEQ ID NO: 21379 - DNA, 118 bp, Homo sapiens
cagctcagcactcctgatgtgtgtgctctaactctggggagctggtactgagcccctggctttgttctctagctcctggaggttaggaacctactgcactggaggggcttaggtgctg

SEQ ID NO: 21380 - DNA, 104 bp, Homo sapiens
gccctggagctctcctgttgaaagctgtttcccacatactgggactgattcactctgtcactccctaggattttcactaatactttctattagttgccattggc

SEQ ID NO: 21381 - DNA, 65 bp, Homo sapiens
ctgcctgcatgtggttgaaggttcttcttaggagaaagagtatttgacagtgcagctgggggcag

SEQ ID NO: 21382 - DNA, 56 bp, Homo sapiens
gtgtgtgtgtgtgcatatgcatgtgtgtgaataaacacatgcacacgcacacaaac

SEQ ID NO: 21383 - DNA, 96 bp, Homo sapiens
catgaggcagaaaaggaaaagttctgtatttcaatgtctttattttcagtatgggccgaggagtgcagatcactgcttttaaaatcaccagtcatg

SEQ ID NO: 21384 - DNA, 113 bp, Homo sapiens
agtatttcaaaggtgtgcgtgtgttgtaaaaagagtattctctctttctctgacattggtgaaatggtttcagagggagtgttttctctataagacttccaccgtggtgtgct

SEQ ID NO: 21385 - DNA, 97 bp, Homo sapiens
ccctcatggttatttagccttttaatctgtctggttaagatgtccttaatactggtgacataggaggaattaggaagaaaagggaaaaagagcaggg

SEQ ID NO: 21386 - DNA, 119 bp, Homo sapiens
tcagggatcccaaggtttctacattatggtgagttgtataattatttcattatattttacaatgtaataataatagaactaaagtgcaaaataaatgtaatgcacttggatcatcctga

SEQ ID NO: 21387 - DNA, 110 bp, Homo sapiens
tcttaattttggattattaaatacatgatataattatgtaatgtcatacacaataattgtatgtattttacttcaattacttccaattggtttgtagtttaattttaaga

SEQ ID NO: 21388 - DNA, 76 bp, Homo sapiens
atgttctagacttcttaggagcaatctttatttatttttggagctcacagattgcatttgaacgagtcaggaatat

SEQ ID NO: 21389 - DNA, 99 bp, Homo sapiens
ccttacatgtgttttactgttaggatttccactccacctctgatgtgtgtgggtgtgtgggtgtgtgggatatctcaagagggtgatgacaaagatagg

SEQ ID NO: 21390 - DNA, 83 bp, Homo sapiens
gcatgccagatgacttgtgttttaattgtagttctgttactaacaagcctggtgatcagtgacacgcaataacctctgggtgc

SEQ ID NO: 21391 - DNA, 71 bp, Homo sapiens
tgtgtgtgtatatatgtgtccatatatatatatatatatatatatatatatatatatatatatatatatat

SEQ ID NO: 21392 - DNA, 168 bp, Homo sapiens
gtgacagagcagggctctgcctagaatctgctgactgtgaggctggctctctctctgcactttgccaggtcatactgggtcctcttttctttttcttttctttctttctttttttttttttttttttttaagatggagtctggctctgtcgcccaggctggagtgcag

SEQ ID NO: 21393 - DNA, 98 bp, Homo sapiens
gtatatctgaattttaatatatctgaatatgttatatgtgatatatattttaatatatctgaatatacatatattcagatatactagaattaaaatac

SEQ ID NO: 21394 - DNA, 95 bp, Homo sapiens; identical to SEQ ID NO: 68

SEQ ID NO: 21395 - DNA, 93 bp, Homo sapiens; identical to SEQ ID NO: 69

SEQ ID NO: 21396 - DNA, 103 bp, Homo sapiens
ccatagaagtcattttcttgaaagtaaatgcagaacaaggcattatctgttatagaagcatatgaaatgtgttgaaaatttacaaagaaaactgatgctgtgg

SEQ ID NO: 21397 - DNA, 94 bp, Homo sapiens
gttcctgagcttagggagaaagcattcagtcttttttttttttttttttttttttttttgagatcaagtctttctctctcacccaggctggaat

SEQ ID NO: 21398 - DNA, 84 bp, Homo sapiens
cagttcacaatagggttcgctctcctgtgagaatctgatgccctggctgatctgacaggagacagagctcaggtggtgaggctg

SEQ ID NO: 21399 - DNA, 78 bp, Homo sapiens
tatatgtatgtatgtatgtgtgtgtgtgtgtatatatatatatatgcacatacacacacatatacacacatgcctatg

SEQ ID NO: 21400 - DNA, 110 bp, Homo sapiens
tcaggcttgatgtgtttctagaagcagctgttaggacaataatatttaagattattttttaaagttcttttaaatatagttcttctaaaaatcactgagagaaaatttga

SEQ ID NO: 21401 - DNA, 115 bp, Homo sapiens
tcagccttctgagtaactaggactacaagcacatgccaccatacccagcaaatttttcaatttttttagagatggggttcttgctttgttgcctaggttggtcttgaactcctga

SEQ ID NO: 21402 - DNA, 116 bp, Homo sapiens
tgcaccttgagcctgacacattaataaactacaaggcactggtaattcttttttttttaattatactttaagttttagggtacatgtgcacaatgtgcaggttagttacatatgta

SEQ ID NO: 21403 - DNA, 80 bp, Homo sapiens
gcctgaggattgcttagaagcctgagaagctgggaatgggagagtgcagactgagaggatttctggggcctgtccaaggt

SEQ ID NO: 21404 - DNA, 119 bp, Homo sapiens
tgtggcccacgttcaagaggccaagctcttaactgttctggatccactggggatgataatactgtctctttctcactgtgcaatgcaagtaacataagccttcttaattaatggacaca

SEQ ID NO: 21405 - DNA, 95 bp, Homo sapiens; identical to SEQ ID NO: 68

SEQ ID NO: 21406 - DNA, 93 bp, Homo sapiens; identical to SEQ ID NO: 69

SEQ ID NO: 21407 - DNA, 97 bp, Homo sapiens
gtagtattccatggtgtctgtgtgtgtgtgtgtatatatatatatatacatatatgtacatatatatactatatatacatatatgtacatatatatg

SEQ ID NO: 21408 - DNA, 100 bp, Homo sapiens
catggttctggaggttagaagtctgagatcaaggtgtcagcaagtttggtttcttctgaggcctctcctcttggcttgtggctgctgtctccctactgtg

SEQ ID NO: 21409 - DNA, 117 bp, Homo sapiens
tcagtctagatgaaaagatatgaccaaatcacgcaggacaggctcacaagtcgcttctctgtctgtcaagatagaaagtgaaggtgggcagtggtgagaacaggttttttggaaagg

SEQ ID NO: 21410 - DNA, 96 bp, Homo sapiens
actgctcaagggtcacatagcttgtggtcacaagatttaacttctccagtagttgcttctatagataacattgctatggtgaaacttaagactggt

SEQ ID NO: 21411 - DNA, 114 bp, Homo sapiens
gcctgaaccctatcccagatcaggtatagcaaaatcccctaggctggaaccagaatatcaatattttttaaaccctccctaggtgatgctactatgcattcagggttgagctgc

SEQ ID NO: 21412 - DNA, 73 bp, Homo sapiens
cttgcacatttctgtgttggtcttataggctcaggcaagtaaagtgagacagacacagagacagggctgtgag

SEQ ID NO: 21413 - DNA, 113 bp, Homo sapiens
gtgtattgtcttgaaaacgtgtctttttgtctttgttttttgttgttttttttttttttgccagaaattacaacttaaaaaaaaagattttgtcagaaggaagtgacctgcac

SEQ ID NO: 21414 - DNA, 101 bp, Homo sapiens
atgtcaaactctatctatagatagtatgtatatacatatatatgtacatgtatatatataaacatttggtgtatgtgtgtgagtatgagcgtgtgtatgca

SEQ ID NO: 21415 - DNA, 86 bp, Homo sapiens
ctgggattacaggtgtcggccaccacgctaggctaagactaacttttatatttttagtagagacggggtttcaccatgttggccag

SEQ ID NO: 21416 - DNA, 90 bp, Homo sapiens
ggagaacatggtgagagaaacatagcaataaactcaatcttataactgattgccagtcttcattatatgtatttctttcaaatgttaacc

SEQ ID NO: 21417 - DNA, 97 bp, Homo sapiens
gctgtgactcatcatgcctggccagagagtgatttttttttaattgattgattgattgagacggagtctcattctgtctcccaggctggagtgcagt

SEQ ID NO: 21418 - DNA, 105 bp, Homo sapiens
accttctgaagcctacttctgtcagttcgtcacactcattctctgtccagttttgttcccttgctggcgaggagttgtgatcctttggagaagaggcattctggt

SEQ ID NO: 21419 - DNA, 91 bp, Homo sapiens
agagtattgtactaataaagttaagcatgaagttattagacatttatcattgatttcatgtctgtgtctttatctgtgttacgaatgcttt

SEQ ID NO: 21420 - DNA, 95 bp, Homo sapiens; identical to SEQ ID NO: 68

SEQ ID NO: 21421 - DNA, 93 bp, Homo sapiens; identical to SEQ ID NO: 69

SEQ ID NO: 21422 - DNA, 97 bp, Homo sapiens
cctcctggaggacctttctgaggctatttcacggttaaattttttttttttttttttttttttgtgagacagagtctcactctgtcacccaggctgg

SEQ ID NO: 21423 - DNA, 108 bp, Homo sapiens
ttgtatggcctgtcactttgagagatagtgagaaagggaggagagaggaactctaattttatttttcatcagttttaattttttaatatgtgtagctatttactgcaa

SEQ ID NO: 21424 - DNA, 102 bp, Homo sapiens
ggtagctgatatatattgaggacttcttacatgccagacattgtgattatatttataatcacgatcacataagaaccttactgagtatgtatgtaattttcc

SEQ ID NO: 21425 - DNA, 95 bp, Homo sapiens; identical to SEQ ID NO: 68

SEQ ID NO: 21426 - DNA, 93 bp, Homo sapiens; identical to SEQ ID NO: 69

SEQ ID NO: 21427 - DNA, 93 bp, Homo sapiens
gacaggcaagacctttctgagaaaatggcatgcgggtataacataaactttggttattttttctttttttttgagatggagtctcactctgtc

SEQ ID NO: 21428 - DNA, 106 bp, Homo sapiens
ataatctgtgtttggctgggtgcagtggctgacacctgtaatcccaatactttgggaggctgaggtaggaggatcacttgagcccaggagttccagaccagcctgt

SEQ ID NO: 21429 - DNA, 73 bp, Homo sapiens
gatagactggaaaagtaggtcataggatgggctggatgatataagttagctcaatgactcactcacagtcatc

SEQ ID NO: 21430 - DNA, 110 bp, Homo sapiens
gagtgtgctacaattttctaggccttgttgaaaagatatgagaaaagctcttatacttttttttttttttttaatgaaaaccacaaaggcagaaaataaaagcagtattc

SEQ ID NO: 21431 - DNA, 95 bp, Homo sapiens
gaatcttgtccaatatatgtgtctccctccctctgtgccttcataaatattttagagccttagacagggaaaggagacacagtgaaatcagtttc

SEQ ID NO: 21432 - DNA, 115 bp, Homo sapiens
taggattgacttggctatgcgggctcttttaaggttccatatgaaatttaaagtaattttttccaattctgtgaagaaagtcagtggtagcttgatggggatagcatcaatgcta

SEQ ID NO: 21433 - DNA, 111 bp, Homo sapiens
ctgttcaactcacctggcagccactcccagagcccctggaactctggcccaaggctctctgactgactccttcccagatcttcttggcttagcggctgaagactgacacag

SEQ ID NO: 21434 - DNA, 81 bp, Homo sapiens; identical to SEQ ID NO: 7982

SEQ ID NO: 21435 - DNA, 86 bp, Homo sapiens
gcttccagagtctagaaacaaggtagagctcccataaggtttcatgggagctcactttccctgctttgtgtctgtaactctgaggc

SEQ ID NO: 21436 - DNA, 70 bp, Homo sapiens
gatgggagctggcatcatatgcctcttataaaataccaccctccgaggctgtggagaaaagttctttatc

SEQ ID NO: 21437 - DNA, 68 bp, Homo sapiens
ggcggcttgcctggcaccctgatttccagccagagttgatgaggactgcatggcaggcaggctaatcc

SEQ ID NO: 21438 - DNA, 74 bp, Homo sapiens
aaaaaaaaaaaaaaattggagtcaagagtggctttgaagccagagagccttggttttttttttttttttttttt

SEQ ID NO: 21439 - DNA, 140 bp, Homo sapiens
gagagaaagatgaacatgagtttgattcctgacctcagtactcactgggtgtcacaggcaaatttactttttttttgtcttgctcttgcccaggctggagtacagtggcgtgatctttgcttaccgcagcctggacatgc

SEQ ID NO: 21440 - DNA, 58 bp, Homo sapiens
tgagactgagtctcgctctgtcacccaggctggagtgcagtggcgtgatcttggctta

SEQ ID NO: 21441 - DNA, 87 bp, Homo sapiens
tgattacaggcacctgccaccatgctggactaatttttctatttttagtagagatggagtttcaccatgttggcctggctggtctcg

SEQ ID NO: 21442 - DNA, 97 bp, Homo sapiens
tggtatctgatatggtagaaaaataggtacttacatacatttgtacatatatatatacatacatgtgtgtacccttctataggctctttcattacca

SEQ ID NO: 21443 - DNA, 58 bp, Homo sapiens; identical to SEQ ID NO: 2248

SEQ ID NO: 21444 - DNA, 114 bp, Homo sapiens
tgggattacaggcctgagacactgcactcacccaagaaattattaataagacattttatattcttttattggcctgaaaatgcagtgtgcattttatacttctggcacatccca

SEQ ID NO: 21445 - DNA, 105 bp, Homo sapiens
acataaatgtgcatcatatgtaatgtatattgttatacatgtaatatatgtgtatatgtatgtatatatatgtgtgtatatgtgtatatatgtatatatgtgtgt

SEQ ID NO: 21446 - DNA, 87 bp, Homo sapiens
tttgagacaaggactcagtctgtcactgaggctggagtgcagtggcatgaaaatggctcagtgcagcctctacctcctgaactcaag

SEQ ID NO: 21447 - DNA, 70 bp, Homo sapiens
ggaaggtgagccagagacaggcacatgaaaaaagctcacaatgagtctctgtctctttcttaaagcttcc

SEQ ID NO: 21448 - DNA, 122 bp, Homo sapiens
gtataatatatatgtatatctacatatacaggtatatttctatatactatataatatatgtatatttatacatgtatatgtatatttatacatgtataatatatgtatatttatacatgtat

SEQ ID NO: 21449 - DNA, 102 bp, Homo sapiens
tatattatacatgtataaatatacatatacatgtataaatatacatatattatatagtatatagaaatatacctgtatatgtagatatacatatatattata

SEQ ID NO: 21450 - DNA, 81 bp, Homo sapiens
ctgttttgtaaataaagttttattggacaatacatcatttattgatgtattgtctatggtagagttgagtatttgtaacag

SEQ ID NO: 21451 - DNA, 58 bp, Homo sapiens; identical to SEQ ID NO: 9775

SEQ ID NO: 21452 - DNA, 64 bp, Homo sapiens
atatgtgtgtgtgtatatatacacacaattttgcatatatatgtatatatatacacacatatat

SEQ ID NO: 21453 - DNA, 73 bp, Homo sapiens
gacattatatacaagtatatatccacaataatatatatgtatgtgtatgtatatgtgtatatgtatataagtc

SEQ ID NO: 21454 - DNA, 135 bp, Homo sapiens
atacgtgtgtatatatgtatatacatatatatacgtgtgtgtatatatgtatatacatatatatacgtgtgtgtatatatgtatatacatatatatacgtgtgtatatatgtatacacacacacacacatatata

SEQ ID NO: 21455 - DNA, 199 bp, Homo sapiens
atatgtgtgtgtgtgtgtatacatatatacacacgtatatatatgtatatacatatatacacacacgtatatatatgtatatacatatatacacacacgtatatatatgtatatacatatatacacacgtatatatatgtatatacatatatacacacgtatatatatgtatatacatatatacacacgtatatatatg

SEQ ID NO: 21456 - DNA, 106 bp, Homo sapiens
ggatacatatatacacacgtatatacgtgtgtatatatgtatatacatatatatacgtgtgtatatatgtatatacatatatatacgtgtgtatatatgtatatac

SEQ ID NO: 21457 - DNA, 110 bp, Homo sapiens
atacatatatacacacgtatatatatgtatatacatatatacacacgtatatatatgtatatacatatatacacacgtatatacgtgtgtatatatgtatcctggatata

SEQ ID NO: 21458 - DNA, 108 bp, Homo sapiens
catctgtgttcattgctgctagcatactgttcgagaaagtgtttttatatctattttcgttgatctaaggatatattgtcacaggctgaattaatgaaatcacatttg

SEQ ID NO: 21459 - DNA, 132 bp, Homo sapiens
attttcagtatttttatttatttttttgagatggagtctcactctgtcacacaggctggagtgcattggcgctatctttttttttattatactttaagttttagggtacatgtgcacaatgtgcaggtttgt

SEQ ID NO: 21460 - DNA, 80 bp, Homo sapiens
tccctccctggctgtatgggacagtagcatacctgaggatgggttaggattgctgagatgggctggagccggggcagggg

SEQ ID NO: 21461 - DNA, 94 bp, Homo sapiens
gtgcatgcacactcagtggtgactacatggatgtggctgtgtcctgggctgtcacactgtcttagtgtgtctgctactcccccgggcccaatcc

SEQ ID NO: 21462 - DNA, 114 bp, Homo sapiens
ctgaactcaatgaggaaagagacagtttatgagctaaagaaaatataggaattttgtttatatttctatatatttccatgcagccttcttatgcttttaactctaaattagcag

SEQ ID NO: 21463 - DNA, 101 bp, Homo sapiens
gaaagagtgaactgaaagggatattattaggacgttagcaataactcaagtttgtgagctctgtctattcttttattgtcctttttttgtttcaatttttc

SEQ ID NO: 21464 - DNA, 56 bp, Homo sapiens
tgtgtatatgcacacctatacatatatacacatatatatgtatatgtatatgcaca

SEQ ID NO: 21465 - DNA, 97 bp, Homo sapiens
gggaacaaagatgccatcaagactgtctgcctgtctctgtgcaaacgtgactgtccttacagaaagcagtagacatatggctatctggactgttttc

SEQ ID NO: 21466 - DNA, 95 bp, Homo sapiens; identical to SEQ ID NO: 68

SEQ ID NO: 21467 - DNA, 93 bp, Homo sapiens; identical to SEQ ID NO: 69

SEQ ID NO: 21468 - DNA, 89 bp, Homo sapiens
tacatgtagaaacttaaccaaagtcagtctttttctctgaaaggaaagtcagaaggaaagactgcttctcaccaattgtttccttagta

SEQ ID NO: 21469 - DNA, 115 bp, Homo sapiens
agagatatattttgcttaactttgagctcccaggatggatatgttatgtatgtaatagatagttaatgcatagataatgatgtgaattagctgagtgtaattagggcaggactct

SEQ ID NO: 21470 - DNA, 95 bp, Homo sapiens; identical to SEQ ID NO: 68

SEQ ID NO: 21471 - DNA, 93 bp, Homo sapiens; identical to SEQ ID NO: 69

SEQ ID NO: 21472 - DNA, 78 bp, Homo sapiens
gatattcgatgtgctggcagagacatgggcgtaaaaaagagacagcctgtgtctgtctgaggctgaggtgggaggatc

SEQ ID NO: 21473 - DNA, 109 bp, Homo sapiens
atatatttctttttctgtgcgtgtgtattttttttctgtgctttttttttattattatactttaagttctagggtacatgtgcacaacgtgcaggtttgttacatatat

SEQ ID NO: 21474 - DNA, 58 bp, Homo sapiens; identical to SEQ ID NO: 2595

SEQ ID NO: 21475 - DNA, 94 bp, Homo sapiens
gtgaggctgagattttataaagtgttaaaaaaaatggttcacaactgtgttgttgttgggtttttttttttttttttttgaaacagggtctcgc

SEQ ID NO: 21476 - DNA, 95 bp, Homo sapiens
agtggatattagtctgttgttttcaagagttggttgataaaacttaatagtttatttttaatatcagtttgagggtatcagaatgactagccatt

SEQ ID NO: 21477 - DNA, 96 bp, Homo sapiens
gtgcagctcccagttggatggacagaacagtgtgtggagattcacaccatgaacttttcgtccaagaagcactggaggaatgtaccaggaaaactg

SEQ ID NO: 21478 - DNA, 95 bp, Homo sapiens; identical to SEQ ID NO: 68

SEQ ID NO: 21479 - DNA, 93 bp, Homo sapiens; identical to SEQ ID NO: 69

SEQ ID NO: 21480 - DNA, 99 bp, Homo sapiens
tagcaggctttatgctaggggctggagatagatctgtgaaccagacaagcacggtgcctgacctcacagaactcacagagcagtgtggcggggctgcta

SEQ ID NO: 21481 - DNA, 100 bp, Homo sapiens
tcatgaaggataacctgggcaaggcatatagttctcaggctcactcttacagacttatgtagctcctaaaactattgcagacttaggtgttcaattttga

SEQ ID NO: 21482 - DNA, 58 bp, Homo sapiens; identical to SEQ ID NO: 2758

SEQ ID NO: 21483 - DNA, 74 bp, Homo sapiens
tgagcagacaagggtgaggttgacttttttttttttttttttttttttgggacggagtctcactctgccgctca

SEQ ID NO: 21484 - DNA, 93 bp, Homo sapiens
tggcagagctgaggcctgccaaggacatcaggactgaagctgcagttgcaggtggttttttttttttttttgagacagggtctcactctgtca

SEQ ID NO: 21485 - DNA, 96 bp, Homo sapiens
ctctctgctctctgccagtttggatgatgctgctccagtagtctgaagacagtatgcaaagaagagtcacgggcatggcacacagaagcgggaggg

SEQ ID NO: 21486 - DNA, 81 bp, Homo sapiens
catttggtagatagccgataggtatggtagcagaaactgtttgctttgcttaggccaatctgtcaatctgtctctaatatg

SEQ ID NO: 21487 - DNA, 89 bp, Homo sapiens
tgggattacaggtgcctgccaccgtgcctgtctaatttttgtatttttagtagagacagggtttcgccatgttggccaggttggtctca

SEQ ID NO: 21488 - DNA, 71 bp, Homo sapiens
ctcagaggacaatttgcagctgattttgttgtgacttcctttgcacagtttttatgtttttgtttcctgag

SEQ ID NO: 21489 - DNA, 58 bp, Homo sapiens; identical to SEQ ID NO: 2626

SEQ ID NO: 21490 - DNA, 103 bp, Homo sapiens
taggccctaggctgaccggccagaataacaggtttgttgttgttgttatttttttttaatgcacacctactcctgttatttcagtgcccctctccagttcctg

SEQ ID NO: 21491 - DNA, 109 bp, Homo sapiens
tcagcctctcgagtcgctgggattacacgtgcaccacaatgcccaactaattttatatttatagtagggacagggtttcaccatgttgatcaagctggtcttgaactga

SEQ ID NO: 21492 - DNA, 111 bp, Homo sapiens
gccctcctcccattctcttaggtgttctggctttgttcacttgaaaattatttattactgtttttaattgtgtattgcaagagagagagaccaaagagtgtgtgttcaggc

SEQ ID NO: 21493 - DNA, 95 bp, Homo sapiens; identical to SEQ ID NO: 68

SEQ ID NO: 21494 - DNA, 93 bp, Homo sapiens; identical to SEQ ID NO: 69

SEQ ID NO: 21495 - DNA, 103 bp, Homo sapiens
gcaataccatccacttagagtctgccatgctcatgtctgtgtctgtctctctcctagatcctgcccggcctgtacatcggcaacttcaaaggtgagttcttgc

SEQ ID NO: 21496 - DNA, 57 bp, Homo sapiens
tgagtggggaggagactttttttttttttttgagttggagtctcgctctgtcactca

SEQ ID NO: 21497 - DNA, 100 bp, Homo sapiens
ggaaatttaatttcttcttatgctttgctgtattttctacaataattatatattataattgaaaagacagtttgttgtttttatcaagaaagttttttcc

SEQ ID NO: 21498 - DNA, 81 bp, Homo sapiens
gtcagaaaggggagatgcaaaggagagctagagaaaaggataactccagttctctgcctgtcagtgtgtctcaaggtgggc

SEQ ID NO: 21499 - DNA, 93 bp, Homo sapiens
gggaaacttcctaagggttattgaggttttatatggagtgtggtgacttctcattctctatccccattgagccttcaatttgggaaatatcct

SEQ ID NO: 21500 - DNA, 115 bp, Homo sapiens
tctggtgcttctcttctcacacatttcctgccacttgttccgtactgattgatttactgtcagctattgactctattttcactcagctctggagcacggtggtcactgggcttgt

SEQ ID NO: 21501 - DNA, 89 bp, Homo sapiens
ctgcttttagggggaaaacagctgtcaggttttcttagatgcctttttttttttttttttgacggagtctggctctgttgcccaggcag

SEQ ID NO: 21502 - DNA, 99 bp, Homo sapiens
gtgcttcggaaacttataatctagttggagagacaagactaacataaaagagaatttagtgttgcttttttttttttttaagtgcaaattttgaggcac

SEQ ID NO: 21503 - DNA, 144 bp, Homo sapiens
gctattgtgtgtgtgtatatatatatatatagctactatatatatatacagctactatatatatgtgtatatatatatatagctactatatatatgtgtgtgtgtgtgtgtgtatatatatatatatatatatatatatatata

SEQ ID NO: 21504 - DNA, 58 bp, Homo sapiens; identical to SEQ ID NO: 1847

SEQ ID NO: 21505 - DNA, 166 bp, Homo sapiens
attatataatatataatgtaatagtatgttatataataattatatattatttgatatataatgtaattgcatgttatataataatcatgtgatatatatcataatttgtatatgcataatatatgaaaatatatcatgtacataacattatatattatatcattat

SEQ ID NO: 21506 - DNA, 84 bp, Homo sapiens
cctttgtttgagtaaatcatctggtatagttctggcttatttttatttttttgagacagagtctcactgtgtcactcaggctgg

SEQ ID NO: 21507 - DNA, 107 bp, Homo sapiens
gtgcattcaagagatgtaggctgtgtgctccatatgagaatctagttgatgctcgatgatctgaggtggaactttttcatcctgaaaccatctctcctcccccccac

SEQ ID NO: 21508 - DNA, 117 bp, Homo sapiens
tgctttgcacagtggggaatgtgaagatgatgaatggaacagtcccaacttccaaaggtttacaatctagtgactatccataaaataagctgtcatgttactttactggataaagta

SEQ ID NO: 21509 - DNA, 97 bp, Homo sapiens
tggggttcaatcttacattatggaacaaagctacatgaattggcctatctgggcattatgtactctgctctttggtctctttaagtgtcatacccta

SEQ ID NO: 21510 - DNA, 73 bp, Homo sapiens
ttctggagaaataagtatatttataacattagtgtaaagcactgactatgacatagatgtcttttctttggaa

SEQ ID NO: 21511 - DNA, 100 bp, Homo sapiens
agttatagtttcaaatatgtttatcactgtggatgacttgtggaggtccacagtgcatgtgtgtatccaaaatccagagttcgtagttagaaaatgtgct

SEQ ID NO: 21512 - DNA, 88 bp, Homo sapiens
tacatgcctttctcgattctggctgtctagtgattttgaccattctgttacttattattgcagtgtttacagctggaaaaaggtggta

SEQ ID NO: 21513 - DNA, 80 bp, Homo sapiens
gccaaatgaaagacagaagtcagagagcaactcctaaaaagtggaataaattgttcctgatggttgacaagttaaatggt

SEQ ID NO: 21514 - DNA, 56 bp, Homo sapiens; identical to SEQ ID NO: 379

SEQ ID NO: 21515 - DNA, 110 bp, Homo sapiens
ttggtgccctcagacacagcatgtttagccagctctcccggcagtagcaagcgcactgctgtctgaatctctctggaagaaatggtggagcgcttgctgtagtgagccaa

SEQ ID NO: 21516 - DNA, 112 bp, Homo sapiens
ggtttgagatataacccacatactaaaatattagtatctttatacttataaatacgagtatttataagtatgaacatatttatatctcagtgtgtccattatatctcaaacc

SEQ ID NO: 21517 - DNA, 86 bp, Homo sapiens
tgctccagaatgggttttgggttaacaatgaaatcaagattgaaataaatagtgacacaagttaccaaaacatctgggatacagca

SEQ ID NO: 21518 - DNA, 80 bp, Homo sapiens
agatgagagggagagaattgagtgagatcaaggtgtcttttcaaaccctggttagctctgtcttatgattgcctcaatct

SEQ ID NO: 21519 - DNA, 93 bp, Homo sapiens
tcatttatatgactcatacaaatgagtatatatatttctaagatttacttagagtcatttatacatttatatgtggagtactttgttcaatgg

SEQ ID NO: 21520 - DNA, 104 bp, Homo sapiens
ttggcttctgctagatttttaagggagataggtagagtcaggcggtgtttatctctgacagtctctcttttagggtgtgcagatggctgagctttctacagttc

SEQ ID NO: 21521 - DNA, 103 bp, Homo sapiens
atgtcacatataaattatatgctatacatgtatatatagttatacatacaaagtatatgtaatatattataaattatatgtagctatttaaatatgtgcacat

SEQ ID NO: 21522 - DNA, 75 bp, Homo sapiens
tacagtagttaagagcatagacacatgagctacattgtgagctggtctctctgtgcctgtgtttcttcatctgta

SEQ ID NO: 21523 - DNA, 82 bp, Homo sapiens
cctgggatctagggagtggaataagttttgggaaagtcttttttttttttttttttgactgagtcttgctctgtctcacagg

SEQ ID NO: 21524 - DNA, 105 bp, Homo sapiens
atatttatacagtatacatacatatttatacatacatacatatgcatacatatttatatttatgtatttatacataagtatttataaataaggctatataagtat

SEQ ID NO: 21525 - DNA, 84 bp, Homo sapiens
ctgtgacagcgttggcttagaagcagattttttttttttttttttttgaaatggagtttcgctcttgcccaggctggagtgcag

SEQ ID NO: 21526 - DNA, 116 bp, Homo sapiens
ttattatgtttgcttatcaaaggatttgtaattatgcttcagttgatacatagattgtttatatttttcatggttacttgaagcacttatattttcctcatacttttacaaagtaa

SEQ ID NO: 21527 - DNA, 58 bp, Homo sapiens
tgagacagagtctcacactgtcacccaggctggagtgcaatggtgtgatctcagctca

SEQ ID NO: 21528 - DNA, 69 bp, Homo sapiens
ttccctgtctctctcagacttttgcagaaaaatgagtcattcaacaaatatttgaatcgagatagggaa

SEQ ID NO: 21529 - DNA, 87 bp, Homo sapiens
gatggctcagttaatggctgcaagtatagtgtgtgtgtatatatatatatatacctagcagtatttattaaatcccagctgaggctc

SEQ ID NO: 21530 - DNA, 108 bp, Homo sapiens
tttctacaagttatgcaagggtcgcaggagtcctatgcacattttgttgtacaattacaagaggcagtgaggcatcagattcctcataccgctgctgcagaaatgctt

SEQ ID NO: 21531 - DNA, 68 bp, Homo sapiens
accttcaactgacacacacagatgcttattgtatgtttttaagcatttgtgtgtgtgtgtgtgtgtgt

SEQ ID NO: 21532 - DNA, 56 bp, Homo sapiens
cagggtcttactctgtcactctgttacccaggctggagtgcagtagtgtgattatg

SEQ ID NO: 21533 - DNA, 82 bp, Homo sapiens
tcagtaacagtgtgagtcacttttttgaatttttatctaggaggcaggagaagaattcaagtggggctggggatgtcattgg

SEQ ID NO: 21534 - DNA, 108 bp, Homo sapiens
ggtccttgaacttctgacctagagtggcttaatcctgctgccacctctctctcacactctgatgccgaatgattccaggaactgggccatgctctggtgggaatgacc

SEQ ID NO: 21535 - DNA, 91 bp, Homo sapiens
cttttgtccatcaacggcagtcaccagctgtgttcagtagcactcacgtactctctctgacatgcaggtcctggctagcaaattccagaag

SEQ ID NO: 21536 - DNA, 106 bp, Homo sapiens
tgagtggtttagcaccatcccctcagtgctatttttttgggagacagagtctctctctgtcgcctaggctggagtgaagtgagtggcatgatctcggctcactgca

SEQ ID NO: 21537 - DNA, 102 bp, Homo sapiens
gttggcaccacatatatatattttatatatatatataatatatatatgtgcacatatattatatatgtgtgtgtatatatatgtgtgtgtgtgtgtgcatac

SEQ ID NO: 21538 - DNA, 114 bp, Homo sapiens
gcctcccgaagtgctgggattacaggtgtgagccaccacgctcggccccacatttgcttatttatttattttttttagggacagagtctggctcagttgcccaggctggggtgc

SEQ ID NO: 21539 - DNA, 112 bp, Homo sapiens
gcccggcatggtggtgcacacctgtaagtcccagctacttgggaggctgaggtaggaggatcacttgagaccaggatatggaggctgcagtgagccatgatcatgccactgc

SEQ ID NO: 21540 - DNA, 58 bp, Homo sapiens
tgagacggagtctcgctctgtcgctcaggctggagtgcagtagcatgatctcggctca

SEQ ID NO: 21541 - DNA, 73 bp, Homo sapiens
gtggcccaggggttggggacccctgctttaaagaatttttttctttttttgagacagggtctcactctgtcac

SEQ ID NO: 21542 - DNA, 81 bp, Homo sapiens
agtgctgggattacagaaaagagtctggacttgggcttacctttcaagtcaactttgacttattgtcttccttcaaacact

SEQ ID NO: 21543 - DNA, 100 bp, Homo sapiens
gacaatctatccctacacctgtgtataaatgccttatttatttatttttattattatactttaagttttagggtacatgtgcacaatgtgcaggtttgtt

SEQ ID NO: 21544 - DNA, 81 bp, Homo sapiens; identical to SEQ ID NO: 21542

SEQ ID NO: 21545 - DNA, 77 bp, Homo sapiens
gctatgttcatcagggatactggcgggaagttttgtttttgactttttttttcactgtgtctctgccagattgtggt

SEQ ID NO: 21546 - DNA, 89 bp, Homo sapiens
ctattctccacagctttgctggcatctgttattattattttttttttttttactttttagtaatagccattgtgagtggcatgagatag

SEQ ID NO: 21547 - DNA, 69 bp, Homo sapiens
gggcaacagagtaagaccccaactctacaaaaaggattttttttttgagacagtctcactctgtcaccc

SEQ ID NO: 21548 - DNA, 95 bp, Homo sapiens; identical to SEQ ID NO: 68

SEQ ID NO: 21549 - DNA, 93 bp, Homo sapiens; identical to SEQ ID NO: 69

SEQ ID NO: 21550 - DNA, 184 bp, Homo sapiens
atatatatatatacacatatatatatgtatatatatatacacacacacacacacacacacacacacacatatatatgtgtatatatatgtatgtatatgtgtgtgtatatatatacacacactatatatatatgtgtgtgtgtgtatatatatatacacacacacacatatatatatacacaca

SEQ ID NO: 21551 - DNA, 112 bp, Homo sapiens
tctaaaccataactttgtagctacatgatttgggtgagatgatttttttttttttttttttttttgagaaggagtcttgctctgtcacccagactagagggcagtggtgtga

SEQ ID NO: 21552 - DNA, 75 bp, Homo sapiens
ggatgcctgtcccctcagtgctatgtttatgtcatcagtgtttgacagaagagagtgtcttgggtaagggtgtcc

SEQ ID NO: 21553 - DNA, 83 bp, Homo sapiens
gcaggaggatcactggaggccatgagttcaagaccagcctaggtaacatagcaagactccgtctctctgtggcacagttctgt

SEQ ID NO: 21554 - DNA, 102 bp, Homo sapiens
atatatatatatatatatatatatatatatatatatacacacacacacacacacacacacacacgtatatatatacatatatgtgtgtatatgtatatatat

SEQ ID NO: 21555 - DNA, 84 bp, Homo sapiens
gttgttgttgttgttttgagatgcagtctcactctgtcacccaggctggagtgtagtggtgccatctcagctcactgcaacctc

SEQ ID NO: 21556 - DNA, 77 bp, Homo sapiens
tggacctgtctcaacctcacagtctctcccagacagaagctaacctagcagagacgtcatgagagttccaaggttca

SEQ ID NO: 21557 - DNA, 119 bp, Homo sapiens
gtcttggcctgaacctggtgacctggagctggtggaaggcctggtgagagacagctcagacactggctcactctttcctggctgaagcctgactcctggtggacagaaacatcagcgac

SEQ ID NO: 21558 - DNA, 79 bp, Homo sapiens
ttttatatgcctgtgtcagcgagcacatagctgcaagtgtagcccatggccagtctgtcactgtgtccttggcagaaaa

SEQ ID NO: 21559 - DNA, 66 bp, Homo sapiens
gtgtatatatgtgtgcatgtatatatatatatatatatatatatatatacacatacacacacacac

SEQ ID NO: 21560 - DNA, 112 bp, Homo sapiens
aggtatcaaaattagtcactgcctattgtctatctgaagaaaattgttatatatactttgtacagttttccagttgtttaaggtggtagggtaagtctggtttctattactt

SEQ ID NO: 21561 - DNA, 77 bp, Homo sapiens
tttttgagacagagtgtcgctctgagtgtcactcaggctagtgtgatctcagctcactgcaacctctgcctcctgga

SEQ ID NO: 21562 - DNA, 113 bp, Homo sapiens
ggatgagtgttttttcatttagtaacattttggggttttccattttatttctgatattgattttatttttattatgctgggcccacagaatatattctgtgtcatttcaatcc

SEQ ID NO: 21563 - DNA, 70 bp, Homo sapiens
gttgttcgagacagagtctcactctgtcgcccaggctggagtgcagtggcgagatcttggctcatgcaac

SEQ ID NO: 21564 - DNA, 134 bp, Homo sapiens
atactatctatagatatgtacatatctatagatactatatatacaatatgtatatatctataggtactatatatacaatatgtatatatctatagatactatatatacaatatgtatatatctatagatactgt

SEQ ID NO: 21565 - DNA, 94 bp, Homo sapiens
ttatactatattgtatatatattgatttacagtatatagatattgatttgctttatatattgtatatatattgatatctatacagtatctatag

SEQ ID NO: 21566 - DNA, 96 bp, Homo sapiens
tgcatttgtctcaggtgagcagagggaggacagtttttttttttttttttttttttttgagacagagtctcactctgtcacccagactaaagtgca

SEQ ID NO: 21567 - DNA, 107 bp, Homo sapiens
tatatgtttactgtatatatatatgattatgtgtgtatatatttatatataaagctatatatatagttaactgtacatatataattgtgtgtgtgtatatatatgtg

SEQ ID NO: 21568 - DNA, 107 bp, Homo sapiens
ggacttagtgatgacttgtagcttcttacatgcccgactggataatttatgtatataaatctatagctttctatccaagaacagtgttagcagctgtcaataagttt

SEQ ID NO: 21569 - DNA, 79 bp, Homo sapiens
atatgtgtatatatgcacatgcacatgtgtaagtatatatgattatatgtgtatacatgcacatgtatttcctaggtgt

SEQ ID NO: 21570 - DNA, 65 bp, Homo sapiens
gcagaaaaaaaattcaccatagctcatgcttggaagtcaagtgtgagaactgacggtggagatgc

SEQ ID NO: 21571 - DNA, 84 bp, Homo sapiens
cggtgctgactctctgtatgacacatgttcacacaatgcggtgctgaccttctgtatgaagcgtgttcacacagtgcagtgctg

SEQ ID NO: 21572 - DNA, 95 bp, Homo sapiens
ggtatataaataaaaatgtatgtgtatgtatatgtcagtatatatatatatatatatatatatatatacacacacacacactctatttgtaagct

SEQ ID NO: 21573 - DNA, 95 bp, Homo sapiens; identical to SEQ ID NO: 68

SEQ ID NO: 21574 - DNA, 93 bp, Homo sapiens; identical to SEQ ID NO: 69

SEQ ID NO: 21575 - DNA, 109 bp, Homo sapiens
ttccaggagaaaagcatagctgtggttttgtttagaaattttttttccaggttgaggaagtacatttttattcataatttgatcgtagatggatgttgaattttgtgaa

SEQ ID NO: 21576 - DNA, 95 bp, Homo sapiens; identical to SEQ ID NO: 68

SEQ ID NO: 21577 - DNA, 93 bp, Homo sapiens; identical to SEQ ID NO: 69

SEQ ID NO: 21578 - DNA, 72 bp, Homo sapiens
agatatatatatgtgtgtctgtgtgtgtgtatatatatatatatacacacacagacacacatatgtttgttt

SEQ ID NO: 21579 - DNA, 107 bp, Homo sapiens
tcatatctgttagaatagcatatatataatatatatgaaagtaacaagtgtgtgtacaattctctctctctctcatatatacatatatgctattctaacagatgtga

SEQ ID NO: 21580 - DNA, 58 bp, Homo sapiens; identical to SEQ ID NO: 6359

SEQ ID NO: 21581 - DNA, 119 bp, Homo sapiens
acttagccacagaggttttttgttgttgttgtttgagatagggtctcactctttcactctggctggagtgcagtggtatcatctcagctcactgcaacctctgcctcccgagttcaagt

SEQ ID NO: 21582 - DNA, 117 bp, Homo sapiens
gctggcctcctagaatgaatttggaagtagtccctcctcttcaatttttttttttttttttgaagaatttgaataggattggtattagttctttttaaatgtttggtagaattcagc

SEQ ID NO: 21583 - DNA, 74 bp, Homo sapiens
cctcacagttggatggctgccaggttaattaactctggcctttcttggcttagtctctctctctgtgctacagg

SEQ ID NO: 21584 - DNA, 74 bp, Homo sapiens
cagggtctcagtctgtcactcaagctagagtgcagtggcacgatcatggctactgcagctggtgattatccctg

SEQ ID NO: 21585 - DNA, 91 bp, Homo sapiens
aaatatgtatgtatatgtctgtatgtgtatacatatatatttgtatttataatactggtttatgtatattatacataatatatatgtgttt

SEQ ID NO: 21586 - DNA, 98 bp, Homo sapiens
gtattttcagtgctgtgttgaataagagtggtgagagtggacattcttgtcttcatcccaatgttatggttaaagcatagtcttttgctgttaagtat

SEQ ID NO: 21587 - DNA, 76 bp, Homo sapiens
tgacttctgctaattcattgtagaggggtatgtagtcagggatctataagccccaaacttgctagtggttaagtta

SEQ ID NO: 21588 - DNA, 60 bp, Homo sapiens
attctttcaatgtgtgtatgtgtgtgtatatatatatatatgcataatcattgaaaggat

SEQ ID NO: 21589 - DNA, 116 bp, Homo sapiens
tacagagggatatgcatacagggatgggaggaacttgcagctgttaatcaattgttaatttattatcaaacaacacggtgaatagccctcctattgatatgttcattgtacatctt

SEQ ID NO: 21590 - DNA, 89 bp, Homo sapiens
gctgtgcccacgctggtctgttctgtgtgggtctctttctggtcagaaagagccgtgtctgtacgcagagcagccaaaaaagcaaaagc

SEQ ID NO: 21591 - DNA, 80 bp, Homo sapiens
tctaggtggtcgactggggatttctttttattttattttatttttttgaaagggagtctcgctctgtctcccaggctgga

SEQ ID NO: 21592 - DNA, 114 bp, Homo sapiens
tgctaccctgtcctgcccggtttgaatcctgaagtgaaagaagtgagagtgcagaaaaactcctttgtcttctaccagtgctgagctcagactctgggtattgttgagagagca

SEQ ID NO: 21593 - DNA, 77 bp, Homo sapiens
gccaaaaggagagaaaaggaaaagtctagataatttcattttagttttagatagtttcctttagttttctgagcggt

SEQ ID NO: 21594 - DNA, 99 bp, Homo sapiens
caatcagcaacagtggaatatatatgtgtgtgtgtgtatgtgtgtgtgtatatatatgtatatgtacatatgacaaaaattatttctctaaactatttg

SEQ ID NO: 21595 - DNA, 82 bp, Homo sapiens
gagatgcagtctcactctgtccctcaggctggagtgcagtggcacaatctcggctcccaggttcaagtgattcttctgcctc

SEQ ID NO: 21596 - DNA, 92 bp, Homo sapiens
gcatttatcatttattcagcagagattgactgagtgcctttttttttttttttttgagatggagtctcggtctgtctcccaggctggagtgc

SEQ ID NO: 21597 - DNA, 85 bp, Homo sapiens
gggccagtctcactcccactgtgcctcccctaacagcaccaaatctgtttccaggcagtgggcaagaagagttgagaatttgccc

SEQ ID NO: 21598 - DNA, 118 bp, Homo sapiens
ctctgcgtagatacccagtagtgggattgctggatcaaatggtagttctatttttagttatttaaggaatcgccatactattttccacagtggttgtactatccatcagcagtgtaga

SEQ ID NO: 21599 - DNA, 98 bp, Homo sapiens
tttgataaaatgtttttagtgtccttttgtttcattatgtatggttttaaattttcatttttataataagagaaaaggccattttgacatatgttgaa

SEQ ID NO: 21600 - DNA, 106 bp, Homo sapiens
cagcttgcccaaaagccactcccagagcccctggaactctgccccaaggctctctgactgactccttcccagatcttcttggcttagtggctgaagactgatgctg

SEQ ID NO: 21601 - DNA, 97 bp, Homo sapiens
gatttgttaatatttagggatgtttgcaactgtgtttatgaaagatactgataaacattttttatttttttgtaaatccttgtaatgtttttaagtc

SEQ ID NO: 21602 - DNA, 78 bp, Homo sapiens
tgagacgagtctcgctctgtcacccaggctggagtgcagtggcgcgaccttggctcactgtaacctccgcctcctggg

SEQ ID NO: 21603 - DNA, 112 bp, Homo sapiens
ggattatcttggctatgtgggctcttgtttggttccatatgaaatttaaagtagttttttcctattctgtgaagaaagtcaatggtaacttgatggggatagcattgaatct

SEQ ID NO: 21604 - DNA, 58 bp, Homo sapiens; identical to SEQ ID NO: 7309

SEQ ID NO: 21605 - DNA, 99 bp, Homo sapiens
tattgactctggatgacataatattattgtatgaatggtatttttttattattggtcattttactagttatgcaagagaatgtctgttcttaggaaata

SEQ ID NO: 21606 - DNA, 102 bp, Homo sapiens
gccccattgtgtgccagccaccgcacatagcaactgtctctctctcactcttctgggccatgctgtgactttgttgatgaggaggttgaggcacagaggggt

SEQ ID NO: 21607 - DNA, 112 bp, Homo sapiens
tccttattatgcaatatgtctctaccacttcagcgggttttcagatttttctttttaaatctttgtttttctcagtttatgatgtatgtagatgtggtattgataatgtgga

SEQ ID NO: 21608 - DNA, 82 bp, Homo sapiens
gtgagtctgtgtttctcacactcatgcactcctgagtgaaagtggagttttccagagactgtatgaggtgagatgaagccgc

SEQ ID NO: 21609 - DNA, 58 bp, Homo sapiens
tgagttggagtctcactctgtcacccaggctggagtgcagtggcgcgatctcagctca

SEQ ID NO: 21610 - DNA, 134 bp, Homo sapiens
tctcatgggttcttggcattgcacaacacctgttgacagcacagcctgccctgaggagggtcacagcagagagagcagaccagcctgcctgcaggtgcccagcttcaccttcatactggtcatgaatttcctgc

SEQ ID NO: 21611 - DNA, 73 bp, Homo sapiens
atgtttctgagggcagaaatgttggcccataattacagttgtctggttatgtctctgtctccctcactaacat

SEQ ID NO: 21612 - DNA, 88 bp, Homo sapiens
ggtggcctcaatcagccatttcccttgaattgtgatattgttcttgattcactgtctttgcggtaagaggtgtagattcagggcttcc

SEQ ID NO: 21613 - DNA, 105 bp, Homo sapiens
tctctgtaggctcaattattgctctattggttgaatgaattttatagaactctgtacattccatttattttgtattttttcatttgcaagtaagcttatcagaga

SEQ ID NO: 21614 - DNA, 61 bp, Homo sapiens
tcctgatgaactgcatgtgcatgtgcatggaaatgccatgtgcacagatgtatgatcagga

SEQ ID NO: 21615 - DNA, 82 bp, Homo sapiens
ctcactccctggggtggttacagctaggccacggaacactgtgatcagtcagggctgtgaactgccactcctggggtcggag

SEQ ID NO: 21616 - DNA, 93 bp, Homo sapiens
tcagattctgagctactaagaaataaggctgctttctcccctagacctggagagtggatgcactgtgcctctgtcagtcaggtggctccctga

SEQ ID NO: 21617 - DNA, 85 bp, Homo sapiens
ttgacacagagtctcgctctgtcacccaggctggagtgcaatggcgccctccgcctcctgggttcaagtgattctcctgcctcag

SEQ ID NO: 21618 - DNA, 110 bp, Homo sapiens
gctggtgtggtggctcatgcctgtaatcccagctactcgggaggctgaggtagaagaatcacttgaacctgggaggcagaggttgcagtgagcagagatcacgccattgc

SEQ ID NO: 21619 - DNA, 82 bp, Homo sapiens
cttgaagaacatgggtgtgggtgaactgagcaggcagggctgcacagtcactgtgtctgatttacatgccatggactttgag

SEQ ID NO: 21620 - DNA, 58 bp, Homo sapiens
aggtgagttctgtctgagttagcagtgtccctcctcacctttcagagtgatctcacct

SEQ ID NO: 21621 - DNA, 72 bp, Homo sapiens
ccacttgcactgtttagggtggctgggtctgtctgtcagcagcagagccacccaggatctctaggaaggtgg

SEQ ID NO: 21622 - DNA, 58 bp, Homo sapiens; identical to SEQ ID NO: 2442

SEQ ID NO: 21623 - DNA, 102 bp, Homo sapiens
ttatggcactgtggtccaagagtgtggttggtatttcagggtttttttgtttttttgagatgagtctcactctgtcaaccagactggagtgcaatggcgtga

SEQ ID NO: 21624 - DNA, 62 bp, Homo sapiens
caggctgaggttgtaggttgagactgcagtaagttgtagtcatgccactgcactccagcctg

SEQ ID NO: 21625 - DNA, 151 bp, Homo sapiens
gctccagtgcctggagaactgcacgtcacaaagtgggaagagttttggaatttttttttttttttttttttttttgcgacagtctcgctctgtcacccaggctggagtgcagtggtgcaatctcggcttactgcaacctctgcctcccggg

SEQ ID NO: 21626 - DNA, 102 bp, Homo sapiens
tgaggcaggagaatcacttgaacccaggaagtggaggttgcagtgagcagagaccgtgctattgcactccagcctgggcgacaagagtgaaactccacctca

SEQ ID NO: 21627 - DNA, 104 bp, Homo sapiens
ttgctgtgcagaggcttttagtctaattaaatcccatctatttatctttgtttttgttgcatttgcttttgggttcctggtcatgaagtctttgcctaaggcaa

SEQ ID NO: 21628 - DNA, 120 bp, Homo sapiens
ggccaaggctgacctgacatttatttttatatagctcctgaactttataaaaataatttttgtattttcaaagagttgttaaaaaaaaaaaagaatatgtgatagagattgtatgtggcc

SEQ ID NO: 21629 - DNA, 76 bp, Homo sapiens
acagagcaagactgtctcaaaaaaaaaatccttccactttttcttttttctttttttagatggagtctcgctctgt

SEQ ID NO: 21630 - DNA, 63 bp, Homo sapiens
ttgagacagggtctctcactctgttgtccaggctggagtgcaggtgcagtggcgcagtctcgg

SEQ ID NO: 21631 - DNA, 57 bp, Homo sapiens
gagactaggtgacttaaatgacaaatatgtttttgtttgtttttgagacagggtctc

SEQ ID NO: 21632 - DNA, 99 bp, Homo sapiens
ctgggatggagaaacctggaggtaggtggaggcccaaaacagtctcttacagtcagtctatgttgcttcatctgagctggaggctgagaggccagtcac

SEQ ID NO: 21633 - DNA, 89 bp, Homo sapiens
gagaccgtggtgaaggccagggtggactcaagggccaggatagaggctgtcactggctcagacactgcagtggagaacctgatggtctc

SEQ ID NO: 21634 - DNA, 105 bp, Homo sapiens
atttagacaattgtattgctgggatggtccttgggttttcatcattctgcagaggaaactagtgtttttgaagttccaggactctcttacttggaccaactaaat

SEQ ID NO: 21635 - DNA, 105 bp, Homo sapiens
actttctaagtgtttctaattttataatcaggaaatatgtatataagatatatgtatatataattgctgtgtacattgtatgtatttaaaaaaaacttggggggt

SEQ ID NO: 21636 - DNA, 73 bp, Homo sapiens
gtttgtttgagactgagtctcgctctgtcacccaggctggagtgcagtggcgcgatctcggctcactacaagc

SEQ ID NO: 21637 - DNA, 58 bp, Homo sapiens; identical to SEQ ID NO: 3270

SEQ ID NO: 21638 - DNA, 79 bp, Homo sapiens
cactcgcgtccgtgtgaagagaccaccaaacaggctttgtgtgagcaacaaggttgtttatttcatctgggtgcaggcg

SEQ ID NO: 21639 - DNA, 56 bp, Homo sapiens
ccatgttgctcacactctcactctggaccccagcagagcagggagtgtgaagatgg

SEQ ID NO: 21640 - DNA, 58 bp, Homo sapiens
tcacagcctctgtgtgcctccctcctcgcaagataagaggggtggcctcagggtgtga

SEQ ID NO: 21641 - DNA, 58 bp, Homo sapiens; identical to SEQ ID NO: 2441

SEQ ID NO: 21642 - DNA, 112 bp, Homo sapiens
gcctttgcattcagctctgagtccagtgcctctctagattacaaagtatttaaaatcctgcttcatggtgggtccagagagggactagaaatgcttagctagtgaggagagc

SEQ ID NO: 21643 - DNA, 80 bp, Homo sapiens
ggagtctcactctgtcacccaggctggagtgagatctcagctcactgcaacctccacctcccgggttcaagtgattctcc

SEQ ID NO: 21644 - DNA, 93 bp, Homo sapiens
ctgcagccctagtggctcaatatgggcagtttatagagttcagagcccaaatcagctagaaatgtaaatgagaatgttgaaagagagctgcag

SEQ ID NO: 21645 - DNA, 78 bp, Homo sapiens
cagcctggcgacagagcgagactctgtctcaaaaaaaaaaaaaaaaaaagacagagtctcactctgtcacccaggctg

SEQ ID NO: 21646 - DNA, 65 bp, Homo sapiens
gcaggtgagtgcattattctctgcttcccctccacagagctgtggttcactctcctccatcctgc

SEQ ID NO: 21647 - DNA, 81 bp, Homo sapiens
ttctgactgggtgcgaatggtaactagaccaggcagtgccctccttgtcagtctgcctgtctgcctggttccctctcagag

SEQ ID NO: 21648 - DNA, 58 bp, Homo sapiens
tcccagcctctctgtctctcgggctcactagggtgcgtccaggtggggtgagttggga

SEQ ID NO: 21649 - DNA, 58 bp, Homo sapiens
tgagactgagtctcgctctgtcacccaggctggagtgcagtggtgtgatctcggctca

SEQ ID NO: 21650 - DNA, 72 bp, Homo sapiens
tctgaaaaagtgatatttgagcaaagatttcttttcttttttttgagatggagtctcactctgtcactcagg

SEQ ID NO: 21651 - DNA, 72 bp, Homo sapiens
tgaggcttggggcgggggcccagcaaggtcaggttgctgactggctgtcatctctctccctgaccagcctca

SEQ ID NO: 21652 - DNA, 76 bp, Homo sapiens
ccttacttctggggaactttcttgtctggtacctggaggtttcgggggatgagttccaaagtagccagaggtgagg

SEQ ID NO: 21653 - DNA, 64 bp, Homo sapiens
tttcagatactgggtgtttgtttttgtttttgttattaggcagagactcaccctctgtctcaaa

SEQ ID NO: 21654 - DNA, 57 bp, Homo sapiens
tgagacagaatctcactctgtcacccagctggagtgcagcagtgtgatctcagctca

SEQ ID NO: 21655 - DNA, 70 bp, Homo sapiens
ttgttttgagactgagtctcactctgtcgcccaggctggagtgcagtggtgagatctctgctcattgcaa

SEQ ID NO: 21656 - DNA, 62 bp, Homo sapiens
ttgagacggagtctcactctcactcttgtcgcccaggctggagtgcagtggcgcaatctcag

SEQ ID NO: 21657 - DNA, 88 bp, Homo sapiens
gggacaggctgagccccatggtggtggtgaggggacctgcttcttcatcctgctctgtgtctgtgtgtctgtcctttcactcctgcca

SEQ ID NO: 21658 - DNA, 58 bp, Homo sapiens
tgagatggagtctcacactgtcacccaggctggagtgcagtggcgtgatcttggctca

SEQ ID NO: 21659 - DNA, 63 bp, Homo sapiens
ctgctcccccagattctcctgccagcaaagggtgacaggagacagtgtcatctagggcagtgg

SEQ ID NO: 21660 - DNA, 71 bp, Homo sapiens
cccacaagacagtgagctcccagggcacaggctgccgtattcctgtctgtgttgggaaaaggacttgtggg

SEQ ID NO: 21661 - DNA, 71 bp, Homo sapiens; identical to SEQ ID NO: 21660

SEQ ID NO: 21662 - DNA, 104 bp, Homo sapiens
gggggtaagctgtcctggtccacgttcagttttgtgttcctgtctccactgtggggaaccacagaactgacagaggacaggctgagggacccacccctgcccct

SEQ ID NO: 21663 - DNA, 103 bp, Homo sapiens
gagagtctgggtgcagcgacacaccagccatctgtctctacctgtctctgtgaaccagccggcagggaagaaacggaaactgagaccacggccccgacccctc

SEQ ID NO: 21664 - DNA, 89 bp, Homo sapiens
ggactcgggtctgggacgtgcacagagcctgcagagaggatcctaaaacttgttcttggccagagctctgcactcatgactcacggttc

SEQ ID NO: 21665 - DNA, 62 bp, Homo sapiens
gctcgtgggtctctgtgtgtgtctgagcagctgctctgccaagactccacacagctgtgtgt

SEQ ID NO: 21666 - DNA, 87 bp, Homo sapiens
ttcaactttattttagattcagcaagtacatgtggaggtttgttacctgtgagtattgtataatgctgaggtttggaatatgaatga

SEQ ID NO: 21667 - DNA, 97 bp, Homo sapiens
gtctagatacaacacttttgttaggtctcttcctttatgtaggtatttttaaatttttatctgaagggttttgcagttttcagtgtaggtatcttgc

SEQ ID NO: 21668 - DNA, 106 bp, Homo sapiens
ctggacatggtggctcctgcctgtagtctcagctacttgggaggctgaggtaggaggatcacttgagcccaggaggtcgaggctgcagtgagccatgatcgtgcca

SEQ ID NO: 21669 - DNA, 82 bp, Homo sapiens
tgagcctcacatcttttgtctgtaacatagagggaaacaatctgtcccttgtgtggttattgtgagaagagaatgagctaca

SEQ ID NO: 21670 - DNA, 72 bp, Homo sapiens
ttcccctctctctctctggcacaatgtctgggacacctggcataatgtcaagtgagcttcagattttgggaa

SEQ ID NO: 21671 - DNA, 184 bp, Homo sapiens; identical to SEQ ID NO: 3161

SEQ ID NO: 21672 - DNA, 136 bp, Homo sapiens; identical to SEQ ID NO: 3160

SEQ ID NO: 21673 - DNA, 111 bp, Homo sapiens
gtgtcaggagatgaggaatgtccctggagtcacagaaagaaggtatcagatgtgtctcactctgacatatgcaggtgtttatgaaactctgggatttctaaggaaggatgc

SEQ ID NO: 21674 - DNA, 104 bp, Homo sapiens
ctgccttccatgagcaacacagcaaacataagctctgcagatgtgctcagacttgagcctgactcactgaagagagtgtggtgctgccaggcctcagacaccag

SEQ ID NO: 21675 - DNA, 106 bp, Homo sapiens
agagcttctaatgacccccagaagtgctgagtgacctagcgaggtaccctccaggcccattgtgtctctttctctctcggagcagctggggatcgtggtaagttct

SEQ ID NO: 21676 - DNA, 116 bp, Homo sapiens
tgtgcgctggcatggtggcgaaggagaggagggtttgggatggggcgcacagggagatcatgtttttttttgttttttgagacagagtctcgctctgtcgcccaggctggagtaca

SEQ ID NO: 21677 - DNA, 134 bp, Homo sapiens
gggtcccacaggtttcaggggcgagggtgatgggagagacacctggccacgtgtctgtctgtcactcaccttctctcccttggctccagcatcgccccggagaccaggcagccctgggggtccctgtggagaga

SEQ ID NO: 21678 - DNA, 83 bp, Homo sapiens
ggggcctaggatcagacaccaggaggaaaggggttgtggcggctccctttgcctctcactctgtgtgtatctctctcggttac

SEQ ID NO: 21679 - DNA, 119 bp, Homo sapiens
cttccccgccccgggccgcggctcctgattgtccaaacgcaattctcgagtctatggctccggccgagagttgagtctggacgtcccgagccgccgcccccaaacctcgagcgggagag

SEQ ID NO: 21680 - DNA, 109 bp, Homo sapiens
ctcctccgtgtgcctgtagcactctccactgtcctagtcacagaatcatagcgctcgtcacactgactctgtgttcaacatggtttggttttatttaaccacggagtag

SEQ ID NO: 21681 - DNA, 71 bp, Homo sapiens
catatatatatgtgtgtgtatatatatatgtttgtatatatataatatataaatatttgtatatatgtata

SEQ ID NO: 21682 - DNA, 141 bp, Homo sapiens
ttgaggggatctgcctgggcaacatagtgagactccatttcttttttttttttttttttttagacagagtctccctctgtctcccaggctggagtggtgcagtggtgcaatctcagctcactgcaagctccgcctcccggg

SEQ ID NO: 21683 - DNA, 91 bp, Homo sapiens
cacctggctgtattttccatcctttacatccttctgtctgttcaagaaccagtctgggatcttgtactggcgtggattctgcataatggtg

SEQ ID NO: 21684 - DNA, 66 bp, Homo sapiens
gcatcccagccccctgatccagccagctgtctgactgtgagtcaggatggcagaggaaggtgatgt

SEQ ID NO: 21685 - DNA, 95 bp, Homo sapiens; identical to SEQ ID NO: 68

SEQ ID NO: 21686 - DNA, 93 bp, Homo sapiens; identical to SEQ ID NO: 69

SEQ ID NO: 21687 - DNA, 82 bp, Homo sapiens
gctgtagatcctcaggggagaagagagtgaggtcaggcacttgtatgcccagcttgctctctgccaggttggaggggccagc

SEQ ID NO: 21688 - DNA, 139 bp, Homo sapiens
atccgggaggcagagatggcagtgagccaaaattgcagcattgcactccagcctgggtgacacagccagactctgtctcaaaaaaaaaaaaaaaaagagagacagtgtcttactctgtcacccaggctggagtacagtg

SEQ ID NO: 21689 - DNA, 69 bp, Homo sapiens
gggtgacagagtaagacactgtctctctttttttttttttttttgagacagagtctggctgtgtcaccc

SEQ ID NO: 21690 - DNA, 58 bp, Homo sapiens
tgagacggactctcgctctgtcacccaggctggagtgcagtggcatggtctcggatca

SEQ ID NO: 21691 - DNA, 77 bp, Homo sapiens
ctggccaagagtgcagactctggctccctttttttttttttttttttttttagacggagtctcactctgtcgcccag

SEQ ID NO: 21692 - DNA, 83 bp, Homo sapiens
ggggtttgggggcagcgttccagagcagagctgggcccttggcccacctgtgactctctgtgacccccagcctgtctgccccc

SEQ ID NO: 21693 - DNA, 97 bp, Homo sapiens
gcggggaggtagggctacgagtctcggtgtgtctctgcccctaacattgatgagggaaagaggcagctctgaacacctctgcccaccctcaggacgc

SEQ ID NO: 21694 - DNA, 109 bp, Homo sapiens
ggttacagctgagtccaggaattctgggaactctctaggagactgtctctttcacacaggaagtttcagaagtgagagtggtcgggtgcggtggctcaagcctgtaatc

SEQ ID NO: 21695 - DNA, 69 bp, Homo sapiens
gagatggagtcttgctctgtggctctgtcgcccaggctggtgttcagtgaatggcgcaacctccgcctc

SEQ ID NO: 21696 - DNA, 98 bp, Homo sapiens
ctgagccatattccactgcatgggtagacaacactgtgtttctctctccattggtgatggacgcagggttgtttccagcctgtggtgattatgcttag

SEQ ID NO: 21697 - DNA, 103 bp, Homo sapiens
gtgtttgtgtgtgtttcctctacccacctctgcccctctgtgtctctctgtcgccccgcccttgggaccacatgtgagggggatggcaaggatacgatgccgc

SEQ ID NO: 21698 - DNA, 71 bp, Homo sapiens
ggtcctccctctgtgtgtgtctgtgtcctcatctctccttgtaaggacaccagtcaccttggattagggcc

SEQ ID NO: 21699 - DNA, 58 bp, Homo sapiens; identical to SEQ ID NO: 1725

SEQ ID NO: 21700 - DNA, 112 bp, Homo sapiens
ggcatgctagtgacatgtgcactttgctaagagacctgccaagctgtgtcacgcagcctgtcagcctctcaaagccactcttggggtgtggggggggaggtgaccctgggct

SEQ ID NO: 21701 - DNA, 109 bp, Homo sapiens
ggaaggtgaaggaagcaggagggactcagcacagaacagactcagctcatcagtgagggcagagcctgtgtccatctgccctgagtttgaacctggctccatcacatct

SEQ ID NO: 21702 - DNA, 69 bp, Homo sapiens
ctgtctgtctgtctgtctgtctctgggccaggcactggaagtagggggggaagaccaagagcggttcag

SEQ ID NO: 21703 - DNA, 58 bp, Homo sapiens; identical to SEQ ID NO: 1265

SEQ ID NO: 21704 - DNA, 111 bp, Homo sapiens
tagctgggcatgggcacatgcctgtagtcccagctatttgggaggctgaggtagaaggatcacctgagcccaggaagttgaggctgcagtgagccgtgatcgtgccgctgc

SEQ ID NO: 21705 - DNA, 89 bp, Homo sapiens
tatgtgtatatgtgtgtggaatatatgtgcatatatgtttgtacatatatacatactgacacatatatatatatttacatatatacata

SEQ ID NO: 21706 - DNA, 86 bp, Homo sapiens
gtgtgctagagcttgaaaaggagactgcggtggatgtgtggtgtggccctatcctcagagcactctctgtcaggcaggagtcatac

SEQ ID NO: 21707 - DNA, 104 bp, Homo sapiens
tcagcttgtttgccttgctggggtcactgaagtttgagacctctgtggtagcccacccatccacagtcctctccctggtggtctagctagttaaatttacatga

SEQ ID NO: 21708 - DNA, 56 bp, Homo sapiens
gagatagagtctcgctctgtcgctcaggctggagtgcagtggtgtgatcttggctc

SEQ ID NO: 21709 - DNA, 112 bp, Homo sapiens
caggtggtgaatgtttgcttctattcctagcttgctgagagtattgactgtgaaataataattttatttaaaagtcaagtgcttttctaggatcaagacaatcatatagttg

SEQ ID NO: 21710 - DNA, 96 bp, Homo sapiens
gtggtggtgtgcgcctgtggtctcagctacttgagaggctgaggtaggaggatcacttgagcccaggaggttgacgctacagtgagccatgatcat

SEQ ID NO: 21711 - DNA, 61 bp, Homo sapiens
ccagagtctctgcctctgtcccagcccttgggaaaatccaggtcaacatcagggaagctgg

SEQ ID NO: 21712 - DNA, 80 bp, Homo sapiens
atggcagacacccagtaaaactggctgcctggacctgctgcaggatgaagggaacttgtgactgtgactgtgtgtgtcat

SEQ ID NO: 21713 - DNA, 101 bp, Homo sapiens
ggtttgcctgttatggaacttcacagacatggaatcacgtggaatgtgctgtttggtgctcagtgctctgtctgtgagagtcccccgtgctccggtgggct

SEQ ID NO: 21714 - DNA, 137 bp, Homo sapiens
cccaggccctgtggggcagctttagttgtatcggcttaggatggtgcctgggaactctggctgtctctctgtctgggaagtcgccgtgggggaagggcaggtctcaggccagggacagggcaagggcagtaggatca

SEQ ID NO: 21715 - DNA, 110 bp, Homo sapiens
gagtctataagtcaagccctgaccctgctgtgtgacttcaggcagaccccttactctctctgagtctgtcttggggtccgagcacagggcaggccgtgtctcagcccctc

SEQ ID NO: 21716 - DNA, 102 bp, Homo sapiens
ggggatatgaggcctaactagtgggttaagcagatgtgtaacctctcctgtttttgtacatgtgtttattcctgaactgttttgggctactcattgttaacc

SEQ ID NO: 21717 - DNA, 124 bp, Homo sapiens
ctgggcttggtggtgctcacctgtagtcccagctaagtgggaggctgaggtggaaggatcaattgagcctgggaggtgaagggtgcagtgagctgtgattgtgctgctgcactcctgcccaggt

SEQ ID NO: 21718 - DNA, 111 bp, Homo sapiens
tgctctctagcctgggcaatggagcgagactgtctcaaaataaataaataaaaataatatttattattattttttgagacagtctcgctctgttgctcaggctgaagtgca

SEQ ID NO: 21719 - DNA, 81 bp, Homo sapiens
gggctgagggacaggaggcagagcagtggaaggtcagacaccacagcacacctgggctttctctgtctctccctgagaacc

SEQ ID NO: 21720 - DNA, 121 bp, Homo sapiens
ccaggagtttgagaccagcttgggcaacatagggagaccttcatctctacaaaaaagttttgggttttttttttttttttgagacagtctcactctgttgcccaggctagagttcagtggc

SEQ ID NO: 21721 - DNA, 56 bp, Homo sapiens
gacagagtctcactctgtcccacccaggctggtttgcgacagagtctcactctgtc

SEQ ID NO: 21722 - DNA, 58 bp, Homo sapiens
tgagacggagtctcgctctgtctcccaggctggagtgcagtggcgccatctccgctca

SEQ ID NO: 21723 - DNA, 104 bp, Homo sapiens
ttcttctggacagtgataggctggttccctcttgttttttaaagacagtttcttgatgtgtcgcttaggctggagtgcagtggtgtgatcatagttcactggaa

SEQ ID NO: 21724 - DNA, 102 bp, Homo sapiens
gccaggagaaatccatcacgttcttagagacagcgtcagtgtcacagtgtcacggtgaaccagcctgtgcctggggaagctctggggtggggaggagcaggc

SEQ ID NO: 21725 - DNA, 76 bp, Homo sapiens
tcaactggttttccagctagtaagcacctgcatcctgagagaacaggctaagatgagactgtgctgtgagcgttga

SEQ ID NO: 21726 - DNA, 66 bp, Homo sapiens
gacagagacatgcaaaaatcaaggagtcctgggcctgcctcttcttgatctctctctgtctctttc

SEQ ID NO: 21727 - DNA, 139 bp, Homo sapiens
gaggcgcaggttgtgagggacgcaggccctggggcttcggtctctgtcctccgagctcagagcctccaggcttcttcccggccgcgcgctcagcactcactgtcttacggtcccgaagcgctttaaggtgcgcagtccg

SEQ ID NO: 21728 - DNA, 58 bp, Homo sapiens; identical to SEQ ID NO: 2758

SEQ ID NO: 21729 - DNA, 85 bp, Homo sapiens
gtggggaaaagattgagaaatcggatggttgccgtgtctgtgtagaaagaagtagacatgggagacttctcattttgttctgcac

SEQ ID NO: 21730 - DNA, 65 bp, Homo sapiens
gggctctggtctgtcccccactgggttgggctttctgtctgtcactcactgggactctcctgtct

SEQ ID NO: 21731 - DNA, 59 bp, Homo sapiens
gttttgagtcagtgtctcgctctgtcacccaggctggagtgaaggcatgtgatcatagc

SEQ ID NO: 21732 - DNA, 80 bp, Homo sapiens
tgagacttacagaaaataagtatcttatcccataccacaaagtggtagtgataagattcactgaagtcttacacgagtct

SEQ ID NO: 21733 - DNA, 70 bp, Homo sapiens
gagtctcgctctgtggctgtgagtgcagtggcatgatcccagctcactgcaacctccacctctcgagttc

SEQ ID NO: 21734 - DNA, 125 bp, Homo sapiens
tagccaggcatgatggcacacgcctgtaatcccagctactagggaggctgaggtaggaggatgggttgagccaggaggtcgaggctgcggtaagccatgattgtgccactgcactctagctgggg

SEQ ID NO: 21735 - DNA, 85 bp, Homo sapiens
cagatgggacatgttgcacaggctggtcttaaacttttatttttatttttatttgagacagagtctggctctgttgaccaggctg

SEQ ID NO: 21736 - DNA, 96 bp, Homo sapiens
ttccagctatgtgacctcaggcaggttgctcaccctctctctgtctgaagacagggctgactctgaaaacacctccctcagtggttattatgagaa

SEQ ID NO: 21737 - DNA, 95 bp, Homo sapiens; identical to SEQ ID NO: 68

SEQ ID NO: 21738 - DNA, 93 bp, Homo sapiens; identical to SEQ ID NO: 69

SEQ ID NO: 21739 - DNA, 58 bp, Homo sapiens; identical to SEQ ID NO: 9124

SEQ ID NO: 21740 - DNA, 58 bp, Homo sapiens
tgagatggagtctcactctgtcacccaggctggagtgcagtggtgcaatctccgctca

SEQ ID NO: 21741 - DNA, 85 bp, Homo sapiens
agcctggcaacacagtgacaccctgtctctatgaaaactacaaaaaatctagatgggcatggtggtgcatacctgtagtccagct

SEQ ID NO: 21742 - DNA, 60 bp, Homo sapiens
tgagacggagtctctcgctctgtcgcccaggctggggtgcagtggcgcgatctcggctca

SEQ ID NO: 21743 - DNA, 113 bp, Homo sapiens
tgtgacactgaaaaacattctactttgtgcacttaagacctttttttttttttttttttttttttatgagacagggtctcactatgtcacccaggctggaatgcagtggcaca

SEQ ID NO: 21744 - DNA, 85 bp, Homo sapiens
ccatgaagacacatctgccagtcctcacagggttagcaccaactcacctttcctggggacacagatgtgagtctggaccttggag

SEQ ID NO: 21745 - DNA, 73 bp, Homo sapiens; identical to SEQ ID NO: 15185

SEQ ID NO: 21746 - DNA, 58 bp, Homo sapiens; identical to SEQ ID NO: 1215

SEQ ID NO: 21747 - DNA, 99 bp, Homo sapiens
gccaagatgaaaggatcgcttgaatccaggagttcaagactccatttttttttttttgagacggagtcttgctctcttgccaggctggagtgcagtggc

SEQ ID NO: 21748 - DNA, 98 bp, Homo sapiens
agggcatgccctttgagttggtgccataactattgattttgtacttgaaatatttgcatcttcaaagcgattgaatttaaagcactagctaatgctct

SEQ ID NO: 21749 - DNA, 70 bp, Homo sapiens
gtttttgaggtggagtctcactctgtcacccaggctggagtgcagtgatgtgatcttggctcactgtgac

SEQ ID NO: 21750 - DNA, 118 bp, Homo sapiens
atatatgtgtgtatatatacgtatatacatatgtgtatatgtatatatgtatacatgtgtacatatatacatatgtatacatgtgtatatacatataaatatatatatatatacatat

SEQ ID NO: 21751 - DNA, 69 bp, Homo sapiens
tatatacatatatgtgtgtgtgtgtgtgtgtactaatatatatacatatattacatatatgtgtgtgta

SEQ ID NO: 21752 - DNA, 73 bp, Homo sapiens
gagaatctcagagagaagggactgtggagagttggtgcaacctccttttttttttttttcgaaatggagtctc

SEQ ID NO: 21753 - DNA, 82 bp, Homo sapiens
cccagggcttggaaacgatacagcagtcaagcaatacatatttgtttatttttagttagttatttatttttgagactctggg

SEQ ID NO: 21754 - DNA, 66 bp, Homo sapiens
gttttgagacggagtctcactctgtcactcaggctggagtgcagtggtgtgatctcagctcactgc

SEQ ID NO: 21755 - DNA, 58 bp, Homo sapiens; identical to SEQ ID NO: 555

SEQ ID NO: 21756 - DNA, 116 bp, Homo sapiens
cagctttaacactgacaggaaagccaagaagttgggagtattagagtgcattgatgaatggctggctcgctcattctagctgcttggagtttaatgaggacaggtttactgagctg

SEQ ID NO: 21757 - DNA, 111 bp, Homo sapiens
tgccaggcacaaagtgcacagaatcagacctttgtcctcactgccagctttgtcgacctgctgacaagggtcagggggacccaagctgctatccacccagggtgcttttca

SEQ ID NO: 21758 - DNA, 86 bp, Homo sapiens
agcctagggtggaatcacggaagcctcactcactcactcccttgctcccatttgaggactggtgctggctgaaaggggccctggct

SEQ ID NO: 21759 - DNA, 98 bp, Homo sapiens
gacatattttcatgtgtatttgatctattaggttgaatcgtatgaaattgccctttatgtagatcaaagctgatcaaatacttgaaatttcatttgtc

SEQ ID NO: 21760 - DNA, 70 bp, Homo sapiens
gtgtctgggtacacattcaagtgcatggttgcaaacttttttttttaaagcactgaatagtactagacac

SEQ ID NO: 21761 - DNA, 109 bp, Homo sapiens
ggagtgcagtggcatgatcttggctcactgcaacctccgcctcctgggagtctcactctgtcatccaggctggagtgcagtggcatgatcttggctcaccgcaacctcc

SEQ ID NO: 21762 - DNA, 82 bp, Homo sapiens
gggacgttagcaggcagggctccctttctatctctctctttttttttttttttttttgagacagagtcttgctctgtcaccc

SEQ ID NO: 21763 - DNA, 87 bp, Homo sapiens
gctcagtccctctggcacttcggagagactgtagagcagagctgtctccagggtgagtgaagaagctgagcagtcagtcctccagcc

SEQ ID NO: 21764 - DNA, 58 bp, Homo sapiens; identical to SEQ ID NO: 20050

SEQ ID NO: 21765 - DNA, 66 bp, Homo sapiens
gagccagctgccttcagcatcattggcgagttttaaaatgctgatgcaggccaggtgcagtggctc

SEQ ID NO: 21766 - DNA, 78 bp, Homo sapiens
catacttgctgggtaagattgggacagatttactcaacctctctgtccctcagtttacccgtctgtaaggcaaggatg

SEQ ID NO: 21767 - DNA, 87 bp, Homo sapiens
ccacttggacagcagacctggtcggctcctgtagacagcatggccctgtgtcccccagcctgaccctgtctgtgcctccctgcgtgg

SEQ ID NO: 21768 - DNA, 111 bp, Homo sapiens
gccaagcatggtggtgttcacctgtggtcccagctacttggaaggctgaggtaggaggatcacttgagtccaggaggtcgaggctgcagtgagccatgatcgtgccactgc

SEQ ID NO: 21769 - DNA, 58 bp, Homo sapiens; identical to SEQ ID NO: 3380

SEQ ID NO: 21770 - DNA, 122 bp, Homo sapiens
gccacacctggatccaagacgtctgctttttactgagagaaagaggctgtgtcagacactgtctggttttgttggctgaaggaggtttggtttggcttctgaattttcagggagggctgatg

SEQ ID NO: 21771 - DNA, 150 bp, Homo sapiens
caaggaaggaaatcagggaaccttttgtaagatatatatatatatatatatatatatatatatttttttttttttttttttttttttttttttgaggcagggtctcactgtgacactcaggctggagtgcagtggcacaatcttggctca

SEQ ID NO: 21772 - DNA, 84 bp, Homo sapiens
gtatatatgtatgtgtgtatatgcatatatgtatatatatgtatgtgtgtatatatgtgtatgcgtgtgtatgtgcgtgtatat

SEQ ID NO: 21773 - DNA, 84 bp, Homo sapiens
tagattccttgatcattctgaaattgggacatggtggatttcctaagtgtctcccactatcacaatgatttcaatttaaaaagg

SEQ ID NO: 21774 - DNA, 117 bp, Homo sapiens
tgcatccctgcctcatagtgtgagtgtggtatggctgtgtctcaataaaactctcttttttttttttttttttttgaggcagagtcttgctctgtcacccaggctggagtgcagtgg

SEQ ID NO: 21775 - DNA, 79 bp, Homo sapiens
ggtcatccctctctgtgtgtctgtgtcctaatcttctcttcttataagaaatgtcagattaggtctgacactaatgacc

SEQ ID NO: 21776 - DNA, 85 bp, Homo sapiens
cttcccttggggggaatagagaggtacaggttctgcccaccgtgggggcctgtgtttgactctctcccagaccccagagtggcag

SEQ ID NO: 21777 - DNA, 69 bp, Homo sapiens
atgcatgtgtgtgtgcatatatatatgcatacatgtatatgtatgttatgtatgtatacatgtatgtat

SEQ ID NO: 21778 - DNA, 61 bp, Homo sapiens
tgagacggagtgtcactcacactgtcatccaggctggagtcagtggtgtgatcttggctca

SEQ ID NO: 21779 - DNA, 80 bp, Homo sapiens
gggtgacagaggcagaaatcgtttttagggttggggaatttttttttttttttttgagacggagtctcactctgtccccc

SEQ ID NO: 21780 - DNA, 105 bp, Homo sapiens
agtctgctgtgggattaattggactgtatggagtagcaacccaggaagacctagaaccttgaattctttattgtctctgtaatccttgtgatttccgaatggtcc

SEQ ID NO: 21781 - DNA, 84 bp, Homo sapiens
ccagttgtcccatggtgtcctttgtagtaaacaagaattttttttttttttgagacggagtttcactcttgttgcccaggctgg

SEQ ID NO: 21782 - DNA, 81 bp, Homo sapiens
tgagcctgaggtatagagttaaggtctcctcaggtctttttttttttctgagatgcagtctcactctgtcacccaggctgg

SEQ ID NO: 21783 - DNA, 119 bp, Homo sapiens
gctttagcagtgacaattctcattcttaaatgaatctaagagaaaatggaggggtcaactataatatttctttctttttttttattttttgagacagagtctcactttgttaattaggc

SEQ ID NO: 21784 - DNA, 95 bp, Homo sapiens
gagacaacaggctgtaagagtgaagagtgtgagcccaggagtctgtctgcctggatttgaatcctggctctgccacctaccagctttgttatctt

SEQ ID NO: 21785 - DNA, 68 bp, Homo sapiens
acagtgagagcagtgtgtgtgcacatgtacatttgaggtgtgcgcatgtgtagaatgtgtatcactgt

SEQ ID NO: 21786 - DNA, 81 bp, Homo sapiens
tgctgtctgtccagctataaattatttttgttttgctataaaagaaggtgagaaacaggtattggttgggggaggagggca

SEQ ID NO: 21787 - DNA, 119 bp, Homo sapiens
ggtgttttacatatattgcattagcccctcattagcagccctgggagaaggcatcattgttcttattttataaatgaagaggctgaggctcagagaggttaagtaatttgctcagcatc

SEQ ID NO: 21788 - DNA, 110 bp, Homo sapiens
gttggtgaacttcatataaatagaatcatgtagtatatatctttttatgttggcttcatttgctcaacttatgtctgtctattgtccatgttgctgtttgtatcggtaac

SEQ ID NO: 21789 - DNA, 60 bp, Homo sapiens
ttgagatggagtctcactctgtcacccaggctggagtgcagtggtgcgatctcagctcaa

SEQ ID NO: 21790 - DNA, 58 bp, Homo sapiens; identical to SEQ ID NO: 2051

SEQ ID NO: 21791 - DNA, 111 bp, Homo sapiens
ctctttgccttgccactgagttattttccctagctcctttttcttgggtcccttgaccctgactgacgaatgagagcagagaaccctataacatcctggacctctggagag

SEQ ID NO: 21792 - DNA, 76 bp, Homo sapiens
acaggtgcatgccaccacacctgccaaattttaaagtttttcttttttttttgtagagatgggggtctgtctctgt

SEQ ID NO: 21793 - DNA, 112 bp, Homo sapiens
tgatatatgcatatatgagcatatatcattatatatgcataatgatatatgcatatgagcatatatcattatatatacataatgatatatgcatatgtatcatatagtgtca

SEQ ID NO: 21794 - DNA, 111 bp, Homo sapiens
ggcctataggcggttgagtggcaaagctagtttaaagaagaaaaatccttcctatctttttttgtagttctgtaagcattatttgaagaaacttggatttccctgtgtgct

SEQ ID NO: 21795 - DNA, 84 bp, Homo sapiens
tccagctcagggtgccaggtgagaaccagccctggacagggcaccatcccattgcagggcgcactcacagtcactcattctgga

SEQ ID NO: 21796 - DNA, 82 bp, Homo sapiens
ccgggtgtgctggtgcaggactgtggttccagctactcaggaggctgaggtaggaggatcgtttgagcccaggaggtcaagg

SEQ ID NO: 21797 - DNA, 95 bp, Homo sapiens
gtgtgtgtatatacgtgtgtgtgtatatatatgtgtgtgtgtatatatatattgtgtgtatatatatatatatatatacatacacacacacacac

SEQ ID NO: 21798 - DNA, 103 bp, Homo sapiens
gtgtgtatgtatgtatgtgtgtgtgtatatatatgtgtatatatacacgtgtatatatatacacgtgtatatatgtgtgtatatatatacacgtgtatatatg

SEQ ID NO: 21799 - DNA, 94 bp, Homo sapiens
tgggtgtcctctaattcaactacaatgctgtttacctggaggtcgtgtcagatctcacagtgctcagtgtctgaggctgccatccttaacccca

SEQ ID NO: 21800 - DNA, 56 bp, Homo sapiens; identical to SEQ ID NO: 15704

SEQ ID NO: 21801 - DNA, 111 bp, Homo sapiens
gcactactcctgtgctggacagcgccttttttgttgttgtggtttgttttgagacagaatctcactctgtcacccaggctggagcacagtggcgcgatctcagctcactgc

SEQ ID NO: 21802 - DNA, 86 bp, Homo sapiens
cagcagcttcactctttctctctctgggcaccagcgcgagccgtgctgtggctcccctgtgtccatctgcaggacggacagctctg

SEQ ID NO: 21803 - DNA, 122 bp, Homo sapiens
tgtacaatgggcaatacttggcagtgtgctgaggaggatgagacaaaagtgcttaatttgttaatattttttctctgtttttttttttggtgtattgcttaacctcctgtcaaaatagtgtt

SEQ ID NO: 21804 - DNA, 119 bp, Homo sapiens
gagttaggtagagctcttctcaaattcttgtttaaaacagtgggctgtggagttaggtcgaactcttctcaaattcttgtttaaaacaatgggctgtggagttaggtagagctcttctc

SEQ ID NO: 21805 - DNA, 93 bp, Homo sapiens
tatcttcaatcagtggtttcattgtgggaaccttttttattttttaagacagggtgtattagggttctctagagggacaggattgataggata

SEQ ID NO: 21806 - DNA, 84 bp, Homo sapiens
ttagcagagaaagaatcactctgaaaagcttggcatgagacaatgatggcaaatattttcagattttttttctttttgtgctaa

SEQ ID NO: 21807 - DNA, 61 bp, Homo sapiens
ttgagatggtgtctcactctgtcaccaggctggagactggagtgcagtggcacaatctcag

SEQ ID NO: 21808 - DNA, 79 bp, Homo sapiens
gttcatataagatctggttgtttaaaggagtctgggacctgcaccctcactctctcactccagctctcacaatatgacc

SEQ ID NO: 21809 - DNA, 103 bp, Homo sapiens
gcttttattttatttatggtgcttttgacatacagattttttttatttcaacaggttttggggggaacaggttgtgtttggttgcatgaataagatttttagt

SEQ ID NO: 21810 - DNA, 91 bp, Homo sapiens
aggcacggtgctgaagtgctgtctactgtctctgagtgcaggaggctgcgatgtgcctgtggagacagtacctgtgctggatgaggtgcct

SEQ ID NO: 21811 - DNA, 77 bp, Homo sapiens
ttgcttttttttttgagactgaatctctctctgtcacccaggctggagtacagtggtgtgatctcagctcactgcaa

SEQ ID NO: 21812 - DNA, 86 bp, Homo sapiens
gagaaatggagagacacagagagagagaaaggaaaagaaagaaagatttgttctggtccaaacttctcagtgggtgttcagggttc

SEQ ID NO: 21813 - DNA, 58 bp, Homo sapiens
tgagacagagtctcactctgtcgcccaggctggagggcaatggcgcgatctctgctca

SEQ ID NO: 21814 - DNA, 91 bp, Homo sapiens
gctcgatttggcggaggcattgatgtcctgggtcctggcttggttccccaccccttcgtccaagagcccagagtccagacagctgcgcgcc

SEQ ID NO: 21815 - DNA, 68 bp, Homo sapiens
ggtccctccgacacggtcactctgtgagcagataaatgttgcccggtcagtgcccggtcagagccgcc

SEQ ID NO: 21816 - DNA, 92 bp, Homo sapiens
gtatgtatgtataggtgtatgtatacatatgcatgtatgtatatatgaatgcatgtatatatatatatgtgtgtgtgtgtgtatacatgtat

SEQ ID NO: 21817 - DNA, 95 bp, Homo sapiens; identical to SEQ ID NO: 68

SEQ ID NO: 21818 - DNA, 93 bp, Homo sapiens; identical to SEQ ID NO: 69

SEQ ID NO: 21819 - DNA, 114 bp, Homo sapiens
agatcacagcaggaatctccatggtgccctggtacttgaagtgacttttctttttttttttttaatttaatttaattttaagttctgggatacatgtgcaggatgtgcaggttt

SEQ ID NO: 21820 - DNA, 118 bp, Homo sapiens
cagtttgccctgaggttggggaaaaaggctttatttatttatttatttatttatttatttatttatttatctatttagttagttattgagatggagtctcactctgtcgcccaggctg

SEQ ID NO: 21821 - DNA, 77 bp, Homo sapiens
gatgtgtctattctcagcctctgactgacagggacatgtcctgtgtggctgagacacagactgtctgacctggaggc

SEQ ID NO: 21822 - DNA, 106 bp, Homo sapiens
atgggatggtggtggtggtggtggtggtgtgggaacagttccccaaatgaacagcttactgttttcactggcattttctttttaaaccacccttccagagttctgt

SEQ ID NO: 21823 - DNA, 96 bp, Homo sapiens
atggctgcgttatgcaaattcataggctagaaacaggacaggcaccaagaggaagcacgtgagctgagtgagcagagtgtgtgtggagtgagttat

SEQ ID NO: 21824 - DNA, 78 bp, Homo sapiens
gctttgctctgaagcagctcctctggggaagatcagaggctagcccctgagggatgtcagagtgctcacaggcacagc

SEQ ID NO: 21825 - DNA, 86 bp, Homo sapiens
tgtttggggtttgaaatgtcataaactgtacattatatacattttgtatgtatatgtaaaagcatatgaatatagaacataagaca

SEQ ID NO: 21826 - DNA, 145 bp, Homo sapiens
gtgtgtgcatgtgtgtgtatatatatgtatatatgtgtgtatgtgtatatatgtgtatatatgtatgtatatgtgtatatatgtatatatgtatatgtgtgtacatatgtatatatgtgtgtatgtatatataactggctacaca

SEQ ID NO: 21827 - DNA, 64 bp, Homo sapiens
tagaatgtttagaagtattcccttttcaatgttttgggagggttattaatttttaaatgtttta

SEQ ID NO: 21828 - DNA, 245 bp, Homo sapiens
catatgtacatatatgtacgtatgtacatatgtacatatatgtatatatgtatatatgtacatatatgtatatatgtacatatatgtatatatgtatatgtgtacatatatgtatatatgtatatacatatgtatatacatgtatatgtatatacgtatatatgtatatatgtatatatgtatatatgtatatgtatgtatatatgtatatatgtgtatatatgtatatatgtacatatatgtat

SEQ ID NO: 21829 - DNA, 58 bp, Homo sapiens; identical to SEQ ID NO: 2595

SEQ ID NO: 21830 - DNA, 112 bp, Homo sapiens
gtttcttgcccaagattataaactattaattggtgaagccaggattcaaacacaggctctctggccctgagtctctggtcttgaccactgtgttataccatctgctaaaaac

SEQ ID NO: 21831 - DNA, 119 bp, Homo sapiens
ggaggagaagtgagcatggcagagatgcagccacgagagggacagaagacagtcaggtctgccgcctgctcttcccgtcctgagtcaggtctggaccctgcagtggacacagccactcc

SEQ ID NO: 21832 - DNA, 88 bp, Homo sapiens
tgttagggcctaaacatatgtgagggattcttatctaatattcaagggttagttaatggtgactctcagacactggctggttctgagg

SEQ ID NO: 21833 - DNA, 73 bp, Homo sapiens
tgtgtccctcagacactgtctccatgtctgtgccactgagatgtgagcatggctgagctgtggagggagcgca

SEQ ID NO: 21834 - DNA, 89 bp, Homo sapiens
gcgacgcggccccatgcctttgaaggaaggacttggagtctgcctccctgcactcttcactgtctctctagtggcttctcccgcctggc

SEQ ID NO: 21835 - DNA, 83 bp, Homo sapiens
gtctgtccgtctgcagctgtctgctgtcgccgggtgcatttggcaacagtctggctcagtccctctgcggtctccactcaggc

SEQ ID NO: 21836 - DNA, 87 bp, Homo sapiens
gccaaaacaaaaggggctacttcctgcttgtttatggactgatcctggttctccttccctggctcagtcagactcagagcctctggc

SEQ ID NO: 21837 - DNA, 68 bp, Homo sapiens
gtgtatatgtgtatgtgtatatgtacgcatgtgaatgtatgtgtctgtgtctgcatgtgcatgtgtgc

SEQ ID NO: 21838 - DNA, 59 bp, Homo sapiens
gtcactgaacctctctgtgcctcactagggcagcccaggggccagatggatcattgcac

SEQ ID NO: 21839 - DNA, 58 bp, Homo sapiens; identical to SEQ ID NO: 1868

SEQ ID NO: 21840 - DNA, 114 bp, Homo sapiens
gttgtcctccaaaaccgccgaggccttgacttactgctgaaaaaaaaggactctatatttttaaatgaagagtgttgtttttacctaaatcaatctggtctggtgtatgacaac

SEQ ID NO: 21841 - DNA, 74 bp, Homo sapiens
cttcttgagggcagaaactgtctttttgtctctctaaattgggtgatgatcatagtgtctgcacagagtaggag

SEQ ID NO: 21842 - DNA, 63 bp, Homo sapiens
gtctagccacttgtgtgtgtgctcactagggtctcgtggtttttataggcacaggatgggggc

SEQ ID NO: 21843 - DNA, 94 bp, Homo sapiens
tagtctcaggccaggacttgtacattttagactgactctgcctctcactggctgtgtgaccccaggattaggtgcttctcctctctgggctctg

SEQ ID NO: 21844 - DNA, 119 bp, Homo sapiens
ctccaacttagtggcctcacacagtagtcatttataatctctcactgtgtctgtggctcaaggagtcaggagcagttcctggttcagggactccatgaggcagcagtcatctgaaggtt

SEQ ID NO: 21845 - DNA, 67 bp, Homo sapiens
gcacccttataagaagagacacaggagagcttgcttcctttctgtctgctttttatcacatgggcgc

SEQ ID NO: 21846 - DNA, 102 bp, Homo sapiens
cttcctgcagacacagaccttagaaagagacagaggctttctgggagtcccatcccagggctctgcctctgtctctgtcctgagaggaaaaagaccaggagg

SEQ ID NO: 21847 - DNA, 79 bp, Homo sapiens
tgtgcagctcccacttggacagacagaacagtgtgtggagactcacaccatgatcttttgctccaagaaccactgcaga

SEQ ID NO: 21848 - DNA, 73 bp, Homo sapiens
agcattgagctgtctgtatttcatgccaaccccaagtggctggtggaatgaaggaccaagcatgtttggggct

SEQ ID NO: 21849 - DNA, 58 bp, Homo sapiens
tgagacggagtctcgctctgtcgctcaggctggagtgcagtggcgtgatctcagctca

SEQ ID NO: 21850 - DNA, 95 bp, Homo sapiens; identical to SEQ ID NO: 68

SEQ ID NO: 21851 - DNA, 93 bp, Homo sapiens; identical to SEQ ID NO: 69

SEQ ID NO: 21852 - DNA, 73 bp, Homo sapiens
gagggcctgcaggagttctctgaggccctcagtttctctgtttctctgaggcctcagtttctctgaggccctc

SEQ ID NO: 21853 - DNA, 114 bp, Homo sapiens
ggagcagcctcactcagacaagggatcattcttgagcttttttttagatgaatttattttttcttgaaacagatctcactctgtcacccaggctggagtgcaatggcgtgatct

SEQ ID NO: 21854 - DNA, 84 bp, Homo sapiens
gggcctgtgtggatgtgtggctggctgacctagaagcagccagaagggtgtgagcccatcagcccgcttcgccccacccggccc

SEQ ID NO: 21855 - DNA, 119 bp, Homo sapiens
ctccatttttcctcccaaaaaggctggggagctccttctgaatggtgaagactgggactgtctgtctcttattaataagggtagtatccagtgtgagaggcagtggtgattaagcttca

SEQ ID NO: 21856 - DNA, 93 bp, Homo sapiens
ggcaggtgtgccggggtgtgtgagaggagacaaagtgcaggtcctcgtgcaaggtgggccacgttttgaatccttcccatgctgtagactgcc

SEQ ID NO: 21857 - DNA, 87 bp, Homo sapiens
gccactgagcgctccaccctggggaactgaggagggaggggccagcacgggcctcgtgcctgtctctcagtccctgcctcagttgct

SEQ ID NO: 21858 - DNA, 86 bp, Homo sapiens
cacggtactcctggctagggtggggtgggtgtgcaagggttctagggaggggggcacccactgtggctctgagcctggagagagtg

SEQ ID NO: 21859 - DNA, 83 bp, Homo sapiens
agaactgtcagactcatggatatctgcatatggattgaaaattagtagagcacgttcatgtatgatatcagagctgaacttct

SEQ ID NO: 21860 - DNA, 99 bp, Homo sapiens
gaggaaaggaaaagggaacagcttatttctgtgtgtgtctgtatcatttttattgttaacaacaactacgattcaagctggaatcaaatacttgccctc

SEQ ID NO: 21861 - DNA, 132 bp, Homo sapiens
ttggggagcgctgataacattctgtttcatgatctgtgtactggttttgtgggtatgttcagtttgtgagaagtcagtgagctgtaatcttgatagatgctactttctgtatatccattatacttcaataca

SEQ ID NO: 21862 - DNA, 109 bp, Homo sapiens
gcattgcgtatgtcggaaaaaaaggtcgaaacttcctcaataaatgaagagatgtctttttgtatatctgcatttgtggaacatagaatttttcagctgggtgcaatgt

SEQ ID NO: 21863 - DNA, 92 bp, Homo sapiens
tttgttttgagactgagtctcactctgtcgcccaggctggagtgcagtggcgcgatcttggctcactgcaagctctgcctcctgggttcgag

SEQ ID NO: 21864 - DNA, 113 bp, Homo sapiens
gagagatccaagttcagccatcgacctatgacctaggagttcttcgtgggagcttctgcatctccaactcctacccttgtcttggccatggcaaacttttcaaaggatttctc

SEQ ID NO: 21865 - DNA, 87 bp, Homo sapiens
ctggacatgggtcagagatgagaagactcccttttttttttctttttttttttttgagatggagtctctctctgtcacccaggctgg

SEQ ID NO: 21866 - DNA, 99 bp, Homo sapiens
gtgttggccaggatggtcttgatctcttgtttttttttgagtccgagtctcactctgtcacccgggctggagtgcagtggcacattcttggctcaattc

SEQ ID NO: 21867 - DNA, 67 bp, Homo sapiens
gtgactgagaccgtttttatttttagtgatgggggtcttcctctgtcacccagactggctcaatcac

SEQ ID NO: 21868 - DNA, 152 bp, Homo sapiens
gttttctctatgtcttttcatggcttgatagctctttttttttttttttttttttttttttttttttttttaagacaagagtctgtcgctctgtcacccaggctggagtgcagtggtgtgatcttggttgactacaacctccacctcccggg

SEQ ID NO: 21869 - DNA, 89 bp, Homo sapiens
ccctgttgagacattgtcacgtacacagtctcaggactagtagagcaggctggtaggcccctgactgcctgtgtgcgtgacatgcaggg

SEQ ID NO: 21870 - DNA, 56 bp, Homo sapiens
gagaccgagtctcgctctgtcacccaggctgcagtgcagtggcgtgatctcggctc

SEQ ID NO: 21871 - DNA, 133 bp, Homo sapiens
tgggtttgggatggggctggggaattcacatgtctttctttttttgttgttttttgagatggagtctcactctgtctcccaggctggagtgcagtggtgcgatctcggttcactgcaacctctgtctcctggg

SEQ ID NO: 21872 - DNA, 113 bp, Homo sapiens
ctgggagttggagagtcttggggaatgtagtccacagagggcagggtcaggctgggggcagcctctgtctctgtcaggctgctgccgccaagactcttttcaggaacacctgg

SEQ ID NO: 21873 - DNA, 103 bp, Homo sapiens
ccatgcccggcttttttttttttttgagacagagtctctctctgtcgcccaggctggagtgcagtggcacaatcttggctcactgcaacctctgtctcctggg

SEQ ID NO: 21874 - DNA, 62 bp, Homo sapiens
tgtgtgtatatatgtatatatacatacatatgtatgtatgtatatatacgtatatatatgta

SEQ ID NO: 21875 - DNA, 60 bp, Homo sapiens
gtccactgggacctagaagtgggtagggctggagccactgcctgtctgcctctctctgac

SEQ ID NO: 21876 - DNA, 88 bp, Homo sapiens
tcttaaaaaaagtatatgtataaattatgtatcatgtatatgtatatatacttataggatacattatatatatgtatgtatacagaga

SEQ ID NO: 21877 - DNA, 59 bp, Homo sapiens
gaaggctgactgtgcacacagtgcccacaaaggagctgtgagctgccatattggccttt

SEQ ID NO: 21878 - DNA, 65 bp, Homo sapiens
ctgtcaagggaggactgtgcctcgccaggtcccgcatggggctcacatcactctctgtctgacgg

SEQ ID NO: 21879 - DNA, 95 bp, Homo sapiens; identical to SEQ ID NO: 68

SEQ ID NO: 21880 - DNA, 93 bp, Homo sapiens; identical to SEQ ID NO: 69

SEQ ID NO: 21881 - DNA, 58 bp, Homo sapiens
tgagacagtgtctccctctgtcacccaggctggagtgcagtggtgcgatctctgctca

SEQ ID NO: 21882 - DNA, 94 bp, Homo sapiens
gtgttgccagcagattgcatggtgcccgtccacactgagggcaggtcttcctctctcggtcactgactcatgcatcaatctcctctggaaacac

SEQ ID NO: 21883 - DNA, 73 bp, Homo sapiens
tatatacatactcatgtgtgtgtatatatatatatacatacacgtgtgtgtgtgtgtatatatatatatatat

SEQ ID NO: 21884 - DNA, 64 bp, Homo sapiens
ccaagtcatgacttgtctgcctgtctgcctcacatgaggtggggggactgcaggatgtttttgg

SEQ ID NO: 21885 - DNA, 58 bp, Homo sapiens; identical to SEQ ID NO: 2758

SEQ ID NO: 21886 - DNA, 120 bp, Homo sapiens
agaccagtatccgcttggggggtgagatggggggcgagcagagctgatggagtaatttcaatattaatttatgtcagccgccttctctcagcgctactcacttactgtactgccctcagc

SEQ ID NO: 21887 - DNA, 73 bp, Homo sapiens
agctctgtgttctcactcactcacttcctgattctgcctgggctggtgaagtgcattgtgatggggtggggct

SEQ ID NO: 21888 - DNA, 105 bp, Homo sapiens
catggttgtgcatgcctgtagtcccagctactcaggaggctgaggtaggaggatcgcttgagcccaggaggtcagcccaggaggtcaaggctgcagtgagccatg

SEQ ID NO: 21889 - DNA, 98 bp, Homo sapiens
tgacaggatgtcaggcccataagtgaggacctataagtgattgttattgttggtgttactattattctatatgtcttctgggactgatgcttctgtca

SEQ ID NO: 21890 - DNA, 103 bp, Homo sapiens
aaatacaaattaatgtaaaatccaacaggactctgtatggcacagttgttaatcctgtctttatttaaaagcttgctatttgtccatcattaattttgtattt

SEQ ID NO: 21891 - DNA, 103 bp, Homo sapiens
gcctgggcagtatagccagaccctgtctcaacaacaacaacaacaaaacattttgctatactttttttttttttgagacagggtctggctctgttgcccaggt

SEQ ID NO: 21892 - DNA, 93 bp, Homo sapiens
atatgtacatgcatacatatatatgtacgtgtgtgtgtatatatatgtgcgcgcgtgtgtgtgtgtgtgtgtgtgtgtgtgtatatatatata

SEQ ID NO: 21893 - DNA, 92 bp, Homo sapiens
catttcttgactttatttttatttatttattttttgagacggagtctcactctgtcgcccaggttggagtccagtggagtgatctcagctca

SEQ ID NO: 21894 - DNA, 95 bp, Homo sapiens; identical to SEQ ID NO: 68

SEQ ID NO: 21895 - DNA, 93 bp, Homo sapiens; identical to SEQ ID NO: 69

SEQ ID NO: 21896 - DNA, 58 bp, Homo sapiens
tgagatcgagtctcacactgtctcccgggctggagtacagtggcaagatctcggctca

SEQ ID NO: 21897 - DNA, 71 bp, Homo sapiens
cattaaacatagttacagaccagaggttgtgccaggcatgcacgactgtgtcttagtcactgtgtttcatg

SEQ ID NO: 21898 - DNA, 63 bp, Homo sapiens
tggtgcacacctgtggtcccagctactcaggagaggctgaggtaggaggatcacttgagccca

SEQ ID NO: 21899 - DNA, 67 bp, Homo sapiens
cactctccctgtgtgcctgcttctgttgcaggtttgccatcctgtgaccaacacattagaaagggtg

SEQ ID NO: 21900 - DNA, 137 bp, Homo sapiens
acacacacatgcatgtatatgtatgtatacgtatatatacatatacatacatgtatgtgtatatatatgtatgtatacatgtgtgttgtgtatatatataatttatatatatacatatacatatgtgtatgtatata

SEQ ID NO: 21901 - DNA, 58 bp, Homo sapiens; identical to SEQ ID NO: 20439

SEQ ID NO: 21902 - DNA, 95 bp, Homo sapiens
ggtgagccaccgcgcccggctactttttttgtttttgagacagggtcttgctctgtcacccagactggagtgcagtggtacagtcaaggctcact

SEQ ID NO: 21903 - DNA, 67 bp, Homo sapiens
ggtccctcactctctgtgagcctcagttgcctcacctgtgaaatgtaactcagtggttgagtggatc

SEQ ID NO: 21904 - DNA, 80 bp, Homo sapiens
gtctcactctgtcacttaggctggagtgtagtagtacgatctaggctctctgcaacctccgcctcccaagtagctgagac

SEQ ID NO: 21905 - DNA, 58 bp, Homo sapiens
tgagacggagtctcactctgtcacccgggctggagtgcagtggtgtgatgctggctca

SEQ ID NO: 21906 - DNA, 102 bp, Homo sapiens
ctcgcactaaagaagcattttttttttttttgagacagagtctggctctgtcacgcactaaagaagcatttttttttttttgagacagagtctggctctgtc

SEQ ID NO: 21907 - DNA, 69 bp, Homo sapiens
gtatcagtcagtctctccgtgtgtcgtgggagctgcctgcgcttccgtgaacgggacactgagaaatgc

SEQ ID NO: 21908 - DNA, 119 bp, Homo sapiens
gagggggtgagggtctagtgaggtgtgtgttgcaagggttgctgttgtgggaagtgagcttgagagacattcagcatgagcccccaactcctcctcaacatggactttgggggccctta

SEQ ID NO: 21909 - DNA, 83 bp, Homo sapiens
cacctggctcagtgaggagtcactggctctgtgagtgtcctaatttgtgagctctttagtcctgaaatctcacttagctggtg

SEQ ID NO: 21910 - DNA, 58 bp, Homo sapiens; identical to SEQ ID NO: 1868

SEQ ID NO: 21911 - DNA, 96 bp, Homo sapiens
tgggagctcagacggagggttggagacaggagacagtggggtgggaaatccaaatctcaactgcttttgtactgtctcctgctcccgagtgcccca

SEQ ID NO: 21912 - DNA, 61 bp, Homo sapiens
gaggtggttgggagagagacatgctcagagctctctgtctgtctacctgtccctgactctc

SEQ ID NO: 21913 - DNA, 115 bp, Homo sapiens
tcccagagtgctgggatcacaggcatgagccactgtgcctggcctctaaagtcattttttatattatccaggttcattgggtccccagcctgtgggaagaaagcagtgactgggg

SEQ ID NO: 21914 - DNA, 98 bp, Homo sapiens
gctttgggtatcctgtgcctgagttttctgttttgccataaatttgtatatgttttttagaaggggctgaaaatttgtaaggctctttcacttgaagt

SEQ ID NO: 21915 - DNA, 58 bp, Homo sapiens; identical to SEQ ID NO: 1265

SEQ ID NO: 21916 - DNA, 67 bp, Homo sapiens
ctggagctgtctgtgcctctgtcttcccatctgtaaatgagggttaagcagagcacctacctcacag

SEQ ID NO: 21917 - DNA, 103 bp, Homo sapiens
tttcacttctatccatgtgtagaaactctctggttgtagtttcttgtgttactaattaaggactggagccaggggaaatacataccaggcagttagaaggaaa

SEQ ID NO: 21918 - DNA, 73 bp, Homo sapiens
ggctacagtgaagcatgatcacgctgttgcactctggcctgtgcaacagagtgagactctgtctcagtcagtc

SEQ ID NO: 21919 - DNA, 101 bp, Homo sapiens
gccagaggctctgatctgggtgtagggagagaattgactgtggagaagggcgtactatttctccacacttcctccttgttagactcaatatgcctgtgtgt

SEQ ID NO: 21920 - DNA, 84 bp, Homo sapiens
ctgcccccacctcttagatgagtacatggaggctgagaagggacactgatctttctcagtcactcagttcagaagtggcagcgg

SEQ ID NO: 21921 - DNA, 67 bp, Homo sapiens
ccagggaagagagtcaggacactgggcatagatgccctccctgcgtcacctaaccctgcatccctgg

SEQ ID NO: 21922 - DNA, 85 bp, Homo sapiens
gctgtatcatctatatgtgtattagtatatatatatgtactagtgtatatacatgtacactaataacatcatgaccaagtagagc

SEQ ID NO: 21923 - DNA, 76 bp, Homo sapiens
cacagatgaggtgaaacagacaactgtcttggccgcgcctgggctctgtgtgtgtgtgcctgtctgtgacagtgtc

SEQ ID NO: 21924 - DNA, 74 bp, Homo sapiens
gtcggtgagagggtggagacagaggacacaggggccccggcttcaggaagtctaggtctttccaccctagagac

SEQ ID NO: 21925 - DNA, 62 bp, Homo sapiens
ccctggtgagtggggagcatgtccttgcaggatcaactgtatggttttcttgcttaaagggg

SEQ ID NO: 21926 - DNA, 95 bp, Homo sapiens; identical to SEQ ID NO: 68

SEQ ID NO: 21927 - DNA, 93 bp, Homo sapiens; identical to SEQ ID NO: 69

SEQ ID NO: 21928 - DNA, 67 bp, Homo sapiens
gcagctcatatactctctctgtatctcagtgtcctcctggggttgtgatggggagcaaatgagttac

SEQ ID NO: 21929 - DNA, 99 bp, Homo sapiens
tctaaatcccccctgccgccgccacccccacactctcattctctctgtcttagggcagggggcggagctgagcctgggaagacagggaggggtcttagg

SEQ ID NO: 21930 - DNA, 67 bp, Homo sapiens
tgaaattctgtctttcccatctatgctgtaattttttttttatgtgtgtgtgagagacagggtctca

SEQ ID NO: 21931 - DNA, 63 bp, Homo sapiens
tttttttgagacagtgtctcactctgtcgcccaggctggagtgcagcccttttttcaagaaaa

SEQ ID NO: 21932 - DNA, 58 bp, Homo sapiens; identical to SEQ ID NO: 1101

SEQ ID NO: 21933 - DNA, 56 bp, Homo sapiens; identical to SEQ ID NO: 1102

SEQ ID NO: 21934 - DNA, 109 bp, Homo sapiens
cactagtgagcccctccctagtgggcaaggtaagtcttctatttttattgattgattgattgattgagacagtgtctcaccctgtctcccaggctggagtacggtggtg

SEQ ID NO: 21935 - DNA, 96 bp, Homo sapiens
gctaggctgttcatgcttggggtctctcacagggtctcagtcagaggtcacagaggagcttcctcactcatgtgtctggtgattgatgctggttgt

SEQ ID NO: 21936 - DNA, 64 bp, Homo sapiens
ttgttttttgagacagagtctcactctgtcgcccaggctggagtgcgatctctgctcactgcaa

SEQ ID NO: 21937 - DNA, 104 bp, Homo sapiens
gtgtgttagaagttttctgtcctcctcagactctgagtgtctgccaagtcccataaattaggccaacgtctctgggctcaggagcccggcaaaatgagtaccac

SEQ ID NO: 21938 - DNA, 84 bp, Homo sapiens
tgggcatgccactgtccctctctgggcctcagtttcctcactacaagtaagaagcttggggctgagcccagtggctcacaccta

SEQ ID NO: 21939 - DNA, 65 bp, Homo sapiens
agagcaaagatgagaggtggagaaacaggcctggtggcgtctgagacactgcttctagttgttct

SEQ ID NO: 21940 - DNA, 65 bp, Homo sapiens
ggtgagcttctggaagctggaagataggccatgcctccactctgtccctctctccttggctcact

SEQ ID NO: 21941 - DNA, 62 bp, Homo sapiens
ctaggccctgtctctgtccctgcctcacagtttagctgtagagaaggatgagttacccctag

SEQ ID NO: 21942 - DNA, 112 bp, Homo sapiens
gcccacttgtcttagccacagccatcctatgccagacgcagtcacctgacccctaaacagatgatagtgtccagccaggatcagcagagctgccaaccaacacacagaacgc

SEQ ID NO: 21943 - DNA, 57 bp, Homo sapiens
ttgagatggagtctctcgctctgtcatccaggctggagtgcagtggcacgatctcag

SEQ ID NO: 21944 - DNA, 115 bp, Homo sapiens
acaactctgggaaacttccagggcccttcttagcacactgttaaaaatcaaccctttcaatttttatattagaaaactgtggctggggccaggcatggtggtggctcacatctgt

SEQ ID NO: 21945 - DNA, 95 bp, Homo sapiens; identical to SEQ ID NO: 580

SEQ ID NO: 21946 - DNA, 93 bp, Homo sapiens; identical to SEQ ID NO: 69

SEQ ID NO: 21947 - DNA, 71 bp, Homo sapiens
ggaattctctttgtcactcactcattggtggttaacatccatgggctcgtggaggaagagagagatggtcc

SEQ ID NO: 21948 - DNA, 118 bp, Homo sapiens
ggtacatgaacactagctaaaacttaaaatcaccagctgcatgagcccctgacaagagagtcagctttgaagctttgaagccaggcattgatttctcctcttctagctatgaatggcc

SEQ ID NO: 21949 - DNA, 95 bp, Homo sapiens; identical to SEQ ID NO: 68

SEQ ID NO: 21950 - DNA, 93 bp, Homo sapiens; identical to SEQ ID NO: 69

SEQ ID NO: 21951 - DNA, 108 bp, Homo sapiens
cagatgtgatgatgcacgcctatagtcccagctactcaggaggctgaggtggaaggatctatagtgcctaggaggttgaggctgcagtgagctgtgatcacaccactg

SEQ ID NO: 21952 - DNA, 77 bp, Homo sapiens
tgtattctgtggcttaggatgtgggtttctttgtttctgatagtctcagacactgagagaaacaagttacatatgca

SEQ ID NO: 21953 - DNA, 120 bp, Homo sapiens
ctaggattacacatgtgagccactgtgcctggctgaagaattctctctctctttttttttttttagttgagacggagtcttgctgtgtcgccaggctggagtgcagtggtgctatctcag

SEQ ID NO: 21954 - DNA, 89 bp, Homo sapiens
gtgtgtgtgtagtatgtgtatgtatatatgtatgtatatgtgtgtatgtatatgtatatgtgtgtatatatacttatatatatatcaca

SEQ ID NO: 21955 - DNA, 113 bp, Homo sapiens
gcaaaaacttctttcatttgttgttggattcttcacagaaaatatgtacatttttattaaatccccatgttaagctgtccgtaggaattatgccacagaaggaagagggatgc

SEQ ID NO: 21956 - DNA, 58 bp, Homo sapiens
tgagactgagtctcactctgtcacccaggctggagtgcagtggtgcgatatcggctca

SEQ ID NO: 21957 - DNA, 93 bp, Homo sapiens
tgctgccaacacagctttcaagcaatataagcaagagataaatgtttattcttttaaaccattgagttattgaggctgtttgttattgtagca

SEQ ID NO: 21958 - DNA, 58 bp, Homo sapiens
tgagacagattctcactctgtcaccctggctggagtgcagtggtgtgatctgggctca

SEQ ID NO: 21959 - DNA, 92 bp, Homo sapiens
gtctctttgccagctgtgttctctgtgcctgagctgctggtggctcccgggagatgtgcatggtgaagaagggaatggctggtgtcagagac

SEQ ID NO: 21960 - DNA, 103 bp, Homo sapiens
tgagaccaacatttgatttctacttttgcagctaaaatcactcatttttaaatttaaaatgtatgagtttttattgctgttgttgttttgagaccgagtctca

SEQ ID NO: 21961 - DNA, 81 bp, Homo sapiens
cctgtggttgaccacatgagaacttgagcccagtgactagggtttctgtacccggtcacagcacactctgtcaccctcagg

SEQ ID NO: 21962 - DNA, 114 bp, Homo sapiens
gagtacccggccgtgtgaggtgtcagtctgcccctactggtgggtgcctccctgatagcctactcaggcatcagggaaccacttgaggaggcagtctgtccattctcagatctc

SEQ ID NO: 21963 - DNA, 80 bp, Homo sapiens
ctgggactatagccatgcgtcaccatgcccacataatttttaaatttcttgtagaggtgaggtcttgctatgttgcccag

SEQ ID NO: 21964 - DNA, 93 bp, Homo sapiens
agatgctaaggccctctctctctcaatcactctgctatatcatttccctaattagagacagaatgacccttgtggggatgaggcttgagttct

SEQ ID NO: 21965 - DNA, 85 bp, Homo sapiens
tgcccagccctgtgtcagtgtctcagttgtggcccttggttgaacaggccaagggcagacagctccatctagatgggaggtggca

SEQ ID NO: 21966 - DNA, 75 bp, Homo sapiens
tgaatatatatgtatataatatatatactgaatatatatatactgaatacatatatattcagtatatataatata

SEQ ID NO: 21967 - DNA, 57 bp, Homo sapiens
gctgtcattctctctgtcagatgaggaaactgaagcatagagcagttgaatggcagc

SEQ ID NO: 21968 - DNA, 144 bp, Homo sapiens
gttacttggtatatatatatatatgtatatgtgtgtatatatatatatatatatgtatatgtaatatatatgtatatatatgtgtgtatatatgtgtatatatatgtatatatgtgtgtgtgtgtgtgtgtgtgtgtgtgtgta

SEQ ID NO: 21969 - DNA, 83 bp, Homo sapiens
cgggaagggaggggaaaggactaggggaaaggtgcctttatgtaagtcatgcagctgtcctgacagtcaaactctctctctgg

SEQ ID NO: 21970 - DNA, 135 bp, Homo sapiens
tatatgtacacacacgtatatataatatacatgtgtatatgtgtatataatatataattatatattatatatacatatgtgtgtatgtatatgtgtatgtatatatatctcatgcacatatatgtatatatatta

SEQ ID NO: 21971 - DNA, 102 bp, Homo sapiens
ctttcacagtgaagttctcccaacttctttttttgttttcaagtgagtcccaactacttgattaaggggtaggtcagctttgagagacattctttgtaaaag

SEQ ID NO: 21972 - DNA, 85 bp, Homo sapiens
gttcgccctctggttagctgctgcttctgacttttccagagctggggcaaagggaagcaatgtaaagaaaattgaagggtcttac

SEQ ID NO: 21973 - DNA, 81 bp, Homo sapiens
cccagacccattattgttgcttcattgtacaggggattgattcattgggtcacatgtgcagcaacacatgttggagatggg

SEQ ID NO: 21974 - DNA, 66 bp, Homo sapiens
gcctggactatatctggctcaatatttcttttttaatgagaggcatgttgtgggctagaaagaggc

SEQ ID NO: 21975 - DNA, 77 bp, Homo sapiens
ttctgaatgtgagagcctctgtgactcacaggtcacacatccgtgaagctgtccttgataggggcactcagaaagaa

SEQ ID NO: 21976 - DNA, 101 bp, Homo sapiens
catcaaggtactggatggactgtcatgtcatctggaggtgcaggtggggaagaattcacttctgactcattcaggttgttggcagaatttgtccccttgtg

SEQ ID NO: 21977 - DNA, 83 bp, Homo sapiens
gcttaatagaagggaagtttgagcacaaattgtgggagttcaaaactgctatgatcttgagtttgcttttcattctgtatggt

SEQ ID NO: 21978 - DNA, 95 bp, Homo sapiens; identical to SEQ ID NO: 68

SEQ ID NO: 21979 - DNA, 93 bp, Homo sapiens; identical to SEQ ID NO: 69

SEQ ID NO: 21980 - DNA, 74 bp, Homo sapiens
gcctcactacggtccttgcacaggtgcccctgcacttcagagcctgcaactgtgtgtcggtctctctctcaggc

SEQ ID NO: 21981 - DNA, 79 bp, Homo sapiens
gcagacagaaaagagactgcttttgatatttgaaggtggggacatggatatttaaaataagtgctttctgcatgtttgc

SEQ ID NO: 21982 - DNA, 82 bp, Homo sapiens
atgctctgaatctctgtgtatcagtgaactcagaccctgtgcccggtcttgaaatctttggatattccctttttcacagcat

SEQ ID NO: 21983 - DNA, 58 bp, Homo sapiens; identical to SEQ ID NO: 10264

SEQ ID NO: 21984 - DNA, 112 bp, Homo sapiens
tattttgaagtatgtatgtatatatatgtatatatatgtgtgtatatgtatgtgtatatatatatatttatacacacacacacacacacatatatatatacacagtggaatg

SEQ ID NO: 21985 - DNA, 60 bp, Homo sapiens
ttgagatagagtctcactctgtcacccaggctggagtgcagtggtgtgatctcggctcaa

SEQ ID NO: 21986 - DNA, 104 bp, Homo sapiens
gtgggctctaatctgaccttacagccccgtcactgtggctctgtgtccctgtccagcatcagcacgtggcctcgggatatctcctggcttcagacttggctcac

SEQ ID NO: 21987 - DNA, 84 bp, Homo sapiens
tgtgtgaaatgagtaattgagtttgctttacatttatttatttatttatgtatttattgagacggagtctcgctctgtcacaca

SEQ ID NO: 21988 - DNA, 118 bp, Homo sapiens
atatatatatatatatgtgtgtgtgtgtgtatatatatgtgtacatatgtgtatatatgtgtgtacatacgtatgtgtatatatatgtgcacatacatatgtgtatatgtgtgtgtat

SEQ ID NO: 21989 - DNA, 79 bp, Homo sapiens
tgtggcaaccttgcattaagcatgtctactggtgtcatttttccaacagcatgggctcacttagtgtctctgtgtcaca

SEQ ID NO: 21990 - DNA, 73 bp, Homo sapiens
tgtcaaggaactgcatggattaggttgactctggatgaccctgggtagagacacattcagtttcctgctgaca

SEQ ID NO: 21991 - DNA, 90 bp, Homo sapiens
gtgtatgtgtgtatatatatatatgtgtgtgtgtgtgtgtttgtgcatatatacagatatacacccatatcacatacgtatacacacata

SEQ ID NO: 21992 - DNA, 85 bp, Homo sapiens
tgtgtctgtgtgtgtatatatgtatatttgtcaatacacctaaatttgtatgtttttatatatattatatatatatatggagaga

SEQ ID NO: 21993 - DNA, 59 bp, Homo sapiens
gacacagctacttgagaggcagaggtagaaggatgccttgagcctggcaggctgaggtt

SEQ ID NO: 21994 - DNA, 108 bp, Homo sapiens
gcgggttggttttgaattggggatgctgttttgatatatttatatacatacatgtatgtatgtatatatagttctgctaaactttcttaggatatttggaatcatggc

SEQ ID NO: 21995 - DNA, 90 bp, Homo sapiens
aatatatacccttttgattctaggtgagatttgttttctatgaatatatcttagtttgatatgtcttattggaagtaaagtgtatatatt

SEQ ID NO: 21996 - DNA, 113 bp, Homo sapiens
atatgtatatatgtgtgtgtgtatatatatgtgtgtgtgtgtatatatatatatgtgtgtgtgtatatatgtatacatatatacacacacacacacacacatacatatatata

SEQ ID NO: 21997 - DNA, 86 bp, Homo sapiens
tgtgtatatgtgtatgcatatgtgtatacttgtgtgtatgtttatacatatatgtatgtatgtgtatatatgtatctatatacaca

SEQ ID NO: 21998 - DNA, 109 bp, Homo sapiens
catatatgtacagatgtgtatatatgtgcatgtatacatgtatgtatatatgtgcatatatgcatgtatgtatatatgtgcatatatgcatgtatgtatatatgtgcat

SEQ ID NO: 21999 - DNA, 58 bp, Homo sapiens
tgagactgagtctcactctgtctcccaggctggagtgcagtggcgcgatctcagctca

SEQ ID NO: 22000 - DNA, 197 bp, Homo sapiens
tgtgtgcgtgtgtgtgtgtgtatatatatatatatacgtgtatatatatatatatatacgtatatatatatatacgtgtatatatatatacacgtatatatatatatacgtgtatatatatatatacacgtatatatatatgtgtgtgtgtatatatatatatatatatatatatatatatatatatatataggatg

SEQ ID NO: 22001 - DNA, 65 bp, Homo sapiens
catgtatgtttgtatgtatatgtgtatatatttgtatatgcataaatacatattctacatatttg

SEQ ID NO: 22002 - DNA, 78 bp, Homo sapiens
tgtagtatacatgaagcatttttttttatgtaacttggatacatagatacataaagaaaataatgctatgtgaagaca

SEQ ID NO: 22003 - DNA, 58 bp, Homo sapiens
tgagaccgtgtctcactctgtcatccagactggagtgcagtggcactacctcggctca

SEQ ID NO: 22004 - DNA, 72 bp, Homo sapiens
gtgtgagccactgtgcccggcttgatgtttctttattattagattcataagcatgtgtggtgggattaccac

SEQ ID NO: 22005 - DNA, 155 bp, Homo sapiens
tatgcacaattatatatatatgtatatatatgtgcatatatatatgtgtgtatatatgtgcatatatatgtgtatatatgtgtatatatgtgcatatatgtgtatatatatgtgtatatatatatatgtgtgtgtgtgtatatatatatatatat

SEQ ID NO: 22006 - DNA, 93 bp, Homo sapiens
gtctcatgtcagaagaatcaaatgtgtctgacacattcttagatagctcaataatgtgttaattacatttattttctttctagaaaatgagtc

SEQ ID NO: 22007 - DNA, 103 bp, Homo sapiens
gcaggtgcaagatgccaagaatgctatttttttttttttgagactgagtctcgctctgttgccaggctggagttcaatggtgtgatcttggctcactgcaacc

SEQ ID NO: 22008 - DNA, 90 bp, Homo sapiens
tttgatacatactcattgatgtgtatatatatatatgtgtgtgtgtatgtatatatatatgtgtgtgtgtatatacagtgtattatcaaa

SEQ ID NO: 22009 - DNA, 95 bp, Homo sapiens; identical to SEQ ID NO: 68

SEQ ID NO: 22010 - DNA, 93 bp, Homo sapiens; identical to SEQ ID NO: 69

SEQ ID NO: 22011 - DNA, 119 bp, Homo sapiens
gggcctaagttgtttttgggttgttgttgtttgtgagatggagtctcactctgtcgctcaggcttgagtgcagtggtggaatcttggctcactgcaacctcaacctcccgggttcaagt

SEQ ID NO: 22012 - DNA, 107 bp, Homo sapiens
gtgctggaattacaggcatgagccactgtgcccggcctcctaagtttttgtttaataaatgtgctaaataggccgggcacagtggctcacgcctataatcccagcac

SEQ ID NO: 22013 - DNA, 128 bp, Homo sapiens
tccagctttgttctttttgcttaggattgtcttggctgtatgggctcttttttggttccatatgaaatttaaagtagttttttctaattctgtgaagaaagtccatggtagcttgatgaggatagcaa

SEQ ID NO: 22014 - DNA, 58 bp, Homo sapiens; identical to SEQ ID NO: 315

SEQ ID NO: 22015 - DNA, 110 bp, Homo sapiens
agagatatatatctcagatatatatatctcagagatatatatcacatggtgtatatatatgtgtatatatatgtgagagatatatatatctgtatgtggtgtgtatatct

SEQ ID NO: 22016 - DNA, 150 bp, Homo sapiens
acacacacatatgtgagatatatatatgtgatatatatgtgagagatatatgtgaaatatatatgtatctatatatggtgtgtatatatatggtgtgtatatatatatatatggtgtgtatatatatctatatatggtgtgtatatatat

SEQ ID NO: 22017 - DNA, 71 bp, Homo sapiens
tgtcatatttatatatatatatacatacacatatatgtgtatatatgtatatatgtgtgtatatatagaca

SEQ ID NO: 22018 - DNA, 111 bp, Homo sapiens
ttgcttgtgattttataggctcataagcagaagggacttgccttgtctcagatgagactctggactgtggacttttgggttaatgctgaaatgagttaagactgtggggga

SEQ ID NO: 22019 - DNA, 98 bp, Homo sapiens
tatatatacacctagacatcatatatacctatgtgtgtatacacacatatatatgtatatattatacatataggtatatattgtatagactatatata

SEQ ID NO: 22020 - DNA, 92 bp, Homo sapiens
ctaacaggtataaggtgatatctcattgtggttttaatttgcatttccttgatgattagtgattttgaaaaaattatttatatacttgttgg

SEQ ID NO: 22021 - DNA, 102 bp, Homo sapiens
gcatttttaccacatgcatgccaacatctatttttttttgattttctaattatggtcattcttgcaagagaaaggtggtatcacattgtggttttgatttgc

SEQ ID NO: 22022 - DNA, 69 bp, Homo sapiens
tttcatgcaatgaagactgcaagaatattatatatttttaaaattcttgtatgtttttaattgatgaaa

SEQ ID NO: 22023 - DNA, 95 bp, Homo sapiens; identical to SEQ ID NO: 68

SEQ ID NO: 22024 - DNA, 93 bp, Homo sapiens; identical to SEQ ID NO: 69

SEQ ID NO: 22025 - DNA, 111 bp, Homo sapiens
aactattttttttgcatcccattttgtgcttctgtttcctttttcttttttttttttattattattatactttaagttttagggtacatgtgcacaatgtgcaggttagtt

SEQ ID NO: 22026 - DNA, 88 bp, Homo sapiens
tatatctcctagatatatatatctccaagatatatatatatatatcctagatatatatatctaggatatatatcaagagctttatctt

SEQ ID NO: 22027 - DNA, 77 bp, Homo sapiens
acgggcgcatgccaccatgcccagataatctttgtatttttgtagagatgagatttcaccatgttggccaggctggt

SEQ ID NO: 22028 - DNA, 116 bp, Homo sapiens
atacacatttatgggatacatgtggatggtatttcgataaatgcatatgaattgtaataagcaaatcatgttattcaggatatccatcaccttgaacatttatcatttctttgtat

SEQ ID NO: 22029 - DNA, 66 bp, Homo sapiens
gcctgggaactctgtgagcacactgccaatagttccaggtctcacaaatgagtttctgttttgggc

SEQ ID NO: 22030 - DNA, 86 bp, Homo sapiens
agccatatatatatactgtgtgtgtgtgtgtgtgtatatatatatatatatatatatatacacacacacacacacgtaatactgct

SEQ ID NO: 22031 - DNA, 129 bp, Homo sapiens
gtatatatatatacattatatatgtatacattatatatgtatacattatatatgtatacattatatatgtatacattatatatgtatacattatgtatacatatataatgtatatataatgtatatata

SEQ ID NO: 22032 - DNA, 158 bp, Homo sapiens
atacataatatataataatatataatatataatacataatatataataatatatattatataatatatattattattaatgtatacattatatatgtatacatatataatgtgtacatacatacatatataatgcatacatatataatgtatacatta

SEQ ID NO: 22033 - DNA, 69 bp, Homo sapiens
agctcacttggggctccatgtgtgtctgagcagctgctcttctaatactctgtgtagctctgtgtgtct

SEQ ID NO: 22034 - DNA, 67 bp, Homo sapiens
ggaagttcttggcatatatatatatatatatatatatatatatatatatatacacacaggttgttct

SEQ ID NO: 22035 - DNA, 95 bp, Homo sapiens; identical to SEQ ID NO: 68

SEQ ID NO: 22036 - DNA, 93 bp, Homo sapiens; identical to SEQ ID NO: 69

SEQ ID NO: 22037 - DNA, 63 bp, Homo sapiens
ggcccctgtctcagtgtctgtgggaaaagagcagcctaattcccacaagtgccagttagtgcc

SEQ ID NO: 22038 - DNA, 109 bp, Homo sapiens
tatttcttggctttgttggcatatctgaaggcatcagacaagacttctcactttatttatttatttttttttctgctttaggttgagttgaagaaagtcacaagacgtg

SEQ ID NO: 22039 - DNA, 213 bp, Homo sapiens
gttacttaacatctctgtgccttatttcccttatttacaaatggatataatattttttttttgtagagttgccatgaggttaaagtgagagaagatacacacagaattggtgacagattctggcatgtggtgttagcttttatttttgttattcataattttagatggaaatatgactctatacttgcttctaatcacagccagcatttattc

SEQ ID NO: 22040 - DNA, 95 bp, Homo sapiens; identical to SEQ ID NO: 68

SEQ ID NO: 22041 - DNA, 93 bp, Homo sapiens; identical to SEQ ID NO: 69

SEQ ID NO: 22042 - DNA, 86 bp, Homo sapiens
cagggacctttgtgtgcgggagagctccggttgagctccgctatggatgcccatcccagggctctctgtcactctgagaggctctg

SEQ ID NO: 22043 - DNA, 88 bp, Homo sapiens
gcagtgaaaatgttttatttatttgttttctaaacatctacagcgactaggaggtggccatgagatcagtgaatccaagtattcctgc

SEQ ID NO: 22044 - DNA, 111 bp, Homo sapiens
aatgtgtgtgttgtgtgtgtctgatatatatattaatatgtgtgtatctgatatataatatatattaatatatatatgacaagtatatatatatatatatacacacacaca

SEQ ID NO: 22045 - DNA, 114 bp, Homo sapiens
ataagcactaaaagtatatagtgtgtaggtgtgtgtgtatatatatgtatgtgtatatatatatatgtatgtgtgtatatatatacacacacacaaatgtgtacatgtgtatat

SEQ ID NO: 22046 - DNA, 78 bp, Homo sapiens
acagtgagctagtaggttttagagctgaggttcaggtcaagtgctgcttctacagccttcacctctaagccaagctgt

SEQ ID NO: 22047 - DNA, 94 bp, Homo sapiens
tgatcatttctctggcagtatagaagctttgagtttgatatagttctacttatttatttttgcttttgttgcctgtgcttttgagatcatatca

SEQ ID NO: 22048 - DNA, 71 bp, Homo sapiens
gctgtgtctactccactctgctgcggtagcatggaagcagcacagagaagacagaaatgagtgtgcacggc

SEQ ID NO: 22049 - DNA, 101 bp, Homo sapiens
tgtttcctaagtgtcttttgagtctatgttgattttatgataataatgctatttaattttaataaatcaaaacagatttgaaaataaaaaattaggtgaca

SEQ ID NO: 22050 - DNA, 109 bp, Homo sapiens
gagtacataaatcaagaattataaaaggggatattatttatataatttaaaggcaaaaatgcatttgtctttattattaagttattccatataattccagactgttgcc

SEQ ID NO: 22051 - DNA, 81 bp, Homo sapiens
tgccaccatttcacttccagctttagaattcccttgtacatttctggtaaaggagttctagtggtgatgattcccttggta

SEQ ID NO: 22052 - DNA, 102 bp, Homo sapiens
ggcttcagtgtttcagtgttgctatgagggtaaaatatgcatatatatatatatatatatatggtatctagcacatagtacatatctgaaaaaaaagcagct

SEQ ID NO: 22053 - DNA, 110 bp, Homo sapiens
cttaacaagctacagtgaccttggacaatttacttaacattttatgtttaatattttatattcaaaattgggataattcttgagcaaatgccataggtcattttgtgagg

SEQ ID NO: 22054 - DNA, 69 bp, Homo sapiens
ggagtctcactctgtcacccaggctggagtgcagtagtgcgatctcagctcactgtgacctctgcctcc

SEQ ID NO: 22055 - DNA, 113 bp, Homo sapiens
cataaatagtaagtatatacgtacatataagtatatatctagtgtgtatatataaatatgtgtatataagtacttatgtataatgtatgtatgtgtatatttatatatccatg

SEQ ID NO: 22056 - DNA, 99 bp, Homo sapiens
tcctaggtattttattctctttgtagcaatcgtgaatgggagttcactcatggtttggctctctgtttgtctgttatttgtgtataagaatgcttgtga

SEQ ID NO: 22057 - DNA, 108 bp, Homo sapiens
gctcacaactgtttggaagatagaggacttggaaaaggagatgaatatgtggattatttctatgtatttcaatttagagttggactgcttcaaaaagatagtcctggc

SEQ ID NO: 22058 - DNA, 74 bp, Homo sapiens
gctcctaacctctcctagtcactcagtcactgctcttggggaatgcccaagagctctggtgagtgggtgggggc

SEQ ID NO: 22059 - DNA, 104 bp, Homo sapiens
tatatagaataattacatatattctctatatagatatatatatctatagagaatatagagaatatagagaatatctatatagagagatatacatattctgtata

SEQ ID NO: 22060 - DNA, 133 bp, Homo sapiens
tggcactattgataaagaattatctggcacatttggggccagataattctttattatgagagctatcttgtgtgctgcaggatgtttagtagatttttggtttctatgcagtagacttcagtagcatccctca

SEQ ID NO: 22061 - DNA, 95 bp, Homo sapiens; identical to SEQ ID NO: 68

SEQ ID NO: 22062 - DNA, 93 bp, Homo sapiens; identical to SEQ ID NO: 69

SEQ ID NO: 22063 - DNA, 172 bp, Homo sapiens
aatatataggtttatatatgtatatatgtgcttatatatgtttaatatatcagtaaatatgtgtgtaaatatatgtgtttatatgtgtgtaatatgtgtatatatatggcatatatatctatgtatatctatctatttagacacacacacacacacatatatatgacactgc

SEQ ID NO: 22064 - DNA, 101 bp, Homo sapiens
gtgtgtgttggttggttgagagtgaattcagtggtgtgctggaccagtgcataatggcttgcaagaacatactgagcacatcttttgccatctttacattc

SEQ ID NO: 22065 - DNA, 56 bp, Homo sapiens
tatatacactatatatatgtatgtataacaatatatacactatatatatgtatata

SEQ ID NO: 22066 - DNA, 118 bp, Homo sapiens
gttttgttattcaatactaacatgcataaaatatggttcaagtcttaacaatttatatattgattgttaggaagccacatctagatttgtgctttgatatacatgggggaaaaaaagc

SEQ ID NO: 22067 - DNA, 110 bp, Homo sapiens
ggaggcctaccaagcagctgtcccaggcagcagactactgtatacagacagaaaggcctgatttcacagttgtcttttcctccatacccatgtgcgtagaatggtgcctg

SEQ ID NO: 22068 - DNA, 120 bp, Homo sapiens
tcctcatagaactcaacccctcggcatataaatattgaagtcagtttttctctctgtatctgactacggccctatatagcaagaactgttctcagtctcacttctatgccttttattgga

SEQ ID NO: 22069 - DNA, 121 bp, Homo sapiens
gacctcaatgaggaagctgatctgtaatttcaactacagcctggttagtgaatttgttcttgtttaggtctcaggagaaatacagaatagccaggcctatcactctgatttctcctacctg

SEQ ID NO: 22070 - DNA, 115 bp, Homo sapiens
gtgatgtgagtatatctatgtctctatatataatgtgtatatatatatatcatatagatttattgggattatatatatatatggattatatgtgtatataaaataccaatattat

SEQ ID NO: 22071 - DNA, 118 bp, Homo sapiens
cattttattatttagagctcaatatacattcatggtttttgtttttctttttttaaattgacacataacaattgtatatatttatggagtatatagtgaggtttggatatgtacaatg

SEQ ID NO: 22072 - DNA, 106 bp, Homo sapiens
gtagcctccagcatctttgtgtgtttatgtgtgtggtagaattcactgttacattttgtatattactttgaactgtccttatttgaagacatgaatgggagagtac

SEQ ID NO: 22073 - DNA, 118 bp, Homo sapiens
tgcaacatagttatctgctgttatattaggacaatactttttgcccattctatcttaatatatgaagaaaagcaatagatgtccattatcctactttaggtgaccatataccattgca

SEQ ID NO: 22074 - DNA, 78 bp, Homo sapiens
gggccaatcgatcaagctatgagactacttcctatgtgcccacgtgcatctgacctctctcagtctgagtggttgtcc

SEQ ID NO: 22075 - DNA, 103 bp, Homo sapiens
ggttttgatttgcatttctctgatggccagtgatgatgagcatttttttatgtgttttttggctccataaatgtcttcttttgagaagtgtctgttcatgtcc

SEQ ID NO: 22076 - DNA, 110 bp, Homo sapiens
taccagagttagaaagcattgggatatttgaacagtactttttaaaaaatttaatttaattttaagttctagggtacatgtgcaggatgtgcaggtttgttacataggta

SEQ ID NO: 22077 - DNA, 95 bp, Homo sapiens; identical to SEQ ID NO: 68

SEQ ID NO: 22078 - DNA, 93 bp, Homo sapiens; identical to SEQ ID NO: 69

SEQ ID NO: 22079 - DNA, 114 bp, Homo sapiens
gcttctggatgacactgcttcccgaggccacatgcttctttatatccccatatggattactttgctatggaatgtaaggaagtgtgtggtttcggcaagtgcctcctcgctggc

SEQ ID NO: 22080 - DNA, 99 bp, Homo sapiens
acagagtgagactccgtcccaaaaaaaaaaaaaagaagaacagagtcccaaatttaagtacttttttttttttttttttgagatcgagtctcactctgt

SEQ ID NO: 22081 - DNA, 58 bp, Homo sapiens
gagtgtggcatttttaagacaggacggagatcactctgtccctctgtgtgcctttttc

SEQ ID NO: 22082 - DNA, 72 bp, Homo sapiens
tgggtagacataggaagctacgtttcagttgaatccatttttttttaagacagggtctcactctgtcaccca

SEQ ID NO: 22083 - DNA, 58 bp, Homo sapiens
tgagacggactctcgctctgtcgcccaggctggagtgcagtggcgggatctcggctca

SEQ ID NO: 22084 - DNA, 90 bp, Homo sapiens
atatatatatatatatatattttatatgtacacattcatacacacacacgcttatatgtatacatatagtatgtatatgtgtatatatat

SEQ ID NO: 22085 - DNA, 96 bp, Homo sapiens
gccaggagttcgagaccagcctcggcatggtggcgtgtacctcagctactgaagaggctgaggtaggaggatcatttgaggctgggaggttgaggc

SEQ ID NO: 22086 - DNA, 118 bp, Homo sapiens
acagatgatccgtccttgtgttgtgctgcttgactaaaagcactgtttttttttttttttaatgataggatacagggtggcttttcagtctagtaaacaggaggaggggagagattgt

SEQ ID NO: 22087 - DNA, 123 bp, Homo sapiens
gcctccagttttgttctttttgcttaggattgtcttggctatgcaggctctttattggttccatataaaatgtaaagtagttttctccaattctgtgaagaaagtcagtggtagcttgatggg

SEQ ID NO: 22088 - DNA, 95 bp, Homo sapiens; identical to SEQ ID NO: 68

SEQ ID NO: 22089 - DNA, 93 bp, Homo sapiens; identical to SEQ ID NO: 69

SEQ ID NO: 22090 - DNA, 116 bp, Homo sapiens
gtggcatagcattccatggtgtatatgtgccacattttctttcttttttcttttttttttattattattatactttaagttttagggtacatgtgcacaatgtgcaggttagttac

SEQ ID NO: 22091 - DNA, 58 bp, Homo sapiens
tgagacagagtctcgctctgtcacccaggctggagtgcagtggtgcgatctcgtctca

SEQ ID NO: 22092 - DNA, 108 bp, Homo sapiens
atgtttgtagctgtttcctattgttgctcctttatttcttttttttcttccatttgtatggtgtattagtctagagggacagaactaataggatatatatatatatat

SEQ ID NO: 22093 - DNA, 62 bp, Homo sapiens
tctctctgtctctcaggctgctgctgcccaggctccaggagcccatcagagggaagtggaga

SEQ ID NO: 22094 - DNA, 155 bp, Homo sapiens
tatatatatatatatatatgttttatatgctctcatgtatatatatatatatatatatatatatatatatatatatatatatgctctattgtgtatatatatatgtatatgctcttatgtgtgtgtatatatatatatatatatatatatgtatg

SEQ ID NO: 22095 - DNA, 70 bp, Homo sapiens
ttttagtgaggcagagtctcactctgtcacccaagctggagtgcagtggtgcaatcctggcttactgaag

SEQ ID NO: 22096 - DNA, 89 bp, Homo sapiens
gttatgatcacgctactgcactctggtctgggcaacagagccagtctctgtctcaaaaaaacttatgttggtaatgtgattggaataac

SEQ ID NO: 22097 - DNA, 58 bp, Homo sapiens; identical to SEQ ID NO: 1265

SEQ ID NO: 22098 - DNA, 58 bp, Homo sapiens
ttgagatggagtctctctctgtcacccaggctggagtgcagtagtggcatgatctcgg

SEQ ID NO: 22099 - DNA, 58 bp, Homo sapiens; identical to SEQ ID NO: 2224

SEQ ID NO: 22100 - DNA, 56 bp, Homo sapiens; identical to SEQ ID NO: 335

SEQ ID NO: 22101 - DNA, 74 bp, Homo sapiens
gttgttgttgttgagagagtctcgctctgtcacccgggctggagtgcagtggtgcgatctcagctcactgcagc

SEQ ID NO: 22102 - DNA, 87 bp, Homo sapiens
caaacagccaggcacagtgggtcatggcttggagtcccggtcactcgggaggctgaggtagaaggatctcttgaacctgagagtttg

SEQ ID NO: 22103 - DNA, 121 bp, Homo sapiens
ggcatgacagcgtgcacctgtagtctcagctacttgggaggctgaggtaggaggatggcttgagcccaggaagtggaggttgcagtgagctgagattgtgccactgcacaccagcctgagc

SEQ ID NO: 22104 - DNA, 100 bp, Homo sapiens
tgtttgtgtcaggcctccccccagaacaggcagctttgcagagaatgagagagagagagagagatgctgttcgttggggagaaagtaaaggaagagaaca

SEQ ID NO: 22105 - DNA, 110 bp, Homo sapiens
tacggcaatatagttatttgcataagtgaaataagaatctgtttttatttgtaacaggacacaattggagaaactggttattttactgagtctttggctggaatggtgtg

SEQ ID NO: 22106 - DNA, 92 bp, Homo sapiens
tttgggttcttagaaggcgagacttgagaagatgaccttttagcaatgactatattaggtctttggttgtacaaagtcattaaggagccaga

SEQ ID NO: 22107 - DNA, 70 bp, Homo sapiens
gaatttagagccttcttgctaaaagagtgccactgctacggggctctcagtaaacacagagctctatctc

SEQ ID NO: 22108 - DNA, 75 bp, Homo sapiens
ctcttctttgggggcactctctgactgtctctcccacactctacacctgtggggttgactagatgctctgaggag

SEQ ID NO: 22109 - DNA, 66 bp, Homo sapiens
gttttgagactgagtctcactctgtcacccaggctggagtgcagtggtgagatctcagcttactgc

SEQ ID NO: 22110 - DNA, 75 bp, Homo sapiens
ttgtcaggctgtggctctctttctcacagagaatgccagaggcactcgggaaggcatttgccagggctctgacag

SEQ ID NO: 22111 - DNA, 118 bp, Homo sapiens
gcctatgtgacacagtgagactctgtctctaaaaaagaaaaacaagctaaaagatgttgaatgatttattgtttttagatttttggagctttcaggaagcctacagattacaaagtgc

SEQ ID NO: 22112 - DNA, 72 bp, Homo sapiens
ctcagcatcggaggcctggacaatagttttttaactaactgattactgtctggctgactgtttgccctagag

SEQ ID NO: 22113 - DNA, 98 bp, Homo sapiens
gctcagtctgaaagtaaatgaataaaaaatatggtggtcatttcagagcattgttgactgctaagtgctttgtgcatcatcttctcacaaaagtgagc

SEQ ID NO: 22114 - DNA, 58 bp, Homo sapiens; identical to SEQ ID NO: 7074

SEQ ID NO: 22115 - DNA, 87 bp, Homo sapiens
cagccccaatcctattagtcatgcgtcgtcattaatatacatctattccagggatatgtcaggcagcaatgaggtcggagggggctg

SEQ ID NO: 22116 - DNA, 80 bp, Homo sapiens
gataggagaaataataggaaatagtagagtttattacaaatactgaggtaataaactctctgtgtctgtatgtgtgtgtt

SEQ ID NO: 22117 - DNA, 71 bp, Homo sapiens
cccaagtagctgggattacaggtgcgtgccattgcctggttaatttttgtatttcttaagtggagattggg

SEQ ID NO: 22118 - DNA, 91 bp, Homo sapiens
gatgaaaaaattgcctcagtctcactgggtggctcgcatgcaatattctctagagcacactgtgggtggcctgatcctgttaaaagtcatc

SEQ ID NO: 22119 - DNA, 121 bp, Homo sapiens
ggccctcacagcaagggaagggagagctgcagggtctcccaagcccagacctggaaggggctcacagtctgtctatctgtctgcttagatgccactagcaagaggaaggtcatgtggcccc

SEQ ID NO: 22120 - DNA, 104 bp, Homo sapiens
ccaaaattgtaaaaatatgaaaggagatagtcaagagacttaaaatatttcagctgctgaaatgattatgatcttgagtaagcatctcttattaacaatttagg

SEQ ID NO: 22121 - DNA, 95 bp, Homo sapiens; identical to SEQ ID NO: 68

SEQ ID NO: 22122 - DNA, 93 bp, Homo sapiens; identical to SEQ ID NO: 69

SEQ ID NO: 22123 - DNA, 81 bp, Homo sapiens
gtatatatatatgtgtgtgtatatatatgtatgtgtgtatatatatatatgtatgtgtatatatatagatatatatgcaca

SEQ ID NO: 22124 - DNA, 96 bp, Homo sapiens
ttggcttgtagatggctgccttctctgtgtgtgtgtctgtgtcctaatatcctcatctatgacaccagtcattggattagggcccatcccaatcac

SEQ ID NO: 22125 - DNA, 113 bp, Homo sapiens
tgcttttcttccacagtgattttaaatcacttcaagcacttgagttttttttcattaaaaaagacctacctcataatgttgttgtgaagaataactgagagagaatatggaca

SEQ ID NO: 22126 - DNA, 116 bp, Homo sapiens
gtttcattccactgtgttcagaaaagatatttgatatgatttctgtatttttaaatttgttaaaacatgttttgtgacacagcatatgatctattctggataatatatgtgtgtgc

SEQ ID NO: 22127 - DNA, 115 bp, Homo sapiens
ggattttcataggaattgtattgaattcatggattaatttgaagattatttctattttaacaagattgaatcttccaatccataaacacagaatatcttttaatttaggtagtcc

SEQ ID NO: 22128 - DNA, 72 bp, Homo sapiens
tatatatgtatacttataagtatatatacatatatatgtatatatgtgtatatatgtatgtgtacatatata

SEQ ID NO: 22129 - DNA, 86 bp, Homo sapiens
gtgtgtatgttaaatgtgtatgttaatttaactgatcccacttttgattgggagcagttattttaatataattttaatgaacattc

SEQ ID NO: 22130 - DNA, 78 bp, Homo sapiens
ggcttgctgtttccctggacaccaattcttatgtcgactggttgctgacattttgttgatgtcttggagtcacaggtc

SEQ ID NO: 22131 - DNA, 113 bp, Homo sapiens
atacacacacacacacacacacacgtatatatgtaaatacatgtatatatatacatatatgtgtgtgtatgtgtgtgtgtgtgtgtgtgtgtgtatgtatatatatatatata

SEQ ID NO: 22132 - DNA, 112 bp, Homo sapiens
catacacacacacacacacacacacacatacacacacatatatgtatatatatacatgtatttacatatatacgtgtgtgtgtgtgtgtgtgtgtatgtatgtatgtatgta

SEQ ID NO: 22133 - DNA, 118 bp, Homo sapiens
ctatccatatccaaatatatttgtcagtatatgaatgtgtctttatgtatgtaggtttatgtatatgaatatatatatttatatatggacatatttactattgttgggtaaatggtag

SEQ ID NO: 22134 - DNA, 117 bp, Homo sapiens
agagagctgactgcattgatgtgttcttttgttgatcctctttataattctttttttttttttttaaaaagaattgaaaagggcatcaaaactacagatacgattcgtcagcttgct

SEQ ID NO: 22135 - DNA, 118 bp, Homo sapiens
ccattttagtagaggaataagagcttatcaaaattaatatttcaattagtaatgtcattatttgttagtatttctaattactaaaataaaggattgggttgataagtagttccttggg

SEQ ID NO: 22136 - DNA, 114 bp, Homo sapiens
aagatagcttagactacatatcactttctccaatacacacacacacacacacacacacacacacacacacacgtgtgtataggggagaaatgagtactgtattagtagcatttt

SEQ ID NO: 22137 - DNA, 74 bp, Homo sapiens
tttcaattacatgaatatatgtatatgtgtgtatgcatgcatatattatatacatatatatatggagagagaaa

SEQ ID NO: 22138 - DNA, 69 bp, Homo sapiens
gaatgtgatgattcagtgtatatatatgtatatacatatatgtattgtattgtaatgattatcacaatc

SEQ ID NO: 22139 - DNA, 79 bp, Homo sapiens
tatacactttatgcacatagcttgaagataattttattcaatattttcaataatttgtgcatgaagcaaagcttgtata

SEQ ID NO: 22140 - DNA, 75 bp, Homo sapiens
gccagtaagtgacagcagagactgagggctccacgtaagacgccagccctgtttctgaagtttgaaaaggtgctg

SEQ ID NO: 22141 - DNA, 76 bp, Homo sapiens
gttccattttgtattagaaaaatgtgtgatttcaggcaagctaagtcactctgtttctctgtttgtaaaatgggat

SEQ ID NO: 22142 - DNA, 108 bp, Homo sapiens
gagatttctcaacaatatggtttatctaaggattgttatgtgagggaagaataaattaattttttctttaagtcaaaatatttgggagcttctttgttgtagtagctt

SEQ ID NO: 22143 - DNA, 67 bp, Homo sapiens
tggtttttgagacagtctcactcgctctgtcacccaggctggagtgcagtggcacgatctcggttca

SEQ ID NO: 22144 - DNA, 81 bp, Homo sapiens
caggcctctgtgtctctctgacagtctcctctcaaatctctctagagtctgtgagactacagctccgagaaatgcttcctg

SEQ ID NO: 22145 - DNA, 105 bp, Homo sapiens
gtcctataaaggaacataatttcattgtttatagatattttcatctttgtgtgtttgtgtgtgtgtgtgtgtgtttgtgtatgagagtggttctctttatgaagc

SEQ ID NO: 22146 - DNA, 91 bp, Homo sapiens
ggccactcctgttatgtttactgtttgattgctctactgctggagagagagagagagagagagagagagagagtgtgtgtgtgagtgtgtc

SEQ ID NO: 22147 - DNA, 106 bp, Homo sapiens
gtactcttttccctacccctgcccctttaaaattacagtttttgatgtttatgtacatatgtttctaggcaggaacgtaggatgaggaggaggtagaagagagtat

SEQ ID NO: 22148 - DNA, 61 bp, Homo sapiens
ctgtgtctgtctctgcctggctccataaaagcaatggaggcagcagaatatccagacacag

SEQ ID NO: 22149 - DNA, 78 bp, Homo sapiens
tttaattatatatatacacacacacatatatatgtgtatatgtgtatatatatgtgtgtgtgtatatatatatagaaa

SEQ ID NO: 22150 - DNA, 114 bp, Homo sapiens
tgcttaggattgtctcggctatacgggctcttttttggttccatatgaaatttaaagtagttttttctaattctgtgaagaaagtcaatggtagcttgatggcgatagcactga

SEQ ID NO: 22151 - DNA, 108 bp, Homo sapiens
gcctccagaggtagttttgactctatttctccacagtacattctttttttttccgaattttttttttttttttttttttgagatggagtctcactccatcgtgtaggc

SEQ ID NO: 22152 - DNA, 93 bp, Homo sapiens
agaggcaagaaacctaaaatccaaaacaggaggaaaaggtagctttagcctacttctatttttttttttttttttgagaaggagtctcactct

SEQ ID NO: 22153 - DNA, 182 bp, Homo sapiens
acacacacatatacatatatacatatataacagtgtgtgtatatatgtgtatatatgtatatgtatgtgtatatatatgtgtgtgtatatatatacacacatatatgtgtatacgtatgtgtgtatatatatacacacatatatgtgtatatatatatgtgtgtatatatatacacagaaac

SEQ ID NO: 22154 - DNA, 116 bp, Homo sapiens
gctctgtcataaagcctagtgcaaaagaaaactacttgactactatatgtttatgaatataagcacttggtttaatttcacatatgttttccagcataatttggcttcaagtaagc

SEQ ID NO: 22155 - DNA, 95 bp, Homo sapiens
catccccaaatagaagcattctgtcattctctcagtccttccatttgtggaaggattttgatcaaagagtgtttttgctttttatttatttagtg

SEQ ID NO: 22156 - DNA, 82 bp, Homo sapiens
gttgttgttgttttttgagatgagtctcactctgtcacccaggccggagtgtaatggcatggtcttggctcactgcaacctc

SEQ ID NO: 22157 - DNA, 84 bp, Homo sapiens
ggaacagtcatcagagtaaagagacagcccacaaagtgggagagaatctgcacaatctatacatctgacaaaggactaatatcc

SEQ ID NO: 22158 - DNA, 79 bp, Homo sapiens
cactgtggtctgagagtatggttcatataatttcaatttttttgaatttattgagatttgctctgtggccaggcatgtg

SEQ ID NO: 22159 - DNA, 110 bp, Homo sapiens
tagatgttgtgactgagttaaatttgagtttctgaggtaaaagttataagttacatagttgtttttatttttattttttgagacggagtctcactctgtcacacaggctg

SEQ ID NO: 22160 - DNA, 83 bp, Homo sapiens
gtgctgtttctattcatattggatatggtattctatggtattggctatagatacatacattttaaaatgttatttaacagcat

SEQ ID NO: 22161 - DNA, 94 bp, Homo sapiens
gtacagtacataacacttgaaaattataataaactctggtactggtttatgtatttactatactttttattattattttagagggtactgctac

SEQ ID NO: 22162 - DNA, 95 bp, Homo sapiens; identical to SEQ ID NO: 68

SEQ ID NO: 22163 - DNA, 93 bp, Homo sapiens; identical to SEQ ID NO: 69

SEQ ID NO: 22164 - DNA, 58 bp, Homo sapiens
tgagatggagtctcgctctgtcactcaggctggagtgcagtggtgcgatctcagctca

SEQ ID NO: 22165 - DNA, 111 bp, Homo sapiens
tgtgctcttttagaactttcgtttatctttgtaaagagaaaataatacaaggcattcactgtggcactcacagtctgctttctctaaggacaagcctatctatactcaaca

SEQ ID NO: 22166 - DNA, 117 bp, Homo sapiens
ggggtctggtcaggggaagattgtagtgtgattaatttaaatttaatttttttatggaccctaaaaattgaacctaaaatttgcaatacatctgtttttctcacattctgtggcttt

SEQ ID NO: 22167 - DNA, 59 bp, Homo sapiens
ctccatcctcacacactcagcctctgcctcaggtggcaggggccctggctagggtgtgg

SEQ ID NO: 22168 - DNA, 99 bp, Homo sapiens
atagctggatatggggtgcacacctgtggtcccaactacttgggaggctgaggtaggaggatcacttgagctgggaaggttgaggctgcaatcagctgt

SEQ ID NO: 22169 - DNA, 80 bp, Homo sapiens
gtatacagtatatatgtatgtataatacacatgtatacatgcatatatgtgtgtatatacacacatatatacatgtatat

SEQ ID NO: 22170 - DNA, 82 bp, Homo sapiens
tttgtttatgagaatttcagtgcatactatgtgtctgtgcatgtttgagtacatgtgcatgtgttttgtttatataagcaag

SEQ ID NO: 22171 - DNA, 82 bp, Homo sapiens
agttttagggtacatgtgcacaacgtgcaggtttgttatatatttatacatgtgctatgttggtgtgctgcacccattaact

SEQ ID NO: 22172 - DNA, 163 bp, Homo sapiens
tacacacacacacacatgtatatacatatacatatatgtgtgtatatatatatgtatatgtgtgtgtatatatgtatatacgtatgtatatatgtatgtgtgtatatatatacatacatatatacatacgtatatacatatatacacacacatatacatatat

SEQ ID NO: 22173 - DNA, 79 bp, Homo sapiens
tagactccataccaaaatgtgtattagggttctccagagaacggaaccactagtgtgtgtgtgtgtgtgtgtgtgtgtg

SEQ ID NO: 22174 - DNA, 94 bp, Homo sapiens
tatatactcatatatatcgatatatctatatagacatagatatagatatctatatctatatatctatatctatatcgatatatatgagtatgtg

SEQ ID NO: 22175 - DNA, 118 bp, Homo sapiens
tttgtattgcactgtggtgtgagaatgtgcttggtatgatttcaatttttttcaatgtattgagacttgctgtatgactgagcatgtggttgatcttagaatatgttgcatgtacaga

SEQ ID NO: 22176 - DNA, 95 bp, Homo sapiens; identical to SEQ ID NO: 68

SEQ ID NO: 22177 - DNA, 93 bp, Homo sapiens; identical to SEQ ID NO: 69

SEQ ID NO: 22178 - DNA, 76 bp, Homo sapiens
gttgttttgttttgagacacagtctcgctctgtcaccaggctggagtacagtggagcgatctcagctcactgcaac

SEQ ID NO: 22179 - DNA, 107 bp, Homo sapiens
ctagtatatatgtatatagtactaatatatattattagcatgtatgtatgtatgtatgtatgtgtgcatatatgtataatactatataaatcactagcagatattag

SEQ ID NO: 22180 - DNA, 112 bp, Homo sapiens
tattactcccaatattgcagggggtggacaccccctctgtgatattgttcttaatatccaatgaaaatgagtatgatattactcccaatatcgcaaagcgtgtacactcctt

SEQ ID NO: 22181 - DNA, 118 bp, Homo sapiens
aaaaggtatttgttggttaggctccttaactaatgttgtagttttaaaacatcacttcaacttttattttgtttaatattactatttggtttatccaggagtaacccaatgctctttt

SEQ ID NO: 22182 - DNA, 81 bp, Homo sapiens; identical to SEQ ID NO: 21542

SEQ ID NO: 22183 - DNA, 119 bp, Homo sapiens
gtatctgcacatgcatatgtacatacatgcatgtacatgtgaatacacgtgtatgtatacatgtatgtacacctgtgtgcacatgcctctacatatctgtataactatatgtgtgtgta

SEQ ID NO: 22184 - DNA, 108 bp, Homo sapiens
agcaactggtatatagtaactaggtggcctgatggtcttcataataaagttatattttactttagtataaaataaaaggtcaaggcttgtaactgtcatgagactgct

SEQ ID NO: 22185 - DNA, 70 bp, Homo sapiens
ccgtgcctggctgatactagcattcttttttttttttaaagatagagtcttgctctgttgcccaggctgg

SEQ ID NO: 22186 - DNA, 125 bp, Homo sapiens
cctgggcaacagagtaagaccccaactctataaaaaggatttttttttgagacagtctcactctgtcacccaggatagagtgcagtggcatgatctcaattcaccgcagcccctgcctcctgggt

SEQ ID NO: 22187 - DNA, 108 bp, Homo sapiens
ccttggtgggaggcccagattttttatttatttatttatatttatttatttatttatttatttatttatttatttatttattgtgatgatctcactctgtcacccagg

SEQ ID NO: 22188 - DNA, 116 bp, Homo sapiens
atacacacatactcatatatatcgatatagatataggtatatagatatagatatctatatctatatctatatctatatagatatatcgatatatatgagtatatataagtgtgtgt

SEQ ID NO: 22189 - DNA, 90 bp, Homo sapiens
ctggagtcagcagaggttgttgggaggcagggctggaaaagacaatgacaggtttcagaatgagctcacaggctctgctcactctcccag

SEQ ID NO: 22190 - DNA, 95 bp, Homo sapiens; identical to SEQ ID NO: 580

SEQ ID NO: 22191 - DNA, 93 bp, Homo sapiens; identical to SEQ ID NO: 69

SEQ ID NO: 22192 - DNA, 118 bp, Homo sapiens
tttgtattgcactgtggtgtgagaatgtgcttggtatgatttcaatttttttcaatgtattgagacgtgctttatgactgagcatgtggttgatcttagaatatgttgcatgtgcaga

SEQ ID NO: 22193 - DNA, 69 bp, Homo sapiens
gtccttccctctgtgtgtgtctctgtccaaattcttccaataaggacaccagtcatactggattaggac

SEQ ID NO: 22194 - DNA, 112 bp, Homo sapiens
ggattatcttggcaatgtgggctcttttttggttccatatgaaatttaaagtatttctttctaattctgtgaagaaagtcaatggtagcttgatggggttggcatttaatct

SEQ ID NO: 22195 - DNA, 101 bp, Homo sapiens
gtatatacatattactagtatatatgtatatagtactaatatatattattagcatgtatatatgtatgtatgtgtgtatatatgtataatactatatagat

SEQ ID NO: 22196 - DNA, 87 bp, Homo sapiens
atctgctccaactatctaggactaaagcctatgtatttatgtactacacaataggtttatagacctagaaatggattttagtaagat

SEQ ID NO: 22197 - DNA, 89 bp, Homo sapiens
gcgggctctgttttggttccatgtgaacttcaaagtatttttttttccaattctgtgaagaaagtcattggtagcttgacggggatggc

SEQ ID NO: 22198 - DNA, 95 bp, Homo sapiens; identical to SEQ ID NO: 68

SEQ ID NO: 22199 - DNA, 93 bp, Homo sapiens; identical to SEQ ID NO: 69

SEQ ID NO: 22200 - DNA, 110 bp, Homo sapiens
tctgagtctattcagtatgtttattaaagaagaaagtgattctatttacatttttaaaatgttacttttgtaaaaaacatgttttgagaagctgttgaatggaataaaga

SEQ ID NO: 22201 - DNA, 117 bp, Homo sapiens
agtgtgcaagtgttctcttcttcacagcctcaccagcatgttagtttttgaattttttataataaccatccttactgttatgagatggtgtctcattgtggttttgatttgcatatt

SEQ ID NO: 22202 - DNA, 113 bp, Homo sapiens
cgggtccaggcatttgagaaatacttggtgaattaacatgagtctggaaacacatcagaattatgatttttttttaagcaaaccagtaattctctttggtaatggatagtacg

SEQ ID NO: 22203 - DNA, 78 bp, Homo sapiens
tctctctctgtctttctctagagacaggtggttgcagtatgttaaccccaagatgtatttggagtgtgaagagggaga

SEQ ID NO: 22204 - DNA, 102 bp, Homo sapiens
tgtgacgatcaaagtgtctgtgagtacagaattgttcattatttatatagcaacataaatgcatgcagcaatttactatacatagcacctgctgaacaaaca

SEQ ID NO: 22205 - DNA, 62 bp, Homo sapiens
tatatatatataggttccatatatatatatatatatatatatatatgttccatatatatata

SEQ ID NO: 22206 - DNA, 120 bp, Homo sapiens
gctactgaattttgtatattgattttgtatcctgcaactttactgaatttgttgatcagttctaatagttttttggtggagtctttaggtttttaatacaagatcatatcatctgcaagc

SEQ ID NO: 22207 - DNA, 95 bp, Homo sapiens; identical to SEQ ID NO: 580

SEQ ID NO: 22208 - DNA, 93 bp, Homo sapiens; identical to SEQ ID NO: 69

SEQ ID NO: 22209 - DNA, 84 bp, Homo sapiens
agagagatccctgccaaaatagtaaaaagttatatattttttgagttttgaagtgtaaatctgctttgtttggaggtttcctct

SEQ ID NO: 22210 - DNA, 111 bp, Homo sapiens
ctttgtgatgtgtgcatttatctcgcagagttaaaactttccttacattcagcagtttagaaaactgattttgtagaatctgtgaagggatatttgggagcacattgaaag

SEQ ID NO: 22211 - DNA, 117 bp, Homo sapiens
cttttattgtgttgtggtctaagagtgtgcttggtatgattttgtatttttttaaatttgttgagaattgttttacagctgagcgtgtggcctatttagaatacatgcaatgtacag

SEQ ID NO: 22212 - DNA, 57 bp, Homo sapiens
cactgatgcaagaggtgggctcccacaaccttggaaagctctgtctctgtgtctttg

SEQ ID NO: 22213 - DNA, 95 bp, Homo sapiens; identical to SEQ ID NO: 68

SEQ ID NO: 22214 - DNA, 93 bp, Homo sapiens; identical to SEQ ID NO: 69

SEQ ID NO: 22215 - DNA, 64 bp, Homo sapiens
agatatatgtgtgtatatatgtatagacatgtatgtgtatgtatatgtgtatatatatatgtgt

SEQ ID NO: 22216 - DNA, 118 bp, Homo sapiens; identical to SEQ ID NO: 22181

SEQ ID NO: 22217 - DNA, 95 bp, Homo sapiens; identical to SEQ ID NO: 68

SEQ ID NO: 22218 - DNA, 93 bp, Homo sapiens; identical to SEQ ID NO: 69

SEQ ID NO: 22219 - DNA, 106 bp, Homo sapiens
tgaatatatttgcagacttcctgtttggctttcaaatttcttatcttttatttattaacttatagaagatgtatatttctttatggctaggaacttagtgtgttca

SEQ ID NO: 22220 - DNA, 90 bp, Homo sapiens
tgtcaattgcctttctctttgtcttctcatttccccatatggtattgcgaaaatgacacaagacactgagaagataggagcatgatgaca

SEQ ID NO: 22221 - DNA, 103 bp, Homo sapiens
tatgtaacagagtcaggttacatactgccatatgatttctttattattattatttttattttaacttttaggttcaggggtacatgtgcagctttgttacata

SEQ ID NO: 22222 - DNA, 78 bp, Homo sapiens
cctgtcttgtattatattttcattatttttgtttctaaaaacaatttaatgagtaaggtttaatacgtgactgatagg

SEQ ID NO: 22223 - DNA, 121 bp, Homo sapiens
gcttcaggttgctaccttggaagtagaagccactcttatattgcatctcagacctggcatcactgggctccaggacagtgtgcagtccattgggtgcagggctctaaaatggtaccttgct

SEQ ID NO: 22224 - DNA, 82 bp, Homo sapiens
gtgtgtgaatgtgtgtgtctctgtgtgtatgcctgcatagaaatgtgcgtgtgtctacatatacacatatatatacatatac

SEQ ID NO: 22225 - DNA, 114 bp, Homo sapiens
gtatgtagacatatttatgtatatatacacatacatacttatgtatacatatatatgtatatatacacatacatacttatgtatacatacatatgtgtatatacacatacatac

SEQ ID NO: 22226 - DNA, 68 bp, Homo sapiens
atacacacgtatatgtgtatacatacatatatgtatacatacatgtatgtatatatgtatgtgtgtat

SEQ ID NO: 22227 - DNA, 114 bp, Homo sapiens
tgtatacatatacgtgtatatatacacatacgtatgtgtatgtatacatatgtgtatatatacatatgtgtatatatacacatatgtatgtatgtatacatgtgtatatataca

SEQ ID NO: 22228 - DNA, 132 bp, Homo sapiens
atgtgtatatatacacatatgtatgtatacatgtgtatatatacacgtatgtatgtatgtatacatgtgtgtatatacacgtatgtatgtatgcatacatgtgtatatacacgtatgtatgtatgcatatat

SEQ ID NO: 22229 - DNA, 111 bp, Homo sapiens
gcatatatatgtatatagcagatatacacacacacacatatatgtgtatatatatgtatttgtgtatatatatatgtgtgtgtgtgtatacacatatatatatatatatgt

SEQ ID NO: 22230 - DNA, 100 bp, Homo sapiens
aggatcttaagatgagaatacagtataatagtttttgttttgctattatagtagtgggaaaataactttaatgtgtactgattttcaccataagatatct

SEQ ID NO: 22231 - DNA, 95 bp, Homo sapiens; identical to SEQ ID NO: 580

SEQ ID NO: 22232 - DNA, 93 bp, Homo sapiens; identical to SEQ ID NO: 69

SEQ ID NO: 22233 - DNA, 86 bp, Homo sapiens
gtgattgtgagtgagttctcagaggtctgatggttttataagtgtctagcgtttcccctgctgtctctcattctctctcctgtcac

SEQ ID NO: 22234 - DNA, 214 bp, Homo sapiens
tatatacacacatatatatgtgtgtgtgtatatatacatatatatacatatatgtatacgtatatatacatatatacatatatgtgtacgtatatatacacacatatatgtgtgtatatgtatatatacacacatatatgtgtatatataaatataaatgtgtatatatttatattcatgtatacatatatatatatatatatatatatatatg

SEQ ID NO: 22235 - DNA, 97 bp, Homo sapiens
tggcataaaaacagaaatatagactagtggaacataacatggagtccagacatgaatctatacatgtatgttcaattgttctttgacacaggtgcca

SEQ ID NO: 22236 - DNA, 64 bp, Homo sapiens
cctgctcatttgctgggaaaggaggaagagtgccagcacgcagtctgtgttcatgctgagtggg

SEQ ID NO: 22237 - DNA, 109 bp, Homo sapiens
gttctgaaagagattaccttgttcagttctccacttgtaaggatgtaatttttaagggaaatatatttttcttttttcctcagtgctactgaagactgtattttggaat

SEQ ID NO: 22238 - DNA, 107 bp, Homo sapiens
tatgtacattgaacatcagaaagcaaaggtgtcactctgtcagccacacttgtggacaatgtatgattgtctggcatcactgtcatttctgactctaaatttacatg

SEQ ID NO: 22239 - DNA, 98 bp, Homo sapiens
ctgcctgtgccccgtcacagagttctgatttccttgtttttagctgtggcctgagtatcactatatttcagaactccctgtgtgattttaaaatgcag

SEQ ID NO: 22240 - DNA, 85 bp, Homo sapiens
gctccaggcactgaaaacagattctgttcttctgtaaaagaagaacaagcattttcagaatctaatttcttatttgcttgcttgc

SEQ ID NO: 22241 - DNA, 106 bp, Homo sapiens
ggaaagtaataattgaaggcacaaattattgggcacctaatgcaatgaacagatgaatggacatttccacatgcttaattattctttagttgtgatgaatctttcc

SEQ ID NO: 22242 - DNA, 78 bp, Homo sapiens
gatattgttacagtctcaccaatgcaacacaatgtggcagtctgtcactgtgtgaggtgtcacctgaaattatttgtc

SEQ ID NO: 22243 - DNA, 110 bp, Homo sapiens
tttttaatgttatgcatatactatgcagggtaagttaattatattataacttaatttatcattataattatattaacttaccttggatagtatatgtataatattaaaaa

SEQ ID NO: 22244 - DNA, 142 bp, Homo sapiens
ttgctgatatattgtgatagtgaggtctcacaagatctgatattttaaaagtatggggtactttctgtcactctctctgtctctcctggcaaaatgggaagaaggtgcttgcttcccattcactttctgtcataattgtaag

SEQ ID NO: 22245 - DNA, 160 bp, Homo sapiens
atatatgtattatatgtgtgtttgtgtatgtatataatatactattgtactaatagtatatatatatatactttatatatagacagagtatatgtataatgtgtgtgtgtgtatatatatgtatatatacacacacatatatgtgtgtatatatatgggg

SEQ ID NO: 22246 - DNA, 80 bp, Homo sapiens
tatgtttatatatatttcatatgtgtgtgatgtatacatatatatacacatgaaatatatgctatatacacacacatatg

SEQ ID NO: 22247 - DNA, 78 bp, Homo sapiens
ctgggagtttacaggcatgagccactttgcccagattattattatttttttgagacatggtctcactctgtcacccag

SEQ ID NO: 22248 - DNA, 70 bp, Homo sapiens
gggccttctcctctgtctctgtgtgttccctcctcttcctgtagggataccagccattggattcgggtcc

SEQ ID NO: 22249 - DNA, 100 bp, Homo sapiens
gccactgtgcctctgggccacagatgagtttttatttatttttatttttattttgagacggagtttcactcttgttgcccaggctggagtgcaatgatgc

SEQ ID NO: 22250 - DNA, 68 bp, Homo sapiens
ggtgatcagaaaaggttctttttaaaatttatttttattttttgagatggagttttgctcttgtcacc

SEQ ID NO: 22251 - DNA, 57 bp, Homo sapiens
gttgagacagagtctcgctctgtcacccaggctggagtgcagtgacacaatctcggc

SEQ ID NO: 22252 - DNA, 118 bp, Homo sapiens
gttctttggtgatgctgatgatactaggtgtgggaaccgcattttgagaagtaataatatttatttatttatttatttttatttttgagatggagtctcactctgtcacccaggctgc

SEQ ID NO: 22253 - DNA, 116 bp, Homo sapiens
cttctgtagctccttgtcttatggcagcataactccaaccttttttttaaagttttattttaagttcaggggtacatgagccggttggttatataggtaaacatgtgtcacaggag

SEQ ID NO: 22254 - DNA, 126 bp, Homo sapiens
gttacattgggtatatatatatatacacacgtatatacacgtgtgtatatatatatatatatacgtgtatacatatatgtgtatatatgtgtatttatatatatatacgtgtatttatatatgtgt

SEQ ID NO: 22255 - DNA, 103 bp, Homo sapiens
gtttggttggtttttttttttttttttttttttgagacaagatctcactctgtcacccagaatggagtgcagtggtgtgatctcggctcaccacaacttccgc

SEQ ID NO: 22256 - DNA, 109 bp, Homo sapiens
aatgacgagttagatggttccctgaatttgtctttggaagctttataatttttttctttatgtttggtgttcagaaatttcaagaggatgtgctggctcagtagttatt

SEQ ID NO: 22257 - DNA, 85 bp, Homo sapiens
tccaatcttggggtagaaaagttatttttgtttgtttggtttttttttttttgaaacagactctcgctctgttgcccaggctgga

SEQ ID NO: 22258 - DNA, 91 bp, Homo sapiens
tatgcaatatgtaatattatatatatgtatgtatgtgtacattgatatatatgtatatatgcatagatatgtgtcatgtaatatacacata

SEQ ID NO: 22259 - DNA, 81 bp, Homo sapiens
atactattgttaactaaagtagatactttatattagagttcactctatgttgtaaagttctgtagcttttggcaaatgtat

SEQ ID NO: 22260 - DNA, 93 bp, Homo sapiens
tgcatatatatatgtatatatatatatgtgtgtatatatgtatatatgtgtgtatatatgtatatacacatatatgtatatacatatatgtgt

SEQ ID NO: 22261 - DNA, 110 bp, Homo sapiens
tctttccacatagttccatatttcttggaggctttgtctgttccttttcattcttttttttttgaaatggagtctcactctgtcgcccaggctggagttcagtggcagga

SEQ ID NO: 22262 - DNA, 84 bp, Homo sapiens
aggatgctattgacagtaggaccacagagttttagttatgttatatataactatatatattagtcacactgataatttgcacct

SEQ ID NO: 22263 - DNA, 91 bp, Homo sapiens
tactttcaaggagtgtgaatggaaagatgtgaggttatgttattttttaatatatcctttatgacacatattttagcacttaatatgtgta

SEQ ID NO: 22264 - DNA, 118 bp, Homo sapiens
tctatctatctatatatagatctatccatatatatagatatgtatatctatatatatctatcgatatatatctagatatatagaatctgtccatatatagatctatcgatcaatagat

SEQ ID NO: 22265 - DNA, 84 bp, Homo sapiens
tatatatctatgtatatatatgtgtatatatatacgtatatatatgtgtgtatatatatacacatatatatgtgtgtgtatata

SEQ ID NO: 22266 - DNA, 115 bp, Homo sapiens
tcagcctctgagtagctgtgattacaggcgtccaccaccacacctggctaattttttgtatttttagtagaaatagggtatcgtcatgttggaccgactgatctcgaactcctga

SEQ ID NO: 22267 - DNA, 115 bp, Homo sapiens
tgtatatattattcatggaagaatacattgccatatatttatagtgtgtatatatatatataaaataaatcataatatattcatgatatgtattcctcatagaagaatgtatata

SEQ ID NO: 22268 - DNA, 60 bp, Homo sapiens
aatatatatatatatatatatatatatatatatatatgtatatgtatatgtgtatatatt

SEQ ID NO: 22269 - DNA, 136 bp, Homo sapiens
tactatcagaggagacagaaggaccaaggcagctttaacagagaagaaagtaaaacagtggccaatgttgtctccttctcagtgagcccacagcctgagtaaatggggctgtgggtatcccaggcaagaggatggc

SEQ ID NO: 22270 - DNA, 95 bp, Homo sapiens; identical to SEQ ID NO: 68

SEQ ID NO: 22271 - DNA, 93 bp, Homo sapiens; identical to SEQ ID NO: 69

SEQ ID NO: 22272 - DNA, 84 bp, Homo sapiens; identical to SEQ ID NO: 2078

SEQ ID NO: 22273 - DNA, 64 bp, Homo sapiens
tcatatatatgagtcatatgcatatgtatatcttatatataaatatatgtacttatctatatga

SEQ ID NO: 22274 - DNA, 117 bp, Homo sapiens
gtacttcatacaactcagaagagatatttggatcaatgcttcacaaatttttatttacatatgaatcatgtgggactcttggttaaattggatttgccttcagttggtctggagtgc

SEQ ID NO: 22275 - DNA, 141 bp, Homo sapiens
ggtgcgtgtgtgtgtgtgtgtttgtgtattttatatatatatatatatatatatatatatatatatatataattttattgtatgtattaatataatatatatcactgatatatgtgtgtatatatgtatatatgtatacac

SEQ ID NO: 22276 - DNA, 114 bp, Homo sapiens
catgtttttccatttatgaaagagctgtgaaaaaccatcaggctcagaatgacgattgatttgtcagtcattttcgggtagctgtattttacagtttatcataaagaattgctg

SEQ ID NO: 22277 - DNA, 95 bp, Homo sapiens; identical to SEQ ID NO: 68

SEQ ID NO: 22278 - DNA, 93 bp, Homo sapiens; identical to SEQ ID NO: 69

SEQ ID NO: 22279 - DNA, 77 bp, Homo sapiens
cctgtatgaggtactactgtacagaatactggagacaactgtatcacatggtaagtatttcaatatatttaaacagg

SEQ ID NO: 22280 - DNA, 77 bp, Homo sapiens
gagagcttagggatgatgagaagaaactgaaagataaaataatttttcttatttctttttttccagctttgtgcctc

SEQ ID NO: 22281 - DNA, 73 bp, Homo sapiens
tatatatgtgtatatacatgtgtgtatatatatactgtgtgtgtgtatatgtgtgtgtgtgtgtgtgtgtgtg

SEQ ID NO: 22282 - DNA, 75 bp, Homo sapiens
attattatttttgtttttcttatccctattttctcaggtgagagaactgggtcacagagagtttgaggtattaat

SEQ ID NO: 22283 - DNA, 239 bp, Homo sapiens
tatatatatatatatatatgtgtatatatatagagagtgtatatatatatatgtgtatatatatatagagtatatatgtatatatatgtgtatatatatatagagtatatatatatgtatatatatatagagtatatatatgtatatatatatagagtatatatatatgtatatatagagtatatatatatgtatatagagtatatatatgtatatatatatagagtatatatatatac

SEQ ID NO: 22284 - DNA, 95 bp, Homo sapiens; identical to SEQ ID NO: 68

SEQ ID NO: 22285 - DNA, 93 bp, Homo sapiens; identical to SEQ ID NO: 69

SEQ ID NO: 22286 - DNA, 112 bp, Homo sapiens
gaattttgaagctatttttactattgtcagatgataatatccaaaaattaaaatatctttgttttattttagtttttggatgacagtatccaacaactaaaacttttttttc

SEQ ID NO: 22287 - DNA, 112 bp, Homo sapiens
tgaggtggcatacagtaaatattatgagtggcacatcaagttttctataatacactatatacattttttgtgttttcaaatctaaaatatttacatatgtcttgctaattca

SEQ ID NO: 22288 - DNA, 79 bp, Homo sapiens
ctgtactgtaagaatgttgagatctatacttgttatttttagttagcaggtgtattctgcttgctttctctgcagttgg

SEQ ID NO: 22289 - DNA, 114 bp, Homo sapiens
agatatttacattgtcttaaacaaaagcaagatctgccagagctttcaggttgttatctctaagaggatccttgagtcattaggatggttactctgatatctactcttgttttt

SEQ ID NO: 22290 - DNA, 75 bp, Homo sapiens
tatagatctataatagggcacatatgtaagaagatacataatatatcttctatatatgtatatctgtatctatag

SEQ ID NO: 22291 - DNA, 95 bp, Homo sapiens
tgtgtgggcacgattgtgtatgcctatttctgcatgtaagttccagagctgtgagctcacacacacaggcacacagatacacacaggaacacaca

SEQ ID NO: 22292 - DNA, 73 bp, Homo sapiens
gtgtgttcctgtgtgtatctgtgtgcctgtgtgtgtgagctcacagctctggaacttacatgcagaaataggc

SEQ ID NO: 22293 - DNA, 82 bp, Homo sapiens
gtgcattatgtgtgtatacctgtgtatgtatatacatatatttgtacatatacctacagataaacacaaacacatatgccac

SEQ ID NO: 22294 - DNA, 106 bp, Homo sapiens
cctatgagaatgtaatggcactgctgatctgacaggagacagagctcaggtgataatgcttgcccactgctcacctcctgctgtgcagcctggcttccaacaggtc

SEQ ID NO: 22295 - DNA, 75 bp, Homo sapiens
ctctaaaggaacaggaggagtctttgacacattacagattttttttgtaaatgactactctttctgtacattgag

SEQ ID NO: 22296 - DNA, 217 bp, Homo sapiens
atatatccatatatattcatattatatctccatatatattcatggaggatatgtgtatgtgtgtgtgtgtgtgtgtgtatatatgtgtatatatatccatagaggatatgtgtgtgtgtgtgtatatatatatatccatagaggatatgtgtgtgtgtgtatatatatatatatatccatagaggatatgtatatatgtgtgtgtgtatatatatgt

SEQ ID NO: 22297 - DNA, 91 bp, Homo sapiens
aaacagaacatgataagaaaactgtgttaaagtaaacctcttgaggtctatagagtacattagatgtttttttgttttttgttttttgttt

SEQ ID NO: 22298 - DNA, 107 bp, Homo sapiens
cattaccagaataatctccatttgattttatatattatatttttatgcattgctcgattctacttgctataagagtgtatttgttagattctattattttgttgatg

SEQ ID NO: 22299 - DNA, 58 bp, Homo sapiens; identical to SEQ ID NO: 605

SEQ ID NO: 22300 - DNA, 118 bp, Homo sapiens
ggcgctgtgtacttgtcagttgccctgctaataccttctgaaaagctgtctataacaacatttattttgttttacaaaaggaaaagacaagcagcaaagaaaacaaaacattagtgtc

SEQ ID NO: 22301 - DNA, 58 bp, Homo sapiens
tgagtcagagtctcactctgtcacccaggctggagtgcaatggcgtgatctcggctca

SEQ ID NO: 22302 - DNA, 95 bp, Homo sapiens
tgctaaatttcacagcatgttgaagtagagaataatgtggcattttccctttgttacaaagaattattttctttaatcttgctgcctccctagca

SEQ ID NO: 22303 - DNA, 118 bp, Homo sapiens
ggacggcaacagattttataggcaggctggataatgtggtgtctgatttacatagggctcacagcttggtttgatcaggtatgacatctacatagtgcttggggaaggctgctcaccc

SEQ ID NO: 22304 - DNA, 93 bp, Homo sapiens
gcctttgattctgagagggaaatatctgcttttaattcctggggttttatgggaaaaacagatttttttttttcctaaagcagggtctgtggc

SEQ ID NO: 22305 - DNA, 95 bp, Homo sapiens; identical to SEQ ID NO: 68

SEQ ID NO: 22306 - DNA, 93 bp, Homo sapiens; identical to SEQ ID NO: 69

SEQ ID NO: 22307 - DNA, 93 bp, Homo sapiens; identical to SEQ ID NO: 69

SEQ ID NO: 22308 - DNA, 116 bp, Homo sapiens
acacacacacacaaatgtatatatatgtgtatatatacatatatgtgtatatatatttgtgtgtgtatgtacatatatatgtgtatatatatgtgtacatatttgtgtgtgtgtgt

SEQ ID NO: 22309 - DNA, 117 bp, Homo sapiens
atttcctcagcctttggccacctttgcttaacagcccttgaagaagacagtgcttagttctttatatttaattctggctgctccaaaatataggcaagtagctagttgctcagaaat

SEQ ID NO: 22310 - DNA, 112 bp, Homo sapiens
tgaagcccagatgttgaacttactagacaaaagtttttaaattagctattaaaatatatttttcagttttacaactcttttagaatgtgtctagtagattttctggtcttta

SEQ ID NO: 22311 - DNA, 84 bp, Homo sapiens
gacaaggtctgttgggctgagatgggcaggtggagagtccccctgactcacacccgctcacttactggccccaggtcctgtgtt

SEQ ID NO: 22312 - DNA, 98 bp, Homo sapiens
atataacaggcattaacaattgttattatattgttatatttttgtgtattattgtattgttattatattgtattaacaattgttgaaaattgttgtat

SEQ ID NO: 22313 - DNA, 79 bp, Homo sapiens
ttcggggcagaatgtcaagtattttaatatattctaacaccagaggaatggttaaaagtgcaagatattttttcttgga

SEQ ID NO: 22314 - DNA, 95 bp, Homo sapiens; identical to SEQ ID NO: 68

SEQ ID NO: 22315 - DNA, 93 bp, Homo sapiens; identical to SEQ ID NO: 69

SEQ ID NO: 22316 - DNA, 70 bp, Homo sapiens
tatcatagtttgtatatatctgtatatatgtatctatatacatatatacatgtatatatatctgtagata

SEQ ID NO: 22317 - DNA, 114 bp, Homo sapiens
tatgtgtatgtatgtaagtgtgtgtatgtgtgtgtgtatatatatatgtatatatgtaagacatgtatatatgtaactatatataggcaagtaggaaatatatgtatatagagg

SEQ ID NO: 22318 - DNA, 87 bp, Homo sapiens
tacatatagaaatattatatatataaaaaactgtgtatgcatgtttgtatgtatataaatgtatgtatgtacgtgtgtgtgtgtgtg

SEQ ID NO: 22319 - DNA, 354 bp, Homo sapiens
tatatagttatatagaatatatattcatatatattcacatatagttatatagaatatatattcatatatagttatataagaatatatgcatatatattcatatatagttacatagaatatatatccatatatagttatagagaatatatatccatatatattcatatatagttatagagaatatatatccatatatattcatatatagttatagagaatatatatccatatatattcatatatagttatagagaatatatatccatatatatccatatatagttatagagaatatatatccatatatattcatatatagttatatagaatatatatccatatattcatatatag

SEQ ID NO: 22320 - DNA, 310 bp, Homo sapiens
atatatattctctataactatatatggatatatatggatatatattctctataactatatatgaatatatatggatatatattctctataactatatatgaatatatatggatatatattctctataactatatatgaatatatatggatatatattctctataactatatatggatatatattctatgtaactatatatgaatatatatgcatatattcttatataactatatatgaatatatattctatataactatatgtgaatatatatgaatatatattctatataactatatatgaatatatat

SEQ ID NO: 22321 - DNA, 118 bp, Homo sapiens
atagtcaggatttggcttttgtaatgcatgtattttattagtttgagtcatagtttttttttaattttcaattattaaaatatttctaaatagtagacagaggttatcagatgattat

SEQ ID NO: 22322 - DNA, 180 bp, Homo sapiens
tattcatatatacatacatgcgtatgtatatacataatgtatatacatacgcatgtatgtatatatgtatatacatacgcatgtatgtatatatgtatatacatgcatgcatgtatgtatatatgtatatacatgcatgcatgcatatgtatatacatgtatacatatgtgttttcatac

SEQ ID NO: 22323 - DNA, 86 bp, Homo sapiens
atatggttagatatatatggttttaaattgtatatatatggttataacatatgtacatatatggttttatatatatataactttgt

SEQ ID NO: 22324 - DNA, 76 bp, Homo sapiens
atgtattattatatacatatatatgatgtatacatacatatatacattatacatatatgcatatatggttatatat

SEQ ID NO: 22325 - DNA, 101 bp, Homo sapiens
tgcccatcagtgatagactccatttatttttttaaattgtgatggtctttcctatctattcgaatgtgagtattggaatggcaggatatctctgttctgta

SEQ ID NO: 22326 - DNA, 101 bp, Homo sapiens
atggtatatatactatatatgtgtatatatggtatatatatggtatatatatggtatatatactatatatgtatatatgtggtatatatactatatatatg

SEQ ID NO: 22327 - DNA, 115 bp, Homo sapiens
gtatctgatcataggatttggaaaattatgaagacagtttcagttgcatacaggtaattctgtatataaatttaaataatcttgaaataaacacttttcatgaattaaatgatac

SEQ ID NO: 22328 - DNA, 70 bp, Homo sapiens
ggaggaagtctttgtattttctatgtatatgattatatcatcagtgaatagagataacttgatttcctcc

SEQ ID NO: 22329 - DNA, 110 bp, Homo sapiens
tgtctgcattctacctttaatttgatgcataagtttatttgggttctcttagaagcatatccaaagaaaagaatttgagtgcaagtaattctgtgagggacgtgcagggg

SEQ ID NO: 22330 - DNA, 58 bp, Homo sapiens
gagtaaagaagaatcatgaagagggaaggcatttctctcttttttttttctttttctc

SEQ ID NO: 22331 - DNA, 112 bp, Homo sapiens
agctcagggatatgtttttaaatgagtcacgtgtacaacatttattatttatacttgcaggaatctaacaagtttgtgtgtgtgcgtgtatttgtgcatgtacacctatgtt

SEQ ID NO: 22332 - DNA, 113 bp, Homo sapiens
gtgtgtgagtatgtgtaataccagcatatataccaacatttacatatgtattgtataattattattcaatatatgtggtatatatgctggtatatatgctattaattaaccac

SEQ ID NO: 22333 - DNA, 82 bp, Homo sapiens
aaagttaaagtgacctgtatgggttgcatgtaagtatgagtttgcttgcatgctctatctcacacactgtctctctctcttt

SEQ ID NO: 22334 - DNA, 108 bp, Homo sapiens
tgtatatgtgtgtgtatatatatatgtacatcccatgtatgttatatatataaatatatatataaatatatatatatttatatatataacaggatgtatatatcatgt

SEQ ID NO: 22335 - DNA, 61 bp, Homo sapiens
agatatatgtatatatgtacatatatattttgtgtatatatgtgtatatgtacatatattt

SEQ ID NO: 22336 - DNA, 85 bp, Homo sapiens
tatgtatatgtgtctgcataattcagaaattataaaaaaattattatatattataatttctgaattatgtatgcatatgcacata

SEQ ID NO: 22337 - DNA, 93 bp, Homo sapiens
catggtggcaggagagagaagaatgagagctgagcaaaggaggaaaccccttaagaaaccatcagatctcatgagaacttattcactatcatg

SEQ ID NO: 22338 - DNA, 87 bp, Homo sapiens
catatatatatgtatgtgtgtatatatatatatgtgtgtgtgtgtgtatatatatgtatatatgtatatatatgtgtgtgtatatat

SEQ ID NO: 22339 - DNA, 58 bp, Homo sapiens; identical to SEQ ID NO: 18987

SEQ ID NO: 22340 - DNA, 84 bp, Homo sapiens
ctgggaccatgggtacttgcctggagactggagctgcagcagcttccttggagctcagtctctgtgtgacagcctagtgcttgg

SEQ ID NO: 22341 - DNA, 83 bp, Homo sapiens
taagtatgtgaggtgatagatatgtaaattagcttgattcattcattttacattgtatatatttgtcaaaacatcacatttta

SEQ ID NO: 22342 - DNA, 108 bp, Homo sapiens
tgttttatttaaggtttagataaattactggaattgtatagatcactctggaaacagaattatatcttaatatttatttaaaattatttatttgaaaataataataca

SEQ ID NO: 22343 - DNA, 62 bp, Homo sapiens
tgtgtgcatactttatatgtatataaaatacttgtttgcatatatatatgagtgtgtgtata

SEQ ID NO: 22344 - DNA, 95 bp, Homo sapiens; identical to SEQ ID NO: 68

SEQ ID NO: 22345 - DNA, 93 bp, Homo sapiens; identical to SEQ ID NO: 69

SEQ ID NO: 22346 - DNA, 102 bp, Homo sapiens
cgcagggtgaataagtgaaacattactcctgtatttttgaaaatattgtatcattttatgaatatttggaaatgtcagggtgagtgccccttgtgtaatact

SEQ ID NO: 22347 - DNA, 82 bp, Homo sapiens
tatatctatatctatatatctatctagatatatctatatctatatatatctatatctagatagatatatagatatagatatg

SEQ ID NO: 22348 - DNA, 78 bp, Homo sapiens
gcagctttgcaacttgctggacagagctctgagggacaactgaaaccctctctgccactgtctctgcagcagatctgc

SEQ ID NO: 22349 - DNA, 101 bp, Homo sapiens
aaagaggtactgatatggcacgggctctttttagatgttattattattattttttaatctaaggggagtagatgcatgttttcccaaatgtttgtctcttt

SEQ ID NO: 22350 - DNA, 119 bp, Homo sapiens
gtcaatctgcttagttttatttctttatatttggttattttggttaattttatttctttttataagaaataaatcttcaaaatctaagtttgactggaatcaatgcttgactcagggat

SEQ ID NO: 22351 - DNA, 114 bp, Homo sapiens
gtggctacatgggattctggttatgaatccaaacaatggattttttttttaagattaaagagatttatctagcattttttggttcatatgaaagtaattgtatgctttatccat

SEQ ID NO: 22352 - DNA, 119 bp, Homo sapiens
catttaatgattgtttggctatttacgcctatattatgccttcagaccatgagtctcagtgagtctcagtgtgttggtttcacaaatgtaaaggtcagaacacaatagattatgatgtg

SEQ ID NO: 22353 - DNA, 118 bp, Homo sapiens
tctgacataaggatagcatctcctgacttttttggctccattggcatggaatatcattttttatctctttattttcagtctgtgtgtgtctttacaggtgaagtgtgtttcctgtagg

SEQ ID NO: 22354 - DNA, 89 bp, Homo sapiens
gtggctcatgactgtaatctcagtactttggaaggccatagtgggagaaccacttgaagtcagaagtttgagaccagcctgggaaacac

SEQ ID NO: 22355 - DNA, 105 bp, Homo sapiens
ctaagaacttatgagaaatgcagattctcaggccccactccgacacactgaatcagaaatactggggtggggcccggccatcagtgtttttatcaagggctctag

SEQ ID NO: 22356 - DNA, 115 bp, Homo sapiens
acaaatatgaatcagcatattaacttaaagaatactgtaaaaatatatcattttaaagttttaagtgataaattacatatatttatggggtaaaatatggtgtttcggtatatgt

SEQ ID NO: 22357 - DNA, 139 bp, Homo sapiens
tttggaggaggacaggggaggaattacatgatttggctatgtgttcccccccaaatctcatgtcaaattgtaattctcaatattgagggagaaatctggtgagagatgattggatcatggggacagattcctgcttttc

SEQ ID NO: 22358 - DNA, 87 bp, Homo sapiens
gggccagtctcactcccactgtgtcccacccctaacagcaccaattctgtttccaggcagtgggcaagcagggctgagaacttgccc

SEQ ID NO: 22359 - DNA, 120 bp, Homo sapiens
taaggatagatacatatatataaaattgacaggtatatatatatatatatatatatatataactgacacatatatatatatatgtgtgtatacctgtcaattttagatttttatttaact

SEQ ID NO: 22360 - DNA, 139 bp, Homo sapiens
tgggcaacaaagcgagactcctcaggaaaaaaaaaaaaaaaagaaaagagccaaagataaaatttcttttaattaattttttttctctagagactgggtctcactgtgtcacccaggctagagtgaagtggtacaatta

SEQ ID NO: 22361 - DNA, 88 bp, Homo sapiens
ctaggattcttacagttttagactatatatttaagtctttaatcaatcttgagttgatttttgtatatggtaaaaggaaagagcctgg

SEQ ID NO: 22362 - DNA, 181 bp, Homo sapiens
acattataggtggccaaaatatatatatatatgtgtgtgtgtgtgtgtgtgtatatatatatatatatgtgtgtgtgtgtgtgtgtgtgtatatatatgtgtatacatatatatatgtgtgtatacatatatatgtgtgtgtatatatatgtgtatacatatatatatgtgtgtatacata

SEQ ID NO: 22363 - DNA, 99 bp, Homo sapiens
ctaggcttctaactctgtgtctcactctgtgtctgtcagtgcccccgaccacacaccttcagaaccagatggacatgtgaagggtttaattgaagagag

SEQ ID NO: 22364 - DNA, 77 bp, Homo sapiens
cttcacatgtccatctggttctgaaggtgtgtggtcgggggcactgacagacacagagtgagacacagagttagaag

SEQ ID NO: 22365 - DNA, 80 bp, Homo sapiens
gtagaatgaatattctgtcatgatccagagactgtgacaaacataggctctgtttctgcaacagcttctgcttatcctac

SEQ ID NO: 22366 - DNA, 96 bp, Homo sapiens
tctttgaggcaattgtgaatgggcgttcactcatgatttggctctctgtttgtctgttattgatgtataagaatgcttgtgatttttgcacattga

SEQ ID NO: 22367 - DNA, 67 bp, Homo sapiens
atagctcagttggttaaatttatcatcagttagttaatactgtagagaatttaatgaactgggagat

SEQ ID NO: 22368 - DNA, 130 bp, Homo sapiens
atatatatatatgtgtgtgtgtgtgtatgtgtgtgtgtgtatgtatatatacatatatacatacacacacacgtatgtatatatacatatatacatacacacacgtatgtatatatacatatatacatac

SEQ ID NO: 22369 - DNA, 57 bp, Homo sapiens
gatctctctggctgtctgattcctgggggtacagtgagtacagctggttgtgagatc

SEQ ID NO: 22370 - DNA, 92 bp, Homo sapiens
atttgtccttggctttcttctagaggacagcctcattcactcactgtaagaagatggtgtctttccttagaatacagctgcagaggctaagt

SEQ ID NO: 22371 - DNA, 117 bp, Homo sapiens
ctgagatgaagtaactagctcaaggtcacagaataagttgtatgtatgtatgtatgtatgtttgaaaccagctttgttctgccatattgattttatatgtttgaagcctcctcttgg

SEQ ID NO: 22372 - DNA, 65 bp, Homo sapiens
gttagggctttggagtcacagacttgggttctaattctaattctgtcactcactggctgcatgac

SEQ ID NO: 22373 - DNA, 70 bp, Homo sapiens
tatatatatatatatatatatgatatatattaatatatgatatatatgagtgtgtgtgtgtatctatata

SEQ ID NO: 22374 - DNA, 99 bp, Homo sapiens
tttgatgaatgtctggaggaataaaagaaaaggtcatgtttcagtttctactggggatcctttattttttttttcttttaaaataacacttttatggaa

SEQ ID NO: 22375 - DNA, 74 bp, Homo sapiens
gaaatgaataatcaagggactaggaggttatagtaggacaacagagtctctgctatctcactgtctctcacttc

SEQ ID NO: 22376 - DNA, 99 bp, Homo sapiens
gttttctttgcctcctgtgttggaacattacttgagctgaaagacactctgtctcataattttctgacatgtagggctctaattatttctaaggaagac

SEQ ID NO: 22377 - DNA, 88 bp, Homo sapiens
gatgatcagagtcacattctgttttcagtagatactagtaccacttgagctcactgcaacagcaacaggaggtggctatgcaattatt

SEQ ID NO: 22378 - DNA, 117 bp, Homo sapiens
taccagtgatctttatatttacaaggattttaatgttactcgttagcttttttttttttcaatttgaagagcttcctttagcatttcttgtaaaataggaaaataggtctgatggtg

SEQ ID NO: 22379 - DNA, 95 bp, Homo sapiens; identical to SEQ ID NO: 580

SEQ ID NO: 22380 - DNA, 93 bp, Homo sapiens; identical to SEQ ID NO: 69

SEQ ID NO: 22381 - DNA, 114 bp, Homo sapiens
catttggaaatcttttcattgtttcaataatgaatgtatttagtgtgccattgttaaagagtcacacacacacacatacatttaagaatcttgaaaacagaattttctaaactg

SEQ ID NO: 22382 - DNA, 95 bp, Homo sapiens; identical to SEQ ID NO: 68

SEQ ID NO: 22383 - DNA, 93 bp, Homo sapiens; identical to SEQ ID NO: 69

SEQ ID NO: 22384 - DNA, 113 bp, Homo sapiens
ttagagaaagaaccattaaaattacttaggaagtaattttttatttattttatttatttatcacatttactagtataataagaaatcactcttaagtgattttttttccttaa

SEQ ID NO: 22385 - DNA, 98 bp, Homo sapiens
tggctctgtatatcgctttgtttcttggataagagattttgacattttcagaatttctggatattctttttattttaaaacagtgtagtatacttcca

SEQ ID NO: 22386 - DNA, 117 bp, Homo sapiens
acttttgatccaatcctctacagttttaaaacaagagtccatgatttgtcattttgttctgttataaatttatgtgacacatggaggtttttgctaattattagataggatataagt

SEQ ID NO: 22387 - DNA, 104 bp, Homo sapiens
cttcagaaactctcatttttgtatcagaaatcaacacacagtggtgagtgagcaccaactatgcaatcgttctaggtgcaggagatgggaaaatattcttgaag

SEQ ID NO: 22388 - DNA, 99 bp, Homo sapiens
tatatgatatgtctatgaatatatatgatatatatgaatatatatatgaatatatatgatatatatatgaatatatatatgaatatacatatgaatata

SEQ ID NO: 22389 - DNA, 58 bp, Homo sapiens; identical to SEQ ID NO: 9211

SEQ ID NO: 22390 - DNA, 95 bp, Homo sapiens; identical to SEQ ID NO: 68

SEQ ID NO: 22391 - DNA, 93 bp, Homo sapiens; identical to SEQ ID NO: 69

SEQ ID NO: 22392 - DNA, 90 bp, Homo sapiens
acaatgtttaaacagtcctgattttgatgtattggctcttggtggattattgatacaatctgctactaacatcatagtaggaataattgt

SEQ ID NO: 22393 - DNA, 78 bp, Homo sapiens
tatgtatgtatgtatgtatgtatgtatatatgtgtgtatatatatatacacatatacacacatatatgtatatatata

SEQ ID NO: 22394 - DNA, 60 bp, Homo sapiens
taccaattttgaactgtgttagaagtatatatatatacttctaacagttcaaaattggta

SEQ ID NO: 22395 - DNA, 60 bp, Homo sapiens
taccaattttgaactgttagaagtatatatatatacttctaacacagttcaaaattggta

SEQ ID NO: 22396 - DNA, 111 bp, Homo sapiens
ccatagaagttataaagagaatgaggtcagggtcagaagtgacagtgggcaaagatgccttttgtattttctggagcctataaattaactttcctaacatccaagaagtgg

SEQ ID NO: 22397 - DNA, 103 bp, Homo sapiens
ggttttgatttgcatttctctgatggccagtgatgatgagcatttttttatgtgttttttggctgcataaatgtcttcttttgagaagtgtctgttcgtatcc

SEQ ID NO: 22398 - DNA, 79 bp, Homo sapiens
gttgtgtgtatatatacacacacatatacagttgtatatacgtatatatatatatagttgtgtatatatacacacacac

SEQ ID NO: 22399 - DNA, 57 bp, Homo sapiens
ttgagacggtgtctcactctctgttgcccagcctggagtgcagtggtgcagtctcag

SEQ ID NO: 22400 - DNA, 97 bp, Homo sapiens
taggtgtgagcagggccagccagcttcttggtagtatagtcttggcagttgcacagggctcactctcagaagaggcttgatttaatctgctgtggcc

SEQ ID NO: 22401 - DNA, 137 bp, Homo sapiens
atatatgtatatatacgtatatatgtatatatatgcatatatacgtatatatgtatgtatatgtgtgtatatatgtatgtgtatatattatatatatgtatgtatatatgtatgtgtatatatatgtatatatatgt

SEQ ID NO: 22402 - DNA, 112 bp, Homo sapiens
ttgtgaaaactatgcagatagcttcctgaaacaatacgttagaatgaattttagttttactattaatggctgttgttcaggtacttcttagcatctgagggacaaagtacag

SEQ ID NO: 22403 - DNA, 101 bp, Homo sapiens
tgcaatacagcttaatttatttattgtgaaaacatactagttgtatatatttacatttgaatattggaacttttttggttatataatgttgagctcttgca

SEQ ID NO: 22404 - DNA, 99 bp, Homo sapiens
ttgtaggtattttattctcttggtagtaattgtgaaggggagttcactcatgatttggctctctgtttgtctgttattgatgtataagaatgcttgtga

SEQ ID NO: 22405 - DNA, 89 bp, Homo sapiens
cagttcttcccctgcctgtggagtctgcatgccagattcatgcccttcccctgagttctcgcaggaggcttcttggccagttcaaattg

SEQ ID NO: 22406 - DNA, 63 bp, Homo sapiens
ctgtgcctctctcagtggctcacccatctgtgcgtttgggatgggtctaggggcgaggcaggg

SEQ ID NO: 22407 - DNA, 56 bp, Homo sapiens
gtagcacacacaatcactcctgtattgtgtgtgtgtgtgtgtgtgtgtgtgcctgc

SEQ ID NO: 22408 - DNA, 79 bp, Homo sapiens
gaacttggtagacattgctttatcatcctgtaacccagaatgttactccagagaagattgagtccagtctgctttgctc

SEQ ID NO: 22409 - DNA, 117 bp, Homo sapiens
caaattggatttgtattgtttacttagatttattcttgttgcagtctattaatttaataaatatatattgggtgtttacagagagtaagttatattagagatacaaagtacatgttg

SEQ ID NO: 22410 - DNA, 118 bp, Homo sapiens
gtgtctggaagagcagtagttgtaatgagtggggttgtaatttaattaaaaattaagtttttaattttaataaagtctaattcatcaatttttatggttatagttctgttctatttac

SEQ ID NO: 22411 - DNA, 280 bp, Homo sapiens
tatacacacatctatatatatatgtatatgtatatatacatatatgtgtgtatgtatatgtatatatacatatgtgtgtatatatgtatatatacatatatgtgtgtatatatgtatatatacatatatgtgtgtatatatgtatatatacatatatgtgtgtatatatgtatatatacatatatgtgtgtatatatgtatatatacatatatgtgtgtatatatgtatatgtgtgtgtatatatatatgtgtgtatgtgtgtgtgtgtgtgtgcgtgtg

SEQ ID NO: 22412 - DNA, 88 bp, Homo sapiens
ctgagcgacagatactgtaaacatcctacactctcagctgtggaaagtaagaaagctgggagaaggctgtttactctttctgccttgg

SEQ ID NO: 22413 - DNA, 113 bp, Homo sapiens
gaaggtatattgctgttgacagtgagcgactgtaaacatcctcgactggaagctgtgaagccacagatgggctttcagtcggatgtttgcagctgcctactgcctcggacttc

SEQ ID NO: 22414 - DNA, 115 bp, Homo sapiens
gtacgcagagcaaaaccatgttagttatatatgtatatattatatatattatgtattttatatatatatacacatatgtacatatatataactgatatggttttgctctgtgtat

SEQ ID NO: 22415 - DNA, 113 bp, Homo sapiens
tacacagagcaaaaccatatcagttatatatatgtacatatgtgtatatatatataaaatacataatatatataatatatacatatataactaacatggttttgctctgcgta

SEQ ID NO: 22416 - DNA, 114 bp, Homo sapiens
atttttattggatgccagacattgtgttaccttgttgagtactgaattttttgtattgctataaatattctcagcttttgttctaggatacaattatctgcaaacagtttgagt

SEQ ID NO: 22417 - DNA, 67 bp, Homo sapiens
gtatatatacatatacatactatatatgtatatatgtacatatgtatgtatgtatatatgtatatac

SEQ ID NO: 22418 - DNA, 68 bp, Homo sapiens
tatacatgtatatgtatgtatatatatgtacatatatacatatatacatatatatacacatatatata

SEQ ID NO: 22419 - DNA, 70 bp, Homo sapiens
ttgttttgagacagagtctcacactgtcacccaggctggagtgcagtggcatgatctcggctcactgcaa

SEQ ID NO: 22420 - DNA, 67 bp, Homo sapiens
gctaagcctttttcaaaagtttgaaaccagatggaaagttggggtcaggcttaagttggtgaaaagc

SEQ ID NO: 22421 - DNA, 99 bp, Homo sapiens
accaaatatatgtatatatatatatatatatatatatgtgtgtgtgtgtgtgtatatatatatgtttgtgtatatatatatgtgtgtgtgtatatatat

SEQ ID NO: 22422 - DNA, 95 bp, Homo sapiens; identical to SEQ ID NO: 68

(The sequence listing continues in the following parts.)

What is claimed is:

1. A method for post-transcriptionally repressing the expression of a target gene, the method comprising:
   inserting into the target gene a target sequence capable of specifically hybridizing with SEQ ID NO: 160280 or SEQ ID NO: 160281,
   allowing the target gene to be transcribed such that the transcript contains the target sequence capable of specifically hybridizing with SEQ ID NO: 160280 or SEQ ID NO: 160281,
   providing a nucleic acid molecule comprising a precursor sequence, SEQ ID NO: 46984, which precursor sequence comprises mature sequences SEQ ID NO: 160280 and SEQ ID NO: 160281, or providing a nucleic acid molecule comprising one or both of mature sequences SEQ ID NO: 160280 and SEQ ID NO: 160281, and
   allowing the precursor sequence or the nucleic acid comprising one or both mature sequences to be transcribed and processed to generate one or more interfering ribonucleic acids that comprise the RNA form of mature sequence SEQ ID NO: 160280 and/or the RNA form of mature sequence SEQ ID NO: 160281, such that the one or more interfering ribonucleic acid is present in the same environment as the transcript containing the target sequence, and the expression of the target gene is post-transcriptionally repressed.

2. The method of claim 1 wherein the method is performed in the presence of a genome that naturally contains the precursor sequence, SEQ ID NO: 46984, but from which the precursor sequence has been synthetically removed.

3. The method of claim 1 wherein the method is performed in the presence of a genome that does not naturally contain the precursor sequence, SEQ ID NO: 46984, but into which the precursor sequence has been synthetically introduced.

4. The method of claim 1 wherein the method is performed in the presence of a genome that encodes both the precursor sequence comprising the mature sequences and the target gene comprising the target sequence.

5. The method of claim 1 wherein the method is performed in the presence of two different genomes, wherein one genome encodes the precursor sequence comprising the mature sequences, and the other genome encodes the target gene comprising the target sequence.

6. The method of claim 1 wherein the precursor sequence comprising the mature sequences is synthetically constructed.

7. The method of claim 1, wherein the precursor sequence having SEQ ID NO: 46,984 is derived from a genomic sequence of *H. sapiens*.

8. The method of claim 1, wherein the mature sequences having SEQ ID NO: 160,280 and SEQ ID NO: 160,281 are derived from a genomic sequence of *H. sapiens*.

* * * * *